United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 106

SEQ ID NO: 4488600 - DNA, 20 bp, Homo sapiens
ataaatttaagaaaacaagt

SEQ ID NO: 4488601 - DNA, 12 bp, Homo sapiens
ataaatttaatc

SEQ ID NO: 4488602 - DNA, 13 bp, Homo sapiens
ataaatttcccag

SEQ ID NO: 4488603 - DNA, 21 bp, Homo sapiens
ataaatttcccagttaaagat

SEQ ID NO: 4488604 - DNA, 17 bp, Homo sapiens
ataaatttcgcttctta

SEQ ID NO: 4488605 - DNA, 18 bp, Homo sapiens
ataaatttgacttttctg

SEQ ID NO: 4488606 - DNA, 21 bp, Homo sapiens
ataaatttgacttttctgtaa

SEQ ID NO: 4488607 - DNA, 16 bp, Homo sapiens
ataaattttaattcaa

SEQ ID NO: 4488608 - DNA, 15 bp, Homo sapiens
ataaattttctaaaa

SEQ ID NO: 4488609 - DNA, 14 bp, Homo sapiens
ataaattttttgac

SEQ ID NO: 4488610 - DNA, 15 bp, Homo sapiens
ataacaacctggaga

SEQ ID NO: 4488611 - DNA, 20 bp, Homo sapiens
ataacaactatttttgttgt

SEQ ID NO: 4488612 - DNA, 21 bp, Homo sapiens
ataacaactatttttgttgtt

SEQ ID NO: 4488613 - DNA, 14 bp, Homo sapiens
ataacaattcctct

SEQ ID NO: 4488614 - DNA, 22 bp, Homo sapiens
ataacactgtattttaatgtac

SEQ ID NO: 4488615 - DNA, 12 bp, Homo sapiens
ataacagatgtg

SEQ ID NO: 4488616 - DNA, 15 bp, Homo sapiens
ataacagatgtgaaa

SEQ ID NO: 4488617 - DNA, 17 bp, Homo sapiens
ataacagatgtgaaaat

SEQ ID NO: 4488618 - DNA, 18 bp, Homo sapiens
ataacagtgcagggcaaa

SEQ ID NO: 4488619 - DNA, 14 bp, Homo sapiens
ataacagtgccatt

SEQ ID NO: 4488620 - DNA, 15 bp, Homo sapiens
ataacagtgccattg

SEQ ID NO: 4488621 - DNA, 23 bp, Homo sapiens
ataacagtgccattgtctttata

SEQ ID NO: 4488622 - DNA, 15 bp, Homo sapiens
ataacatatcaaatg

SEQ ID NO: 4488623 - DNA, 14 bp, Homo sapiens
ataacatctttatt

SEQ ID NO: 4488624 - DNA, 16 bp, Homo sapiens
ataacattatataaca

SEQ ID NO: 4488625 - DNA, 20 bp, Homo sapiens
ataaccaaagcccaaagtgg

SEQ ID NO: 4488626 - DNA, 22 bp, Homo sapiens
ataaccatttaaagaaagaatg

SEQ ID NO: 4488627 - DNA, 16 bp, Homo sapiens
ataaccgtgaagctct

SEQ ID NO: 4488628 - DNA, 17 bp, Homo sapiens
ataacctagttaaagaa

SEQ ID NO: 4488629 - DNA, 20 bp, Homo sapiens
ataacctagttaaagaaagg

SEQ ID NO: 4488630 - DNA, 21 bp, Homo sapiens
ataacggaaaaataattgcca

SEQ ID NO: 4488631 - DNA, 18 bp, Homo sapiens
ataactattttaaatatc

SEQ ID NO: 4488632 - DNA, 18 bp, Homo sapiens
ataactcctgtccctttt

SEQ ID NO: 4488633 - DNA, 21 bp, Homo sapiens
ataactgaaaattatttaaac

SEQ ID NO: 4488634 - DNA, 16 bp, Homo sapiens
ataactgaaggagaag

SEQ ID NO: 4488635 - DNA, 22 bp, Homo sapiens
ataactgagatattattttaaa

SEQ ID NO: 4488636 - DNA, 14 bp, Homo sapiens
ataactgatttcta

SEQ ID NO: 4488637 - DNA, 15 bp, Homo sapiens
ataactgatttctat

SEQ ID NO: 4488638 - DNA, 15 bp, Homo sapiens
ataactgtcttgttt

SEQ ID NO: 4488639 - DNA, 16 bp, Homo sapiens
ataactgtcttgtttc

SEQ ID NO: 4488640 - DNA, 22 bp, Homo sapiens
ataactgtcttgtttcagtgag

SEQ ID NO: 4488641 - DNA, 16 bp, Homo sapiens
ataactgtgtactgtt

SEQ ID NO: 4488642 - DNA, 20 bp, Homo sapiens
ataactgttttagaaattgg

SEQ ID NO: 4488643 - DNA, 14 bp, Homo sapiens
ataacttattgctg

SEQ ID NO: 4488644 - DNA, 14 bp, Homo sapiens
ataacttcttgaaa

SEQ ID NO: 4488645 - DNA, 16 bp, Homo sapiens
ataactttagaaataa

SEQ ID NO: 4488646 - DNA, 14 bp, Homo sapiens
ataactttctctgt

SEQ ID NO: 4488647 - DNA, 17 bp, Homo sapiens
ataactttctctgtgaa

SEQ ID NO: 4488648 - DNA, 19 bp, Homo sapiens
ataactttctctgtgaaag

SEQ ID NO: 4488649 - DNA, 19 bp, Homo sapiens
ataacttttttgagtcatt

SEQ ID NO: 4488650 - DNA, 23 bp, Homo sapiens
ataacttttttgagtcattgact

SEQ ID NO: 4488651 - DNA, 13 bp, Homo sapiens
ataagaaaagtaa

SEQ ID NO: 4488652 - DNA, 13 bp, Homo sapiens
ataagaagaatgc

SEQ ID NO: 4488653 - DNA, 19 bp, Homo sapiens
ataagaagaatgcttaatc

SEQ ID NO: 4488654 - DNA, 22 bp, Homo sapiens
ataagaagcaatctttgaaata

SEQ ID NO: 4488655 - DNA, 15 bp, Homo sapiens
ataagaattactttg

SEQ ID NO: 4488656 - DNA, 16 bp, Homo sapiens
ataagaattcagacat

SEQ ID NO: 4488657 - DNA, 14 bp, Homo sapiens
ataagacaaaaata

SEQ ID NO: 4488658 - DNA, 20 bp, Homo sapiens
ataagacaagagatctacac

SEQ ID NO: 4488659 - DNA, 24 bp, Homo sapiens
ataagacaagagatctacacatgt

SEQ ID NO: 4488660 - DNA, 22 bp, Homo sapiens
ataagacaatagtatttctcct

SEQ ID NO: 4488661 - DNA, 21 bp, Homo sapiens
ataagacaatgacatacgctt

SEQ ID NO: 4488662 - DNA, 15 bp, Homo sapiens
ataagacattttgtt

SEQ ID NO: 4488663 - DNA, 15 bp, Homo sapiens
ataagagaatcaaca

SEQ ID NO: 4488664 - DNA, 17 bp, Homo sapiens
ataagagagatgagaaa

SEQ ID NO: 4488665 - DNA, 20 bp, Homo sapiens
ataagagagatgagaaagct

SEQ ID NO: 4488666 - DNA, 14 bp, Homo sapiens
ataagataaaataa

SEQ ID NO: 4488667 - DNA, 16 bp, Homo sapiens
ataagatgaaacatca

SEQ ID NO: 4488668 - DNA, 15 bp, Homo sapiens
ataagattaataaga

SEQ ID NO: 4488669 - DNA, 22 bp, Homo sapiens
ataagattccaaaaagcacata

SEQ ID NO: 4488670 - DNA, 18 bp, Homo sapiens
ataagcaaattgcttttt

SEQ ID NO: 4488671 - DNA, 23 bp, Homo sapiens
ataagcaagaaggcaaaaatagt

SEQ ID NO: 4488672 - DNA, 17 bp, Homo sapiens
ataagcaatcaaggtta

SEQ ID NO: 4488673 - DNA, 14 bp, Homo sapiens
ataagccagacatc

SEQ ID NO: 4488674 - DNA, 15 bp, Homo sapiens
ataagcccttaataa

SEQ ID NO: 4488675 - DNA, 17 bp, Homo sapiens
ataagcccttaataata

SEQ ID NO: 4488676 - DNA, 13 bp, Homo sapiens
ataagctttcaat

SEQ ID NO: 4488677 - DNA, 15 bp, Homo sapiens
ataaggaatagcttt

SEQ ID NO: 4488678 - DNA, 17 bp, Homo sapiens
ataaggaattatagacc

SEQ ID NO: 4488679 - DNA, 10 bp, Homo sapiens
ataaggactg

SEQ ID NO: 4488680 - DNA, 14 bp, Homo sapiens
ataaggactgcatg

SEQ ID NO: 4488681 - DNA, 20 bp, Homo sapiens
ataaggagttagaaccacag

SEQ ID NO: 4488682 - DNA, 24 bp, Homo sapiens
ataaggagttagaaccacagcaga

SEQ ID NO: 4488683 - DNA, 15 bp, Homo sapiens
ataaggattctgaag

SEQ ID NO: 4488684 - DNA, 23 bp, Homo sapiens
ataaggcccagagcgaggaaagg

SEQ ID NO: 4488685 - DNA, 20 bp, Homo sapiens
agtttttaaaaataaaggaa

SEQ ID NO: 4488686 - DNA, 19 bp, Homo sapiens
agtttttagaatgttgaaa

SEQ ID NO: 4488687 - DNA, 23 bp, Homo sapiens
agtttttatagttattaaatgtt

SEQ ID NO: 4488688 - DNA, 17 bp, Homo sapiens
agtttttatggggctga

SEQ ID NO: 4488689 - DNA, 18 bp, Homo sapiens
agtttttattccttgtga

SEQ ID NO: 4488690 - DNA, 15 bp, Homo sapiens
agtttttattgcttg

SEQ ID NO: 4488691 - DNA, 20 bp, Homo sapiens
agtttttattgcttgttgga

SEQ ID NO: 4488692 - DNA, 9 bp, Homo sapiens
agtttttca

SEQ ID NO: 4488693 - DNA, 19 bp, Homo sapiens
agtttttcatactgtacac

SEQ ID NO: 4488694 - DNA, 22 bp, Homo sapiens
agtttttcatactgtacacatt

SEQ ID NO: 4488695 - DNA, 12 bp, Homo sapiens
agtttttcctcc

SEQ ID NO: 4488696 - DNA, 13 bp, Homo sapiens
agtttttgatagt

SEQ ID NO: 4488697 - DNA, 23 bp, Homo sapiens
agtttttggagtgttatgtattt

SEQ ID NO: 4488698 - DNA, 16 bp, Homo sapiens
agtttttgtttttgca

SEQ ID NO: 4488699 - DNA, 22 bp, Homo sapiens
agtttttgtttttgcatgaaat

SEQ ID NO: 4488700 - DNA, 23 bp, Homo sapiens
agttttttaattaagcagaaaca

SEQ ID NO: 4488701 - DNA, 18 bp, Homo sapiens
agttttttacttctctta

SEQ ID NO: 4488702 - DNA, 15 bp, Homo sapiens
agttttttactttgg

SEQ ID NO: 4488703 - DNA, 21 bp, Homo sapiens
agttttttgaaattatgtgac

SEQ ID NO: 4488704 - DNA, 23 bp, Homo sapiens
agttttttgaaattatgtgacat

SEQ ID NO: 4488705 - DNA, 21 bp, Homo sapiens
ataaaaaagaaaacttgtgtt

SEQ ID NO: 4488706 - DNA, 14 bp, Homo sapiens
ataaaaaagtctct

SEQ ID NO: 4488707 - DNA, 20 bp, Homo sapiens
ataaaaaatatgtatttacc

SEQ ID NO: 4488708 - DNA, 13 bp, Homo sapiens
ataaaaaatattg

SEQ ID NO: 4488709 - DNA, 15 bp, Homo sapiens
ataaaaaatctgaag

SEQ ID NO: 4488710 - DNA, 13 bp, Homo sapiens
ataaaaaatgaaa

SEQ ID NO: 4488711 - DNA, 20 bp, Homo sapiens
ataaaaaggatccaggtaaa

SEQ ID NO: 4488712 - DNA, 17 bp, Homo sapiens
ataaaaagtaatgactt

SEQ ID NO: 4488713 - DNA, 23 bp, Homo sapiens
ataaaaatactacaatagtttta

SEQ ID NO: 4488714 - DNA, 14 bp, Homo sapiens
ataaaaatactgac

SEQ ID NO: 4488715 - DNA, 17 bp, Homo sapiens
ataaaaatataaattgt

SEQ ID NO: 4488716 - DNA, 13 bp, Homo sapiens
ataaaaatgtggt

SEQ ID NO: 4488717 - DNA, 12 bp, Homo sapiens
ataaaaatgttt

SEQ ID NO: 4488718 - DNA, 16 bp, Homo sapiens
ataaaaattaaatgtg

SEQ ID NO: 4488719 - DNA, 17 bp, Homo sapiens
ataaaaattacatatat

SEQ ID NO: 4488720 - DNA, 15 bp, Homo sapiens
ataaaaattatcaaa

SEQ ID NO: 4488721 - DNA, 18 bp, Homo sapiens
ataaaaattctagattac

SEQ ID NO: 4488722 - DNA, 14 bp, Homo sapiens
ataaaacacacctc

SEQ ID NO: 4488723 - DNA, 14 bp, Homo sapiens
ataaaacatcacta

SEQ ID NO: 4488724 - DNA, 18 bp, Homo sapiens
ataaaacatcactatcaa

SEQ ID NO: 4488725 - DNA, 12 bp, Homo sapiens
ataaaacatcat

SEQ ID NO: 4488726 - DNA, 19 bp, Homo sapiens
ataaaacatcataaatctt

SEQ ID NO: 4488727 - DNA, 17 bp, Homo sapiens
ataaaacattaattgct

SEQ ID NO: 4488728 - DNA, 22 bp, Homo sapiens
ataaaacctgatatatacacat

SEQ ID NO: 4488729 - DNA, 15 bp, Homo sapiens
ataaaactgcgagga

SEQ ID NO: 4488730 - DNA, 20 bp, Homo sapiens
ataaaagatgaaagagcagt

SEQ ID NO: 4488731 - DNA, 20 bp, Homo sapiens
ataaaagcaattccaacctt

SEQ ID NO: 4488732 - DNA, 20 bp, Homo sapiens
ataaaagcacaagtactttt

SEQ ID NO: 4488733 - DNA, 20 bp, Homo sapiens
ataaaaggtggagtttctct

SEQ ID NO: 4488734 - DNA, 21 bp, Homo sapiens
ataaaagtacatgttaaactt

SEQ ID NO: 4488735 - DNA, 15 bp, Homo sapiens
ataaaataaagcaaa

SEQ ID NO: 4488736 - DNA, 19 bp, Homo sapiens
ataaaataactaaaatgta

SEQ ID NO: 4488737 - DNA, 21 bp, Homo sapiens
ataaaataagtggattttgta

SEQ ID NO: 4488738 - DNA, 17 bp, Homo sapiens
ataaaatgaaaattgta

SEQ ID NO: 4488739 - DNA, 19 bp, Homo sapiens
ataaaatgaaaattgtatt

SEQ ID NO: 4488740 - DNA, 16 bp, Homo sapiens
ataaaatggctgtaat

SEQ ID NO: 4488741 - DNA, 16 bp, Homo sapiens
ataaaattaatgaaga

SEQ ID NO: 4488742 - DNA, 16 bp, Homo sapiens
ataaaattatttgcag

SEQ ID NO: 4488743 - DNA, 16 bp, Homo sapiens
ataaaattcatttcta

SEQ ID NO: 4488744 - DNA, 16 bp, Homo sapiens
ataaaattgcctctct

SEQ ID NO: 4488745 - DNA, 13 bp, Homo sapiens
ataaaatttacct

SEQ ID NO: 4488746 - DNA, 22 bp, Homo sapiens
ataaacacaaaatccattccag

SEQ ID NO: 4488747 - DNA, 15 bp, Homo sapiens
ataaacacatagatt

SEQ ID NO: 4488748 - DNA, 23 bp, Homo sapiens
ataaacacatagattcacctgta

SEQ ID NO: 4488749 - DNA, 12 bp, Homo sapiens
ataaacactgtg

SEQ ID NO: 4488750 - DNA, 22 bp, Homo sapiens
ataaacagaactccactgcaag

SEQ ID NO: 4488751 - DNA, 12 bp, Homo sapiens
ataaacagtcac

SEQ ID NO: 4488752 - DNA, 12 bp, Homo sapiens
ataaacatatgt

SEQ ID NO: 4488753 - DNA, 20 bp, Homo sapiens
ataaacatgtcacaatacag

SEQ ID NO: 4488754 - DNA, 22 bp, Homo sapiens
ataaacatgtcacaatacagta

SEQ ID NO: 4488755 - DNA, 15 bp, Homo sapiens
ataaaccaataaatc

SEQ ID NO: 4488756 - DNA, 11 bp, Homo sapiens
ataaaccagtg

SEQ ID NO: 4488757 - DNA, 12 bp, Homo sapiens
ataaaccagtgt

SEQ ID NO: 4488758 - DNA, 19 bp, Homo sapiens
ataaaccatttttgttact

SEQ ID NO: 4488759 - DNA, 20 bp, Homo sapiens
ataaaccatttttgttactc

SEQ ID NO: 4488760 - DNA, 20 bp, Homo sapiens
ataaaccctccttggtgcct

SEQ ID NO: 4488761 - DNA, 18 bp, Homo sapiens
ataaaccttaatatttct

SEQ ID NO: 4488762 - DNA, 14 bp, Homo sapiens
ataaactaccaaat

SEQ ID NO: 4488763 - DNA, 16 bp, Homo sapiens
ataaactactctttga

SEQ ID NO: 4488764 - DNA, 17 bp, Homo sapiens
ataaactactctttgat

SEQ ID NO: 4488765 - DNA, 19 bp, Homo sapiens
ataaactactctttgattt

SEQ ID NO: 4488766 - DNA, 19 bp, Homo sapiens
ataaactataaacttaagg

SEQ ID NO: 4488767 - DNA, 23 bp, Homo sapiens
ataaactatttatatcacacaat

SEQ ID NO: 4488768 - DNA, 11 bp, Homo sapiens
ataaagaaatt

SEQ ID NO: 4488769 - DNA, 15 bp, Homo sapiens
ataaagaaattcaag

SEQ ID NO: 4488770 - DNA, 16 bp, Homo sapiens
ataaagaaattcaaga

SEQ ID NO: 4488771 - DNA, 22 bp, Homo sapiens
ataaagaagctactattttgga

SEQ ID NO: 4488772 - DNA, 19 bp, Homo sapiens
ataaagaatacttgaactt

SEQ ID NO: 4488773 - DNA, 20 bp, Homo sapiens
ataaagaatacttgaacttg

SEQ ID NO: 4488774 - DNA, 15 bp, Homo sapiens
ataaagaatatatat

SEQ ID NO: 4488775 - DNA, 21 bp, Homo sapiens
ataaagaatgccatttctcac

SEQ ID NO: 4488776 - DNA, 18 bp, Homo sapiens
ataaagaattaatgactt

SEQ ID NO: 4488777 - DNA, 14 bp, Homo sapiens
ataaagaccacttt

SEQ ID NO: 4488778 - DNA, 17 bp, Homo sapiens
ataaagaccagaaattc

SEQ ID NO: 4488779 - DNA, 13 bp, Homo sapiens
ataaagactttta

SEQ ID NO: 4488780 - DNA, 23 bp, Homo sapiens
ataaagacttttatgtgagattt

SEQ ID NO: 4488781 - DNA, 16 bp, Homo sapiens
ataaagaggcatcttt

SEQ ID NO: 4488782 - DNA, 21 bp, Homo sapiens
ataaagataacccttattcca

SEQ ID NO: 4488783 - DNA, 18 bp, Homo sapiens
ataaagatacatgattga

SEQ ID NO: 4488784 - DNA, 19 bp, Homo sapiens
ataaagatacatgattgaa

SEQ ID NO: 4488785 - DNA, 14 bp, Homo sapiens
ataaagatcattta

SEQ ID NO: 4488786 - DNA, 13 bp, Homo sapiens
ataaagatttttt

SEQ ID NO: 4488787 - DNA, 11 bp, Homo sapiens
ataaagcaatt

SEQ ID NO: 4488788 - DNA, 14 bp, Homo sapiens
ataaagcagtattt

SEQ ID NO: 4488789 - DNA, 16 bp, Homo sapiens
ataaagcagtattttt

SEQ ID NO: 4488790 - DNA, 12 bp, Homo sapiens
ataaagcatgtg

SEQ ID NO: 4488791 - DNA, 17 bp, Homo sapiens
ataaagcctttgtatct

SEQ ID NO: 4488792 - DNA, 12 bp, Homo sapiens
ataaagctgttc

SEQ ID NO: 4488793 - DNA, 17 bp, Homo sapiens
ataaagctgttcttgaa

SEQ ID NO: 4488794 - DNA, 19 bp, Homo sapiens
ataaagctgttcttgaaag

SEQ ID NO: 4488795 - DNA, 14 bp, Homo sapiens
ataaaggaaaacaa

SEQ ID NO: 4488796 - DNA, 18 bp, Homo sapiens
ataaaggaaaacaaaaaa

SEQ ID NO: 4488797 - DNA, 14 bp, Homo sapiens
ataaaggactgtaa

SEQ ID NO: 4488798 - DNA, 17 bp, Homo sapiens
ataaaggatgtgattgt

SEQ ID NO: 4488799 - DNA, 22 bp, Homo sapiens
ataaaggatgtgattgtggaat

SEQ ID NO: 4488800 - DNA, 23 bp, Homo sapiens
ataaaggcagctgcctctgctcc

SEQ ID NO: 4488801 - DNA, 16 bp, Homo sapiens
ataaaggcagttttct

SEQ ID NO: 4488802 - DNA, 15 bp, Homo sapiens
ataaagggtcaggcc

SEQ ID NO: 4488803 - DNA, 21 bp, Homo sapiens
ataaaggtctgcactccttta

SEQ ID NO: 4488804 - DNA, 14 bp, Homo sapiens
ataaagtagttatt

SEQ ID NO: 4488805 - DNA, 17 bp, Homo sapiens
ataaagtataatgttta

SEQ ID NO: 4488806 - DNA, 14 bp, Homo sapiens
agttgctgtttact

SEQ ID NO: 4488807 - DNA, 15 bp, Homo sapiens
agttgggtagaaaaa

SEQ ID NO: 4488808 - DNA, 16 bp, Homo sapiens
agttggtaacttttgt

SEQ ID NO: 4488809 - DNA, 15 bp, Homo sapiens
agttggttggataag

SEQ ID NO: 4488810 - DNA, 16 bp, Homo sapiens
agttgtaaaatagaaa

SEQ ID NO: 4488811 - DNA, 21 bp, Homo sapiens
agttgtaaaatagaaaaagtg

SEQ ID NO: 4488812 - DNA, 12 bp, Homo sapiens
agttgtaaagta

SEQ ID NO: 4488813 - DNA, 18 bp, Homo sapiens
agttgtaaataatttatt

SEQ ID NO: 4488814 - DNA, 16 bp, Homo sapiens
agttgtaataaatcta

SEQ ID NO: 4488815 - DNA, 19 bp, Homo sapiens
agttgtacatgataagaca

SEQ ID NO: 4488816 - DNA, 14 bp, Homo sapiens
agttgtagacaaag

SEQ ID NO: 4488817 - DNA, 23 bp, Homo sapiens
agttgtagacaaagtacattctg

SEQ ID NO: 4488818 - DNA, 16 bp, Homo sapiens
agttgtatgtttgctg

SEQ ID NO: 4488819 - DNA, 17 bp, Homo sapiens
agttgtatgtttgctga

SEQ ID NO: 4488820 - DNA, 18 bp, Homo sapiens
agttgtatgtttgctgat

SEQ ID NO: 4488821 - DNA, 19 bp, Homo sapiens
agttgtatttaacagaaat

SEQ ID NO: 4488822 - DNA, 23 bp, Homo sapiens
agttgtatttaacagaaattgta

SEQ ID NO: 4488823 - DNA, 13 bp, Homo sapiens
agttgtcaacttg

SEQ ID NO: 4488824 - DNA, 17 bp, Homo sapiens
agttgtctgtctgaatg

SEQ ID NO: 4488825 - DNA, 15 bp, Homo sapiens
agttgtgtggcccag

SEQ ID NO: 4488826 - DNA, 17 bp, Homo sapiens
agttgtgtggcccagca

SEQ ID NO: 4488827 - DNA, 16 bp, Homo sapiens
agttgtgtgtatgtgt

SEQ ID NO: 4488828 - DNA, 14 bp, Homo sapiens
agttgtgtttcaac

SEQ ID NO: 4488829 - DNA, 23 bp, Homo sapiens
agttgtgtttcaacggaaagtgc

SEQ ID NO: 4488830 - DNA, 21 bp, Homo sapiens
agttgtgttttttaagatggc

SEQ ID NO: 4488831 - DNA, 23 bp, Homo sapiens
agttgttaataaaagtacatgtt

SEQ ID NO: 4488832 - DNA, 23 bp, Homo sapiens
agttgttgctatacatgttggaa

SEQ ID NO: 4488833 - DNA, 18 bp, Homo sapiens
agttgttggtctgtagca

SEQ ID NO: 4488834 - DNA, 14 bp, Homo sapiens
agttgttgtttgcc

SEQ ID NO: 4488835 - DNA, 14 bp, Homo sapiens
agttgtttgcttct

SEQ ID NO: 4488836 - DNA, 18 bp, Homo sapiens
agtttaaaaatcaacttt

SEQ ID NO: 4488837 - DNA, 21 bp, Homo sapiens
agtttaaaagcacgacagtgg

SEQ ID NO: 4488838 - DNA, 21 bp, Homo sapiens
agtttaaaatcatcagaaagg

SEQ ID NO: 4488839 - DNA, 13 bp, Homo sapiens
agtttaacaaatg

SEQ ID NO: 4488840 - DNA, 16 bp, Homo sapiens
agtttaacaataataa

SEQ ID NO: 4488841 - DNA, 19 bp, Homo sapiens
agtttaacttccactgtta

SEQ ID NO: 4488842 - DNA, 18 bp, Homo sapiens
agtttaaggtacactgtt

SEQ ID NO: 4488843 - DNA, 14 bp, Homo sapiens
agtttaattgactt

SEQ ID NO: 4488844 - DNA, 13 bp, Homo sapiens
agtttaattgtct

SEQ ID NO: 4488845 - DNA, 12 bp, Homo sapiens
agtttacacact

SEQ ID NO: 4488846 - DNA, 17 bp, Homo sapiens
agtttagaacagaggga

SEQ ID NO: 4488847 - DNA, 15 bp, Homo sapiens
agtttatatttaact

SEQ ID NO: 4488848 - DNA, 18 bp, Homo sapiens
agtttatatttaactctc

SEQ ID NO: 4488849 - DNA, 14 bp, Homo sapiens
agtttatcattcaa

SEQ ID NO: 4488850 - DNA, 21 bp, Homo sapiens
agtttatcttaagcatgtcaa

SEQ ID NO: 4488851 - DNA, 17 bp, Homo sapiens
agtttattacaatgtat

SEQ ID NO: 4488852 - DNA, 15 bp, Homo sapiens
agtttcaagttttaa

SEQ ID NO: 4488853 - DNA, 17 bp, Homo sapiens
agtttcacagaaaataa

SEQ ID NO: 4488854 - DNA, 16 bp, Homo sapiens
agtttcatataaagta

SEQ ID NO: 4488855 - DNA, 13 bp, Homo sapiens
agtttcattcaac

SEQ ID NO: 4488856 - DNA, 15 bp, Homo sapiens
agtttcctaaaagtt

SEQ ID NO: 4488857 - DNA, 20 bp, Homo sapiens
agtttcgaggggtcctcacc

SEQ ID NO: 4488858 - DNA, 20 bp, Homo sapiens
agtttctaaaattgagttct

SEQ ID NO: 4488859 - DNA, 16 bp, Homo sapiens
agtttctatggattca

SEQ ID NO: 4488860 - DNA, 15 bp, Homo sapiens
agtttctcagaagtc

SEQ ID NO: 4488861 - DNA, 11 bp, Homo sapiens
agtttctctgt

SEQ ID NO: 4488862 - DNA, 22 bp, Homo sapiens
agtttctgacaattaacataca

SEQ ID NO: 4488863 - DNA, 19 bp, Homo sapiens
agtttctgtttgattcttt

SEQ ID NO: 4488864 - DNA, 16 bp, Homo sapiens
agtttcttgtgtagat

SEQ ID NO: 4488865 - DNA, 20 bp, Homo sapiens
agtttcttgtgtagatttga

SEQ ID NO: 4488866 - DNA, 23 bp, Homo sapiens
agtttcttgtgtagatttgaaaa

SEQ ID NO: 4488867 - DNA, 14 bp, Homo sapiens
agtttctttacatt

SEQ ID NO: 4488868 - DNA, 17 bp, Homo sapiens
agtttgaaaagcaatat

SEQ ID NO: 4488869 - DNA, 12 bp, Homo sapiens
agtttgaaagtt

SEQ ID NO: 4488870 - DNA, 12 bp, Homo sapiens
agtttgaaattc

SEQ ID NO: 4488871 - DNA, 14 bp, Homo sapiens
agtttgaaattctg

SEQ ID NO: 4488872 - DNA, 23 bp, Homo sapiens
agtttgaaattctgaatttgcaa

SEQ ID NO: 4488873 - DNA, 16 bp, Homo sapiens
agtttgagctgccttc

SEQ ID NO: 4488874 - DNA, 18 bp, Homo sapiens
agtttgattattcagtgt

SEQ ID NO: 4488875 - DNA, 23 bp, Homo sapiens
agtttgattattcagtgtcactg

SEQ ID NO: 4488876 - DNA, 16 bp, Homo sapiens
agtttgcaaacctgca

SEQ ID NO: 4488877 - DNA, 13 bp, Homo sapiens
agtttgcagaaaa

SEQ ID NO: 4488878 - DNA, 14 bp, Homo sapiens
agtttgcagaaaag

SEQ ID NO: 4488879 - DNA, 15 bp, Homo sapiens
agtttgcctgcagtt

SEQ ID NO: 4488880 - DNA, 19 bp, Homo sapiens
agtttggaaataaaaatgt

SEQ ID NO: 4488881 - DNA, 20 bp, Homo sapiens
agtttggaaataaaaatgtt

SEQ ID NO: 4488882 - DNA, 17 bp, Homo sapiens
agtttggatatgtaaaa

SEQ ID NO: 4488883 - DNA, 22 bp, Homo sapiens
agtttggatatgtaaaacattt

SEQ ID NO: 4488884 - DNA, 17 bp, Homo sapiens
agtttggatgtctgtag

SEQ ID NO: 4488885 - DNA, 19 bp, Homo sapiens
agtttggatgtctgtagca

SEQ ID NO: 4488886 - DNA, 18 bp, Homo sapiens
agtttggctataagtgct

SEQ ID NO: 4488887 - DNA, 19 bp, Homo sapiens
agtttggctataagtgctc

SEQ ID NO: 4488888 - DNA, 21 bp, Homo sapiens
agtttgggctggagctcctcc

SEQ ID NO: 4488889 - DNA, 23 bp, Homo sapiens
agtttgggggcagattctgaatt

SEQ ID NO: 4488890 - DNA, 20 bp, Homo sapiens
agtttgtaggtaaaatgtat

SEQ ID NO: 4488891 - DNA, 24 bp, Homo sapiens
agtttgtattattacaaatattgt

SEQ ID NO: 4488892 - DNA, 23 bp, Homo sapiens
agtttgtattttaattatgggaa

SEQ ID NO: 4488893 - DNA, 15 bp, Homo sapiens
agtttgttctccggg

SEQ ID NO: 4488894 - DNA, 22 bp, Homo sapiens
agtttgtttaaacacttatctt

SEQ ID NO: 4488895 - DNA, 14 bp, Homo sapiens
agtttgtttagtta

SEQ ID NO: 4488896 - DNA, 22 bp, Homo sapiens
agtttgtttttgtttggtataa

SEQ ID NO: 4488897 - DNA, 13 bp, Homo sapiens
agttttaactgtg

SEQ ID NO: 4488898 - DNA, 18 bp, Homo sapiens
agttttaactgtggatat

SEQ ID NO: 4488899 - DNA, 14 bp, Homo sapiens
agttttaactttaa

SEQ ID NO: 4488900 - DNA, 19 bp, Homo sapiens
agttttaactttaatacag

SEQ ID NO: 4488901 - DNA, 20 bp, Homo sapiens
agttttaactttaatacagc

SEQ ID NO: 4488902 - DNA, 13 bp, Homo sapiens
agttttaataaga

SEQ ID NO: 4488903 - DNA, 16 bp, Homo sapiens
agttttaattaaaaaa

SEQ ID NO: 4488904 - DNA, 17 bp, Homo sapiens
agttttaattaaaaaaa

SEQ ID NO: 4488905 - DNA, 19 bp, Homo sapiens
agttttactcttaaatcat

SEQ ID NO: 4488906 - DNA, 15 bp, Homo sapiens
agttttactgcctgt

SEQ ID NO: 4488907 - DNA, 19 bp, Homo sapiens
agttttacttttaaactgt

SEQ ID NO: 4488908 - DNA, 20 bp, Homo sapiens
agttttagggtacagtttgg

SEQ ID NO: 4488909 - DNA, 16 bp, Homo sapiens
agttttattttatgtt

SEQ ID NO: 4488910 - DNA, 16 bp, Homo sapiens
agttttcagccttggg

SEQ ID NO: 4488911 - DNA, 14 bp, Homo sapiens
agttttcaggctat

SEQ ID NO: 4488912 - DNA, 13 bp, Homo sapiens
agttttcattgat

SEQ ID NO: 4488913 - DNA, 20 bp, Homo sapiens
agttttccctgcactgtgtc

SEQ ID NO: 4488914 - DNA, 12 bp, Homo sapiens
agttttctgaga

SEQ ID NO: 4488915 - DNA, 17 bp, Homo sapiens
agttttctgagaaagac

SEQ ID NO: 4488916 - DNA, 19 bp, Homo sapiens
agttttctgagaaagacta

SEQ ID NO: 4488917 - DNA, 23 bp, Homo sapiens
agttttctgagaaagactattca

SEQ ID NO: 4488918 - DNA, 23 bp, Homo sapiens
agttttcttcctttgaaagactg

SEQ ID NO: 4488919 - DNA, 18 bp, Homo sapiens
agttttgaagattctatg

SEQ ID NO: 4488920 - DNA, 17 bp, Homo sapiens
agttttgacacttccca

SEQ ID NO: 4488921 - DNA, 19 bp, Homo sapiens
agttttgctttagtacaat

SEQ ID NO: 4488922 - DNA, 22 bp, Homo sapiens
agttttgtggattaaacctttt

SEQ ID NO: 4488923 - DNA, 22 bp, Homo sapiens
agttttgtgtttgttgtagatt

SEQ ID NO: 4488924 - DNA, 21 bp, Homo sapiens
agttttgtttcactttgacat

SEQ ID NO: 4488925 - DNA, 15 bp, Homo sapiens
agtttttaaaaataa

SEQ ID NO: 4488926 - DNA, 14 bp, Homo sapiens
agtagtgtctggat

SEQ ID NO: 4488927 - DNA, 19 bp, Homo sapiens
agtagttactaaaattatg

SEQ ID NO: 4488928 - DNA, 13 bp, Homo sapiens
agtagttatataa

SEQ ID NO: 4488929 - DNA, 19 bp, Homo sapiens
agtataaaataaagcaaat

SEQ ID NO: 4488930 - DNA, 18 bp, Homo sapiens
agtataatgtttattaaa

SEQ ID NO: 4488931 - DNA, 12 bp, Homo sapiens
agtatacattgt

SEQ ID NO: 4488932 - DNA, 21 bp, Homo sapiens
agtatacgtataaatatcagt

SEQ ID NO: 4488933 - DNA, 15 bp, Homo sapiens
agtatagatggccaa

SEQ ID NO: 4488934 - DNA, 15 bp, Homo sapiens
agtatagtagaaaga

SEQ ID NO: 4488935 - DNA, 14 bp, Homo sapiens
agtatataagcttt

SEQ ID NO: 4488936 - DNA, 22 bp, Homo sapiens
agtatattgttgaagagacaga

SEQ ID NO: 4488937 - DNA, 22 bp, Homo sapiens
agtatatttcttcgttcttttt

SEQ ID NO: 4488938 - DNA, 19 bp, Homo sapiens
agtatattttatttcaatg

SEQ ID NO: 4488939 - DNA, 15 bp, Homo sapiens
agtatattttctgta

SEQ ID NO: 4488940 - DNA, 16 bp, Homo sapiens
agtatattttctgtat

SEQ ID NO: 4488941 - DNA, 18 bp, Homo sapiens
agtatattttctgtattt

SEQ ID NO: 4488942 - DNA, 23 bp, Homo sapiens
agtatcagagatgtccattttta

SEQ ID NO: 4488943 - DNA, 13 bp, Homo sapiens
agtatcagcacta

SEQ ID NO: 4488944 - DNA, 22 bp, Homo sapiens
agtatccacagaaaatgtaaac

SEQ ID NO: 4488945 - DNA, 23 bp, Homo sapiens
agtatccaggctttgtacagagt

SEQ ID NO: 4488946 - DNA, 15 bp, Homo sapiens
agtatctattagcag

SEQ ID NO: 4488947 - DNA, 14 bp, Homo sapiens
agtatcttgtgctt

SEQ ID NO: 4488948 - DNA, 12 bp, Homo sapiens
agtatcttttga

SEQ ID NO: 4488949 - DNA, 19 bp, Homo sapiens
agtatgcattattaaattg

SEQ ID NO: 4488950 - DNA, 20 bp, Homo sapiens
agtatggcctgacagctctg

SEQ ID NO: 4488951 - DNA, 23 bp, Homo sapiens
agtatggtaatctttacctgtat

SEQ ID NO: 4488952 - DNA, 13 bp, Homo sapiens
agtatggtacatt

SEQ ID NO: 4488953 - DNA, 19 bp, Homo sapiens
agtatggtacatttttcaa

SEQ ID NO: 4488954 - DNA, 14 bp, Homo sapiens
agtatgtcactctg

SEQ ID NO: 4488955 - DNA, 23 bp, Homo sapiens
agtatgtgggcagattttcagca

SEQ ID NO: 4488956 - DNA, 14 bp, Homo sapiens
agtattacatgatt

SEQ ID NO: 4488957 - DNA, 22 bp, Homo sapiens
agtattacatgatttaaagact

SEQ ID NO: 4488958 - DNA, 23 bp, Homo sapiens
agtattatccacaattattggca

SEQ ID NO: 4488959 - DNA, 23 bp, Homo sapiens
agtattatttctccatcccctcc

SEQ ID NO: 4488960 - DNA, 16 bp, Homo sapiens
agtattcagagtctct

SEQ ID NO: 4488961 - DNA, 18 bp, Homo sapiens
agtattcaggcactgaga

SEQ ID NO: 4488962 - DNA, 21 bp, Homo sapiens
agtattccaccttaaattaaa

SEQ ID NO: 4488963 - DNA, 21 bp, Homo sapiens
agtattctgacatgtaagaaa

SEQ ID NO: 4488964 - DNA, 12 bp, Homo sapiens
agtattcttctc

SEQ ID NO: 4488965 - DNA, 12 bp, Homo sapiens
agtattcttttt

SEQ ID NO: 4488966 - DNA, 14 bp, Homo sapiens
agtattgggcagga

SEQ ID NO: 4488967 - DNA, 13 bp, Homo sapiens
agtattgtaaatt

SEQ ID NO: 4488968 - DNA, 19 bp, Homo sapiens
agtatttaagctttaaatg

SEQ ID NO: 4488969 - DNA, 22 bp, Homo sapiens
agtatttactttttaaaaataa

SEQ ID NO: 4488970 - DNA, 19 bp, Homo sapiens
agtatttagaagccaacta

SEQ ID NO: 4488971 - DNA, 19 bp, Homo sapiens
agtatttataaaaatataa

SEQ ID NO: 4488972 - DNA, 22 bp, Homo sapiens
agtatttataaaaatataaatt

SEQ ID NO: 4488973 - DNA, 19 bp, Homo sapiens
agtatttctcctttgcaat

SEQ ID NO: 4488974 - DNA, 22 bp, Homo sapiens
agtatttctgggttaaatgaaa

SEQ ID NO: 4488975 - DNA, 22 bp, Homo sapiens
agtatttgatgtacattacaga

SEQ ID NO: 4488976 - DNA, 19 bp, Homo sapiens
agtatttgattcaaaatat

SEQ ID NO: 4488977 - DNA, 15 bp, Homo sapiens
agtatttgttaattt

SEQ ID NO: 4488978 - DNA, 20 bp, Homo sapiens
agtattttaattttaaagag

SEQ ID NO: 4488979 - DNA, 13 bp, Homo sapiens
agtattttatctg

SEQ ID NO: 4488980 - DNA, 16 bp, Homo sapiens
agtattttatctggaa

SEQ ID NO: 4488981 - DNA, 18 bp, Homo sapiens
agtattttatctggaaca

SEQ ID NO: 4488982 - DNA, 17 bp, Homo sapiens
agtattttccagcctta

SEQ ID NO: 4488983 - DNA, 18 bp, Homo sapiens
agtattttccagccttat

SEQ ID NO: 4488984 - DNA, 14 bp, Homo sapiens
agtattttcccaat

SEQ ID NO: 4488985 - DNA, 14 bp, Homo sapiens
agtatttttaaagg

SEQ ID NO: 4488986 - DNA, 14 bp, Homo sapiens
agtatttttgctgc

SEQ ID NO: 4488987 - DNA, 19 bp, Homo sapiens
agtattttttgtataattg

SEQ ID NO: 4488988 - DNA, 22 bp, Homo sapiens
agtattttttgtataattggat

SEQ ID NO: 4488989 - DNA, 22 bp, Homo sapiens
agtcaaaagatccttcatttta

SEQ ID NO: 4488990 - DNA, 16 bp, Homo sapiens
agtcaaaaggtgcctg

SEQ ID NO: 4488991 - DNA, 17 bp, Homo sapiens
agtcaaaaggtgcctgt

SEQ ID NO: 4488992 - DNA, 22 bp, Homo sapiens
agtcaaatggtaggcatttcct

SEQ ID NO: 4488993 - DNA, 14 bp, Homo sapiens
agtcaacctgggca

SEQ ID NO: 4488994 - DNA, 20 bp, Homo sapiens
agtcaacggggggctcctgc

SEQ ID NO: 4488995 - DNA, 21 bp, Homo sapiens
agtcaacggggggctcctgcc

SEQ ID NO: 4488996 - DNA, 24 bp, Homo sapiens
agtcaacggggggctcctgcccag

SEQ ID NO: 4488997 - DNA, 21 bp, Homo sapiens
agtcaactacacaaagcaggc

SEQ ID NO: 4488998 - DNA, 20 bp, Homo sapiens
agtcaactggctggccagtc

SEQ ID NO: 4488999 - DNA, 20 bp, Homo sapiens
agtcaagtgcgtccacgagc

SEQ ID NO: 4489000 - DNA, 17 bp, Homo sapiens
agtcaatatttttagat

SEQ ID NO: 4489001 - DNA, 15 bp, Homo sapiens
agtcaatggatccac

SEQ ID NO: 4489002 - DNA, 17 bp, Homo sapiens
agtcaatggatccacaa

SEQ ID NO: 4489003 - DNA, 13 bp, Homo sapiens
agtcaatgtactt

SEQ ID NO: 4489004 - DNA, 19 bp, Homo sapiens
agtcaatgtacttgtttga

SEQ ID NO: 4489005 - DNA, 12 bp, Homo sapiens
agtcacaaagac

SEQ ID NO: 4489006 - DNA, 11 bp, Homo sapiens
agtcacacagt

SEQ ID NO: 4489007 - DNA, 15 bp, Homo sapiens
agtcacatcacaata

SEQ ID NO: 4489008 - DNA, 14 bp, Homo sapiens
agtcaccagagact

SEQ ID NO: 4489009 - DNA, 12 bp, Homo sapiens
agtcactgcatt

SEQ ID NO: 4489010 - DNA, 20 bp, Homo sapiens
agtcactgcatttgcctgct

SEQ ID NO: 4489011 - DNA, 21 bp, Homo sapiens
agtcacttgtaaggggaacag

SEQ ID NO: 4489012 - DNA, 19 bp, Homo sapiens
agtcagaaggacggcagga

SEQ ID NO: 4489013 - DNA, 23 bp, Homo sapiens
agtcagaatgtgaaaaaggaata

SEQ ID NO: 4489014 - DNA, 17 bp, Homo sapiens
agtcagagagagtgttt

SEQ ID NO: 4489015 - DNA, 19 bp, Homo sapiens
agtcagatttttatttatg

SEQ ID NO: 4489016 - DNA, 22 bp, Homo sapiens
agtcagcagcagctctgagcca

SEQ ID NO: 4489017 - DNA, 13 bp, Homo sapiens
agtcagctttttt

SEQ ID NO: 4489018 - DNA, 20 bp, Homo sapiens
agtcaggaatcattaatttc

SEQ ID NO: 4489019 - DNA, 23 bp, Homo sapiens
agtcaggagttttactgcctgta

SEQ ID NO: 4489020 - DNA, 15 bp, Homo sapiens
agtcagggacctgct

SEQ ID NO: 4489021 - DNA, 17 bp, Homo sapiens
agtcagggacctgctgc

SEQ ID NO: 4489022 - DNA, 21 bp, Homo sapiens
agtcagggacctgctgctcag

SEQ ID NO: 4489023 - DNA, 21 bp, Homo sapiens
agtcagggtgggaagaaagaa

SEQ ID NO: 4489024 - DNA, 17 bp, Homo sapiens
agtcagtacgatcaagt

SEQ ID NO: 4489025 - DNA, 14 bp, Homo sapiens
agtcagtttctaca

SEQ ID NO: 4489026 - DNA, 15 bp, Homo sapiens
agtcagtttctacac

SEQ ID NO: 4489027 - DNA, 15 bp, Homo sapiens
agtcataaatactgt

SEQ ID NO: 4489028 - DNA, 23 bp, Homo sapiens
agtcataccaatgaaaaaatgta

SEQ ID NO: 4489029 - DNA, 16 bp, Homo sapiens
agtcatctactttttt

SEQ ID NO: 4489030 - DNA, 13 bp, Homo sapiens
agtcatcttgcta

SEQ ID NO: 4489031 - DNA, 16 bp, Homo sapiens
agtcatgatctccctg

SEQ ID NO: 4489032 - DNA, 19 bp, Homo sapiens
agtcatgatctccctgccg

SEQ ID NO: 4489033 - DNA, 23 bp, Homo sapiens
agtcatgatctccctgccgcctc

SEQ ID NO: 4489034 - DNA, 15 bp, Homo sapiens
agtcatgatgaatca

SEQ ID NO: 4489035 - DNA, 19 bp, Homo sapiens
agtcatggataactacatt

SEQ ID NO: 4489036 - DNA, 19 bp, Homo sapiens
agtcatggcctgagatgca

SEQ ID NO: 4489037 - DNA, 10 bp, Homo sapiens
agtcatggta

SEQ ID NO: 4489038 - DNA, 15 bp, Homo sapiens
agtcatggtcacagt

SEQ ID NO: 4489039 - DNA, 23 bp, Homo sapiens
agtcattaaattactatagcaaa

SEQ ID NO: 4489040 - DNA, 14 bp, Homo sapiens
agtcattagactcc

SEQ ID NO: 4489041 - DNA, 15 bp, Homo sapiens
agtcattagactcct

SEQ ID NO: 4489042 - DNA, 20 bp, Homo sapiens
agtcattagactcctcctcc

SEQ ID NO: 4489043 - DNA, 18 bp, Homo sapiens
agtcattatgttaatatt

SEQ ID NO: 4489044 - DNA, 13 bp, Homo sapiens
agtcattcagcag

SEQ ID NO: 4489045 - DNA, 22 bp, Homo sapiens
agtcattcagcagcaaattttc

SEQ ID NO: 4489046 - DNA, 13 bp, Homo sapiens
aggttttggttat

SEQ ID NO: 4489047 - DNA, 21 bp, Homo sapiens
aggttttgttttttttcagcc

SEQ ID NO: 4489048 - DNA, 15 bp, Homo sapiens
aggtttttgaggaaa

SEQ ID NO: 4489049 - DNA, 16 bp, Homo sapiens
aggttttttttcagtt

SEQ ID NO: 4489050 - DNA, 17 bp, Homo sapiens
aggttttttttcagttg

SEQ ID NO: 4489051 - DNA, 17 bp, Homo sapiens
agtaaaaagacattttt

SEQ ID NO: 4489052 - DNA, 19 bp, Homo sapiens
agtaaaaccacagcagttg

SEQ ID NO: 4489053 - DNA, 20 bp, Homo sapiens
agtaaaactctcaagcaggt

SEQ ID NO: 4489054 - DNA, 18 bp, Homo sapiens
agtaaaatgttttttaaa

SEQ ID NO: 4489055 - DNA, 18 bp, Homo sapiens
agtaaaattcagtttttt

SEQ ID NO: 4489056 - DNA, 13 bp, Homo sapiens
agtaaaatttatt

SEQ ID NO: 4489057 - DNA, 15 bp, Homo sapiens
agtaaaatttatttc

SEQ ID NO: 4489058 - DNA, 17 bp, Homo sapiens
agtaaaatttatttcat

SEQ ID NO: 4489059 - DNA, 22 bp, Homo sapiens
agtaaagaacgtggtcagagta

SEQ ID NO: 4489060 - DNA, 15 bp, Homo sapiens
agtaaagagaaactt

SEQ ID NO: 4489061 - DNA, 20 bp, Homo sapiens
agtaaagccattaaatgaat

SEQ ID NO: 4489062 - DNA, 21 bp, Homo sapiens
agtaaagccattaaatgaata

SEQ ID NO: 4489063 - DNA, 12 bp, Homo sapiens
agtaaagtggtt

SEQ ID NO: 4489064 - DNA, 15 bp, Homo sapiens
agtaaataaacaagt

SEQ ID NO: 4489065 - DNA, 15 bp, Homo sapiens
agtaacaatacatga

SEQ ID NO: 4489066 - DNA, 16 bp, Homo sapiens
agtaacactaatatat

SEQ ID NO: 4489067 - DNA, 12 bp, Homo sapiens
agtaacagggca

SEQ ID NO: 4489068 - DNA, 19 bp, Homo sapiens
agtaacatgacttccttat

SEQ ID NO: 4489069 - DNA, 18 bp, Homo sapiens
agtaacgagaagtgcttt

SEQ ID NO: 4489070 - DNA, 17 bp, Homo sapiens
agtaacgtgctcactgt

SEQ ID NO: 4489071 - DNA, 21 bp, Homo sapiens
agtaactataagatacaataa

SEQ ID NO: 4489072 - DNA, 17 bp, Homo sapiens
agtaacttcttatggaa

SEQ ID NO: 4489073 - DNA, 20 bp, Homo sapiens
agtaagaaagtgaagcaaat

SEQ ID NO: 4489074 - DNA, 21 bp, Homo sapiens
agtaagaaagtgaagcaaatc

SEQ ID NO: 4489075 - DNA, 17 bp, Homo sapiens
agtaagcctcatcatca

SEQ ID NO: 4489076 - DNA, 21 bp, Homo sapiens
agtaagcctcatcatcagagc

SEQ ID NO: 4489077 - DNA, 22 bp, Homo sapiens
agtaaggaaatattaagagcta

SEQ ID NO: 4489078 - DNA, 19 bp, Homo sapiens
agtaaggtgcttggagttt

SEQ ID NO: 4489079 - DNA, 15 bp, Homo sapiens
agtaagtatttccat

SEQ ID NO: 4489080 - DNA, 18 bp, Homo sapiens
agtaataggaccagagcg

SEQ ID NO: 4489081 - DNA, 18 bp, Homo sapiens
agtaatatcaaagcattt

SEQ ID NO: 4489082 - DNA, 23 bp, Homo sapiens
agtaatattggtgctatttaaca

SEQ ID NO: 4489083 - DNA, 16 bp, Homo sapiens
agtaatcacttaaagg

SEQ ID NO: 4489084 - DNA, 21 bp, Homo sapiens
agtaatcatgttttaatgtag

SEQ ID NO: 4489085 - DNA, 18 bp, Homo sapiens
agtaatctgtcagtgttt

SEQ ID NO: 4489086 - DNA, 17 bp, Homo sapiens
agtaatgaaatgtttac

SEQ ID NO: 4489087 - DNA, 15 bp, Homo sapiens
agtaatgaagaatca

SEQ ID NO: 4489088 - DNA, 12 bp, Homo sapiens
agtaatgaattt

SEQ ID NO: 4489089 - DNA, 21 bp, Homo sapiens
agtaatgaatttttatgatat

SEQ ID NO: 4489090 - DNA, 17 bp, Homo sapiens
agtaatgagtttaaaaa

SEQ ID NO: 4489091 - DNA, 20 bp, Homo sapiens
agtaatgcagtttttaaaaa

SEQ ID NO: 4489092 - DNA, 13 bp, Homo sapiens
agtaatgtaaaga

SEQ ID NO: 4489093 - DNA, 15 bp, Homo sapiens
agtaatgtaaagatg

SEQ ID NO: 4489094 - DNA, 17 bp, Homo sapiens
agtaatgtaaagatgat

SEQ ID NO: 4489095 - DNA, 17 bp, Homo sapiens
agtaatgttattttctt

SEQ ID NO: 4489096 - DNA, 21 bp, Homo sapiens
agtaatgttattttcttctaa

SEQ ID NO: 4489097 - DNA, 19 bp, Homo sapiens
agtaattaaggtacatcat

SEQ ID NO: 4489098 - DNA, 20 bp, Homo sapiens
agtaattaaggtacatcatt

SEQ ID NO: 4489099 - DNA, 19 bp, Homo sapiens
agtaattctgtcattccta

SEQ ID NO: 4489100 - DNA, 12 bp, Homo sapiens
agtaattgtgaa

SEQ ID NO: 4489101 - DNA, 15 bp, Homo sapiens
agtaattgtgaaaaa

SEQ ID NO: 4489102 - DNA, 23 bp, Homo sapiens
agtaatttagaaatcattttgca

SEQ ID NO: 4489103 - DNA, 15 bp, Homo sapiens
agtaatttatataga

SEQ ID NO: 4489104 - DNA, 17 bp, Homo sapiens
agtaatttatatagatg

SEQ ID NO: 4489105 - DNA, 22 bp, Homo sapiens
agtaatttcagtgtaaagtgtg

SEQ ID NO: 4489106 - DNA, 14 bp, Homo sapiens
agtaatttcattta

SEQ ID NO: 4489107 - DNA, 15 bp, Homo sapiens
agtacaaacatgaaa

SEQ ID NO: 4489108 - DNA, 14 bp, Homo sapiens
agtacaataaaagt

SEQ ID NO: 4489109 - DNA, 13 bp, Homo sapiens
agtacaatgtgtt

SEQ ID NO: 4489110 - DNA, 16 bp, Homo sapiens
agtacacaataagcaa

SEQ ID NO: 4489111 - DNA, 21 bp, Homo sapiens
agtacacaataagcaaaaaca

SEQ ID NO: 4489112 - DNA, 15 bp, Homo sapiens
agtacagaattggat

SEQ ID NO: 4489113 - DNA, 12 bp, Homo sapiens
agtacagaattt

SEQ ID NO: 4489114 - DNA, 23 bp, Homo sapiens
agtacagcggctcccctctgctt

SEQ ID NO: 4489115 - DNA, 18 bp, Homo sapiens
agtacaggtgcatattaa

SEQ ID NO: 4489116 - DNA, 22 bp, Homo sapiens
agtacatgataaatgatagaca

SEQ ID NO: 4489117 - DNA, 14 bp, Homo sapiens
agtacatgttaaac

SEQ ID NO: 4489118 - DNA, 22 bp, Homo sapiens
agtacattgcttaaaatatata

SEQ ID NO: 4489119 - DNA, 13 bp, Homo sapiens
agtacatttaaat

SEQ ID NO: 4489120 - DNA, 15 bp, Homo sapiens
agtacatttaaattt

SEQ ID NO: 4489121 - DNA, 15 bp, Homo sapiens
agtacccgactgttt

SEQ ID NO: 4489122 - DNA, 21 bp, Homo sapiens
agtaccctccattgggcacag

SEQ ID NO: 4489123 - DNA, 21 bp, Homo sapiens
agtacctagctggctctgtga

SEQ ID NO: 4489124 - DNA, 18 bp, Homo sapiens
agtacctgattgtatttt

SEQ ID NO: 4489125 - DNA, 18 bp, Homo sapiens
agtaccttaggttctttc

SEQ ID NO: 4489126 - DNA, 22 bp, Homo sapiens
agtacgaatcttatttttcctg

SEQ ID NO: 4489127 - DNA, 19 bp, Homo sapiens
agtactagagatattttgt

SEQ ID NO: 4489128 - DNA, 14 bp, Homo sapiens
agtactattactat

SEQ ID NO: 4489129 - DNA, 13 bp, Homo sapiens
agtactcatacat

SEQ ID NO: 4489130 - DNA, 20 bp, Homo sapiens
agtactggtaagattgttat

SEQ ID NO: 4489131 - DNA, 23 bp, Homo sapiens
agtactggtaagattgttattaa

SEQ ID NO: 4489132 - DNA, 23 bp, Homo sapiens
agtactggttactttcaaaatga

SEQ ID NO: 4489133 - DNA, 18 bp, Homo sapiens
agtactgtgggcaattta

SEQ ID NO: 4489134 - DNA, 20 bp, Homo sapiens
agtactgtgggcaatttaga

SEQ ID NO: 4489135 - DNA, 16 bp, Homo sapiens
agtacttcttctgtaa

SEQ ID NO: 4489136 - DNA, 23 bp, Homo sapiens
agtacttcttctgtaatatttac

SEQ ID NO: 4489137 - DNA, 17 bp, Homo sapiens
agtacttgtcatatgta

SEQ ID NO: 4489138 - DNA, 13 bp, Homo sapiens
agtacttttttaa

SEQ ID NO: 4489139 - DNA, 19 bp, Homo sapiens
agtagaaaaatctcattcc

SEQ ID NO: 4489140 - DNA, 12 bp, Homo sapiens
agtagaaatcat

SEQ ID NO: 4489141 - DNA, 11 bp, Homo sapiens
agtagaactgt

SEQ ID NO: 4489142 - DNA, 14 bp, Homo sapiens
agtagaattgcatt

SEQ ID NO: 4489143 - DNA, 15 bp, Homo sapiens
agtagaattgcattg

SEQ ID NO: 4489144 - DNA, 19 bp, Homo sapiens
agtagacaatcattgtttt

SEQ ID NO: 4489145 - DNA, 12 bp, Homo sapiens
agtagacattta

SEQ ID NO: 4489146 - DNA, 14 bp, Homo sapiens
agtagacatttata

SEQ ID NO: 4489147 - DNA, 15 bp, Homo sapiens
agtagatctatatta

SEQ ID NO: 4489148 - DNA, 18 bp, Homo sapiens
agtagattcatgaaaatg

SEQ ID NO: 4489149 - DNA, 21 bp, Homo sapiens
agtagattcatgaaaatgtat

SEQ ID NO: 4489150 - DNA, 20 bp, Homo sapiens
agtagattgcagaaaattct

SEQ ID NO: 4489151 - DNA, 15 bp, Homo sapiens
agtagcaaatgttta

SEQ ID NO: 4489152 - DNA, 17 bp, Homo sapiens
agtagcaaatgtttact

SEQ ID NO: 4489153 - DNA, 18 bp, Homo sapiens
agtagcaaatgtttactg

SEQ ID NO: 4489154 - DNA, 22 bp, Homo sapiens
agtagcagtgattgtcttaata

SEQ ID NO: 4489155 - DNA, 16 bp, Homo sapiens
agtagcgctatagtta

SEQ ID NO: 4489156 - DNA, 18 bp, Homo sapiens
agtagcgttttttaaatg

SEQ ID NO: 4489157 - DNA, 19 bp, Homo sapiens
agtagcgttttttaaatgt

SEQ ID NO: 4489158 - DNA, 20 bp, Homo sapiens
agtagcgttttttaaatgta

SEQ ID NO: 4489159 - DNA, 21 bp, Homo sapiens
agtagctgggatgacaggcgc

SEQ ID NO: 4489160 - DNA, 20 bp, Homo sapiens
agtagctgtcagatgtcaca

SEQ ID NO: 4489161 - DNA, 21 bp, Homo sapiens
agtagctgtcagatgtcacat

SEQ ID NO: 4489162 - DNA, 18 bp, Homo sapiens
agtaggaatgtacatgaa

SEQ ID NO: 4489163 - DNA, 18 bp, Homo sapiens
agtaggcatatatcacta

SEQ ID NO: 4489164 - DNA, 21 bp, Homo sapiens
agtagtacttcttctgtaata

SEQ ID NO: 4489165 - DNA, 16 bp, Homo sapiens
agtagtccttggcata

SEQ ID NO: 4489166 - DNA, 13 bp, Homo sapiens
aggtcctgcccat

SEQ ID NO: 4489167 - DNA, 20 bp, Homo sapiens
aggtcctgcccatgtgtccc

SEQ ID NO: 4489168 - DNA, 17 bp, Homo sapiens
aggtcgaggctacagtg

SEQ ID NO: 4489169 - DNA, 18 bp, Homo sapiens
aggtcgttttccaaagag

SEQ ID NO: 4489170 - DNA, 16 bp, Homo sapiens
aggtctcatctcccag

SEQ ID NO: 4489171 - DNA, 17 bp, Homo sapiens
aggtctcatctcccagg

SEQ ID NO: 4489172 - DNA, 15 bp, Homo sapiens
aggtctcctcagggt

SEQ ID NO: 4489173 - DNA, 18 bp, Homo sapiens
aggtctgagccacagcag

SEQ ID NO: 4489174 - DNA, 23 bp, Homo sapiens
aggtctgagccacagcagcattt

SEQ ID NO: 4489175 - DNA, 13 bp, Homo sapiens
aggtctgcctggt

SEQ ID NO: 4489176 - DNA, 18 bp, Homo sapiens
aggtctttactgaatgtt

SEQ ID NO: 4489177 - DNA, 17 bp, Homo sapiens
aggtgacacgcttctga

SEQ ID NO: 4489178 - DNA, 21 bp, Homo sapiens
aggtgacagtggctgctctgg

SEQ ID NO: 4489179 - DNA, 22 bp, Homo sapiens
aggtgacagtggctgctctggg

SEQ ID NO: 4489180 - DNA, 19 bp, Homo sapiens
aggtgaccaaatcagtgtg

SEQ ID NO: 4489181 - DNA, 16 bp, Homo sapiens
aggtgacctcctgcag

SEQ ID NO: 4489182 - DNA, 19 bp, Homo sapiens
aggtgagtttgagctgcct

SEQ ID NO: 4489183 - DNA, 12 bp, Homo sapiens
aggtgataaaga

SEQ ID NO: 4489184 - DNA, 15 bp, Homo sapiens
aggtgataagggaaa

SEQ ID NO: 4489185 - DNA, 19 bp, Homo sapiens
aggtgataggtaaattttt

SEQ ID NO: 4489186 - DNA, 21 bp, Homo sapiens
aggtgcaacagacttgaatgc

SEQ ID NO: 4489187 - DNA, 22 bp, Homo sapiens
aggtgcagggaagtgcagagct

SEQ ID NO: 4489188 - DNA, 20 bp, Homo sapiens
aggtgccacccagtagccca

SEQ ID NO: 4489189 - DNA, 22 bp, Homo sapiens
aggtgccacccagtagcccaga

SEQ ID NO: 4489190 - DNA, 16 bp, Homo sapiens
aggtgccatggaagag

SEQ ID NO: 4489191 - DNA, 17 bp, Homo sapiens
aggtgccatggaagagg

SEQ ID NO: 4489192 - DNA, 12 bp, Homo sapiens
aggtgcccagga

SEQ ID NO: 4489193 - DNA, 16 bp, Homo sapiens
aggtgcccaggaaagg

SEQ ID NO: 4489194 - DNA, 17 bp, Homo sapiens
aggtgcccctgatgacg

SEQ ID NO: 4489195 - DNA, 22 bp, Homo sapiens
aggtgccgacactgagctgtga

SEQ ID NO: 4489196 - DNA, 11 bp, Homo sapiens
aggtgcctgtg

SEQ ID NO: 4489197 - DNA, 13 bp, Homo sapiens
aggtgccttctta

SEQ ID NO: 4489198 - DNA, 23 bp, Homo sapiens
aggtgccttcttattctcactcc

SEQ ID NO: 4489199 - DNA, 18 bp, Homo sapiens
aggtgcctttcaaattta

SEQ ID NO: 4489200 - DNA, 15 bp, Homo sapiens
aggtgctaacataga

SEQ ID NO: 4489201 - DNA, 20 bp, Homo sapiens
aggtgctaatttgttttgga

SEQ ID NO: 4489202 - DNA, 23 bp, Homo sapiens
aggtgctacaaaaacacagcaag

SEQ ID NO: 4489203 - DNA, 24 bp, Homo sapiens
aggtgctacaaaaacacagcaagg

SEQ ID NO: 4489204 - DNA, 17 bp, Homo sapiens
aggtgctattgttactc

SEQ ID NO: 4489205 - DNA, 18 bp, Homo sapiens
aggtgctctctttctgtc

SEQ ID NO: 4489206 - DNA, 13 bp, Homo sapiens
aggtgctggactg

SEQ ID NO: 4489207 - DNA, 23 bp, Homo sapiens
aggtgcttctagttctgccagga

SEQ ID NO: 4489208 - DNA, 24 bp, Homo sapiens
aggtggaaattttatatgtaaatg

SEQ ID NO: 4489209 - DNA, 15 bp, Homo sapiens
aggtggaagaaggga

SEQ ID NO: 4489210 - DNA, 20 bp, Homo sapiens
aggtggaagcagaggccctg

SEQ ID NO: 4489211 - DNA, 23 bp, Homo sapiens
aggtggaagcagaggccctgccc

SEQ ID NO: 4489212 - DNA, 17 bp, Homo sapiens
aggtggaagccctcctt

SEQ ID NO: 4489213 - DNA, 20 bp, Homo sapiens
aggtggaagccctccttcca

SEQ ID NO: 4489214 - DNA, 20 bp, Homo sapiens
aggtggaagttgcagtgagt

SEQ ID NO: 4489215 - DNA, 18 bp, Homo sapiens
aggtggagagcactagaa

SEQ ID NO: 4489216 - DNA, 16 bp, Homo sapiens
aggtggagtttctctg

SEQ ID NO: 4489217 - DNA, 17 bp, Homo sapiens
aggtggagtttctctgt

SEQ ID NO: 4489218 - DNA, 17 bp, Homo sapiens
aggtggatcacctgagg

SEQ ID NO: 4489219 - DNA, 15 bp, Homo sapiens
aggtggatcctgtag

SEQ ID NO: 4489220 - DNA, 15 bp, Homo sapiens
aggtggcacctgcag

SEQ ID NO: 4489221 - DNA, 19 bp, Homo sapiens
aggtggcctttgtgctgcg

SEQ ID NO: 4489222 - DNA, 20 bp, Homo sapiens
aggtggcctttgtgctgcgc

SEQ ID NO: 4489223 - DNA, 22 bp, Homo sapiens
aggtggcctttgtgctgcgcct

SEQ ID NO: 4489224 - DNA, 22 bp, Homo sapiens
aggtggctgacccagtccctgg

SEQ ID NO: 4489225 - DNA, 16 bp, Homo sapiens
aggtgggatcctccct

SEQ ID NO: 4489226 - DNA, 17 bp, Homo sapiens
aggtgggatcctccctc

SEQ ID NO: 4489227 - DNA, 19 bp, Homo sapiens
aggtgggcaaagggaagta

SEQ ID NO: 4489228 - DNA, 16 bp, Homo sapiens
aggtgggccacaccca

SEQ ID NO: 4489229 - DNA, 21 bp, Homo sapiens
aggtggggagactgggctgag

SEQ ID NO: 4489230 - DNA, 22 bp, Homo sapiens
aggtggggattgcccctggctt

SEQ ID NO: 4489231 - DNA, 19 bp, Homo sapiens
aggtgggttttcttcccat

SEQ ID NO: 4489232 - DNA, 21 bp, Homo sapiens
aggtgtacacatgccaacact

SEQ ID NO: 4489233 - DNA, 11 bp, Homo sapiens
aggtgtcccca

SEQ ID NO: 4489234 - DNA, 12 bp, Homo sapiens
aggtgtccccaa

SEQ ID NO: 4489235 - DNA, 19 bp, Homo sapiens
aggtgtcctgagcaccaca

SEQ ID NO: 4489236 - DNA, 16 bp, Homo sapiens
aggtgtcttcctccca

SEQ ID NO: 4489237 - DNA, 19 bp, Homo sapiens
aggtgtgaacagctttgta

SEQ ID NO: 4489238 - DNA, 19 bp, Homo sapiens
aggtgtgaacctacctgcc

SEQ ID NO: 4489239 - DNA, 21 bp, Homo sapiens
aggtgtgaacctacctgcctt

SEQ ID NO: 4489240 - DNA, 17 bp, Homo sapiens
aggtgtgtactcagggc

SEQ ID NO: 4489241 - DNA, 18 bp, Homo sapiens
aggtgtgtgtgtccagag

SEQ ID NO: 4489242 - DNA, 15 bp, Homo sapiens
aggtgttactgtaat

SEQ ID NO: 4489243 - DNA, 14 bp, Homo sapiens
aggtgttgggtcag

SEQ ID NO: 4489244 - DNA, 22 bp, Homo sapiens
aggtgttgggtcagtggccagg

SEQ ID NO: 4489245 - DNA, 23 bp, Homo sapiens
aggtgttgggtcagtggccaggt

SEQ ID NO: 4489246 - DNA, 21 bp, Homo sapiens
aggtgtttattaaaattctga

SEQ ID NO: 4489247 - DNA, 19 bp, Homo sapiens
aggttaaacggtgcccatc

SEQ ID NO: 4489248 - DNA, 14 bp, Homo sapiens
aggttaaagctaaa

SEQ ID NO: 4489249 - DNA, 17 bp, Homo sapiens
aggttaaagctaaactg

SEQ ID NO: 4489250 - DNA, 19 bp, Homo sapiens
aggttactacttaatgctt

SEQ ID NO: 4489251 - DNA, 21 bp, Homo sapiens
aggttagatatttcgaccctg

SEQ ID NO: 4489252 - DNA, 17 bp, Homo sapiens
aggttaggaaggcagca

SEQ ID NO: 4489253 - DNA, 20 bp, Homo sapiens
aggttataattttttttaaa

SEQ ID NO: 4489254 - DNA, 16 bp, Homo sapiens
aggttattgcaataaa

SEQ ID NO: 4489255 - DNA, 23 bp, Homo sapiens
aggttattttctttatcattgct

SEQ ID NO: 4489256 - DNA, 16 bp, Homo sapiens
aggttcagaaaattaa

SEQ ID NO: 4489257 - DNA, 11 bp, Homo sapiens
aggttccagaa

SEQ ID NO: 4489258 - DNA, 13 bp, Homo sapiens
aggttcccactta

SEQ ID NO: 4489259 - DNA, 17 bp, Homo sapiens
aggttcccccagcaagc

SEQ ID NO: 4489260 - DNA, 23 bp, Homo sapiens
aggttccgcttggagcagagggg

SEQ ID NO: 4489261 - DNA, 15 bp, Homo sapiens
aggttcctctgcctg

SEQ ID NO: 4489262 - DNA, 16 bp, Homo sapiens
aggttcctctgcctgc

SEQ ID NO: 4489263 - DNA, 17 bp, Homo sapiens
aggttcctctgcctgcc

SEQ ID NO: 4489264 - DNA, 23 bp, Homo sapiens
aggttctcattaggttttgcttg

SEQ ID NO: 4489265 - DNA, 16 bp, Homo sapiens
aggttcttgctttctc

SEQ ID NO: 4489266 - DNA, 21 bp, Homo sapiens
aggttcttgctttctctctca

SEQ ID NO: 4489267 - DNA, 23 bp, Homo sapiens
aggttcttgctttctctctcatg

SEQ ID NO: 4489268 - DNA, 14 bp, Homo sapiens
aggttctttctgaa

SEQ ID NO: 4489269 - DNA, 12 bp, Homo sapiens
aggttgaagcca

SEQ ID NO: 4489270 - DNA, 15 bp, Homo sapiens
aggttgaataatata

SEQ ID NO: 4489271 - DNA, 17 bp, Homo sapiens
aggttgagctcttctta

SEQ ID NO: 4489272 - DNA, 14 bp, Homo sapiens
aggttgcacagcaa

SEQ ID NO: 4489273 - DNA, 14 bp, Homo sapiens
aggttgcagtgagc

SEQ ID NO: 4489274 - DNA, 17 bp, Homo sapiens
aggttgcctgaaaaatg

SEQ ID NO: 4489275 - DNA, 14 bp, Homo sapiens
aggttgggatggga

SEQ ID NO: 4489276 - DNA, 18 bp, Homo sapiens
aggttgggcttccatgcc

SEQ ID NO: 4489277 - DNA, 18 bp, Homo sapiens
aggttgtagtgagccaag

SEQ ID NO: 4489278 - DNA, 17 bp, Homo sapiens
aggtttaaccttaaaat

SEQ ID NO: 4489279 - DNA, 19 bp, Homo sapiens
aggtttaagtagatttcat

SEQ ID NO: 4489280 - DNA, 14 bp, Homo sapiens
aggtttatgaaaaa

SEQ ID NO: 4489281 - DNA, 16 bp, Homo sapiens
aggtttatgaaaaaga

SEQ ID NO: 4489282 - DNA, 20 bp, Homo sapiens
aggtttcagatgaggtcaac

SEQ ID NO: 4489283 - DNA, 13 bp, Homo sapiens
aggtttcatttct

SEQ ID NO: 4489284 - DNA, 13 bp, Homo sapiens
aggtttgcaggag

SEQ ID NO: 4489285 - DNA, 20 bp, Homo sapiens
aggttttatgtgttcttcgt

SEQ ID NO: 4489286 - DNA, 22 bp, Homo sapiens
aggggcccaaggcggcccctcc

SEQ ID NO: 4489287 - DNA, 13 bp, Homo sapiens
aggggcccaggga

SEQ ID NO: 4489288 - DNA, 16 bp, Homo sapiens
aggggcccctccagct

SEQ ID NO: 4489289 - DNA, 16 bp, Homo sapiens
aggggccctggccagg

SEQ ID NO: 4489290 - DNA, 17 bp, Homo sapiens
aggggccggctgtttcc

SEQ ID NO: 4489291 - DNA, 14 bp, Homo sapiens
aggggcgcacccca

SEQ ID NO: 4489292 - DNA, 18 bp, Homo sapiens
aggggcgcaccccacagc

SEQ ID NO: 4489293 - DNA, 19 bp, Homo sapiens
aggggcgcaccccacagct

SEQ ID NO: 4489294 - DNA, 17 bp, Homo sapiens
aggggctccatgctggg

SEQ ID NO: 4489295 - DNA, 21 bp, Homo sapiens
aggggctccatgctgggtctg

SEQ ID NO: 4489296 - DNA, 21 bp, Homo sapiens
aggggctggggacttgtgtct

SEQ ID NO: 4489297 - DNA, 14 bp, Homo sapiens
aggggctgtacagt

SEQ ID NO: 4489298 - DNA, 21 bp, Homo sapiens
aggggcttaattattgatgtt

SEQ ID NO: 4489299 - DNA, 15 bp, Homo sapiens
aggggcttcctgggt

SEQ ID NO: 4489300 - DNA, 19 bp, Homo sapiens
agggggaaaaagtgtcaac

SEQ ID NO: 4489301 - DNA, 20 bp, Homo sapiens
agggggatatgggtcctctg

SEQ ID NO: 4489302 - DNA, 21 bp, Homo sapiens
agggggatatgggtcctctgg

SEQ ID NO: 4489303 - DNA, 19 bp, Homo sapiens
agggggccccgccagggct

SEQ ID NO: 4489304 - DNA, 21 bp, Homo sapiens
agggggccctgccccacccca

SEQ ID NO: 4489305 - DNA, 14 bp, Homo sapiens
agggggccctgcct

SEQ ID NO: 4489306 - DNA, 16 bp, Homo sapiens
agggggctgctcccac

SEQ ID NO: 4489307 - DNA, 22 bp, Homo sapiens
agggggctgctcccacctggct

SEQ ID NO: 4489308 - DNA, 19 bp, Homo sapiens
agggggcttgaagccaaag

SEQ ID NO: 4489309 - DNA, 22 bp, Homo sapiens
aggggggggtgggtgagagaga

SEQ ID NO: 4489310 - DNA, 17 bp, Homo sapiens
agggggtgtctgcacct

SEQ ID NO: 4489311 - DNA, 23 bp, Homo sapiens
aggggtacattctagctgagaag

SEQ ID NO: 4489312 - DNA, 20 bp, Homo sapiens
aggggtcagtgcagcagagg

SEQ ID NO: 4489313 - DNA, 14 bp, Homo sapiens
aggggtccaggccc

SEQ ID NO: 4489314 - DNA, 15 bp, Homo sapiens
aggggtccaggcccc

SEQ ID NO: 4489315 - DNA, 19 bp, Homo sapiens
aggggtcccagccaccccg

SEQ ID NO: 4489316 - DNA, 23 bp, Homo sapiens
aggggtccctgcaaaactccagg

SEQ ID NO: 4489317 - DNA, 19 bp, Homo sapiens
aggggtctccctggctccc

SEQ ID NO: 4489318 - DNA, 14 bp, Homo sapiens
aggggtctgagcca

SEQ ID NO: 4489319 - DNA, 23 bp, Homo sapiens
aggggtgagagacctgctcaggc

SEQ ID NO: 4489320 - DNA, 12 bp, Homo sapiens
aggggtgctcct

SEQ ID NO: 4489321 - DNA, 14 bp, Homo sapiens
aggggtgctcctgt

SEQ ID NO: 4489322 - DNA, 21 bp, Homo sapiens
aggggtggggagatgcttctc

SEQ ID NO: 4489323 - DNA, 14 bp, Homo sapiens
aggggttcctcaaa

SEQ ID NO: 4489324 - DNA, 20 bp, Homo sapiens
aggggttcctcaaatttttt

SEQ ID NO: 4489325 - DNA, 14 bp, Homo sapiens
aggggtttacagtg

SEQ ID NO: 4489326 - DNA, 23 bp, Homo sapiens
aggggtttcagaattttgcattg

SEQ ID NO: 4489327 - DNA, 15 bp, Homo sapiens
agggtaaggtgcctt

SEQ ID NO: 4489328 - DNA, 15 bp, Homo sapiens
agggtaatagaaatg

SEQ ID NO: 4489329 - DNA, 13 bp, Homo sapiens
agggtacagatcc

SEQ ID NO: 4489330 - DNA, 19 bp, Homo sapiens
agggtacagatccccagcc

SEQ ID NO: 4489331 - DNA, 23 bp, Homo sapiens
agggtacagatccccagcccctc

SEQ ID NO: 4489332 - DNA, 14 bp, Homo sapiens
agggtacagtttgg

SEQ ID NO: 4489333 - DNA, 20 bp, Homo sapiens
agggtagccccctcatctgc

SEQ ID NO: 4489334 - DNA, 16 bp, Homo sapiens
agggtataagttgctg

SEQ ID NO: 4489335 - DNA, 14 bp, Homo sapiens
agggtataatgtgt

SEQ ID NO: 4489336 - DNA, 19 bp, Homo sapiens
agggtcagacgcctgagga

SEQ ID NO: 4489337 - DNA, 13 bp, Homo sapiens
agggtcccaagct

SEQ ID NO: 4489338 - DNA, 20 bp, Homo sapiens
agggtcctctcttccacagt

SEQ ID NO: 4489339 - DNA, 20 bp, Homo sapiens
agggtcctgccggtgggacc

SEQ ID NO: 4489340 - DNA, 23 bp, Homo sapiens
agggtcctgccggtgggaccctg

SEQ ID NO: 4489341 - DNA, 17 bp, Homo sapiens
agggtcctggctcctga

SEQ ID NO: 4489342 - DNA, 20 bp, Homo sapiens
agggtcctggctcctgaggg

SEQ ID NO: 4489343 - DNA, 21 bp, Homo sapiens
agggtcctggctcctgagggg

SEQ ID NO: 4489344 - DNA, 15 bp, Homo sapiens
agggtctagggagag

SEQ ID NO: 4489345 - DNA, 14 bp, Homo sapiens
agggtctggagaag

SEQ ID NO: 4489346 - DNA, 20 bp, Homo sapiens
agggtcttgggggtcagggg

SEQ ID NO: 4489347 - DNA, 19 bp, Homo sapiens
agggtgacttttcctgctg

SEQ ID NO: 4489348 - DNA, 14 bp, Homo sapiens
agggtgctgactgg

SEQ ID NO: 4489349 - DNA, 20 bp, Homo sapiens
agggtggatgtgctggaggg

SEQ ID NO: 4489350 - DNA, 15 bp, Homo sapiens
agggtggccacacag

SEQ ID NO: 4489351 - DNA, 23 bp, Homo sapiens
agggtggccacacaggcagggcc

SEQ ID NO: 4489352 - DNA, 18 bp, Homo sapiens
agggtggcccttgcagtt

SEQ ID NO: 4489353 - DNA, 16 bp, Homo sapiens
agggtggctttgctgt

SEQ ID NO: 4489354 - DNA, 18 bp, Homo sapiens
agggtgggaagaaagaat

SEQ ID NO: 4489355 - DNA, 17 bp, Homo sapiens
agggtgggagtggggcc

SEQ ID NO: 4489356 - DNA, 18 bp, Homo sapiens
agggtgggcttcctgccc

SEQ ID NO: 4489357 - DNA, 18 bp, Homo sapiens
agggtgggggagggaggt

SEQ ID NO: 4489358 - DNA, 21 bp, Homo sapiens
agggtggggggggggcgcggc

SEQ ID NO: 4489359 - DNA, 12 bp, Homo sapiens
agggtggggggt

SEQ ID NO: 4489360 - DNA, 15 bp, Homo sapiens
agggtgtatagtgtt

SEQ ID NO: 4489361 - DNA, 19 bp, Homo sapiens
agggtgtatagtgttcaca

SEQ ID NO: 4489362 - DNA, 15 bp, Homo sapiens
agggtgtttcctcta

SEQ ID NO: 4489363 - DNA, 14 bp, Homo sapiens
agggttatatttgg

SEQ ID NO: 4489364 - DNA, 16 bp, Homo sapiens
agggttcacacagccc

SEQ ID NO: 4489365 - DNA, 19 bp, Homo sapiens
agggttctaaatgcaataa

SEQ ID NO: 4489366 - DNA, 17 bp, Homo sapiens
agggttgaccccagagg

SEQ ID NO: 4489367 - DNA, 18 bp, Homo sapiens
agggttgaccccagagga

SEQ ID NO: 4489368 - DNA, 14 bp, Homo sapiens
agggttgagagcca

SEQ ID NO: 4489369 - DNA, 15 bp, Homo sapiens
agggttgggcccaga

SEQ ID NO: 4489370 - DNA, 16 bp, Homo sapiens
aggtaaaatgtatttt

SEQ ID NO: 4489371 - DNA, 22 bp, Homo sapiens
aggtaaatttttaggcaaagat

SEQ ID NO: 4489372 - DNA, 14 bp, Homo sapiens
aggtaacactacag

SEQ ID NO: 4489373 - DNA, 17 bp, Homo sapiens
aggtaagctcaggatat

SEQ ID NO: 4489374 - DNA, 21 bp, Homo sapiens
aggtaatccaagatattttaa

SEQ ID NO: 4489375 - DNA, 16 bp, Homo sapiens
aggtaatgtgaataaa

SEQ ID NO: 4489376 - DNA, 15 bp, Homo sapiens
aggtacacctccccc

SEQ ID NO: 4489377 - DNA, 17 bp, Homo sapiens
aggtacacctccccctg

SEQ ID NO: 4489378 - DNA, 18 bp, Homo sapiens
aggtacacctccccctgc

SEQ ID NO: 4489379 - DNA, 23 bp, Homo sapiens
aggtaccagctgcgcttgctttt

SEQ ID NO: 4489380 - DNA, 14 bp, Homo sapiens
aggtagaaaaaggg

SEQ ID NO: 4489381 - DNA, 17 bp, Homo sapiens
aggtagaaaaagggtca

SEQ ID NO: 4489382 - DNA, 19 bp, Homo sapiens
aggtagacttttatgagaa

SEQ ID NO: 4489383 - DNA, 14 bp, Homo sapiens
aggtagtgggctca

SEQ ID NO: 4489384 - DNA, 18 bp, Homo sapiens
aggtagttgggtagaaaa

SEQ ID NO: 4489385 - DNA, 20 bp, Homo sapiens
aggtagttgggtagaaaaat

SEQ ID NO: 4489386 - DNA, 21 bp, Homo sapiens
aggtatatgatgagcagactt

SEQ ID NO: 4489387 - DNA, 18 bp, Homo sapiens
aggtatgatctcttctgg

SEQ ID NO: 4489388 - DNA, 15 bp, Homo sapiens
aggtattagcaaagc

SEQ ID NO: 4489389 - DNA, 15 bp, Homo sapiens
aggtcaaactcccta

SEQ ID NO: 4489390 - DNA, 14 bp, Homo sapiens
aggtcaacacaggt

SEQ ID NO: 4489391 - DNA, 19 bp, Homo sapiens
aggtcaacagagaaggcag

SEQ ID NO: 4489392 - DNA, 21 bp, Homo sapiens
aggtcaacagagaaggcagga

SEQ ID NO: 4489393 - DNA, 13 bp, Homo sapiens
aggtcaataacac

SEQ ID NO: 4489394 - DNA, 20 bp, Homo sapiens
aggtcacctgccgccctgtg

SEQ ID NO: 4489395 - DNA, 18 bp, Homo sapiens
aggtcactccaccatccc

SEQ ID NO: 4489396 - DNA, 20 bp, Homo sapiens
aggtcactggaaaggggaga

SEQ ID NO: 4489397 - DNA, 15 bp, Homo sapiens
aggtcagcatgtcta

SEQ ID NO: 4489398 - DNA, 19 bp, Homo sapiens
aggtcagcatttgatctgt

SEQ ID NO: 4489399 - DNA, 20 bp, Homo sapiens
aggtcagggaggatctgttc

SEQ ID NO: 4489400 - DNA, 19 bp, Homo sapiens
aggtcagttgtgtttttta

SEQ ID NO: 4489401 - DNA, 18 bp, Homo sapiens
aggtccaaggacaccctc

SEQ ID NO: 4489402 - DNA, 15 bp, Homo sapiens
aggtccaggtcccag

SEQ ID NO: 4489403 - DNA, 18 bp, Homo sapiens
aggtccaggtcccagccc

SEQ ID NO: 4489404 - DNA, 14 bp, Homo sapiens
aggtccgcaccctg

SEQ ID NO: 4489405 - DNA, 21 bp, Homo sapiens
aggtccgtagctcccctggct

SEQ ID NO: 4489406 - DNA, 19 bp, Homo sapiens
aggctgcagtggctcccct

SEQ ID NO: 4489407 - DNA, 13 bp, Homo sapiens
aggctgccagtgc

SEQ ID NO: 4489408 - DNA, 16 bp, Homo sapiens
aggctgccagtgcctg

SEQ ID NO: 4489409 - DNA, 20 bp, Homo sapiens
aggctgccagtgcctgggtg

SEQ ID NO: 4489410 - DNA, 15 bp, Homo sapiens
aggctgcccccggcc

SEQ ID NO: 4489411 - DNA, 12 bp, Homo sapiens
aggctgcccctc

SEQ ID NO: 4489412 - DNA, 17 bp, Homo sapiens
aggctgcccctctcacc

SEQ ID NO: 4489413 - DNA, 16 bp, Homo sapiens
aggctgcctcccaaca

SEQ ID NO: 4489414 - DNA, 16 bp, Homo sapiens
aggctgcctcctgccc

SEQ ID NO: 4489415 - DNA, 17 bp, Homo sapiens
aggctgcctcctgccct

SEQ ID NO: 4489416 - DNA, 12 bp, Homo sapiens
aggctgctggcg

SEQ ID NO: 4489417 - DNA, 13 bp, Homo sapiens
aggctgcttggga

SEQ ID NO: 4489418 - DNA, 15 bp, Homo sapiens
aggctggaaatagga

SEQ ID NO: 4489419 - DNA, 19 bp, Homo sapiens
aggctggaaggcagcaggc

SEQ ID NO: 4489420 - DNA, 21 bp, Homo sapiens
aggctggactgcagtggcctg

SEQ ID NO: 4489421 - DNA, 17 bp, Homo sapiens
aggctggaggcagggcc

SEQ ID NO: 4489422 - DNA, 18 bp, Homo sapiens
aggctggaggcagggcct

SEQ ID NO: 4489423 - DNA, 19 bp, Homo sapiens
aggctggaggcagggcctt

SEQ ID NO: 4489424 - DNA, 23 bp, Homo sapiens
aggctggaggcagggccttgccc

SEQ ID NO: 4489425 - DNA, 17 bp, Homo sapiens
aggctggagtgcagtgg

SEQ ID NO: 4489426 - DNA, 18 bp, Homo sapiens
aggctgggccatgtccaa

SEQ ID NO: 4489427 - DNA, 12 bp, Homo sapiens
aggctgggcccc

SEQ ID NO: 4489428 - DNA, 15 bp, Homo sapiens
aggctgggtcctgcc

SEQ ID NO: 4489429 - DNA, 16 bp, Homo sapiens
aggctgggtcctgcca

SEQ ID NO: 4489430 - DNA, 17 bp, Homo sapiens
aggctggtaagagaagt

SEQ ID NO: 4489431 - DNA, 18 bp, Homo sapiens
aggctggtaagagaagtg

SEQ ID NO: 4489432 - DNA, 22 bp, Homo sapiens
aggctggttcggatttggggtg

SEQ ID NO: 4489433 - DNA, 22 bp, Homo sapiens
aggctgtccttaacccacctct

SEQ ID NO: 4489434 - DNA, 21 bp, Homo sapiens
aggctgttccatgttctattt

SEQ ID NO: 4489435 - DNA, 14 bp, Homo sapiens
aggctgttctcagc

SEQ ID NO: 4489436 - DNA, 16 bp, Homo sapiens
aggctgttctttaaat

SEQ ID NO: 4489437 - DNA, 13 bp, Homo sapiens
aggctgttttctt

SEQ ID NO: 4489438 - DNA, 23 bp, Homo sapiens
aggctgtttttggctgttttccc

SEQ ID NO: 4489439 - DNA, 19 bp, Homo sapiens
aggcttcaggttgcattgg

SEQ ID NO: 4489440 - DNA, 20 bp, Homo sapiens
aggcttccctgacttgcttt

SEQ ID NO: 4489441 - DNA, 21 bp, Homo sapiens
aggcttccctgacttgcttta

SEQ ID NO: 4489442 - DNA, 15 bp, Homo sapiens
aggcttctattacct

SEQ ID NO: 4489443 - DNA, 16 bp, Homo sapiens
aggcttctccgccagc

SEQ ID NO: 4489444 - DNA, 20 bp, Homo sapiens
aggcttctccgccagcctcc

SEQ ID NO: 4489445 - DNA, 21 bp, Homo sapiens
aggcttctccgccagcctcct

SEQ ID NO: 4489446 - DNA, 12 bp, Homo sapiens
aggcttctcctg

SEQ ID NO: 4489447 - DNA, 16 bp, Homo sapiens
aggcttctctctgtgg

SEQ ID NO: 4489448 - DNA, 21 bp, Homo sapiens
aggcttgcccagtacatttaa

SEQ ID NO: 4489449 - DNA, 18 bp, Homo sapiens
aggcttggtgtctgcggg

SEQ ID NO: 4489450 - DNA, 19 bp, Homo sapiens
aggctttggatttgacatt

SEQ ID NO: 4489451 - DNA, 13 bp, Homo sapiens
aggctttggccca

SEQ ID NO: 4489452 - DNA, 20 bp, Homo sapiens
aggctttggggtcctagccc

SEQ ID NO: 4489453 - DNA, 14 bp, Homo sapiens
aggctttttcagtg

SEQ ID NO: 4489454 - DNA, 14 bp, Homo sapiens
agggaaaaatatat

SEQ ID NO: 4489455 - DNA, 13 bp, Homo sapiens
agggaaaacagaa

SEQ ID NO: 4489456 - DNA, 16 bp, Homo sapiens
agggaaaacagaaaac

SEQ ID NO: 4489457 - DNA, 10 bp, Homo sapiens
agggaaaagg

SEQ ID NO: 4489458 - DNA, 13 bp, Homo sapiens
agggaaacagcct

SEQ ID NO: 4489459 - DNA, 11 bp, Homo sapiens
agggaaacctt

SEQ ID NO: 4489460 - DNA, 15 bp, Homo sapiens
agggaaactaagatt

SEQ ID NO: 4489461 - DNA, 16 bp, Homo sapiens
agggaaactgccagca

SEQ ID NO: 4489462 - DNA, 19 bp, Homo sapiens
agggaaactgccagcaacg

SEQ ID NO: 4489463 - DNA, 14 bp, Homo sapiens
agggaaagcgggca

SEQ ID NO: 4489464 - DNA, 15 bp, Homo sapiens
agggaaaggggtgct

SEQ ID NO: 4489465 - DNA, 18 bp, Homo sapiens
agggaaaggggtgctttt

SEQ ID NO: 4489466 - DNA, 22 bp, Homo sapiens
agggaaatgtgactggttcaga

SEQ ID NO: 4489467 - DNA, 17 bp, Homo sapiens
agggaacagacaggaga

SEQ ID NO: 4489468 - DNA, 19 bp, Homo sapiens
agggaacccccaaatttaa

SEQ ID NO: 4489469 - DNA, 14 bp, Homo sapiens
agggaagagacagc

SEQ ID NO: 4489470 - DNA, 17 bp, Homo sapiens
agggaagctggcctgag

SEQ ID NO: 4489471 - DNA, 23 bp, Homo sapiens
agggaagctggcctgagagggga

SEQ ID NO: 4489472 - DNA, 20 bp, Homo sapiens
agggaaggacagtccctgct

SEQ ID NO: 4489473 - DNA, 15 bp, Homo sapiens
agggaaggatcccat

SEQ ID NO: 4489474 - DNA, 15 bp, Homo sapiens
agggaagtagtcctt

SEQ ID NO: 4489475 - DNA, 21 bp, Homo sapiens
agggaagtgcagagcttgtgg

SEQ ID NO: 4489476 - DNA, 14 bp, Homo sapiens
agggaagtggaagg

SEQ ID NO: 4489477 - DNA, 19 bp, Homo sapiens
agggaataaggtacaagaa

SEQ ID NO: 4489478 - DNA, 14 bp, Homo sapiens
agggaattcttaca

SEQ ID NO: 4489479 - DNA, 18 bp, Homo sapiens
agggaatttaatactttt

SEQ ID NO: 4489480 - DNA, 17 bp, Homo sapiens
agggacaggataagagg

SEQ ID NO: 4489481 - DNA, 20 bp, Homo sapiens
agggacatgaaatttacaaa

SEQ ID NO: 4489482 - DNA, 16 bp, Homo sapiens
agggacatgccctgtg

SEQ ID NO: 4489483 - DNA, 23 bp, Homo sapiens
agggacatttctataaaaatact

SEQ ID NO: 4489484 - DNA, 19 bp, Homo sapiens
agggaccaactgggcccaa

SEQ ID NO: 4489485 - DNA, 16 bp, Homo sapiens
agggaccactgggtga

SEQ ID NO: 4489486 - DNA, 21 bp, Homo sapiens
agggaccactgggtgagagag

SEQ ID NO: 4489487 - DNA, 17 bp, Homo sapiens
agggacccctcgcccca

SEQ ID NO: 4489488 - DNA, 19 bp, Homo sapiens
agggacccctcgccccagc

SEQ ID NO: 4489489 - DNA, 14 bp, Homo sapiens
agggaccggcggac

SEQ ID NO: 4489490 - DNA, 18 bp, Homo sapiens
agggaccggtgctgcagg

SEQ ID NO: 4489491 - DNA, 17 bp, Homo sapiens
agggacctgctgctcag

SEQ ID NO: 4489492 - DNA, 23 bp, Homo sapiens
agggaccttcatgcccttctgat

SEQ ID NO: 4489493 - DNA, 15 bp, Homo sapiens
agggaccttggaaac

SEQ ID NO: 4489494 - DNA, 22 bp, Homo sapiens
agggactatctttgctgcagag

SEQ ID NO: 4489495 - DNA, 14 bp, Homo sapiens
agggactctgaagc

SEQ ID NO: 4489496 - DNA, 22 bp, Homo sapiens
agggactctgaagcctctggga

SEQ ID NO: 4489497 - DNA, 18 bp, Homo sapiens
agggactgccaggctgtt

SEQ ID NO: 4489498 - DNA, 18 bp, Homo sapiens
agggacttttattttctt

SEQ ID NO: 4489499 - DNA, 12 bp, Homo sapiens
agggagaaatgc

SEQ ID NO: 4489500 - DNA, 14 bp, Homo sapiens
agggagaaatgcca

SEQ ID NO: 4489501 - DNA, 21 bp, Homo sapiens
agggagaagtagctagtagca

SEQ ID NO: 4489502 - DNA, 14 bp, Homo sapiens
agggagaatgttgt

SEQ ID NO: 4489503 - DNA, 22 bp, Homo sapiens
agggagacagccaggtggcacc

SEQ ID NO: 4489504 - DNA, 23 bp, Homo sapiens
agggagacagccaggtggcacct

SEQ ID NO: 4489505 - DNA, 14 bp, Homo sapiens
agggagagaagata

SEQ ID NO: 4489506 - DNA, 14 bp, Homo sapiens
agggagagggaggt

SEQ ID NO: 4489507 - DNA, 14 bp, Homo sapiens
agggagattttgag

SEQ ID NO: 4489508 - DNA, 19 bp, Homo sapiens
agggagcagggaaggcctg

SEQ ID NO: 4489509 - DNA, 14 bp, Homo sapiens
agggagcctggccc

SEQ ID NO: 4489510 - DNA, 17 bp, Homo sapiens
agggagccttctgccac

SEQ ID NO: 4489511 - DNA, 15 bp, Homo sapiens
agggaggaaggaggc

SEQ ID NO: 4489512 - DNA, 18 bp, Homo sapiens
agggaggctcccggggcc

SEQ ID NO: 4489513 - DNA, 20 bp, Homo sapiens
agggaggtcactggaaaggg

SEQ ID NO: 4489514 - DNA, 12 bp, Homo sapiens
agggagtccagg

SEQ ID NO: 4489515 - DNA, 14 bp, Homo sapiens
agggatattgcctt

SEQ ID NO: 4489516 - DNA, 16 bp, Homo sapiens
agggatcacagaccac

SEQ ID NO: 4489517 - DNA, 20 bp, Homo sapiens
agggatcacagaccacagga

SEQ ID NO: 4489518 - DNA, 12 bp, Homo sapiens
agggatgagcca

SEQ ID NO: 4489519 - DNA, 14 bp, Homo sapiens
agggatgagccaaa

SEQ ID NO: 4489520 - DNA, 14 bp, Homo sapiens
agggatgggcagcc

SEQ ID NO: 4489521 - DNA, 17 bp, Homo sapiens
agggatggggaaaacta

SEQ ID NO: 4489522 - DNA, 12 bp, Homo sapiens
agggatgtattt

SEQ ID NO: 4489523 - DNA, 14 bp, Homo sapiens
agggatgtatttgt

SEQ ID NO: 4489524 - DNA, 16 bp, Homo sapiens
agggattcaggctgct

SEQ ID NO: 4489525 - DNA, 21 bp, Homo sapiens
agggcaaatccagtcccaatg

SEQ ID NO: 4489526 - DNA, 14 bp, Homo sapiens
agggcaagccctgc

SEQ ID NO: 4489527 - DNA, 15 bp, Homo sapiens
agggcaagccctgcc

SEQ ID NO: 4489528 - DNA, 21 bp, Homo sapiens
agggcaagccctgcccacaga

SEQ ID NO: 4489529 - DNA, 14 bp, Homo sapiens
agggcaaggagttt

SEQ ID NO: 4489530 - DNA, 20 bp, Homo sapiens
agggcaaggagtttattaca

SEQ ID NO: 4489531 - DNA, 17 bp, Homo sapiens
agggcaattggaacaaa

SEQ ID NO: 4489532 - DNA, 12 bp, Homo sapiens
agggcacccagg

SEQ ID NO: 4489533 - DNA, 14 bp, Homo sapiens
agggcacccaggca

SEQ ID NO: 4489534 - DNA, 18 bp, Homo sapiens
agggcactgacggactca

SEQ ID NO: 4489535 - DNA, 23 bp, Homo sapiens
agggcactgccagcccaccccct

SEQ ID NO: 4489536 - DNA, 19 bp, Homo sapiens
agggcagaaaggttctgcc

SEQ ID NO: 4489537 - DNA, 20 bp, Homo sapiens
agggcagaggctggaggcag

SEQ ID NO: 4489538 - DNA, 14 bp, Homo sapiens
agggcagagggaga

SEQ ID NO: 4489539 - DNA, 12 bp, Homo sapiens
agggcagagtga

SEQ ID NO: 4489540 - DNA, 15 bp, Homo sapiens
agggcagcagggcta

SEQ ID NO: 4489541 - DNA, 20 bp, Homo sapiens
agggcagctgggcccaaccc

SEQ ID NO: 4489542 - DNA, 16 bp, Homo sapiens
agggcaggaaggagag

SEQ ID NO: 4489543 - DNA, 23 bp, Homo sapiens
agggcaggaaggagagcctgctg

SEQ ID NO: 4489544 - DNA, 20 bp, Homo sapiens
agggcagggcgagctgcagg

SEQ ID NO: 4489545 - DNA, 20 bp, Homo sapiens
agggcagtcgatagagctgt

SEQ ID NO: 4489546 - DNA, 14 bp, Homo sapiens
agggcattctttcc

SEQ ID NO: 4489547 - DNA, 19 bp, Homo sapiens
agggcattctttcccagtg

SEQ ID NO: 4489548 - DNA, 23 bp, Homo sapiens
agggccaaacgctgagccacctg

SEQ ID NO: 4489549 - DNA, 20 bp, Homo sapiens
agggccacatgggaggctca

SEQ ID NO: 4489550 - DNA, 15 bp, Homo sapiens
agggccacgctccag

SEQ ID NO: 4489551 - DNA, 16 bp, Homo sapiens
agggccacgtgccagg

SEQ ID NO: 4489552 - DNA, 18 bp, Homo sapiens
agggccacgtgccaggcc

SEQ ID NO: 4489553 - DNA, 19 bp, Homo sapiens
agggccacgtgccaggccc

SEQ ID NO: 4489554 - DNA, 21 bp, Homo sapiens
agggccactcaacagagagga

SEQ ID NO: 4489555 - DNA, 16 bp, Homo sapiens
agggccaggcctctgc

SEQ ID NO: 4489556 - DNA, 22 bp, Homo sapiens
agggccaggcctctgctggctc

SEQ ID NO: 4489557 - DNA, 13 bp, Homo sapiens
agggccagtcctg

SEQ ID NO: 4489558 - DNA, 19 bp, Homo sapiens
agggccagtcctgcctggc

SEQ ID NO: 4489559 - DNA, 21 bp, Homo sapiens
agggccagtcctgcctggcca

SEQ ID NO: 4489560 - DNA, 23 bp, Homo sapiens
agggccagtcctgcctggccagg

SEQ ID NO: 4489561 - DNA, 14 bp, Homo sapiens
agggccatgtgctg

SEQ ID NO: 4489562 - DNA, 18 bp, Homo sapiens
agggccatgtgctgccct

SEQ ID NO: 4489563 - DNA, 11 bp, Homo sapiens
agggcccagcc

SEQ ID NO: 4489564 - DNA, 17 bp, Homo sapiens
agggcccccaataaacc

SEQ ID NO: 4489565 - DNA, 20 bp, Homo sapiens
agggccgactaagagaagtt

SEQ ID NO: 4489566 - DNA, 17 bp, Homo sapiens
agggcctctccttggaa

SEQ ID NO: 4489567 - DNA, 19 bp, Homo sapiens
agggcctgaaacccgccct

SEQ ID NO: 4489568 - DNA, 22 bp, Homo sapiens
agggcctgaaacccgccctcag

SEQ ID NO: 4489569 - DNA, 17 bp, Homo sapiens
agggcctgacttgagcc

SEQ ID NO: 4489570 - DNA, 20 bp, Homo sapiens
agggcctgacttgagccact

SEQ ID NO: 4489571 - DNA, 22 bp, Homo sapiens
agggcctgacttgagccactcc

SEQ ID NO: 4489572 - DNA, 12 bp, Homo sapiens
agggcctggagc

SEQ ID NO: 4489573 - DNA, 13 bp, Homo sapiens
agggcctggagcc

SEQ ID NO: 4489574 - DNA, 13 bp, Homo sapiens
agggcctggctcc

SEQ ID NO: 4489575 - DNA, 18 bp, Homo sapiens
agggcctggctccagtct

SEQ ID NO: 4489576 - DNA, 12 bp, Homo sapiens
agggccttgccc

SEQ ID NO: 4489577 - DNA, 15 bp, Homo sapiens
agggccttgcccaga

SEQ ID NO: 4489578 - DNA, 13 bp, Homo sapiens
agggcgccaagtc

SEQ ID NO: 4489579 - DNA, 21 bp, Homo sapiens
agggcgccaagtctggcacca

SEQ ID NO: 4489580 - DNA, 18 bp, Homo sapiens
agggcgggcagagggctg

SEQ ID NO: 4489581 - DNA, 13 bp, Homo sapiens
agggcggggctgg

SEQ ID NO: 4489582 - DNA, 17 bp, Homo sapiens
agggcgtgactcaccca

SEQ ID NO: 4489583 - DNA, 18 bp, Homo sapiens
agggctaaaaaggtcctg

SEQ ID NO: 4489584 - DNA, 21 bp, Homo sapiens
agggctaaaaaggtcctgtaa

SEQ ID NO: 4489585 - DNA, 13 bp, Homo sapiens
agggctaagagct

SEQ ID NO: 4489586 - DNA, 14 bp, Homo sapiens
agggctaagagcta

SEQ ID NO: 4489587 - DNA, 22 bp, Homo sapiens
agggctaagagctagcgctgcc

SEQ ID NO: 4489588 - DNA, 21 bp, Homo sapiens
agggctagaacctagaagggc

SEQ ID NO: 4489589 - DNA, 16 bp, Homo sapiens
agggctagaacctgga

SEQ ID NO: 4489590 - DNA, 17 bp, Homo sapiens
agggctagaacctggaa

SEQ ID NO: 4489591 - DNA, 19 bp, Homo sapiens
agggctagaacctggaagg

SEQ ID NO: 4489592 - DNA, 22 bp, Homo sapiens
agggctagaacctggagggctg

SEQ ID NO: 4489593 - DNA, 18 bp, Homo sapiens
agggctagaactggagag

SEQ ID NO: 4489594 - DNA, 20 bp, Homo sapiens
agggctccaggagcctcatc

SEQ ID NO: 4489595 - DNA, 14 bp, Homo sapiens
agggctcccagggg

SEQ ID NO: 4489596 - DNA, 22 bp, Homo sapiens
agggctcccaggggtctccctg

SEQ ID NO: 4489597 - DNA, 12 bp, Homo sapiens
agggctcctggg

SEQ ID NO: 4489598 - DNA, 22 bp, Homo sapiens
agggctgctccccaacacctgc

SEQ ID NO: 4489599 - DNA, 17 bp, Homo sapiens
agggctggactgaggcc

SEQ ID NO: 4489600 - DNA, 18 bp, Homo sapiens
agggctggactgaggcct

SEQ ID NO: 4489601 - DNA, 15 bp, Homo sapiens
agggctggcccagcc

SEQ ID NO: 4489602 - DNA, 18 bp, Homo sapiens
agggctggcccagccctg

SEQ ID NO: 4489603 - DNA, 19 bp, Homo sapiens
agggctggcccagccctgc

SEQ ID NO: 4489604 - DNA, 17 bp, Homo sapiens
agggctggctcaattga

SEQ ID NO: 4489605 - DNA, 17 bp, Homo sapiens
agggctggctggcctca

SEQ ID NO: 4489606 - DNA, 20 bp, Homo sapiens
agggctggctggcctcaccc

SEQ ID NO: 4489607 - DNA, 13 bp, Homo sapiens
agggctgggccac

SEQ ID NO: 4489608 - DNA, 16 bp, Homo sapiens
agggctgggccaccag

SEQ ID NO: 4489609 - DNA, 20 bp, Homo sapiens
agggctgggccaccagggat

SEQ ID NO: 4489610 - DNA, 10 bp, Homo sapiens
agggctgggg

SEQ ID NO: 4489611 - DNA, 19 bp, Homo sapiens
agggctggggttgccagag

SEQ ID NO: 4489612 - DNA, 17 bp, Homo sapiens
agggctggtccttattt

SEQ ID NO: 4489613 - DNA, 19 bp, Homo sapiens
agggctggtccttatttat

SEQ ID NO: 4489614 - DNA, 12 bp, Homo sapiens
agggctgtccca

SEQ ID NO: 4489615 - DNA, 19 bp, Homo sapiens
agggcttcggccacaggca

SEQ ID NO: 4489616 - DNA, 15 bp, Homo sapiens
agggcttggcccagc

SEQ ID NO: 4489617 - DNA, 18 bp, Homo sapiens
agggcttggcccagcgcc

SEQ ID NO: 4489618 - DNA, 13 bp, Homo sapiens
agggcttggggct

SEQ ID NO: 4489619 - DNA, 22 bp, Homo sapiens
agggcttggggctgcacctcct

SEQ ID NO: 4489620 - DNA, 20 bp, Homo sapiens
agggcttgtcacagtctcta

SEQ ID NO: 4489621 - DNA, 19 bp, Homo sapiens
agggcttgtttttcttcag

SEQ ID NO: 4489622 - DNA, 20 bp, Homo sapiens
agggctttgaatctgggact

SEQ ID NO: 4489623 - DNA, 23 bp, Homo sapiens
agggctttttaaatttggtgccg

SEQ ID NO: 4489624 - DNA, 15 bp, Homo sapiens
aggggaaaaaaatgt

SEQ ID NO: 4489625 - DNA, 16 bp, Homo sapiens
aggggaaaaaaatgtt

SEQ ID NO: 4489626 - DNA, 15 bp, Homo sapiens
aggggaaaaaatcat

SEQ ID NO: 4489627 - DNA, 14 bp, Homo sapiens
aggggaaagtccag

SEQ ID NO: 4489628 - DNA, 16 bp, Homo sapiens
aggggaaggccctgag

SEQ ID NO: 4489629 - DNA, 22 bp, Homo sapiens
aggggaatggaagagaaaagac

SEQ ID NO: 4489630 - DNA, 21 bp, Homo sapiens
aggggacctctccacacaggt

SEQ ID NO: 4489631 - DNA, 14 bp, Homo sapiens
aggggagaaagagg

SEQ ID NO: 4489632 - DNA, 17 bp, Homo sapiens
aggggagagacaggcag

SEQ ID NO: 4489633 - DNA, 22 bp, Homo sapiens
aggggagagcctgctggcaccc

SEQ ID NO: 4489634 - DNA, 18 bp, Homo sapiens
aggggagcatgggaagtg

SEQ ID NO: 4489635 - DNA, 23 bp, Homo sapiens
aggggaggggcgcaccccacagc

SEQ ID NO: 4489636 - DNA, 20 bp, Homo sapiens
aggggatatttactgctctt

SEQ ID NO: 4489637 - DNA, 19 bp, Homo sapiens
aggggatgaggggcttcct

SEQ ID NO: 4489638 - DNA, 18 bp, Homo sapiens
aggggatttttatgtctg

SEQ ID NO: 4489639 - DNA, 21 bp, Homo sapiens
aggggcaaccaactgccccag

SEQ ID NO: 4489640 - DNA, 23 bp, Homo sapiens
aggggcagatgccaccctgccca

SEQ ID NO: 4489641 - DNA, 19 bp, Homo sapiens
aggggcagccacaccactg

SEQ ID NO: 4489642 - DNA, 22 bp, Homo sapiens
aggggccaacctcaggctccta

SEQ ID NO: 4489643 - DNA, 16 bp, Homo sapiens
aggggccaataaaatg

SEQ ID NO: 4489644 - DNA, 20 bp, Homo sapiens
aggggccaccacctttggct

SEQ ID NO: 4489645 - DNA, 15 bp, Homo sapiens
aggggccagaggctc

SEQ ID NO: 4489646 - DNA, 17 bp, Homo sapiens
aggggccagaggctcgt

SEQ ID NO: 4489647 - DNA, 18 bp, Homo sapiens
aggccccgaggacccaga

SEQ ID NO: 4489648 - DNA, 20 bp, Homo sapiens
aggccccgaggacccagacc

SEQ ID NO: 4489649 - DNA, 17 bp, Homo sapiens
aggccccgcttgtccag

SEQ ID NO: 4489650 - DNA, 18 bp, Homo sapiens
aggccccgcttgtccagc

SEQ ID NO: 4489651 - DNA, 22 bp, Homo sapiens
aggccccgcttgtccagcgcct

SEQ ID NO: 4489652 - DNA, 12 bp, Homo sapiens
aggcccctgcaa

SEQ ID NO: 4489653 - DNA, 13 bp, Homo sapiens
aggcccctgcctc

SEQ ID NO: 4489654 - DNA, 20 bp, Homo sapiens
aggcccctggaggctgcctc

SEQ ID NO: 4489655 - DNA, 18 bp, Homo sapiens
aggcccgtcagcatcact

SEQ ID NO: 4489656 - DNA, 17 bp, Homo sapiens
aggccctccctgactcc

SEQ ID NO: 4489657 - DNA, 15 bp, Homo sapiens
aggccctccctgtct

SEQ ID NO: 4489658 - DNA, 16 bp, Homo sapiens
aggccctccctgtctc

SEQ ID NO: 4489659 - DNA, 15 bp, Homo sapiens
aggccctcgctgcca

SEQ ID NO: 4489660 - DNA, 20 bp, Homo sapiens
aggccctcgggcccagcccc

SEQ ID NO: 4489661 - DNA, 17 bp, Homo sapiens
aggccctgactcctctg

SEQ ID NO: 4489662 - DNA, 22 bp, Homo sapiens
aggccctgactcctctggcttt

SEQ ID NO: 4489663 - DNA, 21 bp, Homo sapiens
aggccctgaggcggaggctgt

SEQ ID NO: 4489664 - DNA, 11 bp, Homo sapiens
aggccctgccc

SEQ ID NO: 4489665 - DNA, 12 bp, Homo sapiens
aggccctgccca

SEQ ID NO: 4489666 - DNA, 14 bp, Homo sapiens
aggccctggaggga

SEQ ID NO: 4489667 - DNA, 22 bp, Homo sapiens
aggccctgggctgggtgctggg

SEQ ID NO: 4489668 - DNA, 16 bp, Homo sapiens
aggccgagcctcccct

SEQ ID NO: 4489669 - DNA, 17 bp, Homo sapiens
aggccgctgttcaccca

SEQ ID NO: 4489670 - DNA, 12 bp, Homo sapiens
aggccggcccag

SEQ ID NO: 4489671 - DNA, 13 bp, Homo sapiens
aggccggcccaga

SEQ ID NO: 4489672 - DNA, 15 bp, Homo sapiens
aggccgtcatttcat

SEQ ID NO: 4489673 - DNA, 13 bp, Homo sapiens
aggccgtgtctct

SEQ ID NO: 4489674 - DNA, 14 bp, Homo sapiens
aggccgtgtctctg

SEQ ID NO: 4489675 - DNA, 16 bp, Homo sapiens
aggccgtgtctctgag

SEQ ID NO: 4489676 - DNA, 19 bp, Homo sapiens
aggcctaatttttttttgt

SEQ ID NO: 4489677 - DNA, 18 bp, Homo sapiens
aggcctaccccagttcct

SEQ ID NO: 4489678 - DNA, 21 bp, Homo sapiens
aggcctaccccagttcctagc

SEQ ID NO: 4489679 - DNA, 23 bp, Homo sapiens
aggcctaccccagttcctagcac

SEQ ID NO: 4489680 - DNA, 16 bp, Homo sapiens
aggcctagactctgtc

SEQ ID NO: 4489681 - DNA, 17 bp, Homo sapiens
aggcctagactctgtct

SEQ ID NO: 4489682 - DNA, 14 bp, Homo sapiens
aggcctatttaaca

SEQ ID NO: 4489683 - DNA, 20 bp, Homo sapiens
aggcctcaactcctcccata

SEQ ID NO: 4489684 - DNA, 13 bp, Homo sapiens
aggcctccaagga

SEQ ID NO: 4489685 - DNA, 17 bp, Homo sapiens
aggcctccatctcatgt

SEQ ID NO: 4489686 - DNA, 13 bp, Homo sapiens
aggcctctctctg

SEQ ID NO: 4489687 - DNA, 17 bp, Homo sapiens
aggcctctctctgctcc

SEQ ID NO: 4489688 - DNA, 20 bp, Homo sapiens
aggcctctgctggctcagga

SEQ ID NO: 4489689 - DNA, 18 bp, Homo sapiens
aggcctctggttgcctcc

SEQ ID NO: 4489690 - DNA, 15 bp, Homo sapiens
aggcctcttggagac

SEQ ID NO: 4489691 - DNA, 19 bp, Homo sapiens
aggcctcttgtaaagactg

SEQ ID NO: 4489692 - DNA, 19 bp, Homo sapiens
aggcctgaaatgacatttc

SEQ ID NO: 4489693 - DNA, 17 bp, Homo sapiens
aggcctgacttctgctg

SEQ ID NO: 4489694 - DNA, 19 bp, Homo sapiens
aggcctgacttctgctggc

SEQ ID NO: 4489695 - DNA, 21 bp, Homo sapiens
aggcctgacttctgctggcat

SEQ ID NO: 4489696 - DNA, 17 bp, Homo sapiens
aggcctgagatttcatc

SEQ ID NO: 4489697 - DNA, 22 bp, Homo sapiens
aggcctgagatttcatctgctc

SEQ ID NO: 4489698 - DNA, 13 bp, Homo sapiens
aggcctgagcccc

SEQ ID NO: 4489699 - DNA, 21 bp, Homo sapiens
aggcctgagcgctcctgccgc

SEQ ID NO: 4489700 - DNA, 20 bp, Homo sapiens
aggcctgcctccagggctgg

SEQ ID NO: 4489701 - DNA, 18 bp, Homo sapiens
aggcctgcgggcccctgg

SEQ ID NO: 4489702 - DNA, 17 bp, Homo sapiens
aggcctgctgccagtgc

SEQ ID NO: 4489703 - DNA, 22 bp, Homo sapiens
aggcctgctgccagtgcagcca

SEQ ID NO: 4489704 - DNA, 17 bp, Homo sapiens
aggcctggcctcatctc

SEQ ID NO: 4489705 - DNA, 21 bp, Homo sapiens
aggcctggcctcatctcagac

SEQ ID NO: 4489706 - DNA, 13 bp, Homo sapiens
aggcctggctgga

SEQ ID NO: 4489707 - DNA, 17 bp, Homo sapiens
aggcctgggggcaggga

SEQ ID NO: 4489708 - DNA, 17 bp, Homo sapiens
aggcctgtcccttgcct

SEQ ID NO: 4489709 - DNA, 14 bp, Homo sapiens
aggcgaataaatgt

SEQ ID NO: 4489710 - DNA, 18 bp, Homo sapiens
aggcgaataaatgttcaa

SEQ ID NO: 4489711 - DNA, 16 bp, Homo sapiens
aggcgagtctggggac

SEQ ID NO: 4489712 - DNA, 19 bp, Homo sapiens
aggcgctgcatacagggga

SEQ ID NO: 4489713 - DNA, 17 bp, Homo sapiens
aggcggacgttccagcc

SEQ ID NO: 4489714 - DNA, 17 bp, Homo sapiens
aggcggaggctgtgctc

SEQ ID NO: 4489715 - DNA, 19 bp, Homo sapiens
aggcggcagatcctgccct

SEQ ID NO: 4489716 - DNA, 19 bp, Homo sapiens
aggcgggctcggaggctac

SEQ ID NO: 4489717 - DNA, 17 bp, Homo sapiens
aggcgtcgctggattta

SEQ ID NO: 4489718 - DNA, 19 bp, Homo sapiens
aggcgtgagccactgcgcc

SEQ ID NO: 4489719 - DNA, 12 bp, Homo sapiens
aggcgtgatcca

SEQ ID NO: 4489720 - DNA, 13 bp, Homo sapiens
aggcgtgcccccc

SEQ ID NO: 4489721 - DNA, 18 bp, Homo sapiens
aggctaaaaggcttccag

SEQ ID NO: 4489722 - DNA, 22 bp, Homo sapiens
aggctaatttttttgtatttta

SEQ ID NO: 4489723 - DNA, 23 bp, Homo sapiens
aggctaatttttttgtattttag

SEQ ID NO: 4489724 - DNA, 20 bp, Homo sapiens
aggctacagctccacacgcc

SEQ ID NO: 4489725 - DNA, 21 bp, Homo sapiens
aggctacagctccacacgccc

SEQ ID NO: 4489726 - DNA, 17 bp, Homo sapiens
aggctactgtcagctcc

SEQ ID NO: 4489727 - DNA, 19 bp, Homo sapiens
aggctagaacctggcaagc

SEQ ID NO: 4489728 - DNA, 17 bp, Homo sapiens
aggctagcttctgcttt

SEQ ID NO: 4489729 - DNA, 14 bp, Homo sapiens
aggctagggtgggg

SEQ ID NO: 4489730 - DNA, 21 bp, Homo sapiens
aggctatgaggaaactgagtc

SEQ ID NO: 4489731 - DNA, 22 bp, Homo sapiens
aggctatgaggaaactgagtca

SEQ ID NO: 4489732 - DNA, 22 bp, Homo sapiens
aggctatggggtaggagaaaag

SEQ ID NO: 4489733 - DNA, 19 bp, Homo sapiens
aggctcacccccttctcca

SEQ ID NO: 4489734 - DNA, 21 bp, Homo sapiens
aggctcacccccttctccatc

SEQ ID NO: 4489735 - DNA, 23 bp, Homo sapiens
aggctcacccccttctccatcca

SEQ ID NO: 4489736 - DNA, 24 bp, Homo sapiens
aggctcagagatgtgcacccatgg

SEQ ID NO: 4489737 - DNA, 19 bp, Homo sapiens
aggctcaggcacatacacc

SEQ ID NO: 4489738 - DNA, 13 bp, Homo sapiens
aggctcatttaaa

SEQ ID NO: 4489739 - DNA, 13 bp, Homo sapiens
aggctccagaggg

SEQ ID NO: 4489740 - DNA, 15 bp, Homo sapiens
aggctccagagggca

SEQ ID NO: 4489741 - DNA, 16 bp, Homo sapiens
aggctccagagggcac

SEQ ID NO: 4489742 - DNA, 16 bp, Homo sapiens
aggctccccgcctcca

SEQ ID NO: 4489743 - DNA, 16 bp, Homo sapiens
aggctcccggggcctg

SEQ ID NO: 4489744 - DNA, 18 bp, Homo sapiens
aggctcccggggcctgga

SEQ ID NO: 4489745 - DNA, 21 bp, Homo sapiens
aggctcccggggcctggacag

SEQ ID NO: 4489746 - DNA, 14 bp, Homo sapiens
aggctcctccttgc

SEQ ID NO: 4489747 - DNA, 21 bp, Homo sapiens
aggctcctccttgcccagact

SEQ ID NO: 4489748 - DNA, 18 bp, Homo sapiens
aggctcgtggactgagtg

SEQ ID NO: 4489749 - DNA, 23 bp, Homo sapiens
aggctctcctggctgtcctacca

SEQ ID NO: 4489750 - DNA, 17 bp, Homo sapiens
aggctctctctgtccct

SEQ ID NO: 4489751 - DNA, 15 bp, Homo sapiens
aggctctggacagca

SEQ ID NO: 4489752 - DNA, 23 bp, Homo sapiens
aggctctggacagcagaagcctc

SEQ ID NO: 4489753 - DNA, 16 bp, Homo sapiens
aggctctgtgctgacc

SEQ ID NO: 4489754 - DNA, 22 bp, Homo sapiens
aggctctgtgctgaccctcctg

SEQ ID NO: 4489755 - DNA, 20 bp, Homo sapiens
aggctgacattcactgagtg

SEQ ID NO: 4489756 - DNA, 22 bp, Homo sapiens
aggctgagagccggccgtggaa

SEQ ID NO: 4489757 - DNA, 23 bp, Homo sapiens
aggctgagagccggccgtggaag

SEQ ID NO: 4489758 - DNA, 17 bp, Homo sapiens
aggctgaggcagaagaa

SEQ ID NO: 4489759 - DNA, 14 bp, Homo sapiens
aggctgaggcagga

SEQ ID NO: 4489760 - DNA, 14 bp, Homo sapiens
aggctgatgggcaa

SEQ ID NO: 4489761 - DNA, 17 bp, Homo sapiens
aggctgcaaaattaaat

SEQ ID NO: 4489762 - DNA, 18 bp, Homo sapiens
aggctgcaatgagccatg

SEQ ID NO: 4489763 - DNA, 18 bp, Homo sapiens
aggctgcagagctgaccc

SEQ ID NO: 4489764 - DNA, 20 bp, Homo sapiens
aggctgcagagctgacccag

SEQ ID NO: 4489765 - DNA, 21 bp, Homo sapiens
aggctgcagaggcacctcaac

SEQ ID NO: 4489766 - DNA, 17 bp, Homo sapiens
aggctgcagtggctccc

SEQ ID NO: 4489767 - DNA, 20 bp, Homo sapiens
aggcaattttagtgtattaa

SEQ ID NO: 4489768 - DNA, 15 bp, Homo sapiens
aggcacacacagccc

SEQ ID NO: 4489769 - DNA, 18 bp, Homo sapiens
aggcacacacagccccta

SEQ ID NO: 4489770 - DNA, 16 bp, Homo sapiens
aggcacacactgtgct

SEQ ID NO: 4489771 - DNA, 21 bp, Homo sapiens
aggcacacactgtgctttcta

SEQ ID NO: 4489772 - DNA, 15 bp, Homo sapiens
aggcacacagcagcc

SEQ ID NO: 4489773 - DNA, 16 bp, Homo sapiens
aggcacacagcagccc

SEQ ID NO: 4489774 - DNA, 21 bp, Homo sapiens
aggcacacagcagccccccag

SEQ ID NO: 4489775 - DNA, 20 bp, Homo sapiens
aggcaccaaaagaagtaaaa

SEQ ID NO: 4489776 - DNA, 12 bp, Homo sapiens
aggcaccaggaa

SEQ ID NO: 4489777 - DNA, 15 bp, Homo sapiens
aggcaccaggaagcc

SEQ ID NO: 4489778 - DNA, 14 bp, Homo sapiens
aggcaccagtccag

SEQ ID NO: 4489779 - DNA, 16 bp, Homo sapiens
aggcaccagtccagca

SEQ ID NO: 4489780 - DNA, 22 bp, Homo sapiens
aggcaccctcagggagcctccc

SEQ ID NO: 4489781 - DNA, 23 bp, Homo sapiens
aggcacctacactcacctgcact

SEQ ID NO: 4489782 - DNA, 17 bp, Homo sapiens
aggcacgaacccacctg

SEQ ID NO: 4489783 - DNA, 18 bp, Homo sapiens
aggcacgaacccacctgc

SEQ ID NO: 4489784 - DNA, 20 bp, Homo sapiens
aggcacgaacccacctgctg

SEQ ID NO: 4489785 - DNA, 21 bp, Homo sapiens
aggcacgaacccacctgctga

SEQ ID NO: 4489786 - DNA, 17 bp, Homo sapiens
aggcactcagtgagcct

SEQ ID NO: 4489787 - DNA, 20 bp, Homo sapiens
aggcactcagtgagcctcct

SEQ ID NO: 4489788 - DNA, 22 bp, Homo sapiens
aggcactcagtgagcctcctgt

SEQ ID NO: 4489789 - DNA, 16 bp, Homo sapiens
aggcactgagaatgat

SEQ ID NO: 4489790 - DNA, 14 bp, Homo sapiens
aggcacttattgta

SEQ ID NO: 4489791 - DNA, 18 bp, Homo sapiens
aggcacttttattttcat

SEQ ID NO: 4489792 - DNA, 21 bp, Homo sapiens
aggcagacgtctgtcaggggc

SEQ ID NO: 4489793 - DNA, 13 bp, Homo sapiens
aggcagagaaatc

SEQ ID NO: 4489794 - DNA, 16 bp, Homo sapiens
aggcagatctgtgccc

SEQ ID NO: 4489795 - DNA, 22 bp, Homo sapiens
aggcagatctgtgccccatgcc

SEQ ID NO: 4489796 - DNA, 20 bp, Homo sapiens
aggcagcagtgtgaggccag

SEQ ID NO: 4489797 - DNA, 14 bp, Homo sapiens
aggcagccacaggg

SEQ ID NO: 4489798 - DNA, 15 bp, Homo sapiens
aggcagccagccgtg

SEQ ID NO: 4489799 - DNA, 17 bp, Homo sapiens
aggcagccagccgtggc

SEQ ID NO: 4489800 - DNA, 20 bp, Homo sapiens
aggcagcccagcagtgtgga

SEQ ID NO: 4489801 - DNA, 14 bp, Homo sapiens
aggcagctcaggat

SEQ ID NO: 4489802 - DNA, 15 bp, Homo sapiens
aggcagctgcctctg

SEQ ID NO: 4489803 - DNA, 16 bp, Homo sapiens
aggcagctgcctctgc

SEQ ID NO: 4489804 - DNA, 17 bp, Homo sapiens
aggcagctgcctctgct

SEQ ID NO: 4489805 - DNA, 19 bp, Homo sapiens
aggcagctgcctctgctcc

SEQ ID NO: 4489806 - DNA, 22 bp, Homo sapiens
aggcagctgcctctgctccctc

SEQ ID NO: 4489807 - DNA, 23 bp, Homo sapiens
aggcagctgcctctgctccctct

SEQ ID NO: 4489808 - DNA, 17 bp, Homo sapiens
aggcagctgtcctgtga

SEQ ID NO: 4489809 - DNA, 20 bp, Homo sapiens
aggcaggaagggcaggaagg

SEQ ID NO: 4489810 - DNA, 16 bp, Homo sapiens
aggcaggattgaaaat

SEQ ID NO: 4489811 - DNA, 22 bp, Homo sapiens
aggcaggattgaaaatgtccag

SEQ ID NO: 4489812 - DNA, 22 bp, Homo sapiens
aggcaggcatagaggcttctcc

SEQ ID NO: 4489813 - DNA, 15 bp, Homo sapiens
aggcaggccagatgg

SEQ ID NO: 4489814 - DNA, 15 bp, Homo sapiens
aggcagggcctggct

SEQ ID NO: 4489815 - DNA, 16 bp, Homo sapiens
aggcagggcctggctc

SEQ ID NO: 4489816 - DNA, 22 bp, Homo sapiens
aggcagggccttgcccagagat

SEQ ID NO: 4489817 - DNA, 16 bp, Homo sapiens
aggcagggctctcccg

SEQ ID NO: 4489818 - DNA, 19 bp, Homo sapiens
aggcaggggaatgtatgtg

SEQ ID NO: 4489819 - DNA, 15 bp, Homo sapiens
aggcagggggccctg

SEQ ID NO: 4489820 - DNA, 20 bp, Homo sapiens
aggcagggggccctgcccca

SEQ ID NO: 4489821 - DNA, 16 bp, Homo sapiens
aggcaggggtgggggt

SEQ ID NO: 4489822 - DNA, 14 bp, Homo sapiens
aggcaggtacaggt

SEQ ID NO: 4489823 - DNA, 16 bp, Homo sapiens
aggcaggtcacagaaa

SEQ ID NO: 4489824 - DNA, 17 bp, Homo sapiens
aggcagtaaggtagaaa

SEQ ID NO: 4489825 - DNA, 15 bp, Homo sapiens
aggcagtatccttta

SEQ ID NO: 4489826 - DNA, 12 bp, Homo sapiens
aggcagttttct

SEQ ID NO: 4489827 - DNA, 13 bp, Homo sapiens
aggcagttttcta

SEQ ID NO: 4489828 - DNA, 22 bp, Homo sapiens
aggcatattccctgcacacaca

SEQ ID NO: 4489829 - DNA, 22 bp, Homo sapiens
aggcatcagtatgtcactctgg

SEQ ID NO: 4489830 - DNA, 19 bp, Homo sapiens
aggcatcgtcatgcacagt

SEQ ID NO: 4489831 - DNA, 19 bp, Homo sapiens
aggcatctgtgggcatggt

SEQ ID NO: 4489832 - DNA, 18 bp, Homo sapiens
aggcatgtcccacccacc

SEQ ID NO: 4489833 - DNA, 14 bp, Homo sapiens
aggcattgccaagg

SEQ ID NO: 4489834 - DNA, 16 bp, Homo sapiens
aggcattgccaagggc

SEQ ID NO: 4489835 - DNA, 21 bp, Homo sapiens
aggcattgccaagggctttgt

SEQ ID NO: 4489836 - DNA, 13 bp, Homo sapiens
aggcattggatat

SEQ ID NO: 4489837 - DNA, 20 bp, Homo sapiens
aggcatttgctaaggcagct

SEQ ID NO: 4489838 - DNA, 21 bp, Homo sapiens
aggcatttgctaaggcagctg

SEQ ID NO: 4489839 - DNA, 23 bp, Homo sapiens
aggcattttatatgaattataaa

SEQ ID NO: 4489840 - DNA, 15 bp, Homo sapiens
aggccaaaatcaaga

SEQ ID NO: 4489841 - DNA, 13 bp, Homo sapiens
aggccaccccaaa

SEQ ID NO: 4489842 - DNA, 21 bp, Homo sapiens
aggccaccccaaaccccagcc

SEQ ID NO: 4489843 - DNA, 23 bp, Homo sapiens
aggccaccccctatcctctgagt

SEQ ID NO: 4489844 - DNA, 14 bp, Homo sapiens
aggccactcctcca

SEQ ID NO: 4489845 - DNA, 17 bp, Homo sapiens
aggccacttgcttgctg

SEQ ID NO: 4489846 - DNA, 15 bp, Homo sapiens
aggccagacatggtg

SEQ ID NO: 4489847 - DNA, 22 bp, Homo sapiens
aggccagagtggcctggccagg

SEQ ID NO: 4489848 - DNA, 20 bp, Homo sapiens
aggccagcaggcgggctcct

SEQ ID NO: 4489849 - DNA, 13 bp, Homo sapiens
aggccagcccagc

SEQ ID NO: 4489850 - DNA, 16 bp, Homo sapiens
aggccagcccagccag

SEQ ID NO: 4489851 - DNA, 16 bp, Homo sapiens
aggccagccccaccca

SEQ ID NO: 4489852 - DNA, 10 bp, Homo sapiens
aggccagcct

SEQ ID NO: 4489853 - DNA, 23 bp, Homo sapiens
aggccagcctccgagagggagag

SEQ ID NO: 4489854 - DNA, 11 bp, Homo sapiens
aggccagctca

SEQ ID NO: 4489855 - DNA, 12 bp, Homo sapiens
aggccagctcag

SEQ ID NO: 4489856 - DNA, 11 bp, Homo sapiens
aggccagctgc

SEQ ID NO: 4489857 - DNA, 22 bp, Homo sapiens
aggccagctgcggccaggcctg

SEQ ID NO: 4489858 - DNA, 13 bp, Homo sapiens
aggccagggcaga

SEQ ID NO: 4489859 - DNA, 15 bp, Homo sapiens
aggccagggcagagt

SEQ ID NO: 4489860 - DNA, 12 bp, Homo sapiens
aggccaggtgcc

SEQ ID NO: 4489861 - DNA, 13 bp, Homo sapiens
aggccaggtgccc

SEQ ID NO: 4489862 - DNA, 16 bp, Homo sapiens
aggccaggtgcccagg

SEQ ID NO: 4489863 - DNA, 18 bp, Homo sapiens
aggccaggtgcccaggaa

SEQ ID NO: 4489864 - DNA, 21 bp, Homo sapiens
aggccaggtgcccaggaaagg

SEQ ID NO: 4489865 - DNA, 15 bp, Homo sapiens
aggccagtggaagaa

SEQ ID NO: 4489866 - DNA, 16 bp, Homo sapiens
aggccatctcaggaga

SEQ ID NO: 4489867 - DNA, 14 bp, Homo sapiens
aggccattgtgaac

SEQ ID NO: 4489868 - DNA, 19 bp, Homo sapiens
aggccattgtgaaccaatg

SEQ ID NO: 4489869 - DNA, 14 bp, Homo sapiens
aggccatttttggt

SEQ ID NO: 4489870 - DNA, 15 bp, Homo sapiens
aggcccaaatgatgg

SEQ ID NO: 4489871 - DNA, 15 bp, Homo sapiens
aggcccactccccag

SEQ ID NO: 4489872 - DNA, 16 bp, Homo sapiens
aggcccactccccagc

SEQ ID NO: 4489873 - DNA, 16 bp, Homo sapiens
aggcccagagcgagga

SEQ ID NO: 4489874 - DNA, 16 bp, Homo sapiens
aggcccagccgcagga

SEQ ID NO: 4489875 - DNA, 16 bp, Homo sapiens
aggcccaggagtccag

SEQ ID NO: 4489876 - DNA, 13 bp, Homo sapiens
aggccccacctga

SEQ ID NO: 4489877 - DNA, 17 bp, Homo sapiens
aggccccacctgaaggg

SEQ ID NO: 4489878 - DNA, 13 bp, Homo sapiens
aggccccagacag

SEQ ID NO: 4489879 - DNA, 17 bp, Homo sapiens
aggccccagacagggtg

SEQ ID NO: 4489880 - DNA, 15 bp, Homo sapiens
aggccccagcctcca

SEQ ID NO: 4489881 - DNA, 18 bp, Homo sapiens
aggccccagcctccaggc

SEQ ID NO: 4489882 - DNA, 19 bp, Homo sapiens
aggccccagcctccaggcc

SEQ ID NO: 4489883 - DNA, 17 bp, Homo sapiens
aggcccccaacccctcc

SEQ ID NO: 4489884 - DNA, 20 bp, Homo sapiens
aggcccccaacccctcctcc

SEQ ID NO: 4489885 - DNA, 22 bp, Homo sapiens
aggcccccaacccctcctccct

SEQ ID NO: 4489886 - DNA, 22 bp, Homo sapiens
aggcccccagcccctcctccct

SEQ ID NO: 4489887 - DNA, 17 bp, Homo sapiens
aggccccgaggacccag

SEQ ID NO: 4489888 - DNA, 13 bp, Homo sapiens
agctattttagaa

SEQ ID NO: 4489889 - DNA, 15 bp, Homo sapiens
agctcaactttctgt

SEQ ID NO: 4489890 - DNA, 23 bp, Homo sapiens
agctcaagaattgttagcaaatg

SEQ ID NO: 4489891 - DNA, 16 bp, Homo sapiens
agctcacatgggactg

SEQ ID NO: 4489892 - DNA, 19 bp, Homo sapiens
agctcacatgggactggga

SEQ ID NO: 4489893 - DNA, 21 bp, Homo sapiens
agctcacatgggactgggata

SEQ ID NO: 4489894 - DNA, 15 bp, Homo sapiens
agctcaccccccaca

SEQ ID NO: 4489895 - DNA, 16 bp, Homo sapiens
agctcagacccccact

SEQ ID NO: 4489896 - DNA, 17 bp, Homo sapiens
agctcagacccccactc

SEQ ID NO: 4489897 - DNA, 18 bp, Homo sapiens
agctcaggaattccctgg

SEQ ID NO: 4489898 - DNA, 13 bp, Homo sapiens
agctcaggaggcg

SEQ ID NO: 4489899 - DNA, 22 bp, Homo sapiens
agctcaggaggcgaataaatgt

SEQ ID NO: 4489900 - DNA, 20 bp, Homo sapiens
agctcaggagtttgagacca

SEQ ID NO: 4489901 - DNA, 20 bp, Homo sapiens
agctcaggtcctgctgcctc

SEQ ID NO: 4489902 - DNA, 19 bp, Homo sapiens
agctcagtaacataactgc

SEQ ID NO: 4489903 - DNA, 21 bp, Homo sapiens
agctcatccatgcctcagaag

SEQ ID NO: 4489904 - DNA, 17 bp, Homo sapiens
agctcatttcatgctct

SEQ ID NO: 4489905 - DNA, 21 bp, Homo sapiens
agctcatttcggggtcaggtg

SEQ ID NO: 4489906 - DNA, 14 bp, Homo sapiens
agctccacacgccc

SEQ ID NO: 4489907 - DNA, 15 bp, Homo sapiens
agctccacacgcccc

SEQ ID NO: 4489908 - DNA, 17 bp, Homo sapiens
agctccatgttctccca

SEQ ID NO: 4489909 - DNA, 19 bp, Homo sapiens
agctccatgttctcccaaa

SEQ ID NO: 4489910 - DNA, 21 bp, Homo sapiens
agctcccacaccgcgtcccag

SEQ ID NO: 4489911 - DNA, 13 bp, Homo sapiens
agctcccacccca

SEQ ID NO: 4489912 - DNA, 18 bp, Homo sapiens
agctcccccgtggtgcct

SEQ ID NO: 4489913 - DNA, 19 bp, Homo sapiens
agctcccccgtggtgcctg

SEQ ID NO: 4489914 - DNA, 17 bp, Homo sapiens
agctcccctcttttgta

SEQ ID NO: 4489915 - DNA, 20 bp, Homo sapiens
agctcccctcttttgtaagt

SEQ ID NO: 4489916 - DNA, 14 bp, Homo sapiens
agctcccctggctg

SEQ ID NO: 4489917 - DNA, 15 bp, Homo sapiens
agctcccctggctgg

SEQ ID NO: 4489918 - DNA, 21 bp, Homo sapiens
agctcccctggctggctccta

SEQ ID NO: 4489919 - DNA, 20 bp, Homo sapiens
agctccctggcttctgtggg

SEQ ID NO: 4489920 - DNA, 15 bp, Homo sapiens
agctccgggatcagc

SEQ ID NO: 4489921 - DNA, 21 bp, Homo sapiens
agctccgggggtacagccctt

SEQ ID NO: 4489922 - DNA, 13 bp, Homo sapiens
agctcctctcctg

SEQ ID NO: 4489923 - DNA, 15 bp, Homo sapiens
agctcctctcctgga

SEQ ID NO: 4489924 - DNA, 16 bp, Homo sapiens
agctcctctcctggag

SEQ ID NO: 4489925 - DNA, 17 bp, Homo sapiens
agctcctctcctggagg

SEQ ID NO: 4489926 - DNA, 18 bp, Homo sapiens
agctcctctcctggagga

SEQ ID NO: 4489927 - DNA, 13 bp, Homo sapiens
agctcctgccaca

SEQ ID NO: 4489928 - DNA, 20 bp, Homo sapiens
agctcctgccacatggagcc

SEQ ID NO: 4489929 - DNA, 21 bp, Homo sapiens
agctcctgccacatggagccc

SEQ ID NO: 4489930 - DNA, 13 bp, Homo sapiens
agctcctgggacc

SEQ ID NO: 4489931 - DNA, 16 bp, Homo sapiens
agctcctgggaccctt

SEQ ID NO: 4489932 - DNA, 17 bp, Homo sapiens
agctcctggggagctcc

SEQ ID NO: 4489933 - DNA, 16 bp, Homo sapiens
agctcctttctcctgt

SEQ ID NO: 4489934 - DNA, 22 bp, Homo sapiens
agctcgatgtggtcacagctgt

SEQ ID NO: 4489935 - DNA, 23 bp, Homo sapiens
agctcgatgtggtcacagctgta

SEQ ID NO: 4489936 - DNA, 18 bp, Homo sapiens
agctcgcatccagacagt

SEQ ID NO: 4489937 - DNA, 15 bp, Homo sapiens
agctcggcaccaact

SEQ ID NO: 4489938 - DNA, 20 bp, Homo sapiens
agctctagttttcagccttg

SEQ ID NO: 4489939 - DNA, 21 bp, Homo sapiens
agctctcaagtcaaggaagct

SEQ ID NO: 4489940 - DNA, 19 bp, Homo sapiens
agctctcaggccgagagcc

SEQ ID NO: 4489941 - DNA, 20 bp, Homo sapiens
agctctcaggccgagagcct

SEQ ID NO: 4489942 - DNA, 13 bp, Homo sapiens
agctctccctctg

SEQ ID NO: 4489943 - DNA, 18 bp, Homo sapiens
agctctccctctggccct

SEQ ID NO: 4489944 - DNA, 20 bp, Homo sapiens
agctctccctctggccctgc

SEQ ID NO: 4489945 - DNA, 22 bp, Homo sapiens
agctctccctctggccctgcct

SEQ ID NO: 4489946 - DNA, 22 bp, Homo sapiens
agctctgaagaactctctggaa

SEQ ID NO: 4489947 - DNA, 17 bp, Homo sapiens
agctctgaatagttaaa

SEQ ID NO: 4489948 - DNA, 21 bp, Homo sapiens
agctctgaatagttaaaaatt

SEQ ID NO: 4489949 - DNA, 23 bp, Homo sapiens
agctctgcccatcctgcccctga

SEQ ID NO: 4489950 - DNA, 21 bp, Homo sapiens
agctctgccttgcactgtggt

SEQ ID NO: 4489951 - DNA, 18 bp, Homo sapiens
agctctggggcagaggaa

SEQ ID NO: 4489952 - DNA, 19 bp, Homo sapiens
agctctggggtgggcagtt

SEQ ID NO: 4489953 - DNA, 20 bp, Homo sapiens
agctctggggtgggcagttt

SEQ ID NO: 4489954 - DNA, 12 bp, Homo sapiens
agctctgtatca

SEQ ID NO: 4489955 - DNA, 16 bp, Homo sapiens
agctcttcaggcctcc

SEQ ID NO: 4489956 - DNA, 16 bp, Homo sapiens
agctcttcttcccagc

SEQ ID NO: 4489957 - DNA, 13 bp, Homo sapiens
agctcttggcccg

SEQ ID NO: 4489958 - DNA, 14 bp, Homo sapiens
agctcttgggtcag

SEQ ID NO: 4489959 - DNA, 11 bp, Homo sapiens
agctcttttaa

SEQ ID NO: 4489960 - DNA, 13 bp, Homo sapiens
agctgaaatttta

SEQ ID NO: 4489961 - DNA, 17 bp, Homo sapiens
agctgaaattttagaaa

SEQ ID NO: 4489962 - DNA, 16 bp, Homo sapiens
agctgaagatccccaa

SEQ ID NO: 4489963 - DNA, 20 bp, Homo sapiens
agctgaagatccccaactgc

SEQ ID NO: 4489964 - DNA, 23 bp, Homo sapiens
agctgaagatccccaactgctcc

SEQ ID NO: 4489965 - DNA, 24 bp, Homo sapiens
agctgaagatccccaactgctcca

SEQ ID NO: 4489966 - DNA, 18 bp, Homo sapiens
agctgaagtcaaaatatg

SEQ ID NO: 4489967 - DNA, 22 bp, Homo sapiens
agctgacccagagtggagtctg

SEQ ID NO: 4489968 - DNA, 20 bp, Homo sapiens
agctgacttgcacagggatt

SEQ ID NO: 4489969 - DNA, 12 bp, Homo sapiens
agctgagcagcc

SEQ ID NO: 4489970 - DNA, 14 bp, Homo sapiens
agctgagtgggaac

SEQ ID NO: 4489971 - DNA, 21 bp, Homo sapiens
agctgatatgtcagtccctgg

SEQ ID NO: 4489972 - DNA, 19 bp, Homo sapiens
agctgattccagaacaaat

SEQ ID NO: 4489973 - DNA, 14 bp, Homo sapiens
agctgcaaagtgtt

SEQ ID NO: 4489974 - DNA, 19 bp, Homo sapiens
agctgcaaagtgttttgta

SEQ ID NO: 4489975 - DNA, 23 bp, Homo sapiens
agctgcaaggtactctggtgagt

SEQ ID NO: 4489976 - DNA, 23 bp, Homo sapiens
agctgcacagggcagctgggccc

SEQ ID NO: 4489977 - DNA, 15 bp, Homo sapiens
agctgcactgtgaac

SEQ ID NO: 4489978 - DNA, 16 bp, Homo sapiens
agctgcactgtgaacc

SEQ ID NO: 4489979 - DNA, 11 bp, Homo sapiens
agctgcagaac

SEQ ID NO: 4489980 - DNA, 19 bp, Homo sapiens
agctgcagctgagcctgag

SEQ ID NO: 4489981 - DNA, 21 bp, Homo sapiens
agctgcaggaatcacccctct

SEQ ID NO: 4489982 - DNA, 15 bp, Homo sapiens
agctgcccagccctg

SEQ ID NO: 4489983 - DNA, 15 bp, Homo sapiens
agctgccccagccag

SEQ ID NO: 4489984 - DNA, 16 bp, Homo sapiens
agctgccccagccaga

SEQ ID NO: 4489985 - DNA, 19 bp, Homo sapiens
agctgccccggcccctccc

SEQ ID NO: 4489986 - DNA, 11 bp, Homo sapiens
agctgccctcc

SEQ ID NO: 4489987 - DNA, 13 bp, Homo sapiens
agctgcccttgca

SEQ ID NO: 4489988 - DNA, 15 bp, Homo sapiens
agctgcccttgcagg

SEQ ID NO: 4489989 - DNA, 17 bp, Homo sapiens
agctgccgacttggaga

SEQ ID NO: 4489990 - DNA, 13 bp, Homo sapiens
agctgcctcactt

SEQ ID NO: 4489991 - DNA, 18 bp, Homo sapiens
agctgcctcctgcgccct

SEQ ID NO: 4489992 - DNA, 19 bp, Homo sapiens
agctgcctcctgcgccctg

SEQ ID NO: 4489993 - DNA, 12 bp, Homo sapiens
agctgcctctgc

SEQ ID NO: 4489994 - DNA, 17 bp, Homo sapiens
agctgcctctgctccct

SEQ ID NO: 4489995 - DNA, 18 bp, Homo sapiens
agctgccttagcttcagg

SEQ ID NO: 4489996 - DNA, 12 bp, Homo sapiens
agctgccttccc

SEQ ID NO: 4489997 - DNA, 14 bp, Homo sapiens
agctgccttcccta

SEQ ID NO: 4489998 - DNA, 16 bp, Homo sapiens
agctgccttccctagc

SEQ ID NO: 4489999 - DNA, 14 bp, Homo sapiens
agctgctaaatctc

SEQ ID NO: 4490000 - DNA, 22 bp, Homo sapiens
agctgctaaatctcctattttt

SEQ ID NO: 4490001 - DNA, 22 bp, Homo sapiens
agctgctatccccatctccctg

SEQ ID NO: 4490002 - DNA, 23 bp, Homo sapiens
agctgctatccccatctccctgc

SEQ ID NO: 4490003 - DNA, 14 bp, Homo sapiens
agctgctcccctgg

SEQ ID NO: 4490004 - DNA, 18 bp, Homo sapiens
agctgctccgaggaccca

SEQ ID NO: 4490005 - DNA, 19 bp, Homo sapiens
agctgctccgaggacccag

SEQ ID NO: 4490006 - DNA, 20 bp, Homo sapiens
agctgctccgaggacccagg

SEQ ID NO: 4490007 - DNA, 14 bp, Homo sapiens
agctgctgaaacaa

SEQ ID NO: 4490008 - DNA, 20 bp, Homo sapiens
agctgctgaaacaacaaata

SEQ ID NO: 4490009 - DNA, 14 bp, Homo sapiens
agctgctgaggccc

SEQ ID NO: 4490010 - DNA, 15 bp, Homo sapiens
agctgctggatgact

SEQ ID NO: 4490011 - DNA, 14 bp, Homo sapiens
agctgctggcttgc

SEQ ID NO: 4490012 - DNA, 17 bp, Homo sapiens
agctgctgtgtcctcta

SEQ ID NO: 4490013 - DNA, 16 bp, Homo sapiens
agctgctgttctcagg

SEQ ID NO: 4490014 - DNA, 20 bp, Homo sapiens
agctgcttggacggattcct

SEQ ID NO: 4490015 - DNA, 19 bp, Homo sapiens
agctggaatgtgccacaga

SEQ ID NO: 4490016 - DNA, 20 bp, Homo sapiens
agctggaatgtgccacagag

SEQ ID NO: 4490017 - DNA, 22 bp, Homo sapiens
agctggaatgtgccacagaggc

SEQ ID NO: 4490018 - DNA, 20 bp, Homo sapiens
agctggagcccccagcagag

SEQ ID NO: 4490019 - DNA, 22 bp, Homo sapiens
agctggaggactagaacctgga

SEQ ID NO: 4490020 - DNA, 12 bp, Homo sapiens
agctggcctgag

SEQ ID NO: 4490021 - DNA, 21 bp, Homo sapiens
agctggcctgagaggggaagc

SEQ ID NO: 4490022 - DNA, 11 bp, Homo sapiens
agctggcctgg

SEQ ID NO: 4490023 - DNA, 22 bp, Homo sapiens
agctggcctggtttcctcgaga

SEQ ID NO: 4490024 - DNA, 14 bp, Homo sapiens
agctggctctgtga

SEQ ID NO: 4490025 - DNA, 20 bp, Homo sapiens
agctggctttgaaacctcag

SEQ ID NO: 4490026 - DNA, 23 bp, Homo sapiens
agctggctttgaaacctcagggc

SEQ ID NO: 4490027 - DNA, 14 bp, Homo sapiens
agctgggaaagcat

SEQ ID NO: 4490028 - DNA, 21 bp, Homo sapiens
agctgggacaccccgactttt

SEQ ID NO: 4490029 - DNA, 15 bp, Homo sapiens
agctgggactacagg

SEQ ID NO: 4490030 - DNA, 14 bp, Homo sapiens
agctgggagacaaa

SEQ ID NO: 4490031 - DNA, 20 bp, Homo sapiens
agctgggccagccgcccacc

SEQ ID NO: 4490032 - DNA, 15 bp, Homo sapiens
agctgggcccaaccc

SEQ ID NO: 4490033 - DNA, 17 bp, Homo sapiens
agctgggccccagccca

SEQ ID NO: 4490034 - DNA, 20 bp, Homo sapiens
agctgggccccagcccaccc

SEQ ID NO: 4490035 - DNA, 22 bp, Homo sapiens
agctgggccccagcccaccctc

SEQ ID NO: 4490036 - DNA, 16 bp, Homo sapiens
agctgggccctgcctg

SEQ ID NO: 4490037 - DNA, 19 bp, Homo sapiens
agctgggccctgcctgcag

SEQ ID NO: 4490038 - DNA, 15 bp, Homo sapiens
agctggggactcagg

SEQ ID NO: 4490039 - DNA, 17 bp, Homo sapiens
agctggggactcaggga

SEQ ID NO: 4490040 - DNA, 16 bp, Homo sapiens
agctggggccagaggc

SEQ ID NO: 4490041 - DNA, 19 bp, Homo sapiens
agctggggccagaggctgg

SEQ ID NO: 4490042 - DNA, 21 bp, Homo sapiens
agctggggccagaggctggga

SEQ ID NO: 4490043 - DNA, 14 bp, Homo sapiens
agctggggccggtt

SEQ ID NO: 4490044 - DNA, 17 bp, Homo sapiens
agctggtcgagcagctt

SEQ ID NO: 4490045 - DNA, 20 bp, Homo sapiens
agctggtgcaaattcagaac

SEQ ID NO: 4490046 - DNA, 15 bp, Homo sapiens
agctggtggtgcagc

SEQ ID NO: 4490047 - DNA, 20 bp, Homo sapiens
agctggtttaatgttttggc

SEQ ID NO: 4490048 - DNA, 22 bp, Homo sapiens
agctgtaatttcgccttaaact

SEQ ID NO: 4490049 - DNA, 20 bp, Homo sapiens
agctgtacttcttgaatata

SEQ ID NO: 4490050 - DNA, 20 bp, Homo sapiens
agctgtaggtgtgcgggacc

SEQ ID NO: 4490051 - DNA, 23 bp, Homo sapiens
agctgtataattaattgtcatta

SEQ ID NO: 4490052 - DNA, 11 bp, Homo sapiens
agctgtcatca

SEQ ID NO: 4490053 - DNA, 23 bp, Homo sapiens
agctgtcccatctggtcatttgg

SEQ ID NO: 4490054 - DNA, 18 bp, Homo sapiens
agctgtccctgtcaccaa

SEQ ID NO: 4490055 - DNA, 22 bp, Homo sapiens
agctgtccctgtcaccaagctc

SEQ ID NO: 4490056 - DNA, 19 bp, Homo sapiens
agctgtcctgtgatgtcag

SEQ ID NO: 4490057 - DNA, 19 bp, Homo sapiens
agctgtgacttctatttta

SEQ ID NO: 4490058 - DNA, 10 bp, Homo sapiens
agctgtgcag

SEQ ID NO: 4490059 - DNA, 12 bp, Homo sapiens
agctgtgcaggt

SEQ ID NO: 4490060 - DNA, 18 bp, Homo sapiens
agctgtggcagagttaca

SEQ ID NO: 4490061 - DNA, 22 bp, Homo sapiens
agctgtggcagagttacagttc

SEQ ID NO: 4490062 - DNA, 15 bp, Homo sapiens
agctgtgtccttgca

SEQ ID NO: 4490063 - DNA, 19 bp, Homo sapiens
agctgtgttattcctggtt

SEQ ID NO: 4490064 - DNA, 17 bp, Homo sapiens
agctgtgttcacagacc

SEQ ID NO: 4490065 - DNA, 11 bp, Homo sapiens
agctgtgttta

SEQ ID NO: 4490066 - DNA, 17 bp, Homo sapiens
agctgttatttcttccc

SEQ ID NO: 4490067 - DNA, 16 bp, Homo sapiens
agctgttcacagccag

SEQ ID NO: 4490068 - DNA, 22 bp, Homo sapiens
agctgttctaattaagaaaact

SEQ ID NO: 4490069 - DNA, 15 bp, Homo sapiens
agctgttcttgaaag

SEQ ID NO: 4490070 - DNA, 16 bp, Homo sapiens
agctgttcttgaaagc

SEQ ID NO: 4490071 - DNA, 22 bp, Homo sapiens
agctgttgaagtctcaggagtc

SEQ ID NO: 4490072 - DNA, 22 bp, Homo sapiens
agctgtttactagggatccctc

SEQ ID NO: 4490073 - DNA, 21 bp, Homo sapiens
agctgtttatggcctcagctg

SEQ ID NO: 4490074 - DNA, 22 bp, Homo sapiens
agctgttttggaacgcagttga

SEQ ID NO: 4490075 - DNA, 19 bp, Homo sapiens
agcttaaacccatacaatg

SEQ ID NO: 4490076 - DNA, 21 bp, Homo sapiens
agcttaaacccatacaatgta

SEQ ID NO: 4490077 - DNA, 23 bp, Homo sapiens
agcttaagtccagctcatttcag

SEQ ID NO: 4490078 - DNA, 20 bp, Homo sapiens
agcttaatagctgtagtttt

SEQ ID NO: 4490079 - DNA, 22 bp, Homo sapiens
agcttacaaatactaaaaagaa

SEQ ID NO: 4490080 - DNA, 15 bp, Homo sapiens
agcttagatttcata

SEQ ID NO: 4490081 - DNA, 22 bp, Homo sapiens
agcttaggtcaaagttcataga

SEQ ID NO: 4490082 - DNA, 18 bp, Homo sapiens
agcttatccataaaaaaa

SEQ ID NO: 4490083 - DNA, 14 bp, Homo sapiens
agcttatctgcccc

SEQ ID NO: 4490084 - DNA, 15 bp, Homo sapiens
agcttatctgcccct

SEQ ID NO: 4490085 - DNA, 23 bp, Homo sapiens
agcttattgtttttattctgtat

SEQ ID NO: 4490086 - DNA, 14 bp, Homo sapiens
agcttcaaagttta

SEQ ID NO: 4490087 - DNA, 19 bp, Homo sapiens
agcttcaatataagaagca

SEQ ID NO: 4490088 - DNA, 18 bp, Homo sapiens
agcttcacccaccaggcc

SEQ ID NO: 4490089 - DNA, 19 bp, Homo sapiens
agcttcacccaccaggcca

SEQ ID NO: 4490090 - DNA, 22 bp, Homo sapiens
agcttcacccaccaggccagct

SEQ ID NO: 4490091 - DNA, 23 bp, Homo sapiens
agcttcacccaccaggccagctc

SEQ ID NO: 4490092 - DNA, 13 bp, Homo sapiens
agcttcaggaacc

SEQ ID NO: 4490093 - DNA, 23 bp, Homo sapiens
agcttcaggaacctcgagtactg

SEQ ID NO: 4490094 - DNA, 17 bp, Homo sapiens
agcttccatagctgctg

SEQ ID NO: 4490095 - DNA, 23 bp, Homo sapiens
agcttccatagctgctgccctag

SEQ ID NO: 4490096 - DNA, 15 bp, Homo sapiens
agcttcctgagggct

SEQ ID NO: 4490097 - DNA, 16 bp, Homo sapiens
agcttcctgagggcta

SEQ ID NO: 4490098 - DNA, 14 bp, Homo sapiens
agcttcctgtctgt

SEQ ID NO: 4490099 - DNA, 16 bp, Homo sapiens
agcttcctgtctgttt

SEQ ID NO: 4490100 - DNA, 17 bp, Homo sapiens
agcttcctgtctgttta

SEQ ID NO: 4490101 - DNA, 15 bp, Homo sapiens
agcttcgaggacagg

SEQ ID NO: 4490102 - DNA, 20 bp, Homo sapiens
agcttcggagggcccctgcg

SEQ ID NO: 4490103 - DNA, 22 bp, Homo sapiens
agcttctactcctgcctcatgc

SEQ ID NO: 4490104 - DNA, 13 bp, Homo sapiens
agcttctctgcag

SEQ ID NO: 4490105 - DNA, 20 bp, Homo sapiens
agcttctcttctttctgaag

SEQ ID NO: 4490106 - DNA, 12 bp, Homo sapiens
agcttctgcttt

SEQ ID NO: 4490107 - DNA, 17 bp, Homo sapiens
agcttctgcttttctgc

SEQ ID NO: 4490108 - DNA, 21 bp, Homo sapiens
agcttctgcttttctgccctg

SEQ ID NO: 4490109 - DNA, 23 bp, Homo sapiens
agcttctgcttttctgccctggc

SEQ ID NO: 4490110 - DNA, 13 bp, Homo sapiens
agcttcttcacag

SEQ ID NO: 4490111 - DNA, 17 bp, Homo sapiens
agcttgaaagttttcag

SEQ ID NO: 4490112 - DNA, 20 bp, Homo sapiens
agcttgactaatggaatgat

SEQ ID NO: 4490113 - DNA, 15 bp, Homo sapiens
agcttgatttgatct

SEQ ID NO: 4490114 - DNA, 14 bp, Homo sapiens
agcttgcagctgga

SEQ ID NO: 4490115 - DNA, 19 bp, Homo sapiens
agcttgccctgttaaaaga

SEQ ID NO: 4490116 - DNA, 18 bp, Homo sapiens
agcttggaaagggaagat

SEQ ID NO: 4490117 - DNA, 12 bp, Homo sapiens
agcttgggcagt

SEQ ID NO: 4490118 - DNA, 20 bp, Homo sapiens
agcttgggcagtgccccagg

SEQ ID NO: 4490119 - DNA, 23 bp, Homo sapiens
agcttgggcagtgccccagggag

SEQ ID NO: 4490120 - DNA, 14 bp, Homo sapiens
agcttggggagagg

SEQ ID NO: 4490121 - DNA, 23 bp, Homo sapiens
agcttggttgactgatgttcatg

SEQ ID NO: 4490122 - DNA, 20 bp, Homo sapiens
agcttgtctgtgatctctgc

SEQ ID NO: 4490123 - DNA, 22 bp, Homo sapiens
agcttgtctgtgatctctgctg

SEQ ID NO: 4490124 - DNA, 14 bp, Homo sapiens
agctttaaatgaca

SEQ ID NO: 4490125 - DNA, 19 bp, Homo sapiens
agctttaaatgacagtaat

SEQ ID NO: 4490126 - DNA, 17 bp, Homo sapiens
agctttaaattatgtga

SEQ ID NO: 4490127 - DNA, 21 bp, Homo sapiens
aggaatctgtttctctgctgt

SEQ ID NO: 4490128 - DNA, 23 bp, Homo sapiens
aggaatctgtttctctgctgtca

SEQ ID NO: 4490129 - DNA, 16 bp, Homo sapiens
aggaatgatattgctg

SEQ ID NO: 4490130 - DNA, 13 bp, Homo sapiens
aggaatggtgctt

SEQ ID NO: 4490131 - DNA, 14 bp, Homo sapiens
aggaattactttat

SEQ ID NO: 4490132 - DNA, 23 bp, Homo sapiens
aggaattgacccacaagaaatga

SEQ ID NO: 4490133 - DNA, 22 bp, Homo sapiens
aggaatttactttcttcaccaa

SEQ ID NO: 4490134 - DNA, 22 bp, Homo sapiens
aggaatttcacctgtaaacctg

SEQ ID NO: 4490135 - DNA, 13 bp, Homo sapiens
aggaatttcttaa

SEQ ID NO: 4490136 - DNA, 15 bp, Homo sapiens
aggacaagttttagt

SEQ ID NO: 4490137 - DNA, 12 bp, Homo sapiens
aggacacagtga

SEQ ID NO: 4490138 - DNA, 15 bp, Homo sapiens
aggacacagttcctg

SEQ ID NO: 4490139 - DNA, 24 bp, Homo sapiens
aggacaccctccctccagggtcct

SEQ ID NO: 4490140 - DNA, 17 bp, Homo sapiens
aggacagaacagtgttt

SEQ ID NO: 4490141 - DNA, 21 bp, Homo sapiens
aggacagagggaagccagtca

SEQ ID NO: 4490142 - DNA, 23 bp, Homo sapiens
aggacagcctgtggcggtgcctg

SEQ ID NO: 4490143 - DNA, 12 bp, Homo sapiens
aggacagctcct

SEQ ID NO: 4490144 - DNA, 15 bp, Homo sapiens
aggacaggagcctgg

SEQ ID NO: 4490145 - DNA, 14 bp, Homo sapiens
aggacagtccctgc

SEQ ID NO: 4490146 - DNA, 15 bp, Homo sapiens
aggacagtccctgct

SEQ ID NO: 4490147 - DNA, 16 bp, Homo sapiens
aggacagtccctgctg

SEQ ID NO: 4490148 - DNA, 18 bp, Homo sapiens
aggacagtccctgctggg

SEQ ID NO: 4490149 - DNA, 14 bp, Homo sapiens
aggacagtctggag

SEQ ID NO: 4490150 - DNA, 16 bp, Homo sapiens
aggacagtctggagaa

SEQ ID NO: 4490151 - DNA, 19 bp, Homo sapiens
aggacagtctggagaaggt

SEQ ID NO: 4490152 - DNA, 20 bp, Homo sapiens
aggacagtctggagaaggta

SEQ ID NO: 4490153 - DNA, 21 bp, Homo sapiens
aggacatagaggtatattgga

SEQ ID NO: 4490154 - DNA, 12 bp, Homo sapiens
aggacatcagca

SEQ ID NO: 4490155 - DNA, 16 bp, Homo sapiens
aggacatcagcaaaca

SEQ ID NO: 4490156 - DNA, 17 bp, Homo sapiens
aggaccaggactccctc

SEQ ID NO: 4490157 - DNA, 19 bp, Homo sapiens
aggaccaggactccctcct

SEQ ID NO: 4490158 - DNA, 12 bp, Homo sapiens
aggaccaggaga

SEQ ID NO: 4490159 - DNA, 18 bp, Homo sapiens
aggacccagacccagtgg

SEQ ID NO: 4490160 - DNA, 13 bp, Homo sapiens
aggacccagagga

SEQ ID NO: 4490161 - DNA, 15 bp, Homo sapiens
aggacccagaggaag

SEQ ID NO: 4490162 - DNA, 17 bp, Homo sapiens
aggacccagtggtcagc

SEQ ID NO: 4490163 - DNA, 16 bp, Homo sapiens
aggacccgtctccagc

SEQ ID NO: 4490164 - DNA, 22 bp, Homo sapiens
aggaccctgacctccgcccctg

SEQ ID NO: 4490165 - DNA, 14 bp, Homo sapiens
aggaccgaggctac

SEQ ID NO: 4490166 - DNA, 20 bp, Homo sapiens
aggaccgaggctacagctcc

SEQ ID NO: 4490167 - DNA, 19 bp, Homo sapiens
aggacctggcgtgctcaga

SEQ ID NO: 4490168 - DNA, 21 bp, Homo sapiens
aggacctgtatttaagcaaat

SEQ ID NO: 4490169 - DNA, 21 bp, Homo sapiens
aggacctgtggccaagttctt

SEQ ID NO: 4490170 - DNA, 12 bp, Homo sapiens
aggacgccactc

SEQ ID NO: 4490171 - DNA, 20 bp, Homo sapiens
aggacgccactcatttcatc

SEQ ID NO: 4490172 - DNA, 22 bp, Homo sapiens
aggacgcctgcaggagagagca

SEQ ID NO: 4490173 - DNA, 22 bp, Homo sapiens
aggacgcgacctcagttgtcct

SEQ ID NO: 4490174 - DNA, 14 bp, Homo sapiens
aggacggctgagca

SEQ ID NO: 4490175 - DNA, 20 bp, Homo sapiens
aggacgggagtgagctgggg

SEQ ID NO: 4490176 - DNA, 16 bp, Homo sapiens
aggacggtgcaaccca

SEQ ID NO: 4490177 - DNA, 21 bp, Homo sapiens
aggacgtcatcggaggctggg

SEQ ID NO: 4490178 - DNA, 22 bp, Homo sapiens
aggacgtggatgaccctcccct

SEQ ID NO: 4490179 - DNA, 18 bp, Homo sapiens
aggactagaacctggagg

SEQ ID NO: 4490180 - DNA, 22 bp, Homo sapiens
aggactagaacctggagggctg

SEQ ID NO: 4490181 - DNA, 13 bp, Homo sapiens
aggactagaagat

SEQ ID NO: 4490182 - DNA, 21 bp, Homo sapiens
aggactagaagattagaaact

SEQ ID NO: 4490183 - DNA, 15 bp, Homo sapiens
aggactccaggccca

SEQ ID NO: 4490184 - DNA, 15 bp, Homo sapiens
aggactccctcctca

SEQ ID NO: 4490185 - DNA, 16 bp, Homo sapiens
aggactccctcctcac

SEQ ID NO: 4490186 - DNA, 17 bp, Homo sapiens
aggactccctcctcacc

SEQ ID NO: 4490187 - DNA, 23 bp, Homo sapiens
aggactccctcctcacctctgga

SEQ ID NO: 4490188 - DNA, 12 bp, Homo sapiens
aggactctgcgg

SEQ ID NO: 4490189 - DNA, 17 bp, Homo sapiens
aggactctttccgactg

SEQ ID NO: 4490190 - DNA, 19 bp, Homo sapiens
aggactctttccgactgcc

SEQ ID NO: 4490191 - DNA, 13 bp, Homo sapiens
aggactgaaagaa

SEQ ID NO: 4490192 - DNA, 23 bp, Homo sapiens
aggactgaaagaagaaaacagta

SEQ ID NO: 4490193 - DNA, 19 bp, Homo sapiens
aggactgaattgtccccag

SEQ ID NO: 4490194 - DNA, 15 bp, Homo sapiens
aggactgagactggc

SEQ ID NO: 4490195 - DNA, 13 bp, Homo sapiens
aggactgagcccc

SEQ ID NO: 4490196 - DNA, 15 bp, Homo sapiens
aggactgagccccca

SEQ ID NO: 4490197 - DNA, 12 bp, Homo sapiens
aggactgaggga

SEQ ID NO: 4490198 - DNA, 23 bp, Homo sapiens
aggactgcacagcgtcctgtcca

SEQ ID NO: 4490199 - DNA, 21 bp, Homo sapiens
aggactgcatggtaatttata

SEQ ID NO: 4490200 - DNA, 15 bp, Homo sapiens
aggactgggccactt

SEQ ID NO: 4490201 - DNA, 16 bp, Homo sapiens
aggactggtgaatata

SEQ ID NO: 4490202 - DNA, 23 bp, Homo sapiens
aggactggtgaatataaatgatg

SEQ ID NO: 4490203 - DNA, 16 bp, Homo sapiens
aggactgtttcagtgt

SEQ ID NO: 4490204 - DNA, 17 bp, Homo sapiens
aggacttgatgtacata

SEQ ID NO: 4490205 - DNA, 15 bp, Homo sapiens
aggactttgtacatt

SEQ ID NO: 4490206 - DNA, 17 bp, Homo sapiens
aggagaaactggaactc

SEQ ID NO: 4490207 - DNA, 22 bp, Homo sapiens
aggagaaagaaagtacccagca

SEQ ID NO: 4490208 - DNA, 23 bp, Homo sapiens
aggagaaagaaagtacccagcaa

SEQ ID NO: 4490209 - DNA, 16 bp, Homo sapiens
aggagaaatgcatcca

SEQ ID NO: 4490210 - DNA, 12 bp, Homo sapiens
aggagaacaaat

SEQ ID NO: 4490211 - DNA, 15 bp, Homo sapiens
aggagaaggaaaaag

SEQ ID NO: 4490212 - DNA, 12 bp, Homo sapiens
aggagaaggaag

SEQ ID NO: 4490213 - DNA, 16 bp, Homo sapiens
aggagaaggaaggaga

SEQ ID NO: 4490214 - DNA, 22 bp, Homo sapiens
aggagaagtcttctatttattt

SEQ ID NO: 4490215 - DNA, 20 bp, Homo sapiens
aggagaatagcctgaacctg

SEQ ID NO: 4490216 - DNA, 20 bp, Homo sapiens
aggagaatcacttgaaccca

SEQ ID NO: 4490217 - DNA, 18 bp, Homo sapiens
aggagaatccaagcgagg

SEQ ID NO: 4490218 - DNA, 22 bp, Homo sapiens
aggagaatctccgcttgtccaa

SEQ ID NO: 4490219 - DNA, 19 bp, Homo sapiens
aggagacattgctctatgt

SEQ ID NO: 4490220 - DNA, 11 bp, Homo sapiens
aggagactcac

SEQ ID NO: 4490221 - DNA, 13 bp, Homo sapiens
aggagactcacct

SEQ ID NO: 4490222 - DNA, 16 bp, Homo sapiens
aggagactcacctctg

SEQ ID NO: 4490223 - DNA, 18 bp, Homo sapiens
aggagactcacctctgcc

SEQ ID NO: 4490224 - DNA, 21 bp, Homo sapiens
aggagactcacctctgcctca

SEQ ID NO: 4490225 - DNA, 20 bp, Homo sapiens
aggagagactcccatgaagc

SEQ ID NO: 4490226 - DNA, 22 bp, Homo sapiens
aggagagactcccatgaagcct

SEQ ID NO: 4490227 - DNA, 22 bp, Homo sapiens
aggagagactgagcagccgcca

SEQ ID NO: 4490228 - DNA, 14 bp, Homo sapiens
aggagagccagccc

SEQ ID NO: 4490229 - DNA, 16 bp, Homo sapiens
aggagagccagccctc

SEQ ID NO: 4490230 - DNA, 12 bp, Homo sapiens
aggagagcctgc

SEQ ID NO: 4490231 - DNA, 13 bp, Homo sapiens
aggagagcctgct

SEQ ID NO: 4490232 - DNA, 20 bp, Homo sapiens
aggagagcctgctgcatggg

SEQ ID NO: 4490233 - DNA, 22 bp, Homo sapiens
aggagaggaaactactgccttt

SEQ ID NO: 4490234 - DNA, 20 bp, Homo sapiens
aggagaggcaaagaaaggag

SEQ ID NO: 4490235 - DNA, 20 bp, Homo sapiens
aggagaggcaacatccaaaa

SEQ ID NO: 4490236 - DNA, 13 bp, Homo sapiens
aggagaggggtgg

SEQ ID NO: 4490237 - DNA, 20 bp, Homo sapiens
aggagatcgagaccatcctg

SEQ ID NO: 4490238 - DNA, 19 bp, Homo sapiens
aggagatgaccagggatgc

SEQ ID NO: 4490239 - DNA, 16 bp, Homo sapiens
aggagatgctccttgg

SEQ ID NO: 4490240 - DNA, 18 bp, Homo sapiens
aggagatgctccttgggc

SEQ ID NO: 4490241 - DNA, 21 bp, Homo sapiens
aggagatgtcatcaagctcca

SEQ ID NO: 4490242 - DNA, 20 bp, Homo sapiens
aggagattctgtgtattaac

SEQ ID NO: 4490243 - DNA, 24 bp, Homo sapiens
aggagcactgcatgtcagagcact

SEQ ID NO: 4490244 - DNA, 14 bp, Homo sapiens
aggagcagaaatgc

SEQ ID NO: 4490245 - DNA, 13 bp, Homo sapiens
aggagcagcagct

SEQ ID NO: 4490246 - DNA, 12 bp, Homo sapiens
aggagcagccct

SEQ ID NO: 4490247 - DNA, 13 bp, Homo sapiens
aggagcagccctg

SEQ ID NO: 4490248 - DNA, 15 bp, Homo sapiens
aggagcagccctggc

SEQ ID NO: 4490249 - DNA, 21 bp, Homo sapiens
aggagcatttggagagaaggc

SEQ ID NO: 4490250 - DNA, 21 bp, Homo sapiens
aggagccccattcctgggaaa

SEQ ID NO: 4490251 - DNA, 23 bp, Homo sapiens
aggagcccttctatacccaccca

SEQ ID NO: 4490252 - DNA, 16 bp, Homo sapiens
aggagcctcatccagc

SEQ ID NO: 4490253 - DNA, 21 bp, Homo sapiens
aggagcctcatccagcctcag

SEQ ID NO: 4490254 - DNA, 14 bp, Homo sapiens
aggagcctgctggt

SEQ ID NO: 4490255 - DNA, 20 bp, Homo sapiens
aggagcctggtccttccctg

SEQ ID NO: 4490256 - DNA, 14 bp, Homo sapiens
aggagcgagcatgt

SEQ ID NO: 4490257 - DNA, 22 bp, Homo sapiens
aggagctgactcacacctgaac

SEQ ID NO: 4490258 - DNA, 13 bp, Homo sapiens
aggagctgctggc

SEQ ID NO: 4490259 - DNA, 21 bp, Homo sapiens
aggagctgctggcttgcagtg

SEQ ID NO: 4490260 - DNA, 12 bp, Homo sapiens
aggagctggcct

SEQ ID NO: 4490261 - DNA, 14 bp, Homo sapiens
aggagctggcctgc

SEQ ID NO: 4490262 - DNA, 21 bp, Homo sapiens
aggagcttgggtctctctcgg

SEQ ID NO: 4490263 - DNA, 13 bp, Homo sapiens
aggagcttttctg

SEQ ID NO: 4490264 - DNA, 15 bp, Homo sapiens
aggagcttttctgga

SEQ ID NO: 4490265 - DNA, 16 bp, Homo sapiens
aggaggacaaaaggaa

SEQ ID NO: 4490266 - DNA, 17 bp, Homo sapiens
aggaggagaaaagaaat

SEQ ID NO: 4490267 - DNA, 16 bp, Homo sapiens
aggaggatcacttgag

SEQ ID NO: 4490268 - DNA, 13 bp, Homo sapiens
aggaggattgcct

SEQ ID NO: 4490269 - DNA, 21 bp, Homo sapiens
aggaggcaagcgtgttctcag

SEQ ID NO: 4490270 - DNA, 18 bp, Homo sapiens
aggaggcacctacactca

SEQ ID NO: 4490271 - DNA, 13 bp, Homo sapiens
aggaggcccactg

SEQ ID NO: 4490272 - DNA, 15 bp, Homo sapiens
aggaggcctccatct

SEQ ID NO: 4490273 - DNA, 17 bp, Homo sapiens
aggaggctgaggcagaa

SEQ ID NO: 4490274 - DNA, 12 bp, Homo sapiens
aggaggctgcca

SEQ ID NO: 4490275 - DNA, 16 bp, Homo sapiens
aggaggctggcaggta

SEQ ID NO: 4490276 - DNA, 22 bp, Homo sapiens
aggaggctggtgacaggccaaa

SEQ ID NO: 4490277 - DNA, 15 bp, Homo sapiens
aggagggaaaccttt

SEQ ID NO: 4490278 - DNA, 12 bp, Homo sapiens
aggagggagagg

SEQ ID NO: 4490279 - DNA, 15 bp, Homo sapiens
aggagggcagaggga

SEQ ID NO: 4490280 - DNA, 13 bp, Homo sapiens
aggagggcaggca

SEQ ID NO: 4490281 - DNA, 12 bp, Homo sapiens
aggagggccagc

SEQ ID NO: 4490282 - DNA, 17 bp, Homo sapiens
aggagggcgtgactcac

SEQ ID NO: 4490283 - DNA, 17 bp, Homo sapiens
aggaggggaaaaaaatg

SEQ ID NO: 4490284 - DNA, 17 bp, Homo sapiens
aggaggggacctctcca

SEQ ID NO: 4490285 - DNA, 21 bp, Homo sapiens
aggagggtctccacactgctg

SEQ ID NO: 4490286 - DNA, 15 bp, Homo sapiens
aggagggtgggaagg

SEQ ID NO: 4490287 - DNA, 13 bp, Homo sapiens
aggagggtggggg

SEQ ID NO: 4490288 - DNA, 21 bp, Homo sapiens
aggagggtgggggagggaggt

SEQ ID NO: 4490289 - DNA, 22 bp, Homo sapiens
aggagggttgggcgtgctacct

SEQ ID NO: 4490290 - DNA, 22 bp, Homo sapiens
aggaggtaagaggtattggatt

SEQ ID NO: 4490291 - DNA, 21 bp, Homo sapiens
aggaggtcaagatcagcctgg

SEQ ID NO: 4490292 - DNA, 23 bp, Homo sapiens
aggaggtccttaggcctctgaga

SEQ ID NO: 4490293 - DNA, 22 bp, Homo sapiens
aggaggttctcccagcccatct

SEQ ID NO: 4490294 - DNA, 14 bp, Homo sapiens
aggagtaaaattca

SEQ ID NO: 4490295 - DNA, 12 bp, Homo sapiens
aggagtattttt

SEQ ID NO: 4490296 - DNA, 13 bp, Homo sapiens
aggagtatttttg

SEQ ID NO: 4490297 - DNA, 11 bp, Homo sapiens
aggagtccagg

SEQ ID NO: 4490298 - DNA, 20 bp, Homo sapiens
aggagtccaggcccccagcc

SEQ ID NO: 4490299 - DNA, 18 bp, Homo sapiens
aggagtggaggaggcctg

SEQ ID NO: 4490300 - DNA, 18 bp, Homo sapiens
aggagttacagggaagtg

SEQ ID NO: 4490301 - DNA, 20 bp, Homo sapiens
aggagttcaagaccagcctg

SEQ ID NO: 4490302 - DNA, 21 bp, Homo sapiens
aggagttcaagactagcctgg

SEQ ID NO: 4490303 - DNA, 22 bp, Homo sapiens
aggagttctgaagctgacagca

SEQ ID NO: 4490304 - DNA, 21 bp, Homo sapiens
aggagttgctgtttgtttgac

SEQ ID NO: 4490305 - DNA, 15 bp, Homo sapiens
aggagtttattacaa

SEQ ID NO: 4490306 - DNA, 17 bp, Homo sapiens
aggagtttattacaatg

SEQ ID NO: 4490307 - DNA, 18 bp, Homo sapiens
aggagttttactgcctgt

SEQ ID NO: 4490308 - DNA, 13 bp, Homo sapiens
aggataaattttt

SEQ ID NO: 4490309 - DNA, 14 bp, Homo sapiens
aggatacatttaat

SEQ ID NO: 4490310 - DNA, 22 bp, Homo sapiens
aggatacatttaataaaactgc

SEQ ID NO: 4490311 - DNA, 23 bp, Homo sapiens
aggatagaagtatacctgatttt

SEQ ID NO: 4490312 - DNA, 21 bp, Homo sapiens
aggatataagagggcttttta

SEQ ID NO: 4490313 - DNA, 21 bp, Homo sapiens
aggatattgaatgtgaaacat

SEQ ID NO: 4490314 - DNA, 13 bp, Homo sapiens
aggatccagagag

SEQ ID NO: 4490315 - DNA, 16 bp, Homo sapiens
aggatccggaaagaag

SEQ ID NO: 4490316 - DNA, 17 bp, Homo sapiens
aggatcggactctgccc

SEQ ID NO: 4490317 - DNA, 20 bp, Homo sapiens
aggatcggactctgcccctg

SEQ ID NO: 4490318 - DNA, 16 bp, Homo sapiens
aggatctgctccaaca

SEQ ID NO: 4490319 - DNA, 17 bp, Homo sapiens
aggatctgtctgtgcac

SEQ ID NO: 4490320 - DNA, 15 bp, Homo sapiens
aggatctttgactga

SEQ ID NO: 4490321 - DNA, 13 bp, Homo sapiens
aggatgacttttt

SEQ ID NO: 4490322 - DNA, 13 bp, Homo sapiens
aggatgaggacag

SEQ ID NO: 4490323 - DNA, 23 bp, Homo sapiens
aggatgaggacagagggcacatg

SEQ ID NO: 4490324 - DNA, 22 bp, Homo sapiens
aggatgcaacaaatgtggccaa

SEQ ID NO: 4490325 - DNA, 16 bp, Homo sapiens
aggatggcctttcctt

SEQ ID NO: 4490326 - DNA, 20 bp, Homo sapiens
aggatggcctttccttccct

SEQ ID NO: 4490327 - DNA, 16 bp, Homo sapiens
aggatgggaacaagga

SEQ ID NO: 4490328 - DNA, 20 bp, Homo sapiens
aggatgggaacaaggaagga

SEQ ID NO: 4490329 - DNA, 16 bp, Homo sapiens
aggatggggctcccag

SEQ ID NO: 4490330 - DNA, 22 bp, Homo sapiens
aggatggggctcccagctcctt

SEQ ID NO: 4490331 - DNA, 23 bp, Homo sapiens
aggatggtctcgatctcctgacc

SEQ ID NO: 4490332 - DNA, 23 bp, Homo sapiens
aggatggtgctgagtaaacataa

SEQ ID NO: 4490333 - DNA, 15 bp, Homo sapiens
aggatggtgtcctga

SEQ ID NO: 4490334 - DNA, 23 bp, Homo sapiens
aggatggttttgggactagaggc

SEQ ID NO: 4490335 - DNA, 19 bp, Homo sapiens
aggatgtaaacagtgcctg

SEQ ID NO: 4490336 - DNA, 20 bp, Homo sapiens
aggatgtaaacagtgcctgc

SEQ ID NO: 4490337 - DNA, 21 bp, Homo sapiens
aggatgtactgttgaaaaaga

SEQ ID NO: 4490338 - DNA, 20 bp, Homo sapiens
aggatgtatattttatataa

SEQ ID NO: 4490339 - DNA, 13 bp, Homo sapiens
aggatgtctgggc

SEQ ID NO: 4490340 - DNA, 20 bp, Homo sapiens
aggatgtgattgtggaatgg

SEQ ID NO: 4490341 - DNA, 20 bp, Homo sapiens
aggatgttagacttgctccc

SEQ ID NO: 4490342 - DNA, 21 bp, Homo sapiens
aggatgttagacttgctccct

SEQ ID NO: 4490343 - DNA, 17 bp, Homo sapiens
aggattaatatattgaa

SEQ ID NO: 4490344 - DNA, 15 bp, Homo sapiens
aggattctttcccca

SEQ ID NO: 4490345 - DNA, 24 bp, Homo sapiens
aggattgaaaatgtccaggaaagt

SEQ ID NO: 4490346 - DNA, 18 bp, Homo sapiens
aggattgcctttaatatt

SEQ ID NO: 4490347 - DNA, 13 bp, Homo sapiens
aggattttaccaa

SEQ ID NO: 4490348 - DNA, 14 bp, Homo sapiens
aggattttaccaaa

SEQ ID NO: 4490349 - DNA, 17 bp, Homo sapiens
aggattttaccaaagca

SEQ ID NO: 4490350 - DNA, 14 bp, Homo sapiens
aggattttcttttt

SEQ ID NO: 4490351 - DNA, 13 bp, Homo sapiens
aggcaaaattgca

SEQ ID NO: 4490352 - DNA, 21 bp, Homo sapiens
aggcaaagataatttatttca

SEQ ID NO: 4490353 - DNA, 22 bp, Homo sapiens
aggcaaagtttacagatgtttt

SEQ ID NO: 4490354 - DNA, 12 bp, Homo sapiens
aggcaaatattg

SEQ ID NO: 4490355 - DNA, 16 bp, Homo sapiens
aggcaaatattgaagt

SEQ ID NO: 4490356 - DNA, 16 bp, Homo sapiens
aggcaacagacttaaa

SEQ ID NO: 4490357 - DNA, 23 bp, Homo sapiens
aggcaacagggccatgtgctgcc

SEQ ID NO: 4490358 - DNA, 21 bp, Homo sapiens
aggcaagagggggtggagggg

SEQ ID NO: 4490359 - DNA, 16 bp, Homo sapiens
aggcaagcatgaataa

SEQ ID NO: 4490360 - DNA, 21 bp, Homo sapiens
aggcaagcgtgttctcagcac

SEQ ID NO: 4490361 - DNA, 21 bp, Homo sapiens
aggcaagctgaaattttagaa

SEQ ID NO: 4490362 - DNA, 17 bp, Homo sapiens
aggcaataaataaatgt

SEQ ID NO: 4490363 - DNA, 20 bp, Homo sapiens
aggcaataagaattactttg

SEQ ID NO: 4490364 - DNA, 17 bp, Homo sapiens
aggcaatcgttctgctg

SEQ ID NO: 4490365 - DNA, 21 bp, Homo sapiens
aggcaattagacactttggaa

SEQ ID NO: 4490366 - DNA, 18 bp, Homo sapiens
aggcaattttagtgtatt

SEQ ID NO: 4490367 - DNA, 13 bp, Homo sapiens
agctttagaccct

SEQ ID NO: 4490368 - DNA, 17 bp, Homo sapiens
agctttagaccctgggt

SEQ ID NO: 4490369 - DNA, 13 bp, Homo sapiens
agctttatctttg

SEQ ID NO: 4490370 - DNA, 16 bp, Homo sapiens
agctttatctttgtgt

SEQ ID NO: 4490371 - DNA, 17 bp, Homo sapiens
agctttatctttgtgta

SEQ ID NO: 4490372 - DNA, 12 bp, Homo sapiens
agctttatgatt

SEQ ID NO: 4490373 - DNA, 17 bp, Homo sapiens
agctttatgattttcat

SEQ ID NO: 4490374 - DNA, 21 bp, Homo sapiens
agctttatggtcctaaaagca

SEQ ID NO: 4490375 - DNA, 22 bp, Homo sapiens
agctttcatgtaaactgtgcac

SEQ ID NO: 4490376 - DNA, 20 bp, Homo sapiens
agctttcctcaaaaagcaga

SEQ ID NO: 4490377 - DNA, 20 bp, Homo sapiens
agctttgacgtattatctgt

SEQ ID NO: 4490378 - DNA, 22 bp, Homo sapiens
agctttgcatgttccactaacc

SEQ ID NO: 4490379 - DNA, 22 bp, Homo sapiens
agctttggaatattttatcctg

SEQ ID NO: 4490380 - DNA, 18 bp, Homo sapiens
agctttggacctaatcca

SEQ ID NO: 4490381 - DNA, 16 bp, Homo sapiens
agctttgtcacttgcc

SEQ ID NO: 4490382 - DNA, 19 bp, Homo sapiens
agctttgtcacttgccaca

SEQ ID NO: 4490383 - DNA, 13 bp, Homo sapiens
agcttttatggat

SEQ ID NO: 4490384 - DNA, 19 bp, Homo sapiens
agcttttattcctttgaat

SEQ ID NO: 4490385 - DNA, 15 bp, Homo sapiens
agcttttcattttaa

SEQ ID NO: 4490386 - DNA, 23 bp, Homo sapiens
agcttttgtgtgcctggtagaaa

SEQ ID NO: 4490387 - DNA, 13 bp, Homo sapiens
agcttttgttgtt

SEQ ID NO: 4490388 - DNA, 22 bp, Homo sapiens
agcttttgttttttaaatgact

SEQ ID NO: 4490389 - DNA, 12 bp, Homo sapiens
agctttttaatt

SEQ ID NO: 4490390 - DNA, 16 bp, Homo sapiens
agctttttattccctg

SEQ ID NO: 4490391 - DNA, 13 bp, Homo sapiens
agctttttggaat

SEQ ID NO: 4490392 - DNA, 14 bp, Homo sapiens
agcttttttcctgt

SEQ ID NO: 4490393 - DNA, 19 bp, Homo sapiens
aggaaaaaaactgggataa

SEQ ID NO: 4490394 - DNA, 15 bp, Homo sapiens
aggaaaaaaactttt

SEQ ID NO: 4490395 - DNA, 17 bp, Homo sapiens
aggaaaaacacaagcaa

SEQ ID NO: 4490396 - DNA, 19 bp, Homo sapiens
aggaaaaacacaagcaaaa

SEQ ID NO: 4490397 - DNA, 13 bp, Homo sapiens
aggaaaaacaggt

SEQ ID NO: 4490398 - DNA, 12 bp, Homo sapiens
aggaaaaagctc

SEQ ID NO: 4490399 - DNA, 20 bp, Homo sapiens
aggaaaacactatttccaaa

SEQ ID NO: 4490400 - DNA, 21 bp, Homo sapiens
aggaaaaggcccctgcaatgt

SEQ ID NO: 4490401 - DNA, 22 bp, Homo sapiens
aggaaaaggttgaataatatat

SEQ ID NO: 4490402 - DNA, 22 bp, Homo sapiens
aggaaaagtccacaagaacaat

SEQ ID NO: 4490403 - DNA, 19 bp, Homo sapiens
aggaaaagtgcaatgcgtg

SEQ ID NO: 4490404 - DNA, 16 bp, Homo sapiens
aggaaaagttctttca

SEQ ID NO: 4490405 - DNA, 16 bp, Homo sapiens
aggaaaatagtaatgt

SEQ ID NO: 4490406 - DNA, 17 bp, Homo sapiens
aggaaaatgtattgatt

SEQ ID NO: 4490407 - DNA, 14 bp, Homo sapiens
aggaaaattgaatg

SEQ ID NO: 4490408 - DNA, 21 bp, Homo sapiens
aggaaacaaaccttgccttga

SEQ ID NO: 4490409 - DNA, 22 bp, Homo sapiens
aggaaacagttgcatgtagtaa

SEQ ID NO: 4490410 - DNA, 16 bp, Homo sapiens
aggaaaccttttcttg

SEQ ID NO: 4490411 - DNA, 21 bp, Homo sapiens
aggaaactactgcctttagaa

SEQ ID NO: 4490412 - DNA, 16 bp, Homo sapiens
aggaaactccacatct

SEQ ID NO: 4490413 - DNA, 21 bp, Homo sapiens
aggaaactccacatctgcctt

SEQ ID NO: 4490414 - DNA, 18 bp, Homo sapiens
aggaaactgagtcactca

SEQ ID NO: 4490415 - DNA, 18 bp, Homo sapiens
aggaaagagcagtcagag

SEQ ID NO: 4490416 - DNA, 16 bp, Homo sapiens
aggaaagcaataaatg

SEQ ID NO: 4490417 - DNA, 18 bp, Homo sapiens
aggaaagcaataaatgaa

SEQ ID NO: 4490418 - DNA, 14 bp, Homo sapiens
aggaaagccctccc

SEQ ID NO: 4490419 - DNA, 24 bp, Homo sapiens
aggaaaggacggctgagcatgtgg

SEQ ID NO: 4490420 - DNA, 12 bp, Homo sapiens
aggaaaggattt

SEQ ID NO: 4490421 - DNA, 19 bp, Homo sapiens
aggaaaggattttaccaaa

SEQ ID NO: 4490422 - DNA, 17 bp, Homo sapiens
aggaaaggctcatttaa

SEQ ID NO: 4490423 - DNA, 18 bp, Homo sapiens
aggaaaggctcatttaaa

SEQ ID NO: 4490424 - DNA, 15 bp, Homo sapiens
aggaaagtttcttca

SEQ ID NO: 4490425 - DNA, 20 bp, Homo sapiens
aggaaagtttgccaggagga

SEQ ID NO: 4490426 - DNA, 20 bp, Homo sapiens
aggaaataaaaaagtctcta

SEQ ID NO: 4490427 - DNA, 22 bp, Homo sapiens
aggaaataaaaaagtctctatt

SEQ ID NO: 4490428 - DNA, 14 bp, Homo sapiens
aggaaataaacatt

SEQ ID NO: 4490429 - DNA, 13 bp, Homo sapiens
aggaaatcaaatg

SEQ ID NO: 4490430 - DNA, 22 bp, Homo sapiens
aggaaattctttcccagtctgt

SEQ ID NO: 4490431 - DNA, 15 bp, Homo sapiens
aggaacaaagacagg

SEQ ID NO: 4490432 - DNA, 22 bp, Homo sapiens
aggaacacctgatcttacagaa

SEQ ID NO: 4490433 - DNA, 16 bp, Homo sapiens
aggaacatatgaaaat

SEQ ID NO: 4490434 - DNA, 19 bp, Homo sapiens
aggaacatatgaaaataca

SEQ ID NO: 4490435 - DNA, 19 bp, Homo sapiens
aggaacatggagctgtcat

SEQ ID NO: 4490436 - DNA, 20 bp, Homo sapiens
aggaacatggagctgtcatc

SEQ ID NO: 4490437 - DNA, 16 bp, Homo sapiens
aggaaccgaggcaggg

SEQ ID NO: 4490438 - DNA, 23 bp, Homo sapiens
aggaaccgagggggctgctccca

SEQ ID NO: 4490439 - DNA, 17 bp, Homo sapiens
aggaacctcgagtactg

SEQ ID NO: 4490440 - DNA, 18 bp, Homo sapiens
aggaacctcgagtactgt

SEQ ID NO: 4490441 - DNA, 20 bp, Homo sapiens
aggaacctcgagtactgtgg

SEQ ID NO: 4490442 - DNA, 21 bp, Homo sapiens
aggaacctctgatttattttg

SEQ ID NO: 4490443 - DNA, 13 bp, Homo sapiens
aggaacctgtcct

SEQ ID NO: 4490444 - DNA, 14 bp, Homo sapiens
aggaaccttccttc

SEQ ID NO: 4490445 - DNA, 15 bp, Homo sapiens
aggaacggctctggg

SEQ ID NO: 4490446 - DNA, 23 bp, Homo sapiens
aggaacgggcagcctgggcctgg

SEQ ID NO: 4490447 - DNA, 20 bp, Homo sapiens
aggaactagtaaacatatgt

SEQ ID NO: 4490448 - DNA, 13 bp, Homo sapiens
aggaactgtacag

SEQ ID NO: 4490449 - DNA, 15 bp, Homo sapiens
aggaagaaagaatgt

SEQ ID NO: 4490450 - DNA, 20 bp, Homo sapiens
aggaagaacaacaaagacat

SEQ ID NO: 4490451 - DNA, 17 bp, Homo sapiens
aggaagacagttctaca

SEQ ID NO: 4490452 - DNA, 11 bp, Homo sapiens
aggaagagcca

SEQ ID NO: 4490453 - DNA, 13 bp, Homo sapiens
aggaagagccacc

SEQ ID NO: 4490454 - DNA, 21 bp, Homo sapiens
aggaagagccacctgcaagat

SEQ ID NO: 4490455 - DNA, 15 bp, Homo sapiens
aggaagcaagcttaa

SEQ ID NO: 4490456 - DNA, 15 bp, Homo sapiens
aggaagcattgtaaa

SEQ ID NO: 4490457 - DNA, 11 bp, Homo sapiens
aggaagccaga

SEQ ID NO: 4490458 - DNA, 14 bp, Homo sapiens
aggaagccgtcctg

SEQ ID NO: 4490459 - DNA, 12 bp, Homo sapiens
aggaaggaaact

SEQ ID NO: 4490460 - DNA, 13 bp, Homo sapiens
aggaaggaaactg

SEQ ID NO: 4490461 - DNA, 16 bp, Homo sapiens
aggaaggaacaaagac

SEQ ID NO: 4490462 - DNA, 23 bp, Homo sapiens
aggaaggagactcacctctgcct

SEQ ID NO: 4490463 - DNA, 15 bp, Homo sapiens
aggaaggatgccact

SEQ ID NO: 4490464 - DNA, 19 bp, Homo sapiens
aggaaggcagcattccatg

SEQ ID NO: 4490465 - DNA, 19 bp, Homo sapiens
aggaagggatgtatttgta

SEQ ID NO: 4490466 - DNA, 17 bp, Homo sapiens
aggaagggcaggaagga

SEQ ID NO: 4490467 - DNA, 21 bp, Homo sapiens
aggaagggccattttggtgct

SEQ ID NO: 4490468 - DNA, 23 bp, Homo sapiens
aggaagggccattttggtgctta

SEQ ID NO: 4490469 - DNA, 12 bp, Homo sapiens
aggaagggctgg

SEQ ID NO: 4490470 - DNA, 13 bp, Homo sapiens
aggaagggctggg

SEQ ID NO: 4490471 - DNA, 17 bp, Homo sapiens
aggaagggctgggccac

SEQ ID NO: 4490472 - DNA, 19 bp, Homo sapiens
aggaaggtgaatctgccct

SEQ ID NO: 4490473 - DNA, 15 bp, Homo sapiens
aggaagtagaaacaa

SEQ ID NO: 4490474 - DNA, 13 bp, Homo sapiens
aggaagtagagga

SEQ ID NO: 4490475 - DNA, 14 bp, Homo sapiens
aggaagtaggaagt

SEQ ID NO: 4490476 - DNA, 18 bp, Homo sapiens
aggaagtcaaagcaagga

SEQ ID NO: 4490477 - DNA, 15 bp, Homo sapiens
aggaagtggctcaga

SEQ ID NO: 4490478 - DNA, 16 bp, Homo sapiens
aggaagtgtgtttgcc

SEQ ID NO: 4490479 - DNA, 22 bp, Homo sapiens
aggaagttgacttatagtacat

SEQ ID NO: 4490480 - DNA, 14 bp, Homo sapiens
aggaataaatgaga

SEQ ID NO: 4490481 - DNA, 16 bp, Homo sapiens
aggaatacattttatt

SEQ ID NO: 4490482 - DNA, 18 bp, Homo sapiens
aggaatacattttattct

SEQ ID NO: 4490483 - DNA, 20 bp, Homo sapiens
aggaatatctgttcccagcc

SEQ ID NO: 4490484 - DNA, 21 bp, Homo sapiens
aggaatatctgttcccagccc

SEQ ID NO: 4490485 - DNA, 16 bp, Homo sapiens
aggaatcaagagctgc

SEQ ID NO: 4490486 - DNA, 19 bp, Homo sapiens
aggaatcaagagctgccct

SEQ ID NO: 4490487 - DNA, 16 bp, Homo sapiens
aggaatcacccctctg

SEQ ID NO: 4490488 - DNA, 16 bp, Homo sapiens
agatacactgcacttt

SEQ ID NO: 4490489 - DNA, 16 bp, Homo sapiens
agatacatgattgaaa

SEQ ID NO: 4490490 - DNA, 18 bp, Homo sapiens
agataccttgaaaggaag

SEQ ID NO: 4490491 - DNA, 18 bp, Homo sapiens
agatactaaggacgttgt

SEQ ID NO: 4490492 - DNA, 18 bp, Homo sapiens
agatactctcttcttctc

SEQ ID NO: 4490493 - DNA, 14 bp, Homo sapiens
agatagcgcatata

SEQ ID NO: 4490494 - DNA, 18 bp, Homo sapiens
agatagcgcatatatttg

SEQ ID NO: 4490495 - DNA, 14 bp, Homo sapiens
agataggaaactga

SEQ ID NO: 4490496 - DNA, 21 bp, Homo sapiens
agatagtatgcactatataca

SEQ ID NO: 4490497 - DNA, 15 bp, Homo sapiens
agatagtgccaggtg

SEQ ID NO: 4490498 - DNA, 19 bp, Homo sapiens
agatagtgtaacttgctta

SEQ ID NO: 4490499 - DNA, 14 bp, Homo sapiens
agatagttttcatt

SEQ ID NO: 4490500 - DNA, 17 bp, Homo sapiens
agatataactgtcttgt

SEQ ID NO: 4490501 - DNA, 16 bp, Homo sapiens
agatataatgaacaaa

SEQ ID NO: 4490502 - DNA, 17 bp, Homo sapiens
agatatcagtgtctccc

SEQ ID NO: 4490503 - DNA, 17 bp, Homo sapiens
agatatcctctccccct

SEQ ID NO: 4490504 - DNA, 19 bp, Homo sapiens
agatatcgagagtttctat

SEQ ID NO: 4490505 - DNA, 18 bp, Homo sapiens
agatatgaacatattgtt

SEQ ID NO: 4490506 - DNA, 23 bp, Homo sapiens
agatatggaagaacgaggtttat

SEQ ID NO: 4490507 - DNA, 21 bp, Homo sapiens
agatattactacttaccattt

SEQ ID NO: 4490508 - DNA, 15 bp, Homo sapiens
agatattatttgtct

SEQ ID NO: 4490509 - DNA, 19 bp, Homo sapiens
agatattatttgtcttaaa

SEQ ID NO: 4490510 - DNA, 19 bp, Homo sapiens
agatattgaaggagaaaat

SEQ ID NO: 4490511 - DNA, 17 bp, Homo sapiens
agatattgctactataa

SEQ ID NO: 4490512 - DNA, 20 bp, Homo sapiens
agatatttaggaaaatgctt

SEQ ID NO: 4490513 - DNA, 21 bp, Homo sapiens
agatatttaggaaaatgctta

SEQ ID NO: 4490514 - DNA, 19 bp, Homo sapiens
agatatttttatctttata

SEQ ID NO: 4490515 - DNA, 12 bp, Homo sapiens
agatatttttgt

SEQ ID NO: 4490516 - DNA, 17 bp, Homo sapiens
agatatttttgtacgtt

SEQ ID NO: 4490517 - DNA, 23 bp, Homo sapiens
agatatttttgtacgttatatat

SEQ ID NO: 4490518 - DNA, 12 bp, Homo sapiens
agatcaaagatg

SEQ ID NO: 4490519 - DNA, 14 bp, Homo sapiens
agatcaaatagttg

SEQ ID NO: 4490520 - DNA, 19 bp, Homo sapiens
agatcaaatagttgcatag

SEQ ID NO: 4490521 - DNA, 22 bp, Homo sapiens
agatcaacaacactacttccct

SEQ ID NO: 4490522 - DNA, 20 bp, Homo sapiens
agatcacatcttaaattcat

SEQ ID NO: 4490523 - DNA, 22 bp, Homo sapiens
agatcacgccattgtactccag

SEQ ID NO: 4490524 - DNA, 13 bp, Homo sapiens
agatcagtaaaga

SEQ ID NO: 4490525 - DNA, 22 bp, Homo sapiens
agatcatcctaacaatgtgggg

SEQ ID NO: 4490526 - DNA, 20 bp, Homo sapiens
agatcatggacctggtgccc

SEQ ID NO: 4490527 - DNA, 16 bp, Homo sapiens
agatcatttggagctc

SEQ ID NO: 4490528 - DNA, 23 bp, Homo sapiens
agatccaagccaagttttctcaa

SEQ ID NO: 4490529 - DNA, 22 bp, Homo sapiens
agatccagttgaatatttaaag

SEQ ID NO: 4490530 - DNA, 17 bp, Homo sapiens
agatccccaactgctcc

SEQ ID NO: 4490531 - DNA, 21 bp, Homo sapiens
agatccccaactgctccagcc

SEQ ID NO: 4490532 - DNA, 23 bp, Homo sapiens
agatccccaactgctccagcctc

SEQ ID NO: 4490533 - DNA, 15 bp, Homo sapiens
agatccccagcccct

SEQ ID NO: 4490534 - DNA, 22 bp, Homo sapiens
agatccccagcccctcctccct

SEQ ID NO: 4490535 - DNA, 16 bp, Homo sapiens
agatccctgcagaacc

SEQ ID NO: 4490536 - DNA, 12 bp, Homo sapiens
agatcctaaact

SEQ ID NO: 4490537 - DNA, 17 bp, Homo sapiens
agatcctctctggggct

SEQ ID NO: 4490538 - DNA, 15 bp, Homo sapiens
agatcctgcacccca

SEQ ID NO: 4490539 - DNA, 17 bp, Homo sapiens
agatcctgcaccccagc

SEQ ID NO: 4490540 - DNA, 20 bp, Homo sapiens
agatcctgttacttgcttca

SEQ ID NO: 4490541 - DNA, 22 bp, Homo sapiens
agatcgtgccgttactctccaa

SEQ ID NO: 4490542 - DNA, 19 bp, Homo sapiens
agatcgtgctactgcactc

SEQ ID NO: 4490543 - DNA, 14 bp, Homo sapiens
agatctaaacagtt

SEQ ID NO: 4490544 - DNA, 22 bp, Homo sapiens
agatctcggtttgccaaaattc

SEQ ID NO: 4490545 - DNA, 12 bp, Homo sapiens
agatctgtgccc

SEQ ID NO: 4490546 - DNA, 14 bp, Homo sapiens
agatctgtgcccca

SEQ ID NO: 4490547 - DNA, 19 bp, Homo sapiens
agatctgtgccccatgcct

SEQ ID NO: 4490548 - DNA, 14 bp, Homo sapiens
agatctgttttgaa

SEQ ID NO: 4490549 - DNA, 19 bp, Homo sapiens
agatcttaatataaattca

SEQ ID NO: 4490550 - DNA, 17 bp, Homo sapiens
agatcttccgtggtcag

SEQ ID NO: 4490551 - DNA, 13 bp, Homo sapiens
agatgaaaactag

SEQ ID NO: 4490552 - DNA, 14 bp, Homo sapiens
agatgaaataattt

SEQ ID NO: 4490553 - DNA, 22 bp, Homo sapiens
agatgaaatatatattgtaaag

SEQ ID NO: 4490554 - DNA, 15 bp, Homo sapiens
agatgaagttttaca

SEQ ID NO: 4490555 - DNA, 19 bp, Homo sapiens
agatgaagttttacattgt

SEQ ID NO: 4490556 - DNA, 11 bp, Homo sapiens
agatgaataaa

SEQ ID NO: 4490557 - DNA, 20 bp, Homo sapiens
agatgagaaagcttttattc

SEQ ID NO: 4490558 - DNA, 22 bp, Homo sapiens
agatgagaaagcttttattcct

SEQ ID NO: 4490559 - DNA, 20 bp, Homo sapiens
agatgagaaatgatgaaaag

SEQ ID NO: 4490560 - DNA, 16 bp, Homo sapiens
agatgagatgaccacc

SEQ ID NO: 4490561 - DNA, 21 bp, Homo sapiens
agatgagcaaccacatttaga

SEQ ID NO: 4490562 - DNA, 16 bp, Homo sapiens
agatgagcaggagctt

SEQ ID NO: 4490563 - DNA, 15 bp, Homo sapiens
agatgaggaggggag

SEQ ID NO: 4490564 - DNA, 18 bp, Homo sapiens
agatgaggtcagttgtgt

SEQ ID NO: 4490565 - DNA, 14 bp, Homo sapiens
agatgataaagaga

SEQ ID NO: 4490566 - DNA, 16 bp, Homo sapiens
agatgataaagagaca

SEQ ID NO: 4490567 - DNA, 18 bp, Homo sapiens
agatgataatttagtgga

SEQ ID NO: 4490568 - DNA, 15 bp, Homo sapiens
agatgatctctccac

SEQ ID NO: 4490569 - DNA, 19 bp, Homo sapiens
agatgatggatgccaatat

SEQ ID NO: 4490570 - DNA, 18 bp, Homo sapiens
agatgatttcccccctcc

SEQ ID NO: 4490571 - DNA, 20 bp, Homo sapiens
agatgattttttgaaagtta

SEQ ID NO: 4490572 - DNA, 17 bp, Homo sapiens
agatgcaaggaccagga

SEQ ID NO: 4490573 - DNA, 18 bp, Homo sapiens
agatgcaattgctcccat

SEQ ID NO: 4490574 - DNA, 13 bp, Homo sapiens
agatgcactcgct

SEQ ID NO: 4490575 - DNA, 21 bp, Homo sapiens
agatgcatcgggaaagaagaa

SEQ ID NO: 4490576 - DNA, 22 bp, Homo sapiens
agatgcatcgggaaagaagaaa

SEQ ID NO: 4490577 - DNA, 19 bp, Homo sapiens
agatgcccgagggagggga

SEQ ID NO: 4490578 - DNA, 13 bp, Homo sapiens
agatgcctccacc

SEQ ID NO: 4490579 - DNA, 18 bp, Homo sapiens
agatgcctcttaggactg

SEQ ID NO: 4490580 - DNA, 13 bp, Homo sapiens
agatgcctggtga

SEQ ID NO: 4490581 - DNA, 15 bp, Homo sapiens
agatgcctgttaatt

SEQ ID NO: 4490582 - DNA, 19 bp, Homo sapiens
agatgcctgttaatttata

SEQ ID NO: 4490583 - DNA, 23 bp, Homo sapiens
agatgcgcattctaacctggagg

SEQ ID NO: 4490584 - DNA, 13 bp, Homo sapiens
agatgctatggaa

SEQ ID NO: 4490585 - DNA, 13 bp, Homo sapiens
agatgctccaggg

SEQ ID NO: 4490586 - DNA, 15 bp, Homo sapiens
agatgctggtggagg

SEQ ID NO: 4490587 - DNA, 15 bp, Homo sapiens
agatgcttggagcaa

SEQ ID NO: 4490588 - DNA, 19 bp, Homo sapiens
agatgcttggagcaatcag

SEQ ID NO: 4490589 - DNA, 21 bp, Homo sapiens
agatggaaaaataacaactat

SEQ ID NO: 4490590 - DNA, 14 bp, Homo sapiens
agatggaaatacag

SEQ ID NO: 4490591 - DNA, 15 bp, Homo sapiens
agatggaccccagca

SEQ ID NO: 4490592 - DNA, 13 bp, Homo sapiens
agatggagcccat

SEQ ID NO: 4490593 - DNA, 17 bp, Homo sapiens
agatggagggggctggg

SEQ ID NO: 4490594 - DNA, 15 bp, Homo sapiens
agatggcaacattgg

SEQ ID NO: 4490595 - DNA, 15 bp, Homo sapiens
agatggccatgctca

SEQ ID NO: 4490596 - DNA, 22 bp, Homo sapiens
agatggcttccgtgagacacaa

SEQ ID NO: 4490597 - DNA, 15 bp, Homo sapiens
agatgggacagcaac

SEQ ID NO: 4490598 - DNA, 21 bp, Homo sapiens
agatgggagaatcacttgaac

SEQ ID NO: 4490599 - DNA, 13 bp, Homo sapiens
agatgggagctcc

SEQ ID NO: 4490600 - DNA, 14 bp, Homo sapiens
agatgggaggtgga

SEQ ID NO: 4490601 - DNA, 21 bp, Homo sapiens
agatgggaggtggaagcagag

SEQ ID NO: 4490602 - DNA, 22 bp, Homo sapiens
agatgggcaaaccctggtgctt

SEQ ID NO: 4490603 - DNA, 18 bp, Homo sapiens
agatgggcatcttttgta

SEQ ID NO: 4490604 - DNA, 22 bp, Homo sapiens
agatgggcatcttttgtattaa

SEQ ID NO: 4490605 - DNA, 19 bp, Homo sapiens
agatggggcatataataaa

SEQ ID NO: 4490606 - DNA, 21 bp, Homo sapiens
agatggggcatataataaaga

SEQ ID NO: 4490607 - DNA, 23 bp, Homo sapiens
agatgggtccaggggtctgtctg

SEQ ID NO: 4490608 - DNA, 21 bp, Homo sapiens
agaggagggcgtgactcaccc

SEQ ID NO: 4490609 - DNA, 21 bp, Homo sapiens
agaggagtaaataattggaaa

SEQ ID NO: 4490610 - DNA, 16 bp, Homo sapiens
agaggagtgactgagc

SEQ ID NO: 4490611 - DNA, 19 bp, Homo sapiens
agaggagtgcagccttctc

SEQ ID NO: 4490612 - DNA, 14 bp, Homo sapiens
agaggatacattta

SEQ ID NO: 4490613 - DNA, 19 bp, Homo sapiens
agaggatgcttagtcttaa

SEQ ID NO: 4490614 - DNA, 20 bp, Homo sapiens
agaggcaataaataaatgtt

SEQ ID NO: 4490615 - DNA, 11 bp, Homo sapiens
agaggcaccag

SEQ ID NO: 4490616 - DNA, 16 bp, Homo sapiens
agaggcagcccgcaca

SEQ ID NO: 4490617 - DNA, 13 bp, Homo sapiens
agaggcaggctgg

SEQ ID NO: 4490618 - DNA, 15 bp, Homo sapiens
agaggcatcttttct

SEQ ID NO: 4490619 - DNA, 17 bp, Homo sapiens
agaggccagacatggtg

SEQ ID NO: 4490620 - DNA, 14 bp, Homo sapiens
agaggccctgcccc

SEQ ID NO: 4490621 - DNA, 15 bp, Homo sapiens
agaggccctgccccc

SEQ ID NO: 4490622 - DNA, 19 bp, Homo sapiens
agaggccttgggtgttcca

SEQ ID NO: 4490623 - DNA, 16 bp, Homo sapiens
agaggctacagggcca

SEQ ID NO: 4490624 - DNA, 22 bp, Homo sapiens
agaggctccagctctggcacag

SEQ ID NO: 4490625 - DNA, 18 bp, Homo sapiens
agaggctcgaggggctca

SEQ ID NO: 4490626 - DNA, 22 bp, Homo sapiens
agaggctctggacagcagaagc

SEQ ID NO: 4490627 - DNA, 22 bp, Homo sapiens
agaggctgcacccctgggccag

SEQ ID NO: 4490628 - DNA, 14 bp, Homo sapiens
agaggctgcccctc

SEQ ID NO: 4490629 - DNA, 16 bp, Homo sapiens
agaggctgcccctctc

SEQ ID NO: 4490630 - DNA, 21 bp, Homo sapiens
agaggcttctccgccagcctc

SEQ ID NO: 4490631 - DNA, 23 bp, Homo sapiens
agaggcttctcctgttttatata

SEQ ID NO: 4490632 - DNA, 18 bp, Homo sapiens
agagggaaaacagaaaac

SEQ ID NO: 4490633 - DNA, 22 bp, Homo sapiens
agagggaccaaattgcttctag

SEQ ID NO: 4490634 - DNA, 20 bp, Homo sapiens
agagggaggtcactggaaag

SEQ ID NO: 4490635 - DNA, 16 bp, Homo sapiens
agagggcactctgctt

SEQ ID NO: 4490636 - DNA, 15 bp, Homo sapiens
agagggcccagccca

SEQ ID NO: 4490637 - DNA, 16 bp, Homo sapiens
agagggcccagcccag

SEQ ID NO: 4490638 - DNA, 17 bp, Homo sapiens
agagggcccagcccaga

SEQ ID NO: 4490639 - DNA, 19 bp, Homo sapiens
agagggcccagcccagagc

SEQ ID NO: 4490640 - DNA, 10 bp, Homo sapiens
agagggctgc

SEQ ID NO: 4490641 - DNA, 11 bp, Homo sapiens
agagggctgga

SEQ ID NO: 4490642 - DNA, 13 bp, Homo sapiens
agagggcttcctc

SEQ ID NO: 4490643 - DNA, 19 bp, Homo sapiens
agagggctttttaaatttg

SEQ ID NO: 4490644 - DNA, 22 bp, Homo sapiens
agaggggagacattagaaaaaa

SEQ ID NO: 4490645 - DNA, 16 bp, Homo sapiens
agaggggcaccttttc

SEQ ID NO: 4490646 - DNA, 13 bp, Homo sapiens
agaggggcgggct

SEQ ID NO: 4490647 - DNA, 14 bp, Homo sapiens
agaggggcgggctc

SEQ ID NO: 4490648 - DNA, 18 bp, Homo sapiens
agaggggcgggctcagag

SEQ ID NO: 4490649 - DNA, 20 bp, Homo sapiens
agaggggcgggctcagagct

SEQ ID NO: 4490650 - DNA, 12 bp, Homo sapiens
agaggggctgca

SEQ ID NO: 4490651 - DNA, 19 bp, Homo sapiens
agagggggagtagccaagc

SEQ ID NO: 4490652 - DNA, 18 bp, Homo sapiens
agagggtctggagaagca

SEQ ID NO: 4490653 - DNA, 22 bp, Homo sapiens
agagggtgggagcctaaggaag

SEQ ID NO: 4490654 - DNA, 15 bp, Homo sapiens
agagggtgtcatcta

SEQ ID NO: 4490655 - DNA, 16 bp, Homo sapiens
agagggtgtcctgcac

SEQ ID NO: 4490656 - DNA, 22 bp, Homo sapiens
agagggtgtggctttccaggca

SEQ ID NO: 4490657 - DNA, 21 bp, Homo sapiens
agaggtatcttactttcctct

SEQ ID NO: 4490658 - DNA, 12 bp, Homo sapiens
agaggtccaggc

SEQ ID NO: 4490659 - DNA, 15 bp, Homo sapiens
agaggtccaggcccc

SEQ ID NO: 4490660 - DNA, 12 bp, Homo sapiens
agaggtccaggt

SEQ ID NO: 4490661 - DNA, 18 bp, Homo sapiens
agaggtccaggtcccagc

SEQ ID NO: 4490662 - DNA, 23 bp, Homo sapiens
agaggtccaggtcccagcccctc

SEQ ID NO: 4490663 - DNA, 18 bp, Homo sapiens
agaggtctcatctcccag

SEQ ID NO: 4490664 - DNA, 20 bp, Homo sapiens
agaggtctcatctcccaggc

SEQ ID NO: 4490665 - DNA, 14 bp, Homo sapiens
agaggtctgagccc

SEQ ID NO: 4490666 - DNA, 16 bp, Homo sapiens
agaggtgagaaattta

SEQ ID NO: 4490667 - DNA, 17 bp, Homo sapiens
agaggtgagaaatttaa

SEQ ID NO: 4490668 - DNA, 20 bp, Homo sapiens
agaggtgggatcctccctca

SEQ ID NO: 4490669 - DNA, 19 bp, Homo sapiens
agaggtggggatcctgcct

SEQ ID NO: 4490670 - DNA, 14 bp, Homo sapiens
agaggttaggagta

SEQ ID NO: 4490671 - DNA, 17 bp, Homo sapiens
agaggttttatttacat

SEQ ID NO: 4490672 - DNA, 19 bp, Homo sapiens
agagtacactcagccactg

SEQ ID NO: 4490673 - DNA, 17 bp, Homo sapiens
agagtactttggtttct

SEQ ID NO: 4490674 - DNA, 15 bp, Homo sapiens
agagtagaattgcat

SEQ ID NO: 4490675 - DNA, 18 bp, Homo sapiens
agagtagaattgcattga

SEQ ID NO: 4490676 - DNA, 21 bp, Homo sapiens
agagtcaactacacaaagcag

SEQ ID NO: 4490677 - DNA, 22 bp, Homo sapiens
agagtcagaactaactttggtc

SEQ ID NO: 4490678 - DNA, 16 bp, Homo sapiens
agagtcagaggagaag

SEQ ID NO: 4490679 - DNA, 14 bp, Homo sapiens
agagtcagatcttt

SEQ ID NO: 4490680 - DNA, 18 bp, Homo sapiens
agagtccactgtggcact

SEQ ID NO: 4490681 - DNA, 16 bp, Homo sapiens
agagtccagtgctctg

SEQ ID NO: 4490682 - DNA, 22 bp, Homo sapiens
agagtccagtgctctgcctcag

SEQ ID NO: 4490683 - DNA, 23 bp, Homo sapiens
agagtccagtgctctgcctcaga

SEQ ID NO: 4490684 - DNA, 17 bp, Homo sapiens
agagtccctgcctggac

SEQ ID NO: 4490685 - DNA, 14 bp, Homo sapiens
agagtcctcactcc

SEQ ID NO: 4490686 - DNA, 17 bp, Homo sapiens
agagtctattgtctcct

SEQ ID NO: 4490687 - DNA, 17 bp, Homo sapiens
agagtctccagttactg

SEQ ID NO: 4490688 - DNA, 23 bp, Homo sapiens
agagtctggtgaagctcacttct

SEQ ID NO: 4490689 - DNA, 14 bp, Homo sapiens
agagtgaacaaatt

SEQ ID NO: 4490690 - DNA, 14 bp, Homo sapiens
agagtgaagggaag

SEQ ID NO: 4490691 - DNA, 22 bp, Homo sapiens
agagtgacctcggacagagccc

SEQ ID NO: 4490692 - DNA, 18 bp, Homo sapiens
agagtgagaccatgtttc

SEQ ID NO: 4490693 - DNA, 16 bp, Homo sapiens
agagtgcactactgta

SEQ ID NO: 4490694 - DNA, 15 bp, Homo sapiens
agagtgctggactgt

SEQ ID NO: 4490695 - DNA, 15 bp, Homo sapiens
agagtggacctgtgc

SEQ ID NO: 4490696 - DNA, 18 bp, Homo sapiens
agagtggacctgtgctgt

SEQ ID NO: 4490697 - DNA, 18 bp, Homo sapiens
agagtggagtctgagtct

SEQ ID NO: 4490698 - DNA, 12 bp, Homo sapiens
agagtggcccac

SEQ ID NO: 4490699 - DNA, 14 bp, Homo sapiens
agagtggcctccct

SEQ ID NO: 4490700 - DNA, 15 bp, Homo sapiens
agagtggcctccctg

SEQ ID NO: 4490701 - DNA, 21 bp, Homo sapiens
agagtggcctccctgctgtgc

SEQ ID NO: 4490702 - DNA, 11 bp, Homo sapiens
agagtggcctg

SEQ ID NO: 4490703 - DNA, 14 bp, Homo sapiens
agagtggctttcta

SEQ ID NO: 4490704 - DNA, 15 bp, Homo sapiens
agagtggtggcctat

SEQ ID NO: 4490705 - DNA, 20 bp, Homo sapiens
agagtgtgggggaggcgcac

SEQ ID NO: 4490706 - DNA, 18 bp, Homo sapiens
agagtgtgttataaaata

SEQ ID NO: 4490707 - DNA, 17 bp, Homo sapiens
agagttaaacttagaga

SEQ ID NO: 4490708 - DNA, 11 bp, Homo sapiens
agagttacagt

SEQ ID NO: 4490709 - DNA, 15 bp, Homo sapiens
agagttacagttctg

SEQ ID NO: 4490710 - DNA, 16 bp, Homo sapiens
agagttacagttctgt

SEQ ID NO: 4490711 - DNA, 17 bp, Homo sapiens
agagttatcttctttat

SEQ ID NO: 4490712 - DNA, 23 bp, Homo sapiens
agagttctttgctgcccctgtct

SEQ ID NO: 4490713 - DNA, 15 bp, Homo sapiens
agagtttctgtttga

SEQ ID NO: 4490714 - DNA, 19 bp, Homo sapiens
agagttttattcctttcct

SEQ ID NO: 4490715 - DNA, 14 bp, Homo sapiens
agataaaagcaatt

SEQ ID NO: 4490716 - DNA, 23 bp, Homo sapiens
agataaaaggtggagtttctctg

SEQ ID NO: 4490717 - DNA, 17 bp, Homo sapiens
agataaagaccagaaat

SEQ ID NO: 4490718 - DNA, 17 bp, Homo sapiens
agataacccttattcca

SEQ ID NO: 4490719 - DNA, 13 bp, Homo sapiens
agataacttcttt

SEQ ID NO: 4490720 - DNA, 20 bp, Homo sapiens
agataaggagaaagaaagta

SEQ ID NO: 4490721 - DNA, 20 bp, Homo sapiens
agataatattttacatacac

SEQ ID NO: 4490722 - DNA, 23 bp, Homo sapiens
agataatcaagggcactgtgata

SEQ ID NO: 4490723 - DNA, 19 bp, Homo sapiens
agataatttacaagatatt

SEQ ID NO: 4490724 - DNA, 20 bp, Homo sapiens
agataatttatttcaataaa

SEQ ID NO: 4490725 - DNA, 19 bp, Homo sapiens
agatacaaggcccagaagc

SEQ ID NO: 4490726 - DNA, 12 bp, Homo sapiens
agatacaataaa

SEQ ID NO: 4490727 - DNA, 13 bp, Homo sapiens
agatacaataaaa

SEQ ID NO: 4490728 - DNA, 13 bp, Homo sapiens
agatacaataaat

SEQ ID NO: 4490729 - DNA, 17 bp, Homo sapiens
agagatatggcagcgaa

SEQ ID NO: 4490730 - DNA, 15 bp, Homo sapiens
agagatatttatgta

SEQ ID NO: 4490731 - DNA, 20 bp, Homo sapiens
agagatccctgcagaaccca

SEQ ID NO: 4490732 - DNA, 13 bp, Homo sapiens
agagatctacaca

SEQ ID NO: 4490733 - DNA, 20 bp, Homo sapiens
agagatctctgtagaaggag

SEQ ID NO: 4490734 - DNA, 16 bp, Homo sapiens
agagatgaaataattt

SEQ ID NO: 4490735 - DNA, 15 bp, Homo sapiens
agagatgagaaatga

SEQ ID NO: 4490736 - DNA, 12 bp, Homo sapiens
agagatgagccc

SEQ ID NO: 4490737 - DNA, 14 bp, Homo sapiens
agagatgagcccac

SEQ ID NO: 4490738 - DNA, 15 bp, Homo sapiens
agagatgattcagag

SEQ ID NO: 4490739 - DNA, 17 bp, Homo sapiens
agagatgcctccaccgc

SEQ ID NO: 4490740 - DNA, 23 bp, Homo sapiens
agagatgcctccaccgctgccta

SEQ ID NO: 4490741 - DNA, 22 bp, Homo sapiens
agagatgcttggagcaatcaga

SEQ ID NO: 4490742 - DNA, 20 bp, Homo sapiens
agagatgggagctcctctcc

SEQ ID NO: 4490743 - DNA, 23 bp, Homo sapiens
agagatgtccatttttacaagtt

SEQ ID NO: 4490744 - DNA, 16 bp, Homo sapiens
agagattacctcctga

SEQ ID NO: 4490745 - DNA, 13 bp, Homo sapiens
agagattcatttt

SEQ ID NO: 4490746 - DNA, 23 bp, Homo sapiens
agagattctgaactaaagtgctg

SEQ ID NO: 4490747 - DNA, 21 bp, Homo sapiens
agagattgtggtggtgctaaa

SEQ ID NO: 4490748 - DNA, 15 bp, Homo sapiens
agagcaaacagaaaa

SEQ ID NO: 4490749 - DNA, 17 bp, Homo sapiens
agagcaaagatggcttc

SEQ ID NO: 4490750 - DNA, 19 bp, Homo sapiens
agagcaaagcatcaaagaa

SEQ ID NO: 4490751 - DNA, 16 bp, Homo sapiens
agagcaaaggagaaat

SEQ ID NO: 4490752 - DNA, 18 bp, Homo sapiens
agagcaaaggagaaatct

SEQ ID NO: 4490753 - DNA, 21 bp, Homo sapiens
agagcaagaaggaaagatttg

SEQ ID NO: 4490754 - DNA, 19 bp, Homo sapiens
agagcaagtcctcactctt

SEQ ID NO: 4490755 - DNA, 15 bp, Homo sapiens
agagcaccccctgct

SEQ ID NO: 4490756 - DNA, 15 bp, Homo sapiens
agagcactagaagtg

SEQ ID NO: 4490757 - DNA, 13 bp, Homo sapiens
agagcactcccta

SEQ ID NO: 4490758 - DNA, 12 bp, Homo sapiens
agagcagaggtc

SEQ ID NO: 4490759 - DNA, 13 bp, Homo sapiens
agagcagcactcc

SEQ ID NO: 4490760 - DNA, 12 bp, Homo sapiens
agagcagcagca

SEQ ID NO: 4490761 - DNA, 16 bp, Homo sapiens
agagcagcctgtggca

SEQ ID NO: 4490762 - DNA, 21 bp, Homo sapiens
agagcaggactccaggcccaa

SEQ ID NO: 4490763 - DNA, 18 bp, Homo sapiens
agagcaggggctccagca

SEQ ID NO: 4490764 - DNA, 16 bp, Homo sapiens
agagcataaaacctaa

SEQ ID NO: 4490765 - DNA, 14 bp, Homo sapiens
agagcatctgcccc

SEQ ID NO: 4490766 - DNA, 16 bp, Homo sapiens
agagcatctgccccag

SEQ ID NO: 4490767 - DNA, 18 bp, Homo sapiens
agagcatggatgcatttc

SEQ ID NO: 4490768 - DNA, 20 bp, Homo sapiens
agagcatggatgcatttcaa

SEQ ID NO: 4490769 - DNA, 21 bp, Homo sapiens
agagcatggatgcatttcaaa

SEQ ID NO: 4490770 - DNA, 19 bp, Homo sapiens
agagcatggttccagtgag

SEQ ID NO: 4490771 - DNA, 15 bp, Homo sapiens
agagccaccaagagg

SEQ ID NO: 4490772 - DNA, 12 bp, Homo sapiens
agagccacctgc

SEQ ID NO: 4490773 - DNA, 14 bp, Homo sapiens
agagccacctgcaa

SEQ ID NO: 4490774 - DNA, 20 bp, Homo sapiens
agagccacctgcaagatgga

SEQ ID NO: 4490775 - DNA, 13 bp, Homo sapiens
agagccagccctc

SEQ ID NO: 4490776 - DNA, 19 bp, Homo sapiens
agagccagcctggctctgc

SEQ ID NO: 4490777 - DNA, 15 bp, Homo sapiens
agagccagcggctcc

SEQ ID NO: 4490778 - DNA, 20 bp, Homo sapiens
agagccaggcacacactgtg

SEQ ID NO: 4490779 - DNA, 16 bp, Homo sapiens
agagccagggcagggc

SEQ ID NO: 4490780 - DNA, 13 bp, Homo sapiens
agagccccacagc

SEQ ID NO: 4490781 - DNA, 15 bp, Homo sapiens
agagccccacagccc

SEQ ID NO: 4490782 - DNA, 19 bp, Homo sapiens
agagccctgggtgacttca

SEQ ID NO: 4490783 - DNA, 14 bp, Homo sapiens
agagcccttcccag

SEQ ID NO: 4490784 - DNA, 19 bp, Homo sapiens
agagcccttgcctccccat

SEQ ID NO: 4490785 - DNA, 24 bp, Homo sapiens
agagccgggaggaaaaggcccctg

SEQ ID NO: 4490786 - DNA, 18 bp, Homo sapiens
agagccggtggtgcccgt

SEQ ID NO: 4490787 - DNA, 21 bp, Homo sapiens
agagcctcccaaggagaacaa

SEQ ID NO: 4490788 - DNA, 21 bp, Homo sapiens
agagcctcccaccagagccgg

SEQ ID NO: 4490789 - DNA, 17 bp, Homo sapiens
agagcctgacgctcagc

SEQ ID NO: 4490790 - DNA, 15 bp, Homo sapiens
agagcctgcctggag

SEQ ID NO: 4490791 - DNA, 17 bp, Homo sapiens
agagcctgcctggagcg

SEQ ID NO: 4490792 - DNA, 13 bp, Homo sapiens
agagcctgctccc

SEQ ID NO: 4490793 - DNA, 12 bp, Homo sapiens
agagcctgctgg

SEQ ID NO: 4490794 - DNA, 15 bp, Homo sapiens
agagcctggccccag

SEQ ID NO: 4490795 - DNA, 18 bp, Homo sapiens
agagcctggggtgttctc

SEQ ID NO: 4490796 - DNA, 14 bp, Homo sapiens
agagccttcagaat

SEQ ID NO: 4490797 - DNA, 20 bp, Homo sapiens
agagccttggtgtccacctg

SEQ ID NO: 4490798 - DNA, 23 bp, Homo sapiens
agagccttggtgtccacctggcc

SEQ ID NO: 4490799 - DNA, 15 bp, Homo sapiens
agagcctttatacaa

SEQ ID NO: 4490800 - DNA, 16 bp, Homo sapiens
agagcgaggaaaggat

SEQ ID NO: 4490801 - DNA, 13 bp, Homo sapiens
agagcgccaggaa

SEQ ID NO: 4490802 - DNA, 18 bp, Homo sapiens
agagcgccaggaagccag

SEQ ID NO: 4490803 - DNA, 23 bp, Homo sapiens
agagcgccaggaagccagagccc

SEQ ID NO: 4490804 - DNA, 16 bp, Homo sapiens
agagcggtatctctgg

SEQ ID NO: 4490805 - DNA, 23 bp, Homo sapiens
agagcggtatctctggcaccaca

SEQ ID NO: 4490806 - DNA, 10 bp, Homo sapiens
agagcgtcct

SEQ ID NO: 4490807 - DNA, 13 bp, Homo sapiens
agagcgtccttgg

SEQ ID NO: 4490808 - DNA, 19 bp, Homo sapiens
agagcgtccttggctgccg

SEQ ID NO: 4490809 - DNA, 13 bp, Homo sapiens
agagcgtttggtt

SEQ ID NO: 4490810 - DNA, 17 bp, Homo sapiens
agagctactcccacagc

SEQ ID NO: 4490811 - DNA, 18 bp, Homo sapiens
agagctagaacatggaga

SEQ ID NO: 4490812 - DNA, 23 bp, Homo sapiens
agagctagaacccggcaggctag

SEQ ID NO: 4490813 - DNA, 18 bp, Homo sapiens
agagctagaacctggagg

SEQ ID NO: 4490814 - DNA, 16 bp, Homo sapiens
agagctagcgctgccg

SEQ ID NO: 4490815 - DNA, 21 bp, Homo sapiens
agagctagcgctgccgcaccc

SEQ ID NO: 4490816 - DNA, 20 bp, Homo sapiens
agagctattttagaaagcta

SEQ ID NO: 4490817 - DNA, 21 bp, Homo sapiens
agagctcccccgtggtgcctg

SEQ ID NO: 4490818 - DNA, 22 bp, Homo sapiens
agagctcccccgtggtgcctgc

SEQ ID NO: 4490819 - DNA, 16 bp, Homo sapiens
agagctctcaagtcaa

SEQ ID NO: 4490820 - DNA, 21 bp, Homo sapiens
agagctgccctccttgtccac

SEQ ID NO: 4490821 - DNA, 22 bp, Homo sapiens
agagctgggaaattcatgtgga

SEQ ID NO: 4490822 - DNA, 13 bp, Homo sapiens
agagctggtgccc

SEQ ID NO: 4490823 - DNA, 15 bp, Homo sapiens
agagctggtgcccgg

SEQ ID NO: 4490824 - DNA, 20 bp, Homo sapiens
agagctggtggtgcagcctt

SEQ ID NO: 4490825 - DNA, 20 bp, Homo sapiens
agagctgtttatggcctcag

SEQ ID NO: 4490826 - DNA, 21 bp, Homo sapiens
agagctgtttatggcctcagc

SEQ ID NO: 4490827 - DNA, 15 bp, Homo sapiens
agagcttgcacagcc

SEQ ID NO: 4490828 - DNA, 18 bp, Homo sapiens
agagcttggacagtctga

SEQ ID NO: 4490829 - DNA, 22 bp, Homo sapiens
agagcttggacagtctgagctg

SEQ ID NO: 4490830 - DNA, 19 bp, Homo sapiens
agagcttggactacacaat

SEQ ID NO: 4490831 - DNA, 14 bp, Homo sapiens
agagcttgtggaaa

SEQ ID NO: 4490832 - DNA, 11 bp, Homo sapiens
agagctttgtc

SEQ ID NO: 4490833 - DNA, 12 bp, Homo sapiens
agagctttgtca

SEQ ID NO: 4490834 - DNA, 13 bp, Homo sapiens
agagctttgtcac

SEQ ID NO: 4490835 - DNA, 15 bp, Homo sapiens
agagcttttcagatt

SEQ ID NO: 4490836 - DNA, 20 bp, Homo sapiens
agagctttttaatagcacta

SEQ ID NO: 4490837 - DNA, 15 bp, Homo sapiens
agaggaaagggctgg

SEQ ID NO: 4490838 - DNA, 20 bp, Homo sapiens
agaggaacgggcagcctggg

SEQ ID NO: 4490839 - DNA, 15 bp, Homo sapiens
agaggaacgtgccac

SEQ ID NO: 4490840 - DNA, 11 bp, Homo sapiens
agaggaagaaa

SEQ ID NO: 4490841 - DNA, 15 bp, Homo sapiens
agaggaaggggccag

SEQ ID NO: 4490842 - DNA, 24 bp, Homo sapiens
agaggaatcagacttcacactgca

SEQ ID NO: 4490843 - DNA, 22 bp, Homo sapiens
agaggaatctgtttctctgctg

SEQ ID NO: 4490844 - DNA, 23 bp, Homo sapiens
agaggaatctgtttctctgctgt

SEQ ID NO: 4490845 - DNA, 13 bp, Homo sapiens
agaggaatgaagt

SEQ ID NO: 4490846 - DNA, 23 bp, Homo sapiens
agaggacagagcaggggctccag

SEQ ID NO: 4490847 - DNA, 18 bp, Homo sapiens
agaggacagtctggagaa

SEQ ID NO: 4490848 - DNA, 19 bp, Homo sapiens
agaggacctgtatttaagc

SEQ ID NO: 4490849 - DNA, 22 bp, Homo sapiens
agaggacctgtatttaagcaaa

SEQ ID NO: 4490850 - DNA, 15 bp, Homo sapiens
agactgatgagcaca

SEQ ID NO: 4490851 - DNA, 23 bp, Homo sapiens
agactgcaagagatggaaaaaaa

SEQ ID NO: 4490852 - DNA, 14 bp, Homo sapiens
agactgcaatatag

SEQ ID NO: 4490853 - DNA, 14 bp, Homo sapiens
agactgcagagggg

SEQ ID NO: 4490854 - DNA, 21 bp, Homo sapiens
agactgcagaggggaaagact

SEQ ID NO: 4490855 - DNA, 23 bp, Homo sapiens
agactgccccacggagacagagg

SEQ ID NO: 4490856 - DNA, 17 bp, Homo sapiens
agactgcgttctgcaag

SEQ ID NO: 4490857 - DNA, 18 bp, Homo sapiens
agactggaatagtggcat

SEQ ID NO: 4490858 - DNA, 21 bp, Homo sapiens
agactggcacagttttctgag

SEQ ID NO: 4490859 - DNA, 23 bp, Homo sapiens
agactggcttttattaatgcact

SEQ ID NO: 4490860 - DNA, 23 bp, Homo sapiens
agactgggaaggcttgggatttg

SEQ ID NO: 4490861 - DNA, 17 bp, Homo sapiens
agactgggagccacttc

SEQ ID NO: 4490862 - DNA, 18 bp, Homo sapiens
agactgggagccacttct

SEQ ID NO: 4490863 - DNA, 20 bp, Homo sapiens
agactgggagccacttctcc

SEQ ID NO: 4490864 - DNA, 14 bp, Homo sapiens
agactgtacataat

SEQ ID NO: 4490865 - DNA, 18 bp, Homo sapiens
agactgtacataattgca

SEQ ID NO: 4490866 - DNA, 22 bp, Homo sapiens
agactgtacataattgcatgaa

SEQ ID NO: 4490867 - DNA, 23 bp, Homo sapiens
agactgtatgttttaattgcatt

SEQ ID NO: 4490868 - DNA, 19 bp, Homo sapiens
agactgtgccagaggccag

SEQ ID NO: 4490869 - DNA, 17 bp, Homo sapiens
agactgtgctgtccttt

SEQ ID NO: 4490870 - DNA, 22 bp, Homo sapiens
agactgtgctgtcctttaacat

SEQ ID NO: 4490871 - DNA, 21 bp, Homo sapiens
agacttaaagggcccaatgaa

SEQ ID NO: 4490872 - DNA, 15 bp, Homo sapiens
agacttaatttcaaa

SEQ ID NO: 4490873 - DNA, 14 bp, Homo sapiens
agacttatcaacat

SEQ ID NO: 4490874 - DNA, 19 bp, Homo sapiens
agacttcaagcatggctat

SEQ ID NO: 4490875 - DNA, 15 bp, Homo sapiens
agacttcacactgca

SEQ ID NO: 4490876 - DNA, 21 bp, Homo sapiens
agacttcacactgcaagagcc

SEQ ID NO: 4490877 - DNA, 15 bp, Homo sapiens
agacttcagagagaa

SEQ ID NO: 4490878 - DNA, 16 bp, Homo sapiens
agacttcagagagaat

SEQ ID NO: 4490879 - DNA, 20 bp, Homo sapiens
agacttccaaatcctggaag

SEQ ID NO: 4490880 - DNA, 19 bp, Homo sapiens
agacttcccacggctcctc

SEQ ID NO: 4490881 - DNA, 22 bp, Homo sapiens
agacttgtcaagcctgtgcaaa

SEQ ID NO: 4490882 - DNA, 18 bp, Homo sapiens
agacttgtgtgcatggaa

SEQ ID NO: 4490883 - DNA, 20 bp, Homo sapiens
agacttgtgtgcatggaagt

SEQ ID NO: 4490884 - DNA, 21 bp, Homo sapiens
agactttctttctgtaggtgg

SEQ ID NO: 4490885 - DNA, 20 bp, Homo sapiens
agactttctttttctacatg

SEQ ID NO: 4490886 - DNA, 21 bp, Homo sapiens
agactttctttttctacatgt

SEQ ID NO: 4490887 - DNA, 21 bp, Homo sapiens
agacttttatgtgagatttcc

SEQ ID NO: 4490888 - DNA, 17 bp, Homo sapiens
agacttttggtagagaa

SEQ ID NO: 4490889 - DNA, 20 bp, Homo sapiens
agactttttggtggatgtaa

SEQ ID NO: 4490890 - DNA, 16 bp, Homo sapiens
agagaaaatatatgta

SEQ ID NO: 4490891 - DNA, 13 bp, Homo sapiens
agagaaacagttg

SEQ ID NO: 4490892 - DNA, 17 bp, Homo sapiens
agagaaaccgtcctctt

SEQ ID NO: 4490893 - DNA, 12 bp, Homo sapiens
agagaaagagaa

SEQ ID NO: 4490894 - DNA, 14 bp, Homo sapiens
agagaaatatgaag

SEQ ID NO: 4490895 - DNA, 16 bp, Homo sapiens
agagaaatgaagttta

SEQ ID NO: 4490896 - DNA, 19 bp, Homo sapiens
agagaacagtattgggcag

SEQ ID NO: 4490897 - DNA, 23 bp, Homo sapiens
agagaacagtattgggcaggagg

SEQ ID NO: 4490898 - DNA, 14 bp, Homo sapiens
agagaacctcagat

SEQ ID NO: 4490899 - DNA, 20 bp, Homo sapiens
agagaacctcagattcttca

SEQ ID NO: 4490900 - DNA, 15 bp, Homo sapiens
agagaacgcagccct

SEQ ID NO: 4490901 - DNA, 14 bp, Homo sapiens
agagaagacaggct

SEQ ID NO: 4490902 - DNA, 15 bp, Homo sapiens
agagaagacaggctg

SEQ ID NO: 4490903 - DNA, 17 bp, Homo sapiens
agagaagagggcccagc

SEQ ID NO: 4490904 - DNA, 20 bp, Homo sapiens
agagaagagggcccagccca

SEQ ID NO: 4490905 - DNA, 21 bp, Homo sapiens
agagaagagggcccagcccag

SEQ ID NO: 4490906 - DNA, 15 bp, Homo sapiens
agagaagccacgctg

SEQ ID NO: 4490907 - DNA, 13 bp, Homo sapiens
agagaagcccctt

SEQ ID NO: 4490908 - DNA, 12 bp, Homo sapiens
agagaaggagcc

SEQ ID NO: 4490909 - DNA, 13 bp, Homo sapiens
agagaaggcagga

SEQ ID NO: 4490910 - DNA, 17 bp, Homo sapiens
agagaagtgagtggtgt

SEQ ID NO: 4490911 - DNA, 15 bp, Homo sapiens
agagaatcaacattt

SEQ ID NO: 4490912 - DNA, 20 bp, Homo sapiens
agagaatcaacatttctcaa

SEQ ID NO: 4490913 - DNA, 16 bp, Homo sapiens
agagaatgatgctcaa

SEQ ID NO: 4490914 - DNA, 14 bp, Homo sapiens
agagaatgcacaga

SEQ ID NO: 4490915 - DNA, 20 bp, Homo sapiens
agagaatgcacagatatact

SEQ ID NO: 4490916 - DNA, 16 bp, Homo sapiens
agagaatgctttgaaa

SEQ ID NO: 4490917 - DNA, 20 bp, Homo sapiens
agagaatgtgtgtgtgtggc

SEQ ID NO: 4490918 - DNA, 16 bp, Homo sapiens
agagaatgttccagac

SEQ ID NO: 4490919 - DNA, 18 bp, Homo sapiens
agagacaaactgtaaaaa

SEQ ID NO: 4490920 - DNA, 13 bp, Homo sapiens
agagacaaagatt

SEQ ID NO: 4490921 - DNA, 15 bp, Homo sapiens
agagacaaagatttc

SEQ ID NO: 4490922 - DNA, 15 bp, Homo sapiens
agagacaagtaattt

SEQ ID NO: 4490923 - DNA, 20 bp, Homo sapiens
agagacaagtaatttcagtg

SEQ ID NO: 4490924 - DNA, 14 bp, Homo sapiens
agagacacctgcac

SEQ ID NO: 4490925 - DNA, 13 bp, Homo sapiens
agagacactgagc

SEQ ID NO: 4490926 - DNA, 16 bp, Homo sapiens
agagacagaggatgtg

SEQ ID NO: 4490927 - DNA, 22 bp, Homo sapiens
agagacagatgctggtggagga

SEQ ID NO: 4490928 - DNA, 14 bp, Homo sapiens
agagacaggcagcc

SEQ ID NO: 4490929 - DNA, 16 bp, Homo sapiens
agagacaggcagctcg

SEQ ID NO: 4490930 - DNA, 12 bp, Homo sapiens
agagacatttca

SEQ ID NO: 4490931 - DNA, 17 bp, Homo sapiens
agagaccacacatttta

SEQ ID NO: 4490932 - DNA, 20 bp, Homo sapiens
agagaccacacattttatga

SEQ ID NO: 4490933 - DNA, 13 bp, Homo sapiens
agagacccaagga

SEQ ID NO: 4490934 - DNA, 13 bp, Homo sapiens
agagacccccagg

SEQ ID NO: 4490935 - DNA, 16 bp, Homo sapiens
agagacctcatcctgc

SEQ ID NO: 4490936 - DNA, 14 bp, Homo sapiens
agagacctgaccct

SEQ ID NO: 4490937 - DNA, 16 bp, Homo sapiens
agagacctgctcaggc

SEQ ID NO: 4490938 - DNA, 19 bp, Homo sapiens
agagacgccactccctggg

SEQ ID NO: 4490939 - DNA, 21 bp, Homo sapiens
agagacgccactccctgggac

SEQ ID NO: 4490940 - DNA, 19 bp, Homo sapiens
agagacgccctatttctat

SEQ ID NO: 4490941 - DNA, 22 bp, Homo sapiens
agagacgccctatttctatgtc

SEQ ID NO: 4490942 - DNA, 15 bp, Homo sapiens
agagactcagatgag

SEQ ID NO: 4490943 - DNA, 22 bp, Homo sapiens
agagactcccatgaagcctttt

SEQ ID NO: 4490944 - DNA, 22 bp, Homo sapiens
agagactgaatagatatgaaag

SEQ ID NO: 4490945 - DNA, 20 bp, Homo sapiens
agagactgagcagccgccag

SEQ ID NO: 4490946 - DNA, 17 bp, Homo sapiens
agagactgcgttctgca

SEQ ID NO: 4490947 - DNA, 18 bp, Homo sapiens
agagactgcgttctgcaa

SEQ ID NO: 4490948 - DNA, 22 bp, Homo sapiens
agagactgggagccacttctcc

SEQ ID NO: 4490949 - DNA, 18 bp, Homo sapiens
agagactgtgcttgggag

SEQ ID NO: 4490950 - DNA, 19 bp, Homo sapiens
agagactgtgcttgggagc

SEQ ID NO: 4490951 - DNA, 12 bp, Homo sapiens
agagagaaagaa

SEQ ID NO: 4490952 - DNA, 15 bp, Homo sapiens
agagagacaggcagc

SEQ ID NO: 4490953 - DNA, 18 bp, Homo sapiens
agagagacctcatcctgc

SEQ ID NO: 4490954 - DNA, 13 bp, Homo sapiens
agagagagaaaga

SEQ ID NO: 4490955 - DNA, 15 bp, Homo sapiens
agagagagagagagg

SEQ ID NO: 4490956 - DNA, 14 bp, Homo sapiens
agagagagaggaca

SEQ ID NO: 4490957 - DNA, 15 bp, Homo sapiens
agagagagtgtgtgt

SEQ ID NO: 4490958 - DNA, 20 bp, Homo sapiens
agagagcagctccctttctc

SEQ ID NO: 4490959 - DNA, 22 bp, Homo sapiens
agagagcagctccctttctcag

SEQ ID NO: 4490960 - DNA, 22 bp, Homo sapiens
agagagcccttcccagggcacc

SEQ ID NO: 4490961 - DNA, 14 bp, Homo sapiens
agagaggaatcaga

SEQ ID NO: 4490962 - DNA, 22 bp, Homo sapiens
agagaggccattctttcccaac

SEQ ID NO: 4490963 - DNA, 19 bp, Homo sapiens
agagaggggaaagtgtgag

SEQ ID NO: 4490964 - DNA, 21 bp, Homo sapiens
agagaggggcaaatagagagt

SEQ ID NO: 4490965 - DNA, 22 bp, Homo sapiens
agagaggggcaaatagagagtc

SEQ ID NO: 4490966 - DNA, 23 bp, Homo sapiens
agagaggggcaaatagagagtct

SEQ ID NO: 4490967 - DNA, 14 bp, Homo sapiens
agagagtgtgtgtt

SEQ ID NO: 4490968 - DNA, 15 bp, Homo sapiens
agagatagcttctct

SEQ ID NO: 4490969 - DNA, 18 bp, Homo sapiens
agagataggaaactgaag

SEQ ID NO: 4490970 - DNA, 20 bp, Homo sapiens
agacattgctctatgtctgc

SEQ ID NO: 4490971 - DNA, 18 bp, Homo sapiens
agacatttctttctgttt

SEQ ID NO: 4490972 - DNA, 13 bp, Homo sapiens
agacatttgctga

SEQ ID NO: 4490973 - DNA, 18 bp, Homo sapiens
agacatttgctgaactca

SEQ ID NO: 4490974 - DNA, 19 bp, Homo sapiens
agacatttgctgaactcag

SEQ ID NO: 4490975 - DNA, 22 bp, Homo sapiens
agacatttgtaaatgtaaaact

SEQ ID NO: 4490976 - DNA, 20 bp, Homo sapiens
agacatttttcattcatgaa

SEQ ID NO: 4490977 - DNA, 22 bp, Homo sapiens
agaccaaatctcagttgtttgc

SEQ ID NO: 4490978 - DNA, 14 bp, Homo sapiens
agaccacaggaaga

SEQ ID NO: 4490979 - DNA, 19 bp, Homo sapiens
agaccacccaacctcaccc

SEQ ID NO: 4490980 - DNA, 12 bp, Homo sapiens
agaccagaaatt

SEQ ID NO: 4490981 - DNA, 12 bp, Homo sapiens
agaccaggctgg

SEQ ID NO: 4490982 - DNA, 20 bp, Homo sapiens
agaccagggtggccacacag

SEQ ID NO: 4490983 - DNA, 16 bp, Homo sapiens
agaccatattacctgg

SEQ ID NO: 4490984 - DNA, 14 bp, Homo sapiens
agaccatcctggct

SEQ ID NO: 4490985 - DNA, 22 bp, Homo sapiens
agaccattggggctcccagcca

SEQ ID NO: 4490986 - DNA, 23 bp, Homo sapiens
agacccaagtcaaagatgcccca

SEQ ID NO: 4490987 - DNA, 18 bp, Homo sapiens
agacccagaggtccaggt

SEQ ID NO: 4490988 - DNA, 19 bp, Homo sapiens
agacccagccctcatcccg

SEQ ID NO: 4490989 - DNA, 16 bp, Homo sapiens
agacccaggagtccag

SEQ ID NO: 4490990 - DNA, 17 bp, Homo sapiens
agacccaggagtccaga

SEQ ID NO: 4490991 - DNA, 19 bp, Homo sapiens
agacccaggagtccagacc

SEQ ID NO: 4490992 - DNA, 20 bp, Homo sapiens
agacccaggagtccagaccc

SEQ ID NO: 4490993 - DNA, 22 bp, Homo sapiens
agacccaggagtccagcccctc

SEQ ID NO: 4490994 - DNA, 17 bp, Homo sapiens
agaccccacgctgacca

SEQ ID NO: 4490995 - DNA, 13 bp, Homo sapiens
agaccccagctgg

SEQ ID NO: 4490996 - DNA, 15 bp, Homo sapiens
agaccccagctgggg

SEQ ID NO: 4490997 - DNA, 13 bp, Homo sapiens
agacccccacacc

SEQ ID NO: 4490998 - DNA, 14 bp, Homo sapiens
agacccccacacct

SEQ ID NO: 4490999 - DNA, 15 bp, Homo sapiens
agacccccacacctc

SEQ ID NO: 4491000 - DNA, 13 bp, Homo sapiens
agacccccactct

SEQ ID NO: 4491001 - DNA, 13 bp, Homo sapiens
agacccccaggcc

SEQ ID NO: 4491002 - DNA, 19 bp, Homo sapiens
agacccccatttgtcccag

SEQ ID NO: 4491003 - DNA, 20 bp, Homo sapiens
agacccccatttgtcccaga

SEQ ID NO: 4491004 - DNA, 14 bp, Homo sapiens
agaccccccagccc

SEQ ID NO: 4491005 - DNA, 17 bp, Homo sapiens
agaccccccagcccctc

SEQ ID NO: 4491006 - DNA, 18 bp, Homo sapiens
agaccccccagcccctcc

SEQ ID NO: 4491007 - DNA, 12 bp, Homo sapiens
agacccctcagc

SEQ ID NO: 4491008 - DNA, 17 bp, Homo sapiens
agacccctcagccccag

SEQ ID NO: 4491009 - DNA, 11 bp, Homo sapiens
agacccctgcc

SEQ ID NO: 4491010 - DNA, 18 bp, Homo sapiens
agacccctgcctggactt

SEQ ID NO: 4491011 - DNA, 13 bp, Homo sapiens
agacccctggcct

SEQ ID NO: 4491012 - DNA, 14 bp, Homo sapiens
agaccctcttgccc

SEQ ID NO: 4491013 - DNA, 15 bp, Homo sapiens
agaccctcttgccca

SEQ ID NO: 4491014 - DNA, 21 bp, Homo sapiens
agaccctgaggccctgggctg

SEQ ID NO: 4491015 - DNA, 13 bp, Homo sapiens
agaccctgtctca

SEQ ID NO: 4491016 - DNA, 21 bp, Homo sapiens
agacccttattgctgtcctgg

SEQ ID NO: 4491017 - DNA, 22 bp, Homo sapiens
agacccttattgctgtcctgga

SEQ ID NO: 4491018 - DNA, 16 bp, Homo sapiens
agaccgatccttccca

SEQ ID NO: 4491019 - DNA, 15 bp, Homo sapiens
agaccgatcggcggc

SEQ ID NO: 4491020 - DNA, 14 bp, Homo sapiens
agaccgctctcttt

SEQ ID NO: 4491021 - DNA, 22 bp, Homo sapiens
agaccgctctcttttctgtact

SEQ ID NO: 4491022 - DNA, 15 bp, Homo sapiens
agacctagcaggctg

SEQ ID NO: 4491023 - DNA, 15 bp, Homo sapiens
agacctcaagccatc

SEQ ID NO: 4491024 - DNA, 11 bp, Homo sapiens
agacctcagcc

SEQ ID NO: 4491025 - DNA, 12 bp, Homo sapiens
agacctcagcca

SEQ ID NO: 4491026 - DNA, 21 bp, Homo sapiens
agacctccaataaagtgcctt

SEQ ID NO: 4491027 - DNA, 22 bp, Homo sapiens
agacctgagcgggagtcaggga

SEQ ID NO: 4491028 - DNA, 16 bp, Homo sapiens
agaccttttttaggaa

SEQ ID NO: 4491029 - DNA, 13 bp, Homo sapiens
agacgaggccctc

SEQ ID NO: 4491030 - DNA, 23 bp, Homo sapiens
agacgccactccctgggacacag

SEQ ID NO: 4491031 - DNA, 12 bp, Homo sapiens
agacgcccctcc

SEQ ID NO: 4491032 - DNA, 21 bp, Homo sapiens
agacgccggcttcctccttcc

SEQ ID NO: 4491033 - DNA, 21 bp, Homo sapiens
agacggatgcccattcctgcc

SEQ ID NO: 4491034 - DNA, 22 bp, Homo sapiens
agacggatgcccattcctgcct

SEQ ID NO: 4491035 - DNA, 23 bp, Homo sapiens
agacggatgcccattcctgcctg

SEQ ID NO: 4491036 - DNA, 17 bp, Homo sapiens
agacgggaccctgccca

SEQ ID NO: 4491037 - DNA, 21 bp, Homo sapiens
agacggtgttttgccatgttg

SEQ ID NO: 4491038 - DNA, 15 bp, Homo sapiens
agacgtaaagaattt

SEQ ID NO: 4491039 - DNA, 16 bp, Homo sapiens
agacgtaaagaatttt

SEQ ID NO: 4491040 - DNA, 12 bp, Homo sapiens
agacgtgaatgt

SEQ ID NO: 4491041 - DNA, 16 bp, Homo sapiens
agacgtggtgggactc

SEQ ID NO: 4491042 - DNA, 20 bp, Homo sapiens
agactaaaggatccagagag

SEQ ID NO: 4491043 - DNA, 22 bp, Homo sapiens
agactaaaggatccagagagca

SEQ ID NO: 4491044 - DNA, 19 bp, Homo sapiens
agactaaattcaatcacca

SEQ ID NO: 4491045 - DNA, 19 bp, Homo sapiens
agactaattcctgccctgc

SEQ ID NO: 4491046 - DNA, 15 bp, Homo sapiens
agactactaaggcct

SEQ ID NO: 4491047 - DNA, 15 bp, Homo sapiens
agactactggcctct

SEQ ID NO: 4491048 - DNA, 14 bp, Homo sapiens
agactagagaaacc

SEQ ID NO: 4491049 - DNA, 13 bp, Homo sapiens
agactagatgtag

SEQ ID NO: 4491050 - DNA, 14 bp, Homo sapiens
agactagatgtagt

SEQ ID NO: 4491051 - DNA, 16 bp, Homo sapiens
agactagatgtagtat

SEQ ID NO: 4491052 - DNA, 17 bp, Homo sapiens
agactagcaatctcttc

SEQ ID NO: 4491053 - DNA, 22 bp, Homo sapiens
agactagtttttattccttgtg

SEQ ID NO: 4491054 - DNA, 17 bp, Homo sapiens
agactatcttactattt

SEQ ID NO: 4491055 - DNA, 17 bp, Homo sapiens
agactatggcctcgcct

SEQ ID NO: 4491056 - DNA, 18 bp, Homo sapiens
agactatggcctcgcctc

SEQ ID NO: 4491057 - DNA, 22 bp, Homo sapiens
agactatggcctcgcctcccca

SEQ ID NO: 4491058 - DNA, 14 bp, Homo sapiens
agactattcaaaca

SEQ ID NO: 4491059 - DNA, 13 bp, Homo sapiens
agactatttgcta

SEQ ID NO: 4491060 - DNA, 19 bp, Homo sapiens
agactatttgctaatgtat

SEQ ID NO: 4491061 - DNA, 21 bp, Homo sapiens
agactatttttagattttctt

SEQ ID NO: 4491062 - DNA, 14 bp, Homo sapiens
agactcaatgtgga

SEQ ID NO: 4491063 - DNA, 12 bp, Homo sapiens
agactcacctct

SEQ ID NO: 4491064 - DNA, 17 bp, Homo sapiens
agactcacctctgcctc

SEQ ID NO: 4491065 - DNA, 18 bp, Homo sapiens
agactcacctctgcctca

SEQ ID NO: 4491066 - DNA, 15 bp, Homo sapiens
agactcagaggtcca

SEQ ID NO: 4491067 - DNA, 17 bp, Homo sapiens
agactcagaggtccagg

SEQ ID NO: 4491068 - DNA, 14 bp, Homo sapiens
agactcagcctctg

SEQ ID NO: 4491069 - DNA, 16 bp, Homo sapiens
agactcagcctctgct

SEQ ID NO: 4491070 - DNA, 17 bp, Homo sapiens
agactcagcctctgctg

SEQ ID NO: 4491071 - DNA, 19 bp, Homo sapiens
agactcagcctctgctgga

SEQ ID NO: 4491072 - DNA, 21 bp, Homo sapiens
agactcagcctctgctggaga

SEQ ID NO: 4491073 - DNA, 13 bp, Homo sapiens
agactcaggttcc

SEQ ID NO: 4491074 - DNA, 16 bp, Homo sapiens
agactcaggttccaga

SEQ ID NO: 4491075 - DNA, 12 bp, Homo sapiens
agactccaaaga

SEQ ID NO: 4491076 - DNA, 19 bp, Homo sapiens
agactccaaagaaatgtaa

SEQ ID NO: 4491077 - DNA, 16 bp, Homo sapiens
agactccatctcttct

SEQ ID NO: 4491078 - DNA, 17 bp, Homo sapiens
agactccatctcttctg

SEQ ID NO: 4491079 - DNA, 17 bp, Homo sapiens
agactcccatgaagcct

SEQ ID NO: 4491080 - DNA, 19 bp, Homo sapiens
agactcccatgaagccttt

SEQ ID NO: 4491081 - DNA, 14 bp, Homo sapiens
agactcctcctcca

SEQ ID NO: 4491082 - DNA, 19 bp, Homo sapiens
agactcgagaactttcatt

SEQ ID NO: 4491083 - DNA, 13 bp, Homo sapiens
agactctagaaaa

SEQ ID NO: 4491084 - DNA, 22 bp, Homo sapiens
agactctagaaaaaagggctga

SEQ ID NO: 4491085 - DNA, 21 bp, Homo sapiens
agactcttttccttccctttt

SEQ ID NO: 4491086 - DNA, 17 bp, Homo sapiens
agactgaactcgcaggg

SEQ ID NO: 4491087 - DNA, 22 bp, Homo sapiens
agactgaatagatatgaaagct

SEQ ID NO: 4491088 - DNA, 21 bp, Homo sapiens
agactgaccaatattgtacag

SEQ ID NO: 4491089 - DNA, 13 bp, Homo sapiens
agactgagcagcc

SEQ ID NO: 4491090 - DNA, 15 bp, Homo sapiens
agactgagcagccgc

SEQ ID NO: 4491091 - DNA, 19 bp, Homo sapiens
agaattgaacccaggaggt

SEQ ID NO: 4491092 - DNA, 21 bp, Homo sapiens
agaattgatcattttcccccc

SEQ ID NO: 4491093 - DNA, 22 bp, Homo sapiens
agaattgatcattttcccccca

SEQ ID NO: 4491094 - DNA, 23 bp, Homo sapiens
agaattgctgaagggcattcttt

SEQ ID NO: 4491095 - DNA, 23 bp, Homo sapiens
agaattgcttgagcttgggaagt

SEQ ID NO: 4491096 - DNA, 17 bp, Homo sapiens
agaattggcataatttg

SEQ ID NO: 4491097 - DNA, 18 bp, Homo sapiens
agaattggcataatttgt

SEQ ID NO: 4491098 - DNA, 13 bp, Homo sapiens
agaatttagatct

SEQ ID NO: 4491099 - DNA, 14 bp, Homo sapiens
agaatttagatctt

SEQ ID NO: 4491100 - DNA, 22 bp, Homo sapiens
agaatttagatcttatattggt

SEQ ID NO: 4491101 - DNA, 12 bp, Homo sapiens
agaatttcctgt

SEQ ID NO: 4491102 - DNA, 14 bp, Homo sapiens
agaatttcctgtaa

SEQ ID NO: 4491103 - DNA, 23 bp, Homo sapiens
agaatttcctgtaatatatttat

SEQ ID NO: 4491104 - DNA, 16 bp, Homo sapiens
agaatttctaaagtaa

SEQ ID NO: 4491105 - DNA, 13 bp, Homo sapiens
agaatttctaaga

SEQ ID NO: 4491106 - DNA, 14 bp, Homo sapiens
agaatttctaagaa

SEQ ID NO: 4491107 - DNA, 16 bp, Homo sapiens
agaatttctgctaaat

SEQ ID NO: 4491108 - DNA, 21 bp, Homo sapiens
agaatttgaagacttcaaaat

SEQ ID NO: 4491109 - DNA, 18 bp, Homo sapiens
agaatttgagtgctctga

SEQ ID NO: 4491110 - DNA, 19 bp, Homo sapiens
agaatttgtgttgaaggaa

SEQ ID NO: 4491111 - DNA, 23 bp, Homo sapiens
agaatttgtgttgaaggaacttg

SEQ ID NO: 4491112 - DNA, 16 bp, Homo sapiens
agaatttgtttaaatt

SEQ ID NO: 4491113 - DNA, 13 bp, Homo sapiens
agaatttgtttca

SEQ ID NO: 4491114 - DNA, 15 bp, Homo sapiens
agaatttgtttcatc

SEQ ID NO: 4491115 - DNA, 20 bp, Homo sapiens
agaattttcagaccccagcg

SEQ ID NO: 4491116 - DNA, 21 bp, Homo sapiens
agaattttcagaccccagcgg

SEQ ID NO: 4491117 - DNA, 22 bp, Homo sapiens
agacaaaagtctgtctttcctg

SEQ ID NO: 4491118 - DNA, 18 bp, Homo sapiens
agacaaactgtaaaaaat

SEQ ID NO: 4491119 - DNA, 14 bp, Homo sapiens
agacaaaggaggaa

SEQ ID NO: 4491120 - DNA, 17 bp, Homo sapiens
agacaaaggaggaattt

SEQ ID NO: 4491121 - DNA, 19 bp, Homo sapiens
agacaaaggaggaatttac

SEQ ID NO: 4491122 - DNA, 16 bp, Homo sapiens
agacaacagcacacag

SEQ ID NO: 4491123 - DNA, 19 bp, Homo sapiens
agacaacagcacacaggca

SEQ ID NO: 4491124 - DNA, 23 bp, Homo sapiens
agacaacaggtaaaacagggcca

SEQ ID NO: 4491125 - DNA, 14 bp, Homo sapiens
agacaagagatcta

SEQ ID NO: 4491126 - DNA, 17 bp, Homo sapiens
agacaagagatctacac

SEQ ID NO: 4491127 - DNA, 24 bp, Homo sapiens
agacaagagatctacacatgttgc

SEQ ID NO: 4491128 - DNA, 13 bp, Homo sapiens
agacaagcagagt

SEQ ID NO: 4491129 - DNA, 13 bp, Homo sapiens
agacaaggtgcta

SEQ ID NO: 4491130 - DNA, 18 bp, Homo sapiens
agacaagtaatttcagtg

SEQ ID NO: 4491131 - DNA, 14 bp, Homo sapiens
agacaagttttgtt

SEQ ID NO: 4491132 - DNA, 16 bp, Homo sapiens
agacaatcattgtttt

SEQ ID NO: 4491133 - DNA, 22 bp, Homo sapiens
agacaatcattgttttgaatat

SEQ ID NO: 4491134 - DNA, 15 bp, Homo sapiens
agacaattcctccag

SEQ ID NO: 4491135 - DNA, 22 bp, Homo sapiens
agacaattcctccagagacact

SEQ ID NO: 4491136 - DNA, 23 bp, Homo sapiens
agacaattgaggtaagttttttg

SEQ ID NO: 4491137 - DNA, 18 bp, Homo sapiens
agacaattttttttcaaa

SEQ ID NO: 4491138 - DNA, 21 bp, Homo sapiens
agacaattttttttcaaatgt

SEQ ID NO: 4491139 - DNA, 14 bp, Homo sapiens
agacacaatttcat

SEQ ID NO: 4491140 - DNA, 16 bp, Homo sapiens
agacacaatttcattt

SEQ ID NO: 4491141 - DNA, 19 bp, Homo sapiens
agacacaatttcatttcca

SEQ ID NO: 4491142 - DNA, 19 bp, Homo sapiens
agacacagaatagtttaca

SEQ ID NO: 4491143 - DNA, 12 bp, Homo sapiens
agacacatgaag

SEQ ID NO: 4491144 - DNA, 20 bp, Homo sapiens
agacacatgaaggtaaataa

SEQ ID NO: 4491145 - DNA, 21 bp, Homo sapiens
agacacattgccttctggagc

SEQ ID NO: 4491146 - DNA, 16 bp, Homo sapiens
agacacctgcacctcc

SEQ ID NO: 4491147 - DNA, 20 bp, Homo sapiens
agacacctgcacctcccccc

SEQ ID NO: 4491148 - DNA, 20 bp, Homo sapiens
agacacctggactgagccaa

SEQ ID NO: 4491149 - DNA, 20 bp, Homo sapiens
agacactccccgaagtcttt

SEQ ID NO: 4491150 - DNA, 22 bp, Homo sapiens
agacactccccgaagtcttttg

SEQ ID NO: 4491151 - DNA, 18 bp, Homo sapiens
agacactgatctggctgc

SEQ ID NO: 4491152 - DNA, 22 bp, Homo sapiens
agacactgtctctaccaaaaaa

SEQ ID NO: 4491153 - DNA, 23 bp, Homo sapiens
agacactgtctctaccaaaaaaa

SEQ ID NO: 4491154 - DNA, 17 bp, Homo sapiens
agacacttgctcccaac

SEQ ID NO: 4491155 - DNA, 22 bp, Homo sapiens
agacactttggaatctaaccac

SEQ ID NO: 4491156 - DNA, 12 bp, Homo sapiens
agacagaagaaa

SEQ ID NO: 4491157 - DNA, 17 bp, Homo sapiens
agacagaagaaacaagg

SEQ ID NO: 4491158 - DNA, 21 bp, Homo sapiens
agacagaggaaagggctggct

SEQ ID NO: 4491159 - DNA, 18 bp, Homo sapiens
agacagatgagcaggagc

SEQ ID NO: 4491160 - DNA, 20 bp, Homo sapiens
agacagatgctggtggagga

SEQ ID NO: 4491161 - DNA, 22 bp, Homo sapiens
agacagatgctggtggaggaag

SEQ ID NO: 4491162 - DNA, 15 bp, Homo sapiens
agacagcagcagcct

SEQ ID NO: 4491163 - DNA, 16 bp, Homo sapiens
agacagcatgtgttaa

SEQ ID NO: 4491164 - DNA, 17 bp, Homo sapiens
agacagccaggtggcac

SEQ ID NO: 4491165 - DNA, 23 bp, Homo sapiens
agacagccaggtggcacctgcag

SEQ ID NO: 4491166 - DNA, 17 bp, Homo sapiens
agacagcccaggatact

SEQ ID NO: 4491167 - DNA, 23 bp, Homo sapiens
agacagcccaggatactggcaca

SEQ ID NO: 4491168 - DNA, 16 bp, Homo sapiens
agacagcgataagctt

SEQ ID NO: 4491169 - DNA, 21 bp, Homo sapiens
agacagcgataagctttcaat

SEQ ID NO: 4491170 - DNA, 11 bp, Homo sapiens
agacagcttct

SEQ ID NO: 4491171 - DNA, 12 bp, Homo sapiens
agacagcttctc

SEQ ID NO: 4491172 - DNA, 15 bp, Homo sapiens
agacagcttctctgc

SEQ ID NO: 4491173 - DNA, 18 bp, Homo sapiens
agacaggaaaatcctctg

SEQ ID NO: 4491174 - DNA, 19 bp, Homo sapiens
agacaggaaaatcctctgg

SEQ ID NO: 4491175 - DNA, 15 bp, Homo sapiens
agacaggaacccttg

SEQ ID NO: 4491176 - DNA, 14 bp, Homo sapiens
agacaggagaaatg

SEQ ID NO: 4491177 - DNA, 15 bp, Homo sapiens
agacaggagcctagc

SEQ ID NO: 4491178 - DNA, 11 bp, Homo sapiens
agacaggcagc

SEQ ID NO: 4491179 - DNA, 19 bp, Homo sapiens
agacaggcagggagggctt

SEQ ID NO: 4491180 - DNA, 12 bp, Homo sapiens
agacaggccctc

SEQ ID NO: 4491181 - DNA, 14 bp, Homo sapiens
agacaggccctccc

SEQ ID NO: 4491182 - DNA, 15 bp, Homo sapiens
agacaggctgggtcc

SEQ ID NO: 4491183 - DNA, 17 bp, Homo sapiens
agacaggctgggtcctg

SEQ ID NO: 4491184 - DNA, 21 bp, Homo sapiens
agacaggctgggtcctgccag

SEQ ID NO: 4491185 - DNA, 16 bp, Homo sapiens
agacagggtcttgctc

SEQ ID NO: 4491186 - DNA, 23 bp, Homo sapiens
agacagggtcttgctctgtcccc

SEQ ID NO: 4491187 - DNA, 18 bp, Homo sapiens
agacagggtgggcttcct

SEQ ID NO: 4491188 - DNA, 21 bp, Homo sapiens
agacagggtgggcttcctgcc

SEQ ID NO: 4491189 - DNA, 22 bp, Homo sapiens
agacagtcgctcagtctgttca

SEQ ID NO: 4491190 - DNA, 13 bp, Homo sapiens
agacagtgatatt

SEQ ID NO: 4491191 - DNA, 19 bp, Homo sapiens
agacagtgatattggaact

SEQ ID NO: 4491192 - DNA, 22 bp, Homo sapiens
agacataaagaagaaacttgta

SEQ ID NO: 4491193 - DNA, 22 bp, Homo sapiens
agacatactccttccatcaaat

SEQ ID NO: 4491194 - DNA, 19 bp, Homo sapiens
agacatataccaaaaacaa

SEQ ID NO: 4491195 - DNA, 17 bp, Homo sapiens
agacatatcactgctgc

SEQ ID NO: 4491196 - DNA, 23 bp, Homo sapiens
agacatatgggatattcccaagc

SEQ ID NO: 4491197 - DNA, 14 bp, Homo sapiens
agacatatttaact

SEQ ID NO: 4491198 - DNA, 14 bp, Homo sapiens
agacatatttcagt

SEQ ID NO: 4491199 - DNA, 17 bp, Homo sapiens
agacatcattgtcagcc

SEQ ID NO: 4491200 - DNA, 21 bp, Homo sapiens
agacatcattgtcagccttgc

SEQ ID NO: 4491201 - DNA, 20 bp, Homo sapiens
agacatccaaactaaaagga

SEQ ID NO: 4491202 - DNA, 15 bp, Homo sapiens
agacatctgcctgta

SEQ ID NO: 4491203 - DNA, 18 bp, Homo sapiens
agacatctgcctgtaatt

SEQ ID NO: 4491204 - DNA, 19 bp, Homo sapiens
agacatctgcctgtaatta

SEQ ID NO: 4491205 - DNA, 13 bp, Homo sapiens
agacatgaagcca

SEQ ID NO: 4491206 - DNA, 16 bp, Homo sapiens
agacatgcccaaaact

SEQ ID NO: 4491207 - DNA, 19 bp, Homo sapiens
agacatggacaaggagctg

SEQ ID NO: 4491208 - DNA, 19 bp, Homo sapiens
agacatggagatgtaaaat

SEQ ID NO: 4491209 - DNA, 22 bp, Homo sapiens
agacattgagtttacttataaa

SEQ ID NO: 4491210 - DNA, 19 bp, Homo sapiens
agaagcctttgggaagggg

SEQ ID NO: 4491211 - DNA, 18 bp, Homo sapiens
agaagcgctcatctggct

SEQ ID NO: 4491212 - DNA, 18 bp, Homo sapiens
agaagctctcgagggaag

SEQ ID NO: 4491213 - DNA, 19 bp, Homo sapiens
agaagctctgaagaactct

SEQ ID NO: 4491214 - DNA, 20 bp, Homo sapiens
agaagctgaagatccccaac

SEQ ID NO: 4491215 - DNA, 22 bp, Homo sapiens
agaagctgaggctagttccaga

SEQ ID NO: 4491216 - DNA, 17 bp, Homo sapiens
agaaggaaaaagaaagt

SEQ ID NO: 4491217 - DNA, 19 bp, Homo sapiens
agaaggcaaaaatagtttg

SEQ ID NO: 4491218 - DNA, 14 bp, Homo sapiens
agaaggcaaagttt

SEQ ID NO: 4491219 - DNA, 15 bp, Homo sapiens
agaaggcgtccatgt

SEQ ID NO: 4491220 - DNA, 14 bp, Homo sapiens
agaagggagaagaa

SEQ ID NO: 4491221 - DNA, 16 bp, Homo sapiens
agaagggagaagaaag

SEQ ID NO: 4491222 - DNA, 19 bp, Homo sapiens
agaagggccagtcctgcct

SEQ ID NO: 4491223 - DNA, 13 bp, Homo sapiens
agaagggctagaa

SEQ ID NO: 4491224 - DNA, 23 bp, Homo sapiens
agaagggctagaacctggagagc

SEQ ID NO: 4491225 - DNA, 19 bp, Homo sapiens
agaaggggctttgtgacca

SEQ ID NO: 4491226 - DNA, 13 bp, Homo sapiens
agaagggggtggt

SEQ ID NO: 4491227 - DNA, 20 bp, Homo sapiens
agaagggtgggagtggggcc

SEQ ID NO: 4491228 - DNA, 15 bp, Homo sapiens
agaagtaaaagcaaa

SEQ ID NO: 4491229 - DNA, 20 bp, Homo sapiens
agaagtatttttttaatttc

SEQ ID NO: 4491230 - DNA, 21 bp, Homo sapiens
agaagtatttttttaatttct

SEQ ID NO: 4491231 - DNA, 15 bp, Homo sapiens
agaagtccacagaca

SEQ ID NO: 4491232 - DNA, 15 bp, Homo sapiens
agaagtccttatgtt

SEQ ID NO: 4491233 - DNA, 16 bp, Homo sapiens
agaagtctagttttat

SEQ ID NO: 4491234 - DNA, 23 bp, Homo sapiens
agaagtcttaattgtgtttattt

SEQ ID NO: 4491235 - DNA, 16 bp, Homo sapiens
agaagtgctttatact

SEQ ID NO: 4491236 - DNA, 17 bp, Homo sapiens
agaagtggaccaggaca

SEQ ID NO: 4491237 - DNA, 18 bp, Homo sapiens
agaagtgggccaggacag

SEQ ID NO: 4491238 - DNA, 20 bp, Homo sapiens
agaagttaattcttaaaact

SEQ ID NO: 4491239 - DNA, 15 bp, Homo sapiens
agaagttagtttgta

SEQ ID NO: 4491240 - DNA, 23 bp, Homo sapiens
agaagttattttctacagtggtt

SEQ ID NO: 4491241 - DNA, 18 bp, Homo sapiens
agaagttcaaaatcatgt

SEQ ID NO: 4491242 - DNA, 21 bp, Homo sapiens
agaagttgtaaagtatgtatt

SEQ ID NO: 4491243 - DNA, 19 bp, Homo sapiens
agaagtttcatcatttttt

SEQ ID NO: 4491244 - DNA, 13 bp, Homo sapiens
agaataaaggcag

SEQ ID NO: 4491245 - DNA, 15 bp, Homo sapiens
agaataaaggcagtt

SEQ ID NO: 4491246 - DNA, 14 bp, Homo sapiens
agaataaagttgta

SEQ ID NO: 4491247 - DNA, 22 bp, Homo sapiens
agaataaatccttgggagtcat

SEQ ID NO: 4491248 - DNA, 14 bp, Homo sapiens
agaataaatgaaga

SEQ ID NO: 4491249 - DNA, 20 bp, Homo sapiens
agaataaatggtttctcatt

SEQ ID NO: 4491250 - DNA, 22 bp, Homo sapiens
agaataagacaagagatctaca

SEQ ID NO: 4491251 - DNA, 12 bp, Homo sapiens
agaataagttat

SEQ ID NO: 4491252 - DNA, 13 bp, Homo sapiens
agaataagttatt

SEQ ID NO: 4491253 - DNA, 20 bp, Homo sapiens
agaataagttattgcagttt

SEQ ID NO: 4491254 - DNA, 21 bp, Homo sapiens
agaataagttattgcagttta

SEQ ID NO: 4491255 - DNA, 22 bp, Homo sapiens
agaataatttatagtaatgagt

SEQ ID NO: 4491256 - DNA, 12 bp, Homo sapiens
agaatacagaaa

SEQ ID NO: 4491257 - DNA, 19 bp, Homo sapiens
agaatacttctcatttttt

SEQ ID NO: 4491258 - DNA, 14 bp, Homo sapiens
agaatagaaacgta

SEQ ID NO: 4491259 - DNA, 22 bp, Homo sapiens
agaatagaaataaaggatgtga

SEQ ID NO: 4491260 - DNA, 20 bp, Homo sapiens
agaatagccacatttggaat

SEQ ID NO: 4491261 - DNA, 15 bp, Homo sapiens
agaataggggagcca

SEQ ID NO: 4491262 - DNA, 16 bp, Homo sapiens
agaatagtttacacac

SEQ ID NO: 4491263 - DNA, 16 bp, Homo sapiens
agaatatggaggctgg

SEQ ID NO: 4491264 - DNA, 18 bp, Homo sapiens
agaatattaaatattata

SEQ ID NO: 4491265 - DNA, 14 bp, Homo sapiens
agaatattcagaca

SEQ ID NO: 4491266 - DNA, 13 bp, Homo sapiens
agaatattgtatt

SEQ ID NO: 4491267 - DNA, 21 bp, Homo sapiens
agaatcaacatttctcaataa

SEQ ID NO: 4491268 - DNA, 22 bp, Homo sapiens
agaatcacctgaaccccagagg

SEQ ID NO: 4491269 - DNA, 16 bp, Homo sapiens
agaatcactgctccag

SEQ ID NO: 4491270 - DNA, 21 bp, Homo sapiens
agaatcactgctccaggcctg

SEQ ID NO: 4491271 - DNA, 19 bp, Homo sapiens
agaatcacttaagcctgga

SEQ ID NO: 4491272 - DNA, 21 bp, Homo sapiens
agaatcacttaagcctggaag

SEQ ID NO: 4491273 - DNA, 15 bp, Homo sapiens
agaatcagaataaag

SEQ ID NO: 4491274 - DNA, 18 bp, Homo sapiens
agaatcagaataaagttg

SEQ ID NO: 4491275 - DNA, 13 bp, Homo sapiens
agaatcattacct

SEQ ID NO: 4491276 - DNA, 20 bp, Homo sapiens
agaatcattatttattaaat

SEQ ID NO: 4491277 - DNA, 21 bp, Homo sapiens
agaatcattatttattaaatt

SEQ ID NO: 4491278 - DNA, 15 bp, Homo sapiens
agaatcatttagcat

SEQ ID NO: 4491279 - DNA, 17 bp, Homo sapiens
agaatccagtttctttc

SEQ ID NO: 4491280 - DNA, 13 bp, Homo sapiens
agaatctagaaga

SEQ ID NO: 4491281 - DNA, 13 bp, Homo sapiens
agaatctggagag

SEQ ID NO: 4491282 - DNA, 16 bp, Homo sapiens
agaatctggagagcta

SEQ ID NO: 4491283 - DNA, 22 bp, Homo sapiens
agaatctttgcatgcagaggag

SEQ ID NO: 4491284 - DNA, 12 bp, Homo sapiens
agaatgaaatga

SEQ ID NO: 4491285 - DNA, 15 bp, Homo sapiens
agaatgaaatgaatg

SEQ ID NO: 4491286 - DNA, 20 bp, Homo sapiens
agaatgaaatgaatgattct

SEQ ID NO: 4491287 - DNA, 13 bp, Homo sapiens
agaatgaatttat

SEQ ID NO: 4491288 - DNA, 15 bp, Homo sapiens
agaatgacagccttt

SEQ ID NO: 4491289 - DNA, 14 bp, Homo sapiens
agaatgagagtgtg

SEQ ID NO: 4491290 - DNA, 19 bp, Homo sapiens
agaatgagcagagagcaaa

SEQ ID NO: 4491291 - DNA, 16 bp, Homo sapiens
agaatgcacagatata

SEQ ID NO: 4491292 - DNA, 16 bp, Homo sapiens
agaatgcagtacagaa

SEQ ID NO: 4491293 - DNA, 17 bp, Homo sapiens
agaatgcagtacagaat

SEQ ID NO: 4491294 - DNA, 21 bp, Homo sapiens
agaatgcattccagaacaaat

SEQ ID NO: 4491295 - DNA, 16 bp, Homo sapiens
agaatgccatttctca

SEQ ID NO: 4491296 - DNA, 17 bp, Homo sapiens
agaatgccatttctcac

SEQ ID NO: 4491297 - DNA, 21 bp, Homo sapiens
agaatgccatttctcacgccc

SEQ ID NO: 4491298 - DNA, 14 bp, Homo sapiens
agaatgctgtacat

SEQ ID NO: 4491299 - DNA, 13 bp, Homo sapiens
agaatgctttgaa

SEQ ID NO: 4491300 - DNA, 14 bp, Homo sapiens
agaatgctttgaaa

SEQ ID NO: 4491301 - DNA, 15 bp, Homo sapiens
agaatggaaatttat

SEQ ID NO: 4491302 - DNA, 14 bp, Homo sapiens
agaatggaggaaga

SEQ ID NO: 4491303 - DNA, 16 bp, Homo sapiens
agaatggaggaagaac

SEQ ID NO: 4491304 - DNA, 21 bp, Homo sapiens
agaatggaggaagaacaacaa

SEQ ID NO: 4491305 - DNA, 16 bp, Homo sapiens
agaatggtgctgttta

SEQ ID NO: 4491306 - DNA, 22 bp, Homo sapiens
agaatggtgctgtttaaagtca

SEQ ID NO: 4491307 - DNA, 13 bp, Homo sapiens
agaatggtggctt

SEQ ID NO: 4491308 - DNA, 21 bp, Homo sapiens
agaatgtaaagttatgtattt

SEQ ID NO: 4491309 - DNA, 23 bp, Homo sapiens
agaatgtacagttgagctcaggt

SEQ ID NO: 4491310 - DNA, 19 bp, Homo sapiens
agaatgtcagattcctttc

SEQ ID NO: 4491311 - DNA, 20 bp, Homo sapiens
agaatgtcattttggtactt

SEQ ID NO: 4491312 - DNA, 22 bp, Homo sapiens
agaatgtctgaagtacaaacat

SEQ ID NO: 4491313 - DNA, 20 bp, Homo sapiens
agaatgtgaaaaaggaataa

SEQ ID NO: 4491314 - DNA, 17 bp, Homo sapiens
agaatgtgtgtgtgtgg

SEQ ID NO: 4491315 - DNA, 21 bp, Homo sapiens
agaatgtgtgtgtgtggcagg

SEQ ID NO: 4491316 - DNA, 13 bp, Homo sapiens
agaatgtgttctt

SEQ ID NO: 4491317 - DNA, 21 bp, Homo sapiens
agaatgtgttcttttctcctt

SEQ ID NO: 4491318 - DNA, 22 bp, Homo sapiens
agaatgtgttcttttctccttt

SEQ ID NO: 4491319 - DNA, 20 bp, Homo sapiens
agaatgttgaaaagtaattg

SEQ ID NO: 4491320 - DNA, 15 bp, Homo sapiens
agaatgtttcatttg

SEQ ID NO: 4491321 - DNA, 15 bp, Homo sapiens
agaattaaaatttat

SEQ ID NO: 4491322 - DNA, 15 bp, Homo sapiens
agaattaacacatga

SEQ ID NO: 4491323 - DNA, 22 bp, Homo sapiens
agaattaagcagaacactgcag

SEQ ID NO: 4491324 - DNA, 22 bp, Homo sapiens
agaattaccatttgttaatatc

SEQ ID NO: 4491325 - DNA, 16 bp, Homo sapiens
agaattattttaacaa

SEQ ID NO: 4491326 - DNA, 23 bp, Homo sapiens
agaattcactgagttttgtttca

SEQ ID NO: 4491327 - DNA, 21 bp, Homo sapiens
agaattcattcatacttaaaa

SEQ ID NO: 4491328 - DNA, 19 bp, Homo sapiens
agaattcggtgtgctgcca

SEQ ID NO: 4491329 - DNA, 17 bp, Homo sapiens
agaattcttcaggtgga

SEQ ID NO: 4491330 - DNA, 20 bp, Homo sapiens
agaaatgtaattatgttcta

SEQ ID NO: 4491331 - DNA, 13 bp, Homo sapiens
agaaattagattt

SEQ ID NO: 4491332 - DNA, 18 bp, Homo sapiens
agaaattagatttgtgca

SEQ ID NO: 4491333 - DNA, 19 bp, Homo sapiens
agaaattcaatttggattt

SEQ ID NO: 4491334 - DNA, 20 bp, Homo sapiens
agaaattcgtgtgttttttt

SEQ ID NO: 4491335 - DNA, 19 bp, Homo sapiens
agaaattgggctggattgt

SEQ ID NO: 4491336 - DNA, 17 bp, Homo sapiens
agaaattgtatattgta

SEQ ID NO: 4491337 - DNA, 21 bp, Homo sapiens
agaaattgtatattgtaattt

SEQ ID NO: 4491338 - DNA, 17 bp, Homo sapiens
agaaattttgtaagaag

SEQ ID NO: 4491339 - DNA, 21 bp, Homo sapiens
agaaattttgtaagaaggcaa

SEQ ID NO: 4491340 - DNA, 22 bp, Homo sapiens
agaaattttgtaagaaggcaat

SEQ ID NO: 4491341 - DNA, 18 bp, Homo sapiens
agaacaaatattcagaat

SEQ ID NO: 4491342 - DNA, 12 bp, Homo sapiens
agaacaaggcac

SEQ ID NO: 4491343 - DNA, 21 bp, Homo sapiens
agaacaaggcaccttcttaaa

SEQ ID NO: 4491344 - DNA, 15 bp, Homo sapiens
agaacaatgtgctat

SEQ ID NO: 4491345 - DNA, 14 bp, Homo sapiens
agaacactattttc

SEQ ID NO: 4491346 - DNA, 16 bp, Homo sapiens
agaacactattttcag

SEQ ID NO: 4491347 - DNA, 18 bp, Homo sapiens
agaacactattttcagaa

SEQ ID NO: 4491348 - DNA, 19 bp, Homo sapiens
agaacactattttcagaat

SEQ ID NO: 4491349 - DNA, 22 bp, Homo sapiens
agaacactattttcagaatctg

SEQ ID NO: 4491350 - DNA, 18 bp, Homo sapiens
agaacagaggcatttaaa

SEQ ID NO: 4491351 - DNA, 17 bp, Homo sapiens
agaacagtattgggcag

SEQ ID NO: 4491352 - DNA, 18 bp, Homo sapiens
agaacagtattgggcagg

SEQ ID NO: 4491353 - DNA, 19 bp, Homo sapiens
agaacagtattgggcagga

SEQ ID NO: 4491354 - DNA, 20 bp, Homo sapiens
agaacagtattgggcaggag

SEQ ID NO: 4491355 - DNA, 22 bp, Homo sapiens
agaacagtgggcgttgggagcc

SEQ ID NO: 4491356 - DNA, 19 bp, Homo sapiens
agaacatagacagaagaaa

SEQ ID NO: 4491357 - DNA, 21 bp, Homo sapiens
agaacatagacagaagaaaca

SEQ ID NO: 4491358 - DNA, 18 bp, Homo sapiens
agaacatgcagtttgaaa

SEQ ID NO: 4491359 - DNA, 21 bp, Homo sapiens
agaacatgcagtttgaaattc

SEQ ID NO: 4491360 - DNA, 23 bp, Homo sapiens
agaacatgcagtttgaaattctg

SEQ ID NO: 4491361 - DNA, 13 bp, Homo sapiens
agaacattattca

SEQ ID NO: 4491362 - DNA, 20 bp, Homo sapiens
agaacattctctcatagaac

SEQ ID NO: 4491363 - DNA, 19 bp, Homo sapiens
agaaccaaaaatcccacct

SEQ ID NO: 4491364 - DNA, 23 bp, Homo sapiens
agaaccactgtctagagcaactt

SEQ ID NO: 4491365 - DNA, 20 bp, Homo sapiens
agaaccagcactaaggtgga

SEQ ID NO: 4491366 - DNA, 17 bp, Homo sapiens
agaaccagccgtatttt

SEQ ID NO: 4491367 - DNA, 21 bp, Homo sapiens
agaaccagccgtattttacat

SEQ ID NO: 4491368 - DNA, 22 bp, Homo sapiens
agaaccagccgtattttacatg

SEQ ID NO: 4491369 - DNA, 21 bp, Homo sapiens
agaacccagtgtttccacact

SEQ ID NO: 4491370 - DNA, 16 bp, Homo sapiens
agaaccctgccatgga

SEQ ID NO: 4491371 - DNA, 22 bp, Homo sapiens
agaacctacagactccatctct

SEQ ID NO: 4491372 - DNA, 15 bp, Homo sapiens
agaacctcttcccca

SEQ ID NO: 4491373 - DNA, 19 bp, Homo sapiens
agaacctgagttcccggga

SEQ ID NO: 4491374 - DNA, 20 bp, Homo sapiens
agaacctgagttcccgggag

SEQ ID NO: 4491375 - DNA, 15 bp, Homo sapiens
agaacctggaagggc

SEQ ID NO: 4491376 - DNA, 16 bp, Homo sapiens
agaacctggaagggct

SEQ ID NO: 4491377 - DNA, 12 bp, Homo sapiens
agaacctggaga

SEQ ID NO: 4491378 - DNA, 17 bp, Homo sapiens
agaacctggagggctgg

SEQ ID NO: 4491379 - DNA, 17 bp, Homo sapiens
agaacctgtagagctag

SEQ ID NO: 4491380 - DNA, 15 bp, Homo sapiens
agaaccttaatgaca

SEQ ID NO: 4491381 - DNA, 13 bp, Homo sapiens
agaacgcagccct

SEQ ID NO: 4491382 - DNA, 19 bp, Homo sapiens
agaacgcgacttccacaaa

SEQ ID NO: 4491383 - DNA, 20 bp, Homo sapiens
agaacggggctcttctcatt

SEQ ID NO: 4491384 - DNA, 22 bp, Homo sapiens
agaacgtattggtccagcttgc

SEQ ID NO: 4491385 - DNA, 20 bp, Homo sapiens
agaacgttttttcctcagtg

SEQ ID NO: 4491386 - DNA, 18 bp, Homo sapiens
agaactaaatttttcata

SEQ ID NO: 4491387 - DNA, 17 bp, Homo sapiens
agaactagaacctggag

SEQ ID NO: 4491388 - DNA, 18 bp, Homo sapiens
agaactagaacctggagg

SEQ ID NO: 4491389 - DNA, 19 bp, Homo sapiens
agaactagccaaaccagga

SEQ ID NO: 4491390 - DNA, 21 bp, Homo sapiens
agaactagccaaaccaggacc

SEQ ID NO: 4491391 - DNA, 17 bp, Homo sapiens
agaactcattcatagga

SEQ ID NO: 4491392 - DNA, 21 bp, Homo sapiens
agaactctctggaagcccctg

SEQ ID NO: 4491393 - DNA, 19 bp, Homo sapiens
agaactgaattttgggact

SEQ ID NO: 4491394 - DNA, 15 bp, Homo sapiens
agaactgattacatc

SEQ ID NO: 4491395 - DNA, 18 bp, Homo sapiens
agaactgcccttgctgcc

SEQ ID NO: 4491396 - DNA, 23 bp, Homo sapiens
agaactgttgcctaattggaaag

SEQ ID NO: 4491397 - DNA, 14 bp, Homo sapiens
agaacttcatggat

SEQ ID NO: 4491398 - DNA, 18 bp, Homo sapiens
agaactttcatttttttc

SEQ ID NO: 4491399 - DNA, 16 bp, Homo sapiens
agaactttgtattttc

SEQ ID NO: 4491400 - DNA, 12 bp, Homo sapiens
agaagaaaacag

SEQ ID NO: 4491401 - DNA, 13 bp, Homo sapiens
agaagaaacaagg

SEQ ID NO: 4491402 - DNA, 22 bp, Homo sapiens
agaagaaactccgaagaaaaga

SEQ ID NO: 4491403 - DNA, 17 bp, Homo sapiens
agaagaaacttgtaaat

SEQ ID NO: 4491404 - DNA, 20 bp, Homo sapiens
agaagaaacttgtaaatatc

SEQ ID NO: 4491405 - DNA, 12 bp, Homo sapiens
agaagaaagatg

SEQ ID NO: 4491406 - DNA, 22 bp, Homo sapiens
agaagaaagcaaaagcaaggga

SEQ ID NO: 4491407 - DNA, 19 bp, Homo sapiens
agaagaaccaaatacctca

SEQ ID NO: 4491408 - DNA, 18 bp, Homo sapiens
agaagaagaaggagagca

SEQ ID NO: 4491409 - DNA, 19 bp, Homo sapiens
agaagaaggagagcaagaa

SEQ ID NO: 4491410 - DNA, 22 bp, Homo sapiens
agaagaagtttcatcatttttt

SEQ ID NO: 4491411 - DNA, 14 bp, Homo sapiens
agaagaatattgta

SEQ ID NO: 4491412 - DNA, 19 bp, Homo sapiens
agaagaattgaacccagga

SEQ ID NO: 4491413 - DNA, 20 bp, Homo sapiens
agaagaattgaacccaggag

SEQ ID NO: 4491414 - DNA, 15 bp, Homo sapiens
agaagaatttgaaga

SEQ ID NO: 4491415 - DNA, 23 bp, Homo sapiens
agaagaattttcagaccccagcg

SEQ ID NO: 4491416 - DNA, 10 bp, Homo sapiens
agaagacatt

SEQ ID NO: 4491417 - DNA, 19 bp, Homo sapiens
agaagacccacgtgctagg

SEQ ID NO: 4491418 - DNA, 19 bp, Homo sapiens
agaagactttaattatata

SEQ ID NO: 4491419 - DNA, 14 bp, Homo sapiens
agaagagccatctt

SEQ ID NO: 4491420 - DNA, 24 bp, Homo sapiens
agaagagcgagagatcaaagatga

SEQ ID NO: 4491421 - DNA, 13 bp, Homo sapiens
agaagagctgttc

SEQ ID NO: 4491422 - DNA, 16 bp, Homo sapiens
agaagagggaaaacag

SEQ ID NO: 4491423 - DNA, 17 bp, Homo sapiens
agaagagggaaaacaga

SEQ ID NO: 4491424 - DNA, 18 bp, Homo sapiens
agaagagggaaaacagaa

SEQ ID NO: 4491425 - DNA, 20 bp, Homo sapiens
agaagaggttgggcttccat

SEQ ID NO: 4491426 - DNA, 13 bp, Homo sapiens
agaagatagcagg

SEQ ID NO: 4491427 - DNA, 17 bp, Homo sapiens
agaagatgcctgttaat

SEQ ID NO: 4491428 - DNA, 14 bp, Homo sapiens
agaagatgtgtaaa

SEQ ID NO: 4491429 - DNA, 21 bp, Homo sapiens
agaagattctcgccccttccc

SEQ ID NO: 4491430 - DNA, 22 bp, Homo sapiens
agaagattctcgccccttccct

SEQ ID NO: 4491431 - DNA, 17 bp, Homo sapiens
agaagcaatctttgaaa

SEQ ID NO: 4491432 - DNA, 16 bp, Homo sapiens
agaagcacagaatatt

SEQ ID NO: 4491433 - DNA, 19 bp, Homo sapiens
agaagcacagaatattttt

SEQ ID NO: 4491434 - DNA, 15 bp, Homo sapiens
agaagcagtggcctt

SEQ ID NO: 4491435 - DNA, 19 bp, Homo sapiens
agaagcattttgtaagttg

SEQ ID NO: 4491436 - DNA, 21 bp, Homo sapiens
agaagccaagggaaaggggtg

SEQ ID NO: 4491437 - DNA, 21 bp, Homo sapiens
agaagccacaggcctgagatt

SEQ ID NO: 4491438 - DNA, 18 bp, Homo sapiens
agaagccacgctgtcctc

SEQ ID NO: 4491439 - DNA, 20 bp, Homo sapiens
agaagccacgctgtcctctc

SEQ ID NO: 4491440 - DNA, 20 bp, Homo sapiens
agaagccatgtactcaagta

SEQ ID NO: 4491441 - DNA, 17 bp, Homo sapiens
agaagccccacagcctg

SEQ ID NO: 4491442 - DNA, 19 bp, Homo sapiens
agaagcctccaagcacaga

SEQ ID NO: 4491443 - DNA, 23 bp, Homo sapiens
agaagcctccaagcacagagcct

SEQ ID NO: 4491444 - DNA, 12 bp, Homo sapiens
agaagcctcctg

SEQ ID NO: 4491445 - DNA, 23 bp, Homo sapiens
agaagcctctggctagaggccag

SEQ ID NO: 4491446 - DNA, 13 bp, Homo sapiens
agaagcctgatct

SEQ ID NO: 4491447 - DNA, 21 bp, Homo sapiens
agaagcctgcataatgtttct

SEQ ID NO: 4491448 - DNA, 23 bp, Homo sapiens
agaagccttggaaccagccccat

SEQ ID NO: 4491449 - DNA, 17 bp, Homo sapiens
agaaaacccaagttttt

SEQ ID NO: 4491450 - DNA, 13 bp, Homo sapiens
agaaaagaagtga

SEQ ID NO: 4491451 - DNA, 18 bp, Homo sapiens
agaaaagcacctgccgac

SEQ ID NO: 4491452 - DNA, 23 bp, Homo sapiens
agaaaagcgcgttgtgtatatta

SEQ ID NO: 4491453 - DNA, 16 bp, Homo sapiens
agaaaaggattttgga

SEQ ID NO: 4491454 - DNA, 17 bp, Homo sapiens
agaaaaggattttggaa

SEQ ID NO: 4491455 - DNA, 15 bp, Homo sapiens
agaaaagtaatgaag

SEQ ID NO: 4491456 - DNA, 14 bp, Homo sapiens
agaaaagtagacaa

SEQ ID NO: 4491457 - DNA, 15 bp, Homo sapiens
agaaaagtagacaat

SEQ ID NO: 4491458 - DNA, 15 bp, Homo sapiens
agaaaagtgaattga

SEQ ID NO: 4491459 - DNA, 19 bp, Homo sapiens
agaaaagtgaattgaagtt

SEQ ID NO: 4491460 - DNA, 20 bp, Homo sapiens
agaaaatataaggacttttt

SEQ ID NO: 4491461 - DNA, 23 bp, Homo sapiens
agaaaatatatgtatttttatat

SEQ ID NO: 4491462 - DNA, 15 bp, Homo sapiens
agaaaatatttaact

SEQ ID NO: 4491463 - DNA, 19 bp, Homo sapiens
agaaaatatttaatatcaa

SEQ ID NO: 4491464 - DNA, 20 bp, Homo sapiens
agaaaatatttaatatcaaa

SEQ ID NO: 4491465 - DNA, 16 bp, Homo sapiens
agaaaatcaggctggc

SEQ ID NO: 4491466 - DNA, 15 bp, Homo sapiens
agaaaatctttataa

SEQ ID NO: 4491467 - DNA, 13 bp, Homo sapiens
agaaaatgcaatg

SEQ ID NO: 4491468 - DNA, 12 bp, Homo sapiens
agaaaatggcac

SEQ ID NO: 4491469 - DNA, 23 bp, Homo sapiens
agaaaatggcacttgggggactg

SEQ ID NO: 4491470 - DNA, 10 bp, Homo sapiens
agaaaatgtc

SEQ ID NO: 4491471 - DNA, 22 bp, Homo sapiens
agaaaatgtctttctcttcctt

SEQ ID NO: 4491472 - DNA, 14 bp, Homo sapiens
agaaaatgttctgt

SEQ ID NO: 4491473 - DNA, 16 bp, Homo sapiens
agaaaatgttgagaat

SEQ ID NO: 4491474 - DNA, 20 bp, Homo sapiens
agaaaattatgtaaagttta

SEQ ID NO: 4491475 - DNA, 15 bp, Homo sapiens
agaaaattcctataa

SEQ ID NO: 4491476 - DNA, 19 bp, Homo sapiens
agaaaattcctataaggaa

SEQ ID NO: 4491477 - DNA, 15 bp, Homo sapiens
agaaaattgatattt

SEQ ID NO: 4491478 - DNA, 21 bp, Homo sapiens
agaaaatttacaaaatttatt

SEQ ID NO: 4491479 - DNA, 11 bp, Homo sapiens
agaaaatttta

SEQ ID NO: 4491480 - DNA, 16 bp, Homo sapiens
agaaaatttttgtagt

SEQ ID NO: 4491481 - DNA, 19 bp, Homo sapiens
agaaacaaaaatcaaactt

SEQ ID NO: 4491482 - DNA, 17 bp, Homo sapiens
agaaacagagtggcctc

SEQ ID NO: 4491483 - DNA, 14 bp, Homo sapiens
agaaacagtgtgca

SEQ ID NO: 4491484 - DNA, 17 bp, Homo sapiens
agaaacagttggtaact

SEQ ID NO: 4491485 - DNA, 21 bp, Homo sapiens
agaaacagttggtaacttttg

SEQ ID NO: 4491486 - DNA, 21 bp, Homo sapiens
agaaaccctcattgtgtttct

SEQ ID NO: 4491487 - DNA, 14 bp, Homo sapiens
agaaaccctgtctc

SEQ ID NO: 4491488 - DNA, 19 bp, Homo sapiens
agaaaccttgctctcctca

SEQ ID NO: 4491489 - DNA, 17 bp, Homo sapiens
agaaacgtaaactatga

SEQ ID NO: 4491490 - DNA, 17 bp, Homo sapiens
agaaactaaacagaaaa

SEQ ID NO: 4491491 - DNA, 14 bp, Homo sapiens
agaaactatttctg

SEQ ID NO: 4491492 - DNA, 19 bp, Homo sapiens
agaaactccgaagaaaaga

SEQ ID NO: 4491493 - DNA, 23 bp, Homo sapiens
agaaactgctgcagattagttct

SEQ ID NO: 4491494 - DNA, 19 bp, Homo sapiens
agaaacttccaaatcccct

SEQ ID NO: 4491495 - DNA, 12 bp, Homo sapiens
agaaacttccag

SEQ ID NO: 4491496 - DNA, 14 bp, Homo sapiens
agaaacttgtaaat

SEQ ID NO: 4491497 - DNA, 23 bp, Homo sapiens
agaaacttgtgaagtggaaatgt

SEQ ID NO: 4491498 - DNA, 15 bp, Homo sapiens
agaaacttttttatt

SEQ ID NO: 4491499 - DNA, 18 bp, Homo sapiens
agaaagaaagggaaactg

SEQ ID NO: 4491500 - DNA, 17 bp, Homo sapiens
agaaagaaagtacccag

SEQ ID NO: 4491501 - DNA, 23 bp, Homo sapiens
agaaagaaagtacccagcaaatg

SEQ ID NO: 4491502 - DNA, 17 bp, Homo sapiens
agaaagaataaaatgtt

SEQ ID NO: 4491503 - DNA, 16 bp, Homo sapiens
agaaagaatgcaagag

SEQ ID NO: 4491504 - DNA, 21 bp, Homo sapiens
agaaagaatgttactgcctta

SEQ ID NO: 4491505 - DNA, 12 bp, Homo sapiens
agaaagagctac

SEQ ID NO: 4491506 - DNA, 22 bp, Homo sapiens
agaaagaggcaccaggaagccg

SEQ ID NO: 4491507 - DNA, 13 bp, Homo sapiens
agaaagatttaaa

SEQ ID NO: 4491508 - DNA, 19 bp, Homo sapiens
agaaagatttgatgggcca

SEQ ID NO: 4491509 - DNA, 19 bp, Homo sapiens
agaaagcacttaaacagaa

SEQ ID NO: 4491510 - DNA, 17 bp, Homo sapiens
agaaagcagaacagtga

SEQ ID NO: 4491511 - DNA, 16 bp, Homo sapiens
agaaagcatattgact

SEQ ID NO: 4491512 - DNA, 17 bp, Homo sapiens
agaaagcatccctcacc

SEQ ID NO: 4491513 - DNA, 19 bp, Homo sapiens
agaaagcatccctcaccca

SEQ ID NO: 4491514 - DNA, 23 bp, Homo sapiens
agaaagcatttcttttctcttta

SEQ ID NO: 4491515 - DNA, 16 bp, Homo sapiens
agaaagccaccttgtt

SEQ ID NO: 4491516 - DNA, 20 bp, Homo sapiens
agaaagccacgccctccctg

SEQ ID NO: 4491517 - DNA, 20 bp, Homo sapiens
agaaagccaggagcagccct

SEQ ID NO: 4491518 - DNA, 21 bp, Homo sapiens
agaaagcctcctgccccctgc

SEQ ID NO: 4491519 - DNA, 15 bp, Homo sapiens
agaaagctaaagtga

SEQ ID NO: 4491520 - DNA, 14 bp, Homo sapiens
agaaagctaaatga

SEQ ID NO: 4491521 - DNA, 15 bp, Homo sapiens
agaaagcttcatcca

SEQ ID NO: 4491522 - DNA, 14 bp, Homo sapiens
agaaagcttttatt

SEQ ID NO: 4491523 - DNA, 17 bp, Homo sapiens
agaaagcttttattcct

SEQ ID NO: 4491524 - DNA, 14 bp, Homo sapiens
agaaaggaaaagaa

SEQ ID NO: 4491525 - DNA, 14 bp, Homo sapiens
agaaaggaaacctt

SEQ ID NO: 4491526 - DNA, 21 bp, Homo sapiens
agaaaggaaaccttttcttgt

SEQ ID NO: 4491527 - DNA, 17 bp, Homo sapiens
agaaaggaagcattgta

SEQ ID NO: 4491528 - DNA, 17 bp, Homo sapiens
agaaaggcaggtttcat

SEQ ID NO: 4491529 - DNA, 22 bp, Homo sapiens
agaaaggcaggtttcatttctt

SEQ ID NO: 4491530 - DNA, 21 bp, Homo sapiens
agaaaggctgttaaatacagg

SEQ ID NO: 4491531 - DNA, 16 bp, Homo sapiens
agaaagggaaactggc

SEQ ID NO: 4491532 - DNA, 16 bp, Homo sapiens
agaaagtaagcatttc

SEQ ID NO: 4491533 - DNA, 19 bp, Homo sapiens
agaaagtggaaaacaagga

SEQ ID NO: 4491534 - DNA, 20 bp, Homo sapiens
agaaagtggaaaacaaggaa

SEQ ID NO: 4491535 - DNA, 13 bp, Homo sapiens
agaaagtgggggt

SEQ ID NO: 4491536 - DNA, 16 bp, Homo sapiens
agaaagtgggggtgga

SEQ ID NO: 4491537 - DNA, 20 bp, Homo sapiens
agaaagtgggggtggaggac

SEQ ID NO: 4491538 - DNA, 11 bp, Homo sapiens
agaaagtgtat

SEQ ID NO: 4491539 - DNA, 23 bp, Homo sapiens
agaaagtgtgagcaaactaactt

SEQ ID NO: 4491540 - DNA, 21 bp, Homo sapiens
agaaagttggccaatttcacc

SEQ ID NO: 4491541 - DNA, 22 bp, Homo sapiens
agaaataaaatatctccaaatg

SEQ ID NO: 4491542 - DNA, 14 bp, Homo sapiens
agaaataaacctta

SEQ ID NO: 4491543 - DNA, 14 bp, Homo sapiens
agaaataaattact

SEQ ID NO: 4491544 - DNA, 13 bp, Homo sapiens
agaaataagtttt

SEQ ID NO: 4491545 - DNA, 16 bp, Homo sapiens
agaaatacaaaataaa

SEQ ID NO: 4491546 - DNA, 19 bp, Homo sapiens
agaaatacagtcttccaca

SEQ ID NO: 4491547 - DNA, 13 bp, Homo sapiens
agaaatagacaaa

SEQ ID NO: 4491548 - DNA, 14 bp, Homo sapiens
agaaatagacaaaa

SEQ ID NO: 4491549 - DNA, 23 bp, Homo sapiens
agaaatatacagtttgacttttt

SEQ ID NO: 4491550 - DNA, 21 bp, Homo sapiens
agaaatatatcctgtgtacct

SEQ ID NO: 4491551 - DNA, 12 bp, Homo sapiens
agaaatatctgt

SEQ ID NO: 4491552 - DNA, 14 bp, Homo sapiens
agaaatatctgtga

SEQ ID NO: 4491553 - DNA, 15 bp, Homo sapiens
agaaatatctgtgaa

SEQ ID NO: 4491554 - DNA, 19 bp, Homo sapiens
agaaatatctgtgaaatat

SEQ ID NO: 4491555 - DNA, 14 bp, Homo sapiens
agaaatatggacac

SEQ ID NO: 4491556 - DNA, 13 bp, Homo sapiens
agaaatattgact

SEQ ID NO: 4491557 - DNA, 19 bp, Homo sapiens
agaaatattttaaaatcag

SEQ ID NO: 4491558 - DNA, 19 bp, Homo sapiens
agaaatcaatagttgaatt

SEQ ID NO: 4491559 - DNA, 13 bp, Homo sapiens
agaaatcttgctt

SEQ ID NO: 4491560 - DNA, 22 bp, Homo sapiens
agaaatcttgcttcagaccatc

SEQ ID NO: 4491561 - DNA, 16 bp, Homo sapiens
agaaatgaacattcca

SEQ ID NO: 4491562 - DNA, 18 bp, Homo sapiens
agaaatgaagtttatatt

SEQ ID NO: 4491563 - DNA, 15 bp, Homo sapiens
agaaatgcaataact

SEQ ID NO: 4491564 - DNA, 16 bp, Homo sapiens
agaaatgcaataactc

SEQ ID NO: 4491565 - DNA, 19 bp, Homo sapiens
agaaatgcaataactctgg

SEQ ID NO: 4491566 - DNA, 21 bp, Homo sapiens
agaaatgcactaagacaagaa

SEQ ID NO: 4491567 - DNA, 22 bp, Homo sapiens
agaaatgcatccattcctcagg

SEQ ID NO: 4491568 - DNA, 11 bp, Homo sapiens
agaaatgccag

SEQ ID NO: 4491569 - DNA, 20 bp, Homo sapiens
agaaatgctggtttttcagt

SEQ ID NO: 4491570 - DNA, 16 bp, Homo sapiens
actttcaagacagatg

SEQ ID NO: 4491571 - DNA, 16 bp, Homo sapiens
actttcaatattttaa

SEQ ID NO: 4491572 - DNA, 20 bp, Homo sapiens
actttcaattgtcacttttt

SEQ ID NO: 4491573 - DNA, 23 bp, Homo sapiens
actttcactataatgtgaaatgt

SEQ ID NO: 4491574 - DNA, 20 bp, Homo sapiens
actttcaggctactgttctt

SEQ ID NO: 4491575 - DNA, 22 bp, Homo sapiens
actttcatcttaaactaatacg

SEQ ID NO: 4491576 - DNA, 24 bp, Homo sapiens
actttcatcttaaactaatacgtg

SEQ ID NO: 4491577 - DNA, 18 bp, Homo sapiens
actttcattgccagtgtc

SEQ ID NO: 4491578 - DNA, 17 bp, Homo sapiens
actttccgagcctccag

SEQ ID NO: 4491579 - DNA, 13 bp, Homo sapiens
actttcctcaaat

SEQ ID NO: 4491580 - DNA, 20 bp, Homo sapiens
actttcgaccgactttcccc

SEQ ID NO: 4491581 - DNA, 18 bp, Homo sapiens
actttcgtaatagctcag

SEQ ID NO: 4491582 - DNA, 17 bp, Homo sapiens
actttctcagttttcat

SEQ ID NO: 4491583 - DNA, 16 bp, Homo sapiens
actttctccatttaag

SEQ ID NO: 4491584 - DNA, 21 bp, Homo sapiens
actttctcccagtatgtttta

SEQ ID NO: 4491585 - DNA, 22 bp, Homo sapiens
actttctgtctaggttaaagct

SEQ ID NO: 4491586 - DNA, 11 bp, Homo sapiens
actttcttcaa

SEQ ID NO: 4491587 - DNA, 16 bp, Homo sapiens
actttctttagtcttt

SEQ ID NO: 4491588 - DNA, 16 bp, Homo sapiens
actttctttctcacta

SEQ ID NO: 4491589 - DNA, 17 bp, Homo sapiens
actttcttttattaata

SEQ ID NO: 4491590 - DNA, 20 bp, Homo sapiens
actttgaataaagaatactt

SEQ ID NO: 4491591 - DNA, 18 bp, Homo sapiens
actttgacagtgttttta

SEQ ID NO: 4491592 - DNA, 22 bp, Homo sapiens
actttgatgtcatgtgttccct

SEQ ID NO: 4491593 - DNA, 20 bp, Homo sapiens
actttgcaatccaaataaag

SEQ ID NO: 4491594 - DNA, 21 bp, Homo sapiens
actttgcacactttggcccag

SEQ ID NO: 4491595 - DNA, 13 bp, Homo sapiens
actttgcattgtc

SEQ ID NO: 4491596 - DNA, 14 bp, Homo sapiens
actttgccaaggct

SEQ ID NO: 4491597 - DNA, 17 bp, Homo sapiens
actttgccaaggctctc

SEQ ID NO: 4491598 - DNA, 23 bp, Homo sapiens
actttgcctcctgtgtactgtgt

SEQ ID NO: 4491599 - DNA, 20 bp, Homo sapiens
actttgctaaagacatgaag

SEQ ID NO: 4491600 - DNA, 15 bp, Homo sapiens
actttgctgttactg

SEQ ID NO: 4491601 - DNA, 16 bp, Homo sapiens
actttgctgttactgc

SEQ ID NO: 4491602 - DNA, 14 bp, Homo sapiens
actttgcttcccat

SEQ ID NO: 4491603 - DNA, 16 bp, Homo sapiens
actttgggaggccaag

SEQ ID NO: 4491604 - DNA, 17 bp, Homo sapiens
actttgggaggccaagg

SEQ ID NO: 4491605 - DNA, 22 bp, Homo sapiens
actttggtagctgggaaagcat

SEQ ID NO: 4491606 - DNA, 12 bp, Homo sapiens
actttgtaaatt

SEQ ID NO: 4491607 - DNA, 17 bp, Homo sapiens
actttgtacatttggga

SEQ ID NO: 4491608 - DNA, 14 bp, Homo sapiens
actttgtatacaag

SEQ ID NO: 4491609 - DNA, 17 bp, Homo sapiens
actttgtatactttaaa

SEQ ID NO: 4491610 - DNA, 13 bp, Homo sapiens
actttgtcttttc

SEQ ID NO: 4491611 - DNA, 20 bp, Homo sapiens
actttgtggaccaattattg

SEQ ID NO: 4491612 - DNA, 11 bp, Homo sapiens
actttgtgttt

SEQ ID NO: 4491613 - DNA, 20 bp, Homo sapiens
actttgttaggattttcaca

SEQ ID NO: 4491614 - DNA, 15 bp, Homo sapiens
actttgttgcaagat

SEQ ID NO: 4491615 - DNA, 17 bp, Homo sapiens
actttgttgcaagatgt

SEQ ID NO: 4491616 - DNA, 22 bp, Homo sapiens
actttgttgcaagatgtgaatt

SEQ ID NO: 4491617 - DNA, 15 bp, Homo sapiens
acttttaaaatttgt

SEQ ID NO: 4491618 - DNA, 14 bp, Homo sapiens
acttttaaactgtg

SEQ ID NO: 4491619 - DNA, 15 bp, Homo sapiens
acttttaaactgtgt

SEQ ID NO: 4491620 - DNA, 17 bp, Homo sapiens
acttttaaactgtgtac

SEQ ID NO: 4491621 - DNA, 20 bp, Homo sapiens
acttttaaactgtgtacata

SEQ ID NO: 4491622 - DNA, 19 bp, Homo sapiens
acttttaagatttctctaa

SEQ ID NO: 4491623 - DNA, 19 bp, Homo sapiens
acttttaaggataaatcat

SEQ ID NO: 4491624 - DNA, 14 bp, Homo sapiens
acttttacagatta

SEQ ID NO: 4491625 - DNA, 16 bp, Homo sapiens
acttttataaattaaa

SEQ ID NO: 4491626 - DNA, 17 bp, Homo sapiens
acttttataaattaaat

SEQ ID NO: 4491627 - DNA, 21 bp, Homo sapiens
acttttataaattaaatatat

SEQ ID NO: 4491628 - DNA, 15 bp, Homo sapiens
acttttatgaagttt

SEQ ID NO: 4491629 - DNA, 13 bp, Homo sapiens
acttttattattt

SEQ ID NO: 4491630 - DNA, 17 bp, Homo sapiens
acttttcatatcatttc

SEQ ID NO: 4491631 - DNA, 10 bp, Homo sapiens
acttttcatt

SEQ ID NO: 4491632 - DNA, 18 bp, Homo sapiens
acttttcattctctttta

SEQ ID NO: 4491633 - DNA, 19 bp, Homo sapiens
acttttccaagcaaaatct

SEQ ID NO: 4491634 - DNA, 20 bp, Homo sapiens
acttttcctcttagaagaat

SEQ ID NO: 4491635 - DNA, 18 bp, Homo sapiens
acttttctaaaatctaaa

SEQ ID NO: 4491636 - DNA, 12 bp, Homo sapiens
acttttctcttt

SEQ ID NO: 4491637 - DNA, 12 bp, Homo sapiens
acttttgaaaga

SEQ ID NO: 4491638 - DNA, 16 bp, Homo sapiens
acttttgagacttttt

SEQ ID NO: 4491639 - DNA, 20 bp, Homo sapiens
acttttgctgtttatacttg

SEQ ID NO: 4491640 - DNA, 18 bp, Homo sapiens
acttttggaaccatgcct

SEQ ID NO: 4491641 - DNA, 21 bp, Homo sapiens
acttttggaaccatgccttcc

SEQ ID NO: 4491642 - DNA, 18 bp, Homo sapiens
acttttgtactgaatttt

SEQ ID NO: 4491643 - DNA, 18 bp, Homo sapiens
acttttgttaacagtatt

SEQ ID NO: 4491644 - DNA, 16 bp, Homo sapiens
actttttaaaaataac

SEQ ID NO: 4491645 - DNA, 14 bp, Homo sapiens
actttttaaaatac

SEQ ID NO: 4491646 - DNA, 16 bp, Homo sapiens
actttttaagtttgaa

SEQ ID NO: 4491647 - DNA, 11 bp, Homo sapiens
actttttaatt

SEQ ID NO: 4491648 - DNA, 14 bp, Homo sapiens
actttttacagcag

SEQ ID NO: 4491649 - DNA, 20 bp, Homo sapiens
actttttacagcagcaatat

SEQ ID NO: 4491650 - DNA, 17 bp, Homo sapiens
actttttagtaatttct

SEQ ID NO: 4491651 - DNA, 12 bp, Homo sapiens
actttttataaa

SEQ ID NO: 4491652 - DNA, 22 bp, Homo sapiens
actttttatgggtgaaaataag

SEQ ID NO: 4491653 - DNA, 14 bp, Homo sapiens
actttttattgcct

SEQ ID NO: 4491654 - DNA, 13 bp, Homo sapiens
actttttcatgaa

SEQ ID NO: 4491655 - DNA, 18 bp, Homo sapiens
actttttccttactgtgc

SEQ ID NO: 4491656 - DNA, 11 bp, Homo sapiens
actttttctga

SEQ ID NO: 4491657 - DNA, 20 bp, Homo sapiens
actttttggaattcagcagt

SEQ ID NO: 4491658 - DNA, 21 bp, Homo sapiens
actttttggaattcagcagtt

SEQ ID NO: 4491659 - DNA, 19 bp, Homo sapiens
actttttggtggatgtaaa

SEQ ID NO: 4491660 - DNA, 21 bp, Homo sapiens
actttttggtggatgtaaata

SEQ ID NO: 4491661 - DNA, 13 bp, Homo sapiens
actttttgttcat

SEQ ID NO: 4491662 - DNA, 16 bp, Homo sapiens
actttttgttcatgtg

SEQ ID NO: 4491663 - DNA, 23 bp, Homo sapiens
actttttgtttttatttctttta

SEQ ID NO: 4491664 - DNA, 19 bp, Homo sapiens
acttttttaaatattttct

SEQ ID NO: 4491665 - DNA, 19 bp, Homo sapiens
acttttttagaaatgcaaa

SEQ ID NO: 4491666 - DNA, 23 bp, Homo sapiens
acttttttatttaaaaaactaaa

SEQ ID NO: 4491667 - DNA, 20 bp, Homo sapiens
acttttttgagtcattgact

SEQ ID NO: 4491668 - DNA, 12 bp, Homo sapiens
actttttttagt

SEQ ID NO: 4491669 - DNA, 20 bp, Homo sapiens
actttttttctgtaccagtt

SEQ ID NO: 4491670 - DNA, 15 bp, Homo sapiens
acttttttttaagtt

SEQ ID NO: 4491671 - DNA, 17 bp, Homo sapiens
acttttttttctctctt

SEQ ID NO: 4491672 - DNA, 19 bp, Homo sapiens
acttttttttctctctttt

SEQ ID NO: 4491673 - DNA, 21 bp, Homo sapiens
actttttttttttttgagatg

SEQ ID NO: 4491674 - DNA, 15 bp, Homo sapiens
agaaaaaaattgctc

SEQ ID NO: 4491675 - DNA, 16 bp, Homo sapiens
agaaaaaaattgctct

SEQ ID NO: 4491676 - DNA, 18 bp, Homo sapiens
agaaaaacaataaagata

SEQ ID NO: 4491677 - DNA, 14 bp, Homo sapiens
agaaaaagaagcaa

SEQ ID NO: 4491678 - DNA, 12 bp, Homo sapiens
agaaaaaggaaa

SEQ ID NO: 4491679 - DNA, 17 bp, Homo sapiens
agaaaaaggacaaataa

SEQ ID NO: 4491680 - DNA, 13 bp, Homo sapiens
agaaaaagggtca

SEQ ID NO: 4491681 - DNA, 19 bp, Homo sapiens
agaaaaataaaaatctctt

SEQ ID NO: 4491682 - DNA, 17 bp, Homo sapiens
agaaaaatagagcaaaa

SEQ ID NO: 4491683 - DNA, 17 bp, Homo sapiens
agaaaaatatatactaa

SEQ ID NO: 4491684 - DNA, 22 bp, Homo sapiens
agaaaaatctcattatttcaaa

SEQ ID NO: 4491685 - DNA, 19 bp, Homo sapiens
agaaaaatttacatggcaa

SEQ ID NO: 4491686 - DNA, 12 bp, Homo sapiens
agaaaacaaaaa

SEQ ID NO: 4491687 - DNA, 17 bp, Homo sapiens
agaaaacaagtatataa

SEQ ID NO: 4491688 - DNA, 17 bp, Homo sapiens
agaaaacacttgtaagt

SEQ ID NO: 4491689 - DNA, 14 bp, Homo sapiens
agaaaacagtacag

SEQ ID NO: 4491690 - DNA, 22 bp, Homo sapiens
agaaaacataatatagcttaaa

SEQ ID NO: 4491691 - DNA, 22 bp, Homo sapiens
acttcaggtggagagcactaga

SEQ ID NO: 4491692 - DNA, 21 bp, Homo sapiens
acttcagtttcacagaaaata

SEQ ID NO: 4491693 - DNA, 22 bp, Homo sapiens
acttcatgtaattttattttaa

SEQ ID NO: 4491694 - DNA, 15 bp, Homo sapiens
acttcattttatatt

SEQ ID NO: 4491695 - DNA, 22 bp, Homo sapiens
acttcattttatatttaaaaaa

SEQ ID NO: 4491696 - DNA, 22 bp, Homo sapiens
acttcatttttattaaacagtg

SEQ ID NO: 4491697 - DNA, 15 bp, Homo sapiens
acttccaaagaaagt

SEQ ID NO: 4491698 - DNA, 18 bp, Homo sapiens
acttccaaagaaagttct

SEQ ID NO: 4491699 - DNA, 20 bp, Homo sapiens
acttccaaagactccctcca

SEQ ID NO: 4491700 - DNA, 19 bp, Homo sapiens
acttccaaatcccctaagc

SEQ ID NO: 4491701 - DNA, 15 bp, Homo sapiens
acttccaggatggat

SEQ ID NO: 4491702 - DNA, 20 bp, Homo sapiens
acttccaggtctgcctggtt

SEQ ID NO: 4491703 - DNA, 18 bp, Homo sapiens
acttccagtctggagagc

SEQ ID NO: 4491704 - DNA, 11 bp, Homo sapiens
acttcctctgt

SEQ ID NO: 4491705 - DNA, 18 bp, Homo sapiens
acttcctctgtgaactgt

SEQ ID NO: 4491706 - DNA, 13 bp, Homo sapiens
acttcctgtggcc

SEQ ID NO: 4491707 - DNA, 16 bp, Homo sapiens
acttcctgtggcctga

SEQ ID NO: 4491708 - DNA, 21 bp, Homo sapiens
acttcctgtggcctgaagaag

SEQ ID NO: 4491709 - DNA, 15 bp, Homo sapiens
acttccttactttta

SEQ ID NO: 4491710 - DNA, 21 bp, Homo sapiens
acttctaagtaaaaccacagc

SEQ ID NO: 4491711 - DNA, 22 bp, Homo sapiens
acttctacctacatatttgtat

SEQ ID NO: 4491712 - DNA, 19 bp, Homo sapiens
acttctagatctcagccat

SEQ ID NO: 4491713 - DNA, 14 bp, Homo sapiens
acttctatttagcc

SEQ ID NO: 4491714 - DNA, 20 bp, Homo sapiens
acttctatttatttattatt

SEQ ID NO: 4491715 - DNA, 12 bp, Homo sapiens
acttctcaagta

SEQ ID NO: 4491716 - DNA, 20 bp, Homo sapiens
acttctcattttttaaaaaa

SEQ ID NO: 4491717 - DNA, 19 bp, Homo sapiens
acttctcggaattcataat

SEQ ID NO: 4491718 - DNA, 21 bp, Homo sapiens
acttctcttaaacttgtgaat

SEQ ID NO: 4491719 - DNA, 12 bp, Homo sapiens
acttctgcagct

SEQ ID NO: 4491720 - DNA, 17 bp, Homo sapiens
acttctgggcttcatct

SEQ ID NO: 4491721 - DNA, 19 bp, Homo sapiens
acttctgggcttcatctgg

SEQ ID NO: 4491722 - DNA, 22 bp, Homo sapiens
acttctgtcttcacaacagatt

SEQ ID NO: 4491723 - DNA, 23 bp, Homo sapiens
acttctgtttgatcactgtgaac

SEQ ID NO: 4491724 - DNA, 21 bp, Homo sapiens
acttcttaaaggaattctaca

SEQ ID NO: 4491725 - DNA, 11 bp, Homo sapiens
acttcttcctg

SEQ ID NO: 4491726 - DNA, 18 bp, Homo sapiens
acttcttctcttagattc

SEQ ID NO: 4491727 - DNA, 21 bp, Homo sapiens
acttcttgaatataaaaaatc

SEQ ID NO: 4491728 - DNA, 15 bp, Homo sapiens
acttctttttcatta

SEQ ID NO: 4491729 - DNA, 17 bp, Homo sapiens
acttgaaaccagtattt

SEQ ID NO: 4491730 - DNA, 15 bp, Homo sapiens
acttgaaacccattt

SEQ ID NO: 4491731 - DNA, 12 bp, Homo sapiens
acttgaaagaaa

SEQ ID NO: 4491732 - DNA, 20 bp, Homo sapiens
acttgaaatatataatattc

SEQ ID NO: 4491733 - DNA, 16 bp, Homo sapiens
acttgaacaaaagggt

SEQ ID NO: 4491734 - DNA, 20 bp, Homo sapiens
acttgaacaaaagggtcaga

SEQ ID NO: 4491735 - DNA, 19 bp, Homo sapiens
acttgaacccgggaggcag

SEQ ID NO: 4491736 - DNA, 23 bp, Homo sapiens
acttgaacccgggggacagaggt

SEQ ID NO: 4491737 - DNA, 13 bp, Homo sapiens
acttgaagctaac

SEQ ID NO: 4491738 - DNA, 17 bp, Homo sapiens
acttgaaggtacacccc

SEQ ID NO: 4491739 - DNA, 20 bp, Homo sapiens
acttgaataaccatctgaaa

SEQ ID NO: 4491740 - DNA, 15 bp, Homo sapiens
acttgaatagtattg

SEQ ID NO: 4491741 - DNA, 19 bp, Homo sapiens
acttgactctaatatgatt

SEQ ID NO: 4491742 - DNA, 20 bp, Homo sapiens
acttgactctaatatgatta

SEQ ID NO: 4491743 - DNA, 22 bp, Homo sapiens
acttgagaaccagtctcctcac

SEQ ID NO: 4491744 - DNA, 14 bp, Homo sapiens
acttgagccactcc

SEQ ID NO: 4491745 - DNA, 20 bp, Homo sapiens
acttgagtataagataaaat

SEQ ID NO: 4491746 - DNA, 12 bp, Homo sapiens
acttgatattta

SEQ ID NO: 4491747 - DNA, 22 bp, Homo sapiens
acttgatgttccacctgccaca

SEQ ID NO: 4491748 - DNA, 21 bp, Homo sapiens
acttgcaaccgtctgttatgc

SEQ ID NO: 4491749 - DNA, 17 bp, Homo sapiens
acttgcctcatttccct

SEQ ID NO: 4491750 - DNA, 21 bp, Homo sapiens
acttgcgagtccaaggccagt

SEQ ID NO: 4491751 - DNA, 20 bp, Homo sapiens
acttgctccctctccaagac

SEQ ID NO: 4491752 - DNA, 19 bp, Homo sapiens
acttgcttaaatttcttat

SEQ ID NO: 4491753 - DNA, 13 bp, Homo sapiens
acttgcttcagtg

SEQ ID NO: 4491754 - DNA, 23 bp, Homo sapiens
acttgcttctaaatgcccagttc

SEQ ID NO: 4491755 - DNA, 21 bp, Homo sapiens
acttgcttgctgacttagcct

SEQ ID NO: 4491756 - DNA, 22 bp, Homo sapiens
acttgcttgctgacttagcctc

SEQ ID NO: 4491757 - DNA, 22 bp, Homo sapiens
acttggaaatcagtagaaagct

SEQ ID NO: 4491758 - DNA, 20 bp, Homo sapiens
acttggacccaaaaaatcat

SEQ ID NO: 4491759 - DNA, 19 bp, Homo sapiens
acttggagactcctggtct

SEQ ID NO: 4491760 - DNA, 16 bp, Homo sapiens
acttggaggacctggc

SEQ ID NO: 4491761 - DNA, 20 bp, Homo sapiens
acttggatttagtttcagta

SEQ ID NO: 4491762 - DNA, 22 bp, Homo sapiens
acttggcaaggtcatagacaat

SEQ ID NO: 4491763 - DNA, 15 bp, Homo sapiens
acttggcatacaaaa

SEQ ID NO: 4491764 - DNA, 19 bp, Homo sapiens
acttgggggactgggcgca

SEQ ID NO: 4491765 - DNA, 13 bp, Homo sapiens
acttgtaaaatgc

SEQ ID NO: 4491766 - DNA, 15 bp, Homo sapiens
acttgtaaaatgctt

SEQ ID NO: 4491767 - DNA, 19 bp, Homo sapiens
acttgtaaaatgcttttca

SEQ ID NO: 4491768 - DNA, 16 bp, Homo sapiens
acttgtaaatatcttt

SEQ ID NO: 4491769 - DNA, 16 bp, Homo sapiens
acttgtaatatgtata

SEQ ID NO: 4491770 - DNA, 19 bp, Homo sapiens
acttgtacaaacagtattt

SEQ ID NO: 4491771 - DNA, 14 bp, Homo sapiens
acttgtagcagcta

SEQ ID NO: 4491772 - DNA, 17 bp, Homo sapiens
acttgtctggctttggc

SEQ ID NO: 4491773 - DNA, 14 bp, Homo sapiens
acttgtctttactg

SEQ ID NO: 4491774 - DNA, 11 bp, Homo sapiens
acttgtgaatg

SEQ ID NO: 4491775 - DNA, 17 bp, Homo sapiens
acttgtgaatgcttctc

SEQ ID NO: 4491776 - DNA, 19 bp, Homo sapiens
acttgtgagcatcagaggg

SEQ ID NO: 4491777 - DNA, 16 bp, Homo sapiens
acttgtgatgagagat

SEQ ID NO: 4491778 - DNA, 15 bp, Homo sapiens
acttgtgtgcatgga

SEQ ID NO: 4491779 - DNA, 16 bp, Homo sapiens
acttgtgtgcatggaa

SEQ ID NO: 4491780 - DNA, 21 bp, Homo sapiens
acttgtgttcaatctgtgaag

SEQ ID NO: 4491781 - DNA, 17 bp, Homo sapiens
acttgttccagctcttt

SEQ ID NO: 4491782 - DNA, 16 bp, Homo sapiens
acttgtttgaatattt

SEQ ID NO: 4491783 - DNA, 22 bp, Homo sapiens
acttgtttgaatatttgtttta

SEQ ID NO: 4491784 - DNA, 18 bp, Homo sapiens
actttaaatggaataatt

SEQ ID NO: 4491785 - DNA, 19 bp, Homo sapiens
actttaaatggaataatta

SEQ ID NO: 4491786 - DNA, 15 bp, Homo sapiens
actttaaattatatg

SEQ ID NO: 4491787 - DNA, 22 bp, Homo sapiens
actttacaaaccattacctgta

SEQ ID NO: 4491788 - DNA, 15 bp, Homo sapiens
actttacaaaccttt

SEQ ID NO: 4491789 - DNA, 21 bp, Homo sapiens
actttacaaacctttgtttca

SEQ ID NO: 4491790 - DNA, 14 bp, Homo sapiens
actttacagaaatg

SEQ ID NO: 4491791 - DNA, 15 bp, Homo sapiens
actttacagaaatgg

SEQ ID NO: 4491792 - DNA, 15 bp, Homo sapiens
actttacctctctgt

SEQ ID NO: 4491793 - DNA, 13 bp, Homo sapiens
actttactttcaa

SEQ ID NO: 4491794 - DNA, 15 bp, Homo sapiens
actttactttttcca

SEQ ID NO: 4491795 - DNA, 17 bp, Homo sapiens
actttactttttccatt

SEQ ID NO: 4491796 - DNA, 19 bp, Homo sapiens
actttactttttccatttg

SEQ ID NO: 4491797 - DNA, 18 bp, Homo sapiens
actttagaaagctgacat

SEQ ID NO: 4491798 - DNA, 16 bp, Homo sapiens
actttagaagcctgca

SEQ ID NO: 4491799 - DNA, 15 bp, Homo sapiens
actttagaatgagag

SEQ ID NO: 4491800 - DNA, 17 bp, Homo sapiens
actttagtatttttact

SEQ ID NO: 4491801 - DNA, 12 bp, Homo sapiens
actttataaatt

SEQ ID NO: 4491802 - DNA, 15 bp, Homo sapiens
actttatatctgtaa

SEQ ID NO: 4491803 - DNA, 23 bp, Homo sapiens
actttatatcttgtttacaataa

SEQ ID NO: 4491804 - DNA, 18 bp, Homo sapiens
actttatcatgaatgctt

SEQ ID NO: 4491805 - DNA, 17 bp, Homo sapiens
actttatgctaagtgaa

SEQ ID NO: 4491806 - DNA, 13 bp, Homo sapiens
actttatttactt

SEQ ID NO: 4491807 - DNA, 15 bp, Homo sapiens
actttatttatttct

SEQ ID NO: 4491808 - DNA, 17 bp, Homo sapiens
actttatttatttctag

SEQ ID NO: 4491809 - DNA, 18 bp, Homo sapiens
actttatttatttctagt

SEQ ID NO: 4491810 - DNA, 12 bp, Homo sapiens
actttatttctg

SEQ ID NO: 4491811 - DNA, 16 bp, Homo sapiens
actgtgcagttgctgt

SEQ ID NO: 4491812 - DNA, 12 bp, Homo sapiens
actgtgcctggc

SEQ ID NO: 4491813 - DNA, 16 bp, Homo sapiens
actgtgcctggctccc

SEQ ID NO: 4491814 - DNA, 19 bp, Homo sapiens
actgtgcctggctccctga

SEQ ID NO: 4491815 - DNA, 11 bp, Homo sapiens
actgtgctggg

SEQ ID NO: 4491816 - DNA, 13 bp, Homo sapiens
actgtgctgtcct

SEQ ID NO: 4491817 - DNA, 11 bp, Homo sapiens
actgtgctttc

SEQ ID NO: 4491818 - DNA, 20 bp, Homo sapiens
actgtgctttctattgtaca

SEQ ID NO: 4491819 - DNA, 21 bp, Homo sapiens
actgtgctttctattgtacag

SEQ ID NO: 4491820 - DNA, 20 bp, Homo sapiens
actgtggacctctatcatct

SEQ ID NO: 4491821 - DNA, 15 bp, Homo sapiens
actgtggatattgtt

SEQ ID NO: 4491822 - DNA, 20 bp, Homo sapiens
actgtggccatatatgctgt

SEQ ID NO: 4491823 - DNA, 14 bp, Homo sapiens
actgtgggcaattt

SEQ ID NO: 4491824 - DNA, 17 bp, Homo sapiens
actgtgggcaatttaga

SEQ ID NO: 4491825 - DNA, 18 bp, Homo sapiens
actgtggtcgtcaacttt

SEQ ID NO: 4491826 - DNA, 18 bp, Homo sapiens
actgtggtgacttctgct

SEQ ID NO: 4491827 - DNA, 12 bp, Homo sapiens
actgtgtacata

SEQ ID NO: 4491828 - DNA, 18 bp, Homo sapiens
actgtgtacataactgaa

SEQ ID NO: 4491829 - DNA, 16 bp, Homo sapiens
actgtgtactggagcc

SEQ ID NO: 4491830 - DNA, 20 bp, Homo sapiens
actgtgtactggagcctgca

SEQ ID NO: 4491831 - DNA, 14 bp, Homo sapiens
actgtgtactgttc

SEQ ID NO: 4491832 - DNA, 15 bp, Homo sapiens
actgtgtataggaat

SEQ ID NO: 4491833 - DNA, 22 bp, Homo sapiens
actgtgtctggcgttctcaaga

SEQ ID NO: 4491834 - DNA, 13 bp, Homo sapiens
actgtgtgtgaat

SEQ ID NO: 4491835 - DNA, 22 bp, Homo sapiens
actgtgtgtgtgaatgaacact

SEQ ID NO: 4491836 - DNA, 15 bp, Homo sapiens
actgtgttcatgtgt

SEQ ID NO: 4491837 - DNA, 17 bp, Homo sapiens
actgtgtttcaaatgga

SEQ ID NO: 4491838 - DNA, 21 bp, Homo sapiens
actgtgtttcaaatggactgt

SEQ ID NO: 4491839 - DNA, 11 bp, Homo sapiens
actgtgttttt

SEQ ID NO: 4491840 - DNA, 14 bp, Homo sapiens
actgtgtttttaaa

SEQ ID NO: 4491841 - DNA, 15 bp, Homo sapiens
actgttacagtaatg

SEQ ID NO: 4491842 - DNA, 21 bp, Homo sapiens
actgttactttggcaatttcc

SEQ ID NO: 4491843 - DNA, 16 bp, Homo sapiens
actgttagaacactat

SEQ ID NO: 4491844 - DNA, 20 bp, Homo sapiens
actgttcctcatgttgctga

SEQ ID NO: 4491845 - DNA, 23 bp, Homo sapiens
actgttcggaaggggttcctcaa

SEQ ID NO: 4491846 - DNA, 15 bp, Homo sapiens
actgttcttggtaac

SEQ ID NO: 4491847 - DNA, 16 bp, Homo sapiens
actgttgaaaaagata

SEQ ID NO: 4491848 - DNA, 20 bp, Homo sapiens
actgttgcctaattggaaag

SEQ ID NO: 4491849 - DNA, 15 bp, Homo sapiens
actgttgctttgaaa

SEQ ID NO: 4491850 - DNA, 12 bp, Homo sapiens
actgttggaatg

SEQ ID NO: 4491851 - DNA, 15 bp, Homo sapiens
actgttggtggcaaa

SEQ ID NO: 4491852 - DNA, 21 bp, Homo sapiens
actgtttatatgtgttgaaaa

SEQ ID NO: 4491853 - DNA, 15 bp, Homo sapiens
actgtttcaagccct

SEQ ID NO: 4491854 - DNA, 14 bp, Homo sapiens
actgtttcaaggtc

SEQ ID NO: 4491855 - DNA, 18 bp, Homo sapiens
actgtttgcatgcgcccg

SEQ ID NO: 4491856 - DNA, 19 bp, Homo sapiens
actgtttggaaataaatct

SEQ ID NO: 4491857 - DNA, 20 bp, Homo sapiens
actgtttgtttacaaaatca

SEQ ID NO: 4491858 - DNA, 17 bp, Homo sapiens
actgttttagaaattgg

SEQ ID NO: 4491859 - DNA, 22 bp, Homo sapiens
actgttttgaataaattttcaa

SEQ ID NO: 4491860 - DNA, 19 bp, Homo sapiens
acttaaaaaaaaaaaaaag

SEQ ID NO: 4491861 - DNA, 19 bp, Homo sapiens
acttaaacagaagcagagg

SEQ ID NO: 4491862 - DNA, 22 bp, Homo sapiens
acttaaactttgtcacttctgc

SEQ ID NO: 4491863 - DNA, 20 bp, Homo sapiens
acttaaaggcacaaatagga

SEQ ID NO: 4491864 - DNA, 16 bp, Homo sapiens
acttaaatagtatttc

SEQ ID NO: 4491865 - DNA, 11 bp, Homo sapiens
acttaaatgag

SEQ ID NO: 4491866 - DNA, 15 bp, Homo sapiens
acttaaattcctcaa

SEQ ID NO: 4491867 - DNA, 12 bp, Homo sapiens
acttaacatttc

SEQ ID NO: 4491868 - DNA, 19 bp, Homo sapiens
acttaacatttcattgtac

SEQ ID NO: 4491869 - DNA, 23 bp, Homo sapiens
acttaaccctgacaaattttaat

SEQ ID NO: 4491870 - DNA, 20 bp, Homo sapiens
acttaacgttctataaatga

SEQ ID NO: 4491871 - DNA, 16 bp, Homo sapiens
acttaactgtttcaaa

SEQ ID NO: 4491872 - DNA, 17 bp, Homo sapiens
acttaataactgtgtac

SEQ ID NO: 4491873 - DNA, 18 bp, Homo sapiens
acttaataactgtgtact

SEQ ID NO: 4491874 - DNA, 17 bp, Homo sapiens
acttaatactaccttga

SEQ ID NO: 4491875 - DNA, 19 bp, Homo sapiens
acttaatactaccttgaaa

SEQ ID NO: 4491876 - DNA, 16 bp, Homo sapiens
acttaatcaaaactca

SEQ ID NO: 4491877 - DNA, 13 bp, Homo sapiens
acttaatgtatgt

SEQ ID NO: 4491878 - DNA, 17 bp, Homo sapiens
acttaatttacttaagt

SEQ ID NO: 4491879 - DNA, 18 bp, Homo sapiens
acttaccaggcaccaaaa

SEQ ID NO: 4491880 - DNA, 21 bp, Homo sapiens
acttaccaggcaccaaaagaa

SEQ ID NO: 4491881 - DNA, 21 bp, Homo sapiens
acttactttaattactggaat

SEQ ID NO: 4491882 - DNA, 12 bp, Homo sapiens
acttagaaggat

SEQ ID NO: 4491883 - DNA, 14 bp, Homo sapiens
acttagaatgccat

SEQ ID NO: 4491884 - DNA, 17 bp, Homo sapiens
acttagaatgccataaa

SEQ ID NO: 4491885 - DNA, 14 bp, Homo sapiens
acttagacctgcca

SEQ ID NO: 4491886 - DNA, 18 bp, Homo sapiens
acttagacctgccagcca

SEQ ID NO: 4491887 - DNA, 19 bp, Homo sapiens
acttagacctgccagccac

SEQ ID NO: 4491888 - DNA, 19 bp, Homo sapiens
acttagactctagtattta

SEQ ID NO: 4491889 - DNA, 22 bp, Homo sapiens
acttagagtttctgtttgattc

SEQ ID NO: 4491890 - DNA, 23 bp, Homo sapiens
acttagcccaagaggtctgagcc

SEQ ID NO: 4491891 - DNA, 20 bp, Homo sapiens
acttagcctttacctgtgaa

SEQ ID NO: 4491892 - DNA, 23 bp, Homo sapiens
acttagcgtcaagacatttgctg

SEQ ID NO: 4491893 - DNA, 18 bp, Homo sapiens
acttaggactagaagatt

SEQ ID NO: 4491894 - DNA, 20 bp, Homo sapiens
acttaggactagaagattag

SEQ ID NO: 4491895 - DNA, 17 bp, Homo sapiens
acttataattttcctaa

SEQ ID NO: 4491896 - DNA, 19 bp, Homo sapiens
acttatatgctgaattgaa

SEQ ID NO: 4491897 - DNA, 12 bp, Homo sapiens
acttatatttta

SEQ ID NO: 4491898 - DNA, 20 bp, Homo sapiens
acttatattttataatcaga

SEQ ID NO: 4491899 - DNA, 17 bp, Homo sapiens
acttatctctcaaaaca

SEQ ID NO: 4491900 - DNA, 20 bp, Homo sapiens
acttatctctcaaaacaata

SEQ ID NO: 4491901 - DNA, 22 bp, Homo sapiens
acttatctctcaaaacaatatt

SEQ ID NO: 4491902 - DNA, 22 bp, Homo sapiens
acttatctctctgtgctgtgga

SEQ ID NO: 4491903 - DNA, 17 bp, Homo sapiens
acttatggactgttttg

SEQ ID NO: 4491904 - DNA, 21 bp, Homo sapiens
acttatggactgttttgatag

SEQ ID NO: 4491905 - DNA, 20 bp, Homo sapiens
acttattaaaaaatttgtat

SEQ ID NO: 4491906 - DNA, 16 bp, Homo sapiens
acttattattttgcaa

SEQ ID NO: 4491907 - DNA, 15 bp, Homo sapiens
acttattcaaagaga

SEQ ID NO: 4491908 - DNA, 18 bp, Homo sapiens
acttattcattcctcaca

SEQ ID NO: 4491909 - DNA, 15 bp, Homo sapiens
acttattgctgattt

SEQ ID NO: 4491910 - DNA, 18 bp, Homo sapiens
acttattgctgattttaa

SEQ ID NO: 4491911 - DNA, 20 bp, Homo sapiens
acttatttacctataaaatg

SEQ ID NO: 4491912 - DNA, 12 bp, Homo sapiens
acttatttctgc

SEQ ID NO: 4491913 - DNA, 14 bp, Homo sapiens
acttatttgtcaaa

SEQ ID NO: 4491914 - DNA, 12 bp, Homo sapiens
acttatttttct

SEQ ID NO: 4491915 - DNA, 22 bp, Homo sapiens
acttcaaaaataaaaaatctga

SEQ ID NO: 4491916 - DNA, 23 bp, Homo sapiens
acttcaaaaataaaaaatctgaa

SEQ ID NO: 4491917 - DNA, 13 bp, Homo sapiens
acttcaaaagcaa

SEQ ID NO: 4491918 - DNA, 19 bp, Homo sapiens
acttcaaattttttaaaag

SEQ ID NO: 4491919 - DNA, 19 bp, Homo sapiens
acttcaagcatggctattt

SEQ ID NO: 4491920 - DNA, 23 bp, Homo sapiens
acttcaagcatggctattttata

SEQ ID NO: 4491921 - DNA, 14 bp, Homo sapiens
acttcacactgcaa

SEQ ID NO: 4491922 - DNA, 19 bp, Homo sapiens
acttcacactgcaagagcc

SEQ ID NO: 4491923 - DNA, 23 bp, Homo sapiens
acttcacactgcaagagccttgg

SEQ ID NO: 4491924 - DNA, 15 bp, Homo sapiens
acttcaccaccccct

SEQ ID NO: 4491925 - DNA, 14 bp, Homo sapiens
acttcacccccaac

SEQ ID NO: 4491926 - DNA, 11 bp, Homo sapiens
acttcactgta

SEQ ID NO: 4491927 - DNA, 14 bp, Homo sapiens
acttcactgtatat

SEQ ID NO: 4491928 - DNA, 18 bp, Homo sapiens
acttcactgtatataaac

SEQ ID NO: 4491929 - DNA, 17 bp, Homo sapiens
acttcactttcttcaaa

SEQ ID NO: 4491930 - DNA, 22 bp, Homo sapiens
acttcagcaaccctacagtata

SEQ ID NO: 4491931 - DNA, 22 bp, Homo sapiens
actggcaggggagacaggagcc

SEQ ID NO: 4491932 - DNA, 23 bp, Homo sapiens
actggcatggatatagttttact

SEQ ID NO: 4491933 - DNA, 17 bp, Homo sapiens
actggcatgtcatttgc

SEQ ID NO: 4491934 - DNA, 19 bp, Homo sapiens
actggcatgtcatttgcac

SEQ ID NO: 4491935 - DNA, 11 bp, Homo sapiens
actggccaggg

SEQ ID NO: 4491936 - DNA, 23 bp, Homo sapiens
actggccagtggctggatctgtg

SEQ ID NO: 4491937 - DNA, 12 bp, Homo sapiens
actggcccctgg

SEQ ID NO: 4491938 - DNA, 17 bp, Homo sapiens
actggcctcaaagcaag

SEQ ID NO: 4491939 - DNA, 22 bp, Homo sapiens
actggcctgcacggtgggcctt

SEQ ID NO: 4491940 - DNA, 18 bp, Homo sapiens
actggcctttttcattta

SEQ ID NO: 4491941 - DNA, 19 bp, Homo sapiens
actggcggagaaggagagg

SEQ ID NO: 4491942 - DNA, 16 bp, Homo sapiens
actggcgttcacctcc

SEQ ID NO: 4491943 - DNA, 21 bp, Homo sapiens
actggctagagtcctcactcc

SEQ ID NO: 4491944 - DNA, 18 bp, Homo sapiens
actggctcacccagtcct

SEQ ID NO: 4491945 - DNA, 17 bp, Homo sapiens
actggctgtcagtatga

SEQ ID NO: 4491946 - DNA, 21 bp, Homo sapiens
actggctgtcagtatgacatt

SEQ ID NO: 4491947 - DNA, 15 bp, Homo sapiens
actggcttcagcaag

SEQ ID NO: 4491948 - DNA, 14 bp, Homo sapiens
actggcttttatta

SEQ ID NO: 4491949 - DNA, 20 bp, Homo sapiens
actggcttttattaatgcac

SEQ ID NO: 4491950 - DNA, 11 bp, Homo sapiens
actgggaaact

SEQ ID NO: 4491951 - DNA, 15 bp, Homo sapiens
actgggataactgat

SEQ ID NO: 4491952 - DNA, 18 bp, Homo sapiens
actgggataactgatttc

SEQ ID NO: 4491953 - DNA, 15 bp, Homo sapiens
actgggcactggggc

SEQ ID NO: 4491954 - DNA, 17 bp, Homo sapiens
actgggcactggggcct

SEQ ID NO: 4491955 - DNA, 23 bp, Homo sapiens
actgggccataatgttgcttctc

SEQ ID NO: 4491956 - DNA, 18 bp, Homo sapiens
actgggcccgagcctgaa

SEQ ID NO: 4491957 - DNA, 21 bp, Homo sapiens
actgggctaaggaagtatcag

SEQ ID NO: 4491958 - DNA, 15 bp, Homo sapiens
actgggctggcgctt

SEQ ID NO: 4491959 - DNA, 16 bp, Homo sapiens
actggggactttattt

SEQ ID NO: 4491960 - DNA, 16 bp, Homo sapiens
actggggcaggggccg

SEQ ID NO: 4491961 - DNA, 16 bp, Homo sapiens
actggggcctcagcct

SEQ ID NO: 4491962 - DNA, 22 bp, Homo sapiens
actggggggaaaaagaccaggt

SEQ ID NO: 4491963 - DNA, 14 bp, Homo sapiens
actggggtgccttc

SEQ ID NO: 4491964 - DNA, 20 bp, Homo sapiens
actgggtaatgaaacaaaga

SEQ ID NO: 4491965 - DNA, 17 bp, Homo sapiens
actgggtcttcagcttt

SEQ ID NO: 4491966 - DNA, 18 bp, Homo sapiens
actgggtggtggcctggt

SEQ ID NO: 4491967 - DNA, 17 bp, Homo sapiens
actggtaagattgttat

SEQ ID NO: 4491968 - DNA, 22 bp, Homo sapiens
actggtacccgcccttccgagc

SEQ ID NO: 4491969 - DNA, 14 bp, Homo sapiens
actggtattttatc

SEQ ID NO: 4491970 - DNA, 13 bp, Homo sapiens
actggtctgctgt

SEQ ID NO: 4491971 - DNA, 22 bp, Homo sapiens
actggtgaactgagctgggcag

SEQ ID NO: 4491972 - DNA, 18 bp, Homo sapiens
actggtgaatataaatga

SEQ ID NO: 4491973 - DNA, 13 bp, Homo sapiens
actggtgcacttt

SEQ ID NO: 4491974 - DNA, 16 bp, Homo sapiens
actggtgcactttgta

SEQ ID NO: 4491975 - DNA, 23 bp, Homo sapiens
actggtgtcataaactttctcca

SEQ ID NO: 4491976 - DNA, 21 bp, Homo sapiens
actggtgtgacctgagggcag

SEQ ID NO: 4491977 - DNA, 22 bp, Homo sapiens
actggtgttatcaccgtgggct

SEQ ID NO: 4491978 - DNA, 16 bp, Homo sapiens
actggttactttcaaa

SEQ ID NO: 4491979 - DNA, 18 bp, Homo sapiens
actggttactttcaaaat

SEQ ID NO: 4491980 - DNA, 21 bp, Homo sapiens
actggttcagaaatagctcct

SEQ ID NO: 4491981 - DNA, 19 bp, Homo sapiens
actggtttctcctggtaga

SEQ ID NO: 4491982 - DNA, 18 bp, Homo sapiens
actgtaaaaaatgtgtgt

SEQ ID NO: 4491983 - DNA, 16 bp, Homo sapiens
actgtaaaaataacat

SEQ ID NO: 4491984 - DNA, 22 bp, Homo sapiens
actgtaaaagtgtacagactct

SEQ ID NO: 4491985 - DNA, 23 bp, Homo sapiens
actgtaaaagtgtacagactctt

SEQ ID NO: 4491986 - DNA, 22 bp, Homo sapiens
actgtaaagacaaataaatgat

SEQ ID NO: 4491987 - DNA, 22 bp, Homo sapiens
actgtaaatatccctcccctct

SEQ ID NO: 4491988 - DNA, 22 bp, Homo sapiens
actgtaagaataatttatagta

SEQ ID NO: 4491989 - DNA, 19 bp, Homo sapiens
actgtaaggtgcttgctcc

SEQ ID NO: 4491990 - DNA, 20 bp, Homo sapiens
actgtaatacttctttgtta

SEQ ID NO: 4491991 - DNA, 22 bp, Homo sapiens
actgtaatcttatttaggaagt

SEQ ID NO: 4491992 - DNA, 17 bp, Homo sapiens
actgtacaataaaaaca

SEQ ID NO: 4491993 - DNA, 17 bp, Homo sapiens
actgtacacactttatt

SEQ ID NO: 4491994 - DNA, 23 bp, Homo sapiens
actgtacacactttatttacttc

SEQ ID NO: 4491995 - DNA, 12 bp, Homo sapiens
actgtacagggg

SEQ ID NO: 4491996 - DNA, 15 bp, Homo sapiens
actgtacataaacaa

SEQ ID NO: 4491997 - DNA, 13 bp, Homo sapiens
actgtacattgtg

SEQ ID NO: 4491998 - DNA, 17 bp, Homo sapiens
actgtactagtctgtgt

SEQ ID NO: 4491999 - DNA, 23 bp, Homo sapiens
actgtagaaaagggaactgaaca

SEQ ID NO: 4492000 - DNA, 14 bp, Homo sapiens
actgtatataaaca

SEQ ID NO: 4492001 - DNA, 17 bp, Homo sapiens
actgtatataaacatat

SEQ ID NO: 4492002 - DNA, 13 bp, Homo sapiens
actgtatatttgt

SEQ ID NO: 4492003 - DNA, 15 bp, Homo sapiens
actgtatatttgtat

SEQ ID NO: 4492004 - DNA, 13 bp, Homo sapiens
actgtatattttg

SEQ ID NO: 4492005 - DNA, 21 bp, Homo sapiens
actgtatcaataaaattctgt

SEQ ID NO: 4492006 - DNA, 13 bp, Homo sapiens
actgtatcaattt

SEQ ID NO: 4492007 - DNA, 16 bp, Homo sapiens
actgtatcaatttcta

SEQ ID NO: 4492008 - DNA, 23 bp, Homo sapiens
actgtatcaatttctaatgttta

SEQ ID NO: 4492009 - DNA, 17 bp, Homo sapiens
actgtatcatctttgcc

SEQ ID NO: 4492010 - DNA, 12 bp, Homo sapiens
actgtatgttat

SEQ ID NO: 4492011 - DNA, 22 bp, Homo sapiens
actgtatgtttttactgaatga

SEQ ID NO: 4492012 - DNA, 14 bp, Homo sapiens
actgtatttcagta

SEQ ID NO: 4492013 - DNA, 20 bp, Homo sapiens
actgtatttcagtattttcc

SEQ ID NO: 4492014 - DNA, 22 bp, Homo sapiens
actgtatttcagtattttccag

SEQ ID NO: 4492015 - DNA, 13 bp, Homo sapiens
actgtcacaggca

SEQ ID NO: 4492016 - DNA, 21 bp, Homo sapiens
actgtcacggggttccctcct

SEQ ID NO: 4492017 - DNA, 13 bp, Homo sapiens
actgtcagattaa

SEQ ID NO: 4492018 - DNA, 19 bp, Homo sapiens
actgtcagattaaattaca

SEQ ID NO: 4492019 - DNA, 21 bp, Homo sapiens
actgtcagctcccctcggaga

SEQ ID NO: 4492020 - DNA, 22 bp, Homo sapiens
actgtcagctcccctcggagaa

SEQ ID NO: 4492021 - DNA, 18 bp, Homo sapiens
actgtcagttctctggga

SEQ ID NO: 4492022 - DNA, 20 bp, Homo sapiens
actgtcattgtgtgtggaat

SEQ ID NO: 4492023 - DNA, 18 bp, Homo sapiens
actgtccaatatgaaaac

SEQ ID NO: 4492024 - DNA, 19 bp, Homo sapiens
actgtccagttttcttgct

SEQ ID NO: 4492025 - DNA, 21 bp, Homo sapiens
actgtcccagctaccaagtca

SEQ ID NO: 4492026 - DNA, 15 bp, Homo sapiens
actgtcctattatat

SEQ ID NO: 4492027 - DNA, 20 bp, Homo sapiens
actgtctatatcataactat

SEQ ID NO: 4492028 - DNA, 22 bp, Homo sapiens
actgtctccatggccctgcaaa

SEQ ID NO: 4492029 - DNA, 20 bp, Homo sapiens
actgtcttcctcaaaataaa

SEQ ID NO: 4492030 - DNA, 16 bp, Homo sapiens
actgtcttgtttcagt

SEQ ID NO: 4492031 - DNA, 21 bp, Homo sapiens
actgtgaaaaaaaatttgttt

SEQ ID NO: 4492032 - DNA, 15 bp, Homo sapiens
actgtgaaaatagtg

SEQ ID NO: 4492033 - DNA, 18 bp, Homo sapiens
actgtgaaaatagtgtaa

SEQ ID NO: 4492034 - DNA, 20 bp, Homo sapiens
actgtgaaaatagtgtaaga

SEQ ID NO: 4492035 - DNA, 14 bp, Homo sapiens
actgtgaaatacca

SEQ ID NO: 4492036 - DNA, 21 bp, Homo sapiens
actgtgaaataccacaagcct

SEQ ID NO: 4492037 - DNA, 19 bp, Homo sapiens
actgtgaaccaacccccat

SEQ ID NO: 4492038 - DNA, 22 bp, Homo sapiens
actgtgaacttgactgggtgag

SEQ ID NO: 4492039 - DNA, 15 bp, Homo sapiens
actgtgatacagttt

SEQ ID NO: 4492040 - DNA, 16 bp, Homo sapiens
actgtgatacagtttt

SEQ ID NO: 4492041 - DNA, 22 bp, Homo sapiens
actgtgattactctttgctttg

SEQ ID NO: 4492042 - DNA, 12 bp, Homo sapiens
actgtgattaga

SEQ ID NO: 4492043 - DNA, 16 bp, Homo sapiens
actgtgattagatcac

SEQ ID NO: 4492044 - DNA, 15 bp, Homo sapiens
actgtgatttatctt

SEQ ID NO: 4492045 - DNA, 20 bp, Homo sapiens
actgtgcacatctgtgtctt

SEQ ID NO: 4492046 - DNA, 21 bp, Homo sapiens
actgtgcacatctgtgtcttg

SEQ ID NO: 4492047 - DNA, 22 bp, Homo sapiens
actgtgcaggcctgtccctggg

SEQ ID NO: 4492048 - DNA, 20 bp, Homo sapiens
actgtgcaggtgctattgtt

SEQ ID NO: 4492049 - DNA, 22 bp, Homo sapiens
actgtgcaggtgctattgttac

SEQ ID NO: 4492050 - DNA, 12 bp, Homo sapiens
actgagcagccg

SEQ ID NO: 4492051 - DNA, 12 bp, Homo sapiens
actgagcatcac

SEQ ID NO: 4492052 - DNA, 20 bp, Homo sapiens
actgagcatcactagtgaca

SEQ ID NO: 4492053 - DNA, 16 bp, Homo sapiens
actgagccaaggaggc

SEQ ID NO: 4492054 - DNA, 22 bp, Homo sapiens
actgagctcacatgggactggg

SEQ ID NO: 4492055 - DNA, 17 bp, Homo sapiens
actgagctgtgacccag

SEQ ID NO: 4492056 - DNA, 17 bp, Homo sapiens
actgaggaatttcacct

SEQ ID NO: 4492057 - DNA, 19 bp, Homo sapiens
actgaggaatttcacctgt

SEQ ID NO: 4492058 - DNA, 18 bp, Homo sapiens
actgaggagatgaccagg

SEQ ID NO: 4492059 - DNA, 23 bp, Homo sapiens
actgaggcccaaagcacttgctt

SEQ ID NO: 4492060 - DNA, 22 bp, Homo sapiens
actgagggactctgaagcctct

SEQ ID NO: 4492061 - DNA, 22 bp, Homo sapiens
actgaggggaggggagcatggg

SEQ ID NO: 4492062 - DNA, 17 bp, Homo sapiens
actgaggggccagggag

SEQ ID NO: 4492063 - DNA, 16 bp, Homo sapiens
actgagggggcctgga

SEQ ID NO: 4492064 - DNA, 18 bp, Homo sapiens
actgagggggcctggatg

SEQ ID NO: 4492065 - DNA, 20 bp, Homo sapiens
actgagtactctttctctcc

SEQ ID NO: 4492066 - DNA, 16 bp, Homo sapiens
actgagtcactcacat

SEQ ID NO: 4492067 - DNA, 14 bp, Homo sapiens
actgagtgggaagc

SEQ ID NO: 4492068 - DNA, 23 bp, Homo sapiens
actgagtgtgggagtgcagagaa

SEQ ID NO: 4492069 - DNA, 15 bp, Homo sapiens
actgataaaaatgat

SEQ ID NO: 4492070 - DNA, 17 bp, Homo sapiens
actgataatcacactgc

SEQ ID NO: 4492071 - DNA, 16 bp, Homo sapiens
actgatatattttaca

SEQ ID NO: 4492072 - DNA, 14 bp, Homo sapiens
actgatctttgcaa

SEQ ID NO: 4492073 - DNA, 12 bp, Homo sapiens
actgatgagcac

SEQ ID NO: 4492074 - DNA, 17 bp, Homo sapiens
actgatgagtaaactga

SEQ ID NO: 4492075 - DNA, 17 bp, Homo sapiens
actgatgattttccttt

SEQ ID NO: 4492076 - DNA, 18 bp, Homo sapiens
actgatgggaataaaagt

SEQ ID NO: 4492077 - DNA, 22 bp, Homo sapiens
actgatgggaataaaagtatta

SEQ ID NO: 4492078 - DNA, 19 bp, Homo sapiens
actgatgtgatattctgtt

SEQ ID NO: 4492079 - DNA, 17 bp, Homo sapiens
actgattacctgccaat

SEQ ID NO: 4492080 - DNA, 15 bp, Homo sapiens
actgattatgaaatg

SEQ ID NO: 4492081 - DNA, 12 bp, Homo sapiens
actgatttcaga

SEQ ID NO: 4492082 - DNA, 17 bp, Homo sapiens
actgatttctatggctt

SEQ ID NO: 4492083 - DNA, 21 bp, Homo sapiens
actgatttctatggctttcaa

SEQ ID NO: 4492084 - DNA, 13 bp, Homo sapiens
actgatttctcac

SEQ ID NO: 4492085 - DNA, 19 bp, Homo sapiens
actgatttgctggagttca

SEQ ID NO: 4492086 - DNA, 16 bp, Homo sapiens
actgatttggagatat

SEQ ID NO: 4492087 - DNA, 22 bp, Homo sapiens
actgcaaaaagaaaatctttat

SEQ ID NO: 4492088 - DNA, 19 bp, Homo sapiens
actgcaacctcacctcccg

SEQ ID NO: 4492089 - DNA, 14 bp, Homo sapiens
actgcaacctccac

SEQ ID NO: 4492090 - DNA, 15 bp, Homo sapiens
actgcaagagccttg

SEQ ID NO: 4492091 - DNA, 18 bp, Homo sapiens
actgcacagcgtcctgtc

SEQ ID NO: 4492092 - DNA, 16 bp, Homo sapiens
actgcacccctgcccc

SEQ ID NO: 4492093 - DNA, 13 bp, Homo sapiens
actgcactccagc

SEQ ID NO: 4492094 - DNA, 15 bp, Homo sapiens
actgcactccagcct

SEQ ID NO: 4492095 - DNA, 18 bp, Homo sapiens
actgcactccagcctgag

SEQ ID NO: 4492096 - DNA, 20 bp, Homo sapiens
actgcactccagcctgagtg

SEQ ID NO: 4492097 - DNA, 18 bp, Homo sapiens
actgcactccagcctggg

SEQ ID NO: 4492098 - DNA, 18 bp, Homo sapiens
actgcacttatttgtcaa

SEQ ID NO: 4492099 - DNA, 19 bp, Homo sapiens
actgcactttccaatgcca

SEQ ID NO: 4492100 - DNA, 15 bp, Homo sapiens
actgcactttgttta

SEQ ID NO: 4492101 - DNA, 19 bp, Homo sapiens
actgcactttgtttagaaa

SEQ ID NO: 4492102 - DNA, 21 bp, Homo sapiens
actgcagaggggaaagacttc

SEQ ID NO: 4492103 - DNA, 23 bp, Homo sapiens
actgcagcctcatactcctgggc

SEQ ID NO: 4492104 - DNA, 10 bp, Homo sapiens
actgcaggga

SEQ ID NO: 4492105 - DNA, 12 bp, Homo sapiens
actgcagtcacc

SEQ ID NO: 4492106 - DNA, 15 bp, Homo sapiens
actgcagtcacctct

SEQ ID NO: 4492107 - DNA, 16 bp, Homo sapiens
actgcagtcacctctt

SEQ ID NO: 4492108 - DNA, 22 bp, Homo sapiens
actgcagtggcctgatctctgc

SEQ ID NO: 4492109 - DNA, 16 bp, Homo sapiens
actgcatactttttaa

SEQ ID NO: 4492110 - DNA, 23 bp, Homo sapiens
actgcatcatctgtttgtaatca

SEQ ID NO: 4492111 - DNA, 17 bp, Homo sapiens
actgcatggtaatttat

SEQ ID NO: 4492112 - DNA, 17 bp, Homo sapiens
actgcatgtcagagcac

SEQ ID NO: 4492113 - DNA, 13 bp, Homo sapiens
actgccagcaacg

SEQ ID NO: 4492114 - DNA, 15 bp, Homo sapiens
actgccaggccagcc

SEQ ID NO: 4492115 - DNA, 17 bp, Homo sapiens
actgccaggccagcctc

SEQ ID NO: 4492116 - DNA, 17 bp, Homo sapiens
actgccaggctgtttca

SEQ ID NO: 4492117 - DNA, 14 bp, Homo sapiens
actgccatcctggc

SEQ ID NO: 4492118 - DNA, 15 bp, Homo sapiens
actgccccaactcct

SEQ ID NO: 4492119 - DNA, 17 bp, Homo sapiens
actgccccaactcctgg

SEQ ID NO: 4492120 - DNA, 19 bp, Homo sapiens
actgccccacatgcatgtc

SEQ ID NO: 4492121 - DNA, 20 bp, Homo sapiens
actgccccacgttgtccctg

SEQ ID NO: 4492122 - DNA, 12 bp, Homo sapiens
actgccccaggg

SEQ ID NO: 4492123 - DNA, 20 bp, Homo sapiens
actgcccccagaaagcctcc

SEQ ID NO: 4492124 - DNA, 21 bp, Homo sapiens
actgcccccagaaagcctcct

SEQ ID NO: 4492125 - DNA, 20 bp, Homo sapiens
actgccccccgaggctgcta

SEQ ID NO: 4492126 - DNA, 21 bp, Homo sapiens
actgccccccgaggctgctag

SEQ ID NO: 4492127 - DNA, 17 bp, Homo sapiens
actgccccctcctgtgt

SEQ ID NO: 4492128 - DNA, 22 bp, Homo sapiens
actgcccctgctgtgctgctca

SEQ ID NO: 4492129 - DNA, 14 bp, Homo sapiens
actgcccttgctgc

SEQ ID NO: 4492130 - DNA, 16 bp, Homo sapiens
actgcccttgctgccc

SEQ ID NO: 4492131 - DNA, 21 bp, Homo sapiens
actgccggctctagtaccttt

SEQ ID NO: 4492132 - DNA, 17 bp, Homo sapiens
actgcctcgaaacacag

SEQ ID NO: 4492133 - DNA, 16 bp, Homo sapiens
actgcctgccaccgcg

SEQ ID NO: 4492134 - DNA, 21 bp, Homo sapiens
actgcctgtctgcttgcatct

SEQ ID NO: 4492135 - DNA, 16 bp, Homo sapiens
actgcgaggacatcaa

SEQ ID NO: 4492136 - DNA, 16 bp, Homo sapiens
actgcgcccggcccaa

SEQ ID NO: 4492137 - DNA, 15 bp, Homo sapiens
actgcgggagccaga

SEQ ID NO: 4492138 - DNA, 16 bp, Homo sapiens
actgctaaataaaatt

SEQ ID NO: 4492139 - DNA, 19 bp, Homo sapiens
actgctaaataaaatttgt

SEQ ID NO: 4492140 - DNA, 18 bp, Homo sapiens
actgctccagcctctgcc

SEQ ID NO: 4492141 - DNA, 14 bp, Homo sapiens
actgctccaggcct

SEQ ID NO: 4492142 - DNA, 22 bp, Homo sapiens
actgctcccggcccgcctgccc

SEQ ID NO: 4492143 - DNA, 19 bp, Homo sapiens
actgctcgtggactgtgct

SEQ ID NO: 4492144 - DNA, 15 bp, Homo sapiens
actgctctagaaagt

SEQ ID NO: 4492145 - DNA, 15 bp, Homo sapiens
actgctctcctccac

SEQ ID NO: 4492146 - DNA, 21 bp, Homo sapiens
actgctctcctccacctcaac

SEQ ID NO: 4492147 - DNA, 20 bp, Homo sapiens
actgctgattcttgtaaatc

SEQ ID NO: 4492148 - DNA, 21 bp, Homo sapiens
actgcttacctactttcttca

SEQ ID NO: 4492149 - DNA, 18 bp, Homo sapiens
actgcttgaggaaaacaa

SEQ ID NO: 4492150 - DNA, 23 bp, Homo sapiens
actggaaaactgctactatctgt

SEQ ID NO: 4492151 - DNA, 19 bp, Homo sapiens
actggaaatgtagcactta

SEQ ID NO: 4492152 - DNA, 15 bp, Homo sapiens
actggaagaaagcaa

SEQ ID NO: 4492153 - DNA, 13 bp, Homo sapiens
actggaataatat

SEQ ID NO: 4492154 - DNA, 14 bp, Homo sapiens
actggacaaagaat

SEQ ID NO: 4492155 - DNA, 13 bp, Homo sapiens
actggacagcatc

SEQ ID NO: 4492156 - DNA, 21 bp, Homo sapiens
actggacttcccaagataaat

SEQ ID NO: 4492157 - DNA, 17 bp, Homo sapiens
actggagaggctagaac

SEQ ID NO: 4492158 - DNA, 19 bp, Homo sapiens
actggagcaccaggcacga

SEQ ID NO: 4492159 - DNA, 15 bp, Homo sapiens
actggagctcatctg

SEQ ID NO: 4492160 - DNA, 15 bp, Homo sapiens
actggaggaggcctg

SEQ ID NO: 4492161 - DNA, 16 bp, Homo sapiens
actggaggttgaagcc

SEQ ID NO: 4492162 - DNA, 21 bp, Homo sapiens
actggagttccttatccctct

SEQ ID NO: 4492163 - DNA, 14 bp, Homo sapiens
actggataaattgt

SEQ ID NO: 4492164 - DNA, 18 bp, Homo sapiens
actggataaattgtttag

SEQ ID NO: 4492165 - DNA, 15 bp, Homo sapiens
actggatcctgctgc

SEQ ID NO: 4492166 - DNA, 18 bp, Homo sapiens
actggatctcttaagaca

SEQ ID NO: 4492167 - DNA, 19 bp, Homo sapiens
actggcaaacagggcctct

SEQ ID NO: 4492168 - DNA, 17 bp, Homo sapiens
actggcacacacccctc

SEQ ID NO: 4492169 - DNA, 12 bp, Homo sapiens
actggcacagag

SEQ ID NO: 4492170 - DNA, 20 bp, Homo sapiens
actggcacagttttctgaga

SEQ ID NO: 4492171 - DNA, 20 bp, Homo sapiens
actctatttttacatttaaa

SEQ ID NO: 4492172 - DNA, 21 bp, Homo sapiens
actctcagcccagaagaaaat

SEQ ID NO: 4492173 - DNA, 22 bp, Homo sapiens
actctcaggaccaaagctttca

SEQ ID NO: 4492174 - DNA, 20 bp, Homo sapiens
actctcaggtttttgaggaa

SEQ ID NO: 4492175 - DNA, 17 bp, Homo sapiens
actctcagtctctgagc

SEQ ID NO: 4492176 - DNA, 15 bp, Homo sapiens
actctcattccccag

SEQ ID NO: 4492177 - DNA, 17 bp, Homo sapiens
actctccaacctggaca

SEQ ID NO: 4492178 - DNA, 20 bp, Homo sapiens
actctcccaggcctgcctgc

SEQ ID NO: 4492179 - DNA, 21 bp, Homo sapiens
actctcccaggcctgcctgca

SEQ ID NO: 4492180 - DNA, 20 bp, Homo sapiens
actctccccacgagggctgg

SEQ ID NO: 4492181 - DNA, 10 bp, Homo sapiens
actctccccc

SEQ ID NO: 4492182 - DNA, 16 bp, Homo sapiens
actctcctcctcccct

SEQ ID NO: 4492183 - DNA, 17 bp, Homo sapiens
actctcctcctcccctc

SEQ ID NO: 4492184 - DNA, 15 bp, Homo sapiens
actctctcccaggac

SEQ ID NO: 4492185 - DNA, 20 bp, Homo sapiens
actctctgccattctgtgca

SEQ ID NO: 4492186 - DNA, 22 bp, Homo sapiens
actctctggaagcccctgggcc

SEQ ID NO: 4492187 - DNA, 13 bp, Homo sapiens
actctctgggact

SEQ ID NO: 4492188 - DNA, 18 bp, Homo sapiens
actctctgggactctcct

SEQ ID NO: 4492189 - DNA, 13 bp, Homo sapiens
actctcttcttct

SEQ ID NO: 4492190 - DNA, 15 bp, Homo sapiens
actctgaaagagcaa

SEQ ID NO: 4492191 - DNA, 17 bp, Homo sapiens
actctgaagcctctggg

SEQ ID NO: 4492192 - DNA, 14 bp, Homo sapiens
actctgcaagaaga

SEQ ID NO: 4492193 - DNA, 15 bp, Homo sapiens
actctgcaagaagaa

SEQ ID NO: 4492194 - DNA, 22 bp, Homo sapiens
actctgcatagacaaaggcctt

SEQ ID NO: 4492195 - DNA, 15 bp, Homo sapiens
actctgcatccagag

SEQ ID NO: 4492196 - DNA, 20 bp, Homo sapiens
actctgcatccagagattca

SEQ ID NO: 4492197 - DNA, 21 bp, Homo sapiens
actctgcccccatttccccga

SEQ ID NO: 4492198 - DNA, 13 bp, Homo sapiens
actctgccccctg

SEQ ID NO: 4492199 - DNA, 17 bp, Homo sapiens
actctgccccctgctgg

SEQ ID NO: 4492200 - DNA, 21 bp, Homo sapiens
actctgccccctgctggctct

SEQ ID NO: 4492201 - DNA, 20 bp, Homo sapiens
actctgcccctggacctggg

SEQ ID NO: 4492202 - DNA, 18 bp, Homo sapiens
actctgcgggaggctggg

SEQ ID NO: 4492203 - DNA, 21 bp, Homo sapiens
actctgcgggaggctggggcc

SEQ ID NO: 4492204 - DNA, 15 bp, Homo sapiens
actctgcttgatttt

SEQ ID NO: 4492205 - DNA, 16 bp, Homo sapiens
actctgcttgattttt

SEQ ID NO: 4492206 - DNA, 18 bp, Homo sapiens
actctgcttgatttttgc

SEQ ID NO: 4492207 - DNA, 22 bp, Homo sapiens
actctggaatgtttttccctcc

SEQ ID NO: 4492208 - DNA, 16 bp, Homo sapiens
actctgggtctggcca

SEQ ID NO: 4492209 - DNA, 13 bp, Homo sapiens
actctgtaattgc

SEQ ID NO: 4492210 - DNA, 22 bp, Homo sapiens
actctgtaattgcactttttaa

SEQ ID NO: 4492211 - DNA, 23 bp, Homo sapiens
actctgtaattgcactttttaag

SEQ ID NO: 4492212 - DNA, 16 bp, Homo sapiens
actctgtagcaaattt

SEQ ID NO: 4492213 - DNA, 19 bp, Homo sapiens
actctgtagcaaatttgtt

SEQ ID NO: 4492214 - DNA, 21 bp, Homo sapiens
actctgtagcaaatttgttta

SEQ ID NO: 4492215 - DNA, 16 bp, Homo sapiens
actctgtcagccagcc

SEQ ID NO: 4492216 - DNA, 19 bp, Homo sapiens
actctgtccctgtccttcc

SEQ ID NO: 4492217 - DNA, 23 bp, Homo sapiens
actctgttcccccaccctccatg

SEQ ID NO: 4492218 - DNA, 15 bp, Homo sapiens
actcttaaatcattt

SEQ ID NO: 4492219 - DNA, 17 bp, Homo sapiens
actcttaaatcatttgg

SEQ ID NO: 4492220 - DNA, 20 bp, Homo sapiens
actcttaaatcatttggtta

SEQ ID NO: 4492221 - DNA, 14 bp, Homo sapiens
actcttctgtcttg

SEQ ID NO: 4492222 - DNA, 15 bp, Homo sapiens
actcttcttgaaatt

SEQ ID NO: 4492223 - DNA, 18 bp, Homo sapiens
actcttctttaagccata

SEQ ID NO: 4492224 - DNA, 20 bp, Homo sapiens
actcttgaattcctctcaaa

SEQ ID NO: 4492225 - DNA, 16 bp, Homo sapiens
actcttgatctctctt

SEQ ID NO: 4492226 - DNA, 19 bp, Homo sapiens
actcttgatctctcttgtc

SEQ ID NO: 4492227 - DNA, 16 bp, Homo sapiens
actcttgattatccat

SEQ ID NO: 4492228 - DNA, 15 bp, Homo sapiens
actctttattgtctg

SEQ ID NO: 4492229 - DNA, 16 bp, Homo sapiens
actctttattgtctgt

SEQ ID NO: 4492230 - DNA, 15 bp, Homo sapiens
actctttccgactgc

SEQ ID NO: 4492231 - DNA, 19 bp, Homo sapiens
actctttctgaaggaagag

SEQ ID NO: 4492232 - DNA, 22 bp, Homo sapiens
actctttctgaaggaagagaag

SEQ ID NO: 4492233 - DNA, 18 bp, Homo sapiens
actctttctgagtgcctt

SEQ ID NO: 4492234 - DNA, 22 bp, Homo sapiens
actctttctgagtgccttctgt

SEQ ID NO: 4492235 - DNA, 22 bp, Homo sapiens
actctttctgtatatacttttt

SEQ ID NO: 4492236 - DNA, 15 bp, Homo sapiens
actctttgctgctgc

SEQ ID NO: 4492237 - DNA, 16 bp, Homo sapiens
actctttgctttgtag

SEQ ID NO: 4492238 - DNA, 17 bp, Homo sapiens
actctttgctttgtagt

SEQ ID NO: 4492239 - DNA, 23 bp, Homo sapiens
actctttgctttgtagtttgctt

SEQ ID NO: 4492240 - DNA, 18 bp, Homo sapiens
actctttgttatttgaaa

SEQ ID NO: 4492241 - DNA, 12 bp, Homo sapiens
actcttttgctt

SEQ ID NO: 4492242 - DNA, 20 bp, Homo sapiens
actcttttgctttattccag

SEQ ID NO: 4492243 - DNA, 13 bp, Homo sapiens
actgaaaaaatat

SEQ ID NO: 4492244 - DNA, 14 bp, Homo sapiens
actgaaaaaatata

SEQ ID NO: 4492245 - DNA, 16 bp, Homo sapiens
actgaaaaaatatatg

SEQ ID NO: 4492246 - DNA, 14 bp, Homo sapiens
actgaaaagaagga

SEQ ID NO: 4492247 - DNA, 16 bp, Homo sapiens
actgaaaagaaggaaa

SEQ ID NO: 4492248 - DNA, 17 bp, Homo sapiens
actgaaaagaaggaaag

SEQ ID NO: 4492249 - DNA, 18 bp, Homo sapiens
actgaaaatattgtttta

SEQ ID NO: 4492250 - DNA, 11 bp, Homo sapiens
actgaaaatga

SEQ ID NO: 4492251 - DNA, 15 bp, Homo sapiens
actgaaaatgtgcta

SEQ ID NO: 4492252 - DNA, 19 bp, Homo sapiens
actgaaaatgtgctatact

SEQ ID NO: 4492253 - DNA, 17 bp, Homo sapiens
actgaaaattatttaaa

SEQ ID NO: 4492254 - DNA, 15 bp, Homo sapiens
actgaaaatttaaca

SEQ ID NO: 4492255 - DNA, 18 bp, Homo sapiens
actgaaagttttgtaaaa

SEQ ID NO: 4492256 - DNA, 21 bp, Homo sapiens
actgaacaccattgaaggctt

SEQ ID NO: 4492257 - DNA, 16 bp, Homo sapiens
actgaaccctgcctct

SEQ ID NO: 4492258 - DNA, 23 bp, Homo sapiens
actgaaccttaggctttgtatga

SEQ ID NO: 4492259 - DNA, 20 bp, Homo sapiens
actgaacgatccttcaaagt

SEQ ID NO: 4492260 - DNA, 22 bp, Homo sapiens
actgaactattttaaataaaat

SEQ ID NO: 4492261 - DNA, 18 bp, Homo sapiens
actgaactcactttcctc

SEQ ID NO: 4492262 - DNA, 13 bp, Homo sapiens
actgaactgcttt

SEQ ID NO: 4492263 - DNA, 22 bp, Homo sapiens
actgaactgcttttaaaagtgc

SEQ ID NO: 4492264 - DNA, 12 bp, Homo sapiens
actgaagagctc

SEQ ID NO: 4492265 - DNA, 17 bp, Homo sapiens
actgaagagctcttggc

SEQ ID NO: 4492266 - DNA, 11 bp, Homo sapiens
actgaaggaga

SEQ ID NO: 4492267 - DNA, 13 bp, Homo sapiens
actgaaggagaag

SEQ ID NO: 4492268 - DNA, 21 bp, Homo sapiens
actgaaggagaaggtgcccca

SEQ ID NO: 4492269 - DNA, 20 bp, Homo sapiens
actgaagtgcttgcagatca

SEQ ID NO: 4492270 - DNA, 21 bp, Homo sapiens
actgaatgaagcagtattttg

SEQ ID NO: 4492271 - DNA, 23 bp, Homo sapiens
actgaatgacttgacttcaaaag

SEQ ID NO: 4492272 - DNA, 20 bp, Homo sapiens
actgaatgaggtcagcatgt

SEQ ID NO: 4492273 - DNA, 16 bp, Homo sapiens
actgaatgatctattc

SEQ ID NO: 4492274 - DNA, 22 bp, Homo sapiens
actgaatggactttgcacactt

SEQ ID NO: 4492275 - DNA, 19 bp, Homo sapiens
actgaattgtatcaatttg

SEQ ID NO: 4492276 - DNA, 15 bp, Homo sapiens
actgaatttgtactt

SEQ ID NO: 4492277 - DNA, 18 bp, Homo sapiens
actgaatttttttgtaat

SEQ ID NO: 4492278 - DNA, 20 bp, Homo sapiens
actgaatttttttgtaataa

SEQ ID NO: 4492279 - DNA, 18 bp, Homo sapiens
actgacaagccatcttga

SEQ ID NO: 4492280 - DNA, 13 bp, Homo sapiens
actgacagggagc

SEQ ID NO: 4492281 - DNA, 22 bp, Homo sapiens
actgaccctgcaggttgttcat

SEQ ID NO: 4492282 - DNA, 17 bp, Homo sapiens
actgaccgtatgatgag

SEQ ID NO: 4492283 - DNA, 17 bp, Homo sapiens
actgacctgccagccgg

SEQ ID NO: 4492284 - DNA, 13 bp, Homo sapiens
actgacggactca

SEQ ID NO: 4492285 - DNA, 15 bp, Homo sapiens
actgactctgttatt

SEQ ID NO: 4492286 - DNA, 21 bp, Homo sapiens
actgactggattcattctcat

SEQ ID NO: 4492287 - DNA, 23 bp, Homo sapiens
actgacttggatcccaaagcaag

SEQ ID NO: 4492288 - DNA, 19 bp, Homo sapiens
actgagaatgtaagaacta

SEQ ID NO: 4492289 - DNA, 18 bp, Homo sapiens
actgagataccagcgagg

SEQ ID NO: 4492290 - DNA, 22 bp, Homo sapiens
actgagatattattttaaattt

SEQ ID NO: 4492291 - DNA, 14 bp, Homo sapiens
actcagcctctgct

SEQ ID NO: 4492292 - DNA, 16 bp, Homo sapiens
actcagcctctgctgg

SEQ ID NO: 4492293 - DNA, 13 bp, Homo sapiens
actcagccttcct

SEQ ID NO: 4492294 - DNA, 17 bp, Homo sapiens
actcaggacagaacagt

SEQ ID NO: 4492295 - DNA, 19 bp, Homo sapiens
actcaggaggctgagacag

SEQ ID NO: 4492296 - DNA, 21 bp, Homo sapiens
actcaggaggctgagacagga

SEQ ID NO: 4492297 - DNA, 16 bp, Homo sapiens
actcaggagtctgcca

SEQ ID NO: 4492298 - DNA, 20 bp, Homo sapiens
actcaggcgggacagtgctg

SEQ ID NO: 4492299 - DNA, 17 bp, Homo sapiens
actcagtctctcttctc

SEQ ID NO: 4492300 - DNA, 23 bp, Homo sapiens
actcagtgagcctcctgtgcctg

SEQ ID NO: 4492301 - DNA, 22 bp, Homo sapiens
actcagtgtgtgatccggtttc

SEQ ID NO: 4492302 - DNA, 19 bp, Homo sapiens
actcagttgttctgagcac

SEQ ID NO: 4492303 - DNA, 18 bp, Homo sapiens
actcataaaggtttttgt

SEQ ID NO: 4492304 - DNA, 18 bp, Homo sapiens
actcatagacactgatct

SEQ ID NO: 4492305 - DNA, 18 bp, Homo sapiens
actcatgatcaagatata

SEQ ID NO: 4492306 - DNA, 17 bp, Homo sapiens
actcatgcaaactgctt

SEQ ID NO: 4492307 - DNA, 17 bp, Homo sapiens
actcattagaattacca

SEQ ID NO: 4492308 - DNA, 15 bp, Homo sapiens
actcattccagatcc

SEQ ID NO: 4492309 - DNA, 13 bp, Homo sapiens
actcattccttca

SEQ ID NO: 4492310 - DNA, 15 bp, Homo sapiens
actcattccttcact

SEQ ID NO: 4492311 - DNA, 15 bp, Homo sapiens
actcattctgaatta

SEQ ID NO: 4492312 - DNA, 19 bp, Homo sapiens
actcattctgaattaatta

SEQ ID NO: 4492313 - DNA, 16 bp, Homo sapiens
actcattgaaatgtaa

SEQ ID NO: 4492314 - DNA, 16 bp, Homo sapiens
actcattgcagcagat

SEQ ID NO: 4492315 - DNA, 20 bp, Homo sapiens
actcattgcagcagataact

SEQ ID NO: 4492316 - DNA, 21 bp, Homo sapiens
actcattgcagcagataactt

SEQ ID NO: 4492317 - DNA, 13 bp, Homo sapiens
actcatttcatct

SEQ ID NO: 4492318 - DNA, 20 bp, Homo sapiens
actcattttaaaaaatggaa

SEQ ID NO: 4492319 - DNA, 23 bp, Homo sapiens
actcatttttcatgataatgaac

SEQ ID NO: 4492320 - DNA, 15 bp, Homo sapiens
actccaaagaaatgt

SEQ ID NO: 4492321 - DNA, 17 bp, Homo sapiens
actccaaggttcccttg

SEQ ID NO: 4492322 - DNA, 23 bp, Homo sapiens
actccacaccttttatgaatcaa

SEQ ID NO: 4492323 - DNA, 17 bp, Homo sapiens
actccacatcaacattc

SEQ ID NO: 4492324 - DNA, 14 bp, Homo sapiens
actccacatctgcc

SEQ ID NO: 4492325 - DNA, 17 bp, Homo sapiens
actccacatctgcctta

SEQ ID NO: 4492326 - DNA, 11 bp, Homo sapiens
actccagagaa

SEQ ID NO: 4492327 - DNA, 15 bp, Homo sapiens
actccagccagcgcc

SEQ ID NO: 4492328 - DNA, 21 bp, Homo sapiens
actccagccagcgcctccctc

SEQ ID NO: 4492329 - DNA, 22 bp, Homo sapiens
actccagccagcgcctccctcc

SEQ ID NO: 4492330 - DNA, 17 bp, Homo sapiens
actccaggaaagagcag

SEQ ID NO: 4492331 - DNA, 13 bp, Homo sapiens
actccaggcagga

SEQ ID NO: 4492332 - DNA, 21 bp, Homo sapiens
actccatacagcctctacagc

SEQ ID NO: 4492333 - DNA, 18 bp, Homo sapiens
actccatcagaaaaccaa

SEQ ID NO: 4492334 - DNA, 22 bp, Homo sapiens
actccatcctcctgtgtcactg

SEQ ID NO: 4492335 - DNA, 13 bp, Homo sapiens
actccatctcttc

SEQ ID NO: 4492336 - DNA, 18 bp, Homo sapiens
actccatctcttctgcaa

SEQ ID NO: 4492337 - DNA, 16 bp, Homo sapiens
actccatcttcaataa

SEQ ID NO: 4492338 - DNA, 21 bp, Homo sapiens
actccatgctccttgagagga

SEQ ID NO: 4492339 - DNA, 12 bp, Homo sapiens
actccattctcc

SEQ ID NO: 4492340 - DNA, 17 bp, Homo sapiens
actcccaacttcttcct

SEQ ID NO: 4492341 - DNA, 20 bp, Homo sapiens
actcccaacttcttcctgtg

SEQ ID NO: 4492342 - DNA, 16 bp, Homo sapiens
actcccacctgacaca

SEQ ID NO: 4492343 - DNA, 13 bp, Homo sapiens
actcccatgaagc

SEQ ID NO: 4492344 - DNA, 20 bp, Homo sapiens
actcccatgaagccttttga

SEQ ID NO: 4492345 - DNA, 22 bp, Homo sapiens
actcccatgagggagatgccat

SEQ ID NO: 4492346 - DNA, 21 bp, Homo sapiens
actcccctctcctccccttcc

SEQ ID NO: 4492347 - DNA, 22 bp, Homo sapiens
actcccctctcctccccttcct

SEQ ID NO: 4492348 - DNA, 19 bp, Homo sapiens
actccctaatttatgtgct

SEQ ID NO: 4492349 - DNA, 22 bp, Homo sapiens
actccctaatttatgtgctata

SEQ ID NO: 4492350 - DNA, 19 bp, Homo sapiens
actccctagtctccacctg

SEQ ID NO: 4492351 - DNA, 13 bp, Homo sapiens
actccctccatag

SEQ ID NO: 4492352 - DNA, 16 bp, Homo sapiens
actccctcctcacctc

SEQ ID NO: 4492353 - DNA, 19 bp, Homo sapiens
actccctcctcacctctgg

SEQ ID NO: 4492354 - DNA, 18 bp, Homo sapiens
actccctgggacacagac

SEQ ID NO: 4492355 - DNA, 22 bp, Homo sapiens
actccctgtgggggtggccatc

SEQ ID NO: 4492356 - DNA, 15 bp, Homo sapiens
actcccttctacctg

SEQ ID NO: 4492357 - DNA, 18 bp, Homo sapiens
actcccttctacctgcca

SEQ ID NO: 4492358 - DNA, 22 bp, Homo sapiens
actcccttctacctgccactca

SEQ ID NO: 4492359 - DNA, 14 bp, Homo sapiens
actcccttctgtag

SEQ ID NO: 4492360 - DNA, 15 bp, Homo sapiens
actccgaagaaaaga

SEQ ID NO: 4492361 - DNA, 15 bp, Homo sapiens
actccgcatcacctc

SEQ ID NO: 4492362 - DNA, 15 bp, Homo sapiens
actccgcccagcctc

SEQ ID NO: 4492363 - DNA, 18 bp, Homo sapiens
actccgcccagcctctcc

SEQ ID NO: 4492364 - DNA, 19 bp, Homo sapiens
actccggaggactgagccc

SEQ ID NO: 4492365 - DNA, 14 bp, Homo sapiens
actccggctgtgct

SEQ ID NO: 4492366 - DNA, 20 bp, Homo sapiens
actccgtgcttaaccaaaga

SEQ ID NO: 4492367 - DNA, 20 bp, Homo sapiens
actcctagaagaaccaaata

SEQ ID NO: 4492368 - DNA, 23 bp, Homo sapiens
actcctagaagaaccaaatacct

SEQ ID NO: 4492369 - DNA, 20 bp, Homo sapiens
actcctagagaacgcagccc

SEQ ID NO: 4492370 - DNA, 22 bp, Homo sapiens
actcctagagaacgcagcccta

SEQ ID NO: 4492371 - DNA, 23 bp, Homo sapiens
actcctagagaacgcagccctag

SEQ ID NO: 4492372 - DNA, 17 bp, Homo sapiens
actcctatttttgtaaa

SEQ ID NO: 4492373 - DNA, 14 bp, Homo sapiens
actcctccgtgagc

SEQ ID NO: 4492374 - DNA, 16 bp, Homo sapiens
actcctcctttttcca

SEQ ID NO: 4492375 - DNA, 20 bp, Homo sapiens
actcctctgactcagggctc

SEQ ID NO: 4492376 - DNA, 20 bp, Homo sapiens
actcctctgcagtgccttgg

SEQ ID NO: 4492377 - DNA, 14 bp, Homo sapiens
actcctctggcttt

SEQ ID NO: 4492378 - DNA, 18 bp, Homo sapiens
actcctctggctttccca

SEQ ID NO: 4492379 - DNA, 18 bp, Homo sapiens
actcctgaaacctcttcc

SEQ ID NO: 4492380 - DNA, 20 bp, Homo sapiens
actcctgaaacctcttccta

SEQ ID NO: 4492381 - DNA, 23 bp, Homo sapiens
actcctgagacccctggcctccg

SEQ ID NO: 4492382 - DNA, 16 bp, Homo sapiens
actcctgccaggcaca

SEQ ID NO: 4492383 - DNA, 11 bp, Homo sapiens
actcctggact

SEQ ID NO: 4492384 - DNA, 17 bp, Homo sapiens
actcctggactccggag

SEQ ID NO: 4492385 - DNA, 13 bp, Homo sapiens
actcctggccttt

SEQ ID NO: 4492386 - DNA, 20 bp, Homo sapiens
actcctggtgcaggtctcca

SEQ ID NO: 4492387 - DNA, 21 bp, Homo sapiens
actcctgtcccttttccctta

SEQ ID NO: 4492388 - DNA, 20 bp, Homo sapiens
actccttccatctcttcctt

SEQ ID NO: 4492389 - DNA, 21 bp, Homo sapiens
actccttccttcaggactctg

SEQ ID NO: 4492390 - DNA, 23 bp, Homo sapiens
actcctttccaatagaaagaaac

SEQ ID NO: 4492391 - DNA, 12 bp, Homo sapiens
actcctttctgc

SEQ ID NO: 4492392 - DNA, 13 bp, Homo sapiens
actcgacccagaa

SEQ ID NO: 4492393 - DNA, 16 bp, Homo sapiens
actcgactctgctgct

SEQ ID NO: 4492394 - DNA, 15 bp, Homo sapiens
actcgaggcctgcaa

SEQ ID NO: 4492395 - DNA, 22 bp, Homo sapiens
actcgtgtctggcacagcctgg

SEQ ID NO: 4492396 - DNA, 21 bp, Homo sapiens
actctaaaattataaatgaca

SEQ ID NO: 4492397 - DNA, 15 bp, Homo sapiens
actctaactgtatat

SEQ ID NO: 4492398 - DNA, 22 bp, Homo sapiens
actctaagatacactgcacttt

SEQ ID NO: 4492399 - DNA, 24 bp, Homo sapiens
actctaccatggttctgcctcctg

SEQ ID NO: 4492400 - DNA, 15 bp, Homo sapiens
actctacccctgctc

SEQ ID NO: 4492401 - DNA, 18 bp, Homo sapiens
actctacccctgctccca

SEQ ID NO: 4492402 - DNA, 16 bp, Homo sapiens
actctacctgcacact

SEQ ID NO: 4492403 - DNA, 22 bp, Homo sapiens
actctagatgaagttttacatt

SEQ ID NO: 4492404 - DNA, 18 bp, Homo sapiens
actctagatggcaacatt

SEQ ID NO: 4492405 - DNA, 19 bp, Homo sapiens
actctagcaaggctcatct

SEQ ID NO: 4492406 - DNA, 20 bp, Homo sapiens
actctaggatgtatatttta

SEQ ID NO: 4492407 - DNA, 17 bp, Homo sapiens
actctagttctagatga

SEQ ID NO: 4492408 - DNA, 17 bp, Homo sapiens
actctagtttattctaa

SEQ ID NO: 4492409 - DNA, 16 bp, Homo sapiens
actctatttttacatt

SEQ ID NO: 4492410 - DNA, 18 bp, Homo sapiens
agcatcgggagcacccag

SEQ ID NO: 4492411 - DNA, 13 bp, Homo sapiens
agcatctatcaga

SEQ ID NO: 4492412 - DNA, 14 bp, Homo sapiens
agcatctcttcttc

SEQ ID NO: 4492413 - DNA, 19 bp, Homo sapiens
agcatctcttcttccctgt

SEQ ID NO: 4492414 - DNA, 21 bp, Homo sapiens
agcatctcttcttccctgtca

SEQ ID NO: 4492415 - DNA, 17 bp, Homo sapiens
agcatctgacaggtgaa

SEQ ID NO: 4492416 - DNA, 23 bp, Homo sapiens
agcatctgccccaggtacacctc

SEQ ID NO: 4492417 - DNA, 13 bp, Homo sapiens
agcatctggctct

SEQ ID NO: 4492418 - DNA, 16 bp, Homo sapiens
agcatctggctctaat

SEQ ID NO: 4492419 - DNA, 18 bp, Homo sapiens
agcatgaacgccaaggaa

SEQ ID NO: 4492420 - DNA, 19 bp, Homo sapiens
agcatgaacgccaaggaat

SEQ ID NO: 4492421 - DNA, 19 bp, Homo sapiens
agcatgagatttttctatc

SEQ ID NO: 4492422 - DNA, 18 bp, Homo sapiens
agcatgaggtatctaagg

SEQ ID NO: 4492423 - DNA, 13 bp, Homo sapiens
agcatgcacatgc

SEQ ID NO: 4492424 - DNA, 15 bp, Homo sapiens
agcatgcattgaaaa

SEQ ID NO: 4492425 - DNA, 20 bp, Homo sapiens
agcatgcattgaaaaatttc

SEQ ID NO: 4492426 - DNA, 18 bp, Homo sapiens
agcatggacatttagaag

SEQ ID NO: 4492427 - DNA, 15 bp, Homo sapiens
agcatggatgcattt

SEQ ID NO: 4492428 - DNA, 15 bp, Homo sapiens
agcatggctatttta

SEQ ID NO: 4492429 - DNA, 16 bp, Homo sapiens
agcatggggccaggaa

SEQ ID NO: 4492430 - DNA, 14 bp, Homo sapiens
agcatggtgtcagt

SEQ ID NO: 4492431 - DNA, 13 bp, Homo sapiens
agcatgtaatggt

SEQ ID NO: 4492432 - DNA, 20 bp, Homo sapiens
agcatgtacggattttcagt

SEQ ID NO: 4492433 - DNA, 18 bp, Homo sapiens
agcatgtatagttgcttt

SEQ ID NO: 4492434 - DNA, 22 bp, Homo sapiens
agcatgtcaattcataaaaaca

SEQ ID NO: 4492435 - DNA, 23 bp, Homo sapiens
agcatgtcaattcataaaaacaa

SEQ ID NO: 4492436 - DNA, 18 bp, Homo sapiens
agcatgtggagcgagagg

SEQ ID NO: 4492437 - DNA, 12 bp, Homo sapiens
agcatgtggcat

SEQ ID NO: 4492438 - DNA, 17 bp, Homo sapiens
agcatgtgttaatctta

SEQ ID NO: 4492439 - DNA, 17 bp, Homo sapiens
agcattaactaaatgct

SEQ ID NO: 4492440 - DNA, 18 bp, Homo sapiens
agcattatccttttatct

SEQ ID NO: 4492441 - DNA, 21 bp, Homo sapiens
agcattattttttgttgaata

SEQ ID NO: 4492442 - DNA, 18 bp, Homo sapiens
agcattcacaacttgttt

SEQ ID NO: 4492443 - DNA, 15 bp, Homo sapiens
agcattcagaagaaa

SEQ ID NO: 4492444 - DNA, 19 bp, Homo sapiens
agcattcaggcagcactga

SEQ ID NO: 4492445 - DNA, 18 bp, Homo sapiens
agcattccagacttcaaa

SEQ ID NO: 4492446 - DNA, 15 bp, Homo sapiens
agcattccagctctg

SEQ ID NO: 4492447 - DNA, 17 bp, Homo sapiens
agcattcttagcctgtg

SEQ ID NO: 4492448 - DNA, 20 bp, Homo sapiens
agcattcttagcctgtggca

SEQ ID NO: 4492449 - DNA, 19 bp, Homo sapiens
agcattctttggagttaaa

SEQ ID NO: 4492450 - DNA, 24 bp, Homo sapiens
agcattctttggagttaaaatgca

SEQ ID NO: 4492451 - DNA, 15 bp, Homo sapiens
agcattgaatggcta

SEQ ID NO: 4492452 - DNA, 22 bp, Homo sapiens
agcatttaatggcagctagtgc

SEQ ID NO: 4492453 - DNA, 14 bp, Homo sapiens
agcatttcatgaaa

SEQ ID NO: 4492454 - DNA, 17 bp, Homo sapiens
agcatttcccttccttc

SEQ ID NO: 4492455 - DNA, 18 bp, Homo sapiens
agcatttctcatcagtag

SEQ ID NO: 4492456 - DNA, 21 bp, Homo sapiens
agcatttgacccttgctgtga

SEQ ID NO: 4492457 - DNA, 14 bp, Homo sapiens
agcatttgataatg

SEQ ID NO: 4492458 - DNA, 19 bp, Homo sapiens
agcatttttataaactacc

SEQ ID NO: 4492459 - DNA, 21 bp, Homo sapiens
agcatttttattatatttatg

SEQ ID NO: 4492460 - DNA, 16 bp, Homo sapiens
agcatttttatttcag

SEQ ID NO: 4492461 - DNA, 12 bp, Homo sapiens
agcatttttcaa

SEQ ID NO: 4492462 - DNA, 13 bp, Homo sapiens
agcatttttccat

SEQ ID NO: 4492463 - DNA, 13 bp, Homo sapiens
agcatttttctaa

SEQ ID NO: 4492464 - DNA, 15 bp, Homo sapiens
agccaaaaatagcta

SEQ ID NO: 4492465 - DNA, 14 bp, Homo sapiens
agccaaaagtccct

SEQ ID NO: 4492466 - DNA, 12 bp, Homo sapiens
agccaaagaaaa

SEQ ID NO: 4492467 - DNA, 14 bp, Homo sapiens
agccaaagaaatga

SEQ ID NO: 4492468 - DNA, 17 bp, Homo sapiens
agccaaagaaatgaaca

SEQ ID NO: 4492469 - DNA, 18 bp, Homo sapiens
agccaaagaaatgaacat

SEQ ID NO: 4492470 - DNA, 23 bp, Homo sapiens
agccaaatgcagggaggggaggc

SEQ ID NO: 4492471 - DNA, 19 bp, Homo sapiens
agccaaatttaaaactgtt

SEQ ID NO: 4492472 - DNA, 20 bp, Homo sapiens
agccaaatttcctgtttgaa

SEQ ID NO: 4492473 - DNA, 17 bp, Homo sapiens
agccaactatgattatt

SEQ ID NO: 4492474 - DNA, 15 bp, Homo sapiens
agccaactctcccaa

SEQ ID NO: 4492475 - DNA, 14 bp, Homo sapiens
agccaagatcgcac

SEQ ID NO: 4492476 - DNA, 19 bp, Homo sapiens
agccaagatcgcaccactg

SEQ ID NO: 4492477 - DNA, 20 bp, Homo sapiens
agccaagattttcctcttgt

SEQ ID NO: 4492478 - DNA, 19 bp, Homo sapiens
agccaagctttaaattatg

SEQ ID NO: 4492479 - DNA, 22 bp, Homo sapiens
agccaaggaggaaatgtggaaa

SEQ ID NO: 4492480 - DNA, 23 bp, Homo sapiens
agccaagggcaacagatcagtaa

SEQ ID NO: 4492481 - DNA, 17 bp, Homo sapiens
agccaaggggatattta

SEQ ID NO: 4492482 - DNA, 14 bp, Homo sapiens
agccaagtagcctc

SEQ ID NO: 4492483 - DNA, 13 bp, Homo sapiens
agccaagtggggt

SEQ ID NO: 4492484 - DNA, 17 bp, Homo sapiens
agccaagttgtgacagt

SEQ ID NO: 4492485 - DNA, 14 bp, Homo sapiens
agccacaagctgca

SEQ ID NO: 4492486 - DNA, 19 bp, Homo sapiens
agccacaagctgcactgtg

SEQ ID NO: 4492487 - DNA, 21 bp, Homo sapiens
agccacaagctgcactgtgaa

SEQ ID NO: 4492488 - DNA, 21 bp, Homo sapiens
agccacacctggactgaccct

SEQ ID NO: 4492489 - DNA, 22 bp, Homo sapiens
agccacacctggactgaccctg

SEQ ID NO: 4492490 - DNA, 18 bp, Homo sapiens
agccacagcagcattttt

SEQ ID NO: 4492491 - DNA, 20 bp, Homo sapiens
agccacagcagcatttttat

SEQ ID NO: 4492492 - DNA, 13 bp, Homo sapiens
agccacagctgct

SEQ ID NO: 4492493 - DNA, 22 bp, Homo sapiens
agccacaggaaggaggggagag

SEQ ID NO: 4492494 - DNA, 14 bp, Homo sapiens
agccacaggcctga

SEQ ID NO: 4492495 - DNA, 16 bp, Homo sapiens
agccacaggcctgaga

SEQ ID NO: 4492496 - DNA, 14 bp, Homo sapiens
agccacatgcccca

SEQ ID NO: 4492497 - DNA, 18 bp, Homo sapiens
agccacatgccccaggct

SEQ ID NO: 4492498 - DNA, 19 bp, Homo sapiens
agccacatgccccaggctc

SEQ ID NO: 4492499 - DNA, 20 bp, Homo sapiens
agccacatttggaatacttt

SEQ ID NO: 4492500 - DNA, 21 bp, Homo sapiens
agccacatttggaatactttt

SEQ ID NO: 4492501 - DNA, 12 bp, Homo sapiens
agccaccagttc

SEQ ID NO: 4492502 - DNA, 22 bp, Homo sapiens
agccaccatgcttgcctgaagc

SEQ ID NO: 4492503 - DNA, 23 bp, Homo sapiens
agccaccatgcttgcctgaagct

SEQ ID NO: 4492504 - DNA, 18 bp, Homo sapiens
agccacccaagcctgctg

SEQ ID NO: 4492505 - DNA, 20 bp, Homo sapiens
agccacccaagcctgctggc

SEQ ID NO: 4492506 - DNA, 23 bp, Homo sapiens
agccacccaagcctgctggctgc

SEQ ID NO: 4492507 - DNA, 19 bp, Homo sapiens
agccaccccgggctctctg

SEQ ID NO: 4492508 - DNA, 21 bp, Homo sapiens
agccacccgtggggtgctgcc

SEQ ID NO: 4492509 - DNA, 17 bp, Homo sapiens
agccaccgtgcctggcc

SEQ ID NO: 4492510 - DNA, 21 bp, Homo sapiens
agccaccgtgcctggccagat

SEQ ID NO: 4492511 - DNA, 15 bp, Homo sapiens
agccaccttgttaca

SEQ ID NO: 4492512 - DNA, 13 bp, Homo sapiens
agccacgccctcc

SEQ ID NO: 4492513 - DNA, 14 bp, Homo sapiens
agccacgccctccc

SEQ ID NO: 4492514 - DNA, 15 bp, Homo sapiens
agccacgccctccct

SEQ ID NO: 4492515 - DNA, 16 bp, Homo sapiens
agccacgccctccctg

SEQ ID NO: 4492516 - DNA, 23 bp, Homo sapiens
agccacgctgtcctctcgagccc

SEQ ID NO: 4492517 - DNA, 18 bp, Homo sapiens
agccacgggtgccagaag

SEQ ID NO: 4492518 - DNA, 20 bp, Homo sapiens
agccacgttccttactgcag

SEQ ID NO: 4492519 - DNA, 22 bp, Homo sapiens
agccacgttccttactgcagaa

SEQ ID NO: 4492520 - DNA, 19 bp, Homo sapiens
agccactaagaacccctct

SEQ ID NO: 4492521 - DNA, 21 bp, Homo sapiens
agccactcctctgactcaggg

SEQ ID NO: 4492522 - DNA, 12 bp, Homo sapiens
agccactgtcac

SEQ ID NO: 4492523 - DNA, 15 bp, Homo sapiens
agccactgtcacagg

SEQ ID NO: 4492524 - DNA, 17 bp, Homo sapiens
agccacttaaaatgttc

SEQ ID NO: 4492525 - DNA, 15 bp, Homo sapiens
agccacttctcccca

SEQ ID NO: 4492526 - DNA, 15 bp, Homo sapiens
agccacttgcctgtg

SEQ ID NO: 4492527 - DNA, 21 bp, Homo sapiens
agccacttgtcttgaaaactg

SEQ ID NO: 4492528 - DNA, 14 bp, Homo sapiens
agccagaacctcag

SEQ ID NO: 4492529 - DNA, 14 bp, Homo sapiens
agccagacacgttc

SEQ ID NO: 4492530 - DNA, 14 bp, Homo sapiens
agcactgccccaca

SEQ ID NO: 4492531 - DNA, 17 bp, Homo sapiens
agcactgccccacatgc

SEQ ID NO: 4492532 - DNA, 21 bp, Homo sapiens
agcactgccccacatgcatgt

SEQ ID NO: 4492533 - DNA, 17 bp, Homo sapiens
agcactgcttgaggaaa

SEQ ID NO: 4492534 - DNA, 13 bp, Homo sapiens
agcactggcctgc

SEQ ID NO: 4492535 - DNA, 16 bp, Homo sapiens
agcacttaaacagaag

SEQ ID NO: 4492536 - DNA, 18 bp, Homo sapiens
agcacttaaattcctcaa

SEQ ID NO: 4492537 - DNA, 15 bp, Homo sapiens
agcacttatttaatg

SEQ ID NO: 4492538 - DNA, 16 bp, Homo sapiens
agcacttcaacctagt

SEQ ID NO: 4492539 - DNA, 14 bp, Homo sapiens
agcacttctgctgc

SEQ ID NO: 4492540 - DNA, 15 bp, Homo sapiens
agcacttctgctgca

SEQ ID NO: 4492541 - DNA, 19 bp, Homo sapiens
agcacttgctcaaaatctg

SEQ ID NO: 4492542 - DNA, 21 bp, Homo sapiens
agcacttgtgggtttttgttt

SEQ ID NO: 4492543 - DNA, 22 bp, Homo sapiens
agcactttcattgccagtgtct

SEQ ID NO: 4492544 - DNA, 19 bp, Homo sapiens
agcactttgggaggcaggg

SEQ ID NO: 4492545 - DNA, 20 bp, Homo sapiens
agcagaaagaagagaagtga

SEQ ID NO: 4492546 - DNA, 22 bp, Homo sapiens
agcagaaggaaggatgccactt

SEQ ID NO: 4492547 - DNA, 11 bp, Homo sapiens
agcagaaggag

SEQ ID NO: 4492548 - DNA, 14 bp, Homo sapiens
agcagaattcattc

SEQ ID NO: 4492549 - DNA, 17 bp, Homo sapiens
agcagacaagagggcaa

SEQ ID NO: 4492550 - DNA, 14 bp, Homo sapiens
agcagacactccag

SEQ ID NO: 4492551 - DNA, 11 bp, Homo sapiens
agcagacattt

SEQ ID NO: 4492552 - DNA, 18 bp, Homo sapiens
agcagactggaaaagtga

SEQ ID NO: 4492553 - DNA, 22 bp, Homo sapiens
agcagacttctcggaattcata

SEQ ID NO: 4492554 - DNA, 14 bp, Homo sapiens
agcagagagccctg

SEQ ID NO: 4492555 - DNA, 14 bp, Homo sapiens
agcagagccagggc

SEQ ID NO: 4492556 - DNA, 15 bp, Homo sapiens
agcagagccagggca

SEQ ID NO: 4492557 - DNA, 12 bp, Homo sapiens
agcagaggaggg

SEQ ID NO: 4492558 - DNA, 20 bp, Homo sapiens
agcagaggccctgcccccac

SEQ ID NO: 4492559 - DNA, 21 bp, Homo sapiens
agcagaggccctgcccccacc

SEQ ID NO: 4492560 - DNA, 12 bp, Homo sapiens
agcagataactt

SEQ ID NO: 4492561 - DNA, 14 bp, Homo sapiens
agcagataactttt

SEQ ID NO: 4492562 - DNA, 16 bp, Homo sapiens
agcagatctcatctca

SEQ ID NO: 4492563 - DNA, 15 bp, Homo sapiens
agcagcaaattttca

SEQ ID NO: 4492564 - DNA, 13 bp, Homo sapiens
agcagcaacagcc

SEQ ID NO: 4492565 - DNA, 17 bp, Homo sapiens
agcagcaactgaaaatg

SEQ ID NO: 4492566 - DNA, 16 bp, Homo sapiens
agcagcaagattgctt

SEQ ID NO: 4492567 - DNA, 13 bp, Homo sapiens
agcagcagcctgc

SEQ ID NO: 4492568 - DNA, 15 bp, Homo sapiens
agcagcagcctgcac

SEQ ID NO: 4492569 - DNA, 16 bp, Homo sapiens
agcagcagcctgcacc

SEQ ID NO: 4492570 - DNA, 15 bp, Homo sapiens
agcagcaggctcagg

SEQ ID NO: 4492571 - DNA, 13 bp, Homo sapiens
agcagcagtgtcc

SEQ ID NO: 4492572 - DNA, 17 bp, Homo sapiens
agcagcatggcatagcc

SEQ ID NO: 4492573 - DNA, 20 bp, Homo sapiens
agcagcatttttatttcaga

SEQ ID NO: 4492574 - DNA, 14 bp, Homo sapiens
agcagccccaggag

SEQ ID NO: 4492575 - DNA, 21 bp, Homo sapiens
agcagcccctgagagcctgtg

SEQ ID NO: 4492576 - DNA, 21 bp, Homo sapiens
agcagccctagcggctgctcc

SEQ ID NO: 4492577 - DNA, 12 bp, Homo sapiens
agcagccctcct

SEQ ID NO: 4492578 - DNA, 14 bp, Homo sapiens
agcagccctcctca

SEQ ID NO: 4492579 - DNA, 16 bp, Homo sapiens
agcagccctcctcacc

SEQ ID NO: 4492580 - DNA, 11 bp, Homo sapiens
agcagccctgg

SEQ ID NO: 4492581 - DNA, 15 bp, Homo sapiens
agcagccctggatgg

SEQ ID NO: 4492582 - DNA, 13 bp, Homo sapiens
agcagcctgagca

SEQ ID NO: 4492583 - DNA, 19 bp, Homo sapiens
agcagcctgagcaactctt

SEQ ID NO: 4492584 - DNA, 23 bp, Homo sapiens
agcagcctgagcaactcttgatt

SEQ ID NO: 4492585 - DNA, 15 bp, Homo sapiens
agcagcctgcacctg

SEQ ID NO: 4492586 - DNA, 17 bp, Homo sapiens
agcagcctgcacctgcc

SEQ ID NO: 4492587 - DNA, 18 bp, Homo sapiens
agcagctccctttctcag

SEQ ID NO: 4492588 - DNA, 22 bp, Homo sapiens
agcagctccctttctcaggagc

SEQ ID NO: 4492589 - DNA, 18 bp, Homo sapiens
agcagcttaagtccagct

SEQ ID NO: 4492590 - DNA, 11 bp, Homo sapiens
agcaggaaaaa

SEQ ID NO: 4492591 - DNA, 19 bp, Homo sapiens
agcaggacccagtggtcag

SEQ ID NO: 4492592 - DNA, 19 bp, Homo sapiens
agcaggagccccgccacag

SEQ ID NO: 4492593 - DNA, 14 bp, Homo sapiens
agcaggagcttggg

SEQ ID NO: 4492594 - DNA, 15 bp, Homo sapiens
agcaggagcttgggt

SEQ ID NO: 4492595 - DNA, 22 bp, Homo sapiens
agcaggagcttgggtctctctc

SEQ ID NO: 4492596 - DNA, 23 bp, Homo sapiens
agcaggcaccgccacgtcccagc

SEQ ID NO: 4492597 - DNA, 14 bp, Homo sapiens
agcaggcctctggt

SEQ ID NO: 4492598 - DNA, 20 bp, Homo sapiens
agcaggctactgtcagctcc

SEQ ID NO: 4492599 - DNA, 16 bp, Homo sapiens
agcaggctcaggcaca

SEQ ID NO: 4492600 - DNA, 13 bp, Homo sapiens
agcaggctgccag

SEQ ID NO: 4492601 - DNA, 17 bp, Homo sapiens
agcaggctgccagtgcc

SEQ ID NO: 4492602 - DNA, 15 bp, Homo sapiens
agcaggctggtttgc

SEQ ID NO: 4492603 - DNA, 14 bp, Homo sapiens
agcaggctgttcca

SEQ ID NO: 4492604 - DNA, 19 bp, Homo sapiens
agcagggcatggctgggaa

SEQ ID NO: 4492605 - DNA, 21 bp, Homo sapiens
agcaggggaattccctccccc

SEQ ID NO: 4492606 - DNA, 22 bp, Homo sapiens
agcaggggaattccctccccct

SEQ ID NO: 4492607 - DNA, 14 bp, Homo sapiens
agcaggggcccctg

SEQ ID NO: 4492608 - DNA, 15 bp, Homo sapiens
agcaggggctccagc

SEQ ID NO: 4492609 - DNA, 15 bp, Homo sapiens
agcagggtgctgtgg

SEQ ID NO: 4492610 - DNA, 23 bp, Homo sapiens
agcaggtgtctttaactgtcatt

SEQ ID NO: 4492611 - DNA, 21 bp, Homo sapiens
agcaggtttgttttcagcact

SEQ ID NO: 4492612 - DNA, 15 bp, Homo sapiens
agcagtacaataaaa

SEQ ID NO: 4492613 - DNA, 15 bp, Homo sapiens
agcagtattctattt

SEQ ID NO: 4492614 - DNA, 12 bp, Homo sapiens
agcagtattttt

SEQ ID NO: 4492615 - DNA, 17 bp, Homo sapiens
agcagtcagagtccagt

SEQ ID NO: 4492616 - DNA, 18 bp, Homo sapiens
agcagtcagggtgggaag

SEQ ID NO: 4492617 - DNA, 13 bp, Homo sapiens
agcagtccatgca

SEQ ID NO: 4492618 - DNA, 17 bp, Homo sapiens
agcagtctgataaactg

SEQ ID NO: 4492619 - DNA, 19 bp, Homo sapiens
agcagtctgataaactgac

SEQ ID NO: 4492620 - DNA, 21 bp, Homo sapiens
agcagtgaatgattcagtgtt

SEQ ID NO: 4492621 - DNA, 19 bp, Homo sapiens
agcagtggccttattgcat

SEQ ID NO: 4492622 - DNA, 22 bp, Homo sapiens
agcagtgtgaatagcctggcca

SEQ ID NO: 4492623 - DNA, 23 bp, Homo sapiens
agcagtgtgaatagcctggccac

SEQ ID NO: 4492624 - DNA, 22 bp, Homo sapiens
agcagttcacaaaaaaatgttc

SEQ ID NO: 4492625 - DNA, 23 bp, Homo sapiens
agcagttctgcaaatagaaaaca

SEQ ID NO: 4492626 - DNA, 16 bp, Homo sapiens
agcagttgaaaagact

SEQ ID NO: 4492627 - DNA, 21 bp, Homo sapiens
agcagttgaaaagactccaaa

SEQ ID NO: 4492628 - DNA, 15 bp, Homo sapiens
agcataaaagatgaa

SEQ ID NO: 4492629 - DNA, 14 bp, Homo sapiens
agcataaaatgaaa

SEQ ID NO: 4492630 - DNA, 13 bp, Homo sapiens
agcataaagctca

SEQ ID NO: 4492631 - DNA, 17 bp, Homo sapiens
agcataatctgaaaaca

SEQ ID NO: 4492632 - DNA, 13 bp, Homo sapiens
agcataccaacac

SEQ ID NO: 4492633 - DNA, 17 bp, Homo sapiens
agcatactttgtaaata

SEQ ID NO: 4492634 - DNA, 22 bp, Homo sapiens
agcatactttgtaaataggatt

SEQ ID NO: 4492635 - DNA, 12 bp, Homo sapiens
agcatataaatg

SEQ ID NO: 4492636 - DNA, 18 bp, Homo sapiens
agcatataaatgtttata

SEQ ID NO: 4492637 - DNA, 15 bp, Homo sapiens
agcatattttcttac

SEQ ID NO: 4492638 - DNA, 16 bp, Homo sapiens
agcatattttcttact

SEQ ID NO: 4492639 - DNA, 20 bp, Homo sapiens
agcatattttcttactttta

SEQ ID NO: 4492640 - DNA, 21 bp, Homo sapiens
agcatattttcttacttttat

SEQ ID NO: 4492641 - DNA, 22 bp, Homo sapiens
agcatattttcttacttttatt

SEQ ID NO: 4492642 - DNA, 13 bp, Homo sapiens
agcatcaagccac

SEQ ID NO: 4492643 - DNA, 14 bp, Homo sapiens
agcatcaatcttgt

SEQ ID NO: 4492644 - DNA, 20 bp, Homo sapiens
agcatcaccactcattttga

SEQ ID NO: 4492645 - DNA, 16 bp, Homo sapiens
agcatcactgatggga

SEQ ID NO: 4492646 - DNA, 16 bp, Homo sapiens
agcatccaccccaccc

SEQ ID NO: 4492647 - DNA, 12 bp, Homo sapiens
agcatccaggct

SEQ ID NO: 4492648 - DNA, 19 bp, Homo sapiens
agcatccctggagcaggag

SEQ ID NO: 4492649 - DNA, 15 bp, Homo sapiens
agcatcccttcccac

SEQ ID NO: 4492650 - DNA, 20 bp, Homo sapiens
agcatcccttcccacatgcc

SEQ ID NO: 4492651 - DNA, 21 bp, Homo sapiens
agcatcctgccttagagccag

SEQ ID NO: 4492652 - DNA, 18 bp, Homo sapiens
agcaaaaggctgagaagg

SEQ ID NO: 4492653 - DNA, 17 bp, Homo sapiens
agcaaaataaaaactat

SEQ ID NO: 4492654 - DNA, 13 bp, Homo sapiens
agcaaaatcaaca

SEQ ID NO: 4492655 - DNA, 17 bp, Homo sapiens
agcaaaatctaaaatgt

SEQ ID NO: 4492656 - DNA, 20 bp, Homo sapiens
agcaaacctaacaggagaaa

SEQ ID NO: 4492657 - DNA, 23 bp, Homo sapiens
agcaaacctaacaggagaaagga

SEQ ID NO: 4492658 - DNA, 13 bp, Homo sapiens
agcaaactctttt

SEQ ID NO: 4492659 - DNA, 17 bp, Homo sapiens
agcaaactcttttccca

SEQ ID NO: 4492660 - DNA, 22 bp, Homo sapiens
agcaaagaaggccagcaacatt

SEQ ID NO: 4492661 - DNA, 21 bp, Homo sapiens
agcaaagattaaatgtgtcat

SEQ ID NO: 4492662 - DNA, 22 bp, Homo sapiens
agcaaagcacccatttcaatgt

SEQ ID NO: 4492663 - DNA, 18 bp, Homo sapiens
agcaaagccatccccgct

SEQ ID NO: 4492664 - DNA, 14 bp, Homo sapiens
agcaaaggccctgg

SEQ ID NO: 4492665 - DNA, 16 bp, Homo sapiens
agcaaaggccctgggt

SEQ ID NO: 4492666 - DNA, 20 bp, Homo sapiens
agcaaagggaatgggtctgc

SEQ ID NO: 4492667 - DNA, 14 bp, Homo sapiens
agcaaatacttagc

SEQ ID NO: 4492668 - DNA, 21 bp, Homo sapiens
agcaaatacttagcaaaaagt

SEQ ID NO: 4492669 - DNA, 14 bp, Homo sapiens
agcaaatatatgat

SEQ ID NO: 4492670 - DNA, 20 bp, Homo sapiens
agcaaatcagaaacttgtga

SEQ ID NO: 4492671 - DNA, 17 bp, Homo sapiens
agcaaatcgaatgaaat

SEQ ID NO: 4492672 - DNA, 20 bp, Homo sapiens
agcaaatcgaatgaaattaa

SEQ ID NO: 4492673 - DNA, 22 bp, Homo sapiens
agcaaatcgaatgaaattaact

SEQ ID NO: 4492674 - DNA, 15 bp, Homo sapiens
agcaaatgacagatt

SEQ ID NO: 4492675 - DNA, 13 bp, Homo sapiens
agcaaatgcaaaa

SEQ ID NO: 4492676 - DNA, 14 bp, Homo sapiens
agcaaatgcaaaaa

SEQ ID NO: 4492677 - DNA, 22 bp, Homo sapiens
agcaaatgcaaaaactctttga

SEQ ID NO: 4492678 - DNA, 13 bp, Homo sapiens
agcaaatgggcat

SEQ ID NO: 4492679 - DNA, 20 bp, Homo sapiens
agcaacaaagattgagaagc

SEQ ID NO: 4492680 - DNA, 21 bp, Homo sapiens
agcaacaatttatgaattgaa

SEQ ID NO: 4492681 - DNA, 21 bp, Homo sapiens
agcaacaggaatcaagagctg

SEQ ID NO: 4492682 - DNA, 23 bp, Homo sapiens
agcaacattggcacatgccacct

SEQ ID NO: 4492683 - DNA, 17 bp, Homo sapiens
agcaaccacaaatgcat

SEQ ID NO: 4492684 - DNA, 16 bp, Homo sapiens
agcaaccctacagtat

SEQ ID NO: 4492685 - DNA, 14 bp, Homo sapiens
agcaacctttccct

SEQ ID NO: 4492686 - DNA, 13 bp, Homo sapiens
agcaacggcacag

SEQ ID NO: 4492687 - DNA, 11 bp, Homo sapiens
agcaactccca

SEQ ID NO: 4492688 - DNA, 19 bp, Homo sapiens
agcaactgttagctgggaa

SEQ ID NO: 4492689 - DNA, 16 bp, Homo sapiens
agcaacttgcttctaa

SEQ ID NO: 4492690 - DNA, 19 bp, Homo sapiens
agcaagaaggcaaaaatag

SEQ ID NO: 4492691 - DNA, 21 bp, Homo sapiens
agcaagaatgcagtacagaat

SEQ ID NO: 4492692 - DNA, 22 bp, Homo sapiens
agcaagaggcaagctgaaattt

SEQ ID NO: 4492693 - DNA, 17 bp, Homo sapiens
agcaagatgagctgtgc

SEQ ID NO: 4492694 - DNA, 22 bp, Homo sapiens
agcaagcattcagaagaaaaag

SEQ ID NO: 4492695 - DNA, 14 bp, Homo sapiens
agcaagccagacct

SEQ ID NO: 4492696 - DNA, 13 bp, Homo sapiens
agcaagccatcat

SEQ ID NO: 4492697 - DNA, 21 bp, Homo sapiens
agcaagctgcccagccctggc

SEQ ID NO: 4492698 - DNA, 16 bp, Homo sapiens
agcaagggtgatggga

SEQ ID NO: 4492699 - DNA, 20 bp, Homo sapiens
agcaagggtgatgggaaagc

SEQ ID NO: 4492700 - DNA, 22 bp, Homo sapiens
agcaagggtgatgggaaagcat

SEQ ID NO: 4492701 - DNA, 21 bp, Homo sapiens
agcaaggtttaaatttgttat

SEQ ID NO: 4492702 - DNA, 14 bp, Homo sapiens
agcaagtatattta

SEQ ID NO: 4492703 - DNA, 19 bp, Homo sapiens
agcaagtgtgcactccagc

SEQ ID NO: 4492704 - DNA, 16 bp, Homo sapiens
agcaagttacagtgat

SEQ ID NO: 4492705 - DNA, 18 bp, Homo sapiens
agcaagttcgtctgttgt

SEQ ID NO: 4492706 - DNA, 14 bp, Homo sapiens
agcaatacagggag

SEQ ID NO: 4492707 - DNA, 18 bp, Homo sapiens
agcaatactgtttccatt

SEQ ID NO: 4492708 - DNA, 13 bp, Homo sapiens
agcaatattgtat

SEQ ID NO: 4492709 - DNA, 15 bp, Homo sapiens
agcaatcacaaaggc

SEQ ID NO: 4492710 - DNA, 15 bp, Homo sapiens
agcaatcagaattgt

SEQ ID NO: 4492711 - DNA, 14 bp, Homo sapiens
agcaatcattttat

SEQ ID NO: 4492712 - DNA, 15 bp, Homo sapiens
agcaatcattttatg

SEQ ID NO: 4492713 - DNA, 17 bp, Homo sapiens
agcaatccacctgcctt

SEQ ID NO: 4492714 - DNA, 17 bp, Homo sapiens
agcaatcctcctgcctc

SEQ ID NO: 4492715 - DNA, 22 bp, Homo sapiens
agcaatcctcctgcctcagcct

SEQ ID NO: 4492716 - DNA, 23 bp, Homo sapiens
agcaatcctcctgcctcagcctt

SEQ ID NO: 4492717 - DNA, 14 bp, Homo sapiens
agcaatctttgaaa

SEQ ID NO: 4492718 - DNA, 16 bp, Homo sapiens
agcaatctttgaaata

SEQ ID NO: 4492719 - DNA, 18 bp, Homo sapiens
agcaatggccagagcctc

SEQ ID NO: 4492720 - DNA, 17 bp, Homo sapiens
agcaatgtaaaaatggt

SEQ ID NO: 4492721 - DNA, 23 bp, Homo sapiens
agcaattctcctgcctcagcctc

SEQ ID NO: 4492722 - DNA, 13 bp, Homo sapiens
agcaatttaaatg

SEQ ID NO: 4492723 - DNA, 19 bp, Homo sapiens
agcaatttaaatgttatga

SEQ ID NO: 4492724 - DNA, 16 bp, Homo sapiens
agcacaagtacttttg

SEQ ID NO: 4492725 - DNA, 16 bp, Homo sapiens
agcacacaggcagcca

SEQ ID NO: 4492726 - DNA, 19 bp, Homo sapiens
agcacactggctcacccag

SEQ ID NO: 4492727 - DNA, 20 bp, Homo sapiens
agcacagagcctggccccag

SEQ ID NO: 4492728 - DNA, 22 bp, Homo sapiens
agcacagagcctggccccaggc

SEQ ID NO: 4492729 - DNA, 13 bp, Homo sapiens
agcacagagggct

SEQ ID NO: 4492730 - DNA, 15 bp, Homo sapiens
agcacagattttgaa

SEQ ID NO: 4492731 - DNA, 17 bp, Homo sapiens
agcacaggctaattttt

SEQ ID NO: 4492732 - DNA, 19 bp, Homo sapiens
agcacatagagctttttaa

SEQ ID NO: 4492733 - DNA, 20 bp, Homo sapiens
agcacatagagctttttaat

SEQ ID NO: 4492734 - DNA, 18 bp, Homo sapiens
agcacatattagtgcagc

SEQ ID NO: 4492735 - DNA, 21 bp, Homo sapiens
agcacattcgggaccaatata

SEQ ID NO: 4492736 - DNA, 19 bp, Homo sapiens
agcacattttcagactgca

SEQ ID NO: 4492737 - DNA, 12 bp, Homo sapiens
agcaccacccta

SEQ ID NO: 4492738 - DNA, 23 bp, Homo sapiens
agcaccaggcacgaacccacctg

SEQ ID NO: 4492739 - DNA, 23 bp, Homo sapiens
agcaccattttaagtccctgtca

SEQ ID NO: 4492740 - DNA, 21 bp, Homo sapiens
agcacccatttcaatgtgtat

SEQ ID NO: 4492741 - DNA, 17 bp, Homo sapiens
agcacccccaccaaact

SEQ ID NO: 4492742 - DNA, 22 bp, Homo sapiens
agcaccccctgctccaccagca

SEQ ID NO: 4492743 - DNA, 18 bp, Homo sapiens
agcacccctactcacata

SEQ ID NO: 4492744 - DNA, 18 bp, Homo sapiens
agcaccctcccccgcagc

SEQ ID NO: 4492745 - DNA, 13 bp, Homo sapiens
agcaccctctcct

SEQ ID NO: 4492746 - DNA, 16 bp, Homo sapiens
agcaccgaatattgag

SEQ ID NO: 4492747 - DNA, 18 bp, Homo sapiens
agcaccgaatattgagca

SEQ ID NO: 4492748 - DNA, 23 bp, Homo sapiens
agcaccgtgatggagaggacaga

SEQ ID NO: 4492749 - DNA, 22 bp, Homo sapiens
agcaccgtgtcgggcaggtcag

SEQ ID NO: 4492750 - DNA, 15 bp, Homo sapiens
agcacctacagtgta

SEQ ID NO: 4492751 - DNA, 19 bp, Homo sapiens
agcacctacagtgtacagt

SEQ ID NO: 4492752 - DNA, 19 bp, Homo sapiens
agcacctgccgacctcgtc

SEQ ID NO: 4492753 - DNA, 20 bp, Homo sapiens
agcacctgccgacctcgtcc

SEQ ID NO: 4492754 - DNA, 17 bp, Homo sapiens
agcaccttctttctgga

SEQ ID NO: 4492755 - DNA, 21 bp, Homo sapiens
agcaccttctttctggactgg

SEQ ID NO: 4492756 - DNA, 22 bp, Homo sapiens
agcaccttctttctggactggc

SEQ ID NO: 4492757 - DNA, 15 bp, Homo sapiens
agcacgagcctgggc

SEQ ID NO: 4492758 - DNA, 18 bp, Homo sapiens
agcacgattttgcacaaa

SEQ ID NO: 4492759 - DNA, 14 bp, Homo sapiens
agcacgtggagata

SEQ ID NO: 4492760 - DNA, 17 bp, Homo sapiens
agcactactctgtgcca

SEQ ID NO: 4492761 - DNA, 17 bp, Homo sapiens
agcactactgggtgtca

SEQ ID NO: 4492762 - DNA, 18 bp, Homo sapiens
agcactactgggtgtcat

SEQ ID NO: 4492763 - DNA, 19 bp, Homo sapiens
agcactactgggtgtcatt

SEQ ID NO: 4492764 - DNA, 22 bp, Homo sapiens
agcactactgggtgtcatttca

SEQ ID NO: 4492765 - DNA, 19 bp, Homo sapiens
agcactagaaattgggcag

SEQ ID NO: 4492766 - DNA, 18 bp, Homo sapiens
agcactatgctttccttc

SEQ ID NO: 4492767 - DNA, 19 bp, Homo sapiens
agcactccgcatcacctca

SEQ ID NO: 4492768 - DNA, 20 bp, Homo sapiens
agcactgagctcacatggga

SEQ ID NO: 4492769 - DNA, 19 bp, Homo sapiens
agcactgcatgtcagagca

SEQ ID NO: 4492770 - DNA, 21 bp, Homo sapiens
agcactgcatgtcagagcact

SEQ ID NO: 4492771 - DNA, 15 bp, Homo sapiens
agatgggttcttagc

SEQ ID NO: 4492772 - DNA, 18 bp, Homo sapiens
agatggtaaaccagatct

SEQ ID NO: 4492773 - DNA, 15 bp, Homo sapiens
agatggtgctgctaa

SEQ ID NO: 4492774 - DNA, 13 bp, Homo sapiens
agatggtgtcatt

SEQ ID NO: 4492775 - DNA, 14 bp, Homo sapiens
agatggtgtcattt

SEQ ID NO: 4492776 - DNA, 18 bp, Homo sapiens
agatggttaaacattttc

SEQ ID NO: 4492777 - DNA, 16 bp, Homo sapiens
agatggttacactgtt

SEQ ID NO: 4492778 - DNA, 16 bp, Homo sapiens
agatgtaaaatgagtt

SEQ ID NO: 4492779 - DNA, 15 bp, Homo sapiens
agatgtaacctacaa

SEQ ID NO: 4492780 - DNA, 23 bp, Homo sapiens
agatgtaatgttttctttgcaaa

SEQ ID NO: 4492781 - DNA, 14 bp, Homo sapiens
agatgtacatttaa

SEQ ID NO: 4492782 - DNA, 18 bp, Homo sapiens
agatgtacatttaataat

SEQ ID NO: 4492783 - DNA, 16 bp, Homo sapiens
agatgtagaggagaaa

SEQ ID NO: 4492784 - DNA, 19 bp, Homo sapiens
agatgtagaggagaaactg

SEQ ID NO: 4492785 - DNA, 14 bp, Homo sapiens
agatgtagtatttt

SEQ ID NO: 4492786 - DNA, 16 bp, Homo sapiens
agatgtattctttata

SEQ ID NO: 4492787 - DNA, 13 bp, Homo sapiens
agatgtatttttg

SEQ ID NO: 4492788 - DNA, 22 bp, Homo sapiens
agatgtatttttgatgtatata

SEQ ID NO: 4492789 - DNA, 18 bp, Homo sapiens
agatgtcttccctgggct

SEQ ID NO: 4492790 - DNA, 19 bp, Homo sapiens
agatgtcttccctgggctg

SEQ ID NO: 4492791 - DNA, 17 bp, Homo sapiens
agatgtgaaaatatact

SEQ ID NO: 4492792 - DNA, 11 bp, Homo sapiens
agatgtgaatt

SEQ ID NO: 4492793 - DNA, 23 bp, Homo sapiens
agatgtgagccaccgtgcctggc

SEQ ID NO: 4492794 - DNA, 21 bp, Homo sapiens
agatgtgcacccatgggctct

SEQ ID NO: 4492795 - DNA, 13 bp, Homo sapiens
agatgtgtaaaca

SEQ ID NO: 4492796 - DNA, 18 bp, Homo sapiens
agatgtgtaaacaggtat

SEQ ID NO: 4492797 - DNA, 21 bp, Homo sapiens
agatgtgtcccccccaggcct

SEQ ID NO: 4492798 - DNA, 18 bp, Homo sapiens
agatgttaaaataaatgg

SEQ ID NO: 4492799 - DNA, 15 bp, Homo sapiens
agatgttccaaattt

SEQ ID NO: 4492800 - DNA, 21 bp, Homo sapiens
agatgtttcattttactgtat

SEQ ID NO: 4492801 - DNA, 20 bp, Homo sapiens
agatgtttgtttacataaga

SEQ ID NO: 4492802 - DNA, 19 bp, Homo sapiens
agatgtttttaattctagt

SEQ ID NO: 4492803 - DNA, 21 bp, Homo sapiens
agattaaaaccagagagaaag

SEQ ID NO: 4492804 - DNA, 15 bp, Homo sapiens
agattaaattacagc

SEQ ID NO: 4492805 - DNA, 17 bp, Homo sapiens
agattaagcttttcatt

SEQ ID NO: 4492806 - DNA, 17 bp, Homo sapiens
agattaatgtaggatga

SEQ ID NO: 4492807 - DNA, 12 bp, Homo sapiens
agattacactga

SEQ ID NO: 4492808 - DNA, 17 bp, Homo sapiens
agattacaggaatgaag

SEQ ID NO: 4492809 - DNA, 20 bp, Homo sapiens
agattacaggaatgaagaac

SEQ ID NO: 4492810 - DNA, 21 bp, Homo sapiens
agattacaggaatgaagaact

SEQ ID NO: 4492811 - DNA, 22 bp, Homo sapiens
agattacaggaatgaagaactg

SEQ ID NO: 4492812 - DNA, 16 bp, Homo sapiens
agattacatctgcctt

SEQ ID NO: 4492813 - DNA, 23 bp, Homo sapiens
agattactgatgtgatattctgt

SEQ ID NO: 4492814 - DNA, 17 bp, Homo sapiens
agattatgtgacttgca

SEQ ID NO: 4492815 - DNA, 15 bp, Homo sapiens
agattattataaact

SEQ ID NO: 4492816 - DNA, 21 bp, Homo sapiens
agattattgtgacttcactgt

SEQ ID NO: 4492817 - DNA, 23 bp, Homo sapiens
agattcaaaatggcttgtctttg

SEQ ID NO: 4492818 - DNA, 14 bp, Homo sapiens
agattcacctgtaa

SEQ ID NO: 4492819 - DNA, 17 bp, Homo sapiens
agattcacctgtaaaac

SEQ ID NO: 4492820 - DNA, 19 bp, Homo sapiens
agattcacctgtaaaactt

SEQ ID NO: 4492821 - DNA, 21 bp, Homo sapiens
agattcacctgtaaaacttta

SEQ ID NO: 4492822 - DNA, 18 bp, Homo sapiens
agattcaggccagcccag

SEQ ID NO: 4492823 - DNA, 20 bp, Homo sapiens
agattcaggccagcccagcc

SEQ ID NO: 4492824 - DNA, 23 bp, Homo sapiens
agattcaggccagcccagccagg

SEQ ID NO: 4492825 - DNA, 16 bp, Homo sapiens
agattcaggtaataca

SEQ ID NO: 4492826 - DNA, 13 bp, Homo sapiens
agattcccagaga

SEQ ID NO: 4492827 - DNA, 15 bp, Homo sapiens
agattccctgagcag

SEQ ID NO: 4492828 - DNA, 20 bp, Homo sapiens
agattcctttccctttagca

SEQ ID NO: 4492829 - DNA, 21 bp, Homo sapiens
agattctatgttaatatttta

SEQ ID NO: 4492830 - DNA, 17 bp, Homo sapiens
agattctctgcccagcc

SEQ ID NO: 4492831 - DNA, 21 bp, Homo sapiens
agattctctgcccagccgggc

SEQ ID NO: 4492832 - DNA, 14 bp, Homo sapiens
agattctgaattgg

SEQ ID NO: 4492833 - DNA, 21 bp, Homo sapiens
agattctgagcaaaggccctg

SEQ ID NO: 4492834 - DNA, 19 bp, Homo sapiens
agattctgcctctctggaa

SEQ ID NO: 4492835 - DNA, 19 bp, Homo sapiens
agattctgtgtattaacat

SEQ ID NO: 4492836 - DNA, 12 bp, Homo sapiens
agattcttttaa

SEQ ID NO: 4492837 - DNA, 22 bp, Homo sapiens
agattcttttaaattagaaaat

SEQ ID NO: 4492838 - DNA, 13 bp, Homo sapiens
agattgagaagcc

SEQ ID NO: 4492839 - DNA, 17 bp, Homo sapiens
agattgagaagccatgt

SEQ ID NO: 4492840 - DNA, 19 bp, Homo sapiens
agattgcagaaaattctgt

SEQ ID NO: 4492841 - DNA, 23 bp, Homo sapiens
agattgcagaaaattctgtgcct

SEQ ID NO: 4492842 - DNA, 13 bp, Homo sapiens
agattgctgaaat

SEQ ID NO: 4492843 - DNA, 22 bp, Homo sapiens
agattgctgaaattttatatgc

SEQ ID NO: 4492844 - DNA, 15 bp, Homo sapiens
agattggatttgctg

SEQ ID NO: 4492845 - DNA, 17 bp, Homo sapiens
agattggatttgctgtg

SEQ ID NO: 4492846 - DNA, 19 bp, Homo sapiens
agattggctcacactgaga

SEQ ID NO: 4492847 - DNA, 23 bp, Homo sapiens
agattggctcacactgagaatgt

SEQ ID NO: 4492848 - DNA, 15 bp, Homo sapiens
agattgtattgctgt

SEQ ID NO: 4492849 - DNA, 16 bp, Homo sapiens
agattgtggaatgttg

SEQ ID NO: 4492850 - DNA, 17 bp, Homo sapiens
agattgtggtggtgcta

SEQ ID NO: 4492851 - DNA, 15 bp, Homo sapiens
agattgttattaaat

SEQ ID NO: 4492852 - DNA, 17 bp, Homo sapiens
agattgttattaaatgt

SEQ ID NO: 4492853 - DNA, 18 bp, Homo sapiens
agatttaaagtattttaa

SEQ ID NO: 4492854 - DNA, 23 bp, Homo sapiens
agatttaagtgaatacattaacg

SEQ ID NO: 4492855 - DNA, 22 bp, Homo sapiens
agatttactgctctagaaagta

SEQ ID NO: 4492856 - DNA, 17 bp, Homo sapiens
agatttacttaattgct

SEQ ID NO: 4492857 - DNA, 18 bp, Homo sapiens
agatttagttgagttatt

SEQ ID NO: 4492858 - DNA, 18 bp, Homo sapiens
agatttatacagttgaaa

SEQ ID NO: 4492859 - DNA, 13 bp, Homo sapiens
agatttattatga

SEQ ID NO: 4492860 - DNA, 13 bp, Homo sapiens
agatttattgtaa

SEQ ID NO: 4492861 - DNA, 13 bp, Homo sapiens
agatttatttagc

SEQ ID NO: 4492862 - DNA, 18 bp, Homo sapiens
agatttatttagctattt

SEQ ID NO: 4492863 - DNA, 18 bp, Homo sapiens
agatttcatagttcagaa

SEQ ID NO: 4492864 - DNA, 20 bp, Homo sapiens
agatttcatagttcagaatt

SEQ ID NO: 4492865 - DNA, 17 bp, Homo sapiens
agatttctcactatata

SEQ ID NO: 4492866 - DNA, 15 bp, Homo sapiens
agatttctgacatca

SEQ ID NO: 4492867 - DNA, 18 bp, Homo sapiens
agatttgaaaattgtata

SEQ ID NO: 4492868 - DNA, 16 bp, Homo sapiens
agatttgcccatttac

SEQ ID NO: 4492869 - DNA, 17 bp, Homo sapiens
agatttgcccatttaca

SEQ ID NO: 4492870 - DNA, 21 bp, Homo sapiens
agattttccattaactatttt

SEQ ID NO: 4492871 - DNA, 20 bp, Homo sapiens
agattttcctcttgtgattt

SEQ ID NO: 4492872 - DNA, 16 bp, Homo sapiens
agattttctgctactt

SEQ ID NO: 4492873 - DNA, 14 bp, Homo sapiens
agattttgataact

SEQ ID NO: 4492874 - DNA, 18 bp, Homo sapiens
agattttgataactgttt

SEQ ID NO: 4492875 - DNA, 12 bp, Homo sapiens
agattttgttgg

SEQ ID NO: 4492876 - DNA, 21 bp, Homo sapiens
agatttttaaaaaatattttc

SEQ ID NO: 4492877 - DNA, 22 bp, Homo sapiens
agatttttatattagttgcttt

SEQ ID NO: 4492878 - DNA, 13 bp, Homo sapiens
agatttttattta

SEQ ID NO: 4492879 - DNA, 15 bp, Homo sapiens
agatttttatttatg

SEQ ID NO: 4492880 - DNA, 19 bp, Homo sapiens
agatttttattttgaaaaa

SEQ ID NO: 4492881 - DNA, 12 bp, Homo sapiens
agatttttcaaa

SEQ ID NO: 4492882 - DNA, 19 bp, Homo sapiens
agattttttaaaattttgg

SEQ ID NO: 4492883 - DNA, 13 bp, Homo sapiens
agattttttaata

SEQ ID NO: 4492884 - DNA, 16 bp, Homo sapiens
agattttttcagactt

SEQ ID NO: 4492885 - DNA, 15 bp, Homo sapiens
agatttttttcctga

SEQ ID NO: 4492886 - DNA, 17 bp, Homo sapiens
agattttttttccgtgt

SEQ ID NO: 4492887 - DNA, 17 bp, Homo sapiens
agattttttttgtaact

SEQ ID NO: 4492888 - DNA, 17 bp, Homo sapiens
agcaaaaccaaactggg

SEQ ID NO: 4492889 - DNA, 14 bp, Homo sapiens
agcaaaagaagaag

SEQ ID NO: 4492890 - DNA, 16 bp, Homo sapiens
agcaaaagaccaaatc

SEQ ID NO: 4492891 - DNA, 15 bp, Homo sapiens
agccagaccagcagg

SEQ ID NO: 4492892 - DNA, 14 bp, Homo sapiens
agccagactgtcca

SEQ ID NO: 4492893 - DNA, 18 bp, Homo sapiens
agccagactgtccaggga

SEQ ID NO: 4492894 - DNA, 14 bp, Homo sapiens
agccagagccccaa

SEQ ID NO: 4492895 - DNA, 16 bp, Homo sapiens
agccagagccccaagc

SEQ ID NO: 4492896 - DNA, 13 bp, Homo sapiens
agccagagcctgg

SEQ ID NO: 4492897 - DNA, 16 bp, Homo sapiens
agccagaggagggcag

SEQ ID NO: 4492898 - DNA, 17 bp, Homo sapiens
agccagaggagggcaga

SEQ ID NO: 4492899 - DNA, 15 bp, Homo sapiens
agccagatcctcttg

SEQ ID NO: 4492900 - DNA, 17 bp, Homo sapiens
agccagatcctcttggt

SEQ ID NO: 4492901 - DNA, 18 bp, Homo sapiens
agccagatttgtcttttt

SEQ ID NO: 4492902 - DNA, 17 bp, Homo sapiens
agccagcacaaaaggca

SEQ ID NO: 4492903 - DNA, 20 bp, Homo sapiens
agccagccaagctttaaatt

SEQ ID NO: 4492904 - DNA, 14 bp, Homo sapiens
agccagcccagccc

SEQ ID NO: 4492905 - DNA, 17 bp, Homo sapiens
agccagcccagcccagc

SEQ ID NO: 4492906 - DNA, 20 bp, Homo sapiens
agccagccctccctgtcctc

SEQ ID NO: 4492907 - DNA, 17 bp, Homo sapiens
agccagcccttccctgg

SEQ ID NO: 4492908 - DNA, 21 bp, Homo sapiens
agccagcccttccctggcccc

SEQ ID NO: 4492909 - DNA, 15 bp, Homo sapiens
agccagccgccctgg

SEQ ID NO: 4492910 - DNA, 17 bp, Homo sapiens
agccagccgccctgggc

SEQ ID NO: 4492911 - DNA, 17 bp, Homo sapiens
agccagcctcagaaggc

SEQ ID NO: 4492912 - DNA, 11 bp, Homo sapiens
agccagcctgg

SEQ ID NO: 4492913 - DNA, 16 bp, Homo sapiens
agccagcgcctccctc

SEQ ID NO: 4492914 - DNA, 16 bp, Homo sapiens
agccagcgtcctcctc

SEQ ID NO: 4492915 - DNA, 18 bp, Homo sapiens
agccagcgtcctcctctg

SEQ ID NO: 4492916 - DNA, 23 bp, Homo sapiens
agccagcgtcctcctctgtgacc

SEQ ID NO: 4492917 - DNA, 20 bp, Homo sapiens
agccagcgtttattgtagta

SEQ ID NO: 4492918 - DNA, 14 bp, Homo sapiens
agccagctgcagaa

SEQ ID NO: 4492919 - DNA, 13 bp, Homo sapiens
agccagcttaaac

SEQ ID NO: 4492920 - DNA, 14 bp, Homo sapiens
agccagctttccct

SEQ ID NO: 4492921 - DNA, 17 bp, Homo sapiens
agccaggagcagccctg

SEQ ID NO: 4492922 - DNA, 18 bp, Homo sapiens
agccaggagtgcccccgg

SEQ ID NO: 4492923 - DNA, 16 bp, Homo sapiens
agccaggatggtctcg

SEQ ID NO: 4492924 - DNA, 20 bp, Homo sapiens
agccaggcacacactgtgct

SEQ ID NO: 4492925 - DNA, 12 bp, Homo sapiens
agccaggcctgg

SEQ ID NO: 4492926 - DNA, 13 bp, Homo sapiens
agccaggcctggc

SEQ ID NO: 4492927 - DNA, 14 bp, Homo sapiens
agccaggcctggct

SEQ ID NO: 4492928 - DNA, 21 bp, Homo sapiens
agccaggcctggctggaggag

SEQ ID NO: 4492929 - DNA, 12 bp, Homo sapiens
agccagggcaag

SEQ ID NO: 4492930 - DNA, 14 bp, Homo sapiens
agccagggcagggc

SEQ ID NO: 4492931 - DNA, 18 bp, Homo sapiens
agccagggcagggcgagc

SEQ ID NO: 4492932 - DNA, 21 bp, Homo sapiens
agccagggcagggcgagctgc

SEQ ID NO: 4492933 - DNA, 14 bp, Homo sapiens
agccagggctgggg

SEQ ID NO: 4492934 - DNA, 23 bp, Homo sapiens
agccagggctggggttgccagag

SEQ ID NO: 4492935 - DNA, 13 bp, Homo sapiens
agccaggtgcctt

SEQ ID NO: 4492936 - DNA, 18 bp, Homo sapiens
agccaggtgccttggagg

SEQ ID NO: 4492937 - DNA, 21 bp, Homo sapiens
agccaggttctcattaggttt

SEQ ID NO: 4492938 - DNA, 22 bp, Homo sapiens
agccagttgcttcttcagctga

SEQ ID NO: 4492939 - DNA, 23 bp, Homo sapiens
agccagttgcttcttcagctgac

SEQ ID NO: 4492940 - DNA, 13 bp, Homo sapiens
agccataaatgat

SEQ ID NO: 4492941 - DNA, 22 bp, Homo sapiens
agccatactgcgtccaccctga

SEQ ID NO: 4492942 - DNA, 22 bp, Homo sapiens
agccatacttatctctctgtgc

SEQ ID NO: 4492943 - DNA, 14 bp, Homo sapiens
agccatcaaaatgc

SEQ ID NO: 4492944 - DNA, 13 bp, Homo sapiens
agccatcaagcac

SEQ ID NO: 4492945 - DNA, 15 bp, Homo sapiens
agccatcaagcactt

SEQ ID NO: 4492946 - DNA, 16 bp, Homo sapiens
agccatcaagcacttc

SEQ ID NO: 4492947 - DNA, 19 bp, Homo sapiens
agccatcacttctccccgc

SEQ ID NO: 4492948 - DNA, 16 bp, Homo sapiens
agccatcgtcctggga

SEQ ID NO: 4492949 - DNA, 19 bp, Homo sapiens
agccatcgtcctgggactc

SEQ ID NO: 4492950 - DNA, 22 bp, Homo sapiens
agccatctccatcttgaaggaa

SEQ ID NO: 4492951 - DNA, 19 bp, Homo sapiens
agccatgaggagttgctgt

SEQ ID NO: 4492952 - DNA, 18 bp, Homo sapiens
agccatgatttcccactg

SEQ ID NO: 4492953 - DNA, 20 bp, Homo sapiens
agccatggcaggacagctcc

SEQ ID NO: 4492954 - DNA, 21 bp, Homo sapiens
agccatggcaggacagctcct

SEQ ID NO: 4492955 - DNA, 20 bp, Homo sapiens
agccatgtactcaagtacca

SEQ ID NO: 4492956 - DNA, 20 bp, Homo sapiens
agccatgttccccagttcag

SEQ ID NO: 4492957 - DNA, 17 bp, Homo sapiens
agccattaaatgaatat

SEQ ID NO: 4492958 - DNA, 14 bp, Homo sapiens
agccattttccagt

SEQ ID NO: 4492959 - DNA, 16 bp, Homo sapiens
agccatttttcaaagc

SEQ ID NO: 4492960 - DNA, 20 bp, Homo sapiens
agccatttttcaaagcaatt

SEQ ID NO: 4492961 - DNA, 20 bp, Homo sapiens
agcccaaagtggtatagaaa

SEQ ID NO: 4492962 - DNA, 18 bp, Homo sapiens
agcccaagaggtctgagc

SEQ ID NO: 4492963 - DNA, 20 bp, Homo sapiens
agcccaagaggtctgagccc

SEQ ID NO: 4492964 - DNA, 22 bp, Homo sapiens
agcccaagaggtctgagccctg

SEQ ID NO: 4492965 - DNA, 24 bp, Homo sapiens
agcccaaggtgctgatgtcaaagt

SEQ ID NO: 4492966 - DNA, 16 bp, Homo sapiens
agcccaatgaaatgaa

SEQ ID NO: 4492967 - DNA, 12 bp, Homo sapiens
agcccacagagc

SEQ ID NO: 4492968 - DNA, 14 bp, Homo sapiens
agcccacagagcct

SEQ ID NO: 4492969 - DNA, 18 bp, Homo sapiens
agcccacccccctcccca

SEQ ID NO: 4492970 - DNA, 14 bp, Homo sapiens
agcccaccctcctg

SEQ ID NO: 4492971 - DNA, 15 bp, Homo sapiens
agcccaccctcctgt

SEQ ID NO: 4492972 - DNA, 12 bp, Homo sapiens
agcccagaagaa

SEQ ID NO: 4492973 - DNA, 14 bp, Homo sapiens
agcccagaggaggg

SEQ ID NO: 4492974 - DNA, 15 bp, Homo sapiens
agcccagaggagggc

SEQ ID NO: 4492975 - DNA, 14 bp, Homo sapiens
agcccagccaggcc

SEQ ID NO: 4492976 - DNA, 16 bp, Homo sapiens
agcccagcccaagcac

SEQ ID NO: 4492977 - DNA, 13 bp, Homo sapiens
agcccagcccagg

SEQ ID NO: 4492978 - DNA, 21 bp, Homo sapiens
agcccagcttggccctttcct

SEQ ID NO: 4492979 - DNA, 15 bp, Homo sapiens
agcccaggagcctca

SEQ ID NO: 4492980 - DNA, 22 bp, Homo sapiens
agcccaggagttcaagaccagc

SEQ ID NO: 4492981 - DNA, 15 bp, Homo sapiens
agcccaggggagcag

SEQ ID NO: 4492982 - DNA, 17 bp, Homo sapiens
agcccagtgaagcctct

SEQ ID NO: 4492983 - DNA, 21 bp, Homo sapiens
agcccagttcccgtgacgagg

SEQ ID NO: 4492984 - DNA, 14 bp, Homo sapiens
agcccataaccagt

SEQ ID NO: 4492985 - DNA, 24 bp, Homo sapiens
agcccataggccaccccctatcct

SEQ ID NO: 4492986 - DNA, 23 bp, Homo sapiens
agcccatcctgaccagctgctcc

SEQ ID NO: 4492987 - DNA, 13 bp, Homo sapiens
agcccatggcccc

SEQ ID NO: 4492988 - DNA, 16 bp, Homo sapiens
agcccatggcccccaa

SEQ ID NO: 4492989 - DNA, 19 bp, Homo sapiens
agcccatgtggctaaaaaa

SEQ ID NO: 4492990 - DNA, 15 bp, Homo sapiens
agcccattctcatgt

SEQ ID NO: 4492991 - DNA, 16 bp, Homo sapiens
agcccattctctctcc

SEQ ID NO: 4492992 - DNA, 20 bp, Homo sapiens
agcccattctctctcctgtc

SEQ ID NO: 4492993 - DNA, 16 bp, Homo sapiens
agcccattcttctggg

SEQ ID NO: 4492994 - DNA, 20 bp, Homo sapiens
agcccattggccgagctcct

SEQ ID NO: 4492995 - DNA, 20 bp, Homo sapiens
agccccacttcacccccaac

SEQ ID NO: 4492996 - DNA, 16 bp, Homo sapiens
agccccagccccttcc

SEQ ID NO: 4492997 - DNA, 16 bp, Homo sapiens
agccccagcgggctgg

SEQ ID NO: 4492998 - DNA, 18 bp, Homo sapiens
agccccagcgggctggcg

SEQ ID NO: 4492999 - DNA, 17 bp, Homo sapiens
agccccaggccagctgc

SEQ ID NO: 4493000 - DNA, 18 bp, Homo sapiens
agccccaggccagctgcg

SEQ ID NO: 4493001 - DNA, 19 bp, Homo sapiens
agccccatcagaacctgag

SEQ ID NO: 4493002 - DNA, 20 bp, Homo sapiens
agccccatcagaacctgagc

SEQ ID NO: 4493003 - DNA, 19 bp, Homo sapiens
agcccccacagtgctgtct

SEQ ID NO: 4493004 - DNA, 22 bp, Homo sapiens
agcccccaccggaactgggctg

SEQ ID NO: 4493005 - DNA, 16 bp, Homo sapiens
agcccccactgcctgg

SEQ ID NO: 4493006 - DNA, 14 bp, Homo sapiens
agccccccagcact

SEQ ID NO: 4493007 - DNA, 14 bp, Homo sapiens
agccccccagctcc

SEQ ID NO: 4493008 - DNA, 15 bp, Homo sapiens
agccccccagctccc

SEQ ID NO: 4493009 - DNA, 20 bp, Homo sapiens
agccccccagctcccacacc

SEQ ID NO: 4493010 - DNA, 15 bp, Homo sapiens
agccccctcccaccg

SEQ ID NO: 4493011 - DNA, 16 bp, Homo sapiens
agccccctcccaccgc

SEQ ID NO: 4493012 - DNA, 19 bp, Homo sapiens
agccccctcccaccgctgc

SEQ ID NO: 4493013 - DNA, 22 bp, Homo sapiens
agccccctcccaccgctgcctc

SEQ ID NO: 4493014 - DNA, 20 bp, Homo sapiens
agccccctttgggcccaggg

SEQ ID NO: 4493015 - DNA, 17 bp, Homo sapiens
agccccgactccagcca

SEQ ID NO: 4493016 - DNA, 19 bp, Homo sapiens
agccccgactccagccagc

SEQ ID NO: 4493017 - DNA, 23 bp, Homo sapiens
agccccgactccagccagcgcct

SEQ ID NO: 4493018 - DNA, 14 bp, Homo sapiens
agccccgcctgtca

SEQ ID NO: 4493019 - DNA, 15 bp, Homo sapiens
agccccgcctgtcac

SEQ ID NO: 4493020 - DNA, 20 bp, Homo sapiens
agccccgcctgtcacaataa

SEQ ID NO: 4493021 - DNA, 14 bp, Homo sapiens
agccccggccctgg

SEQ ID NO: 4493022 - DNA, 16 bp, Homo sapiens
agccccggccctgggc

SEQ ID NO: 4493023 - DNA, 17 bp, Homo sapiens
agccccggggccccctg

SEQ ID NO: 4493024 - DNA, 22 bp, Homo sapiens
agccccggggccccctggtcac

SEQ ID NO: 4493025 - DNA, 21 bp, Homo sapiens
agcccctatagcactgagctc

SEQ ID NO: 4493026 - DNA, 17 bp, Homo sapiens
agcccctccccagactc

SEQ ID NO: 4493027 - DNA, 18 bp, Homo sapiens
agcccctccccagactct

SEQ ID NO: 4493028 - DNA, 22 bp, Homo sapiens
agcccctccccagactctcagg

SEQ ID NO: 4493029 - DNA, 14 bp, Homo sapiens
agcccctccccagc

SEQ ID NO: 4493030 - DNA, 15 bp, Homo sapiens
agcccctccccagcc

SEQ ID NO: 4493031 - DNA, 13 bp, Homo sapiens
agcccctcctccc

SEQ ID NO: 4493032 - DNA, 18 bp, Homo sapiens
agcccctcctccctcaga

SEQ ID NO: 4493033 - DNA, 19 bp, Homo sapiens
agcccctcctccctcagac

SEQ ID NO: 4493034 - DNA, 19 bp, Homo sapiens
agcccctcctccctcaggc

SEQ ID NO: 4493035 - DNA, 14 bp, Homo sapiens
agcccctcctctgc

SEQ ID NO: 4493036 - DNA, 21 bp, Homo sapiens
agcccctcctctgccacctcc

SEQ ID NO: 4493037 - DNA, 23 bp, Homo sapiens
agcccctcctctgccacctcccc

SEQ ID NO: 4493038 - DNA, 17 bp, Homo sapiens
agcccctgagagcctgt

SEQ ID NO: 4493039 - DNA, 12 bp, Homo sapiens
agcccctgcaga

SEQ ID NO: 4493040 - DNA, 13 bp, Homo sapiens
agcccctggagcc

SEQ ID NO: 4493041 - DNA, 16 bp, Homo sapiens
agcccctggggcccag

SEQ ID NO: 4493042 - DNA, 16 bp, Homo sapiens
agcccgatattctccc

SEQ ID NO: 4493043 - DNA, 17 bp, Homo sapiens
agcccgatattctccct

SEQ ID NO: 4493044 - DNA, 19 bp, Homo sapiens
agcccgatattctccctga

SEQ ID NO: 4493045 - DNA, 23 bp, Homo sapiens
agcccgatattctccctgacctt

SEQ ID NO: 4493046 - DNA, 15 bp, Homo sapiens
agcccgcacacctgc

SEQ ID NO: 4493047 - DNA, 12 bp, Homo sapiens
agcccgcctgcc

SEQ ID NO: 4493048 - DNA, 14 bp, Homo sapiens
agcccgcctgccag

SEQ ID NO: 4493049 - DNA, 16 bp, Homo sapiens
agcccgcctgccagtc

SEQ ID NO: 4493050 - DNA, 22 bp, Homo sapiens
agcccgcctgccagtcctagct

SEQ ID NO: 4493051 - DNA, 23 bp, Homo sapiens
agcccgcctgccagtcctagctg

SEQ ID NO: 4493052 - DNA, 23 bp, Homo sapiens
agcccgcttgctcgcttgctgga

SEQ ID NO: 4493053 - DNA, 15 bp, Homo sapiens
agccctaaacatcat

SEQ ID NO: 4493054 - DNA, 18 bp, Homo sapiens
agccctaagtggctgcct

SEQ ID NO: 4493055 - DNA, 14 bp, Homo sapiens
agccctagagcctg

SEQ ID NO: 4493056 - DNA, 15 bp, Homo sapiens
agccctagagcctgc

SEQ ID NO: 4493057 - DNA, 17 bp, Homo sapiens
agccctagagcctgcct

SEQ ID NO: 4493058 - DNA, 20 bp, Homo sapiens
agccctagagcctgcctgga

SEQ ID NO: 4493059 - DNA, 14 bp, Homo sapiens
agccctagcggctg

SEQ ID NO: 4493060 - DNA, 16 bp, Homo sapiens
agccctagcggctgct

SEQ ID NO: 4493061 - DNA, 16 bp, Homo sapiens
agccctagggtggaga

SEQ ID NO: 4493062 - DNA, 20 bp, Homo sapiens
agccctcaaagaagtcggaa

SEQ ID NO: 4493063 - DNA, 21 bp, Homo sapiens
agccctcaaagaagtcggaat

SEQ ID NO: 4493064 - DNA, 22 bp, Homo sapiens
agccctcacccctggttctcat

SEQ ID NO: 4493065 - DNA, 20 bp, Homo sapiens
agccctcccccttccccttc

SEQ ID NO: 4493066 - DNA, 17 bp, Homo sapiens
agccctccctgtcctcc

SEQ ID NO: 4493067 - DNA, 22 bp, Homo sapiens
agccctccctgtcctcctcgga

SEQ ID NO: 4493068 - DNA, 13 bp, Homo sapiens
agccctcctcacc

SEQ ID NO: 4493069 - DNA, 15 bp, Homo sapiens
agccctcctgagggc

SEQ ID NO: 4493070 - DNA, 16 bp, Homo sapiens
agccctcctgagggcc

SEQ ID NO: 4493071 - DNA, 13 bp, Homo sapiens
agccctcggcctc

SEQ ID NO: 4493072 - DNA, 17 bp, Homo sapiens
agccctcggcctccgag

SEQ ID NO: 4493073 - DNA, 16 bp, Homo sapiens
agccctctctctcact

SEQ ID NO: 4493074 - DNA, 19 bp, Homo sapiens
agccctgacgcaatgaaaa

SEQ ID NO: 4493075 - DNA, 15 bp, Homo sapiens
agccctgactcctgg

SEQ ID NO: 4493076 - DNA, 17 bp, Homo sapiens
agccctgactcctggac

SEQ ID NO: 4493077 - DNA, 19 bp, Homo sapiens
agccctgactcctggactc

SEQ ID NO: 4493078 - DNA, 17 bp, Homo sapiens
agccctgattgtgccag

SEQ ID NO: 4493079 - DNA, 14 bp, Homo sapiens
agccctgcacgacc

SEQ ID NO: 4493080 - DNA, 13 bp, Homo sapiens
agccctgcccaca

SEQ ID NO: 4493081 - DNA, 13 bp, Homo sapiens
agccctgccccac

SEQ ID NO: 4493082 - DNA, 15 bp, Homo sapiens
agccctgccctccca

SEQ ID NO: 4493083 - DNA, 15 bp, Homo sapiens
agccctgctccctgc

SEQ ID NO: 4493084 - DNA, 17 bp, Homo sapiens
agccctgctccctgcct

SEQ ID NO: 4493085 - DNA, 21 bp, Homo sapiens
agccctgctccctgcctcctg

SEQ ID NO: 4493086 - DNA, 18 bp, Homo sapiens
agccctgctcttctctcc

SEQ ID NO: 4493087 - DNA, 19 bp, Homo sapiens
agccctgctcttctctccc

SEQ ID NO: 4493088 - DNA, 13 bp, Homo sapiens
agccctgctggcc

SEQ ID NO: 4493089 - DNA, 16 bp, Homo sapiens
agccctgctggccgcc

SEQ ID NO: 4493090 - DNA, 17 bp, Homo sapiens
agccctgctgtgggaga

SEQ ID NO: 4493091 - DNA, 16 bp, Homo sapiens
agccctggaaacatac

SEQ ID NO: 4493092 - DNA, 18 bp, Homo sapiens
agccctggcaaatgcctg

SEQ ID NO: 4493093 - DNA, 11 bp, Homo sapiens
agccctggcag

SEQ ID NO: 4493094 - DNA, 13 bp, Homo sapiens
agccctggcccag

SEQ ID NO: 4493095 - DNA, 15 bp, Homo sapiens
agccctggcccaggt

SEQ ID NO: 4493096 - DNA, 18 bp, Homo sapiens
agccctggcccaggtgcc

SEQ ID NO: 4493097 - DNA, 12 bp, Homo sapiens
agccctggcccc

SEQ ID NO: 4493098 - DNA, 19 bp, Homo sapiens
agccctggcccccatcagc

SEQ ID NO: 4493099 - DNA, 23 bp, Homo sapiens
agccctggcccccatcagccctg

SEQ ID NO: 4493100 - DNA, 14 bp, Homo sapiens
agccctggctccca

SEQ ID NO: 4493101 - DNA, 18 bp, Homo sapiens
agccctggctcccacctg

SEQ ID NO: 4493102 - DNA, 16 bp, Homo sapiens
agccctgggccccacc

SEQ ID NO: 4493103 - DNA, 21 bp, Homo sapiens
agccctgggtgacttcaggtg

SEQ ID NO: 4493104 - DNA, 23 bp, Homo sapiens
agccctgggtgacttcaggtgga

SEQ ID NO: 4493105 - DNA, 16 bp, Homo sapiens
agccctggtgtgtttc

SEQ ID NO: 4493106 - DNA, 22 bp, Homo sapiens
agcccttatgcggttaattttg

SEQ ID NO: 4493107 - DNA, 14 bp, Homo sapiens
agcccttcccaggg

SEQ ID NO: 4493108 - DNA, 16 bp, Homo sapiens
agcccttcccagggca

SEQ ID NO: 4493109 - DNA, 12 bp, Homo sapiens
agcccttccctg

SEQ ID NO: 4493110 - DNA, 23 bp, Homo sapiens
agcccttccctgagtgcgggctg

SEQ ID NO: 4493111 - DNA, 17 bp, Homo sapiens
agcccttccctggcccc

SEQ ID NO: 4493112 - DNA, 22 bp, Homo sapiens
agcccttctatacccacccaga

SEQ ID NO: 4493113 - DNA, 23 bp, Homo sapiens
agcccttctatacccacccagaa

SEQ ID NO: 4493114 - DNA, 23 bp, Homo sapiens
agcccttgcactcctactgagtt

SEQ ID NO: 4493115 - DNA, 16 bp, Homo sapiens
agcccttgcctcccca

SEQ ID NO: 4493116 - DNA, 14 bp, Homo sapiens
agccgagaaattgg

SEQ ID NO: 4493117 - DNA, 14 bp, Homo sapiens
agccgagagcctgc

SEQ ID NO: 4493118 - DNA, 16 bp, Homo sapiens
agccgagagcctgctc

SEQ ID NO: 4493119 - DNA, 17 bp, Homo sapiens
agccgagagcctgctcc

SEQ ID NO: 4493120 - DNA, 18 bp, Homo sapiens
agccgagagcctgctccc

SEQ ID NO: 4493121 - DNA, 13 bp, Homo sapiens
agccgccagctgg

SEQ ID NO: 4493122 - DNA, 15 bp, Homo sapiens
agccgccagctggga

SEQ ID NO: 4493123 - DNA, 23 bp, Homo sapiens
agccgccagctgggagcactggt

SEQ ID NO: 4493124 - DNA, 18 bp, Homo sapiens
agccgccattgccaccag

SEQ ID NO: 4493125 - DNA, 12 bp, Homo sapiens
agccgcccaagg

SEQ ID NO: 4493126 - DNA, 13 bp, Homo sapiens
agccgcccaaggc

SEQ ID NO: 4493127 - DNA, 15 bp, Homo sapiens
agccgcccaaggcct

SEQ ID NO: 4493128 - DNA, 22 bp, Homo sapiens
agccgccctgggctgtctgtca

SEQ ID NO: 4493129 - DNA, 24 bp, Homo sapiens
agccgccctgggctgtctgtcacc

SEQ ID NO: 4493130 - DNA, 17 bp, Homo sapiens
agccgcgggccaggagg

SEQ ID NO: 4493131 - DNA, 21 bp, Homo sapiens
agccgcggggaagctggcttt

SEQ ID NO: 4493132 - DNA, 14 bp, Homo sapiens
agccgggagcctga

SEQ ID NO: 4493133 - DNA, 12 bp, Homo sapiens
agccgggcacag

SEQ ID NO: 4493134 - DNA, 15 bp, Homo sapiens
agccgggcatggtgg

SEQ ID NO: 4493135 - DNA, 18 bp, Homo sapiens
agccgggcccctgggctt

SEQ ID NO: 4493136 - DNA, 23 bp, Homo sapiens
agccgggtccggcctctccctgc

SEQ ID NO: 4493137 - DNA, 20 bp, Homo sapiens
agccgggtctgcctcttctg

SEQ ID NO: 4493138 - DNA, 14 bp, Homo sapiens
agccggtggtgccc

SEQ ID NO: 4493139 - DNA, 22 bp, Homo sapiens
agccggttctgctagagcagac

SEQ ID NO: 4493140 - DNA, 18 bp, Homo sapiens
agccgtccaacttaaaaa

SEQ ID NO: 4493141 - DNA, 18 bp, Homo sapiens
agcctaaagtacagcctg

SEQ ID NO: 4493142 - DNA, 20 bp, Homo sapiens
agcctaaagtacagcctgga

SEQ ID NO: 4493143 - DNA, 16 bp, Homo sapiens
agcctacaaagagatg

SEQ ID NO: 4493144 - DNA, 18 bp, Homo sapiens
agcctacagaagggcagt

SEQ ID NO: 4493145 - DNA, 14 bp, Homo sapiens
agcctacctctcca

SEQ ID NO: 4493146 - DNA, 18 bp, Homo sapiens
agcctagatatgaatata

SEQ ID NO: 4493147 - DNA, 20 bp, Homo sapiens
agcctagcggagcccagcct

SEQ ID NO: 4493148 - DNA, 21 bp, Homo sapiens
agcctagcggagcccagcctg

SEQ ID NO: 4493149 - DNA, 22 bp, Homo sapiens
agcctcactattacttgaactt

SEQ ID NO: 4493150 - DNA, 17 bp, Homo sapiens
agcctcagaaggcccca

SEQ ID NO: 4493151 - DNA, 20 bp, Homo sapiens
agcctcagaaggccccagag

SEQ ID NO: 4493152 - DNA, 22 bp, Homo sapiens
agcctcagaaggccccagagag

SEQ ID NO: 4493153 - DNA, 15 bp, Homo sapiens
agcctcagagatctc

SEQ ID NO: 4493154 - DNA, 22 bp, Homo sapiens
agcctcagatgatttcccccct

SEQ ID NO: 4493155 - DNA, 16 bp, Homo sapiens
agcctcatactcctgg

SEQ ID NO: 4493156 - DNA, 18 bp, Homo sapiens
agcctcatccagcctcag

SEQ ID NO: 4493157 - DNA, 23 bp, Homo sapiens
agcctccaagcacagagcctggc

SEQ ID NO: 4493158 - DNA, 13 bp, Homo sapiens
agcctccaagcct

SEQ ID NO: 4493159 - DNA, 12 bp, Homo sapiens
agcctccagcct

SEQ ID NO: 4493160 - DNA, 14 bp, Homo sapiens
agcctccagcctct

SEQ ID NO: 4493161 - DNA, 20 bp, Homo sapiens
agcctccaggcccccaactc

SEQ ID NO: 4493162 - DNA, 20 bp, Homo sapiens
agcctcccaaggagaacaaa

SEQ ID NO: 4493163 - DNA, 14 bp, Homo sapiens
agcctccccctcag

SEQ ID NO: 4493164 - DNA, 15 bp, Homo sapiens
agcctccccctcaga

SEQ ID NO: 4493165 - DNA, 21 bp, Homo sapiens
agcctcccctcccctggggac

SEQ ID NO: 4493166 - DNA, 14 bp, Homo sapiens
agcctcccctgcca

SEQ ID NO: 4493167 - DNA, 19 bp, Homo sapiens
agcctcccctgccagggca

SEQ ID NO: 4493168 - DNA, 20 bp, Homo sapiens
agcctcccctgccagggcag

SEQ ID NO: 4493169 - DNA, 17 bp, Homo sapiens
agcctccctgaagacca

SEQ ID NO: 4493170 - DNA, 17 bp, Homo sapiens
agcctccgagagggaga

SEQ ID NO: 4493171 - DNA, 22 bp, Homo sapiens
agcctccgggcgtgtgaagaac

SEQ ID NO: 4493172 - DNA, 17 bp, Homo sapiens
agcctcctcctgggctc

SEQ ID NO: 4493173 - DNA, 18 bp, Homo sapiens
agcctcctcctgggctcc

SEQ ID NO: 4493174 - DNA, 13 bp, Homo sapiens
agcctcctctgga

SEQ ID NO: 4493175 - DNA, 18 bp, Homo sapiens
agcctcctctggacggca

SEQ ID NO: 4493176 - DNA, 19 bp, Homo sapiens
agcctcctctggacggcag

SEQ ID NO: 4493177 - DNA, 21 bp, Homo sapiens
agcctcctctgtctgcccttc

SEQ ID NO: 4493178 - DNA, 18 bp, Homo sapiens
agcctcctgccccctgcc

SEQ ID NO: 4493179 - DNA, 19 bp, Homo sapiens
agcctcctgtacctcagtg

SEQ ID NO: 4493180 - DNA, 20 bp, Homo sapiens
agcctcctgtacctcagtgg

SEQ ID NO: 4493181 - DNA, 22 bp, Homo sapiens
agcctcctgtgcctggccccag

SEQ ID NO: 4493182 - DNA, 16 bp, Homo sapiens
agcctcgcggtcttgg

SEQ ID NO: 4493183 - DNA, 22 bp, Homo sapiens
agcctcgcggtcttgggcactg

SEQ ID NO: 4493184 - DNA, 19 bp, Homo sapiens
agcctctagtgtaccaagt

SEQ ID NO: 4493185 - DNA, 21 bp, Homo sapiens
agcctctagtgtaccaagtgc

SEQ ID NO: 4493186 - DNA, 13 bp, Homo sapiens
agcctctcccacc

SEQ ID NO: 4493187 - DNA, 22 bp, Homo sapiens
agcctctcccacccggccacag

SEQ ID NO: 4493188 - DNA, 17 bp, Homo sapiens
agcctctccgactctgc

SEQ ID NO: 4493189 - DNA, 19 bp, Homo sapiens
agcctctccgactctgcac

SEQ ID NO: 4493190 - DNA, 15 bp, Homo sapiens
agcctctcctttgta

SEQ ID NO: 4493191 - DNA, 18 bp, Homo sapiens
agcctctctccttggcca

SEQ ID NO: 4493192 - DNA, 21 bp, Homo sapiens
agcctctctccttggccacag

SEQ ID NO: 4493193 - DNA, 23 bp, Homo sapiens
agcctctctccttggccacagac

SEQ ID NO: 4493194 - DNA, 22 bp, Homo sapiens
agcctctgatcaaattggctac

SEQ ID NO: 4493195 - DNA, 21 bp, Homo sapiens
agcctctgccgctgccatgct

SEQ ID NO: 4493196 - DNA, 16 bp, Homo sapiens
agcctctgctggagaa

SEQ ID NO: 4493197 - DNA, 17 bp, Homo sapiens
agcctctggacagccag

SEQ ID NO: 4493198 - DNA, 19 bp, Homo sapiens
agcctctggacagccagtg

SEQ ID NO: 4493199 - DNA, 12 bp, Homo sapiens
agcctctggccc

SEQ ID NO: 4493200 - DNA, 23 bp, Homo sapiens
agcctgactcagctaatgtcaca

SEQ ID NO: 4493201 - DNA, 18 bp, Homo sapiens
agcctgactcttcccttc

SEQ ID NO: 4493202 - DNA, 21 bp, Homo sapiens
agcctgagcaactcttgatta

SEQ ID NO: 4493203 - DNA, 23 bp, Homo sapiens
agcctgatctttgggcatcagaa

SEQ ID NO: 4493204 - DNA, 19 bp, Homo sapiens
agcctgatgagatttttaa

SEQ ID NO: 4493205 - DNA, 13 bp, Homo sapiens
agcctgcacctgc

SEQ ID NO: 4493206 - DNA, 16 bp, Homo sapiens
agcctgcacctgcccc

SEQ ID NO: 4493207 - DNA, 17 bp, Homo sapiens
agcctgcacctgccccg

SEQ ID NO: 4493208 - DNA, 14 bp, Homo sapiens
agcctgcactttga

SEQ ID NO: 4493209 - DNA, 15 bp, Homo sapiens
agcctgcattgagct

SEQ ID NO: 4493210 - DNA, 15 bp, Homo sapiens
agcctgcctcccaag

SEQ ID NO: 4493211 - DNA, 10 bp, Homo sapiens
agcctgctca

SEQ ID NO: 4493212 - DNA, 17 bp, Homo sapiens
agcctgctcccccaccc

SEQ ID NO: 4493213 - DNA, 19 bp, Homo sapiens
agcctgctcccccaccccc

SEQ ID NO: 4493214 - DNA, 21 bp, Homo sapiens
agcctgctcccccaccccctc

SEQ ID NO: 4493215 - DNA, 11 bp, Homo sapiens
agcctgctgca

SEQ ID NO: 4493216 - DNA, 23 bp, Homo sapiens
agcctgctggtcacagcctcctc

SEQ ID NO: 4493217 - DNA, 23 bp, Homo sapiens
agcctgcttgggcgctcggtctc

SEQ ID NO: 4493218 - DNA, 15 bp, Homo sapiens
agcctggatgccatc

SEQ ID NO: 4493219 - DNA, 19 bp, Homo sapiens
agcctggccaacatggtga

SEQ ID NO: 4493220 - DNA, 18 bp, Homo sapiens
agcctggccccaggcccc

SEQ ID NO: 4493221 - DNA, 16 bp, Homo sapiens
agcctggccccatggt

SEQ ID NO: 4493222 - DNA, 17 bp, Homo sapiens
agcctggctctgccccg

SEQ ID NO: 4493223 - DNA, 16 bp, Homo sapiens
agcctgggagcccaga

SEQ ID NO: 4493224 - DNA, 19 bp, Homo sapiens
agcctgggctcactgtgct

SEQ ID NO: 4493225 - DNA, 22 bp, Homo sapiens
agcctgggctcactgtgctggg

SEQ ID NO: 4493226 - DNA, 12 bp, Homo sapiens
agcctgggtcac

SEQ ID NO: 4493227 - DNA, 18 bp, Homo sapiens
agcctgggtcacagagtg

SEQ ID NO: 4493228 - DNA, 21 bp, Homo sapiens
agcctgggtcacagagtgaga

SEQ ID NO: 4493229 - DNA, 15 bp, Homo sapiens
agcctggtccttccc

SEQ ID NO: 4493230 - DNA, 16 bp, Homo sapiens
agcctgtaatcccagc

SEQ ID NO: 4493231 - DNA, 17 bp, Homo sapiens
agcctgtaatcccagct

SEQ ID NO: 4493232 - DNA, 20 bp, Homo sapiens
agcctgtgcaaaaaaattaa

SEQ ID NO: 4493233 - DNA, 15 bp, Homo sapiens
agcctgtggatgatc

SEQ ID NO: 4493234 - DNA, 16 bp, Homo sapiens
agcctgtggatgatca

SEQ ID NO: 4493235 - DNA, 15 bp, Homo sapiens
agcctgtggccagca

SEQ ID NO: 4493236 - DNA, 17 bp, Homo sapiens
agcctgtggcggtgcct

SEQ ID NO: 4493237 - DNA, 20 bp, Homo sapiens
agcctgtggcggtgcctggg

SEQ ID NO: 4493238 - DNA, 18 bp, Homo sapiens
agcctgtgggagtagaaa

SEQ ID NO: 4493239 - DNA, 20 bp, Homo sapiens
agcctgtgggagtagaaaaa

SEQ ID NO: 4493240 - DNA, 16 bp, Homo sapiens
agccttagaggtcttt

SEQ ID NO: 4493241 - DNA, 12 bp, Homo sapiens
agccttagatgc

SEQ ID NO: 4493242 - DNA, 22 bp, Homo sapiens
agccttagcagccctggatggt

SEQ ID NO: 4493243 - DNA, 20 bp, Homo sapiens
agccttagggaagctggcct

SEQ ID NO: 4493244 - DNA, 14 bp, Homo sapiens
agccttatgtgtta

SEQ ID NO: 4493245 - DNA, 21 bp, Homo sapiens
agccttatgtgttacattatt

SEQ ID NO: 4493246 - DNA, 20 bp, Homo sapiens
agccttatttacctagtgca

SEQ ID NO: 4493247 - DNA, 21 bp, Homo sapiens
agccttatttacctagtgcaa

SEQ ID NO: 4493248 - DNA, 18 bp, Homo sapiens
agccttattttgagtaaa

SEQ ID NO: 4493249 - DNA, 15 bp, Homo sapiens
agccttcagaatgct

SEQ ID NO: 4493250 - DNA, 21 bp, Homo sapiens
agccttcagaatgctcctgag

SEQ ID NO: 4493251 - DNA, 18 bp, Homo sapiens
agccttccaactagctgg

SEQ ID NO: 4493252 - DNA, 21 bp, Homo sapiens
agccttccaactagctgggac

SEQ ID NO: 4493253 - DNA, 15 bp, Homo sapiens
agccttccagttttg

SEQ ID NO: 4493254 - DNA, 14 bp, Homo sapiens
agccttcccctccc

SEQ ID NO: 4493255 - DNA, 13 bp, Homo sapiens
agccttctctcaa

SEQ ID NO: 4493256 - DNA, 19 bp, Homo sapiens
agccttctgccaccagccc

SEQ ID NO: 4493257 - DNA, 16 bp, Homo sapiens
agccttgagccctggc

SEQ ID NO: 4493258 - DNA, 17 bp, Homo sapiens
agccttgagccctggct

SEQ ID NO: 4493259 - DNA, 19 bp, Homo sapiens
agccttgagccctggctgt

SEQ ID NO: 4493260 - DNA, 14 bp, Homo sapiens
agccttgcagcggc

SEQ ID NO: 4493261 - DNA, 19 bp, Homo sapiens
agccttgcagcggctcctg

SEQ ID NO: 4493262 - DNA, 11 bp, Homo sapiens
agccttgctct

SEQ ID NO: 4493263 - DNA, 18 bp, Homo sapiens
agccttgctctcttcaat

SEQ ID NO: 4493264 - DNA, 23 bp, Homo sapiens
agccttgctctcttcaataaacc

SEQ ID NO: 4493265 - DNA, 15 bp, Homo sapiens
agccttggaaccagc

SEQ ID NO: 4493266 - DNA, 20 bp, Homo sapiens
agccttggaaccagccccat

SEQ ID NO: 4493267 - DNA, 19 bp, Homo sapiens
agccttggtgtccacctgg

SEQ ID NO: 4493268 - DNA, 22 bp, Homo sapiens
agcctttaaatcatttttatat

SEQ ID NO: 4493269 - DNA, 18 bp, Homo sapiens
agcctttacctgtgaagt

SEQ ID NO: 4493270 - DNA, 14 bp, Homo sapiens
agcctttatacaat

SEQ ID NO: 4493271 - DNA, 16 bp, Homo sapiens
agccttttgctctctg

SEQ ID NO: 4493272 - DNA, 18 bp, Homo sapiens
agccttttgctttatgct

SEQ ID NO: 4493273 - DNA, 12 bp, Homo sapiens
agcgaaactccg

SEQ ID NO: 4493274 - DNA, 20 bp, Homo sapiens
agcgacaccctttctgtttg

SEQ ID NO: 4493275 - DNA, 17 bp, Homo sapiens
agcgacacttgaatgta

SEQ ID NO: 4493276 - DNA, 14 bp, Homo sapiens
agcgagcacagtat

SEQ ID NO: 4493277 - DNA, 19 bp, Homo sapiens
agcgatctctcctggccta

SEQ ID NO: 4493278 - DNA, 18 bp, Homo sapiens
agcgccaggaagccagag

SEQ ID NO: 4493279 - DNA, 17 bp, Homo sapiens
agcgcccccgagccctg

SEQ ID NO: 4493280 - DNA, 21 bp, Homo sapiens
agcgcctagtggggtctccct

SEQ ID NO: 4493281 - DNA, 13 bp, Homo sapiens
agcgcctccctcc

SEQ ID NO: 4493282 - DNA, 18 bp, Homo sapiens
agcgcctccctccacccc

SEQ ID NO: 4493283 - DNA, 22 bp, Homo sapiens
agcgcctccctccaccccagga

SEQ ID NO: 4493284 - DNA, 23 bp, Homo sapiens
agcgcctccctccaccccaggac

SEQ ID NO: 4493285 - DNA, 22 bp, Homo sapiens
agcgcgttgtgtatattacacc

SEQ ID NO: 4493286 - DNA, 20 bp, Homo sapiens
agcgctcctgccgcagagct

SEQ ID NO: 4493287 - DNA, 22 bp, Homo sapiens
agcgctcctgccgcagagctgg

SEQ ID NO: 4493288 - DNA, 19 bp, Homo sapiens
agcgctgccgcaccccaga

SEQ ID NO: 4493289 - DNA, 21 bp, Homo sapiens
agcggagcccgatattctccc

SEQ ID NO: 4493290 - DNA, 17 bp, Homo sapiens
agcggccctaagggagt

SEQ ID NO: 4493291 - DNA, 11 bp, Homo sapiens
agcggccctgg

SEQ ID NO: 4493292 - DNA, 12 bp, Homo sapiens
agcggccctgga

SEQ ID NO: 4493293 - DNA, 16 bp, Homo sapiens
agcggccctggaggat

SEQ ID NO: 4493294 - DNA, 13 bp, Homo sapiens
agcggctcccctc

SEQ ID NO: 4493295 - DNA, 15 bp, Homo sapiens
agcggctcccctctg

SEQ ID NO: 4493296 - DNA, 19 bp, Homo sapiens
agcggctgagtcatgatct

SEQ ID NO: 4493297 - DNA, 16 bp, Homo sapiens
agcggctgctccttca

SEQ ID NO: 4493298 - DNA, 12 bp, Homo sapiens
agcgggcagccc

SEQ ID NO: 4493299 - DNA, 22 bp, Homo sapiens
agcggtgcagcgtgtgtgccac

SEQ ID NO: 4493300 - DNA, 14 bp, Homo sapiens
agcgtcaagacatt

SEQ ID NO: 4493301 - DNA, 15 bp, Homo sapiens
agcgtcaagacattt

SEQ ID NO: 4493302 - DNA, 19 bp, Homo sapiens
agcgtcagaagtctagttt

SEQ ID NO: 4493303 - DNA, 15 bp, Homo sapiens
agcgtcctcctctgt

SEQ ID NO: 4493304 - DNA, 17 bp, Homo sapiens
agcgtcctcctctgtga

SEQ ID NO: 4493305 - DNA, 15 bp, Homo sapiens
agcgtccttggctgc

SEQ ID NO: 4493306 - DNA, 18 bp, Homo sapiens
agcgtccttggctgccgt

SEQ ID NO: 4493307 - DNA, 14 bp, Homo sapiens
agcgtgcgcactgc

SEQ ID NO: 4493308 - DNA, 15 bp, Homo sapiens
agcgtgcgcactgca

SEQ ID NO: 4493309 - DNA, 18 bp, Homo sapiens
agcgtgcgcactgcatgg

SEQ ID NO: 4493310 - DNA, 20 bp, Homo sapiens
agcgtgcgcactgcatggga

SEQ ID NO: 4493311 - DNA, 17 bp, Homo sapiens
agcgtgctttaaaaaat

SEQ ID NO: 4493312 - DNA, 23 bp, Homo sapiens
agcgtgggtgttgaatccagcac

SEQ ID NO: 4493313 - DNA, 13 bp, Homo sapiens
agcgtgttctcag

SEQ ID NO: 4493314 - DNA, 14 bp, Homo sapiens
agcgttttttaaat

SEQ ID NO: 4493315 - DNA, 17 bp, Homo sapiens
agcgttttttaaatgta

SEQ ID NO: 4493316 - DNA, 19 bp, Homo sapiens
agcgttttttaaatgtata

SEQ ID NO: 4493317 - DNA, 16 bp, Homo sapiens
agctaaaatatataat

SEQ ID NO: 4493318 - DNA, 17 bp, Homo sapiens
agctaaacggattccaa

SEQ ID NO: 4493319 - DNA, 20 bp, Homo sapiens
agctaaatacctcaatcagt

SEQ ID NO: 4493320 - DNA, 12 bp, Homo sapiens
agctaaatgctt

SEQ ID NO: 4493321 - DNA, 13 bp, Homo sapiens
agctaaatgcttc

SEQ ID NO: 4493322 - DNA, 22 bp, Homo sapiens
agctaaccttatcctgcattgt

SEQ ID NO: 4493323 - DNA, 19 bp, Homo sapiens
agctaacgttagaatagtg

SEQ ID NO: 4493324 - DNA, 15 bp, Homo sapiens
agctaactgtaaatc

SEQ ID NO: 4493325 - DNA, 16 bp, Homo sapiens
agctaactgtaaatca

SEQ ID NO: 4493326 - DNA, 20 bp, Homo sapiens
agctaataaatctcttcttt

SEQ ID NO: 4493327 - DNA, 20 bp, Homo sapiens
agctaatctgcctggtttta

SEQ ID NO: 4493328 - DNA, 23 bp, Homo sapiens
agctaatctgcctggttttattt

SEQ ID NO: 4493329 - DNA, 21 bp, Homo sapiens
agctaatgtcacaacatggtg

SEQ ID NO: 4493330 - DNA, 24 bp, Homo sapiens
agctaatgtgcagggatattgcct

SEQ ID NO: 4493331 - DNA, 16 bp, Homo sapiens
agctacaaacttttaa

SEQ ID NO: 4493332 - DNA, 17 bp, Homo sapiens
agctacaatattctctc

SEQ ID NO: 4493333 - DNA, 18 bp, Homo sapiens
agctacaatattctctct

SEQ ID NO: 4493334 - DNA, 13 bp, Homo sapiens
agctacaatttgt

SEQ ID NO: 4493335 - DNA, 14 bp, Homo sapiens
agctacaggaagca

SEQ ID NO: 4493336 - DNA, 15 bp, Homo sapiens
agctaccctgtgtat

SEQ ID NO: 4493337 - DNA, 15 bp, Homo sapiens
agctacccttttcct

SEQ ID NO: 4493338 - DNA, 19 bp, Homo sapiens
agctacccttttcctttgt

SEQ ID NO: 4493339 - DNA, 21 bp, Homo sapiens
agctacccttttcctttgtgg

SEQ ID NO: 4493340 - DNA, 16 bp, Homo sapiens
agctacgtatttaata

SEQ ID NO: 4493341 - DNA, 14 bp, Homo sapiens
agctactaaaatca

SEQ ID NO: 4493342 - DNA, 17 bp, Homo sapiens
agctactattttggaaa

SEQ ID NO: 4493343 - DNA, 19 bp, Homo sapiens
agctactcgatagcctgag

SEQ ID NO: 4493344 - DNA, 20 bp, Homo sapiens
agctactcgatagcctgagg

SEQ ID NO: 4493345 - DNA, 18 bp, Homo sapiens
agctactggattcttatt

SEQ ID NO: 4493346 - DNA, 18 bp, Homo sapiens
agctactggggaggctga

SEQ ID NO: 4493347 - DNA, 20 bp, Homo sapiens
agctactggggaggctgagg

SEQ ID NO: 4493348 - DNA, 21 bp, Homo sapiens
agctactggggaggctgaggc

SEQ ID NO: 4493349 - DNA, 15 bp, Homo sapiens
agctagaacctggag

SEQ ID NO: 4493350 - DNA, 24 bp, Homo sapiens
agctagaagtgggccaggacaggc

SEQ ID NO: 4493351 - DNA, 20 bp, Homo sapiens
agctagaattgagtgtttaa

SEQ ID NO: 4493352 - DNA, 13 bp, Homo sapiens
agctagaatttct

SEQ ID NO: 4493353 - DNA, 14 bp, Homo sapiens
agctagaatttctg

SEQ ID NO: 4493354 - DNA, 16 bp, Homo sapiens
agctagcgctgccgca

SEQ ID NO: 4493355 - DNA, 19 bp, Homo sapiens
agctaggcttaaacctgga

SEQ ID NO: 4493356 - DNA, 15 bp, Homo sapiens
agctagtagcaatgt

SEQ ID NO: 4493357 - DNA, 19 bp, Homo sapiens
agctagtaggaatgtacat

SEQ ID NO: 4493358 - DNA, 14 bp, Homo sapiens
agctagtgccaaat

SEQ ID NO: 4493359 - DNA, 20 bp, Homo sapiens
agctagtgccaaataattga

SEQ ID NO: 4493360 - DNA, 17 bp, Homo sapiens
agctagtgcctttagag

SEQ ID NO: 4493361 - DNA, 15 bp, Homo sapiens
agctagttggggagc

SEQ ID NO: 4493362 - DNA, 18 bp, Homo sapiens
agctatctgtcatctctc

SEQ ID NO: 4493363 - DNA, 21 bp, Homo sapiens
agctatgaagagctagagaaa

SEQ ID NO: 4493364 - DNA, 22 bp, Homo sapiens
agctatgctgtatctgtgcttt

SEQ ID NO: 4493365 - DNA, 20 bp, Homo sapiens
agctatgtcccaggaatcag

SEQ ID NO: 4493366 - DNA, 13 bp, Homo sapiens
agctattaaaact

SEQ ID NO: 4493367 - DNA, 14 bp, Homo sapiens
agctattaaaactc

SEQ ID NO: 4493368 - DNA, 20 bp, Homo sapiens
agctattactggatctctta

SEQ ID NO: 4493369 - DNA, 17 bp, Homo sapiens
agctattgcaaatgagg

SEQ ID NO: 4493370 - DNA, 15 bp, Homo sapiens
agctatttaaagcat

SEQ ID NO: 4493371 - DNA, 17 bp, Homo sapiens
agctatttcatctattt

SEQ ID NO: 4493372 - DNA, 18 bp, Homo sapiens
ctccatctccgcctccac

SEQ ID NO: 4493373 - DNA, 14 bp, Homo sapiens
ctccatctcttctg

SEQ ID NO: 4493374 - DNA, 23 bp, Homo sapiens
ctccatctctttaaaaacaaaca

SEQ ID NO: 4493375 - DNA, 16 bp, Homo sapiens
ctccatctggcagggt

SEQ ID NO: 4493376 - DNA, 19 bp, Homo sapiens
ctccatcttactctgccct

SEQ ID NO: 4493377 - DNA, 13 bp, Homo sapiens
ctccatcttcaat

SEQ ID NO: 4493378 - DNA, 22 bp, Homo sapiens
ctccatgcaggggtcagtgcag

SEQ ID NO: 4493379 - DNA, 21 bp, Homo sapiens
ctccatgctcctcacctgtct

SEQ ID NO: 4493380 - DNA, 17 bp, Homo sapiens
ctccatgctgggtctga

SEQ ID NO: 4493381 - DNA, 24 bp, Homo sapiens
ctccatgctgggtctgaggcccct

SEQ ID NO: 4493382 - DNA, 14 bp, Homo sapiens
ctccatggaaaagc

SEQ ID NO: 4493383 - DNA, 20 bp, Homo sapiens
ctccatggccctgtcccagg

SEQ ID NO: 4493384 - DNA, 21 bp, Homo sapiens
ctccatgtgtgtgccaagccc

SEQ ID NO: 4493385 - DNA, 22 bp, Homo sapiens
ctccatgtgtgtgccaagccct

SEQ ID NO: 4493386 - DNA, 17 bp, Homo sapiens
ctccattggtgttgaca

SEQ ID NO: 4493387 - DNA, 14 bp, Homo sapiens
ctccatttaagaca

SEQ ID NO: 4493388 - DNA, 16 bp, Homo sapiens
ctccatttaagacaca

SEQ ID NO: 4493389 - DNA, 18 bp, Homo sapiens
ctccatttttaaccactt

SEQ ID NO: 4493390 - DNA, 12 bp, Homo sapiens
ctccatttttct

SEQ ID NO: 4493391 - DNA, 16 bp, Homo sapiens
ctccatttttctccca

SEQ ID NO: 4493392 - DNA, 20 bp, Homo sapiens
ctccatttttctcccaagaa

SEQ ID NO: 4493393 - DNA, 15 bp, Homo sapiens
ctcccaaaacatttt

SEQ ID NO: 4493394 - DNA, 19 bp, Homo sapiens
ctcccaacatgggagggat

SEQ ID NO: 4493395 - DNA, 22 bp, Homo sapiens
ctcccaacatgggagggatcag

SEQ ID NO: 4493396 - DNA, 22 bp, Homo sapiens
ctcccaacccattcactacagg

SEQ ID NO: 4493397 - DNA, 17 bp, Homo sapiens
ctcccaacttcttcctg

SEQ ID NO: 4493398 - DNA, 21 bp, Homo sapiens
ctcccaagcacccagagcttt

SEQ ID NO: 4493399 - DNA, 16 bp, Homo sapiens
ctcccaaggagaacaa

SEQ ID NO: 4493400 - DNA, 21 bp, Homo sapiens
ctcccaagggtgccctttggg

SEQ ID NO: 4493401 - DNA, 19 bp, Homo sapiens
ctcccaaggtcctctcagt

SEQ ID NO: 4493402 - DNA, 18 bp, Homo sapiens
ctcccaagtcccaccctc

SEQ ID NO: 4493403 - DNA, 22 bp, Homo sapiens
ctcccaagtcccaccctcttcc

SEQ ID NO: 4493404 - DNA, 17 bp, Homo sapiens
ctcccaagtggtgccta

SEQ ID NO: 4493405 - DNA, 13 bp, Homo sapiens
ctcccaatcagct

SEQ ID NO: 4493406 - DNA, 17 bp, Homo sapiens
ctcccacagagtgctgg

SEQ ID NO: 4493407 - DNA, 15 bp, Homo sapiens
ctcccacagcagccc

SEQ ID NO: 4493408 - DNA, 19 bp, Homo sapiens
ctcccacagcttcctgagg

SEQ ID NO: 4493409 - DNA, 14 bp, Homo sapiens
ctcccaccagagcc

SEQ ID NO: 4493410 - DNA, 13 bp, Homo sapiens
ctcccaccccacc

SEQ ID NO: 4493411 - DNA, 21 bp, Homo sapiens
ctcccacccggccacagctgc

SEQ ID NO: 4493412 - DNA, 16 bp, Homo sapiens
ctcccacctcagcctc

SEQ ID NO: 4493413 - DNA, 18 bp, Homo sapiens
ctcccacctcagcctcct

SEQ ID NO: 4493414 - DNA, 15 bp, Homo sapiens
ctcccacctgacaca

SEQ ID NO: 4493415 - DNA, 13 bp, Homo sapiens
ctcccacctggct

SEQ ID NO: 4493416 - DNA, 15 bp, Homo sapiens
ctcccacctggctct

SEQ ID NO: 4493417 - DNA, 16 bp, Homo sapiens
ctcccacctgtttctg

SEQ ID NO: 4493418 - DNA, 23 bp, Homo sapiens
ctcccacgactgttgtacaagct

SEQ ID NO: 4493419 - DNA, 16 bp, Homo sapiens
ctcccagacaggccct

SEQ ID NO: 4493420 - DNA, 21 bp, Homo sapiens
ctcccagaggagccaccagtt

SEQ ID NO: 4493421 - DNA, 22 bp, Homo sapiens
ctcccagaggagccaccagttc

SEQ ID NO: 4493422 - DNA, 13 bp, Homo sapiens
ctcccagccaggc

SEQ ID NO: 4493423 - DNA, 23 bp, Homo sapiens
ctcccagctcctttctcctgtga

SEQ ID NO: 4493424 - DNA, 17 bp, Homo sapiens
ctcccagctgtgctgtg

SEQ ID NO: 4493425 - DNA, 19 bp, Homo sapiens
ctcccagctgtgctgtgga

SEQ ID NO: 4493426 - DNA, 16 bp, Homo sapiens
ctcccaggaagcccag

SEQ ID NO: 4493427 - DNA, 21 bp, Homo sapiens
ctcccaggaagcccaggagcc

SEQ ID NO: 4493428 - DNA, 22 bp, Homo sapiens
ctcccaggacctcggatgacca

SEQ ID NO: 4493429 - DNA, 14 bp, Homo sapiens
ctcccaggccccag

SEQ ID NO: 4493430 - DNA, 18 bp, Homo sapiens
ctcccaggccccagggga

SEQ ID NO: 4493431 - DNA, 19 bp, Homo sapiens
ctcccaggggtctccctgg

SEQ ID NO: 4493432 - DNA, 22 bp, Homo sapiens
ctcccaggggtctccctggctc

SEQ ID NO: 4493433 - DNA, 19 bp, Homo sapiens
ctcccaggtaccagctgcg

SEQ ID NO: 4493434 - DNA, 24 bp, Homo sapiens
ctcccaggtaccagctgcgcttgc

SEQ ID NO: 4493435 - DNA, 13 bp, Homo sapiens
ctcccagtatgtt

SEQ ID NO: 4493436 - DNA, 17 bp, Homo sapiens
ctcccagtcatttaata

SEQ ID NO: 4493437 - DNA, 20 bp, Homo sapiens
ctcccagtccaaatgtcctc

SEQ ID NO: 4493438 - DNA, 15 bp, Homo sapiens
ctcccagtcctgcct

SEQ ID NO: 4493439 - DNA, 21 bp, Homo sapiens
ctcccagtcctgcctgaacag

SEQ ID NO: 4493440 - DNA, 18 bp, Homo sapiens
ctcccagtctacccagag

SEQ ID NO: 4493441 - DNA, 13 bp, Homo sapiens
ctcccatgaagcc

SEQ ID NO: 4493442 - DNA, 15 bp, Homo sapiens
ctcccatgaagcctt

SEQ ID NO: 4493443 - DNA, 16 bp, Homo sapiens
ctcccatgaagccttt

SEQ ID NO: 4493444 - DNA, 19 bp, Homo sapiens
ctcccatgaagccttttga

SEQ ID NO: 4493445 - DNA, 22 bp, Homo sapiens
ctcccatgaagccttttgaaag

SEQ ID NO: 4493446 - DNA, 14 bp, Homo sapiens
ctcccatggagccc

SEQ ID NO: 4493447 - DNA, 15 bp, Homo sapiens
ctcccatggagcccc

SEQ ID NO: 4493448 - DNA, 17 bp, Homo sapiens
ctcccatggagccccag

SEQ ID NO: 4493449 - DNA, 20 bp, Homo sapiens
ctcccatggagccccagccc

SEQ ID NO: 4493450 - DNA, 23 bp, Homo sapiens
ctcccatggagccccagccccct

SEQ ID NO: 4493451 - DNA, 16 bp, Homo sapiens
ctcccattctgcacca

SEQ ID NO: 4493452 - DNA, 16 bp, Homo sapiens
ctcccattgcccagtg

SEQ ID NO: 4493453 - DNA, 16 bp, Homo sapiens
ctccctggcagacaca

SEQ ID NO: 4493454 - DNA, 17 bp, Homo sapiens
ctccctggcagacacaa

SEQ ID NO: 4493455 - DNA, 12 bp, Homo sapiens
ctccctggctcc

SEQ ID NO: 4493456 - DNA, 15 bp, Homo sapiens
ctccctggctcccat

SEQ ID NO: 4493457 - DNA, 14 bp, Homo sapiens
ctccctggctccct

SEQ ID NO: 4493458 - DNA, 13 bp, Homo sapiens
ctccctggcttct

SEQ ID NO: 4493459 - DNA, 22 bp, Homo sapiens
ctccctgggacacagacccagg

SEQ ID NO: 4493460 - DNA, 18 bp, Homo sapiens
ctccctgtagctctgcct

SEQ ID NO: 4493461 - DNA, 14 bp, Homo sapiens
ctccctgtcctcct

SEQ ID NO: 4493462 - DNA, 17 bp, Homo sapiens
ctccctgtgggggtggc

SEQ ID NO: 4493463 - DNA, 22 bp, Homo sapiens
ctccctgtgggggtggccatcc

SEQ ID NO: 4493464 - DNA, 23 bp, Homo sapiens
ctccctgtgggggtggccatccc

SEQ ID NO: 4493465 - DNA, 24 bp, Homo sapiens
ctccctgtgggggtggccatccct

SEQ ID NO: 4493466 - DNA, 17 bp, Homo sapiens
ctccctgtgttctgggc

SEQ ID NO: 4493467 - DNA, 19 bp, Homo sapiens
ctcccttcctctctcctta

SEQ ID NO: 4493468 - DNA, 20 bp, Homo sapiens
ctcccttccttttccctgct

SEQ ID NO: 4493469 - DNA, 18 bp, Homo sapiens
ctcccttctacctgccac

SEQ ID NO: 4493470 - DNA, 15 bp, Homo sapiens
ctccctttctctctc

SEQ ID NO: 4493471 - DNA, 22 bp, Homo sapiens
ctccctttctctctcctctctg

SEQ ID NO: 4493472 - DNA, 17 bp, Homo sapiens
ctcccttttgtccttcc

SEQ ID NO: 4493473 - DNA, 15 bp, Homo sapiens
ctccctttttgggta

SEQ ID NO: 4493474 - DNA, 13 bp, Homo sapiens
ctccgaagaaaag

SEQ ID NO: 4493475 - DNA, 21 bp, Homo sapiens
ctccgactctgcacccgcctc

SEQ ID NO: 4493476 - DNA, 23 bp, Homo sapiens
ctccgagaagctctcgagggaag

SEQ ID NO: 4493477 - DNA, 15 bp, Homo sapiens
ctccgaggacccagg

SEQ ID NO: 4493478 - DNA, 13 bp, Homo sapiens
ctccgaggctccc

SEQ ID NO: 4493479 - DNA, 16 bp, Homo sapiens
ctccgaggctccccgc

SEQ ID NO: 4493480 - DNA, 21 bp, Homo sapiens
ctccgcatcacctcaccaagg

SEQ ID NO: 4493481 - DNA, 21 bp, Homo sapiens
ctccgccagcctcctctggac

SEQ ID NO: 4493482 - DNA, 16 bp, Homo sapiens
ctccgcccagcctctc

SEQ ID NO: 4493483 - DNA, 21 bp, Homo sapiens
ctccgcctgggtcatgggcct

SEQ ID NO: 4493484 - DNA, 15 bp, Homo sapiens
ctccgcgccgatgcc

SEQ ID NO: 4493485 - DNA, 19 bp, Homo sapiens
ctccgcgccgatgccaccg

SEQ ID NO: 4493486 - DNA, 18 bp, Homo sapiens
ctccgcttgtccaagaca

SEQ ID NO: 4493487 - DNA, 16 bp, Homo sapiens
ctccggacatccagcg

SEQ ID NO: 4493488 - DNA, 16 bp, Homo sapiens
ctccggaggactgagc

SEQ ID NO: 4493489 - DNA, 17 bp, Homo sapiens
ctccggaggactgagcc

SEQ ID NO: 4493490 - DNA, 20 bp, Homo sapiens
ctccggaggactgagccccc

SEQ ID NO: 4493491 - DNA, 21 bp, Homo sapiens
ctccggcgggtgacagctccg

SEQ ID NO: 4493492 - DNA, 14 bp, Homo sapiens
ctccggcgtcagcc

SEQ ID NO: 4493493 - DNA, 16 bp, Homo sapiens
ctccggcgtcagcctc

SEQ ID NO: 4493494 - DNA, 18 bp, Homo sapiens
ctccggcgtcagcctcca

SEQ ID NO: 4493495 - DNA, 14 bp, Homo sapiens
ctccggctgtgctg

SEQ ID NO: 4493496 - DNA, 23 bp, Homo sapiens
ctccaagacagcagcagcctgca

SEQ ID NO: 4493497 - DNA, 20 bp, Homo sapiens
ctccaagcacagagcctggc

SEQ ID NO: 4493498 - DNA, 14 bp, Homo sapiens
ctccaagcatttca

SEQ ID NO: 4493499 - DNA, 15 bp, Homo sapiens
ctccaagcatttcat

SEQ ID NO: 4493500 - DNA, 16 bp, Homo sapiens
ctccaagcatttcatg

SEQ ID NO: 4493501 - DNA, 19 bp, Homo sapiens
ctccaagcatttcatgaaa

SEQ ID NO: 4493502 - DNA, 15 bp, Homo sapiens
ctccaagcctgcctc

SEQ ID NO: 4493503 - DNA, 20 bp, Homo sapiens
ctccaaggaggggctgtaaa

SEQ ID NO: 4493504 - DNA, 18 bp, Homo sapiens
ctccaaggtgatgttgta

SEQ ID NO: 4493505 - DNA, 16 bp, Homo sapiens
ctccaataaagtgcct

SEQ ID NO: 4493506 - DNA, 21 bp, Homo sapiens
ctccaataaagtgccttctgg

SEQ ID NO: 4493507 - DNA, 18 bp, Homo sapiens
ctccaatccacacatatt

SEQ ID NO: 4493508 - DNA, 19 bp, Homo sapiens
ctccaatggaaagcttttc

SEQ ID NO: 4493509 - DNA, 20 bp, Homo sapiens
ctccaatggaaagcttttca

SEQ ID NO: 4493510 - DNA, 23 bp, Homo sapiens
ctccaattctgaaatacttttga

SEQ ID NO: 4493511 - DNA, 14 bp, Homo sapiens
ctccaatttcccca

SEQ ID NO: 4493512 - DNA, 21 bp, Homo sapiens
ctccacaaggggattttgctg

SEQ ID NO: 4493513 - DNA, 12 bp, Homo sapiens
ctccacagggct

SEQ ID NO: 4493514 - DNA, 13 bp, Homo sapiens
ctccacagggctg

SEQ ID NO: 4493515 - DNA, 20 bp, Homo sapiens
ctccacatcaacattccagg

SEQ ID NO: 4493516 - DNA, 13 bp, Homo sapiens
ctccacatcctcc

SEQ ID NO: 4493517 - DNA, 18 bp, Homo sapiens
ctccacattcttcagttt

SEQ ID NO: 4493518 - DNA, 12 bp, Homo sapiens
ctccaccaaccc

SEQ ID NO: 4493519 - DNA, 13 bp, Homo sapiens
ctccaccaaccca

SEQ ID NO: 4493520 - DNA, 12 bp, Homo sapiens
ctccaccaccca

SEQ ID NO: 4493521 - DNA, 13 bp, Homo sapiens
ctccaccacccaa

SEQ ID NO: 4493522 - DNA, 14 bp, Homo sapiens
ctccaccacccaaa

SEQ ID NO: 4493523 - DNA, 15 bp, Homo sapiens
ctccaccatccccac

SEQ ID NO: 4493524 - DNA, 18 bp, Homo sapiens
ctccaccccacagaacct

SEQ ID NO: 4493525 - DNA, 12 bp, Homo sapiens
ctccaccccagg

SEQ ID NO: 4493526 - DNA, 13 bp, Homo sapiens
ctccaccccaggg

SEQ ID NO: 4493527 - DNA, 16 bp, Homo sapiens
ctccaccccagggtca

SEQ ID NO: 4493528 - DNA, 14 bp, Homo sapiens
ctccaccctctgag

SEQ ID NO: 4493529 - DNA, 17 bp, Homo sapiens
ctccaccctctgagctt

SEQ ID NO: 4493530 - DNA, 19 bp, Homo sapiens
ctccaccctctgagctttg

SEQ ID NO: 4493531 - DNA, 14 bp, Homo sapiens
ctccacccttggcc

SEQ ID NO: 4493532 - DNA, 16 bp, Homo sapiens
ctccacccttggcctg

SEQ ID NO: 4493533 - DNA, 16 bp, Homo sapiens
ctccaccgctgcctaa

SEQ ID NO: 4493534 - DNA, 15 bp, Homo sapiens
ctccacctcagcctt

SEQ ID NO: 4493535 - DNA, 17 bp, Homo sapiens
ctccacctcagccttgg

SEQ ID NO: 4493536 - DNA, 18 bp, Homo sapiens
ctccacgcctcctggcca

SEQ ID NO: 4493537 - DNA, 19 bp, Homo sapiens
ctccacgcctcctggccag

SEQ ID NO: 4493538 - DNA, 14 bp, Homo sapiens
ctccacgggcaggg

SEQ ID NO: 4493539 - DNA, 21 bp, Homo sapiens
ctccacggtagcacttgacct

SEQ ID NO: 4493540 - DNA, 17 bp, Homo sapiens
ctccacgttctgctcat

SEQ ID NO: 4493541 - DNA, 20 bp, Homo sapiens
ctccacgttctgctcatcat

SEQ ID NO: 4493542 - DNA, 22 bp, Homo sapiens
ctccactcatgtgactctttcc

SEQ ID NO: 4493543 - DNA, 16 bp, Homo sapiens
ctccactctagttcta

SEQ ID NO: 4493544 - DNA, 13 bp, Homo sapiens
ctccactctcccc

SEQ ID NO: 4493545 - DNA, 15 bp, Homo sapiens
ctccactctccccca

SEQ ID NO: 4493546 - DNA, 22 bp, Homo sapiens
ctccactcttgatctctcttgt

SEQ ID NO: 4493547 - DNA, 22 bp, Homo sapiens
ctccactgcaagagggggggcc

SEQ ID NO: 4493548 - DNA, 23 bp, Homo sapiens
ctccactggggaatgctcccagc

SEQ ID NO: 4493549 - DNA, 15 bp, Homo sapiens
ctccacttgtatata

SEQ ID NO: 4493550 - DNA, 17 bp, Homo sapiens
ctccagaagcctctggc

SEQ ID NO: 4493551 - DNA, 21 bp, Homo sapiens
ctccagaagcctctggctaga

SEQ ID NO: 4493552 - DNA, 12 bp, Homo sapiens
ctccagagacac

SEQ ID NO: 4493553 - DNA, 17 bp, Homo sapiens
ctccagagacactgagc

SEQ ID NO: 4493554 - DNA, 16 bp, Homo sapiens
ctccagagccccacag

SEQ ID NO: 4493555 - DNA, 21 bp, Homo sapiens
ctccagagccccacagcccca

SEQ ID NO: 4493556 - DNA, 13 bp, Homo sapiens
ctccagagggcac

SEQ ID NO: 4493557 - DNA, 19 bp, Homo sapiens
ctccagagggcactcagaa

SEQ ID NO: 4493558 - DNA, 20 bp, Homo sapiens
ctccagagggcactctgctt

SEQ ID NO: 4493559 - DNA, 21 bp, Homo sapiens
ctccagagggcactctgcttg

SEQ ID NO: 4493560 - DNA, 20 bp, Homo sapiens
ctccagcatttagataatct

SEQ ID NO: 4493561 - DNA, 13 bp, Homo sapiens
ctccagccagaga

SEQ ID NO: 4493562 - DNA, 23 bp, Homo sapiens
ctccagccagcgcctccctccac

SEQ ID NO: 4493563 - DNA, 14 bp, Homo sapiens
ctccagcctcccct

SEQ ID NO: 4493564 - DNA, 23 bp, Homo sapiens
ctccagcctcccctcccctgggg

SEQ ID NO: 4493565 - DNA, 13 bp, Homo sapiens
ctccagcctctgc

SEQ ID NO: 4493566 - DNA, 23 bp, Homo sapiens
ctccagcctctgccgctgccatg

SEQ ID NO: 4493567 - DNA, 17 bp, Homo sapiens
ctccagcctctgttccc

SEQ ID NO: 4493568 - DNA, 17 bp, Homo sapiens
ctccagcctgagtgaca

SEQ ID NO: 4493569 - DNA, 12 bp, Homo sapiens
ctccagcctggg

SEQ ID NO: 4493570 - DNA, 17 bp, Homo sapiens
ctccagcgatggtgctg

SEQ ID NO: 4493571 - DNA, 21 bp, Homo sapiens
ctccagcgatggtgctgccca

SEQ ID NO: 4493572 - DNA, 15 bp, Homo sapiens
ctccagctctggcac

SEQ ID NO: 4493573 - DNA, 14 bp, Homo sapiens
ctccagctgccccg

SEQ ID NO: 4493574 - DNA, 12 bp, Homo sapiens
ctccagcttgtg

SEQ ID NO: 4493575 - DNA, 12 bp, Homo sapiens
ctccaggaaaga

SEQ ID NO: 4493576 - DNA, 22 bp, Homo sapiens
ctccaggaaagagcagtcagag

SEQ ID NO: 4493577 - DNA, 20 bp, Homo sapiens
ctccaggagcctcatccagc

SEQ ID NO: 4493578 - DNA, 21 bp, Homo sapiens
ctccaggattttaatttcagg

SEQ ID NO: 4493579 - DNA, 15 bp, Homo sapiens
ctccaggcctgcctc

SEQ ID NO: 4493580 - DNA, 20 bp, Homo sapiens
ctccaggcctgcctcccact

SEQ ID NO: 4493581 - DNA, 22 bp, Homo sapiens
ctccaggcctgcctcccacttc

SEQ ID NO: 4493582 - DNA, 22 bp, Homo sapiens
ctcagggaccggtgctgcagga

SEQ ID NO: 4493583 - DNA, 23 bp, Homo sapiens
ctcagggagcagggaaggcctga

SEQ ID NO: 4493584 - DNA, 17 bp, Homo sapiens
ctcagggagcctcccca

SEQ ID NO: 4493585 - DNA, 15 bp, Homo sapiens
ctcagggcctcaggc

SEQ ID NO: 4493586 - DNA, 16 bp, Homo sapiens
ctcagggctgtcccag

SEQ ID NO: 4493587 - DNA, 19 bp, Homo sapiens
ctcagggctgtcccagccc

SEQ ID NO: 4493588 - DNA, 21 bp, Homo sapiens
ctcaggggacaatctcccctc

SEQ ID NO: 4493589 - DNA, 21 bp, Homo sapiens
ctcaggggcctctctcctgcc

SEQ ID NO: 4493590 - DNA, 15 bp, Homo sapiens
ctcaggggctccatg

SEQ ID NO: 4493591 - DNA, 16 bp, Homo sapiens
ctcaggggctctaggg

SEQ ID NO: 4493592 - DNA, 15 bp, Homo sapiens
ctcaggttccagaac

SEQ ID NO: 4493593 - DNA, 18 bp, Homo sapiens
ctcaggttccagaacagc

SEQ ID NO: 4493594 - DNA, 21 bp, Homo sapiens
ctcagtaagtatctggaggaa

SEQ ID NO: 4493595 - DNA, 16 bp, Homo sapiens
ctcagtccatgaagat

SEQ ID NO: 4493596 - DNA, 18 bp, Homo sapiens
ctcagtccctactgagta

SEQ ID NO: 4493597 - DNA, 20 bp, Homo sapiens
ctcagtccctactgagtact

SEQ ID NO: 4493598 - DNA, 18 bp, Homo sapiens
ctcagtctaaggtctcat

SEQ ID NO: 4493599 - DNA, 13 bp, Homo sapiens
ctcagtctctgag

SEQ ID NO: 4493600 - DNA, 18 bp, Homo sapiens
ctcagtctgctttctcta

SEQ ID NO: 4493601 - DNA, 12 bp, Homo sapiens
ctcagtctgttc

SEQ ID NO: 4493602 - DNA, 18 bp, Homo sapiens
ctcagtctgttcactgca

SEQ ID NO: 4493603 - DNA, 19 bp, Homo sapiens
ctcagtctgttcactgcat

SEQ ID NO: 4493604 - DNA, 18 bp, Homo sapiens
ctcagtgaagaatacttc

SEQ ID NO: 4493605 - DNA, 17 bp, Homo sapiens
ctcagtgactcagaact

SEQ ID NO: 4493606 - DNA, 20 bp, Homo sapiens
ctcagtgagcctcctgtgcc

SEQ ID NO: 4493607 - DNA, 18 bp, Homo sapiens
ctcagtgccacctatgcc

SEQ ID NO: 4493608 - DNA, 20 bp, Homo sapiens
ctcagtgccacctatgcctg

SEQ ID NO: 4493609 - DNA, 15 bp, Homo sapiens
ctcagtgctcctgga

SEQ ID NO: 4493610 - DNA, 17 bp, Homo sapiens
ctcagtgctcctggaaa

SEQ ID NO: 4493611 - DNA, 17 bp, Homo sapiens
ctcagtggatcttcaga

SEQ ID NO: 4493612 - DNA, 19 bp, Homo sapiens
ctcagttcccttggcctca

SEQ ID NO: 4493613 - DNA, 20 bp, Homo sapiens
ctcagttctctcccttcctc

SEQ ID NO: 4493614 - DNA, 23 bp, Homo sapiens
ctcagttctctcccttcctctct

SEQ ID NO: 4493615 - DNA, 18 bp, Homo sapiens
ctcagttttatgccccat

SEQ ID NO: 4493616 - DNA, 14 bp, Homo sapiens
ctcataattttgca

SEQ ID NO: 4493617 - DNA, 16 bp, Homo sapiens
ctcataattttgcaaa

SEQ ID NO: 4493618 - DNA, 17 bp, Homo sapiens
ctcataccctccctccc

SEQ ID NO: 4493619 - DNA, 16 bp, Homo sapiens
ctcatactcctgggct

SEQ ID NO: 4493620 - DNA, 14 bp, Homo sapiens
ctcatagacactga

SEQ ID NO: 4493621 - DNA, 18 bp, Homo sapiens
ctcatagacactgatctg

SEQ ID NO: 4493622 - DNA, 19 bp, Homo sapiens
ctcatagcaggaaatgtag

SEQ ID NO: 4493623 - DNA, 18 bp, Homo sapiens
ctcatatggcccagtgtc

SEQ ID NO: 4493624 - DNA, 19 bp, Homo sapiens
ctcatatggcccagtgtca

SEQ ID NO: 4493625 - DNA, 13 bp, Homo sapiens
ctcatcattctct

SEQ ID NO: 4493626 - DNA, 17 bp, Homo sapiens
ctcatcattctctgtct

SEQ ID NO: 4493627 - DNA, 18 bp, Homo sapiens
ctcatcattctctgtctc

SEQ ID NO: 4493628 - DNA, 23 bp, Homo sapiens
ctcatcattctctgtctcatcca

SEQ ID NO: 4493629 - DNA, 16 bp, Homo sapiens
ctcatccagcctcaga

SEQ ID NO: 4493630 - DNA, 18 bp, Homo sapiens
ctcatccagcctcagaga

SEQ ID NO: 4493631 - DNA, 13 bp, Homo sapiens
ctcatcccaacct

SEQ ID NO: 4493632 - DNA, 14 bp, Homo sapiens
ctcatccccagggg

SEQ ID NO: 4493633 - DNA, 22 bp, Homo sapiens
ctcatcccgagcacctccacat

SEQ ID NO: 4493634 - DNA, 12 bp, Homo sapiens
ctcatccctgga

SEQ ID NO: 4493635 - DNA, 15 bp, Homo sapiens
ctcatcccttgttta

SEQ ID NO: 4493636 - DNA, 18 bp, Homo sapiens
ctcatcccttgtttataa

SEQ ID NO: 4493637 - DNA, 14 bp, Homo sapiens
ctcatcctccctga

SEQ ID NO: 4493638 - DNA, 13 bp, Homo sapiens
ctcatcctgctct

SEQ ID NO: 4493639 - DNA, 15 bp, Homo sapiens
ctcatcctgctcttt

SEQ ID NO: 4493640 - DNA, 23 bp, Homo sapiens
ctcatccttcttccactgtctca

SEQ ID NO: 4493641 - DNA, 14 bp, Homo sapiens
ctcatctatctcaa

SEQ ID NO: 4493642 - DNA, 18 bp, Homo sapiens
ctcatctatctcaatcct

SEQ ID NO: 4493643 - DNA, 13 bp, Homo sapiens
ctcatctatggtt

SEQ ID NO: 4493644 - DNA, 19 bp, Homo sapiens
ctcatctatggttctaaat

SEQ ID NO: 4493645 - DNA, 12 bp, Homo sapiens
ctcatctcagac

SEQ ID NO: 4493646 - DNA, 14 bp, Homo sapiens
ctcatctcagaccc

SEQ ID NO: 4493647 - DNA, 15 bp, Homo sapiens
ctcatctcagaccct

SEQ ID NO: 4493648 - DNA, 13 bp, Homo sapiens
ctcatctcccagg

SEQ ID NO: 4493649 - DNA, 21 bp, Homo sapiens
ctcatctgcaggacagaggga

SEQ ID NO: 4493650 - DNA, 13 bp, Homo sapiens
ctcatctgtccct

SEQ ID NO: 4493651 - DNA, 15 bp, Homo sapiens
ctcatctgtccctcc

SEQ ID NO: 4493652 - DNA, 18 bp, Homo sapiens
ctcatctgtccctccggg

SEQ ID NO: 4493653 - DNA, 13 bp, Homo sapiens
ctcatcttagttc

SEQ ID NO: 4493654 - DNA, 13 bp, Homo sapiens
ctcatcttgtgaa

SEQ ID NO: 4493655 - DNA, 13 bp, Homo sapiens
ctcatctttctgc

SEQ ID NO: 4493656 - DNA, 15 bp, Homo sapiens
ctcatgagtgtgccc

SEQ ID NO: 4493657 - DNA, 23 bp, Homo sapiens
ctcatgatagaaggctatgggga

SEQ ID NO: 4493658 - DNA, 14 bp, Homo sapiens
ctcatgatcaagat

SEQ ID NO: 4493659 - DNA, 20 bp, Homo sapiens
ctcatgatcaagatatatgt

SEQ ID NO: 4493660 - DNA, 16 bp, Homo sapiens
ctcatgcaaactgctt

SEQ ID NO: 4493661 - DNA, 18 bp, Homo sapiens
ctcatgcaaactgcttta

SEQ ID NO: 4493662 - DNA, 19 bp, Homo sapiens
ctcatgcaaactgctttat

SEQ ID NO: 4493663 - DNA, 16 bp, Homo sapiens
ctcatgcaaatcaatt

SEQ ID NO: 4493664 - DNA, 16 bp, Homo sapiens
ctcatgcccaccccct

SEQ ID NO: 4493665 - DNA, 17 bp, Homo sapiens
ctcatgcccaccccctg

SEQ ID NO: 4493666 - DNA, 20 bp, Homo sapiens
ctcatgcccaccccctgccc

SEQ ID NO: 4493667 - DNA, 21 bp, Homo sapiens
ctcatgcccaccccctgccct

SEQ ID NO: 4493668 - DNA, 22 bp, Homo sapiens
ctcatgcccaccccctgccctg

SEQ ID NO: 4493669 - DNA, 23 bp, Homo sapiens
ctcatgcccaccccctgccctgc

SEQ ID NO: 4493670 - DNA, 16 bp, Homo sapiens
ctcatgctgttgctgc

SEQ ID NO: 4493671 - DNA, 19 bp, Homo sapiens
ctcatgggtggcactcagt

SEQ ID NO: 4493672 - DNA, 15 bp, Homo sapiens
ctatgagttggactt

SEQ ID NO: 4493673 - DNA, 18 bp, Homo sapiens
ctatgataattatttaca

SEQ ID NO: 4493674 - DNA, 20 bp, Homo sapiens
ctatgatgagaggccagcac

SEQ ID NO: 4493675 - DNA, 14 bp, Homo sapiens
ctatgattattaac

SEQ ID NO: 4493676 - DNA, 23 bp, Homo sapiens
ctatgcactgaagagctcttggc

SEQ ID NO: 4493677 - DNA, 20 bp, Homo sapiens
ctatgcatatcagttgagct

SEQ ID NO: 4493678 - DNA, 20 bp, Homo sapiens
ctatgcatattcaatgtatt

SEQ ID NO: 4493679 - DNA, 22 bp, Homo sapiens
ctatgcatattcaatgtattga

SEQ ID NO: 4493680 - DNA, 19 bp, Homo sapiens
ctatgcccagggaataaga

SEQ ID NO: 4493681 - DNA, 16 bp, Homo sapiens
ctatgctattgacaat

SEQ ID NO: 4493682 - DNA, 17 bp, Homo sapiens
ctatgctattgacaata

SEQ ID NO: 4493683 - DNA, 20 bp, Homo sapiens
ctatgctattgacaataaaa

SEQ ID NO: 4493684 - DNA, 18 bp, Homo sapiens
ctatggaaggaggcctcc

SEQ ID NO: 4493685 - DNA, 15 bp, Homo sapiens
ctatggaatagatta

SEQ ID NO: 4493686 - DNA, 18 bp, Homo sapiens
ctatggagtcttgtgaaa

SEQ ID NO: 4493687 - DNA, 16 bp, Homo sapiens
ctatggattcacttct

SEQ ID NO: 4493688 - DNA, 16 bp, Homo sapiens
ctatggcctcgcctcc

SEQ ID NO: 4493689 - DNA, 14 bp, Homo sapiens
ctatgggagcccca

SEQ ID NO: 4493690 - DNA, 17 bp, Homo sapiens
ctatgggagccccaggg

SEQ ID NO: 4493691 - DNA, 19 bp, Homo sapiens
ctatggggatagatgtgtg

SEQ ID NO: 4493692 - DNA, 18 bp, Homo sapiens
ctatggtatgctggccag

SEQ ID NO: 4493693 - DNA, 20 bp, Homo sapiens
ctatggtcacagacttctgg

SEQ ID NO: 4493694 - DNA, 22 bp, Homo sapiens
ctatggtcacagacttctggcc

SEQ ID NO: 4493695 - DNA, 14 bp, Homo sapiens
ctatggtttgttgc

SEQ ID NO: 4493696 - DNA, 13 bp, Homo sapiens
ctatgtaaactac

SEQ ID NO: 4493697 - DNA, 22 bp, Homo sapiens
ctatgtaacatgtaggaagtag

SEQ ID NO: 4493698 - DNA, 18 bp, Homo sapiens
ctatgtaataatgtacag

SEQ ID NO: 4493699 - DNA, 19 bp, Homo sapiens
ctatgtaataatgtacaga

SEQ ID NO: 4493700 - DNA, 22 bp, Homo sapiens
ctatgtagctgaaaataaaatg

SEQ ID NO: 4493701 - DNA, 11 bp, Homo sapiens
ctatgtatgtt

SEQ ID NO: 4493702 - DNA, 20 bp, Homo sapiens
ctatgtatgttaatttattt

SEQ ID NO: 4493703 - DNA, 17 bp, Homo sapiens
ctatgtattttcctaat

SEQ ID NO: 4493704 - DNA, 18 bp, Homo sapiens
ctatgtcatttttaatgt

SEQ ID NO: 4493705 - DNA, 19 bp, Homo sapiens
ctatgtcatttttaatgta

SEQ ID NO: 4493706 - DNA, 17 bp, Homo sapiens
ctatgtgccttatgttg

SEQ ID NO: 4493707 - DNA, 17 bp, Homo sapiens
ctatgttaatattttag

SEQ ID NO: 4493708 - DNA, 12 bp, Homo sapiens
ctatgttcccca

SEQ ID NO: 4493709 - DNA, 14 bp, Homo sapiens
ctatgttccccagg

SEQ ID NO: 4493710 - DNA, 13 bp, Homo sapiens
ctattaaaagttg

SEQ ID NO: 4493711 - DNA, 11 bp, Homo sapiens
ctattaacaaa

SEQ ID NO: 4493712 - DNA, 13 bp, Homo sapiens
ctattaactctgc

SEQ ID NO: 4493713 - DNA, 13 bp, Homo sapiens
ctattaatatttg

SEQ ID NO: 4493714 - DNA, 13 bp, Homo sapiens
ctattaatcaaga

SEQ ID NO: 4493715 - DNA, 19 bp, Homo sapiens
ctattaatcacctctctgt

SEQ ID NO: 4493716 - DNA, 21 bp, Homo sapiens
ctattacttgaactttccaaa

SEQ ID NO: 4493717 - DNA, 16 bp, Homo sapiens
ctattatggaaaactg

SEQ ID NO: 4493718 - DNA, 18 bp, Homo sapiens
ctattatggaaaactgtg

SEQ ID NO: 4493719 - DNA, 18 bp, Homo sapiens
ctattcaaacagtctcag

SEQ ID NO: 4493720 - DNA, 17 bp, Homo sapiens
ctattcacaattattcc

SEQ ID NO: 4493721 - DNA, 14 bp, Homo sapiens
ctattccctcagcc

SEQ ID NO: 4493722 - DNA, 12 bp, Homo sapiens
ctattctgtcag

SEQ ID NO: 4493723 - DNA, 22 bp, Homo sapiens
ctattctgtcagtgttaaagat

SEQ ID NO: 4493724 - DNA, 21 bp, Homo sapiens
ctattcttaataaaactcact

SEQ ID NO: 4493725 - DNA, 14 bp, Homo sapiens
ctattcttcattta

SEQ ID NO: 4493726 - DNA, 17 bp, Homo sapiens
ctattcttcatttacaa

SEQ ID NO: 4493727 - DNA, 15 bp, Homo sapiens
ctattgacaataaaa

SEQ ID NO: 4493728 - DNA, 16 bp, Homo sapiens
ctattgacaataaaat

SEQ ID NO: 4493729 - DNA, 17 bp, Homo sapiens
ctattgacaataaaata

SEQ ID NO: 4493730 - DNA, 18 bp, Homo sapiens
ctattgacttttcaataa

SEQ ID NO: 4493731 - DNA, 15 bp, Homo sapiens
ctattgatgtacagt

SEQ ID NO: 4493732 - DNA, 17 bp, Homo sapiens
ctattgatgtacagtct

SEQ ID NO: 4493733 - DNA, 19 bp, Homo sapiens
ctattgatgtacagtctgt

SEQ ID NO: 4493734 - DNA, 21 bp, Homo sapiens
ctattgatttgaaaagaattt

SEQ ID NO: 4493735 - DNA, 20 bp, Homo sapiens
ctattgggcacagcctaggg

SEQ ID NO: 4493736 - DNA, 12 bp, Homo sapiens
ctattgtaatat

SEQ ID NO: 4493737 - DNA, 20 bp, Homo sapiens
ctattgtaatatagaaaaaa

SEQ ID NO: 4493738 - DNA, 19 bp, Homo sapiens
ctattgtgaatatttggaa

SEQ ID NO: 4493739 - DNA, 23 bp, Homo sapiens
ctatttaaaatgctcaatttcag

SEQ ID NO: 4493740 - DNA, 14 bp, Homo sapiens
ctatttaaattctt

SEQ ID NO: 4493741 - DNA, 18 bp, Homo sapiens
ctatttaacattttacag

SEQ ID NO: 4493742 - DNA, 14 bp, Homo sapiens
ctatttaatacagc

SEQ ID NO: 4493743 - DNA, 12 bp, Homo sapiens
ctatttaatttt

SEQ ID NO: 4493744 - DNA, 23 bp, Homo sapiens
ctatttagccagcgtttattgta

SEQ ID NO: 4493745 - DNA, 19 bp, Homo sapiens
ctatttatttatttattca

SEQ ID NO: 4493746 - DNA, 13 bp, Homo sapiens
ctatttcaataac

SEQ ID NO: 4493747 - DNA, 19 bp, Homo sapiens
ctatttcaatgagttattg

SEQ ID NO: 4493748 - DNA, 16 bp, Homo sapiens
ctatttcagctgcttt

SEQ ID NO: 4493749 - DNA, 17 bp, Homo sapiens
ctatttcagctgctttg

SEQ ID NO: 4493750 - DNA, 21 bp, Homo sapiens
ctatttccctctactgagtaa

SEQ ID NO: 4493751 - DNA, 16 bp, Homo sapiens
ctatttctatgtcatt

SEQ ID NO: 4493752 - DNA, 18 bp, Homo sapiens
ctatttctatgtcatttt

SEQ ID NO: 4493753 - DNA, 14 bp, Homo sapiens
ctatttcttgaaga

SEQ ID NO: 4493754 - DNA, 21 bp, Homo sapiens
ctatttcttgaagaataaatt

SEQ ID NO: 4493755 - DNA, 14 bp, Homo sapiens
ctatttgaacaagt

SEQ ID NO: 4493756 - DNA, 13 bp, Homo sapiens
ctatttgtacaat

SEQ ID NO: 4493757 - DNA, 15 bp, Homo sapiens
ctatttgtacaattt

SEQ ID NO: 4493758 - DNA, 13 bp, Homo sapiens
ctatttgtctctt

SEQ ID NO: 4493759 - DNA, 13 bp, Homo sapiens
ctattttagaaag

SEQ ID NO: 4493760 - DNA, 18 bp, Homo sapiens
ctattttagaaagctaaa

SEQ ID NO: 4493761 - DNA, 14 bp, Homo sapiens
ctattttcagaatc

SEQ ID NO: 4493762 - DNA, 23 bp, Homo sapiens
ctattttcagaatctgaatgtaa

SEQ ID NO: 4493763 - DNA, 17 bp, Homo sapiens
ctattttggattgtata

SEQ ID NO: 4493764 - DNA, 14 bp, Homo sapiens
ctatttttaatgca

SEQ ID NO: 4493765 - DNA, 14 bp, Homo sapiens
ctatttttctatga

SEQ ID NO: 4493766 - DNA, 21 bp, Homo sapiens
ctatttttggcagtctgaatt

SEQ ID NO: 4493767 - DNA, 15 bp, Homo sapiens
ctatttttgtaaact

SEQ ID NO: 4493768 - DNA, 19 bp, Homo sapiens
ctatttttttaaaatcact

SEQ ID NO: 4493769 - DNA, 17 bp, Homo sapiens
ctatttttttagattga

SEQ ID NO: 4493770 - DNA, 18 bp, Homo sapiens
ctatttttttcaaagact

SEQ ID NO: 4493771 - DNA, 16 bp, Homo sapiens
ctcactcccctctcct

SEQ ID NO: 4493772 - DNA, 12 bp, Homo sapiens
ctcactcctgag

SEQ ID NO: 4493773 - DNA, 11 bp, Homo sapiens
ctcactctgtc

SEQ ID NO: 4493774 - DNA, 13 bp, Homo sapiens
ctcactctgtcag

SEQ ID NO: 4493775 - DNA, 15 bp, Homo sapiens
ctcactctgtcagcc

SEQ ID NO: 4493776 - DNA, 19 bp, Homo sapiens
ctcactctgtcagccagcc

SEQ ID NO: 4493777 - DNA, 14 bp, Homo sapiens
ctcactctgtccct

SEQ ID NO: 4493778 - DNA, 11 bp, Homo sapiens
ctcactgccag

SEQ ID NO: 4493779 - DNA, 12 bp, Homo sapiens
ctcactgccagg

SEQ ID NO: 4493780 - DNA, 13 bp, Homo sapiens
ctcactgccaggc

SEQ ID NO: 4493781 - DNA, 15 bp, Homo sapiens
ctcactgccaggcca

SEQ ID NO: 4493782 - DNA, 19 bp, Homo sapiens
ctcactgccaggccagcct

SEQ ID NO: 4493783 - DNA, 20 bp, Homo sapiens
ctcactgccaggccagcctc

SEQ ID NO: 4493784 - DNA, 22 bp, Homo sapiens
ctcactgtgatcaatattttta

SEQ ID NO: 4493785 - DNA, 21 bp, Homo sapiens
ctcactgtttgtttttattta

SEQ ID NO: 4493786 - DNA, 14 bp, Homo sapiens
ctcacttcaatgtg

SEQ ID NO: 4493787 - DNA, 24 bp, Homo sapiens
ctcacttgaggaggagctggcctg

SEQ ID NO: 4493788 - DNA, 12 bp, Homo sapiens
ctcactttgtaa

SEQ ID NO: 4493789 - DNA, 20 bp, Homo sapiens
ctcactttgtaaataaaaac

SEQ ID NO: 4493790 - DNA, 21 bp, Homo sapiens
ctcactttttttttttgtttg

SEQ ID NO: 4493791 - DNA, 14 bp, Homo sapiens
ctcagaaagatttg

SEQ ID NO: 4493792 - DNA, 22 bp, Homo sapiens
ctcagaagaggttgggcttcca

SEQ ID NO: 4493793 - DNA, 17 bp, Homo sapiens
ctcagaaggaatggtgc

SEQ ID NO: 4493794 - DNA, 16 bp, Homo sapiens
ctcagaaggccccaga

SEQ ID NO: 4493795 - DNA, 18 bp, Homo sapiens
ctcagaaggccccagaga

SEQ ID NO: 4493796 - DNA, 21 bp, Homo sapiens
ctcagaagtgcatctggagag

SEQ ID NO: 4493797 - DNA, 22 bp, Homo sapiens
ctcagaagtgcatctggagaga

SEQ ID NO: 4493798 - DNA, 18 bp, Homo sapiens
ctcagaagttgtgctaaa

SEQ ID NO: 4493799 - DNA, 23 bp, Homo sapiens
ctcagaattcggtgtgctgccaa

SEQ ID NO: 4493800 - DNA, 13 bp, Homo sapiens
ctcagacccagcg

SEQ ID NO: 4493801 - DNA, 17 bp, Homo sapiens
ctcagacccagcggtcc

SEQ ID NO: 4493802 - DNA, 20 bp, Homo sapiens
ctcagacccaggagtccagc

SEQ ID NO: 4493803 - DNA, 22 bp, Homo sapiens
ctcagacccccactctcattcc

SEQ ID NO: 4493804 - DNA, 15 bp, Homo sapiens
ctcagacccctcagc

SEQ ID NO: 4493805 - DNA, 21 bp, Homo sapiens
ctcagacccctcagccccagc

SEQ ID NO: 4493806 - DNA, 20 bp, Homo sapiens
ctcagaccctgcttaggatg

SEQ ID NO: 4493807 - DNA, 16 bp, Homo sapiens
ctcagacgttgcctga

SEQ ID NO: 4493808 - DNA, 18 bp, Homo sapiens
ctcagacgttgcctgaga

SEQ ID NO: 4493809 - DNA, 18 bp, Homo sapiens
ctcagactcagaggtcca

SEQ ID NO: 4493810 - DNA, 22 bp, Homo sapiens
ctcagactcagaggtccaggcc

SEQ ID NO: 4493811 - DNA, 13 bp, Homo sapiens
ctcagactgggca

SEQ ID NO: 4493812 - DNA, 20 bp, Homo sapiens
ctcagagaaaaatgctcccc

SEQ ID NO: 4493813 - DNA, 21 bp, Homo sapiens
ctcagagaaaaatgctcccca

SEQ ID NO: 4493814 - DNA, 23 bp, Homo sapiens
ctcagagaaaaatgctccccaca

SEQ ID NO: 4493815 - DNA, 17 bp, Homo sapiens
ctcagagatctcccttc

SEQ ID NO: 4493816 - DNA, 18 bp, Homo sapiens
ctcagagatctcccttct

SEQ ID NO: 4493817 - DNA, 19 bp, Homo sapiens
ctcagagatctcccttctc

SEQ ID NO: 4493818 - DNA, 20 bp, Homo sapiens
ctcagagatctcccttctca

SEQ ID NO: 4493819 - DNA, 21 bp, Homo sapiens
ctcagagctctcgaggaaagt

SEQ ID NO: 4493820 - DNA, 10 bp, Homo sapiens
ctcagagctt

SEQ ID NO: 4493821 - DNA, 17 bp, Homo sapiens
ctcagagctttgtcact

SEQ ID NO: 4493822 - DNA, 20 bp, Homo sapiens
ctcagagctttgtcacttgc

SEQ ID NO: 4493823 - DNA, 13 bp, Homo sapiens
ctcagaggcctgc

SEQ ID NO: 4493824 - DNA, 20 bp, Homo sapiens
ctcagaggggccagctaacc

SEQ ID NO: 4493825 - DNA, 13 bp, Homo sapiens
ctcagaggtccag

SEQ ID NO: 4493826 - DNA, 14 bp, Homo sapiens
ctcagaggtccagg

SEQ ID NO: 4493827 - DNA, 16 bp, Homo sapiens
ctcagaggtccaggcc

SEQ ID NO: 4493828 - DNA, 18 bp, Homo sapiens
ctcagaggtccaggcccc

SEQ ID NO: 4493829 - DNA, 20 bp, Homo sapiens
ctcagaggtccaggccccca

SEQ ID NO: 4493830 - DNA, 22 bp, Homo sapiens
ctcagagtgacagtcataaata

SEQ ID NO: 4493831 - DNA, 23 bp, Homo sapiens
ctcagatgttaaaataaatggtt

SEQ ID NO: 4493832 - DNA, 16 bp, Homo sapiens
ctcagattcttcattg

SEQ ID NO: 4493833 - DNA, 23 bp, Homo sapiens
ctcagattcttcattgaggattg

SEQ ID NO: 4493834 - DNA, 16 bp, Homo sapiens
ctcagatttctgagga

SEQ ID NO: 4493835 - DNA, 17 bp, Homo sapiens
ctcagatttctgaggaa

SEQ ID NO: 4493836 - DNA, 14 bp, Homo sapiens
ctcagcaagctgcc

SEQ ID NO: 4493837 - DNA, 16 bp, Homo sapiens
ctcagcaagctgccca

SEQ ID NO: 4493838 - DNA, 19 bp, Homo sapiens
ctcagcaagctgcccagcc

SEQ ID NO: 4493839 - DNA, 21 bp, Homo sapiens
ctcagcaagctgcccagccct

SEQ ID NO: 4493840 - DNA, 21 bp, Homo sapiens
ctcagcacattcgggaccaat

SEQ ID NO: 4493841 - DNA, 16 bp, Homo sapiens
ctcagcagacatttat

SEQ ID NO: 4493842 - DNA, 11 bp, Homo sapiens
ctcagcagccc

SEQ ID NO: 4493843 - DNA, 12 bp, Homo sapiens
ctcagcagccct

SEQ ID NO: 4493844 - DNA, 15 bp, Homo sapiens
ctcagcagccctagc

SEQ ID NO: 4493845 - DNA, 13 bp, Homo sapiens
ctcagcagccctc

SEQ ID NO: 4493846 - DNA, 16 bp, Homo sapiens
ctcagcagccctcctc

SEQ ID NO: 4493847 - DNA, 17 bp, Homo sapiens
ctcagcagccctcctca

SEQ ID NO: 4493848 - DNA, 23 bp, Homo sapiens
ctcagccaaatttcctgtttgaa

SEQ ID NO: 4493849 - DNA, 23 bp, Homo sapiens
ctcagccacaaagccccccagct

SEQ ID NO: 4493850 - DNA, 17 bp, Homo sapiens
ctcagccactgtcacag

SEQ ID NO: 4493851 - DNA, 18 bp, Homo sapiens
ctcagccactgtcacagg

SEQ ID NO: 4493852 - DNA, 22 bp, Homo sapiens
ctcagccactgtcacaggcata

SEQ ID NO: 4493853 - DNA, 11 bp, Homo sapiens
ctcagccagcc

SEQ ID NO: 4493854 - DNA, 15 bp, Homo sapiens
ctcagccagcctcct

SEQ ID NO: 4493855 - DNA, 15 bp, Homo sapiens
ctcagccatgaggag

SEQ ID NO: 4493856 - DNA, 20 bp, Homo sapiens
ctcagccccaactctttatc

SEQ ID NO: 4493857 - DNA, 12 bp, Homo sapiens
ctcagccccagg

SEQ ID NO: 4493858 - DNA, 15 bp, Homo sapiens
ctcagccccaggcca

SEQ ID NO: 4493859 - DNA, 16 bp, Homo sapiens
ctcagccccaggccag

SEQ ID NO: 4493860 - DNA, 17 bp, Homo sapiens
ctcagccctgctccctg

SEQ ID NO: 4493861 - DNA, 20 bp, Homo sapiens
ctcagccctgctccctgcct

SEQ ID NO: 4493862 - DNA, 14 bp, Homo sapiens
ctcagccctgggcc

SEQ ID NO: 4493863 - DNA, 15 bp, Homo sapiens
ctcagccctgggccc

SEQ ID NO: 4493864 - DNA, 17 bp, Homo sapiens
ctcagccgagaaattgg

SEQ ID NO: 4493865 - DNA, 16 bp, Homo sapiens
ctcagcctaagaaaca

SEQ ID NO: 4493866 - DNA, 22 bp, Homo sapiens
ctcagcctcccaaagtgctggg

SEQ ID NO: 4493867 - DNA, 14 bp, Homo sapiens
ctcagcctcccaca

SEQ ID NO: 4493868 - DNA, 12 bp, Homo sapiens
ctcagcctctgc

SEQ ID NO: 4493869 - DNA, 18 bp, Homo sapiens
ctcagcctctgctggaga

SEQ ID NO: 4493870 - DNA, 20 bp, Homo sapiens
ctcagcgtcctgggctcaaa

SEQ ID NO: 4493871 - DNA, 18 bp, Homo sapiens
ctcagctataattctgtt

SEQ ID NO: 4493872 - DNA, 22 bp, Homo sapiens
ctcagctataattctgttatat

SEQ ID NO: 4493873 - DNA, 20 bp, Homo sapiens
ctcagctctaggctgttctg

SEQ ID NO: 4493874 - DNA, 14 bp, Homo sapiens
ctcagctctctggg

SEQ ID NO: 4493875 - DNA, 12 bp, Homo sapiens
ctcagctgcctc

SEQ ID NO: 4493876 - DNA, 14 bp, Homo sapiens
ctcagctgcctcac

SEQ ID NO: 4493877 - DNA, 18 bp, Homo sapiens
ctcagctgcctcacttcc

SEQ ID NO: 4493878 - DNA, 14 bp, Homo sapiens
ctcagctgcctcct

SEQ ID NO: 4493879 - DNA, 15 bp, Homo sapiens
ctcagctgcctcctg

SEQ ID NO: 4493880 - DNA, 16 bp, Homo sapiens
ctcagctgctggatga

SEQ ID NO: 4493881 - DNA, 22 bp, Homo sapiens
ctcagctgctggatgacttgag

SEQ ID NO: 4493882 - DNA, 20 bp, Homo sapiens
ctcagcttcttcacaggcac

SEQ ID NO: 4493883 - DNA, 16 bp, Homo sapiens
ctcagcttgcagctgg

SEQ ID NO: 4493884 - DNA, 17 bp, Homo sapiens
ctcagcttgcagctgga

SEQ ID NO: 4493885 - DNA, 20 bp, Homo sapiens
ctcaggaaagaatagaaaga

SEQ ID NO: 4493886 - DNA, 22 bp, Homo sapiens
ctcaggaaatcaaatatgcaaa

SEQ ID NO: 4493887 - DNA, 21 bp, Homo sapiens
ctcaggacagcatcccttccc

SEQ ID NO: 4493888 - DNA, 22 bp, Homo sapiens
ctcaggacagcatcccttccca

SEQ ID NO: 4493889 - DNA, 15 bp, Homo sapiens
ctacacaatacagta

SEQ ID NO: 4493890 - DNA, 17 bp, Homo sapiens
ctacacaatacagtatt

SEQ ID NO: 4493891 - DNA, 18 bp, Homo sapiens
ctacacactcagccacaa

SEQ ID NO: 4493892 - DNA, 20 bp, Homo sapiens
ctacactcattgaaatgtaa

SEQ ID NO: 4493893 - DNA, 21 bp, Homo sapiens
ctacactcattgaaatgtaat

SEQ ID NO: 4493894 - DNA, 16 bp, Homo sapiens
ctacactccagtgaga

SEQ ID NO: 4493895 - DNA, 19 bp, Homo sapiens
ctacactctcctgggcccc

SEQ ID NO: 4493896 - DNA, 22 bp, Homo sapiens
ctacagaaaaacaatggtaaca

SEQ ID NO: 4493897 - DNA, 19 bp, Homo sapiens
ctacagaatattaaatatt

SEQ ID NO: 4493898 - DNA, 15 bp, Homo sapiens
ctacagactccatct

SEQ ID NO: 4493899 - DNA, 19 bp, Homo sapiens
ctacagactccatctcttc

SEQ ID NO: 4493900 - DNA, 20 bp, Homo sapiens
ctacagactccatctcttct

SEQ ID NO: 4493901 - DNA, 16 bp, Homo sapiens
ctacagagcttccctg

SEQ ID NO: 4493902 - DNA, 17 bp, Homo sapiens
ctacagagcttccctga

SEQ ID NO: 4493903 - DNA, 20 bp, Homo sapiens
ctacagagtacgtgaaatgc

SEQ ID NO: 4493904 - DNA, 15 bp, Homo sapiens
ctacagcactactgg

SEQ ID NO: 4493905 - DNA, 21 bp, Homo sapiens
ctacagcactactgggtgtca

SEQ ID NO: 4493906 - DNA, 13 bp, Homo sapiens
ctacagctccaca

SEQ ID NO: 4493907 - DNA, 22 bp, Homo sapiens
ctacaggaagcaccccatgcca

SEQ ID NO: 4493908 - DNA, 20 bp, Homo sapiens
ctacaggcagtctctctctt

SEQ ID NO: 4493909 - DNA, 18 bp, Homo sapiens
ctacaggcctcttcctgt

SEQ ID NO: 4493910 - DNA, 22 bp, Homo sapiens
ctacagtaatgaaatgtttact

SEQ ID NO: 4493911 - DNA, 14 bp, Homo sapiens
ctacagtatataag

SEQ ID NO: 4493912 - DNA, 18 bp, Homo sapiens
ctacagtcaggaaaggaa

SEQ ID NO: 4493913 - DNA, 14 bp, Homo sapiens
ctacagtgtacagt

SEQ ID NO: 4493914 - DNA, 15 bp, Homo sapiens
ctacagtgtacagtc

SEQ ID NO: 4493915 - DNA, 20 bp, Homo sapiens
ctacagtgtacagtcttgta

SEQ ID NO: 4493916 - DNA, 15 bp, Homo sapiens
ctacagttttaactg

SEQ ID NO: 4493917 - DNA, 17 bp, Homo sapiens
ctacagttttaactgtg

SEQ ID NO: 4493918 - DNA, 20 bp, Homo sapiens
ctacagttttaactgtggat

SEQ ID NO: 4493919 - DNA, 16 bp, Homo sapiens
ctacatatgatctgtc

SEQ ID NO: 4493920 - DNA, 19 bp, Homo sapiens
ctacatatttgtatgtttt

SEQ ID NO: 4493921 - DNA, 20 bp, Homo sapiens
ctacatatttgtatgttttt

SEQ ID NO: 4493922 - DNA, 21 bp, Homo sapiens
ctacatcctaaggttcttgct

SEQ ID NO: 4493923 - DNA, 13 bp, Homo sapiens
ctacatctgcctc

SEQ ID NO: 4493924 - DNA, 16 bp, Homo sapiens
ctacatctttttttct

SEQ ID NO: 4493925 - DNA, 18 bp, Homo sapiens
ctacatgacgacaaagct

SEQ ID NO: 4493926 - DNA, 13 bp, Homo sapiens
ctacatgagaaca

SEQ ID NO: 4493927 - DNA, 14 bp, Homo sapiens
ctacatgagaacaa

SEQ ID NO: 4493928 - DNA, 20 bp, Homo sapiens
ctacatgaggtactgagagt

SEQ ID NO: 4493929 - DNA, 15 bp, Homo sapiens
ctacatgcagcccat

SEQ ID NO: 4493930 - DNA, 22 bp, Homo sapiens
ctacatgcataaactaaaaact

SEQ ID NO: 4493931 - DNA, 16 bp, Homo sapiens
ctacatgcataacaaa

SEQ ID NO: 4493932 - DNA, 16 bp, Homo sapiens
ctacatgccatgccta

SEQ ID NO: 4493933 - DNA, 18 bp, Homo sapiens
ctacattataataaaatt

SEQ ID NO: 4493934 - DNA, 23 bp, Homo sapiens
ctacattattgcttattgcttag

SEQ ID NO: 4493935 - DNA, 15 bp, Homo sapiens
ctacatttctgcaga

SEQ ID NO: 4493936 - DNA, 17 bp, Homo sapiens
ctaccaaaaaaaggaag

SEQ ID NO: 4493937 - DNA, 13 bp, Homo sapiens
ctaccacacacag

SEQ ID NO: 4493938 - DNA, 16 bp, Homo sapiens
ctaccacacacagcct

SEQ ID NO: 4493939 - DNA, 18 bp, Homo sapiens
ctaccacacacagcctgt

SEQ ID NO: 4493940 - DNA, 22 bp, Homo sapiens
ctaccagccagcctcagaaggc

SEQ ID NO: 4493941 - DNA, 19 bp, Homo sapiens
ctaccagtatttagaagcc

SEQ ID NO: 4493942 - DNA, 14 bp, Homo sapiens
ctaccatcagctct

SEQ ID NO: 4493943 - DNA, 20 bp, Homo sapiens
ctaccatttgtgttttgaaa

SEQ ID NO: 4493944 - DNA, 20 bp, Homo sapiens
ctacccacacctctgccaga

SEQ ID NO: 4493945 - DNA, 13 bp, Homo sapiens
ctacccagttgcc

SEQ ID NO: 4493946 - DNA, 13 bp, Homo sapiens
ctaccccaccacg

SEQ ID NO: 4493947 - DNA, 21 bp, Homo sapiens
ctaccccagttcctagcactg

SEQ ID NO: 4493948 - DNA, 15 bp, Homo sapiens
ctaccctaaccaagt

SEQ ID NO: 4493949 - DNA, 19 bp, Homo sapiens
ctaccctcctgcactgttt

SEQ ID NO: 4493950 - DNA, 21 bp, Homo sapiens
ctaccctgaaacccagtaatt

SEQ ID NO: 4493951 - DNA, 22 bp, Homo sapiens
ctaccctgagatctgcacagtc

SEQ ID NO: 4493952 - DNA, 13 bp, Homo sapiens
ctaccctgcctcc

SEQ ID NO: 4493953 - DNA, 13 bp, Homo sapiens
ctacctcagcctc

SEQ ID NO: 4493954 - DNA, 19 bp, Homo sapiens
ctacctgacactcccttgg

SEQ ID NO: 4493955 - DNA, 14 bp, Homo sapiens
ctacctgccctcaa

SEQ ID NO: 4493956 - DNA, 16 bp, Homo sapiens
ctacctgccttggaga

SEQ ID NO: 4493957 - DNA, 15 bp, Homo sapiens
ctacctgctctccaa

SEQ ID NO: 4493958 - DNA, 16 bp, Homo sapiens
ctaccttcctgtccct

SEQ ID NO: 4493959 - DNA, 19 bp, Homo sapiens
ctaccttgaaaataagaat

SEQ ID NO: 4493960 - DNA, 17 bp, Homo sapiens
ctaccttgcttttgctt

SEQ ID NO: 4493961 - DNA, 19 bp, Homo sapiens
ctaccttgcttttgcttct

SEQ ID NO: 4493962 - DNA, 21 bp, Homo sapiens
ctaccttggttcccccactga

SEQ ID NO: 4493963 - DNA, 19 bp, Homo sapiens
ctacctttttatatttaaa

SEQ ID NO: 4493964 - DNA, 20 bp, Homo sapiens
ctacctttttatatttaaaa

SEQ ID NO: 4493965 - DNA, 20 bp, Homo sapiens
ctacgcactggacagcatca

SEQ ID NO: 4493966 - DNA, 21 bp, Homo sapiens
ctacgtgaattagctttttct

SEQ ID NO: 4493967 - DNA, 23 bp, Homo sapiens
ctacgtttccccaataaagcctt

SEQ ID NO: 4493968 - DNA, 22 bp, Homo sapiens
ctactaatgtgatgctttcatt

SEQ ID NO: 4493969 - DNA, 17 bp, Homo sapiens
ctactaattccacacct

SEQ ID NO: 4493970 - DNA, 16 bp, Homo sapiens
ctactataatcaaatg

SEQ ID NO: 4493971 - DNA, 17 bp, Homo sapiens
ctactataatcaaatga

SEQ ID NO: 4493972 - DNA, 18 bp, Homo sapiens
ctactataatcaaatgat

SEQ ID NO: 4493973 - DNA, 16 bp, Homo sapiens
ctactcagcagccctc

SEQ ID NO: 4493974 - DNA, 15 bp, Homo sapiens
ctactcctagaagaa

SEQ ID NO: 4493975 - DNA, 21 bp, Homo sapiens
ctactcctctgcagtgccttg

SEQ ID NO: 4493976 - DNA, 14 bp, Homo sapiens
ctactcctgcctca

SEQ ID NO: 4493977 - DNA, 16 bp, Homo sapiens
ctactcctgtgctctg

SEQ ID NO: 4493978 - DNA, 15 bp, Homo sapiens
ctactctagatggca

SEQ ID NO: 4493979 - DNA, 17 bp, Homo sapiens
ctactctccccacgagg

SEQ ID NO: 4493980 - DNA, 13 bp, Homo sapiens
ctactctggaatg

SEQ ID NO: 4493981 - DNA, 21 bp, Homo sapiens
ctactctggaatgtttttccc

SEQ ID NO: 4493982 - DNA, 18 bp, Homo sapiens
ctactgaaccctgcctct

SEQ ID NO: 4493983 - DNA, 17 bp, Homo sapiens
ctactgacctttgtcct

SEQ ID NO: 4493984 - DNA, 18 bp, Homo sapiens
ctactgagtactctttct

SEQ ID NO: 4493985 - DNA, 19 bp, Homo sapiens
ctactgcactccagcctgg

SEQ ID NO: 4493986 - DNA, 16 bp, Homo sapiens
ctactgccatcctggc

SEQ ID NO: 4493987 - DNA, 22 bp, Homo sapiens
ctactgccatcctggcccaggg

SEQ ID NO: 4493988 - DNA, 23 bp, Homo sapiens
ctactgccatcctggcccagggc

SEQ ID NO: 4493989 - DNA, 23 bp, Homo sapiens
ctactgctgctgctgctgccgcc

SEQ ID NO: 4493990 - DNA, 20 bp, Homo sapiens
ctactggaaatgtagcactt

SEQ ID NO: 4493991 - DNA, 21 bp, Homo sapiens
ctactggaaatgtagcactta

SEQ ID NO: 4493992 - DNA, 14 bp, Homo sapiens
ctactggaatggtg

SEQ ID NO: 4493993 - DNA, 21 bp, Homo sapiens
ctactggaatggtgttttgtc

SEQ ID NO: 4493994 - DNA, 14 bp, Homo sapiens
ctactggacaatct

SEQ ID NO: 4493995 - DNA, 18 bp, Homo sapiens
ctactggcctctgtgcca

SEQ ID NO: 4493996 - DNA, 22 bp, Homo sapiens
cctttgagtgcagtcctgatca

SEQ ID NO: 4493997 - DNA, 17 bp, Homo sapiens
cctttgcaagatgcttg

SEQ ID NO: 4493998 - DNA, 21 bp, Homo sapiens
cctttgccagcagagccaggg

SEQ ID NO: 4493999 - DNA, 23 bp, Homo sapiens
cctttgccagcagagccagggca

SEQ ID NO: 4494000 - DNA, 24 bp, Homo sapiens
cctttgccagcagagccagggcag

SEQ ID NO: 4494001 - DNA, 22 bp, Homo sapiens
cctttggacccagggcctgact

SEQ ID NO: 4494002 - DNA, 16 bp, Homo sapiens
cctttgggcccaggga

SEQ ID NO: 4494003 - DNA, 15 bp, Homo sapiens
cctttggtcctggtg

SEQ ID NO: 4494004 - DNA, 16 bp, Homo sapiens
cctttggtttttttct

SEQ ID NO: 4494005 - DNA, 12 bp, Homo sapiens
cctttgtaacca

SEQ ID NO: 4494006 - DNA, 16 bp, Homo sapiens
cctttgtcaacttcag

SEQ ID NO: 4494007 - DNA, 17 bp, Homo sapiens
cctttgtcaacttcagt

SEQ ID NO: 4494008 - DNA, 18 bp, Homo sapiens
cctttgtcaacttcagtt

SEQ ID NO: 4494009 - DNA, 15 bp, Homo sapiens
cctttgtctttcaaa

SEQ ID NO: 4494010 - DNA, 22 bp, Homo sapiens
cctttgtgcacatttatttcct

SEQ ID NO: 4494011 - DNA, 12 bp, Homo sapiens
ccttttaaaatt

SEQ ID NO: 4494012 - DNA, 16 bp, Homo sapiens
ccttttaaaattgaat

SEQ ID NO: 4494013 - DNA, 19 bp, Homo sapiens
ccttttaaaattttgtgtt

SEQ ID NO: 4494014 - DNA, 15 bp, Homo sapiens
ccttttacccctgca

SEQ ID NO: 4494015 - DNA, 17 bp, Homo sapiens
ccttttatctggtgcct

SEQ ID NO: 4494016 - DNA, 21 bp, Homo sapiens
ccttttatctggtgcctcctc

SEQ ID NO: 4494017 - DNA, 19 bp, Homo sapiens
ccttttatgaatcaaatat

SEQ ID NO: 4494018 - DNA, 22 bp, Homo sapiens
ccttttatgtaatttctttaaa

SEQ ID NO: 4494019 - DNA, 15 bp, Homo sapiens
ccttttcactacacc

SEQ ID NO: 4494020 - DNA, 13 bp, Homo sapiens
ccttttccctgct

SEQ ID NO: 4494021 - DNA, 19 bp, Homo sapiens
ccttttctttgttcaagat

SEQ ID NO: 4494022 - DNA, 18 bp, Homo sapiens
ccttttgacactgctcta

SEQ ID NO: 4494023 - DNA, 12 bp, Homo sapiens
ccttttgcagga

SEQ ID NO: 4494024 - DNA, 12 bp, Homo sapiens
ccttttgcattg

SEQ ID NO: 4494025 - DNA, 12 bp, Homo sapiens
ccttttgttaat

SEQ ID NO: 4494026 - DNA, 17 bp, Homo sapiens
cctttttatttgcatgt

SEQ ID NO: 4494027 - DNA, 18 bp, Homo sapiens
cctttttatttgcatgtg

SEQ ID NO: 4494028 - DNA, 21 bp, Homo sapiens
cctttttcaatgaattttata

SEQ ID NO: 4494029 - DNA, 13 bp, Homo sapiens
cctttttcattta

SEQ ID NO: 4494030 - DNA, 20 bp, Homo sapiens
cctttttccaatgttttatt

SEQ ID NO: 4494031 - DNA, 21 bp, Homo sapiens
cctttttccaatgttttattg

SEQ ID NO: 4494032 - DNA, 10 bp, Homo sapiens
cctttttcct

SEQ ID NO: 4494033 - DNA, 19 bp, Homo sapiens
cctttttcttcgctggact

SEQ ID NO: 4494034 - DNA, 15 bp, Homo sapiens
cctttttgacactga

SEQ ID NO: 4494035 - DNA, 16 bp, Homo sapiens
cctttttgacactgaa

SEQ ID NO: 4494036 - DNA, 20 bp, Homo sapiens
ccttttttcaatatgcaagc

SEQ ID NO: 4494037 - DNA, 21 bp, Homo sapiens
ccttttttcccataagacaat

SEQ ID NO: 4494038 - DNA, 20 bp, Homo sapiens
ccttttttctgcctccttta

SEQ ID NO: 4494039 - DNA, 23 bp, Homo sapiens
ccttttttgagattttttttccg

SEQ ID NO: 4494040 - DNA, 13 bp, Homo sapiens
ccttttttgatca

SEQ ID NO: 4494041 - DNA, 23 bp, Homo sapiens
ccttttttgttttttcaaaatag

SEQ ID NO: 4494042 - DNA, 17 bp, Homo sapiens
ccttttttttttttcca

SEQ ID NO: 4494043 - DNA, 19 bp, Homo sapiens
cgaaaaagtgattgtgaag

SEQ ID NO: 4494044 - DNA, 14 bp, Homo sapiens
cgaaaaatgtgtgg

SEQ ID NO: 4494045 - DNA, 15 bp, Homo sapiens
cgaaaagagtcttcc

SEQ ID NO: 4494046 - DNA, 14 bp, Homo sapiens
cgaaactaagccag

SEQ ID NO: 4494047 - DNA, 22 bp, Homo sapiens
cgaaaggatgtaaacagtgcct

SEQ ID NO: 4494048 - DNA, 20 bp, Homo sapiens
cgaaatctgtattctgtttg

SEQ ID NO: 4494049 - DNA, 22 bp, Homo sapiens
cgaagaggggtggtggggggca

SEQ ID NO: 4494050 - DNA, 20 bp, Homo sapiens
cgaagccatcacttctcccc

SEQ ID NO: 4494051 - DNA, 22 bp, Homo sapiens
cgaagccatcacttctccccgc

SEQ ID NO: 4494052 - DNA, 15 bp, Homo sapiens
cgaagcgttgtcctc

SEQ ID NO: 4494053 - DNA, 16 bp, Homo sapiens
cgaagcgttgtcctca

SEQ ID NO: 4494054 - DNA, 18 bp, Homo sapiens
cgaaggccccgcctgggt

SEQ ID NO: 4494055 - DNA, 20 bp, Homo sapiens
cgaagtctttgccttctctg

SEQ ID NO: 4494056 - DNA, 16 bp, Homo sapiens
cgaatctctgcccctc

SEQ ID NO: 4494057 - DNA, 22 bp, Homo sapiens
cgaatctctttttgctttcgaa

SEQ ID NO: 4494058 - DNA, 22 bp, Homo sapiens
cgaatgaaaataactgaatttg

SEQ ID NO: 4494059 - DNA, 15 bp, Homo sapiens
cgaatttggtacaca

SEQ ID NO: 4494060 - DNA, 21 bp, Homo sapiens
cgaatttggtacacatgtgtt

SEQ ID NO: 4494061 - DNA, 21 bp, Homo sapiens
cgacaaagctgctaaatctcc

SEQ ID NO: 4494062 - DNA, 18 bp, Homo sapiens
cgacaaaggccacaggca

SEQ ID NO: 4494063 - DNA, 19 bp, Homo sapiens
cgacagggcctggagcccc

SEQ ID NO: 4494064 - DNA, 16 bp, Homo sapiens
cgacagtgagactctg

SEQ ID NO: 4494065 - DNA, 18 bp, Homo sapiens
cgacatcccagaccagcc

SEQ ID NO: 4494066 - DNA, 19 bp, Homo sapiens
cgacatcccagaccagcca

SEQ ID NO: 4494067 - DNA, 21 bp, Homo sapiens
cgaccacccctgcctccaccc

SEQ ID NO: 4494068 - DNA, 23 bp, Homo sapiens
cgaccacccctgcctccaccctc

SEQ ID NO: 4494069 - DNA, 11 bp, Homo sapiens
cgaccctgggg

SEQ ID NO: 4494070 - DNA, 13 bp, Homo sapiens
cgaccctggggcg

SEQ ID NO: 4494071 - DNA, 16 bp, Homo sapiens
cgacgcttgctctgtt

SEQ ID NO: 4494072 - DNA, 16 bp, Homo sapiens
cgactccagccagcgc

SEQ ID NO: 4494073 - DNA, 20 bp, Homo sapiens
cgactccagccagcgcctcc

SEQ ID NO: 4494074 - DNA, 16 bp, Homo sapiens
cgactctgcacccgcc

SEQ ID NO: 4494075 - DNA, 21 bp, Homo sapiens
cgactctttctgagtgccttc

SEQ ID NO: 4494076 - DNA, 23 bp, Homo sapiens
cgactgcccctgctgtgctgctc

SEQ ID NO: 4494077 - DNA, 17 bp, Homo sapiens
cgactggccagggccac

SEQ ID NO: 4494078 - DNA, 23 bp, Homo sapiens
cgactgtcagtggggcagcctct

SEQ ID NO: 4494079 - DNA, 11 bp, Homo sapiens
cgactgtctcc

SEQ ID NO: 4494080 - DNA, 17 bp, Homo sapiens
cgagaaagaggcaccag

SEQ ID NO: 4494081 - DNA, 12 bp, Homo sapiens
cgagaaattggg

SEQ ID NO: 4494082 - DNA, 17 bp, Homo sapiens
cgagaactttcattttt

SEQ ID NO: 4494083 - DNA, 15 bp, Homo sapiens
cgagaccatcctggc

SEQ ID NO: 4494084 - DNA, 16 bp, Homo sapiens
cgagaccatcctggct

SEQ ID NO: 4494085 - DNA, 11 bp, Homo sapiens
cgagaccccag

SEQ ID NO: 4494086 - DNA, 15 bp, Homo sapiens
cgagaccctgtctca

SEQ ID NO: 4494087 - DNA, 12 bp, Homo sapiens
cgagactcagcc

SEQ ID NO: 4494088 - DNA, 15 bp, Homo sapiens
cgagactccatctct

SEQ ID NO: 4494089 - DNA, 15 bp, Homo sapiens
cgagagcctgctccc

SEQ ID NO: 4494090 - DNA, 16 bp, Homo sapiens
cgagagggagagagag

SEQ ID NO: 4494091 - DNA, 15 bp, Homo sapiens
cgagagggaggcagg

SEQ ID NO: 4494092 - DNA, 19 bp, Homo sapiens
cgagagtagccgagagcct

SEQ ID NO: 4494093 - DNA, 18 bp, Homo sapiens
cgagcaggctactgtcag

SEQ ID NO: 4494094 - DNA, 18 bp, Homo sapiens
cgagcagggtgctgtggg

SEQ ID NO: 4494095 - DNA, 19 bp, Homo sapiens
cgagccacaagctgcactg

SEQ ID NO: 4494096 - DNA, 21 bp, Homo sapiens
cgagccacaagctgcactgtg

SEQ ID NO: 4494097 - DNA, 18 bp, Homo sapiens
cgagccaccatgcttgcc

SEQ ID NO: 4494098 - DNA, 16 bp, Homo sapiens
cgagccatttgtccca

SEQ ID NO: 4494099 - DNA, 20 bp, Homo sapiens
cgagccatttgtcccaagtg

SEQ ID NO: 4494100 - DNA, 19 bp, Homo sapiens
cgagccctgactcctggac

SEQ ID NO: 4494101 - DNA, 21 bp, Homo sapiens
cgagccctgactcctggactc

SEQ ID NO: 4494102 - DNA, 18 bp, Homo sapiens
cgagcctgaactgagccc

SEQ ID NO: 4494103 - DNA, 13 bp, Homo sapiens
cgagctcctgggg

SEQ ID NO: 4494104 - DNA, 15 bp, Homo sapiens
cgagctggatgtccc

SEQ ID NO: 4494105 - DNA, 21 bp, Homo sapiens
cgagctgtttatgtttttata

SEQ ID NO: 4494106 - DNA, 23 bp, Homo sapiens
cgggtccggcctctccctgcctg

SEQ ID NO: 4494107 - DNA, 15 bp, Homo sapiens
cgggtgatggccagc

SEQ ID NO: 4494108 - DNA, 16 bp, Homo sapiens
cgggtgccagaagcta

SEQ ID NO: 4494109 - DNA, 18 bp, Homo sapiens
cgggtggctagtcagaga

SEQ ID NO: 4494110 - DNA, 17 bp, Homo sapiens
cgggtgtggcctcagcc

SEQ ID NO: 4494111 - DNA, 20 bp, Homo sapiens
cgggtgtggcctcagccctc

SEQ ID NO: 4494112 - DNA, 22 bp, Homo sapiens
cgggtgtggcctcagccctcag

SEQ ID NO: 4494113 - DNA, 21 bp, Homo sapiens
cgggttctagacgcccctccc

SEQ ID NO: 4494114 - DNA, 20 bp, Homo sapiens
cggtaaaacaccggagacta

SEQ ID NO: 4494115 - DNA, 23 bp, Homo sapiens
cggtacactacgcactggacagc

SEQ ID NO: 4494116 - DNA, 22 bp, Homo sapiens
cggtaccttccatacacagagg

SEQ ID NO: 4494117 - DNA, 12 bp, Homo sapiens
cggtcactgatg

SEQ ID NO: 4494118 - DNA, 20 bp, Homo sapiens
cggtcagccaagtgcagagt

SEQ ID NO: 4494119 - DNA, 11 bp, Homo sapiens
cggtccacagg

SEQ ID NO: 4494120 - DNA, 19 bp, Homo sapiens
cggtccacaggtccaagga

SEQ ID NO: 4494121 - DNA, 16 bp, Homo sapiens
cggtcccccagagcat

SEQ ID NO: 4494122 - DNA, 21 bp, Homo sapiens
cggtcccccagagcatctgcc

SEQ ID NO: 4494123 - DNA, 13 bp, Homo sapiens
cggtccctgtccc

SEQ ID NO: 4494124 - DNA, 21 bp, Homo sapiens
cggtcccttgagacctcagcc

SEQ ID NO: 4494125 - DNA, 19 bp, Homo sapiens
cggtcgccccgtgtttgcg

SEQ ID NO: 4494126 - DNA, 15 bp, Homo sapiens
cggtcgggcagccag

SEQ ID NO: 4494127 - DNA, 22 bp, Homo sapiens
cggtcgggttttattgtttaaa

SEQ ID NO: 4494128 - DNA, 18 bp, Homo sapiens
cggtctccaccccagggt

SEQ ID NO: 4494129 - DNA, 18 bp, Homo sapiens
cggtgaggagtccagcac

SEQ ID NO: 4494130 - DNA, 16 bp, Homo sapiens
cggtgccagctgccct

SEQ ID NO: 4494131 - DNA, 20 bp, Homo sapiens
cggtgcctgggtggggctgc

SEQ ID NO: 4494132 - DNA, 16 bp, Homo sapiens
cggtgctccatctccg

SEQ ID NO: 4494133 - DNA, 13 bp, Homo sapiens
cggtgctgcagga

SEQ ID NO: 4494134 - DNA, 17 bp, Homo sapiens
cggtggtgcccgtgccc

SEQ ID NO: 4494135 - DNA, 22 bp, Homo sapiens
cggtggtgcccgtgcccgcagg

SEQ ID NO: 4494136 - DNA, 16 bp, Homo sapiens
cggtgtgctgccaact

SEQ ID NO: 4494137 - DNA, 18 bp, Homo sapiens
cggttaagaaagcactta

SEQ ID NO: 4494138 - DNA, 17 bp, Homo sapiens
cggttcagacccctgcc

SEQ ID NO: 4494139 - DNA, 19 bp, Homo sapiens
cggttcagacccctgcctg

SEQ ID NO: 4494140 - DNA, 21 bp, Homo sapiens
cggttgttgatattgtttgct

SEQ ID NO: 4494141 - DNA, 22 bp, Homo sapiens
cggttgttgatattgtttgctg

SEQ ID NO: 4494142 - DNA, 12 bp, Homo sapiens
cgtaaactatga

SEQ ID NO: 4494143 - DNA, 12 bp, Homo sapiens
cgtaaccagcca

SEQ ID NO: 4494144 - DNA, 23 bp, Homo sapiens
cgtaaccagccagatcctcttgg

SEQ ID NO: 4494145 - DNA, 12 bp, Homo sapiens
cgtaaggatgtg

SEQ ID NO: 4494146 - DNA, 14 bp, Homo sapiens
cgtaatagctcaga

SEQ ID NO: 4494147 - DNA, 12 bp, Homo sapiens
cgtaatttaact

SEQ ID NO: 4494148 - DNA, 14 bp, Homo sapiens
cgtacatctgcaat

SEQ ID NO: 4494149 - DNA, 14 bp, Homo sapiens
cgtacatgtgaggc

SEQ ID NO: 4494150 - DNA, 21 bp, Homo sapiens
cgtagagtgacctcggacaga

SEQ ID NO: 4494151 - DNA, 22 bp, Homo sapiens
cgtagcctgggctcactgtgct

SEQ ID NO: 4494152 - DNA, 14 bp, Homo sapiens
cgtagctcccctgg

SEQ ID NO: 4494153 - DNA, 16 bp, Homo sapiens
cgtagctcccctggct

SEQ ID NO: 4494154 - DNA, 17 bp, Homo sapiens
cgtagctcccctggctg

SEQ ID NO: 4494155 - DNA, 16 bp, Homo sapiens
cgtaggacaagtttta

SEQ ID NO: 4494156 - DNA, 15 bp, Homo sapiens
cgtataaatatcagt

SEQ ID NO: 4494157 - DNA, 12 bp, Homo sapiens
cgtatctgccct

SEQ ID NO: 4494158 - DNA, 13 bp, Homo sapiens
cgtcaagacattt

SEQ ID NO: 4494159 - DNA, 17 bp, Homo sapiens
cgtcaagagcatgcaca

SEQ ID NO: 4494160 - DNA, 18 bp, Homo sapiens
cgtcagcctccagcctct

SEQ ID NO: 4494161 - DNA, 16 bp, Homo sapiens
cgtcagcttctcccaa

SEQ ID NO: 4494162 - DNA, 23 bp, Homo sapiens
cgtcaggcctggcctcatctcag

SEQ ID NO: 4494163 - DNA, 16 bp, Homo sapiens
cgtccaccctgagctc

SEQ ID NO: 4494164 - DNA, 11 bp, Homo sapiens
cgtccaggtcc

SEQ ID NO: 4494165 - DNA, 20 bp, Homo sapiens
cgtccaggtccgtagctccc

SEQ ID NO: 4494166 - DNA, 23 bp, Homo sapiens
cgtccaggtccgtagctcccctg

SEQ ID NO: 4494167 - DNA, 18 bp, Homo sapiens
cgtccatagcagtacccc

SEQ ID NO: 4494168 - DNA, 23 bp, Homo sapiens
cgtccatcacgttagctgtccca

SEQ ID NO: 4494169 - DNA, 18 bp, Homo sapiens
cgtccatccgactgcccc

SEQ ID NO: 4494170 - DNA, 17 bp, Homo sapiens
cgtcccagcatccctgg

SEQ ID NO: 4494171 - DNA, 21 bp, Homo sapiens
cgtccccagttgccgtctagg

SEQ ID NO: 4494172 - DNA, 15 bp, Homo sapiens
cgtcccctccgccgt

SEQ ID NO: 4494173 - DNA, 18 bp, Homo sapiens
cgtcccctccgccgtgcc

SEQ ID NO: 4494174 - DNA, 21 bp, Homo sapiens
cgtcctccctgatcccacccc

SEQ ID NO: 4494175 - DNA, 17 bp, Homo sapiens
cgtcggactgcccccag

SEQ ID NO: 4494176 - DNA, 19 bp, Homo sapiens
cgtcggactgcccccagaa

SEQ ID NO: 4494177 - DNA, 17 bp, Homo sapiens
cgtctaatgggggcagt

SEQ ID NO: 4494178 - DNA, 18 bp, Homo sapiens
cgtctctctcccatggag

SEQ ID NO: 4494179 - DNA, 14 bp, Homo sapiens
cgtctggggtgtgg

SEQ ID NO: 4494180 - DNA, 13 bp, Homo sapiens
cgtcttccctgct

SEQ ID NO: 4494181 - DNA, 17 bp, Homo sapiens
cgtcttctccctattcc

SEQ ID NO: 4494182 - DNA, 16 bp, Homo sapiens
cgtcttggtgtaattt

SEQ ID NO: 4494183 - DNA, 14 bp, Homo sapiens
cgtgaatgtctcag

SEQ ID NO: 4494184 - DNA, 15 bp, Homo sapiens
cgtgaatgtctcagc

SEQ ID NO: 4494185 - DNA, 22 bp, Homo sapiens
cgtgacggagcccacactgcca

SEQ ID NO: 4494186 - DNA, 18 bp, Homo sapiens
cgtgactcacccaagcat

SEQ ID NO: 4494187 - DNA, 17 bp, Homo sapiens
cgtgactgccccaactc

SEQ ID NO: 4494188 - DNA, 21 bp, Homo sapiens
cgtgactgccccaactcctgg

SEQ ID NO: 4494189 - DNA, 14 bp, Homo sapiens
cgtgagacacaaga

SEQ ID NO: 4494190 - DNA, 18 bp, Homo sapiens
cgtgagcaccaccagggc

SEQ ID NO: 4494191 - DNA, 21 bp, Homo sapiens
cgtgagcaccaccagggctcc

SEQ ID NO: 4494192 - DNA, 14 bp, Homo sapiens
cgtgagcatgcaca

SEQ ID NO: 4494193 - DNA, 21 bp, Homo sapiens
cgtgagccactgcgcccggcc

SEQ ID NO: 4494194 - DNA, 22 bp, Homo sapiens
cgtgagctggggactcagggac

SEQ ID NO: 4494195 - DNA, 16 bp, Homo sapiens
cgtgagtcatttaaat

SEQ ID NO: 4494196 - DNA, 20 bp, Homo sapiens
cgtgatgtggaggaagagcc

SEQ ID NO: 4494197 - DNA, 18 bp, Homo sapiens
cgtgattttgctgtagaa

SEQ ID NO: 4494198 - DNA, 20 bp, Homo sapiens
cgtgcatcccccctgctcag

SEQ ID NO: 4494199 - DNA, 20 bp, Homo sapiens
cgtgcattaaaatttcttat

SEQ ID NO: 4494200 - DNA, 16 bp, Homo sapiens
cgtgccatgatctgta

SEQ ID NO: 4494201 - DNA, 15 bp, Homo sapiens
cgtgcccccctcctc

SEQ ID NO: 4494202 - DNA, 19 bp, Homo sapiens
cgtgccctcgtcagctggg

SEQ ID NO: 4494203 - DNA, 19 bp, Homo sapiens
cgtgccgttactctccaac

SEQ ID NO: 4494204 - DNA, 14 bp, Homo sapiens
cgtgcgcactgcat

SEQ ID NO: 4494205 - DNA, 21 bp, Homo sapiens
cgtgcgcccgtggggtctgcg

SEQ ID NO: 4494206 - DNA, 20 bp, Homo sapiens
cgtggaacgtttttcctgtt

SEQ ID NO: 4494207 - DNA, 21 bp, Homo sapiens
cgtggactgagtgggaagccc

SEQ ID NO: 4494208 - DNA, 14 bp, Homo sapiens
cgtggactgtgctg

SEQ ID NO: 4494209 - DNA, 13 bp, Homo sapiens
cgtggagatagtg

SEQ ID NO: 4494210 - DNA, 16 bp, Homo sapiens
cgtggagatagtgcca

SEQ ID NO: 4494211 - DNA, 21 bp, Homo sapiens
cgtggagatagtgccaggtgg

SEQ ID NO: 4494212 - DNA, 22 bp, Homo sapiens
cgtggagatagtgccaggtggc

SEQ ID NO: 4494213 - DNA, 17 bp, Homo sapiens
cgtggaggaggaaggca

SEQ ID NO: 4494214 - DNA, 23 bp, Homo sapiens
cgtggctgtggcatccagagtcc

SEQ ID NO: 4494215 - DNA, 18 bp, Homo sapiens
cgtggcttccctgtccca

SEQ ID NO: 4494216 - DNA, 13 bp, Homo sapiens
cgtgggaccctca

SEQ ID NO: 4494217 - DNA, 17 bp, Homo sapiens
cgtgggcggggccttgc

SEQ ID NO: 4494218 - DNA, 13 bp, Homo sapiens
cgtgggctccctg

SEQ ID NO: 4494219 - DNA, 20 bp, Homo sapiens
cgtggggaacggaggaggac

SEQ ID NO: 4494220 - DNA, 23 bp, Homo sapiens
cgtggggtgcgggatacagctga

SEQ ID NO: 4494221 - DNA, 18 bp, Homo sapiens
cgtgggtgggcctggccc

SEQ ID NO: 4494222 - DNA, 18 bp, Homo sapiens
ctaacattatattgcaat

SEQ ID NO: 4494223 - DNA, 10 bp, Homo sapiens
ctaaccaagt

SEQ ID NO: 4494224 - DNA, 12 bp, Homo sapiens
ctaaccaagttc

SEQ ID NO: 4494225 - DNA, 15 bp, Homo sapiens
ctaaccaatgccttt

SEQ ID NO: 4494226 - DNA, 23 bp, Homo sapiens
ctaaccacttcgcacacacccat

SEQ ID NO: 4494227 - DNA, 14 bp, Homo sapiens
ctaaccatccccaa

SEQ ID NO: 4494228 - DNA, 15 bp, Homo sapiens
ctaaccatccccaac

SEQ ID NO: 4494229 - DNA, 23 bp, Homo sapiens
ctaacccaagacatgacattctt

SEQ ID NO: 4494230 - DNA, 19 bp, Homo sapiens
ctaacccaggtatccaaaa

SEQ ID NO: 4494231 - DNA, 20 bp, Homo sapiens
ctaaccccagggcactgcca

SEQ ID NO: 4494232 - DNA, 22 bp, Homo sapiens
ctaacccccagcccacagagcc

SEQ ID NO: 4494233 - DNA, 13 bp, Homo sapiens
ctaacccctttcc

SEQ ID NO: 4494234 - DNA, 12 bp, Homo sapiens
ctaacctcatct

SEQ ID NO: 4494235 - DNA, 21 bp, Homo sapiens
ctaacctgaccgtgggcgggg

SEQ ID NO: 4494236 - DNA, 15 bp, Homo sapiens
ctaactaactggcag

SEQ ID NO: 4494237 - DNA, 23 bp, Homo sapiens
ctaactcctgccattcttctggt

SEQ ID NO: 4494238 - DNA, 13 bp, Homo sapiens
ctaactggaagca

SEQ ID NO: 4494239 - DNA, 13 bp, Homo sapiens
ctaactgtaaatc

SEQ ID NO: 4494240 - DNA, 13 bp, Homo sapiens
ctaacttatggac

SEQ ID NO: 4494241 - DNA, 17 bp, Homo sapiens
ctaacttcctgtgcctt

SEQ ID NO: 4494242 - DNA, 12 bp, Homo sapiens
ctaactttgtaa

SEQ ID NO: 4494243 - DNA, 18 bp, Homo sapiens
ctaagaaaaaaagcacaa

SEQ ID NO: 4494244 - DNA, 22 bp, Homo sapiens
ctaagaaaaaaagcacaaagtt

SEQ ID NO: 4494245 - DNA, 22 bp, Homo sapiens
ctaagaaatatctgtgaaatat

SEQ ID NO: 4494246 - DNA, 21 bp, Homo sapiens
ctaagaaatcaagtaatgaat

SEQ ID NO: 4494247 - DNA, 14 bp, Homo sapiens
ctaagaacccctct

SEQ ID NO: 4494248 - DNA, 13 bp, Homo sapiens
ctaagaagacatt

SEQ ID NO: 4494249 - DNA, 22 bp, Homo sapiens
ctaagacaagaacattctctca

SEQ ID NO: 4494250 - DNA, 16 bp, Homo sapiens
ctaagacatttttcat

SEQ ID NO: 4494251 - DNA, 19 bp, Homo sapiens
ctaagactctgtgtggctg

SEQ ID NO: 4494252 - DNA, 22 bp, Homo sapiens
ctaagactctgtgtggctgtgc

SEQ ID NO: 4494253 - DNA, 11 bp, Homo sapiens
ctaagagaagt

SEQ ID NO: 4494254 - DNA, 13 bp, Homo sapiens
ctaagagaagtag

SEQ ID NO: 4494255 - DNA, 17 bp, Homo sapiens
ctaagagaagtagaaat

SEQ ID NO: 4494256 - DNA, 22 bp, Homo sapiens
ctaagagaagttattttctaca

SEQ ID NO: 4494257 - DNA, 23 bp, Homo sapiens
ctaagatacactgcactttgttt

SEQ ID NO: 4494258 - DNA, 20 bp, Homo sapiens
ctaagatgtgttcttatttt

SEQ ID NO: 4494259 - DNA, 19 bp, Homo sapiens
ctaagattacaaatcagaa

SEQ ID NO: 4494260 - DNA, 22 bp, Homo sapiens
ctaagattacaaatcagaagtc

SEQ ID NO: 4494261 - DNA, 23 bp, Homo sapiens
ctaagattacaaatcagaagtca

SEQ ID NO: 4494262 - DNA, 19 bp, Homo sapiens
ctaagattccttttgtcaa

SEQ ID NO: 4494263 - DNA, 12 bp, Homo sapiens
ctaagattcttt

SEQ ID NO: 4494264 - DNA, 21 bp, Homo sapiens
ctaagcaagtgaactcatccc

SEQ ID NO: 4494265 - DNA, 19 bp, Homo sapiens
ctaagcatgtgtcccagga

SEQ ID NO: 4494266 - DNA, 15 bp, Homo sapiens
ctaagccaggcctgg

SEQ ID NO: 4494267 - DNA, 22 bp, Homo sapiens
ctaagccaggcctggctggagg

SEQ ID NO: 4494268 - DNA, 20 bp, Homo sapiens
ctaagcctacctgctctcca

SEQ ID NO: 4494269 - DNA, 23 bp, Homo sapiens
ctaagcctacctgctctccaagt

SEQ ID NO: 4494270 - DNA, 20 bp, Homo sapiens
ctaaggaagtatcagcacta

SEQ ID NO: 4494271 - DNA, 17 bp, Homo sapiens
ctaaggaggggaaaaaa

SEQ ID NO: 4494272 - DNA, 22 bp, Homo sapiens
ctaaggaggggaaaaaaatgtt

SEQ ID NO: 4494273 - DNA, 23 bp, Homo sapiens
ctaaggagtgtagcaactacagt

SEQ ID NO: 4494274 - DNA, 14 bp, Homo sapiens
ctaaggcaggagga

SEQ ID NO: 4494275 - DNA, 15 bp, Homo sapiens
ctaagggcttgtttt

SEQ ID NO: 4494276 - DNA, 23 bp, Homo sapiens
ctaagggcttgtttttcttcagc

SEQ ID NO: 4494277 - DNA, 19 bp, Homo sapiens
ctaaggtctcatgctgttg

SEQ ID NO: 4494278 - DNA, 15 bp, Homo sapiens
ctaaggttcttgctt

SEQ ID NO: 4494279 - DNA, 18 bp, Homo sapiens
ctaaggttcttgctttct

SEQ ID NO: 4494280 - DNA, 20 bp, Homo sapiens
ctaagtaaaaccacagcagt

SEQ ID NO: 4494281 - DNA, 23 bp, Homo sapiens
ctaagtaaaaccacagcagttga

SEQ ID NO: 4494282 - DNA, 19 bp, Homo sapiens
ctaagtacacaataagcaa

SEQ ID NO: 4494283 - DNA, 14 bp, Homo sapiens
ctaagtctttccat

SEQ ID NO: 4494284 - DNA, 16 bp, Homo sapiens
ctaagtgaaatttcta

SEQ ID NO: 4494285 - DNA, 17 bp, Homo sapiens
ctaagtgcttattacat

SEQ ID NO: 4494286 - DNA, 21 bp, Homo sapiens
ctaagtgcttattacatttta

SEQ ID NO: 4494287 - DNA, 22 bp, Homo sapiens
ctaagtggctgccttctttcca

SEQ ID NO: 4494288 - DNA, 18 bp, Homo sapiens
ctaagtttagaagcgctc

SEQ ID NO: 4494289 - DNA, 15 bp, Homo sapiens
ctaataaaataagtg

SEQ ID NO: 4494290 - DNA, 22 bp, Homo sapiens
ctaataatgagctattaaaact

SEQ ID NO: 4494291 - DNA, 22 bp, Homo sapiens
ctaatacgtgccagatataact

SEQ ID NO: 4494292 - DNA, 23 bp, Homo sapiens
ctaatacgtgccagatataactg

SEQ ID NO: 4494293 - DNA, 13 bp, Homo sapiens
ctaatatatttaa

SEQ ID NO: 4494294 - DNA, 15 bp, Homo sapiens
ctaatatcaaatgca

SEQ ID NO: 4494295 - DNA, 23 bp, Homo sapiens
ctaatatcaaatgcagtatattt

SEQ ID NO: 4494296 - DNA, 17 bp, Homo sapiens
ctaatatccccaaatta

SEQ ID NO: 4494297 - DNA, 15 bp, Homo sapiens
ctaatatgattatac

SEQ ID NO: 4494298 - DNA, 17 bp, Homo sapiens
ctaatatgattatacaa

SEQ ID NO: 4494299 - DNA, 17 bp, Homo sapiens
ctaatattgcttcttgt

SEQ ID NO: 4494300 - DNA, 14 bp, Homo sapiens
ctaatattttatgt

SEQ ID NO: 4494301 - DNA, 20 bp, Homo sapiens
ctaatcacaaactgaatgac

SEQ ID NO: 4494302 - DNA, 15 bp, Homo sapiens
ctaatcaccatgtaa

SEQ ID NO: 4494303 - DNA, 12 bp, Homo sapiens
ctaatcagattg

SEQ ID NO: 4494304 - DNA, 22 bp, Homo sapiens
ctaatcatacaccagaagacaa

SEQ ID NO: 4494305 - DNA, 15 bp, Homo sapiens
ctaatccttttcctt

SEQ ID NO: 4494306 - DNA, 19 bp, Homo sapiens
ctaatctgcctggttttat

SEQ ID NO: 4494307 - DNA, 13 bp, Homo sapiens
ctaatgaaagtga

SEQ ID NO: 4494308 - DNA, 20 bp, Homo sapiens
ctaatgaaagtgatgacata

SEQ ID NO: 4494309 - DNA, 17 bp, Homo sapiens
ctaatgagcatttcctt

SEQ ID NO: 4494310 - DNA, 19 bp, Homo sapiens
ctaatgaggagagaaaata

SEQ ID NO: 4494311 - DNA, 23 bp, Homo sapiens
ctaatgaggagagaaaatatatg

SEQ ID NO: 4494312 - DNA, 15 bp, Homo sapiens
ctaatgatttagtgt

SEQ ID NO: 4494313 - DNA, 16 bp, Homo sapiens
ctaatgcttgtttatg

SEQ ID NO: 4494314 - DNA, 17 bp, Homo sapiens
ctaatgcttgtttatga

SEQ ID NO: 4494315 - DNA, 20 bp, Homo sapiens
ctaatgggggcagtctcccc

SEQ ID NO: 4494316 - DNA, 21 bp, Homo sapiens
ctaatgggggcagtctcccct

SEQ ID NO: 4494317 - DNA, 15 bp, Homo sapiens
ctaatggttgtacat

SEQ ID NO: 4494318 - DNA, 16 bp, Homo sapiens
ctaatggttgtacata

SEQ ID NO: 4494319 - DNA, 17 bp, Homo sapiens
ctaatgtgatcatatga

SEQ ID NO: 4494320 - DNA, 21 bp, Homo sapiens
ctaattaatagccaaagattt

SEQ ID NO: 4494321 - DNA, 18 bp, Homo sapiens
ctaattaatatattaaaa

SEQ ID NO: 4494322 - DNA, 16 bp, Homo sapiens
ctaattatactacttt

SEQ ID NO: 4494323 - DNA, 15 bp, Homo sapiens
ctaattcaattcaaa

SEQ ID NO: 4494324 - DNA, 15 bp, Homo sapiens
ctaattcacagtgct

SEQ ID NO: 4494325 - DNA, 15 bp, Homo sapiens
ctaattccacacctt

SEQ ID NO: 4494326 - DNA, 17 bp, Homo sapiens
ctaattcccaacatttc

SEQ ID NO: 4494327 - DNA, 13 bp, Homo sapiens
ctaattctgggaa

SEQ ID NO: 4494328 - DNA, 17 bp, Homo sapiens
ctaattgactttagaaa

SEQ ID NO: 4494329 - DNA, 16 bp, Homo sapiens
ctaattggaaagtgcc

SEQ ID NO: 4494330 - DNA, 22 bp, Homo sapiens
ctaattggaaagtgccagcatt

SEQ ID NO: 4494331 - DNA, 13 bp, Homo sapiens
ctaatttataaaa

SEQ ID NO: 4494332 - DNA, 12 bp, Homo sapiens
ctaatttgcatt

SEQ ID NO: 4494333 - DNA, 19 bp, Homo sapiens
ctaatttgcattaaattca

SEQ ID NO: 4494334 - DNA, 23 bp, Homo sapiens
ctaatttttaagaaattttgcct

SEQ ID NO: 4494335 - DNA, 19 bp, Homo sapiens
ctaatttttgtattatttt

SEQ ID NO: 4494336 - DNA, 20 bp, Homo sapiens
ctaatttttgtatttttagt

SEQ ID NO: 4494337 - DNA, 22 bp, Homo sapiens
ctacaaaataaaacttggttct

SEQ ID NO: 4494338 - DNA, 20 bp, Homo sapiens
ctacaaacaaaatttctatt

SEQ ID NO: 4494339 - DNA, 22 bp, Homo sapiens
cctctttgtctgcgtgggtcag

SEQ ID NO: 4494340 - DNA, 12 bp, Homo sapiens
cctcttttcctg

SEQ ID NO: 4494341 - DNA, 19 bp, Homo sapiens
cctcttttcctggcagctg

SEQ ID NO: 4494342 - DNA, 20 bp, Homo sapiens
cctcttttcctggcagctgc

SEQ ID NO: 4494343 - DNA, 22 bp, Homo sapiens
cctcttttgtattgtttctaca

SEQ ID NO: 4494344 - DNA, 17 bp, Homo sapiens
cctctttttcctcctgg

SEQ ID NO: 4494345 - DNA, 18 bp, Homo sapiens
cctctttttcctcctgga

SEQ ID NO: 4494346 - DNA, 13 bp, Homo sapiens
cctgaaaacccag

SEQ ID NO: 4494347 - DNA, 17 bp, Homo sapiens
cctgaaaacccagagag

SEQ ID NO: 4494348 - DNA, 22 bp, Homo sapiens
cctgaaaatgtttttctgccag

SEQ ID NO: 4494349 - DNA, 23 bp, Homo sapiens
cctgaaaatgtttttctgccagg

SEQ ID NO: 4494350 - DNA, 21 bp, Homo sapiens
cctgaaacctcttcctaggcc

SEQ ID NO: 4494351 - DNA, 13 bp, Homo sapiens
cctgaaagaggaa

SEQ ID NO: 4494352 - DNA, 18 bp, Homo sapiens
cctgaaagaggaatgaag

SEQ ID NO: 4494353 - DNA, 23 bp, Homo sapiens
cctgaaagaggaatgaagtactc

SEQ ID NO: 4494354 - DNA, 13 bp, Homo sapiens
cctgaaaggcaac

SEQ ID NO: 4494355 - DNA, 15 bp, Homo sapiens
cctgaaataatatat

SEQ ID NO: 4494356 - DNA, 20 bp, Homo sapiens
cctgaacagccctctctctc

SEQ ID NO: 4494357 - DNA, 13 bp, Homo sapiens
cctgaactccaga

SEQ ID NO: 4494358 - DNA, 17 bp, Homo sapiens
cctgaactttctccctc

SEQ ID NO: 4494359 - DNA, 18 bp, Homo sapiens
cctgaactttctccctca

SEQ ID NO: 4494360 - DNA, 14 bp, Homo sapiens
cctgaagctgctgt

SEQ ID NO: 4494361 - DNA, 16 bp, Homo sapiens
cctgaagctgctgtgt

SEQ ID NO: 4494362 - DNA, 23 bp, Homo sapiens
cctgaagcttcggccgcgccacc

SEQ ID NO: 4494363 - DNA, 18 bp, Homo sapiens
cctgaaggcacagctaac

SEQ ID NO: 4494364 - DNA, 12 bp, Homo sapiens
cctgaagggtgg

SEQ ID NO: 4494365 - DNA, 13 bp, Homo sapiens
cctgaagggtgga

SEQ ID NO: 4494366 - DNA, 22 bp, Homo sapiens
cctgaagggtggatgtgctgga

SEQ ID NO: 4494367 - DNA, 12 bp, Homo sapiens
cctgaagtattt

SEQ ID NO: 4494368 - DNA, 21 bp, Homo sapiens
cctgaatccaaactaatccat

SEQ ID NO: 4494369 - DNA, 22 bp, Homo sapiens
cctgaatcccccttgccacccc

SEQ ID NO: 4494370 - DNA, 21 bp, Homo sapiens
cctgaatctgctgagaggcac

SEQ ID NO: 4494371 - DNA, 20 bp, Homo sapiens
ccttctctacactcttgtaa

SEQ ID NO: 4494372 - DNA, 12 bp, Homo sapiens
ccttctctcaag

SEQ ID NO: 4494373 - DNA, 20 bp, Homo sapiens
ccttctctcacttctaaatt

SEQ ID NO: 4494374 - DNA, 16 bp, Homo sapiens
ccttctctcatctctt

SEQ ID NO: 4494375 - DNA, 16 bp, Homo sapiens
ccttctctcctcccca

SEQ ID NO: 4494376 - DNA, 14 bp, Homo sapiens
ccttctctgctcca

SEQ ID NO: 4494377 - DNA, 23 bp, Homo sapiens
ccttctgatcttggaaaaacagc

SEQ ID NO: 4494378 - DNA, 20 bp, Homo sapiens
ccttctgccaccagcccctc

SEQ ID NO: 4494379 - DNA, 22 bp, Homo sapiens
ccttctggagctgggagacaaa

SEQ ID NO: 4494380 - DNA, 13 bp, Homo sapiens
ccttctgggcttt

SEQ ID NO: 4494381 - DNA, 16 bp, Homo sapiens
ccttctgggctttttc

SEQ ID NO: 4494382 - DNA, 17 bp, Homo sapiens
ccttcttattctcactc

SEQ ID NO: 4494383 - DNA, 18 bp, Homo sapiens
ccttcttattctcactcc

SEQ ID NO: 4494384 - DNA, 17 bp, Homo sapiens
ccttgaaaaaaaacagt

SEQ ID NO: 4494385 - DNA, 20 bp, Homo sapiens
ccttgacctgcattgtaaat

SEQ ID NO: 4494386 - DNA, 13 bp, Homo sapiens
ccttgagccctgg

SEQ ID NO: 4494387 - DNA, 22 bp, Homo sapiens
ccttgagccctggctgttctgt

SEQ ID NO: 4494388 - DNA, 19 bp, Homo sapiens
ccttgattgattagataaa

SEQ ID NO: 4494389 - DNA, 15 bp, Homo sapiens
ccttgcagcggctcc

SEQ ID NO: 4494390 - DNA, 18 bp, Homo sapiens
ccttgcagcggctcctgc

SEQ ID NO: 4494391 - DNA, 13 bp, Homo sapiens
ccttgccacccca

SEQ ID NO: 4494392 - DNA, 23 bp, Homo sapiens
ccttgccaccccaccctccctgg

SEQ ID NO: 4494393 - DNA, 24 bp, Homo sapiens
ccttgccaccccaccctccctgga

SEQ ID NO: 4494394 - DNA, 14 bp, Homo sapiens
ccttgcccagagat

SEQ ID NO: 4494395 - DNA, 19 bp, Homo sapiens
ccttgcccagagatgcctc

SEQ ID NO: 4494396 - DNA, 23 bp, Homo sapiens
ccttgcccagagatgcctccacc

SEQ ID NO: 4494397 - DNA, 21 bp, Homo sapiens
ccttgccttgaaatttacaca

SEQ ID NO: 4494398 - DNA, 14 bp, Homo sapiens
ccttgcgcctcagc

SEQ ID NO: 4494399 - DNA, 18 bp, Homo sapiens
ccttgctctcctcatctc

SEQ ID NO: 4494400 - DNA, 17 bp, Homo sapiens
ccttgctctcttcaata

SEQ ID NO: 4494401 - DNA, 20 bp, Homo sapiens
ccttgctctcttcaataaac

SEQ ID NO: 4494402 - DNA, 22 bp, Homo sapiens
ccttgctgcaagcacagccctt

SEQ ID NO: 4494403 - DNA, 11 bp, Homo sapiens
ccttgctgccc

SEQ ID NO: 4494404 - DNA, 15 bp, Homo sapiens
ccttgctttcctggg

SEQ ID NO: 4494405 - DNA, 21 bp, Homo sapiens
ccttgcttttgcttctagagc

SEQ ID NO: 4494406 - DNA, 16 bp, Homo sapiens
ccttggaaccagcccc

SEQ ID NO: 4494407 - DNA, 17 bp, Homo sapiens
ccttggaaccagcccca

SEQ ID NO: 4494408 - DNA, 16 bp, Homo sapiens
ccttggagtcccaggg

SEQ ID NO: 4494409 - DNA, 18 bp, Homo sapiens
ccttggataatgctgttg

SEQ ID NO: 4494410 - DNA, 18 bp, Homo sapiens
ccttggcacccccatgct

SEQ ID NO: 4494411 - DNA, 16 bp, Homo sapiens
ccttggcatagacatg

SEQ ID NO: 4494412 - DNA, 17 bp, Homo sapiens
ccttggccacagactga

SEQ ID NO: 4494413 - DNA, 15 bp, Homo sapiens
ccttggccatgcaga

SEQ ID NO: 4494414 - DNA, 11 bp, Homo sapiens
ccttggcctca

SEQ ID NO: 4494415 - DNA, 14 bp, Homo sapiens
ccttggcctcagaa

SEQ ID NO: 4494416 - DNA, 23 bp, Homo sapiens
ccttggcctgtctcatccccagg

SEQ ID NO: 4494417 - DNA, 21 bp, Homo sapiens
ccttggctatgaaaatgagcc

SEQ ID NO: 4494418 - DNA, 23 bp, Homo sapiens
ccttggctatgaaaatgagccct

SEQ ID NO: 4494419 - DNA, 17 bp, Homo sapiens
ccttggctttcagagcc

SEQ ID NO: 4494420 - DNA, 22 bp, Homo sapiens
ccttggctttcagagccagcct

SEQ ID NO: 4494421 - DNA, 23 bp, Homo sapiens
ccttgggaggttttattctgact

SEQ ID NO: 4494422 - DNA, 13 bp, Homo sapiens
ccttgggctccct

SEQ ID NO: 4494423 - DNA, 21 bp, Homo sapiens
ccttggggtaagccagagcct

SEQ ID NO: 4494424 - DNA, 20 bp, Homo sapiens
ccttggggtccctccacccc

SEQ ID NO: 4494425 - DNA, 13 bp, Homo sapiens
ccttgggtccccc

SEQ ID NO: 4494426 - DNA, 14 bp, Homo sapiens
ccttggtcctggca

SEQ ID NO: 4494427 - DNA, 15 bp, Homo sapiens
ccttggtgcctctgg

SEQ ID NO: 4494428 - DNA, 17 bp, Homo sapiens
ccttggtgtccacctgg

SEQ ID NO: 4494429 - DNA, 20 bp, Homo sapiens
ccttggtgtccacctggccc

SEQ ID NO: 4494430 - DNA, 21 bp, Homo sapiens
ccttggttgtctggcaaggac

SEQ ID NO: 4494431 - DNA, 18 bp, Homo sapiens
ccttgtataatattgaaa

SEQ ID NO: 4494432 - DNA, 12 bp, Homo sapiens
ccttgtctctgg

SEQ ID NO: 4494433 - DNA, 21 bp, Homo sapiens
ccttgtgacttacaatttgca

SEQ ID NO: 4494434 - DNA, 16 bp, Homo sapiens
ccttgtgagagcccat

SEQ ID NO: 4494435 - DNA, 20 bp, Homo sapiens
ccttgtgttgcactgaacag

SEQ ID NO: 4494436 - DNA, 21 bp, Homo sapiens
ccttgtgttgcactgaacagg

SEQ ID NO: 4494437 - DNA, 13 bp, Homo sapiens
ccttgtttaatgg

SEQ ID NO: 4494438 - DNA, 12 bp, Homo sapiens
ccttgtttatta

SEQ ID NO: 4494439 - DNA, 22 bp, Homo sapiens
ccttgtttgattttagctgcag

SEQ ID NO: 4494440 - DNA, 19 bp, Homo sapiens
cctttaactgacaagccat

SEQ ID NO: 4494441 - DNA, 23 bp, Homo sapiens
cctttaacttttttttctctctt

SEQ ID NO: 4494442 - DNA, 21 bp, Homo sapiens
cctttaagaaccttaatgaca

SEQ ID NO: 4494443 - DNA, 21 bp, Homo sapiens
cctttaatattttgtaatatt

SEQ ID NO: 4494444 - DNA, 18 bp, Homo sapiens
cctttacaagggagaaga

SEQ ID NO: 4494445 - DNA, 15 bp, Homo sapiens
cctttacgttcatca

SEQ ID NO: 4494446 - DNA, 18 bp, Homo sapiens
cctttagcacgtttaaag

SEQ ID NO: 4494447 - DNA, 20 bp, Homo sapiens
cctttagcacgtttaaagtt

SEQ ID NO: 4494448 - DNA, 21 bp, Homo sapiens
cctttagcacgtttaaagttc

SEQ ID NO: 4494449 - DNA, 23 bp, Homo sapiens
cctttagcacgtttaaagttctg

SEQ ID NO: 4494450 - DNA, 15 bp, Homo sapiens
cctttaggtctggtt

SEQ ID NO: 4494451 - DNA, 11 bp, Homo sapiens
cctttatttat

SEQ ID NO: 4494452 - DNA, 18 bp, Homo sapiens
cctttatttattaaactt

SEQ ID NO: 4494453 - DNA, 19 bp, Homo sapiens
cctttatttattaaacttc

SEQ ID NO: 4494454 - DNA, 20 bp, Homo sapiens
cctttatttattaaacttca

SEQ ID NO: 4494455 - DNA, 22 bp, Homo sapiens
cctttcaaatttagaaactaat

SEQ ID NO: 4494456 - DNA, 17 bp, Homo sapiens
cctttcaccctcatgaa

SEQ ID NO: 4494457 - DNA, 17 bp, Homo sapiens
cctttcagatgtcttct

SEQ ID NO: 4494458 - DNA, 19 bp, Homo sapiens
cctttcagatgtcttctgc

SEQ ID NO: 4494459 - DNA, 19 bp, Homo sapiens
cctttcccaggtgctacac

SEQ ID NO: 4494460 - DNA, 18 bp, Homo sapiens
cctttcccctagatccag

SEQ ID NO: 4494461 - DNA, 19 bp, Homo sapiens
cctttcccctagatccaga

SEQ ID NO: 4494462 - DNA, 17 bp, Homo sapiens
cctttccctcaccccct

SEQ ID NO: 4494463 - DNA, 11 bp, Homo sapiens
cctttcctgtt

SEQ ID NO: 4494464 - DNA, 17 bp, Homo sapiens
cctttccttccctctct

SEQ ID NO: 4494465 - DNA, 12 bp, Homo sapiens
cctttccttcct

SEQ ID NO: 4494466 - DNA, 17 bp, Homo sapiens
cctttccttttttgaga

SEQ ID NO: 4494467 - DNA, 11 bp, Homo sapiens
cctttctcaga

SEQ ID NO: 4494468 - DNA, 20 bp, Homo sapiens
cctttctcccctgcccccag

SEQ ID NO: 4494469 - DNA, 13 bp, Homo sapiens
cctttctctctcc

SEQ ID NO: 4494470 - DNA, 16 bp, Homo sapiens
cctttctctctcctct

SEQ ID NO: 4494471 - DNA, 21 bp, Homo sapiens
cctttctctctcctctctgct

SEQ ID NO: 4494472 - DNA, 17 bp, Homo sapiens
cctttctggaagtttct

SEQ ID NO: 4494473 - DNA, 20 bp, Homo sapiens
cctttctggaagtttctggt

SEQ ID NO: 4494474 - DNA, 21 bp, Homo sapiens
cctttctggaagtttctggtg

SEQ ID NO: 4494475 - DNA, 23 bp, Homo sapiens
cctttctgtcccactacatctgg

SEQ ID NO: 4494476 - DNA, 20 bp, Homo sapiens
cgaggacccagacccagtgg

SEQ ID NO: 4494477 - DNA, 15 bp, Homo sapiens
cgaggacccaggaaa

SEQ ID NO: 4494478 - DNA, 23 bp, Homo sapiens
cgaggcagacgtctgtcaggggc

SEQ ID NO: 4494479 - DNA, 22 bp, Homo sapiens
cgaggccctcaatccaccttca

SEQ ID NO: 4494480 - DNA, 20 bp, Homo sapiens
cgaggccctcgggcccagcc

SEQ ID NO: 4494481 - DNA, 21 bp, Homo sapiens
cgaggccctcgggcccagccc

SEQ ID NO: 4494482 - DNA, 21 bp, Homo sapiens
cgaggcctgcaaaccttcctg

SEQ ID NO: 4494483 - DNA, 14 bp, Homo sapiens
cgaggctacagctc

SEQ ID NO: 4494484 - DNA, 18 bp, Homo sapiens
cgaggctacagctccaca

SEQ ID NO: 4494485 - DNA, 21 bp, Homo sapiens
cgaggctccccgcctccactc

SEQ ID NO: 4494486 - DNA, 17 bp, Homo sapiens
cgaggctgcagtcagcc

SEQ ID NO: 4494487 - DNA, 15 bp, Homo sapiens
cgagggggctgctcc

SEQ ID NO: 4494488 - DNA, 17 bp, Homo sapiens
cgagggggctgctccca

SEQ ID NO: 4494489 - DNA, 23 bp, Homo sapiens
cgagggggctgctcccacctggc

SEQ ID NO: 4494490 - DNA, 16 bp, Homo sapiens
cgagggtcctggctcc

SEQ ID NO: 4494491 - DNA, 23 bp, Homo sapiens
cgagggtcctggctcctgagggg

SEQ ID NO: 4494492 - DNA, 15 bp, Homo sapiens
cgaggtcaacagaga

SEQ ID NO: 4494493 - DNA, 13 bp, Homo sapiens
cgaggtcaggaga

SEQ ID NO: 4494494 - DNA, 14 bp, Homo sapiens
cgaggtcaggagat

SEQ ID NO: 4494495 - DNA, 14 bp, Homo sapiens
cgaggtccagaccc

SEQ ID NO: 4494496 - DNA, 17 bp, Homo sapiens
cgaggtttatattttca

SEQ ID NO: 4494497 - DNA, 12 bp, Homo sapiens
cgagtactgtgg

SEQ ID NO: 4494498 - DNA, 13 bp, Homo sapiens
cgagtactgtggg

SEQ ID NO: 4494499 - DNA, 16 bp, Homo sapiens
cgagtcaatcccctca

SEQ ID NO: 4494500 - DNA, 17 bp, Homo sapiens
cgagtttggtccctggg

SEQ ID NO: 4494501 - DNA, 17 bp, Homo sapiens
cgatacctggagcagag

SEQ ID NO: 4494502 - DNA, 13 bp, Homo sapiens
cgatctcctgacc

SEQ ID NO: 4494503 - DNA, 20 bp, Homo sapiens
cgatctcggctcactgcaac

SEQ ID NO: 4494504 - DNA, 13 bp, Homo sapiens
cgatctctcctgg

SEQ ID NO: 4494505 - DNA, 16 bp, Homo sapiens
cgatctctcctggcct

SEQ ID NO: 4494506 - DNA, 13 bp, Homo sapiens
cgatgccaccggc

SEQ ID NO: 4494507 - DNA, 17 bp, Homo sapiens
cgatggacctcagcaag

SEQ ID NO: 4494508 - DNA, 22 bp, Homo sapiens
cgatggacctcagcaagctgcc

SEQ ID NO: 4494509 - DNA, 21 bp, Homo sapiens
cgatggtgctgcccaggcctc

SEQ ID NO: 4494510 - DNA, 21 bp, Homo sapiens
cgatgtcaaaggtcgggacag

SEQ ID NO: 4494511 - DNA, 13 bp, Homo sapiens
cgatgtcccctgc

SEQ ID NO: 4494512 - DNA, 16 bp, Homo sapiens
cgatgtgctcagccaa

SEQ ID NO: 4494513 - DNA, 17 bp, Homo sapiens
cgatgtggtcacagctg

SEQ ID NO: 4494514 - DNA, 19 bp, Homo sapiens
cgatgtggtcacagctgta

SEQ ID NO: 4494515 - DNA, 15 bp, Homo sapiens
cgatgttgtcaagga

SEQ ID NO: 4494516 - DNA, 23 bp, Homo sapiens
cgattgcaggagtccctgccatc

SEQ ID NO: 4494517 - DNA, 11 bp, Homo sapiens
cgatttctaaa

SEQ ID NO: 4494518 - DNA, 13 bp, Homo sapiens
cgatttctgtaaa

SEQ ID NO: 4494519 - DNA, 14 bp, Homo sapiens
cgattttgtctacc

SEQ ID NO: 4494520 - DNA, 20 bp, Homo sapiens
cgcaatctcagctcactgca

SEQ ID NO: 4494521 - DNA, 13 bp, Homo sapiens
cgcaatgtggcat

SEQ ID NO: 4494522 - DNA, 15 bp, Homo sapiens
cgcacagccacccgt

SEQ ID NO: 4494523 - DNA, 14 bp, Homo sapiens
cgcaccccagagtg

SEQ ID NO: 4494524 - DNA, 12 bp, Homo sapiens
cgcaccctgtcc

SEQ ID NO: 4494525 - DNA, 22 bp, Homo sapiens
cgcaccgcctgaaggcacagct

SEQ ID NO: 4494526 - DNA, 18 bp, Homo sapiens
cgcacgactgcgggagcc

SEQ ID NO: 4494527 - DNA, 12 bp, Homo sapiens
cgcactgcatgg

SEQ ID NO: 4494528 - DNA, 13 bp, Homo sapiens
cgcactgcatggg

SEQ ID NO: 4494529 - DNA, 23 bp, Homo sapiens
cgcagacggtctgtgtgctgttt

SEQ ID NO: 4494530 - DNA, 18 bp, Homo sapiens
cgcagagcttttcagatt

SEQ ID NO: 4494531 - DNA, 23 bp, Homo sapiens
cgcagatttttatgttttgaaag

SEQ ID NO: 4494532 - DNA, 15 bp, Homo sapiens
cgcagcctccagggc

SEQ ID NO: 4494533 - DNA, 21 bp, Homo sapiens
cgcagcttcctgtctgtttat

SEQ ID NO: 4494534 - DNA, 21 bp, Homo sapiens
cgcaggaactgggctgggcct

SEQ ID NO: 4494535 - DNA, 13 bp, Homo sapiens
cgcaggaaggcag

SEQ ID NO: 4494536 - DNA, 18 bp, Homo sapiens
cgcaggcccccaggtgcc

SEQ ID NO: 4494537 - DNA, 20 bp, Homo sapiens
cgcagttgtgtggcccagca

SEQ ID NO: 4494538 - DNA, 14 bp, Homo sapiens
cgcatccagacagt

SEQ ID NO: 4494539 - DNA, 21 bp, Homo sapiens
cgcatcttctccatctggcag

SEQ ID NO: 4494540 - DNA, 13 bp, Homo sapiens
cgcatgtgtgcct

SEQ ID NO: 4494541 - DNA, 13 bp, Homo sapiens
cgcattccctgag

SEQ ID NO: 4494542 - DNA, 19 bp, Homo sapiens
cgccaaataatgtctctgt

SEQ ID NO: 4494543 - DNA, 13 bp, Homo sapiens
cgccaacacgcct

SEQ ID NO: 4494544 - DNA, 15 bp, Homo sapiens
cgccaacacgcctgg

SEQ ID NO: 4494545 - DNA, 14 bp, Homo sapiens
cgccaagtctggca

SEQ ID NO: 4494546 - DNA, 15 bp, Homo sapiens
cgccaagtctggcac

SEQ ID NO: 4494547 - DNA, 21 bp, Homo sapiens
cgccaatgttatgccagctcc

SEQ ID NO: 4494548 - DNA, 21 bp, Homo sapiens
cgccacgtcccagcatccctg

SEQ ID NO: 4494549 - DNA, 14 bp, Homo sapiens
cgccactcatttca

SEQ ID NO: 4494550 - DNA, 19 bp, Homo sapiens
cgccactcatttcatctca

SEQ ID NO: 4494551 - DNA, 21 bp, Homo sapiens
cgccactcatttcatctcatt

SEQ ID NO: 4494552 - DNA, 14 bp, Homo sapiens
cgccactccctggg

SEQ ID NO: 4494553 - DNA, 16 bp, Homo sapiens
cgccactcgccttctt

SEQ ID NO: 4494554 - DNA, 17 bp, Homo sapiens
cgccagcctcctctgga

SEQ ID NO: 4494555 - DNA, 15 bp, Homo sapiens
cgccagctaattttt

SEQ ID NO: 4494556 - DNA, 14 bp, Homo sapiens
cgccagctgggagc

SEQ ID NO: 4494557 - DNA, 17 bp, Homo sapiens
cgccaggaagccagagc

SEQ ID NO: 4494558 - DNA, 15 bp, Homo sapiens
cgccaggccagcagg

SEQ ID NO: 4494559 - DNA, 14 bp, Homo sapiens
cgccagtacttgtc

SEQ ID NO: 4494560 - DNA, 13 bp, Homo sapiens
cgccattctcctg

SEQ ID NO: 4494561 - DNA, 15 bp, Homo sapiens
cgccattctcctgcc

SEQ ID NO: 4494562 - DNA, 16 bp, Homo sapiens
cgccattgccaccagg

SEQ ID NO: 4494563 - DNA, 18 bp, Homo sapiens
cgccattgccaccaggag

SEQ ID NO: 4494564 - DNA, 16 bp, Homo sapiens
cgccattgtactccag

SEQ ID NO: 4494565 - DNA, 21 bp, Homo sapiens
cgccattgtactccagcctgg

SEQ ID NO: 4494566 - DNA, 15 bp, Homo sapiens
cgcccacaaactgat

SEQ ID NO: 4494567 - DNA, 15 bp, Homo sapiens
cgcccaccagccttg

SEQ ID NO: 4494568 - DNA, 22 bp, Homo sapiens
cgcccaccagccttgctctctt

SEQ ID NO: 4494569 - DNA, 24 bp, Homo sapiens
cgcccaccagccttgctctcttca

SEQ ID NO: 4494570 - DNA, 18 bp, Homo sapiens
cgcccaccccgctctgca

SEQ ID NO: 4494571 - DNA, 13 bp, Homo sapiens
cgcccactcctgg

SEQ ID NO: 4494572 - DNA, 22 bp, Homo sapiens
cgcccaggctggactgcagtgg

SEQ ID NO: 4494573 - DNA, 12 bp, Homo sapiens
cgccccaggccc

SEQ ID NO: 4494574 - DNA, 18 bp, Homo sapiens
cgccccatccctgcttgc

SEQ ID NO: 4494575 - DNA, 14 bp, Homo sapiens
cgcccctcccaagc

SEQ ID NO: 4494576 - DNA, 12 bp, Homo sapiens
cgcccctccttt

SEQ ID NO: 4494577 - DNA, 20 bp, Homo sapiens
cgcccctccttttggcctgg

SEQ ID NO: 4494578 - DNA, 23 bp, Homo sapiens
cgcccctccttttggcctggggg

SEQ ID NO: 4494579 - DNA, 15 bp, Homo sapiens
cgcccctgcctgtgc

SEQ ID NO: 4494580 - DNA, 21 bp, Homo sapiens
cgcccctggggaaatagcctc

SEQ ID NO: 4494581 - DNA, 15 bp, Homo sapiens
cgcccctgttttttg

SEQ ID NO: 4494582 - DNA, 19 bp, Homo sapiens
cgcccgccaacacgcctgg

SEQ ID NO: 4494583 - DNA, 13 bp, Homo sapiens
cgcccggcccaag

SEQ ID NO: 4494584 - DNA, 16 bp, Homo sapiens
cgcccggcccaagaga

SEQ ID NO: 4494585 - DNA, 17 bp, Homo sapiens
cgccctccctgctagca

SEQ ID NO: 4494586 - DNA, 20 bp, Homo sapiens
cgccctccctgctagcacag

SEQ ID NO: 4494587 - DNA, 22 bp, Homo sapiens
cgcccttccatgtgcctttctt

SEQ ID NO: 4494588 - DNA, 19 bp, Homo sapiens
cgccctttcctcctcaggc

SEQ ID NO: 4494589 - DNA, 16 bp, Homo sapiens
cgccgatgccaccggc

SEQ ID NO: 4494590 - DNA, 18 bp, Homo sapiens
cgccgcctcccacggcac

SEQ ID NO: 4494591 - DNA, 13 bp, Homo sapiens
cgccggcttcctc

SEQ ID NO: 4494592 - DNA, 16 bp, Homo sapiens
cgccggggacagaggc

SEQ ID NO: 4494593 - DNA, 20 bp, Homo sapiens
cgccggggacagaggcctgc

SEQ ID NO: 4494594 - DNA, 21 bp, Homo sapiens
cgccgtgccggcggcagcccc

SEQ ID NO: 4494595 - DNA, 16 bp, Homo sapiens
cgccgtgtctcagcct

SEQ ID NO: 4494596 - DNA, 20 bp, Homo sapiens
cgcctagtggggtctccctc

SEQ ID NO: 4494597 - DNA, 16 bp, Homo sapiens
cgcctataatcccagc

SEQ ID NO: 4494598 - DNA, 18 bp, Homo sapiens
cgcctataatcccagcta

SEQ ID NO: 4494599 - DNA, 13 bp, Homo sapiens
cgcctcaccagcc

SEQ ID NO: 4494600 - DNA, 16 bp, Homo sapiens
cgcctcagccctcagt

SEQ ID NO: 4494601 - DNA, 14 bp, Homo sapiens
cgcctcccacggca

SEQ ID NO: 4494602 - DNA, 22 bp, Homo sapiens
cgcctccctagttagcatccag

SEQ ID NO: 4494603 - DNA, 15 bp, Homo sapiens
cgcctccctctcaga

SEQ ID NO: 4494604 - DNA, 12 bp, Homo sapiens
cgcctcctggcc

SEQ ID NO: 4494605 - DNA, 17 bp, Homo sapiens
cgcctcttgaccaggct

SEQ ID NO: 4494606 - DNA, 20 bp, Homo sapiens
cgcctgaggaacccttacag

SEQ ID NO: 4494607 - DNA, 17 bp, Homo sapiens
cgcctgaggcaattaga

SEQ ID NO: 4494608 - DNA, 14 bp, Homo sapiens
cgcctgcaggcaga

SEQ ID NO: 4494609 - DNA, 15 bp, Homo sapiens
cgcctgccaccggag

SEQ ID NO: 4494610 - DNA, 14 bp, Homo sapiens
cgcctgcccagact

SEQ ID NO: 4494611 - DNA, 15 bp, Homo sapiens
cgcctgcccagactg

SEQ ID NO: 4494612 - DNA, 19 bp, Homo sapiens
cgcctgcccagactgatga

SEQ ID NO: 4494613 - DNA, 15 bp, Homo sapiens
cgcctgcctgcagca

SEQ ID NO: 4494614 - DNA, 14 bp, Homo sapiens
cgcctgctgcctgc

SEQ ID NO: 4494615 - DNA, 22 bp, Homo sapiens
cgcctgctggccgacccactga

SEQ ID NO: 4494616 - DNA, 19 bp, Homo sapiens
cgcctgtcacaataaagtt

SEQ ID NO: 4494617 - DNA, 18 bp, Homo sapiens
cgccttcatctgggacaa

SEQ ID NO: 4494618 - DNA, 20 bp, Homo sapiens
cgccttctcccacatgaggc

SEQ ID NO: 4494619 - DNA, 19 bp, Homo sapiens
cgccttgcccagcctggat

SEQ ID NO: 4494620 - DNA, 14 bp, Homo sapiens
cgccttgtgagatg

SEQ ID NO: 4494621 - DNA, 13 bp, Homo sapiens
cgcctttcccagg

SEQ ID NO: 4494622 - DNA, 19 bp, Homo sapiens
cgcgccaaataatgtctct

SEQ ID NO: 4494623 - DNA, 23 bp, Homo sapiens
cgcgccaaataatgtctctgtga

SEQ ID NO: 4494624 - DNA, 22 bp, Homo sapiens
cgcggacccttctgggtccagg

SEQ ID NO: 4494625 - DNA, 14 bp, Homo sapiens
cgcggccagccccg

SEQ ID NO: 4494626 - DNA, 15 bp, Homo sapiens
cgcggccagccccgg

SEQ ID NO: 4494627 - DNA, 12 bp, Homo sapiens
cgcggctgggag

SEQ ID NO: 4494628 - DNA, 22 bp, Homo sapiens
cgcgggagacagcttctctgca

SEQ ID NO: 4494629 - DNA, 15 bp, Homo sapiens
cgcgggcagccaccc

SEQ ID NO: 4494630 - DNA, 15 bp, Homo sapiens
cgcgggccaggaggc

SEQ ID NO: 4494631 - DNA, 18 bp, Homo sapiens
cgcggggaagctggcttt

SEQ ID NO: 4494632 - DNA, 13 bp, Homo sapiens
cgcggtcctgact

SEQ ID NO: 4494633 - DNA, 14 bp, Homo sapiens
cgcgtcccagctcc

SEQ ID NO: 4494634 - DNA, 19 bp, Homo sapiens
cgcgtgcacgtggagagct

SEQ ID NO: 4494635 - DNA, 12 bp, Homo sapiens
cgcgttgtgtat

SEQ ID NO: 4494636 - DNA, 15 bp, Homo sapiens
cgctaaagagccctt

SEQ ID NO: 4494637 - DNA, 19 bp, Homo sapiens
cgctaaagagcccttgcct

SEQ ID NO: 4494638 - DNA, 22 bp, Homo sapiens
cgctaaagagcccttgcctccc

SEQ ID NO: 4494639 - DNA, 17 bp, Homo sapiens
cgctaaagttatatttg

SEQ ID NO: 4494640 - DNA, 23 bp, Homo sapiens
cgctaattcaaggaatttcttaa

SEQ ID NO: 4494641 - DNA, 15 bp, Homo sapiens
cgctatccacagaac

SEQ ID NO: 4494642 - DNA, 13 bp, Homo sapiens
cgctatgtgactt

SEQ ID NO: 4494643 - DNA, 17 bp, Homo sapiens
cgctcaccgctggccct

SEQ ID NO: 4494644 - DNA, 15 bp, Homo sapiens
cgctcagccccaggc

SEQ ID NO: 4494645 - DNA, 18 bp, Homo sapiens
cgctcaggggctccatgc

SEQ ID NO: 4494646 - DNA, 24 bp, Homo sapiens
cgctcatctggcttttcgcttgct

SEQ ID NO: 4494647 - DNA, 18 bp, Homo sapiens
cgctccagctgccccggc

SEQ ID NO: 4494648 - DNA, 18 bp, Homo sapiens
cgctcccacagcttcctg

SEQ ID NO: 4494649 - DNA, 22 bp, Homo sapiens
cgctcccaggttcccccagcaa

SEQ ID NO: 4494650 - DNA, 18 bp, Homo sapiens
cgctcctgccgcagagct

SEQ ID NO: 4494651 - DNA, 19 bp, Homo sapiens
cgctcgatggacctcagca

SEQ ID NO: 4494652 - DNA, 13 bp, Homo sapiens
cgctcgcccagca

SEQ ID NO: 4494653 - DNA, 14 bp, Homo sapiens
cgctctcagttctc

SEQ ID NO: 4494654 - DNA, 19 bp, Homo sapiens
cgctctcttttctgtactt

SEQ ID NO: 4494655 - DNA, 19 bp, Homo sapiens
cgctctgcatgcggcccag

SEQ ID NO: 4494656 - DNA, 16 bp, Homo sapiens
cgctctgtcgcccagg

SEQ ID NO: 4494657 - DNA, 17 bp, Homo sapiens
cgctctgtcgcccaggc

SEQ ID NO: 4494658 - DNA, 19 bp, Homo sapiens
cgctctgtcgcccaggctg

SEQ ID NO: 4494659 - DNA, 20 bp, Homo sapiens
cgctctgtcgcccaggctgg

SEQ ID NO: 4494660 - DNA, 23 bp, Homo sapiens
cgctgaagatggagggggctggg

SEQ ID NO: 4494661 - DNA, 16 bp, Homo sapiens
cgctgagccacctgcc

SEQ ID NO: 4494662 - DNA, 21 bp, Homo sapiens
cgctgagccacctgccctttt

SEQ ID NO: 4494663 - DNA, 20 bp, Homo sapiens
cgctgcacatggcctgagca

SEQ ID NO: 4494664 - DNA, 12 bp, Homo sapiens
cgctgcagaccc

SEQ ID NO: 4494665 - DNA, 13 bp, Homo sapiens
cgctgcagacccc

SEQ ID NO: 4494666 - DNA, 17 bp, Homo sapiens
cgctgcatacaggggag

SEQ ID NO: 4494667 - DNA, 18 bp, Homo sapiens
cgctgcatacaggggagg

SEQ ID NO: 4494668 - DNA, 16 bp, Homo sapiens
cgctgccctgtggaca

SEQ ID NO: 4494669 - DNA, 18 bp, Homo sapiens
cgctgcccttgggtcccc

SEQ ID NO: 4494670 - DNA, 10 bp, Homo sapiens
cgctgcctcg

SEQ ID NO: 4494671 - DNA, 16 bp, Homo sapiens
cgctgtcgccccaggc

SEQ ID NO: 4494672 - DNA, 18 bp, Homo sapiens
cgctgtcgccccaggccc

SEQ ID NO: 4494673 - DNA, 19 bp, Homo sapiens
cgctgtggccggtgccagc

SEQ ID NO: 4494674 - DNA, 23 bp, Homo sapiens
cgctgtggccggtgccagctgcc

SEQ ID NO: 4494675 - DNA, 15 bp, Homo sapiens
cgcttaatccaatat

SEQ ID NO: 4494676 - DNA, 17 bp, Homo sapiens
cgcttctgagcaggggc

SEQ ID NO: 4494677 - DNA, 18 bp, Homo sapiens
cgcttctgagcaggggcc

SEQ ID NO: 4494678 - DNA, 20 bp, Homo sapiens
cgcttgaccatgttgcactg

SEQ ID NO: 4494679 - DNA, 20 bp, Homo sapiens
cgcttgctcgcttgctggaa

SEQ ID NO: 4494680 - DNA, 18 bp, Homo sapiens
cgcttgctggaacacagg

SEQ ID NO: 4494681 - DNA, 22 bp, Homo sapiens
cgcttgctggaacacaggggcc

SEQ ID NO: 4494682 - DNA, 16 bp, Homo sapiens
cgcttgcttctgcagc

SEQ ID NO: 4494683 - DNA, 12 bp, Homo sapiens
cggaaagaagag

SEQ ID NO: 4494684 - DNA, 13 bp, Homo sapiens
cggaaagctcttc

SEQ ID NO: 4494685 - DNA, 19 bp, Homo sapiens
cggaaagtttttagaatgt

SEQ ID NO: 4494686 - DNA, 13 bp, Homo sapiens
cggaactgggctg

SEQ ID NO: 4494687 - DNA, 14 bp, Homo sapiens
cggaagcaagcaga

SEQ ID NO: 4494688 - DNA, 20 bp, Homo sapiens
cggaattcaccagtgttcct

SEQ ID NO: 4494689 - DNA, 14 bp, Homo sapiens
cggacagagccccc

SEQ ID NO: 4494690 - DNA, 20 bp, Homo sapiens
cggacagaggggctgttagg

SEQ ID NO: 4494691 - DNA, 21 bp, Homo sapiens
cggacagttccagaagtgtga

SEQ ID NO: 4494692 - DNA, 18 bp, Homo sapiens
cggaccactcgaggcctg

SEQ ID NO: 4494693 - DNA, 23 bp, Homo sapiens
cggacccaccccaactctcccca

SEQ ID NO: 4494694 - DNA, 24 bp, Homo sapiens
cggacccaccccaactctccccag

SEQ ID NO: 4494695 - DNA, 21 bp, Homo sapiens
cggaccccactccggccctcc

SEQ ID NO: 4494696 - DNA, 15 bp, Homo sapiens
cggacgttccagccg

SEQ ID NO: 4494697 - DNA, 16 bp, Homo sapiens
cggacgttccagccgg

SEQ ID NO: 4494698 - DNA, 14 bp, Homo sapiens
cggactctgcccct

SEQ ID NO: 4494699 - DNA, 24 bp, Homo sapiens
cggagaagagctgttcacagccag

SEQ ID NO: 4494700 - DNA, 16 bp, Homo sapiens
cggagacgggaccctg

SEQ ID NO: 4494701 - DNA, 17 bp, Homo sapiens
cggagcacactggctca

SEQ ID NO: 4494702 - DNA, 13 bp, Homo sapiens
cggagccactcct

SEQ ID NO: 4494703 - DNA, 16 bp, Homo sapiens
cggagctgctgagtga

SEQ ID NO: 4494704 - DNA, 22 bp, Homo sapiens
cggaggctacccgctgtggccg

SEQ ID NO: 4494705 - DNA, 22 bp, Homo sapiens
cggaggctgcccccggccccct

SEQ ID NO: 4494706 - DNA, 14 bp, Homo sapiens
cggaggctgggccc

SEQ ID NO: 4494707 - DNA, 19 bp, Homo sapiens
cggaggctgggcccctggg

SEQ ID NO: 4494708 - DNA, 20 bp, Homo sapiens
cggaggctgggcccctggga

SEQ ID NO: 4494709 - DNA, 17 bp, Homo sapiens
cggagtactagccagca

SEQ ID NO: 4494710 - DNA, 15 bp, Homo sapiens
cggatcatcaacaag

SEQ ID NO: 4494711 - DNA, 18 bp, Homo sapiens
cggatgaccatactcaga

SEQ ID NO: 4494712 - DNA, 17 bp, Homo sapiens
cggatgcccattcctgc

SEQ ID NO: 4494713 - DNA, 20 bp, Homo sapiens
cggatggaccaacctgctct

SEQ ID NO: 4494714 - DNA, 19 bp, Homo sapiens
cggattactgaattgtatc

SEQ ID NO: 4494715 - DNA, 16 bp, Homo sapiens
cggcaaacctttcccc

SEQ ID NO: 4494716 - DNA, 23 bp, Homo sapiens
cggcaacgtagcctgggctcact

SEQ ID NO: 4494717 - DNA, 14 bp, Homo sapiens
cggcacagatgctc

SEQ ID NO: 4494718 - DNA, 15 bp, Homo sapiens
cggcagcatggagct

SEQ ID NO: 4494719 - DNA, 13 bp, Homo sapiens
cggcagccccact

SEQ ID NO: 4494720 - DNA, 17 bp, Homo sapiens
cggcaggctcactgcca

SEQ ID NO: 4494721 - DNA, 19 bp, Homo sapiens
cggcaggctcactgccagg

SEQ ID NO: 4494722 - DNA, 20 bp, Homo sapiens
cggcaggctcactgccaggc

SEQ ID NO: 4494723 - DNA, 23 bp, Homo sapiens
cggcaggctcactgccaggccag

SEQ ID NO: 4494724 - DNA, 19 bp, Homo sapiens
cggcatattattccatatc

SEQ ID NO: 4494725 - DNA, 18 bp, Homo sapiens
cggccaaggacccaggcg

SEQ ID NO: 4494726 - DNA, 17 bp, Homo sapiens
cggccacagctgctgga

SEQ ID NO: 4494727 - DNA, 15 bp, Homo sapiens
cggccaggcctgcgg

SEQ ID NO: 4494728 - DNA, 18 bp, Homo sapiens
cggcccagaagtttccct

SEQ ID NO: 4494729 - DNA, 18 bp, Homo sapiens
cggcccagatgtgtcccc

SEQ ID NO: 4494730 - DNA, 23 bp, Homo sapiens
cggcccaggccaggtgcccagga

SEQ ID NO: 4494731 - DNA, 16 bp, Homo sapiens
cggcccagtgccactg

SEQ ID NO: 4494732 - DNA, 13 bp, Homo sapiens
cggccccaccagt

SEQ ID NO: 4494733 - DNA, 17 bp, Homo sapiens
cggccccaccagtgcct

SEQ ID NO: 4494734 - DNA, 17 bp, Homo sapiens
cggccccccgcacagcc

SEQ ID NO: 4494735 - DNA, 21 bp, Homo sapiens
cggccccccgcgctcgcccag

SEQ ID NO: 4494736 - DNA, 22 bp, Homo sapiens
cggcccctgtctgttcccagcc

SEQ ID NO: 4494737 - DNA, 13 bp, Homo sapiens
cggcccgcctgcc

SEQ ID NO: 4494738 - DNA, 16 bp, Homo sapiens
cggcccgcctgcccag

SEQ ID NO: 4494739 - DNA, 14 bp, Homo sapiens
cggccctatgcatg

SEQ ID NO: 4494740 - DNA, 12 bp, Homo sapiens
cggccctggagg

SEQ ID NO: 4494741 - DNA, 14 bp, Homo sapiens
cggccctggaggat

SEQ ID NO: 4494742 - DNA, 22 bp, Homo sapiens
cggccgcgccacccgggcaagg

SEQ ID NO: 4494743 - DNA, 15 bp, Homo sapiens
cggcctcccaaagtg

SEQ ID NO: 4494744 - DNA, 14 bp, Homo sapiens
cggcctcccaggtc

SEQ ID NO: 4494745 - DNA, 20 bp, Homo sapiens
cggcctccgaggctccccgc

SEQ ID NO: 4494746 - DNA, 19 bp, Homo sapiens
cggcctctaaccccaggcc

SEQ ID NO: 4494747 - DNA, 13 bp, Homo sapiens
cggcctctccctg

SEQ ID NO: 4494748 - DNA, 16 bp, Homo sapiens
cggcctctccctgcct

SEQ ID NO: 4494749 - DNA, 17 bp, Homo sapiens
cggcctctccctgcctg

SEQ ID NO: 4494750 - DNA, 23 bp, Homo sapiens
cggcctgatgctccctcccctgc

SEQ ID NO: 4494751 - DNA, 19 bp, Homo sapiens
cggcctgtgggtctctgaa

SEQ ID NO: 4494752 - DNA, 22 bp, Homo sapiens
cggcggaattcaccagtgttcc

SEQ ID NO: 4494753 - DNA, 23 bp, Homo sapiens
cggcggcagccccacttcacccc

SEQ ID NO: 4494754 - DNA, 17 bp, Homo sapiens
cggcgggatcctccaca

SEQ ID NO: 4494755 - DNA, 19 bp, Homo sapiens
cggcgggatcctccacaga

SEQ ID NO: 4494756 - DNA, 20 bp, Homo sapiens
cggcgggatcctccacagag

SEQ ID NO: 4494757 - DNA, 20 bp, Homo sapiens
cggcgtcagcctccagcctc

SEQ ID NO: 4494758 - DNA, 12 bp, Homo sapiens
cggctactcagc

SEQ ID NO: 4494759 - DNA, 13 bp, Homo sapiens
cggctactcagca

SEQ ID NO: 4494760 - DNA, 16 bp, Homo sapiens
cggctactcagcagcc

SEQ ID NO: 4494761 - DNA, 21 bp, Homo sapiens
cggctactcagcagccctcct

SEQ ID NO: 4494762 - DNA, 21 bp, Homo sapiens
cggctccatcaccagcccggg

SEQ ID NO: 4494763 - DNA, 20 bp, Homo sapiens
cggctcctcagagcgccagg

SEQ ID NO: 4494764 - DNA, 23 bp, Homo sapiens
cggctcctcagagcgccaggaag

SEQ ID NO: 4494765 - DNA, 19 bp, Homo sapiens
cggctctgggggtgggaag

SEQ ID NO: 4494766 - DNA, 22 bp, Homo sapiens
cggctgagtcatgatctccctg

SEQ ID NO: 4494767 - DNA, 19 bp, Homo sapiens
cggctggggactgctacct

SEQ ID NO: 4494768 - DNA, 19 bp, Homo sapiens
cggctggttgtgggcactg

SEQ ID NO: 4494769 - DNA, 13 bp, Homo sapiens
cggctgtgctggg

SEQ ID NO: 4494770 - DNA, 14 bp, Homo sapiens
cggctgttcctccc

SEQ ID NO: 4494771 - DNA, 20 bp, Homo sapiens
cggctgttcctcccctgtag

SEQ ID NO: 4494772 - DNA, 16 bp, Homo sapiens
cggctgtttcctgaca

SEQ ID NO: 4494773 - DNA, 17 bp, Homo sapiens
cgggaaggtcaccagca

SEQ ID NO: 4494774 - DNA, 20 bp, Homo sapiens
cgggaaggtcaccagcacca

SEQ ID NO: 4494775 - DNA, 14 bp, Homo sapiens
cgggaatcacaggt

SEQ ID NO: 4494776 - DNA, 13 bp, Homo sapiens
cgggacctggtgc

SEQ ID NO: 4494777 - DNA, 22 bp, Homo sapiens
cgggactgctgctctcccaagg

SEQ ID NO: 4494778 - DNA, 20 bp, Homo sapiens
cgggagccagactgtccagg

SEQ ID NO: 4494779 - DNA, 16 bp, Homo sapiens
cgggagctgggccctg

SEQ ID NO: 4494780 - DNA, 21 bp, Homo sapiens
cgggaggaaaaggcccctgca

SEQ ID NO: 4494781 - DNA, 19 bp, Homo sapiens
cgggaggcagcgccccacc

SEQ ID NO: 4494782 - DNA, 20 bp, Homo sapiens
cgggaggcagcgccccacca

SEQ ID NO: 4494783 - DNA, 15 bp, Homo sapiens
cgggaggctggggcc

SEQ ID NO: 4494784 - DNA, 16 bp, Homo sapiens
cgggagtcagggacct

SEQ ID NO: 4494785 - DNA, 23 bp, Homo sapiens
cgggatgattgcttgagctcagg

SEQ ID NO: 4494786 - DNA, 18 bp, Homo sapiens
cgggatgctctttaaata

SEQ ID NO: 4494787 - DNA, 14 bp, Homo sapiens
cgggcacagtggct

SEQ ID NO: 4494788 - DNA, 14 bp, Homo sapiens
cgggcaccaggggc

SEQ ID NO: 4494789 - DNA, 17 bp, Homo sapiens
cgggcaccaggggccaa

SEQ ID NO: 4494790 - DNA, 14 bp, Homo sapiens
cgggcagagggctg

SEQ ID NO: 4494791 - DNA, 15 bp, Homo sapiens
cgggcagagggctgg

SEQ ID NO: 4494792 - DNA, 19 bp, Homo sapiens
cgggcagccacccaagcct

SEQ ID NO: 4494793 - DNA, 23 bp, Homo sapiens
cgggcaggtcagcgcggtcctga

SEQ ID NO: 4494794 - DNA, 15 bp, Homo sapiens
cgggcagtctgctct

SEQ ID NO: 4494795 - DNA, 16 bp, Homo sapiens
cgggcagtctgctctg

SEQ ID NO: 4494796 - DNA, 18 bp, Homo sapiens
cgggcagtctgctctgct

SEQ ID NO: 4494797 - DNA, 17 bp, Homo sapiens
cgggcatggtggcaggc

SEQ ID NO: 4494798 - DNA, 21 bp, Homo sapiens
cgggcatggtggctcatgcct

SEQ ID NO: 4494799 - DNA, 17 bp, Homo sapiens
cgggccaggagaatctc

SEQ ID NO: 4494800 - DNA, 13 bp, Homo sapiens
cgggccaggaggc

SEQ ID NO: 4494801 - DNA, 19 bp, Homo sapiens
cgggccaggaggctgccac

SEQ ID NO: 4494802 - DNA, 12 bp, Homo sapiens
cgggcccactca

SEQ ID NO: 4494803 - DNA, 21 bp, Homo sapiens
cgggccccatcctcatccctg

SEQ ID NO: 4494804 - DNA, 19 bp, Homo sapiens
cgggcccctccatccaccc

SEQ ID NO: 4494805 - DNA, 19 bp, Homo sapiens
cgggcccctctctagggac

SEQ ID NO: 4494806 - DNA, 23 bp, Homo sapiens
cgggcccctgggcttggcctgct

SEQ ID NO: 4494807 - DNA, 16 bp, Homo sapiens
cgggcgcggccagccc

SEQ ID NO: 4494808 - DNA, 16 bp, Homo sapiens
cgggcgcggtggctca

SEQ ID NO: 4494809 - DNA, 22 bp, Homo sapiens
cgggctcggaggctacccgctg

SEQ ID NO: 4494810 - DNA, 16 bp, Homo sapiens
cgggctgaggccagag

SEQ ID NO: 4494811 - DNA, 17 bp, Homo sapiens
cgggctgaggccagagt

SEQ ID NO: 4494812 - DNA, 16 bp, Homo sapiens
cggggaagctggcttt

SEQ ID NO: 4494813 - DNA, 18 bp, Homo sapiens
cggggacagaggcctgcc

SEQ ID NO: 4494814 - DNA, 21 bp, Homo sapiens
cggggacagaggcctgcccgg

SEQ ID NO: 4494815 - DNA, 14 bp, Homo sapiens
cggggaccctgtga

SEQ ID NO: 4494816 - DNA, 12 bp, Homo sapiens
cggggccccctg

SEQ ID NO: 4494817 - DNA, 19 bp, Homo sapiens
cggggccccctggtcaccg

SEQ ID NO: 4494818 - DNA, 17 bp, Homo sapiens
cggggcctggacaggcg

SEQ ID NO: 4494819 - DNA, 19 bp, Homo sapiens
cggggcctggacaggcggg

SEQ ID NO: 4494820 - DNA, 17 bp, Homo sapiens
cggggctcttctcattt

SEQ ID NO: 4494821 - DNA, 14 bp, Homo sapiens
cggggctggcaggg

SEQ ID NO: 4494822 - DNA, 21 bp, Homo sapiens
cggggcttctgcggggctgag

SEQ ID NO: 4494823 - DNA, 14 bp, Homo sapiens
cgggggagcccagt

SEQ ID NO: 4494824 - DNA, 15 bp, Homo sapiens
cgggggagcccagtg

SEQ ID NO: 4494825 - DNA, 16 bp, Homo sapiens
cgggggagcccagtga

SEQ ID NO: 4494826 - DNA, 21 bp, Homo sapiens
cgggggcagtctgagagaggc

SEQ ID NO: 4494827 - DNA, 22 bp, Homo sapiens
cgggggcagtgctcacccacac

SEQ ID NO: 4494828 - DNA, 20 bp, Homo sapiens
cggggggctcctgcccaggc

SEQ ID NO: 4494829 - DNA, 18 bp, Homo sapiens
cggggggtgtcttccctg

SEQ ID NO: 4494830 - DNA, 12 bp, Homo sapiens
cggggtccctgg

SEQ ID NO: 4494831 - DNA, 16 bp, Homo sapiens
cctctctgctctgcgt

SEQ ID NO: 4494832 - DNA, 22 bp, Homo sapiens
cctctctggaaagaggctctgg

SEQ ID NO: 4494833 - DNA, 19 bp, Homo sapiens
cctctctgtagtttatggc

SEQ ID NO: 4494834 - DNA, 17 bp, Homo sapiens
cctctcttccacagtgg

SEQ ID NO: 4494835 - DNA, 13 bp, Homo sapiens
cctctcttcccct

SEQ ID NO: 4494836 - DNA, 20 bp, Homo sapiens
cctctcttccccttccctta

SEQ ID NO: 4494837 - DNA, 21 bp, Homo sapiens
cctctcttccccttcccttat

SEQ ID NO: 4494838 - DNA, 12 bp, Homo sapiens
cctctctttctc

SEQ ID NO: 4494839 - DNA, 15 bp, Homo sapiens
cctctgaaacagctg

SEQ ID NO: 4494840 - DNA, 17 bp, Homo sapiens
cctctgaaacagctgcc

SEQ ID NO: 4494841 - DNA, 19 bp, Homo sapiens
cctctgaaacagctgcctt

SEQ ID NO: 4494842 - DNA, 20 bp, Homo sapiens
cctctgaaacagctgcctta

SEQ ID NO: 4494843 - DNA, 21 bp, Homo sapiens
cctctgaaacagctgccttag

SEQ ID NO: 4494844 - DNA, 23 bp, Homo sapiens
cctctgaaacagctgccttagct

SEQ ID NO: 4494845 - DNA, 18 bp, Homo sapiens
cctctgacagtccacagg

SEQ ID NO: 4494846 - DNA, 14 bp, Homo sapiens
cctctgagctttgc

SEQ ID NO: 4494847 - DNA, 19 bp, Homo sapiens
cctctgcacaccctccaga

SEQ ID NO: 4494848 - DNA, 20 bp, Homo sapiens
cctctgcacaccctccagag

SEQ ID NO: 4494849 - DNA, 14 bp, Homo sapiens
cctctgcagtctca

SEQ ID NO: 4494850 - DNA, 16 bp, Homo sapiens
cctctgcagtctcatt

SEQ ID NO: 4494851 - DNA, 21 bp, Homo sapiens
cctctgcagtctcatttctca

SEQ ID NO: 4494852 - DNA, 17 bp, Homo sapiens
cctctgcagtgccttgg

SEQ ID NO: 4494853 - DNA, 20 bp, Homo sapiens
cctctgccacctcccctatc

SEQ ID NO: 4494854 - DNA, 15 bp, Homo sapiens
cctctgcccctgcag

SEQ ID NO: 4494855 - DNA, 18 bp, Homo sapiens
cctctgcccctgcagctg

SEQ ID NO: 4494856 - DNA, 21 bp, Homo sapiens
cctctgcccgggagctcagga

SEQ ID NO: 4494857 - DNA, 16 bp, Homo sapiens
cctctgccgctgccat

SEQ ID NO: 4494858 - DNA, 17 bp, Homo sapiens
cctctgccgctgccatg

SEQ ID NO: 4494859 - DNA, 20 bp, Homo sapiens
cctctgccggtcgggcagcc

SEQ ID NO: 4494860 - DNA, 15 bp, Homo sapiens
cctctgcctacagcc

SEQ ID NO: 4494861 - DNA, 16 bp, Homo sapiens
cctctgcctgccccgc

SEQ ID NO: 4494862 - DNA, 18 bp, Homo sapiens
cctctgccttgccctcct

SEQ ID NO: 4494863 - DNA, 11 bp, Homo sapiens
cctctgctccc

SEQ ID NO: 4494864 - DNA, 12 bp, Homo sapiens
cctctgctccct

SEQ ID NO: 4494865 - DNA, 19 bp, Homo sapiens
cctctgctgcaacaagctc

SEQ ID NO: 4494866 - DNA, 13 bp, Homo sapiens
cctctgctgcttt

SEQ ID NO: 4494867 - DNA, 15 bp, Homo sapiens
cctctgctggctcag

SEQ ID NO: 4494868 - DNA, 22 bp, Homo sapiens
cctctggacggcaggctcactg

SEQ ID NO: 4494869 - DNA, 17 bp, Homo sapiens
cctctggactggctaga

SEQ ID NO: 4494870 - DNA, 18 bp, Homo sapiens
cctctggactggctagag

SEQ ID NO: 4494871 - DNA, 19 bp, Homo sapiens
cctctggcccctcacccac

SEQ ID NO: 4494872 - DNA, 17 bp, Homo sapiens
cctctggccctgccttc

SEQ ID NO: 4494873 - DNA, 15 bp, Homo sapiens
cctctggccgcagag

SEQ ID NO: 4494874 - DNA, 12 bp, Homo sapiens
cctctggctaga

SEQ ID NO: 4494875 - DNA, 13 bp, Homo sapiens
cctctggctagag

SEQ ID NO: 4494876 - DNA, 23 bp, Homo sapiens
cctctggctagaggccagcccca

SEQ ID NO: 4494877 - DNA, 15 bp, Homo sapiens
cctctggctttccca

SEQ ID NO: 4494878 - DNA, 20 bp, Homo sapiens
cctctggctttcccaggaga

SEQ ID NO: 4494879 - DNA, 22 bp, Homo sapiens
cctctgggcacgcctgctggcc

SEQ ID NO: 4494880 - DNA, 13 bp, Homo sapiens
cctctgggccctg

SEQ ID NO: 4494881 - DNA, 15 bp, Homo sapiens
cctctgggccctgtc

SEQ ID NO: 4494882 - DNA, 15 bp, Homo sapiens
cctctggggccactt

SEQ ID NO: 4494883 - DNA, 14 bp, Homo sapiens
cctctgggtttcta

SEQ ID NO: 4494884 - DNA, 15 bp, Homo sapiens
cctctgtccaggcac

SEQ ID NO: 4494885 - DNA, 14 bp, Homo sapiens
cctctgtccccttc

SEQ ID NO: 4494886 - DNA, 17 bp, Homo sapiens
cctctgtccccttctct

SEQ ID NO: 4494887 - DNA, 18 bp, Homo sapiens
cctctgtccccttctctc

SEQ ID NO: 4494888 - DNA, 21 bp, Homo sapiens
cctctgtccccttctctcatc

SEQ ID NO: 4494889 - DNA, 14 bp, Homo sapiens
cctctgtctgccct

SEQ ID NO: 4494890 - DNA, 18 bp, Homo sapiens
cctctgtgaactgtgtgt

SEQ ID NO: 4494891 - DNA, 18 bp, Homo sapiens
cctctgtgaccaatgtct

SEQ ID NO: 4494892 - DNA, 15 bp, Homo sapiens
cctcttaaattatat

SEQ ID NO: 4494893 - DNA, 13 bp, Homo sapiens
cctcttcagaggc

SEQ ID NO: 4494894 - DNA, 14 bp, Homo sapiens
cctcttcagaggcc

SEQ ID NO: 4494895 - DNA, 19 bp, Homo sapiens
cctcttcaggcctgctagt

SEQ ID NO: 4494896 - DNA, 23 bp, Homo sapiens
cctcttcccatgtcccaccctcc

SEQ ID NO: 4494897 - DNA, 14 bp, Homo sapiens
cctcttccccagaa

SEQ ID NO: 4494898 - DNA, 20 bp, Homo sapiens
cctcttcccttagcctctcc

SEQ ID NO: 4494899 - DNA, 16 bp, Homo sapiens
cctcttcctaggccac

SEQ ID NO: 4494900 - DNA, 22 bp, Homo sapiens
cctcttctaaaatagcaataac

SEQ ID NO: 4494901 - DNA, 17 bp, Homo sapiens
cctcttctgctcttttc

SEQ ID NO: 4494902 - DNA, 17 bp, Homo sapiens
cctcttctttgtgcctt

SEQ ID NO: 4494903 - DNA, 18 bp, Homo sapiens
cctcttctttgtgccttt

SEQ ID NO: 4494904 - DNA, 19 bp, Homo sapiens
cctcttctttgtgcctttg

SEQ ID NO: 4494905 - DNA, 23 bp, Homo sapiens
cctcttctttgtgcctttggcct

SEQ ID NO: 4494906 - DNA, 11 bp, Homo sapiens
cctcttctttt

SEQ ID NO: 4494907 - DNA, 13 bp, Homo sapiens
cctcttgcccatc

SEQ ID NO: 4494908 - DNA, 11 bp, Homo sapiens
cctcttgcctc

SEQ ID NO: 4494909 - DNA, 18 bp, Homo sapiens
cctcttggaattacaagc

SEQ ID NO: 4494910 - DNA, 23 bp, Homo sapiens
cctcttggggagtttagggtggg

SEQ ID NO: 4494911 - DNA, 16 bp, Homo sapiens
cctcttgtaaagactg

SEQ ID NO: 4494912 - DNA, 17 bp, Homo sapiens
cctcttgtaaagactgg

SEQ ID NO: 4494913 - DNA, 16 bp, Homo sapiens
cctctttccctgcgag

SEQ ID NO: 4494914 - DNA, 14 bp, Homo sapiens
cctctttctccagc

SEQ ID NO: 4494915 - DNA, 13 bp, Homo sapiens
cctctttgggcag

SEQ ID NO: 4494916 - DNA, 22 bp, Homo sapiens
ccgtgccggcggcagccccact

SEQ ID NO: 4494917 - DNA, 13 bp, Homo sapiens
ccgtgcctggcca

SEQ ID NO: 4494918 - DNA, 14 bp, Homo sapiens
ccgtgcctggccag

SEQ ID NO: 4494919 - DNA, 13 bp, Homo sapiens
ccgtgcctggcta

SEQ ID NO: 4494920 - DNA, 11 bp, Homo sapiens
ccgtggaagga

SEQ ID NO: 4494921 - DNA, 18 bp, Homo sapiens
ccgtgggaccctcagcag

SEQ ID NO: 4494922 - DNA, 19 bp, Homo sapiens
ccgtgggaccctcagcagc

SEQ ID NO: 4494923 - DNA, 19 bp, Homo sapiens
ccgtgggcggggccttgcg

SEQ ID NO: 4494924 - DNA, 18 bp, Homo sapiens
ccgtggggtctgcgcttg

SEQ ID NO: 4494925 - DNA, 19 bp, Homo sapiens
ccgtggggtgctgccctta

SEQ ID NO: 4494926 - DNA, 22 bp, Homo sapiens
ccgtgggtgggcctggccctgc

SEQ ID NO: 4494927 - DNA, 17 bp, Homo sapiens
ccgtgtcctctccctgc

SEQ ID NO: 4494928 - DNA, 18 bp, Homo sapiens
ccgtgtcgggcaggtcag

SEQ ID NO: 4494929 - DNA, 20 bp, Homo sapiens
ccgtgtctcagcctctgcca

SEQ ID NO: 4494930 - DNA, 16 bp, Homo sapiens
ccgtgtctctgaggac

SEQ ID NO: 4494931 - DNA, 21 bp, Homo sapiens
ccgtgtgtgtggccggcctcc

SEQ ID NO: 4494932 - DNA, 14 bp, Homo sapiens
ccgtttctcctttt

SEQ ID NO: 4494933 - DNA, 15 bp, Homo sapiens
ccgttttggggacgt

SEQ ID NO: 4494934 - DNA, 14 bp, Homo sapiens
cctaaaagcaaaat

SEQ ID NO: 4494935 - DNA, 23 bp, Homo sapiens
cctaaaagcaaaataaaaactat

SEQ ID NO: 4494936 - DNA, 22 bp, Homo sapiens
cctaaaagtgggcttgattctg

SEQ ID NO: 4494937 - DNA, 13 bp, Homo sapiens
cctaaacctcagt

SEQ ID NO: 4494938 - DNA, 14 bp, Homo sapiens
cctaaactccaggg

SEQ ID NO: 4494939 - DNA, 16 bp, Homo sapiens
cctaaagaaaaacaaa

SEQ ID NO: 4494940 - DNA, 18 bp, Homo sapiens
cctaaagctaaaaatatt

SEQ ID NO: 4494941 - DNA, 22 bp, Homo sapiens
cctaaaggactattatgtggaa

SEQ ID NO: 4494942 - DNA, 18 bp, Homo sapiens
cctaaagtacagcctgga

SEQ ID NO: 4494943 - DNA, 19 bp, Homo sapiens
cctaaatagcagaaagaag

SEQ ID NO: 4494944 - DNA, 16 bp, Homo sapiens
cctaaccccagggcac

SEQ ID NO: 4494945 - DNA, 23 bp, Homo sapiens
cctaaccccagggcactgccagc

SEQ ID NO: 4494946 - DNA, 12 bp, Homo sapiens
cctaacctgccg

SEQ ID NO: 4494947 - DNA, 20 bp, Homo sapiens
cctaacttcctgtgcctttc

SEQ ID NO: 4494948 - DNA, 22 bp, Homo sapiens
cctaagagactgcgttctgcaa

SEQ ID NO: 4494949 - DNA, 21 bp, Homo sapiens
cctaagatctcggtttgccaa

SEQ ID NO: 4494950 - DNA, 17 bp, Homo sapiens
cctaagcattgcctggc

SEQ ID NO: 4494951 - DNA, 12 bp, Homo sapiens
cctaaggcccat

SEQ ID NO: 4494952 - DNA, 21 bp, Homo sapiens
cctaaggttcttgctttctct

SEQ ID NO: 4494953 - DNA, 22 bp, Homo sapiens
cctaagtcattcctccagtgca

SEQ ID NO: 4494954 - DNA, 18 bp, Homo sapiens
cctaagtggctgccttct

SEQ ID NO: 4494955 - DNA, 19 bp, Homo sapiens
cctaagtggctgccttctt

SEQ ID NO: 4494956 - DNA, 15 bp, Homo sapiens
cctaagtggctgctg

SEQ ID NO: 4494957 - DNA, 15 bp, Homo sapiens
cctaataaagagact

SEQ ID NO: 4494958 - DNA, 21 bp, Homo sapiens
cctaatcatacaccagaagac

SEQ ID NO: 4494959 - DNA, 19 bp, Homo sapiens
cctaatggagaagacccac

SEQ ID NO: 4494960 - DNA, 13 bp, Homo sapiens
cctaatgtgtttc

SEQ ID NO: 4494961 - DNA, 16 bp, Homo sapiens
cctaattcaattcaaa

SEQ ID NO: 4494962 - DNA, 15 bp, Homo sapiens
cctaatttctcctcc

SEQ ID NO: 4494963 - DNA, 17 bp, Homo sapiens
cctaatttctcctccct

SEQ ID NO: 4494964 - DNA, 18 bp, Homo sapiens
cctaatttctcctccctt

SEQ ID NO: 4494965 - DNA, 20 bp, Homo sapiens
cctaatttctcctcccttcc

SEQ ID NO: 4494966 - DNA, 23 bp, Homo sapiens
cctaatttctcctcccttccttt

SEQ ID NO: 4494967 - DNA, 23 bp, Homo sapiens
cctcagtattgatttgtcccaga

SEQ ID NO: 4494968 - DNA, 14 bp, Homo sapiens
cctcagtgctcctg

SEQ ID NO: 4494969 - DNA, 16 bp, Homo sapiens
cctcagtgctcctgga

SEQ ID NO: 4494970 - DNA, 18 bp, Homo sapiens
cctcagtgctcctggaaa

SEQ ID NO: 4494971 - DNA, 23 bp, Homo sapiens
cctcagttcaacctggtggcacc

SEQ ID NO: 4494972 - DNA, 17 bp, Homo sapiens
cctcagttcccttggcc

SEQ ID NO: 4494973 - DNA, 18 bp, Homo sapiens
cctcagttcccttggcct

SEQ ID NO: 4494974 - DNA, 21 bp, Homo sapiens
cctcagttcccttggcctcag

SEQ ID NO: 4494975 - DNA, 23 bp, Homo sapiens
cctcataaaaatctagcacactc

SEQ ID NO: 4494976 - DNA, 14 bp, Homo sapiens
cctcatcccgagca

SEQ ID NO: 4494977 - DNA, 22 bp, Homo sapiens
cctcatcctccctgaccctgct

SEQ ID NO: 4494978 - DNA, 23 bp, Homo sapiens
cctcatcctgctcttttgtgatg

SEQ ID NO: 4494979 - DNA, 16 bp, Homo sapiens
cctcatctcagaccct

SEQ ID NO: 4494980 - DNA, 21 bp, Homo sapiens
cctcatctcagaccctgctta

SEQ ID NO: 4494981 - DNA, 13 bp, Homo sapiens
cctcatctgcagg

SEQ ID NO: 4494982 - DNA, 18 bp, Homo sapiens
cctcatctgcaggacaga

SEQ ID NO: 4494983 - DNA, 17 bp, Homo sapiens
cctcatcttcttcacca

SEQ ID NO: 4494984 - DNA, 15 bp, Homo sapiens
cctcatctttctcct

SEQ ID NO: 4494985 - DNA, 21 bp, Homo sapiens
cctcatgaaaacacacataca

SEQ ID NO: 4494986 - DNA, 20 bp, Homo sapiens
cctcatgccaaccctgggct

SEQ ID NO: 4494987 - DNA, 15 bp, Homo sapiens
cctcatgcccacccc

SEQ ID NO: 4494988 - DNA, 20 bp, Homo sapiens
cctcatgcccaccccctgcc

SEQ ID NO: 4494989 - DNA, 22 bp, Homo sapiens
cctcatgcccaccccctgccct

SEQ ID NO: 4494990 - DNA, 24 bp, Homo sapiens
cctcatgcccaccccctgccctgc

SEQ ID NO: 4494991 - DNA, 16 bp, Homo sapiens
cctcatgggtcctagc

SEQ ID NO: 4494992 - DNA, 15 bp, Homo sapiens
cctcattcaggaaaa

SEQ ID NO: 4494993 - DNA, 16 bp, Homo sapiens
cctcattcaggaaaac

SEQ ID NO: 4494994 - DNA, 17 bp, Homo sapiens
cctccaaaggcccccta

SEQ ID NO: 4494995 - DNA, 21 bp, Homo sapiens
cctccaagcacagagcctggc

SEQ ID NO: 4494996 - DNA, 23 bp, Homo sapiens
cctccaagcacagagcctggccc

SEQ ID NO: 4494997 - DNA, 20 bp, Homo sapiens
cctccaaggaggggctgtaa

SEQ ID NO: 4494998 - DNA, 16 bp, Homo sapiens
cctccacacctgaact

SEQ ID NO: 4494999 - DNA, 12 bp, Homo sapiens
cctccacagaga

SEQ ID NO: 4495000 - DNA, 13 bp, Homo sapiens
cctccacagagag

SEQ ID NO: 4495001 - DNA, 14 bp, Homo sapiens
cctccacagagagg

SEQ ID NO: 4495002 - DNA, 13 bp, Homo sapiens
cctccaccccagg

SEQ ID NO: 4495003 - DNA, 13 bp, Homo sapiens
cctccaccctctg

SEQ ID NO: 4495004 - DNA, 21 bp, Homo sapiens
cctccacgttctgctcatcat

SEQ ID NO: 4495005 - DNA, 13 bp, Homo sapiens
cctccactccttc

SEQ ID NO: 4495006 - DNA, 14 bp, Homo sapiens
cctccactccttcc

SEQ ID NO: 4495007 - DNA, 20 bp, Homo sapiens
cctccactctagttctagat

SEQ ID NO: 4495008 - DNA, 14 bp, Homo sapiens
cctccactctcccc

SEQ ID NO: 4495009 - DNA, 15 bp, Homo sapiens
cctcctctgaaacag

SEQ ID NO: 4495010 - DNA, 13 bp, Homo sapiens
cctcctctgccac

SEQ ID NO: 4495011 - DNA, 14 bp, Homo sapiens
cctcctctgccacc

SEQ ID NO: 4495012 - DNA, 22 bp, Homo sapiens
cctcctctgtgaccaatgtctt

SEQ ID NO: 4495013 - DNA, 12 bp, Homo sapiens
cctcctcttgga

SEQ ID NO: 4495014 - DNA, 17 bp, Homo sapiens
cctcctgacccccatgt

SEQ ID NO: 4495015 - DNA, 19 bp, Homo sapiens
cctcctgcagacacctgga

SEQ ID NO: 4495016 - DNA, 16 bp, Homo sapiens
cctcctgcccaggaga

SEQ ID NO: 4495017 - DNA, 21 bp, Homo sapiens
cctcctgcccaggagagccag

SEQ ID NO: 4495018 - DNA, 14 bp, Homo sapiens
cctcctgccccctg

SEQ ID NO: 4495019 - DNA, 16 bp, Homo sapiens
cctcctgccccctgcc

SEQ ID NO: 4495020 - DNA, 18 bp, Homo sapiens
cctcctgccccctgccag

SEQ ID NO: 4495021 - DNA, 19 bp, Homo sapiens
cctcctgccccctgccagt

SEQ ID NO: 4495022 - DNA, 15 bp, Homo sapiens
cctcctgcctcagcc

SEQ ID NO: 4495023 - DNA, 17 bp, Homo sapiens
cctcctgctgcctaata

SEQ ID NO: 4495024 - DNA, 19 bp, Homo sapiens
cctcctggccaagcaggct

SEQ ID NO: 4495025 - DNA, 12 bp, Homo sapiens
cctcctggccag

SEQ ID NO: 4495026 - DNA, 16 bp, Homo sapiens
cctcctggccagacgc

SEQ ID NO: 4495027 - DNA, 22 bp, Homo sapiens
cctcctggccagacgctgccgc

SEQ ID NO: 4495028 - DNA, 16 bp, Homo sapiens
cctcctgggccctggg

SEQ ID NO: 4495029 - DNA, 17 bp, Homo sapiens
cctcctgggccctgggc

SEQ ID NO: 4495030 - DNA, 18 bp, Homo sapiens
cctcctgggccctgggct

SEQ ID NO: 4495031 - DNA, 20 bp, Homo sapiens
cctcctgggccctgggctgg

SEQ ID NO: 4495032 - DNA, 19 bp, Homo sapiens
cctcctgggctccagaggg

SEQ ID NO: 4495033 - DNA, 21 bp, Homo sapiens
cctcctggtgggtccaggggc

SEQ ID NO: 4495034 - DNA, 18 bp, Homo sapiens
cctcctgtgcctcccttt

SEQ ID NO: 4495035 - DNA, 16 bp, Homo sapiens
cctcctgttgcaccca

SEQ ID NO: 4495036 - DNA, 17 bp, Homo sapiens
cctcctgttgcacccag

SEQ ID NO: 4495037 - DNA, 23 bp, Homo sapiens
cctcctgttgcacccagccctgg

SEQ ID NO: 4495038 - DNA, 15 bp, Homo sapiens
cctccttccagatgc

SEQ ID NO: 4495039 - DNA, 23 bp, Homo sapiens
cctccttccagatgcccgagcac

SEQ ID NO: 4495040 - DNA, 15 bp, Homo sapiens
cctccttccccagac

SEQ ID NO: 4495041 - DNA, 18 bp, Homo sapiens
cctccttccccagaccca

SEQ ID NO: 4495042 - DNA, 19 bp, Homo sapiens
cctccttccccagacccag

SEQ ID NO: 4495043 - DNA, 12 bp, Homo sapiens
cctccttgccta

SEQ ID NO: 4495044 - DNA, 15 bp, Homo sapiens
cctccttggtgcctc

SEQ ID NO: 4495045 - DNA, 16 bp, Homo sapiens
cctccttgtccaccca

SEQ ID NO: 4495046 - DNA, 16 bp, Homo sapiens
cctccttgtgttgcac

SEQ ID NO: 4495047 - DNA, 21 bp, Homo sapiens
cctcctttcctcctctgactt

SEQ ID NO: 4495048 - DNA, 16 bp, Homo sapiens
cctccttttggcctgg

SEQ ID NO: 4495049 - DNA, 20 bp, Homo sapiens
cctccttttggcctggggga

SEQ ID NO: 4495050 - DNA, 16 bp, Homo sapiens
cctcgaaacacagaaa

SEQ ID NO: 4495051 - DNA, 17 bp, Homo sapiens
cctcgacagggcctgga

SEQ ID NO: 4495052 - DNA, 20 bp, Homo sapiens
cctcgacagggcctggagcc

SEQ ID NO: 4495053 - DNA, 21 bp, Homo sapiens
cctcgagatgggtgctggtcc

SEQ ID NO: 4495054 - DNA, 18 bp, Homo sapiens
cctcgaggggcccaggga

SEQ ID NO: 4495055 - DNA, 23 bp, Homo sapiens
cctcgaggggcccagggaagcct

SEQ ID NO: 4495056 - DNA, 19 bp, Homo sapiens
cctcgagtactgtgggcaa

SEQ ID NO: 4495057 - DNA, 21 bp, Homo sapiens
cctcgagtactgtgggcaatt

SEQ ID NO: 4495058 - DNA, 12 bp, Homo sapiens
cctcgccccagc

SEQ ID NO: 4495059 - DNA, 13 bp, Homo sapiens
cctcgccccagcc

SEQ ID NO: 4495060 - DNA, 17 bp, Homo sapiens
cctcgccttcaggagaa

SEQ ID NO: 4495061 - DNA, 15 bp, Homo sapiens
cctcgctcaccgctg

SEQ ID NO: 4495062 - DNA, 19 bp, Homo sapiens
cctcgctgccagctctgta

SEQ ID NO: 4495063 - DNA, 13 bp, Homo sapiens
cctcggacagagc

SEQ ID NO: 4495064 - DNA, 14 bp, Homo sapiens
cctcggacagagcc

SEQ ID NO: 4495065 - DNA, 20 bp, Homo sapiens
cctcggagacgggaccctgc

SEQ ID NO: 4495066 - DNA, 23 bp, Homo sapiens
cctcggagacgggaccctgccca

SEQ ID NO: 4495067 - DNA, 15 bp, Homo sapiens
cctcggagagcagca

SEQ ID NO: 4495068 - DNA, 17 bp, Homo sapiens
cctcggagagcagcagc

SEQ ID NO: 4495069 - DNA, 21 bp, Homo sapiens
cctcggagagcagcagcacca

SEQ ID NO: 4495070 - DNA, 15 bp, Homo sapiens
cctcggatcaccgag

SEQ ID NO: 4495071 - DNA, 21 bp, Homo sapiens
cctcggatgaccatactcaga

SEQ ID NO: 4495072 - DNA, 13 bp, Homo sapiens
cctcgggcctgct

SEQ ID NO: 4495073 - DNA, 14 bp, Homo sapiens
cctcggggacacca

SEQ ID NO: 4495074 - DNA, 18 bp, Homo sapiens
cctcggggacaccagagc

SEQ ID NO: 4495075 - DNA, 14 bp, Homo sapiens
cctcgggtctcctc

SEQ ID NO: 4495076 - DNA, 15 bp, Homo sapiens
cctcgtcctccccct

SEQ ID NO: 4495077 - DNA, 12 bp, Homo sapiens
cctcgtgcgccc

SEQ ID NO: 4495078 - DNA, 15 bp, Homo sapiens
cctcgttggaagagg

SEQ ID NO: 4495079 - DNA, 20 bp, Homo sapiens
cctcgttggaagaggaacag

SEQ ID NO: 4495080 - DNA, 18 bp, Homo sapiens
cctctagaagccaaggga

SEQ ID NO: 4495081 - DNA, 21 bp, Homo sapiens
cctctagagccttcagcctta

SEQ ID NO: 4495082 - DNA, 23 bp, Homo sapiens
cctctagttgagtttctggcgcc

SEQ ID NO: 4495083 - DNA, 18 bp, Homo sapiens
cctctatcccggctttgg

SEQ ID NO: 4495084 - DNA, 23 bp, Homo sapiens
cctctatggaaggaggcctccac

SEQ ID NO: 4495085 - DNA, 14 bp, Homo sapiens
cctctattgatgta

SEQ ID NO: 4495086 - DNA, 16 bp, Homo sapiens
cctctcaaattcagct

SEQ ID NO: 4495087 - DNA, 19 bp, Homo sapiens
cctctcagaggcctgctgc

SEQ ID NO: 4495088 - DNA, 20 bp, Homo sapiens
cctctcagagtgacagtcat

SEQ ID NO: 4495089 - DNA, 20 bp, Homo sapiens
ccgcggggaagctggctttg

SEQ ID NO: 4495090 - DNA, 14 bp, Homo sapiens
ccgcgggttctaga

SEQ ID NO: 4495091 - DNA, 13 bp, Homo sapiens
ccgctcccacagc

SEQ ID NO: 4495092 - DNA, 22 bp, Homo sapiens
ccgctcccacagcttcctgagg

SEQ ID NO: 4495093 - DNA, 18 bp, Homo sapiens
ccgctcccgctcccaggt

SEQ ID NO: 4495094 - DNA, 19 bp, Homo sapiens
ccgctctggatcctgcact

SEQ ID NO: 4495095 - DNA, 13 bp, Homo sapiens
ccgctgaggggtc

SEQ ID NO: 4495096 - DNA, 15 bp, Homo sapiens
ccgctgcaccacggc

SEQ ID NO: 4495097 - DNA, 24 bp, Homo sapiens
ccgctgccacccgcccacccgcct

SEQ ID NO: 4495098 - DNA, 15 bp, Homo sapiens
ccgctgccgctgcac

SEQ ID NO: 4495099 - DNA, 17 bp, Homo sapiens
ccgctgccgctgcacca

SEQ ID NO: 4495100 - DNA, 21 bp, Homo sapiens
ccgctgctgtgctctggggat

SEQ ID NO: 4495101 - DNA, 21 bp, Homo sapiens
ccgctggctggtgggccccca

SEQ ID NO: 4495102 - DNA, 20 bp, Homo sapiens
ccgctgtataaagcatgtgg

SEQ ID NO: 4495103 - DNA, 22 bp, Homo sapiens
ccgctgtggccggtgccagctg

SEQ ID NO: 4495104 - DNA, 16 bp, Homo sapiens
ccgctgttcacccaca

SEQ ID NO: 4495105 - DNA, 19 bp, Homo sapiens
ccgctgttcacccacaggg

SEQ ID NO: 4495106 - DNA, 19 bp, Homo sapiens
ccgcttgctcgcttgctgg

SEQ ID NO: 4495107 - DNA, 21 bp, Homo sapiens
ccgcttgctcgcttgctggaa

SEQ ID NO: 4495108 - DNA, 17 bp, Homo sapiens
ccgcttggagcagaggg

SEQ ID NO: 4495109 - DNA, 16 bp, Homo sapiens
ccgcttgtccagcgcc

SEQ ID NO: 4495110 - DNA, 14 bp, Homo sapiens
ccggaactgggctg

SEQ ID NO: 4495111 - DNA, 17 bp, Homo sapiens
ccggaactgggctggcg

SEQ ID NO: 4495112 - DNA, 11 bp, Homo sapiens
ccggacagagg

SEQ ID NO: 4495113 - DNA, 20 bp, Homo sapiens
ccggagattggacggcctga

SEQ ID NO: 4495114 - DNA, 21 bp, Homo sapiens
ccggagattggacggcctgat

SEQ ID NO: 4495115 - DNA, 15 bp, Homo sapiens
ccggaggactgagcc

SEQ ID NO: 4495116 - DNA, 18 bp, Homo sapiens
ccggaggactgagccccc

SEQ ID NO: 4495117 - DNA, 20 bp, Homo sapiens
ccggcagggcccccaataaa

SEQ ID NO: 4495118 - DNA, 11 bp, Homo sapiens
ccggcagggcg

SEQ ID NO: 4495119 - DNA, 21 bp, Homo sapiens
ccggcagggcgggcagagggc

SEQ ID NO: 4495120 - DNA, 18 bp, Homo sapiens
ccggccaaggacccaggc

SEQ ID NO: 4495121 - DNA, 20 bp, Homo sapiens
ccggccaaggacccaggcgc

SEQ ID NO: 4495122 - DNA, 18 bp, Homo sapiens
ccggccacacccctctgc

SEQ ID NO: 4495123 - DNA, 13 bp, Homo sapiens
ccggccacagctg

SEQ ID NO: 4495124 - DNA, 19 bp, Homo sapiens
ccggcccagatgtgtcccc

SEQ ID NO: 4495125 - DNA, 18 bp, Homo sapiens
ccggcccccggccaagga

SEQ ID NO: 4495126 - DNA, 15 bp, Homo sapiens
ccggccccctggtct

SEQ ID NO: 4495127 - DNA, 15 bp, Homo sapiens
ccggcccggctgagc

SEQ ID NO: 4495128 - DNA, 19 bp, Homo sapiens
ccggcccggctgagccctg

SEQ ID NO: 4495129 - DNA, 17 bp, Homo sapiens
ccggccctccagagccc

SEQ ID NO: 4495130 - DNA, 22 bp, Homo sapiens
ccggccctgggctcggaggctg

SEQ ID NO: 4495131 - DNA, 11 bp, Homo sapiens
ccggcctcctc

SEQ ID NO: 4495132 - DNA, 15 bp, Homo sapiens
ccggcctcctcctca

SEQ ID NO: 4495133 - DNA, 14 bp, Homo sapiens
ccggcctctccctg

SEQ ID NO: 4495134 - DNA, 15 bp, Homo sapiens
ccggcctctccctgc

SEQ ID NO: 4495135 - DNA, 19 bp, Homo sapiens
ccggcctctccctgcctgt

SEQ ID NO: 4495136 - DNA, 21 bp, Homo sapiens
ccggcctctccctgcctgtgg

SEQ ID NO: 4495137 - DNA, 21 bp, Homo sapiens
ccggcctgggtgacagagtga

SEQ ID NO: 4495138 - DNA, 22 bp, Homo sapiens
ccggcctgggtgacagagtgag

SEQ ID NO: 4495139 - DNA, 20 bp, Homo sapiens
ccggcggcagccccacttca

SEQ ID NO: 4495140 - DNA, 17 bp, Homo sapiens
ccggcggctactctgga

SEQ ID NO: 4495141 - DNA, 18 bp, Homo sapiens
ccggcgggtgacagctcc

SEQ ID NO: 4495142 - DNA, 14 bp, Homo sapiens
ccggcgtcagcctc

SEQ ID NO: 4495143 - DNA, 19 bp, Homo sapiens
ccggcgtcagcctccagcc

SEQ ID NO: 4495144 - DNA, 13 bp, Homo sapiens
ccctcagccccag

SEQ ID NO: 4495145 - DNA, 15 bp, Homo sapiens
ccctcagctctctgg

SEQ ID NO: 4495146 - DNA, 13 bp, Homo sapiens
ccctcaggactgc

SEQ ID NO: 4495147 - DNA, 17 bp, Homo sapiens
ccctcaggactgcaaca

SEQ ID NO: 4495148 - DNA, 20 bp, Homo sapiens
ccctcaggcccaggagtcca

SEQ ID NO: 4495149 - DNA, 21 bp, Homo sapiens
ccctcaggcccaggagtccag

SEQ ID NO: 4495150 - DNA, 20 bp, Homo sapiens
ccctcagggagcctccccat

SEQ ID NO: 4495151 - DNA, 15 bp, Homo sapiens
ccctcaggggcctct

SEQ ID NO: 4495152 - DNA, 23 bp, Homo sapiens
ccctcataagtttgtttaaacac

SEQ ID NO: 4495153 - DNA, 14 bp, Homo sapiens
ccctcatctgcagg

SEQ ID NO: 4495154 - DNA, 16 bp, Homo sapiens
ccctcattcaggaaaa

SEQ ID NO: 4495155 - DNA, 12 bp, Homo sapiens
ccctccaaagag

SEQ ID NO: 4495156 - DNA, 14 bp, Homo sapiens
ccctccaccccaca

SEQ ID NO: 4495157 - DNA, 13 bp, Homo sapiens
ccctccaccccag

SEQ ID NO: 4495158 - DNA, 15 bp, Homo sapiens
ccctccacctcaaga

SEQ ID NO: 4495159 - DNA, 20 bp, Homo sapiens
ccctccacgcctcctggcca

SEQ ID NO: 4495160 - DNA, 15 bp, Homo sapiens
ccctccactgctggg

SEQ ID NO: 4495161 - DNA, 13 bp, Homo sapiens
ccctccagctgcg

SEQ ID NO: 4495162 - DNA, 18 bp, Homo sapiens
ccctccagtgctggattt

SEQ ID NO: 4495163 - DNA, 17 bp, Homo sapiens
ccctccattctgcactc

SEQ ID NO: 4495164 - DNA, 15 bp, Homo sapiens
ccctccattgggcac

SEQ ID NO: 4495165 - DNA, 23 bp, Homo sapiens
ccctcccaacagagctgggctac

SEQ ID NO: 4495166 - DNA, 17 bp, Homo sapiens
ccctcccacccccagcc

SEQ ID NO: 4495167 - DNA, 20 bp, Homo sapiens
ccctcccacccccagccccg

SEQ ID NO: 4495168 - DNA, 18 bp, Homo sapiens
ccctcccagacaggccct

SEQ ID NO: 4495169 - DNA, 15 bp, Homo sapiens
ccctccccaactccc

SEQ ID NO: 4495170 - DNA, 10 bp, Homo sapiens
ccctccccac

SEQ ID NO: 4495171 - DNA, 20 bp, Homo sapiens
ccctccccagactctcaggt

SEQ ID NO: 4495172 - DNA, 14 bp, Homo sapiens
ccctccccagccag

SEQ ID NO: 4495173 - DNA, 16 bp, Homo sapiens
ccctccccagccagcc

SEQ ID NO: 4495174 - DNA, 17 bp, Homo sapiens
ccctccccagccagccc

SEQ ID NO: 4495175 - DNA, 15 bp, Homo sapiens
ccctcccccttcccc

SEQ ID NO: 4495176 - DNA, 11 bp, Homo sapiens
ccctcccctgc

SEQ ID NO: 4495177 - DNA, 15 bp, Homo sapiens
ccctccctacctcaa

SEQ ID NO: 4495178 - DNA, 14 bp, Homo sapiens
ccctccctgcctga

SEQ ID NO: 4495179 - DNA, 17 bp, Homo sapiens
ccctccctgcctgaggg

SEQ ID NO: 4495180 - DNA, 14 bp, Homo sapiens
ccctccctggctcc

SEQ ID NO: 4495181 - DNA, 16 bp, Homo sapiens
ccctccctggctccca

SEQ ID NO: 4495182 - DNA, 13 bp, Homo sapiens
ccctccctgtcct

SEQ ID NO: 4495183 - DNA, 16 bp, Homo sapiens
ccctccctgtctccag

SEQ ID NO: 4495184 - DNA, 18 bp, Homo sapiens
ccctccctgtctccaggg

SEQ ID NO: 4495185 - DNA, 21 bp, Homo sapiens
ccctccgaccacttccagggg

SEQ ID NO: 4495186 - DNA, 16 bp, Homo sapiens
ccctccgccgtgccgg

SEQ ID NO: 4495187 - DNA, 16 bp, Homo sapiens
ccctccgcctccagga

SEQ ID NO: 4495188 - DNA, 13 bp, Homo sapiens
ccctccgccttct

SEQ ID NO: 4495189 - DNA, 15 bp, Homo sapiens
ccctccggccccgtc

SEQ ID NO: 4495190 - DNA, 16 bp, Homo sapiens
ccctcctcacctctgg

SEQ ID NO: 4495191 - DNA, 17 bp, Homo sapiens
ccctcctcacctctgga

SEQ ID NO: 4495192 - DNA, 18 bp, Homo sapiens
ccctcctcacctctggac

SEQ ID NO: 4495193 - DNA, 13 bp, Homo sapiens
ccctcctcagcca

SEQ ID NO: 4495194 - DNA, 14 bp, Homo sapiens
ccctcctccagtac

SEQ ID NO: 4495195 - DNA, 20 bp, Homo sapiens
cccttccatgtgcctttctt

SEQ ID NO: 4495196 - DNA, 14 bp, Homo sapiens
cccttcccagggca

SEQ ID NO: 4495197 - DNA, 15 bp, Homo sapiens
cccttcccagggcac

SEQ ID NO: 4495198 - DNA, 16 bp, Homo sapiens
cccttcccagggcacc

SEQ ID NO: 4495199 - DNA, 10 bp, Homo sapiens
cccttcccct

SEQ ID NO: 4495200 - DNA, 13 bp, Homo sapiens
cccttcccctgct

SEQ ID NO: 4495201 - DNA, 16 bp, Homo sapiens
cccttcccctgctgac

SEQ ID NO: 4495202 - DNA, 18 bp, Homo sapiens
cccttccctctctccctg

SEQ ID NO: 4495203 - DNA, 13 bp, Homo sapiens
cccttccctggcc

SEQ ID NO: 4495204 - DNA, 13 bp, Homo sapiens
cccttcctggcac

SEQ ID NO: 4495205 - DNA, 18 bp, Homo sapiens
cccttctacactctcctg

SEQ ID NO: 4495206 - DNA, 16 bp, Homo sapiens
cccttctacctgccac

SEQ ID NO: 4495207 - DNA, 20 bp, Homo sapiens
cccttctatacccacccaga

SEQ ID NO: 4495208 - DNA, 22 bp, Homo sapiens
cccttctcatctccccacgccc

SEQ ID NO: 4495209 - DNA, 20 bp, Homo sapiens
cccttctcggggtgggacag

SEQ ID NO: 4495210 - DNA, 13 bp, Homo sapiens
cccttctgggtcc

SEQ ID NO: 4495211 - DNA, 12 bp, Homo sapiens
cccttctgtgtc

SEQ ID NO: 4495212 - DNA, 17 bp, Homo sapiens
cccttctgtgtcacagt

SEQ ID NO: 4495213 - DNA, 15 bp, Homo sapiens
cccttgaccattggc

SEQ ID NO: 4495214 - DNA, 17 bp, Homo sapiens
cccttgactttgctcct

SEQ ID NO: 4495215 - DNA, 20 bp, Homo sapiens
cccttgcagggtgggtgagc

SEQ ID NO: 4495216 - DNA, 23 bp, Homo sapiens
cccttgcagttcagcaccaccct

SEQ ID NO: 4495217 - DNA, 20 bp, Homo sapiens
cccttgcctccccatttccc

SEQ ID NO: 4495218 - DNA, 11 bp, Homo sapiens
cccttgcctct

SEQ ID NO: 4495219 - DNA, 12 bp, Homo sapiens
cccttgcctctg

SEQ ID NO: 4495220 - DNA, 13 bp, Homo sapiens
cccttgctttcct

SEQ ID NO: 4495221 - DNA, 18 bp, Homo sapiens
cccttgctttcctgggcc

SEQ ID NO: 4495222 - DNA, 20 bp, Homo sapiens
cccttgctttcctgggcctt

SEQ ID NO: 4495223 - DNA, 14 bp, Homo sapiens
cccttggacatttt

SEQ ID NO: 4495224 - DNA, 22 bp, Homo sapiens
cccttgtcggccccaccagtgc

SEQ ID NO: 4495225 - DNA, 10 bp, Homo sapiens
cccttgtggg

SEQ ID NO: 4495226 - DNA, 19 bp, Homo sapiens
ccctttaggatgttttcct

SEQ ID NO: 4495227 - DNA, 17 bp, Homo sapiens
ccctttcccctagatcc

SEQ ID NO: 4495228 - DNA, 18 bp, Homo sapiens
ccctttccttccatccct

SEQ ID NO: 4495229 - DNA, 22 bp, Homo sapiens
ccctttctcccctgcccccagg

SEQ ID NO: 4495230 - DNA, 12 bp, Homo sapiens
ccctttgagtgc

SEQ ID NO: 4495231 - DNA, 15 bp, Homo sapiens
ccctttgggcccagg

SEQ ID NO: 4495232 - DNA, 20 bp, Homo sapiens
ccctttggtttttttcttct

SEQ ID NO: 4495233 - DNA, 19 bp, Homo sapiens
ccctttgtggattcttttt

SEQ ID NO: 4495234 - DNA, 19 bp, Homo sapiens
cccttttttctgcctcctt

SEQ ID NO: 4495235 - DNA, 21 bp, Homo sapiens
cccttttttctgcctccttta

SEQ ID NO: 4495236 - DNA, 11 bp, Homo sapiens
ccgaaaaatgt

SEQ ID NO: 4495237 - DNA, 21 bp, Homo sapiens
ccgaagccatcacttctcccc

SEQ ID NO: 4495238 - DNA, 21 bp, Homo sapiens
ccgaagtggactggcccctgg

SEQ ID NO: 4495239 - DNA, 22 bp, Homo sapiens
ccgaatattgagcaatatgtca

SEQ ID NO: 4495240 - DNA, 18 bp, Homo sapiens
ccgaatttggtacacatg

SEQ ID NO: 4495241 - DNA, 19 bp, Homo sapiens
ccgaatttggtacacatgt

SEQ ID NO: 4495242 - DNA, 22 bp, Homo sapiens
ccgaatttggtacacatgtgtt

SEQ ID NO: 4495243 - DNA, 11 bp, Homo sapiens
ccgactccagc

SEQ ID NO: 4495244 - DNA, 13 bp, Homo sapiens
ccgactccagcca

SEQ ID NO: 4495245 - DNA, 18 bp, Homo sapiens
ccgactctgcacccgcct

SEQ ID NO: 4495246 - DNA, 20 bp, Homo sapiens
ccgagagcctgctcccccac

SEQ ID NO: 4495247 - DNA, 21 bp, Homo sapiens
ccgagagtagccgagagcctg

SEQ ID NO: 4495248 - DNA, 22 bp, Homo sapiens
ccgagcacatagagctttttaa

SEQ ID NO: 4495249 - DNA, 15 bp, Homo sapiens
ccgagccctgactcc

SEQ ID NO: 4495250 - DNA, 18 bp, Homo sapiens
ccgagccctgactcctgg

SEQ ID NO: 4495251 - DNA, 14 bp, Homo sapiens
ccgagcgcctgcgt

SEQ ID NO: 4495252 - DNA, 22 bp, Homo sapiens
ccgagcgggtgcaagcactcgg

SEQ ID NO: 4495253 - DNA, 16 bp, Homo sapiens
ccgagctcctggggag

SEQ ID NO: 4495254 - DNA, 17 bp, Homo sapiens
ccccaggtacacctccc

SEQ ID NO: 4495255 - DNA, 20 bp, Homo sapiens
ccccaggtggctgacccagt

SEQ ID NO: 4495256 - DNA, 15 bp, Homo sapiens
ccccagtcagcctct

SEQ ID NO: 4495257 - DNA, 16 bp, Homo sapiens
ccccagtcagcctctc

SEQ ID NO: 4495258 - DNA, 21 bp, Homo sapiens
ccccagtcagcctctctccca

SEQ ID NO: 4495259 - DNA, 16 bp, Homo sapiens
ccccagtgcctgccac

SEQ ID NO: 4495260 - DNA, 17 bp, Homo sapiens
ccccagtgcctgccact

SEQ ID NO: 4495261 - DNA, 15 bp, Homo sapiens
ccccagttcctagca

SEQ ID NO: 4495262 - DNA, 13 bp, Homo sapiens
ccccatcagtgct

SEQ ID NO: 4495263 - DNA, 13 bp, Homo sapiens
ccccatccctacc

SEQ ID NO: 4495264 - DNA, 14 bp, Homo sapiens
ccccatcctcatcc

SEQ ID NO: 4495265 - DNA, 15 bp, Homo sapiens
ccccatcggccaaga

SEQ ID NO: 4495266 - DNA, 18 bp, Homo sapiens
ccccatctccctgcctgg

SEQ ID NO: 4495267 - DNA, 19 bp, Homo sapiens
ccccatctgtccagctggg

SEQ ID NO: 4495268 - DNA, 23 bp, Homo sapiens
ccccatcttgatctttgagccca

SEQ ID NO: 4495269 - DNA, 15 bp, Homo sapiens
ccccatgaggaagga

SEQ ID NO: 4495270 - DNA, 13 bp, Homo sapiens
ccccatgccaaag

SEQ ID NO: 4495271 - DNA, 17 bp, Homo sapiens
ccccatgcctgtccagc

SEQ ID NO: 4495272 - DNA, 23 bp, Homo sapiens
ccccatgcctgtccagcctgggc

SEQ ID NO: 4495273 - DNA, 19 bp, Homo sapiens
ccccatgctgccttcaggg

SEQ ID NO: 4495274 - DNA, 19 bp, Homo sapiens
ccccatggagctgggctaa

SEQ ID NO: 4495275 - DNA, 20 bp, Homo sapiens
ccccatggccccaggcccac

SEQ ID NO: 4495276 - DNA, 17 bp, Homo sapiens
ccccatgggctgtgtcc

SEQ ID NO: 4495277 - DNA, 23 bp, Homo sapiens
ccccatgggctgtgtcctaaggc

SEQ ID NO: 4495278 - DNA, 17 bp, Homo sapiens
ccccatgtctctcagaa

SEQ ID NO: 4495279 - DNA, 21 bp, Homo sapiens
ccccattctgtgtcccatgtc

SEQ ID NO: 4495280 - DNA, 22 bp, Homo sapiens
ccccattctttgcttgaacaca

SEQ ID NO: 4495281 - DNA, 19 bp, Homo sapiens
ccccatttcccatctgcac

SEQ ID NO: 4495282 - DNA, 16 bp, Homo sapiens
ccccatttcctcacac

SEQ ID NO: 4495283 - DNA, 15 bp, Homo sapiens
ccccatttctgcctc

SEQ ID NO: 4495284 - DNA, 18 bp, Homo sapiens
ccccatttctgcctcgct

SEQ ID NO: 4495285 - DNA, 16 bp, Homo sapiens
ccccatttgtcccaga

SEQ ID NO: 4495286 - DNA, 14 bp, Homo sapiens
cccccaaatttaat

SEQ ID NO: 4495287 - DNA, 15 bp, Homo sapiens
cccccaactcaggac

SEQ ID NO: 4495288 - DNA, 23 bp, Homo sapiens
cccccaactgtggtagctccagc

SEQ ID NO: 4495289 - DNA, 12 bp, Homo sapiens
cccccaataaac

SEQ ID NO: 4495290 - DNA, 14 bp, Homo sapiens
cccccaataaacca

SEQ ID NO: 4495291 - DNA, 16 bp, Homo sapiens
cccccaataaaggcag

SEQ ID NO: 4495292 - DNA, 21 bp, Homo sapiens
cccccaataaaggcagctgcc

SEQ ID NO: 4495293 - DNA, 20 bp, Homo sapiens
cccccaccggaactgggctg

SEQ ID NO: 4495294 - DNA, 21 bp, Homo sapiens
cccccactttcaagacagatg

SEQ ID NO: 4495295 - DNA, 16 bp, Homo sapiens
cccccagaaagcctcc

SEQ ID NO: 4495296 - DNA, 18 bp, Homo sapiens
cccccagagagagctctg

SEQ ID NO: 4495297 - DNA, 23 bp, Homo sapiens
cccccagccccgactccagccag

SEQ ID NO: 4495298 - DNA, 24 bp, Homo sapiens
cccccagccccgactccagccagc

SEQ ID NO: 4495299 - DNA, 22 bp, Homo sapiens
cccccagcccctcctccctcaa

SEQ ID NO: 4495300 - DNA, 20 bp, Homo sapiens
cccccagccttgcccagctt

SEQ ID NO: 4495301 - DNA, 12 bp, Homo sapiens
cccccaggactg

SEQ ID NO: 4495302 - DNA, 11 bp, Homo sapiens
cccccaggagg

SEQ ID NO: 4495303 - DNA, 15 bp, Homo sapiens
cccccagtccccacc

SEQ ID NO: 4495304 - DNA, 12 bp, Homo sapiens
cccccatctccc

SEQ ID NO: 4495305 - DNA, 12 bp, Homo sapiens
cccccattttac

SEQ ID NO: 4495306 - DNA, 21 bp, Homo sapiens
ccccccaagatgagctgcagc

SEQ ID NO: 4495307 - DNA, 12 bp, Homo sapiens
ccccccactgca

SEQ ID NO: 4495308 - DNA, 13 bp, Homo sapiens
ccccccagcacta

SEQ ID NO: 4495309 - DNA, 14 bp, Homo sapiens
ccccccagcactga

SEQ ID NO: 4495310 - DNA, 12 bp, Homo sapiens
cccccgccatgc

SEQ ID NO: 4495311 - DNA, 16 bp, Homo sapiens
cccccgcgggttctag

SEQ ID NO: 4495312 - DNA, 17 bp, Homo sapiens
cccccgcgggttctaga

SEQ ID NO: 4495313 - DNA, 14 bp, Homo sapiens
cccccggccaagga

SEQ ID NO: 4495314 - DNA, 13 bp, Homo sapiens
cccccggccccct

SEQ ID NO: 4495315 - DNA, 17 bp, Homo sapiens
ccccctcccaccgctgc

SEQ ID NO: 4495316 - DNA, 12 bp, Homo sapiens
ccccctcccaga

SEQ ID NO: 4495317 - DNA, 13 bp, Homo sapiens
ccccctccccagg

SEQ ID NO: 4495318 - DNA, 14 bp, Homo sapiens
ccccctcctcagcc

SEQ ID NO: 4495319 - DNA, 16 bp, Homo sapiens
ccccctgccagtgcct

SEQ ID NO: 4495320 - DNA, 23 bp, Homo sapiens
ccccctgccccttctacactctc

SEQ ID NO: 4495321 - DNA, 15 bp, Homo sapiens
ccccctgctggctct

SEQ ID NO: 4495322 - DNA, 18 bp, Homo sapiens
ccccctgctggctcttct

SEQ ID NO: 4495323 - DNA, 20 bp, Homo sapiens
ccccctgtggatgctgctgc

SEQ ID NO: 4495324 - DNA, 19 bp, Homo sapiens
ccccgatgtcccctgcggg

SEQ ID NO: 4495325 - DNA, 16 bp, Homo sapiens
ccccgcacagccaccc

SEQ ID NO: 4495326 - DNA, 21 bp, Homo sapiens
ccccgcagacggtctgtgtgc

SEQ ID NO: 4495327 - DNA, 14 bp, Homo sapiens
ccccgccagggctg

SEQ ID NO: 4495328 - DNA, 18 bp, Homo sapiens
ccccgcgctcgcccagca

SEQ ID NO: 4495329 - DNA, 22 bp, Homo sapiens
ccccgcgctcgcccagcaggag

SEQ ID NO: 4495330 - DNA, 21 bp, Homo sapiens
ccccgcgtggaactcgtgtct

SEQ ID NO: 4495331 - DNA, 13 bp, Homo sapiens
ccccgctctgcat

SEQ ID NO: 4495332 - DNA, 21 bp, Homo sapiens
ccccgctctgcatgcggccca

SEQ ID NO: 4495333 - DNA, 15 bp, Homo sapiens
ccccgcttgtccagc

SEQ ID NO: 4495334 - DNA, 19 bp, Homo sapiens
cccgaggacccagacccag

SEQ ID NO: 4495335 - DNA, 19 bp, Homo sapiens
cccgaggagctgggcccct

SEQ ID NO: 4495336 - DNA, 23 bp, Homo sapiens
cccgagggaggggaagcttctgt

SEQ ID NO: 4495337 - DNA, 17 bp, Homo sapiens
cccgaggggagggcagg

SEQ ID NO: 4495338 - DNA, 15 bp, Homo sapiens
cccgagttcctctgg

SEQ ID NO: 4495339 - DNA, 16 bp, Homo sapiens
cccgatattctccctg

SEQ ID NO: 4495340 - DNA, 15 bp, Homo sapiens
cccgcacagccaccc

SEQ ID NO: 4495341 - DNA, 20 bp, Homo sapiens
cccgcacgactgcgggagcc

SEQ ID NO: 4495342 - DNA, 15 bp, Homo sapiens
cccgcactctgcccc

SEQ ID NO: 4495343 - DNA, 19 bp, Homo sapiens
cccgcagacggtctgtgtg

SEQ ID NO: 4495344 - DNA, 20 bp, Homo sapiens
cccgcagacggtctgtgtgc

SEQ ID NO: 4495345 - DNA, 22 bp, Homo sapiens
cccgcaggaactgggctgggcc

SEQ ID NO: 4495346 - DNA, 17 bp, Homo sapiens
cccgcatgtgtgcctgg

SEQ ID NO: 4495347 - DNA, 11 bp, Homo sapiens
cccgccagggc

SEQ ID NO: 4495348 - DNA, 18 bp, Homo sapiens
cccgccccagagtggccc

SEQ ID NO: 4495349 - DNA, 20 bp, Homo sapiens
cccgcccccacgtcgtgggg

SEQ ID NO: 4495350 - DNA, 13 bp, Homo sapiens
cccgccccgcccc

SEQ ID NO: 4495351 - DNA, 13 bp, Homo sapiens
cccgccctcaggg

SEQ ID NO: 4495352 - DNA, 21 bp, Homo sapiens
cccgccctcaggggcctctct

SEQ ID NO: 4495353 - DNA, 12 bp, Homo sapiens
cccgcctccact

SEQ ID NO: 4495354 - DNA, 24 bp, Homo sapiens
cccgcctccctctcagaggcctgc

SEQ ID NO: 4495355 - DNA, 18 bp, Homo sapiens
cccgcctcggcctcccaa

SEQ ID NO: 4495356 - DNA, 21 bp, Homo sapiens
cccgcctgcccagactgatga

SEQ ID NO: 4495357 - DNA, 14 bp, Homo sapiens
cccgccttgtgaga

SEQ ID NO: 4495358 - DNA, 17 bp, Homo sapiens
cccgcgggttctagacg

SEQ ID NO: 4495359 - DNA, 18 bp, Homo sapiens
cccgctccatggaaaagc

SEQ ID NO: 4495360 - DNA, 12 bp, Homo sapiens
cccgctcccaca

SEQ ID NO: 4495361 - DNA, 15 bp, Homo sapiens
cccgctcccacaccc

SEQ ID NO: 4495362 - DNA, 17 bp, Homo sapiens
cccgctcccacacccct

SEQ ID NO: 4495363 - DNA, 14 bp, Homo sapiens
cccgctcccaggtt

SEQ ID NO: 4495364 - DNA, 17 bp, Homo sapiens
cccgctcctggttggtc

SEQ ID NO: 4495365 - DNA, 22 bp, Homo sapiens
cccgctctgcatgcggcccagc

SEQ ID NO: 4495366 - DNA, 11 bp, Homo sapiens
cccgctgctgt

SEQ ID NO: 4495367 - DNA, 12 bp, Homo sapiens
cccgctgtggcc

SEQ ID NO: 4495368 - DNA, 19 bp, Homo sapiens
cccggaattccgtcaccac

SEQ ID NO: 4495369 - DNA, 18 bp, Homo sapiens
cccggagcaggggtctga

SEQ ID NO: 4495370 - DNA, 17 bp, Homo sapiens
cccggaggagctgggcc

SEQ ID NO: 4495371 - DNA, 13 bp, Homo sapiens
cccggcagacgcc

SEQ ID NO: 4495372 - DNA, 21 bp, Homo sapiens
cccggcagggcgggcagaggg

SEQ ID NO: 4495373 - DNA, 23 bp, Homo sapiens
cccggccaaggacccaggcgctg

SEQ ID NO: 4495374 - DNA, 24 bp, Homo sapiens
cccggccaaggacccaggcgctgc

SEQ ID NO: 4495375 - DNA, 21 bp, Homo sapiens
cccggccaagtaaaatgtttt

SEQ ID NO: 4495376 - DNA, 13 bp, Homo sapiens
cccggccacagct

SEQ ID NO: 4495377 - DNA, 14 bp, Homo sapiens
cccggccacagctg

SEQ ID NO: 4495378 - DNA, 21 bp, Homo sapiens
cccggccccccgcgctcgccc

SEQ ID NO: 4495379 - DNA, 17 bp, Homo sapiens
ccccagaaagcctcctg

SEQ ID NO: 4495380 - DNA, 19 bp, Homo sapiens
ccccagaaagcctcctgcc

SEQ ID NO: 4495381 - DNA, 10 bp, Homo sapiens
ccccagagag

SEQ ID NO: 4495382 - DNA, 22 bp, Homo sapiens
ccccagagagagctctgcacgt

SEQ ID NO: 4495383 - DNA, 12 bp, Homo sapiens
ccccagaggcag

SEQ ID NO: 4495384 - DNA, 16 bp, Homo sapiens
ccccagaggctcccaa

SEQ ID NO: 4495385 - DNA, 17 bp, Homo sapiens
ccccagcaagcgggagc

SEQ ID NO: 4495386 - DNA, 12 bp, Homo sapiens
ccccagcactga

SEQ ID NO: 4495387 - DNA, 13 bp, Homo sapiens
ccccagcactgag

SEQ ID NO: 4495388 - DNA, 15 bp, Homo sapiens
ccccagcactgagga

SEQ ID NO: 4495389 - DNA, 15 bp, Homo sapiens
ccccagcagtttctg

SEQ ID NO: 4495390 - DNA, 19 bp, Homo sapiens
ccccagcagtttctgtcct

SEQ ID NO: 4495391 - DNA, 16 bp, Homo sapiens
ccccagcattccagct

SEQ ID NO: 4495392 - DNA, 22 bp, Homo sapiens
ccccagcattccagctctgccc

SEQ ID NO: 4495393 - DNA, 12 bp, Homo sapiens
ccccagccacag

SEQ ID NO: 4495394 - DNA, 16 bp, Homo sapiens
ccccagccacaggcca

SEQ ID NO: 4495395 - DNA, 18 bp, Homo sapiens
ccccagcccacagagcct

SEQ ID NO: 4495396 - DNA, 19 bp, Homo sapiens
ccccagcccaccctcctgt

SEQ ID NO: 4495397 - DNA, 11 bp, Homo sapiens
ccccagccccc

SEQ ID NO: 4495398 - DNA, 21 bp, Homo sapiens
ccccagccccctcccaccgct

SEQ ID NO: 4495399 - DNA, 17 bp, Homo sapiens
ccccagccccctttggg

SEQ ID NO: 4495400 - DNA, 17 bp, Homo sapiens
ccccagccccgactcca

SEQ ID NO: 4495401 - DNA, 19 bp, Homo sapiens
ccccagccccgactccagc

SEQ ID NO: 4495402 - DNA, 13 bp, Homo sapiens
ccccagcctgggc

SEQ ID NO: 4495403 - DNA, 17 bp, Homo sapiens
ccccagcgggctggcgg

SEQ ID NO: 4495404 - DNA, 14 bp, Homo sapiens
ccccagctcccaca

SEQ ID NO: 4495405 - DNA, 13 bp, Homo sapiens
ccccaggactggg

SEQ ID NO: 4495406 - DNA, 14 bp, Homo sapiens
ccccaggaggcagc

SEQ ID NO: 4495407 - DNA, 14 bp, Homo sapiens
ccccaggcagaggg

SEQ ID NO: 4495408 - DNA, 14 bp, Homo sapiens
ccccaggccccaga

SEQ ID NO: 4495409 - DNA, 12 bp, Homo sapiens
ccccaggccccg

SEQ ID NO: 4495410 - DNA, 16 bp, Homo sapiens
ccccaggcctgtccac

SEQ ID NO: 4495411 - DNA, 18 bp, Homo sapiens
ccccaggctcgtggactg

SEQ ID NO: 4495412 - DNA, 11 bp, Homo sapiens
ccccaggctgg

SEQ ID NO: 4495413 - DNA, 15 bp, Homo sapiens
ccccaggctggagac

SEQ ID NO: 4495414 - DNA, 12 bp, Homo sapiens
ccccagggcact

SEQ ID NO: 4495415 - DNA, 13 bp, Homo sapiens
ccccaggggagaa

SEQ ID NO: 4495416 - DNA, 21 bp, Homo sapiens
cccagtgggaagagtgtgggg

SEQ ID NO: 4495417 - DNA, 18 bp, Homo sapiens
cccagtgggacagaggag

SEQ ID NO: 4495418 - DNA, 16 bp, Homo sapiens
cccagtgggtctggga

SEQ ID NO: 4495419 - DNA, 17 bp, Homo sapiens
cccagtgggtctgggat

SEQ ID NO: 4495420 - DNA, 19 bp, Homo sapiens
cccagtggtcagcaggtgt

SEQ ID NO: 4495421 - DNA, 21 bp, Homo sapiens
cccagtgtcaagttgtgcttg

SEQ ID NO: 4495422 - DNA, 16 bp, Homo sapiens
cccagttcctagcact

SEQ ID NO: 4495423 - DNA, 23 bp, Homo sapiens
cccatacaatgtatgtacaatac

SEQ ID NO: 4495424 - DNA, 20 bp, Homo sapiens
cccatagatactctcttctt

SEQ ID NO: 4495425 - DNA, 14 bp, Homo sapiens
cccatagctgggac

SEQ ID NO: 4495426 - DNA, 23 bp, Homo sapiens
cccatagggtcggaggtgctgtc

SEQ ID NO: 4495427 - DNA, 12 bp, Homo sapiens
cccatatataaa

SEQ ID NO: 4495428 - DNA, 13 bp, Homo sapiens
cccatatataaat

SEQ ID NO: 4495429 - DNA, 15 bp, Homo sapiens
cccatatataaatta

SEQ ID NO: 4495430 - DNA, 20 bp, Homo sapiens
cccatatttgtacaccaata

SEQ ID NO: 4495431 - DNA, 22 bp, Homo sapiens
cccatcagtgctccctcacatg

SEQ ID NO: 4495432 - DNA, 23 bp, Homo sapiens
cccatcagtgctccctcacatgt

SEQ ID NO: 4495433 - DNA, 17 bp, Homo sapiens
cccatcccgaagccatc

SEQ ID NO: 4495434 - DNA, 12 bp, Homo sapiens
cccatcctgcca

SEQ ID NO: 4495435 - DNA, 12 bp, Homo sapiens
cccatctccctg

SEQ ID NO: 4495436 - DNA, 17 bp, Homo sapiens
cccatctccctgcctgg

SEQ ID NO: 4495437 - DNA, 20 bp, Homo sapiens
cccatctccctgcctggccc

SEQ ID NO: 4495438 - DNA, 22 bp, Homo sapiens
cccatctgcgggggcagtgctc

SEQ ID NO: 4495439 - DNA, 19 bp, Homo sapiens
cccatcttgatctttgagc

SEQ ID NO: 4495440 - DNA, 17 bp, Homo sapiens
cccatgaagccttttga

SEQ ID NO: 4495441 - DNA, 13 bp, Homo sapiens
cccatgagctcct

SEQ ID NO: 4495442 - DNA, 14 bp, Homo sapiens
cccatgagctcctt

SEQ ID NO: 4495443 - DNA, 22 bp, Homo sapiens
cccatgagctccttaaggctct

SEQ ID NO: 4495444 - DNA, 21 bp, Homo sapiens
cccatgagggagatgccatga

SEQ ID NO: 4495445 - DNA, 14 bp, Homo sapiens
cccatgcccacctg

SEQ ID NO: 4495446 - DNA, 14 bp, Homo sapiens
cccatgcctgtcca

SEQ ID NO: 4495447 - DNA, 23 bp, Homo sapiens
cccatgcgccttcgtgcctgaga

SEQ ID NO: 4495448 - DNA, 20 bp, Homo sapiens
cccaacccctcctccctcag

SEQ ID NO: 4495449 - DNA, 21 bp, Homo sapiens
cccaacccctcctccctcaga

SEQ ID NO: 4495450 - DNA, 17 bp, Homo sapiens
cccaacccctccttccc

SEQ ID NO: 4495451 - DNA, 13 bp, Homo sapiens
cccaacctcaccc

SEQ ID NO: 4495452 - DNA, 15 bp, Homo sapiens
cccaacctcagggct

SEQ ID NO: 4495453 - DNA, 22 bp, Homo sapiens
cccaacctcagggctcccaggg

SEQ ID NO: 4495454 - DNA, 16 bp, Homo sapiens
cccaacctttccctca

SEQ ID NO: 4495455 - DNA, 20 bp, Homo sapiens
cccaacctttccctcacccc

SEQ ID NO: 4495456 - DNA, 19 bp, Homo sapiens
cccaacgtactcctcagac

SEQ ID NO: 4495457 - DNA, 14 bp, Homo sapiens
cccaacgtcccctc

SEQ ID NO: 4495458 - DNA, 17 bp, Homo sapiens
cccaacgtcccctccgc

SEQ ID NO: 4495459 - DNA, 16 bp, Homo sapiens
cccaactccacagggc

SEQ ID NO: 4495460 - DNA, 18 bp, Homo sapiens
cccaactccaggaaagag

SEQ ID NO: 4495461 - DNA, 12 bp, Homo sapiens
cccaactcctgg

SEQ ID NO: 4495462 - DNA, 15 bp, Homo sapiens
cccaactctccccag

SEQ ID NO: 4495463 - DNA, 18 bp, Homo sapiens
cccaactgctccagcctc

SEQ ID NO: 4495464 - DNA, 21 bp, Homo sapiens
cccaactgctccagcctctgc

SEQ ID NO: 4495465 - DNA, 23 bp, Homo sapiens
cccaactgctccagcctctgccg

SEQ ID NO: 4495466 - DNA, 23 bp, Homo sapiens
cccaagagctacgtatttaatag

SEQ ID NO: 4495467 - DNA, 14 bp, Homo sapiens
cccaagaggactga

SEQ ID NO: 4495468 - DNA, 16 bp, Homo sapiens
ccaatccatgcttcac

SEQ ID NO: 4495469 - DNA, 23 bp, Homo sapiens
ccaatcgggtccagagaccacac

SEQ ID NO: 4495470 - DNA, 19 bp, Homo sapiens
ccaatctcttggtggggag

SEQ ID NO: 4495471 - DNA, 17 bp, Homo sapiens
ccaatcttgcccactgg

SEQ ID NO: 4495472 - DNA, 12 bp, Homo sapiens
ccaatgaaatga

SEQ ID NO: 4495473 - DNA, 23 bp, Homo sapiens
ccaatgaataatggaaaatgcca

SEQ ID NO: 4495474 - DNA, 17 bp, Homo sapiens
ccaatgacacccatgcc

SEQ ID NO: 4495475 - DNA, 14 bp, Homo sapiens
ccaatgactgagca

SEQ ID NO: 4495476 - DNA, 17 bp, Homo sapiens
ccaatgagtctgtaatt

SEQ ID NO: 4495477 - DNA, 15 bp, Homo sapiens
ccaatgcaagacgcc

SEQ ID NO: 4495478 - DNA, 20 bp, Homo sapiens
ccaatgccgccgtgtttcct

SEQ ID NO: 4495479 - DNA, 18 bp, Homo sapiens
ccaatgcctataaaatgc

SEQ ID NO: 4495480 - DNA, 14 bp, Homo sapiens
ccaatgttttattg

SEQ ID NO: 4495481 - DNA, 12 bp, Homo sapiens
ccaattaaaata

SEQ ID NO: 4495482 - DNA, 13 bp, Homo sapiens
ccaattaaaatac

SEQ ID NO: 4495483 - DNA, 18 bp, Homo sapiens
ccaattattgatatatat

SEQ ID NO: 4495484 - DNA, 21 bp, Homo sapiens
ccaattattgatatatattat

SEQ ID NO: 4495485 - DNA, 13 bp, Homo sapiens
ccaattcaataca

SEQ ID NO: 4495486 - DNA, 22 bp, Homo sapiens
ccaattctatcttttgtttcct

SEQ ID NO: 4495487 - DNA, 14 bp, Homo sapiens
ccaattctgaaata

SEQ ID NO: 4495488 - DNA, 13 bp, Homo sapiens
ccaattggaggaa

SEQ ID NO: 4495489 - DNA, 19 bp, Homo sapiens
ccaatttcaagttccaagt

SEQ ID NO: 4495490 - DNA, 23 bp, Homo sapiens
ccacaaaataaccaatcctggac

SEQ ID NO: 4495491 - DNA, 12 bp, Homo sapiens
ccacaaaatata

SEQ ID NO: 4495492 - DNA, 21 bp, Homo sapiens
ccacaaagccccccagctccc

SEQ ID NO: 4495493 - DNA, 15 bp, Homo sapiens
ccacaactgtcttag

SEQ ID NO: 4495494 - DNA, 17 bp, Homo sapiens
ccacaagattcccagag

SEQ ID NO: 4495495 - DNA, 16 bp, Homo sapiens
ccacaagcctgagaac

SEQ ID NO: 4495496 - DNA, 23 bp, Homo sapiens
ccacaagcctgagaactgaattt

SEQ ID NO: 4495497 - DNA, 18 bp, Homo sapiens
ccacaagccttactcacc

SEQ ID NO: 4495498 - DNA, 22 bp, Homo sapiens
ccacaagccttactcacctctc

SEQ ID NO: 4495499 - DNA, 18 bp, Homo sapiens
ccacaagctgcactgtga

SEQ ID NO: 4495500 - DNA, 19 bp, Homo sapiens
ccacaagctgcactgtgaa

SEQ ID NO: 4495501 - DNA, 24 bp, Homo sapiens
ccacaaggaataaatgagagggaa

SEQ ID NO: 4495502 - DNA, 20 bp, Homo sapiens
ccacaagtgccgcaaattgt

SEQ ID NO: 4495503 - DNA, 18 bp, Homo sapiens
ccacaattaaaccgcatg

SEQ ID NO: 4495504 - DNA, 18 bp, Homo sapiens
ccacaattattggcaaag

SEQ ID NO: 4495505 - DNA, 16 bp, Homo sapiens
ccacacacagcctgtc

SEQ ID NO: 4495506 - DNA, 16 bp, Homo sapiens
ccacacaggcagggcc

SEQ ID NO: 4495507 - DNA, 23 bp, Homo sapiens
ccacacaggcagggcctggctcc

SEQ ID NO: 4495508 - DNA, 20 bp, Homo sapiens
ccacaccactaaccatcccc

SEQ ID NO: 4495509 - DNA, 23 bp, Homo sapiens
ccacaccataagctactgccatc

SEQ ID NO: 4495510 - DNA, 15 bp, Homo sapiens
ccacacccagcggcc

SEQ ID NO: 4495511 - DNA, 18 bp, Homo sapiens
ccacacccctctgctgca

SEQ ID NO: 4495512 - DNA, 19 bp, Homo sapiens
ccacacctcagttcccttg

SEQ ID NO: 4495513 - DNA, 15 bp, Homo sapiens
ccacacctccctact

SEQ ID NO: 4495514 - DNA, 12 bp, Homo sapiens
ccacacctgagc

SEQ ID NO: 4495515 - DNA, 16 bp, Homo sapiens
ccacactaacctgggt

SEQ ID NO: 4495516 - DNA, 17 bp, Homo sapiens
ccacactcactcctgag

SEQ ID NO: 4495517 - DNA, 24 bp, Homo sapiens
ccacactcactcctgagacccctg

SEQ ID NO: 4495518 - DNA, 16 bp, Homo sapiens
ccacactccttgtcaa

SEQ ID NO: 4495519 - DNA, 17 bp, Homo sapiens
ccacactgaccaagtgc

SEQ ID NO: 4495520 - DNA, 20 bp, Homo sapiens
ccacactggggtgccgcctg

SEQ ID NO: 4495521 - DNA, 22 bp, Homo sapiens
ccacactggggtgccgcctgcc

SEQ ID NO: 4495522 - DNA, 19 bp, Homo sapiens
ccacagaaagccaggagca

SEQ ID NO: 4495523 - DNA, 20 bp, Homo sapiens
ccacagaaccttcaacccag

SEQ ID NO: 4495524 - DNA, 11 bp, Homo sapiens
ccacagactga

SEQ ID NO: 4495525 - DNA, 11 bp, Homo sapiens
ccacagaggcc

SEQ ID NO: 4495526 - DNA, 18 bp, Homo sapiens
ccacagaggccccacctg

SEQ ID NO: 4495527 - DNA, 15 bp, Homo sapiens
ccacagagtgctgga

SEQ ID NO: 4495528 - DNA, 16 bp, Homo sapiens
ccacagagtgctggac

SEQ ID NO: 4495529 - DNA, 16 bp, Homo sapiens
ccacagataactgaaa

SEQ ID NO: 4495530 - DNA, 12 bp, Homo sapiens
ccacagcagaca

SEQ ID NO: 4495531 - DNA, 18 bp, Homo sapiens
ccacagcagcatttttat

SEQ ID NO: 4495532 - DNA, 12 bp, Homo sapiens
ccacagcagttg

SEQ ID NO: 4495533 - DNA, 23 bp, Homo sapiens
ccacagcagttgaaaagactcca

SEQ ID NO: 4495534 - DNA, 13 bp, Homo sapiens
ccacagccagagg

SEQ ID NO: 4495535 - DNA, 15 bp, Homo sapiens
ccacagccagaggag

SEQ ID NO: 4495536 - DNA, 13 bp, Homo sapiens
ccacagccagggc

SEQ ID NO: 4495537 - DNA, 19 bp, Homo sapiens
ccacagccttcggacagac

SEQ ID NO: 4495538 - DNA, 16 bp, Homo sapiens
ccacagctgctggaga

SEQ ID NO: 4495539 - DNA, 13 bp, Homo sapiens
ccacagctgctgt

SEQ ID NO: 4495540 - DNA, 14 bp, Homo sapiens
ccacagctgctgtt

SEQ ID NO: 4495541 - DNA, 15 bp, Homo sapiens
ccacagctgctgttc

SEQ ID NO: 4495542 - DNA, 17 bp, Homo sapiens
ccacagctgctgttctc

SEQ ID NO: 4495543 - DNA, 19 bp, Homo sapiens
ccacagctggcctggtttc

SEQ ID NO: 4495544 - DNA, 13 bp, Homo sapiens
ccacagctggggc

SEQ ID NO: 4495545 - DNA, 16 bp, Homo sapiens
ccacaggacatttctc

SEQ ID NO: 4495546 - DNA, 18 bp, Homo sapiens
ccacaggagggccagcgc

SEQ ID NO: 4495547 - DNA, 19 bp, Homo sapiens
ccacaggcaggtcacagaa

SEQ ID NO: 4495548 - DNA, 11 bp, Homo sapiens
ccacaggcctg

SEQ ID NO: 4495549 - DNA, 13 bp, Homo sapiens
ccacagggagctc

SEQ ID NO: 4495550 - DNA, 16 bp, Homo sapiens
ccacaggggccaccac

SEQ ID NO: 4495551 - DNA, 16 bp, Homo sapiens
ccacaggtccaaggac

SEQ ID NO: 4495552 - DNA, 14 bp, Homo sapiens
ccacagtgctgtct

SEQ ID NO: 4495553 - DNA, 17 bp, Homo sapiens
ccacagtggcgggccca

SEQ ID NO: 4495554 - DNA, 15 bp, Homo sapiens
ccacagttttaataa

SEQ ID NO: 4495555 - DNA, 21 bp, Homo sapiens
ccacagttttaataagaacag

SEQ ID NO: 4495556 - DNA, 16 bp, Homo sapiens
ccacataaattttaat

SEQ ID NO: 4495557 - DNA, 13 bp, Homo sapiens
ccacatcctccac

SEQ ID NO: 4495558 - DNA, 19 bp, Homo sapiens
ccacatcctccgtccagcc

SEQ ID NO: 4495559 - DNA, 20 bp, Homo sapiens
ccacatcctccgtccagccg

SEQ ID NO: 4495560 - DNA, 13 bp, Homo sapiens
ccacatgaggcca

SEQ ID NO: 4495561 - DNA, 20 bp, Homo sapiens
ccacatgaggccatctcagg

SEQ ID NO: 4495562 - DNA, 13 bp, Homo sapiens
ccacatgcatgtc

SEQ ID NO: 4495563 - DNA, 17 bp, Homo sapiens
ccacatgcatgtctgcc

SEQ ID NO: 4495564 - DNA, 15 bp, Homo sapiens
ccacatgccccaggc

SEQ ID NO: 4495565 - DNA, 17 bp, Homo sapiens
ccacatgccccaggctc

SEQ ID NO: 4495566 - DNA, 16 bp, Homo sapiens
ccacatggagccccct

SEQ ID NO: 4495567 - DNA, 17 bp, Homo sapiens
ccacatggcacagagat

SEQ ID NO: 4495568 - DNA, 20 bp, Homo sapiens
ccacatggtcttcgtccttg

SEQ ID NO: 4495569 - DNA, 16 bp, Homo sapiens
ccacatggtgtctccc

SEQ ID NO: 4495570 - DNA, 22 bp, Homo sapiens
ccacatggtgtctcccaacatg

SEQ ID NO: 4495571 - DNA, 19 bp, Homo sapiens
ccacatttggaatactttt

SEQ ID NO: 4495572 - DNA, 21 bp, Homo sapiens
ccaccaacccatcagaaggag

SEQ ID NO: 4495573 - DNA, 21 bp, Homo sapiens
ccaccaagagggacgcctggg

SEQ ID NO: 4495574 - DNA, 14 bp, Homo sapiens
ccaccacccccttt

SEQ ID NO: 4495575 - DNA, 18 bp, Homo sapiens
ccaccacctaggccactc

SEQ ID NO: 4495576 - DNA, 22 bp, Homo sapiens
ccaccacctaggccactcctcc

SEQ ID NO: 4495577 - DNA, 21 bp, Homo sapiens
ccaggtgcctttcaaatttag

SEQ ID NO: 4495578 - DNA, 22 bp, Homo sapiens
ccaggtgctacacccttttcca

SEQ ID NO: 4495579 - DNA, 15 bp, Homo sapiens
ccaggtggcacctgc

SEQ ID NO: 4495580 - DNA, 23 bp, Homo sapiens
ccaggtggctgacccagtccctg

SEQ ID NO: 4495581 - DNA, 22 bp, Homo sapiens
ccaggtgggtcccggctctgtg

SEQ ID NO: 4495582 - DNA, 13 bp, Homo sapiens
ccaggtgtagcta

SEQ ID NO: 4495583 - DNA, 17 bp, Homo sapiens
ccaggtgttactgtaat

SEQ ID NO: 4495584 - DNA, 20 bp, Homo sapiens
ccagtaggggcttataataa

SEQ ID NO: 4495585 - DNA, 22 bp, Homo sapiens
ccagtagtgggatcatccagag

SEQ ID NO: 4495586 - DNA, 22 bp, Homo sapiens
ccagtagttttgacacttccca

SEQ ID NO: 4495587 - DNA, 18 bp, Homo sapiens
ccagtatgttttaacaaa

SEQ ID NO: 4495588 - DNA, 16 bp, Homo sapiens
ccagtatttaagcttt

SEQ ID NO: 4495589 - DNA, 18 bp, Homo sapiens
ccagtatttagaagccaa

SEQ ID NO: 4495590 - DNA, 22 bp, Homo sapiens
ccagtcaacggggggctcctgc

SEQ ID NO: 4495591 - DNA, 16 bp, Homo sapiens
ccagtcagcagtcatg

SEQ ID NO: 4495592 - DNA, 17 bp, Homo sapiens
ccagtcaggctgcagag

SEQ ID NO: 4495593 - DNA, 12 bp, Homo sapiens
ccagtcagggcc

SEQ ID NO: 4495594 - DNA, 19 bp, Homo sapiens
ccagtcaggtagttgcaat

SEQ ID NO: 4495595 - DNA, 21 bp, Homo sapiens
ccagtcatggtactaccccag

SEQ ID NO: 4495596 - DNA, 22 bp, Homo sapiens
ccagtcattatgttaatatttc

SEQ ID NO: 4495597 - DNA, 21 bp, Homo sapiens
ccagtccaaatgtcctccaga

SEQ ID NO: 4495598 - DNA, 15 bp, Homo sapiens
ccagtccccacccct

SEQ ID NO: 4495599 - DNA, 16 bp, Homo sapiens
ccagtccccacccctg

SEQ ID NO: 4495600 - DNA, 21 bp, Homo sapiens
ccagtccccacccctgccccc

SEQ ID NO: 4495601 - DNA, 22 bp, Homo sapiens
ccagtccccacccctgccccca

SEQ ID NO: 4495602 - DNA, 14 bp, Homo sapiens
ccagtccccgagga

SEQ ID NO: 4495603 - DNA, 22 bp, Homo sapiens
ccagtccccgaggagctgggcc

SEQ ID NO: 4495604 - DNA, 12 bp, Homo sapiens
ccagtccctggg

SEQ ID NO: 4495605 - DNA, 13 bp, Homo sapiens
ccagtccctgggg

SEQ ID NO: 4495606 - DNA, 18 bp, Homo sapiens
ccagtcctagctgcacag

SEQ ID NO: 4495607 - DNA, 13 bp, Homo sapiens
ccagtcctgcccg

SEQ ID NO: 4495608 - DNA, 16 bp, Homo sapiens
ccagtcctgcctgaac

SEQ ID NO: 4495609 - DNA, 17 bp, Homo sapiens
ccagtcctgcctggcca

SEQ ID NO: 4495610 - DNA, 17 bp, Homo sapiens
ccagtcggccccatctc

SEQ ID NO: 4495611 - DNA, 15 bp, Homo sapiens
ccagtctcatcctcc

SEQ ID NO: 4495612 - DNA, 17 bp, Homo sapiens
ccagtctcatcctccca

SEQ ID NO: 4495613 - DNA, 12 bp, Homo sapiens
ccagtctcctca

SEQ ID NO: 4495614 - DNA, 17 bp, Homo sapiens
ccagtctcctcactctg

SEQ ID NO: 4495615 - DNA, 17 bp, Homo sapiens
ccagtctgggtctgggt

SEQ ID NO: 4495616 - DNA, 22 bp, Homo sapiens
ccagtcttcctgacactttaat

SEQ ID NO: 4495617 - DNA, 18 bp, Homo sapiens
ccagtgaactcctgccag

SEQ ID NO: 4495618 - DNA, 15 bp, Homo sapiens
ccagtgaagcctctg

SEQ ID NO: 4495619 - DNA, 13 bp, Homo sapiens
ccagtgaagtcct

SEQ ID NO: 4495620 - DNA, 20 bp, Homo sapiens
ccagtgaagtccttcagtga

SEQ ID NO: 4495621 - DNA, 12 bp, Homo sapiens
ccagtgaatttt

SEQ ID NO: 4495622 - DNA, 19 bp, Homo sapiens
ccagtgaatttttgcaata

SEQ ID NO: 4495623 - DNA, 22 bp, Homo sapiens
ccagtgaatttttgcaataatg

SEQ ID NO: 4495624 - DNA, 14 bp, Homo sapiens
ccagtgcagccact

SEQ ID NO: 4495625 - DNA, 17 bp, Homo sapiens
ccagtgcagccactggc

SEQ ID NO: 4495626 - DNA, 11 bp, Homo sapiens
ccagtgcagtc

SEQ ID NO: 4495627 - DNA, 15 bp, Homo sapiens
ccagtgcatactgta

SEQ ID NO: 4495628 - DNA, 17 bp, Homo sapiens
ccagtgccactgccccc

SEQ ID NO: 4495629 - DNA, 15 bp, Homo sapiens
ccagtgccgaggaca

SEQ ID NO: 4495630 - DNA, 21 bp, Homo sapiens
ccagtgcctctccctgctgct

SEQ ID NO: 4495631 - DNA, 13 bp, Homo sapiens
ccagtgcctgcca

SEQ ID NO: 4495632 - DNA, 23 bp, Homo sapiens
ccagtgcctgccactctctggga

SEQ ID NO: 4495633 - DNA, 20 bp, Homo sapiens
ccagtgccttattacccagg

SEQ ID NO: 4495634 - DNA, 13 bp, Homo sapiens
ccagtgctctgcc

SEQ ID NO: 4495635 - DNA, 16 bp, Homo sapiens
ccagtgctctgcctca

SEQ ID NO: 4495636 - DNA, 17 bp, Homo sapiens
ccagtgctctgcctcag

SEQ ID NO: 4495637 - DNA, 20 bp, Homo sapiens
ccagtgctctgcctcagacg

SEQ ID NO: 4495638 - DNA, 19 bp, Homo sapiens
ccagtgcttagcaaaaaat

SEQ ID NO: 4495639 - DNA, 19 bp, Homo sapiens
ccagtggatgccacagccc

SEQ ID NO: 4495640 - DNA, 21 bp, Homo sapiens
ccagtggatgccacagcccag

SEQ ID NO: 4495641 - DNA, 16 bp, Homo sapiens
ccagtggccactcagc

SEQ ID NO: 4495642 - DNA, 17 bp, Homo sapiens
ccagtggccactcagct

SEQ ID NO: 4495643 - DNA, 22 bp, Homo sapiens
ccagtggcgggtgatggccagc

SEQ ID NO: 4495644 - DNA, 20 bp, Homo sapiens
ccagtggcgttgttgcatgt

SEQ ID NO: 4495645 - DNA, 16 bp, Homo sapiens
ccagtgggagatgtta

SEQ ID NO: 4495646 - DNA, 19 bp, Homo sapiens
ccagtggggaacaggtccc

SEQ ID NO: 4495647 - DNA, 12 bp, Homo sapiens
ccagtgtctttc

SEQ ID NO: 4495648 - DNA, 13 bp, Homo sapiens
ccagtgtctttct

SEQ ID NO: 4495649 - DNA, 15 bp, Homo sapiens
ccagtgtctttcttt

SEQ ID NO: 4495650 - DNA, 17 bp, Homo sapiens
ccagtgttcctgaagct

SEQ ID NO: 4495651 - DNA, 22 bp, Homo sapiens
ccagtgttcctgaagctgctgt

SEQ ID NO: 4495652 - DNA, 23 bp, Homo sapiens
ccagtgttcctgaagctgctgtg

SEQ ID NO: 4495653 - DNA, 17 bp, Homo sapiens
ccagtgttgggtttttt

SEQ ID NO: 4495654 - DNA, 13 bp, Homo sapiens
ccagttaaagatt

SEQ ID NO: 4495655 - DNA, 19 bp, Homo sapiens
ccagttcatcaccatttcc

SEQ ID NO: 4495656 - DNA, 15 bp, Homo sapiens
ccagttccacagcag

SEQ ID NO: 4495657 - DNA, 17 bp, Homo sapiens
ccagttcctagcactgc

SEQ ID NO: 4495658 - DNA, 23 bp, Homo sapiens
ccagtttatgattgaatttttaa

SEQ ID NO: 4495659 - DNA, 20 bp, Homo sapiens
ccagtttcttaaactgaaag

SEQ ID NO: 4495660 - DNA, 11 bp, Homo sapiens
ccagtttcttt

SEQ ID NO: 4495661 - DNA, 20 bp, Homo sapiens
ccagttttccctggaactcc

SEQ ID NO: 4495662 - DNA, 23 bp, Homo sapiens
ccagttttgtggattaaaccttt

SEQ ID NO: 4495663 - DNA, 16 bp, Homo sapiens
ccagtttttgtttttg

SEQ ID NO: 4495664 - DNA, 15 bp, Homo sapiens
ccataaaaccctata

SEQ ID NO: 4495665 - DNA, 18 bp, Homo sapiens
ccataagctactgccatc

SEQ ID NO: 4495666 - DNA, 12 bp, Homo sapiens
ccatacaatgta

SEQ ID NO: 4495667 - DNA, 15 bp, Homo sapiens
ccatacaatttcatc

SEQ ID NO: 4495668 - DNA, 15 bp, Homo sapiens
ccataccttttctct

SEQ ID NO: 4495669 - DNA, 19 bp, Homo sapiens
ccatactgcgtccaccctg

SEQ ID NO: 4495670 - DNA, 16 bp, Homo sapiens
ccatagaccctgaggc

SEQ ID NO: 4495671 - DNA, 19 bp, Homo sapiens
ccatagaccctgaggccct

SEQ ID NO: 4495672 - DNA, 18 bp, Homo sapiens
ccatagagatgagcccac

SEQ ID NO: 4495673 - DNA, 18 bp, Homo sapiens
ccatagagtaatgatgta

SEQ ID NO: 4495674 - DNA, 19 bp, Homo sapiens
ccatagtatatgatagatt

SEQ ID NO: 4495675 - DNA, 12 bp, Homo sapiens
ccatatataaat

SEQ ID NO: 4495676 - DNA, 13 bp, Homo sapiens
ccatatataaatt

SEQ ID NO: 4495677 - DNA, 17 bp, Homo sapiens
ccatatataaattatta

SEQ ID NO: 4495678 - DNA, 19 bp, Homo sapiens
ccatatataaattattact

SEQ ID NO: 4495679 - DNA, 15 bp, Homo sapiens
ccatatatgaccaga

SEQ ID NO: 4495680 - DNA, 18 bp, Homo sapiens
ccatatatgaccagaagc

SEQ ID NO: 4495681 - DNA, 14 bp, Homo sapiens
ccatatatgctgta

SEQ ID NO: 4495682 - DNA, 20 bp, Homo sapiens
ccatatgcatctacttggca

SEQ ID NO: 4495683 - DNA, 12 bp, Homo sapiens
ccatatgctcca

SEQ ID NO: 4495684 - DNA, 15 bp, Homo sapiens
ccatattacctggat

SEQ ID NO: 4495685 - DNA, 18 bp, Homo sapiens
ccatattgtaaaacaggt

SEQ ID NO: 4495686 - DNA, 20 bp, Homo sapiens
ccatgtcaccggtcagtgcc

SEQ ID NO: 4495687 - DNA, 23 bp, Homo sapiens
ccatgtccaaagaggctgcccct

SEQ ID NO: 4495688 - DNA, 13 bp, Homo sapiens
ccatgtcccaccc

SEQ ID NO: 4495689 - DNA, 14 bp, Homo sapiens
ccatgtcggcctct

SEQ ID NO: 4495690 - DNA, 15 bp, Homo sapiens
ccatgtgcctttctt

SEQ ID NO: 4495691 - DNA, 17 bp, Homo sapiens
ccatgtgcctttctttg

SEQ ID NO: 4495692 - DNA, 19 bp, Homo sapiens
ccatgtgcctttctttgcc

SEQ ID NO: 4495693 - DNA, 22 bp, Homo sapiens
ccatgtgcctttctttgcctct

SEQ ID NO: 4495694 - DNA, 14 bp, Homo sapiens
ccatgtgctgccct

SEQ ID NO: 4495695 - DNA, 15 bp, Homo sapiens
ccatgtgctgccctg

SEQ ID NO: 4495696 - DNA, 21 bp, Homo sapiens
ccatgtggataactttacaga

SEQ ID NO: 4495697 - DNA, 23 bp, Homo sapiens
ccatgtggtttgctgttaccaaa

SEQ ID NO: 4495698 - DNA, 13 bp, Homo sapiens
ccatgtgtcccct

SEQ ID NO: 4495699 - DNA, 15 bp, Homo sapiens
ccatgtgtcccctca

SEQ ID NO: 4495700 - DNA, 16 bp, Homo sapiens
ccatgttagccaggat

SEQ ID NO: 4495701 - DNA, 13 bp, Homo sapiens
ccatgttctccca

SEQ ID NO: 4495702 - DNA, 17 bp, Homo sapiens
ccaaccccccagcactg

SEQ ID NO: 4495703 - DNA, 20 bp, Homo sapiens
ccaaccccccagcactgagg

SEQ ID NO: 4495704 - DNA, 17 bp, Homo sapiens
ccaacccctcctccctc

SEQ ID NO: 4495705 - DNA, 21 bp, Homo sapiens
ccaacccctccttccccagac

SEQ ID NO: 4495706 - DNA, 13 bp, Homo sapiens
ccaaccctgggct

SEQ ID NO: 4495707 - DNA, 17 bp, Homo sapiens
ccaacctcaggctccta

SEQ ID NO: 4495708 - DNA, 22 bp, Homo sapiens
ccaacctcagggctcccagggg

SEQ ID NO: 4495709 - DNA, 20 bp, Homo sapiens
ccaacctctttttcctcctg

SEQ ID NO: 4495710 - DNA, 21 bp, Homo sapiens
ccaacctctttttcctcctgg

SEQ ID NO: 4495711 - DNA, 12 bp, Homo sapiens
ccaacctgacca

SEQ ID NO: 4495712 - DNA, 14 bp, Homo sapiens
ccaacctgctctgt

SEQ ID NO: 4495713 - DNA, 15 bp, Homo sapiens
ccaacctttccctca

SEQ ID NO: 4495714 - DNA, 20 bp, Homo sapiens
ccaacgagacacattgcctt

SEQ ID NO: 4495715 - DNA, 14 bp, Homo sapiens
ccaacgtcccctcc

SEQ ID NO: 4495716 - DNA, 17 bp, Homo sapiens
ccaactagcccctgggg

SEQ ID NO: 4495717 - DNA, 12 bp, Homo sapiens
ccaactccacag

SEQ ID NO: 4495718 - DNA, 15 bp, Homo sapiens
ccaactccacagggc

SEQ ID NO: 4495719 - DNA, 22 bp, Homo sapiens
ccaactcctggaagctgtgtcc

SEQ ID NO: 4495720 - DNA, 18 bp, Homo sapiens
ccaactcctttcagccac

SEQ ID NO: 4495721 - DNA, 12 bp, Homo sapiens
ccaactctaata

SEQ ID NO: 4495722 - DNA, 18 bp, Homo sapiens
ccaactctaatattgctt

SEQ ID NO: 4495723 - DNA, 19 bp, Homo sapiens
ccaactctccccagtgcct

SEQ ID NO: 4495724 - DNA, 20 bp, Homo sapiens
ccaactctccccagtgcctg

SEQ ID NO: 4495725 - DNA, 19 bp, Homo sapiens
ccaactctcctggcctggc

SEQ ID NO: 4495726 - DNA, 17 bp, Homo sapiens
ccaactgggcccaagac

SEQ ID NO: 4495727 - DNA, 13 bp, Homo sapiens
ccaacttcctgtg

SEQ ID NO: 4495728 - DNA, 19 bp, Homo sapiens
ccaacttcctgtggcctga

SEQ ID NO: 4495729 - DNA, 16 bp, Homo sapiens
ccaacttcttcctgtg

SEQ ID NO: 4495730 - DNA, 15 bp, Homo sapiens
ccaagaaagatgtat

SEQ ID NO: 4495731 - DNA, 18 bp, Homo sapiens
ccaagaagcagtggcctt

SEQ ID NO: 4495732 - DNA, 13 bp, Homo sapiens
ccaagaagggcta

SEQ ID NO: 4495733 - DNA, 19 bp, Homo sapiens
ccaagacagcagcagcctg

SEQ ID NO: 4495734 - DNA, 21 bp, Homo sapiens
ccaagacagcagcagcctgca

SEQ ID NO: 4495735 - DNA, 19 bp, Homo sapiens
ccaagacgggatgattgct

SEQ ID NO: 4495736 - DNA, 14 bp, Homo sapiens
ccaagactcccatg

SEQ ID NO: 4495737 - DNA, 22 bp, Homo sapiens
ccaagagctacgtatttaatag

SEQ ID NO: 4495738 - DNA, 17 bp, Homo sapiens
ccaagaggactgagact

SEQ ID NO: 4495739 - DNA, 18 bp, Homo sapiens
ccaagaggactgagactg

SEQ ID NO: 4495740 - DNA, 19 bp, Homo sapiens
ccaagaggggcgggctcag

SEQ ID NO: 4495741 - DNA, 22 bp, Homo sapiens
ccaagaggggcgggctcagagc

SEQ ID NO: 4495742 - DNA, 22 bp, Homo sapiens
ccaagatgggcatcttttgtat

SEQ ID NO: 4495743 - DNA, 20 bp, Homo sapiens
ccaagatttaaaattaaatt

SEQ ID NO: 4495744 - DNA, 20 bp, Homo sapiens
ccaagattttcctcttgtga

SEQ ID NO: 4495745 - DNA, 15 bp, Homo sapiens
ccaagcacagagcct

SEQ ID NO: 4495746 - DNA, 17 bp, Homo sapiens
ccaagcacagagcctgg

SEQ ID NO: 4495747 - DNA, 20 bp, Homo sapiens
ccaagcacagagcctggccc

SEQ ID NO: 4495748 - DNA, 13 bp, Homo sapiens
ccaagcatttcat

SEQ ID NO: 4495749 - DNA, 14 bp, Homo sapiens
ccaagcatttcatg

SEQ ID NO: 4495750 - DNA, 22 bp, Homo sapiens
ccaagcatttcatgaaaaagct

SEQ ID NO: 4495751 - DNA, 23 bp, Homo sapiens
ccaagccctggcccccacagcgc

SEQ ID NO: 4495752 - DNA, 23 bp, Homo sapiens
ccaagccgaccttccctccgcct

SEQ ID NO: 4495753 - DNA, 11 bp, Homo sapiens
ccaagcctatc

SEQ ID NO: 4495754 - DNA, 13 bp, Homo sapiens
ccaagcctgctgg

SEQ ID NO: 4495755 - DNA, 20 bp, Homo sapiens
ccaagcgaggtcaacagaga

SEQ ID NO: 4495756 - DNA, 21 bp, Homo sapiens
ccaagcgaggtcaacagagaa

SEQ ID NO: 4495757 - DNA, 13 bp, Homo sapiens
ccaagcgttcctg

SEQ ID NO: 4495758 - DNA, 18 bp, Homo sapiens
ccaagcgttcctggcctt

SEQ ID NO: 4495759 - DNA, 19 bp, Homo sapiens
ccaagctcacagttcctcg

SEQ ID NO: 4495760 - DNA, 14 bp, Homo sapiens
ccaagctccaaatc

SEQ ID NO: 4495761 - DNA, 18 bp, Homo sapiens
ccaagctgctctccttca

SEQ ID NO: 4495762 - DNA, 17 bp, Homo sapiens
ccaagctgggccccagc

SEQ ID NO: 4495763 - DNA, 15 bp, Homo sapiens
ccaaggacccaggcg

SEQ ID NO: 4495764 - DNA, 17 bp, Homo sapiens
ccaaggacccaggcgct

SEQ ID NO: 4495765 - DNA, 19 bp, Homo sapiens
ccaaggacccaggcgctgc

SEQ ID NO: 4495766 - DNA, 20 bp, Homo sapiens
ccaaggacggtccccacccc

SEQ ID NO: 4495767 - DNA, 13 bp, Homo sapiens
ccaaggaggaaaa

SEQ ID NO: 4495768 - DNA, 14 bp, Homo sapiens
ccaaggaggcctgg

SEQ ID NO: 4495769 - DNA, 17 bp, Homo sapiens
ccaaggaggcctgggga

SEQ ID NO: 4495770 - DNA, 19 bp, Homo sapiens
ccaaggcaagcatgaataa

SEQ ID NO: 4495771 - DNA, 17 bp, Homo sapiens
ccaaggcctaccccagt

SEQ ID NO: 4495772 - DNA, 14 bp, Homo sapiens
ccaaggcggcccct

SEQ ID NO: 4495773 - DNA, 15 bp, Homo sapiens
ccaaggctctcccct

SEQ ID NO: 4495774 - DNA, 18 bp, Homo sapiens
ccaagggccgactaagag

SEQ ID NO: 4495775 - DNA, 22 bp, Homo sapiens
ccaaggggatttttatgtctgg

SEQ ID NO: 4495776 - DNA, 21 bp, Homo sapiens
ccaagggtacagatccccagc

SEQ ID NO: 4495777 - DNA, 17 bp, Homo sapiens
ccaagggttgagagcca

SEQ ID NO: 4495778 - DNA, 18 bp, Homo sapiens
ccaagggttgagagccag

SEQ ID NO: 4495779 - DNA, 23 bp, Homo sapiens
ccaaggtcagggaggggcaacca

SEQ ID NO: 4495780 - DNA, 16 bp, Homo sapiens
ccaaggtcctgctcaa

SEQ ID NO: 4495781 - DNA, 15 bp, Homo sapiens
ccaaggtgatgttgt

SEQ ID NO: 4495782 - DNA, 15 bp, Homo sapiens
ccaaggtgctggact

SEQ ID NO: 4495783 - DNA, 17 bp, Homo sapiens
ccaaggtggcagatgtc

SEQ ID NO: 4495784 - DNA, 22 bp, Homo sapiens
ccaaggttactcagcagcagag

SEQ ID NO: 4495785 - DNA, 14 bp, Homo sapiens
ccaagtaaaatgtt

SEQ ID NO: 4495786 - DNA, 24 bp, Homo sapiens
ccaagtaaccaggccccagcctcc

SEQ ID NO: 4495787 - DNA, 18 bp, Homo sapiens
ccaagtaagagtggtggc

SEQ ID NO: 4495788 - DNA, 19 bp, Homo sapiens
ccaagtactaaagcacctt

SEQ ID NO: 4495789 - DNA, 20 bp, Homo sapiens
ccaagtagctgggattacag

SEQ ID NO: 4495790 - DNA, 22 bp, Homo sapiens
ccaagtatatcagctactgtag

SEQ ID NO: 4495791 - DNA, 17 bp, Homo sapiens
ccaagtcagacaccaag

SEQ ID NO: 4495792 - DNA, 16 bp, Homo sapiens
ccaagtcatttttgtt

SEQ ID NO: 4495793 - DNA, 22 bp, Homo sapiens
ccaagtctggcaccatgttggc

SEQ ID NO: 4495794 - DNA, 23 bp, Homo sapiens
ccaagtctttcttcttttttaag

SEQ ID NO: 4495795 - DNA, 20 bp, Homo sapiens
ccaagtgctggcccacccag

SEQ ID NO: 4495796 - DNA, 16 bp, Homo sapiens
ccaagtggggtgctgg

SEQ ID NO: 4495797 - DNA, 17 bp, Homo sapiens
ccaagtgttttgtattt

SEQ ID NO: 4495798 - DNA, 17 bp, Homo sapiens
ccaagttgtgcttgagc

SEQ ID NO: 4495799 - DNA, 22 bp, Homo sapiens
ccaataaaagcaattccaacct

SEQ ID NO: 4495800 - DNA, 12 bp, Homo sapiens
ccaataaaatgt

SEQ ID NO: 4495801 - DNA, 16 bp, Homo sapiens
ccaataaacagctccc

SEQ ID NO: 4495802 - DNA, 12 bp, Homo sapiens
ccaataaaccag

SEQ ID NO: 4495803 - DNA, 16 bp, Homo sapiens
ccaataaaccagtgtg

SEQ ID NO: 4495804 - DNA, 13 bp, Homo sapiens
ccaataaagcctt

SEQ ID NO: 4495805 - DNA, 12 bp, Homo sapiens
ccaataaaggca

SEQ ID NO: 4495806 - DNA, 17 bp, Homo sapiens
ccaataaaggcagctgc

SEQ ID NO: 4495807 - DNA, 12 bp, Homo sapiens
catcagtttgtt

SEQ ID NO: 4495808 - DNA, 14 bp, Homo sapiens
catcataggtaagg

SEQ ID NO: 4495809 - DNA, 20 bp, Homo sapiens
catcatctcctgccttcctc

SEQ ID NO: 4495810 - DNA, 15 bp, Homo sapiens
catcatctctgaagg

SEQ ID NO: 4495811 - DNA, 21 bp, Homo sapiens
catcatctgtttgtaatcatt

SEQ ID NO: 4495812 - DNA, 12 bp, Homo sapiens
catcatgcagct

SEQ ID NO: 4495813 - DNA, 13 bp, Homo sapiens
catcatgcagctc

SEQ ID NO: 4495814 - DNA, 15 bp, Homo sapiens
catcatgtctattgt

SEQ ID NO: 4495815 - DNA, 13 bp, Homo sapiens
catcatgtttaca

SEQ ID NO: 4495816 - DNA, 21 bp, Homo sapiens
catcatgtttacagaggacag

SEQ ID NO: 4495817 - DNA, 15 bp, Homo sapiens
catcattattgtagt

SEQ ID NO: 4495818 - DNA, 16 bp, Homo sapiens
catcattctctgtctc

SEQ ID NO: 4495819 - DNA, 24 bp, Homo sapiens
catcattctctgtctcatccatca

SEQ ID NO: 4495820 - DNA, 15 bp, Homo sapiens
catcattgtcagcct

SEQ ID NO: 4495821 - DNA, 14 bp, Homo sapiens
catcattttttact

SEQ ID NO: 4495822 - DNA, 16 bp, Homo sapiens
catccaagtctttctt

SEQ ID NO: 4495823 - DNA, 14 bp, Homo sapiens
catccacacatgaa

SEQ ID NO: 4495824 - DNA, 16 bp, Homo sapiens
catccacataagcact

SEQ ID NO: 4495825 - DNA, 17 bp, Homo sapiens
catccacatgggagccg

SEQ ID NO: 4495826 - DNA, 21 bp, Homo sapiens
catccacccgggggagcccag

SEQ ID NO: 4495827 - DNA, 16 bp, Homo sapiens
catccagaaataaaga

SEQ ID NO: 4495828 - DNA, 16 bp, Homo sapiens
catccagacctggctc

SEQ ID NO: 4495829 - DNA, 20 bp, Homo sapiens
catccagagattcattttct

SEQ ID NO: 4495830 - DNA, 11 bp, Homo sapiens
catccagcagc

SEQ ID NO: 4495831 - DNA, 12 bp, Homo sapiens
catccagcagca

SEQ ID NO: 4495832 - DNA, 17 bp, Homo sapiens
catccagcagcagcact

SEQ ID NO: 4495833 - DNA, 16 bp, Homo sapiens
catccagccagacccc

SEQ ID NO: 4495834 - DNA, 14 bp, Homo sapiens
catccagtttgttc

SEQ ID NO: 4495835 - DNA, 15 bp, Homo sapiens
catccagtttgttct

SEQ ID NO: 4495836 - DNA, 15 bp, Homo sapiens
catccatagacacag

SEQ ID NO: 4495837 - DNA, 16 bp, Homo sapiens
catccatagacacagt

SEQ ID NO: 4495838 - DNA, 19 bp, Homo sapiens
catccatagacacagtatt

SEQ ID NO: 4495839 - DNA, 13 bp, Homo sapiens
catccatcatcat

SEQ ID NO: 4495840 - DNA, 15 bp, Homo sapiens
catccatgcctcaga

SEQ ID NO: 4495841 - DNA, 17 bp, Homo sapiens
catccatgcctcagaag

SEQ ID NO: 4495842 - DNA, 14 bp, Homo sapiens
catccattcctcag

SEQ ID NO: 4495843 - DNA, 15 bp, Homo sapiens
catccattcctcagg

SEQ ID NO: 4495844 - DNA, 12 bp, Homo sapiens
catccattctcc

SEQ ID NO: 4495845 - DNA, 13 bp, Homo sapiens
catccattgttgt

SEQ ID NO: 4495846 - DNA, 18 bp, Homo sapiens
catcccagtttctcagaa

SEQ ID NO: 4495847 - DNA, 13 bp, Homo sapiens
catcccattgccc

SEQ ID NO: 4495848 - DNA, 16 bp, Homo sapiens
catcccattgccctgg

SEQ ID NO: 4495849 - DNA, 17 bp, Homo sapiens
catcccattgccctggt

SEQ ID NO: 4495850 - DNA, 16 bp, Homo sapiens
catccccacaatctgg

SEQ ID NO: 4495851 - DNA, 20 bp, Homo sapiens
catccccaccactgatatca

SEQ ID NO: 4495852 - DNA, 16 bp, Homo sapiens
catcccccctgctcag

SEQ ID NO: 4495853 - DNA, 17 bp, Homo sapiens
catcccccctgctcagc

SEQ ID NO: 4495854 - DNA, 20 bp, Homo sapiens
catcccctccctgcctgctc

SEQ ID NO: 4495855 - DNA, 21 bp, Homo sapiens
catccccttcccccatcccta

SEQ ID NO: 4495856 - DNA, 21 bp, Homo sapiens
catcccgaagccatcacttct

SEQ ID NO: 4495857 - DNA, 17 bp, Homo sapiens
catcccgagcacctcca

SEQ ID NO: 4495858 - DNA, 22 bp, Homo sapiens
catcccgctggtgcctcccggg

SEQ ID NO: 4495859 - DNA, 16 bp, Homo sapiens
catcccgtatcacagt

SEQ ID NO: 4495860 - DNA, 19 bp, Homo sapiens
catcccgtatcacagtgtt

SEQ ID NO: 4495861 - DNA, 20 bp, Homo sapiens
catcccgtatcacagtgttt

SEQ ID NO: 4495862 - DNA, 14 bp, Homo sapiens
catccctaccactg

SEQ ID NO: 4495863 - DNA, 15 bp, Homo sapiens
catccctaccactgt

SEQ ID NO: 4495864 - DNA, 12 bp, Homo sapiens
catccctacccc

SEQ ID NO: 4495865 - DNA, 21 bp, Homo sapiens
catccctatagaccactgggt

SEQ ID NO: 4495866 - DNA, 16 bp, Homo sapiens
catccctccttaagag

SEQ ID NO: 4495867 - DNA, 19 bp, Homo sapiens
catccctccttgcctagca

SEQ ID NO: 4495868 - DNA, 18 bp, Homo sapiens
catccctgcttgcccgct

SEQ ID NO: 4495869 - DNA, 18 bp, Homo sapiens
catccctggacttctggg

SEQ ID NO: 4495870 - DNA, 13 bp, Homo sapiens
catccctggagca

SEQ ID NO: 4495871 - DNA, 19 bp, Homo sapiens
catccctggagcaggagcc

SEQ ID NO: 4495872 - DNA, 12 bp, Homo sapiens
catccctgggcc

SEQ ID NO: 4495873 - DNA, 22 bp, Homo sapiens
catccctgggcccctccacgcc

SEQ ID NO: 4495874 - DNA, 24 bp, Homo sapiens
catccctgggcccctccacgcctc

SEQ ID NO: 4495875 - DNA, 20 bp, Homo sapiens
catccctgggggccttgggt

SEQ ID NO: 4495876 - DNA, 12 bp, Homo sapiens
catccctgtgag

SEQ ID NO: 4495877 - DNA, 12 bp, Homo sapiens
catcccttccca

SEQ ID NO: 4495878 - DNA, 20 bp, Homo sapiens
catcccttgtttataaatag

SEQ ID NO: 4495879 - DNA, 16 bp, Homo sapiens
catccctttttttaca

SEQ ID NO: 4495880 - DNA, 19 bp, Homo sapiens
catttttaatgtatctatt

SEQ ID NO: 4495881 - DNA, 13 bp, Homo sapiens
catttttacacta

SEQ ID NO: 4495882 - DNA, 14 bp, Homo sapiens
catttttaccatta

SEQ ID NO: 4495883 - DNA, 22 bp, Homo sapiens
catttttataaactaccaaatt

SEQ ID NO: 4495884 - DNA, 12 bp, Homo sapiens
catttttatagc

SEQ ID NO: 4495885 - DNA, 23 bp, Homo sapiens
catttttatttcagattttgata

SEQ ID NO: 4495886 - DNA, 20 bp, Homo sapiens
catttttcaactttgaataa

SEQ ID NO: 4495887 - DNA, 21 bp, Homo sapiens
catttttcaactttgaataaa

SEQ ID NO: 4495888 - DNA, 17 bp, Homo sapiens
catttttcaatagcaca

SEQ ID NO: 4495889 - DNA, 20 bp, Homo sapiens
catttttcagatataaaaga

SEQ ID NO: 4495890 - DNA, 15 bp, Homo sapiens
catttttcagcagca

SEQ ID NO: 4495891 - DNA, 23 bp, Homo sapiens
catttttcagcagcaaaaccaaa

SEQ ID NO: 4495892 - DNA, 14 bp, Homo sapiens
catttttcattcat

SEQ ID NO: 4495893 - DNA, 18 bp, Homo sapiens
catttttcattcatgaat

SEQ ID NO: 4495894 - DNA, 16 bp, Homo sapiens
catttttctcccaaga

SEQ ID NO: 4495895 - DNA, 22 bp, Homo sapiens
catttttctcccaagaaacctg

SEQ ID NO: 4495896 - DNA, 16 bp, Homo sapiens
catttttgttcttatg

SEQ ID NO: 4495897 - DNA, 17 bp, Homo sapiens
catttttgttttgaaag

SEQ ID NO: 4495898 - DNA, 17 bp, Homo sapiens
cattttttaaaagcctt

SEQ ID NO: 4495899 - DNA, 21 bp, Homo sapiens
cattttttaaaagccttccag

SEQ ID NO: 4495900 - DNA, 18 bp, Homo sapiens
cattttttaatgtgctct

SEQ ID NO: 4495901 - DNA, 20 bp, Homo sapiens
cattttttaatgtgctctgt

SEQ ID NO: 4495902 - DNA, 12 bp, Homo sapiens
cattttttactt

SEQ ID NO: 4495903 - DNA, 17 bp, Homo sapiens
cattttttacttgaatc

SEQ ID NO: 4495904 - DNA, 18 bp, Homo sapiens
cattttttgggcagcaat

SEQ ID NO: 4495905 - DNA, 19 bp, Homo sapiens
cattttttgggcagcaatt

SEQ ID NO: 4495906 - DNA, 22 bp, Homo sapiens
cattttttgggcagcaatttaa

SEQ ID NO: 4495907 - DNA, 23 bp, Homo sapiens
catttttttctacctataacact

SEQ ID NO: 4495908 - DNA, 14 bp, Homo sapiens
catttttttcttta

SEQ ID NO: 4495909 - DNA, 19 bp, Homo sapiens
ccaaaaaaaaatacatgct

SEQ ID NO: 4495910 - DNA, 11 bp, Homo sapiens
ccaaaaacatt

SEQ ID NO: 4495911 - DNA, 14 bp, Homo sapiens
ccaaaaacatttga

SEQ ID NO: 4495912 - DNA, 22 bp, Homo sapiens
ccaaaaacatttgattaataaa

SEQ ID NO: 4495913 - DNA, 14 bp, Homo sapiens
ccaaaaaccatgtt

SEQ ID NO: 4495914 - DNA, 16 bp, Homo sapiens
ccaaaaataaatatat

SEQ ID NO: 4495915 - DNA, 13 bp, Homo sapiens
ccaaaaatagaaa

SEQ ID NO: 4495916 - DNA, 12 bp, Homo sapiens
ccaaaaatagct

SEQ ID NO: 4495917 - DNA, 15 bp, Homo sapiens
ccaaaaatagtcaaa

SEQ ID NO: 4495918 - DNA, 19 bp, Homo sapiens
ccaaaacaagccaaagagc

SEQ ID NO: 4495919 - DNA, 21 bp, Homo sapiens
ccaaaacattttaaatgaaag

SEQ ID NO: 4495920 - DNA, 19 bp, Homo sapiens
ccaaaagaatgagtgcctt

SEQ ID NO: 4495921 - DNA, 19 bp, Homo sapiens
ccaaaagattgctgaaatt

SEQ ID NO: 4495922 - DNA, 23 bp, Homo sapiens
ccaaaagattgctgaaattttat

SEQ ID NO: 4495923 - DNA, 14 bp, Homo sapiens
ccaaaaggcagaag

SEQ ID NO: 4495924 - DNA, 19 bp, Homo sapiens
ccaaaaggtttaagaaata

SEQ ID NO: 4495925 - DNA, 19 bp, Homo sapiens
ccaaaagtccctccctgcc

SEQ ID NO: 4495926 - DNA, 12 bp, Homo sapiens
ccaaaatattaa

SEQ ID NO: 4495927 - DNA, 12 bp, Homo sapiens
ccaaaatcaaga

SEQ ID NO: 4495928 - DNA, 14 bp, Homo sapiens
ccaaaatcaagagt

SEQ ID NO: 4495929 - DNA, 21 bp, Homo sapiens
ccaaaatcctgaactttctcc

SEQ ID NO: 4495930 - DNA, 16 bp, Homo sapiens
ccaaaatgacatcttt

SEQ ID NO: 4495931 - DNA, 15 bp, Homo sapiens
ccaaaattttaaaaa

SEQ ID NO: 4495932 - DNA, 12 bp, Homo sapiens
ccaaacacccag

SEQ ID NO: 4495933 - DNA, 15 bp, Homo sapiens
ccaaacacccagagg

SEQ ID NO: 4495934 - DNA, 22 bp, Homo sapiens
ccaaacatgcttataacattaa

SEQ ID NO: 4495935 - DNA, 12 bp, Homo sapiens
ccaaacatgtat

SEQ ID NO: 4495936 - DNA, 17 bp, Homo sapiens
ccaaacatgtatttatg

SEQ ID NO: 4495937 - DNA, 17 bp, Homo sapiens
ccaaaccaggacactac

SEQ ID NO: 4495938 - DNA, 16 bp, Homo sapiens
ccaaaccccagcccca

SEQ ID NO: 4495939 - DNA, 19 bp, Homo sapiens
ccaaacccttaactgacat

SEQ ID NO: 4495940 - DNA, 17 bp, Homo sapiens
ccaaacccttgctttcc

SEQ ID NO: 4495941 - DNA, 17 bp, Homo sapiens
ccaaacctcctgtcagt

SEQ ID NO: 4495942 - DNA, 22 bp, Homo sapiens
ccaaacctcctgtcagtgagga

SEQ ID NO: 4495943 - DNA, 22 bp, Homo sapiens
ccaaacgccctttcctcctcag

SEQ ID NO: 4495944 - DNA, 17 bp, Homo sapiens
ccaaactgatccagtat

SEQ ID NO: 4495945 - DNA, 17 bp, Homo sapiens
ccaaactttatttttct

SEQ ID NO: 4495946 - DNA, 14 bp, Homo sapiens
ccaaagaaatgaac

SEQ ID NO: 4495947 - DNA, 17 bp, Homo sapiens
ccaaagaaatgaacatt

SEQ ID NO: 4495948 - DNA, 16 bp, Homo sapiens
ccaaagaatattttga

SEQ ID NO: 4495949 - DNA, 12 bp, Homo sapiens
ccaaagaggctg

SEQ ID NO: 4495950 - DNA, 22 bp, Homo sapiens
ccaaagaggctgcccctctcac

SEQ ID NO: 4495951 - DNA, 23 bp, Homo sapiens
ccaaagaggctgcccctctcacc

SEQ ID NO: 4495952 - DNA, 23 bp, Homo sapiens
ccaaagattaggtcgttttccaa

SEQ ID NO: 4495953 - DNA, 16 bp, Homo sapiens
ccaaagctttcatgta

SEQ ID NO: 4495954 - DNA, 15 bp, Homo sapiens
ccaaaggacgcctgc

SEQ ID NO: 4495955 - DNA, 15 bp, Homo sapiens
ccaaaggaggctggc

SEQ ID NO: 4495956 - DNA, 14 bp, Homo sapiens
ccaaagggtgctag

SEQ ID NO: 4495957 - DNA, 20 bp, Homo sapiens
ccaaaggttcagaaaattaa

SEQ ID NO: 4495958 - DNA, 22 bp, Homo sapiens
ccaaagtacagaatttgaatta

SEQ ID NO: 4495959 - DNA, 22 bp, Homo sapiens
ccaaagtgctgggattacaggc

SEQ ID NO: 4495960 - DNA, 16 bp, Homo sapiens
ccaaataaagataacc

SEQ ID NO: 4495961 - DNA, 17 bp, Homo sapiens
ccaaataaattcaataa

SEQ ID NO: 4495962 - DNA, 20 bp, Homo sapiens
ccaaatacctcaatttttgt

SEQ ID NO: 4495963 - DNA, 15 bp, Homo sapiens
ccaaatcccctaagc

SEQ ID NO: 4495964 - DNA, 14 bp, Homo sapiens
ccaaatcctattta

SEQ ID NO: 4495965 - DNA, 15 bp, Homo sapiens
ccaaatcctggaagg

SEQ ID NO: 4495966 - DNA, 19 bp, Homo sapiens
ccaaatccttggagtccca

SEQ ID NO: 4495967 - DNA, 15 bp, Homo sapiens
ccaaatctcagttgt

SEQ ID NO: 4495968 - DNA, 18 bp, Homo sapiens
ccaaatgaaaaatctcaa

SEQ ID NO: 4495969 - DNA, 23 bp, Homo sapiens
ccaaatgaaatgccaaaggaagt

SEQ ID NO: 4495970 - DNA, 18 bp, Homo sapiens
ccaaatgttcatcaatga

SEQ ID NO: 4495971 - DNA, 18 bp, Homo sapiens
ccaaattcagtttcataa

SEQ ID NO: 4495972 - DNA, 23 bp, Homo sapiens
ccaaattgtgcttctccccagaa

SEQ ID NO: 4495973 - DNA, 15 bp, Homo sapiens
ccaaattgtgtatat

SEQ ID NO: 4495974 - DNA, 11 bp, Homo sapiens
ccaaatttaaa

SEQ ID NO: 4495975 - DNA, 18 bp, Homo sapiens
ccaaatttaaaactgttg

SEQ ID NO: 4495976 - DNA, 15 bp, Homo sapiens
ccaaatttgattgat

SEQ ID NO: 4495977 - DNA, 23 bp, Homo sapiens
ccaaattttaatttttgctttta

SEQ ID NO: 4495978 - DNA, 15 bp, Homo sapiens
ccaacaccccatatg

SEQ ID NO: 4495979 - DNA, 21 bp, Homo sapiens
ccaacacgagcaggctactgt

SEQ ID NO: 4495980 - DNA, 13 bp, Homo sapiens
ccaacactgccag

SEQ ID NO: 4495981 - DNA, 17 bp, Homo sapiens
catataaatgtttatat

SEQ ID NO: 4495982 - DNA, 16 bp, Homo sapiens
catatagacacataca

SEQ ID NO: 4495983 - DNA, 12 bp, Homo sapiens
catatataaatt

SEQ ID NO: 4495984 - DNA, 14 bp, Homo sapiens
catatataaattat

SEQ ID NO: 4495985 - DNA, 19 bp, Homo sapiens
catatataaattattactt

SEQ ID NO: 4495986 - DNA, 18 bp, Homo sapiens
catatataactagctaga

SEQ ID NO: 4495987 - DNA, 22 bp, Homo sapiens
catatataactattttaaatat

SEQ ID NO: 4495988 - DNA, 16 bp, Homo sapiens
catatataagactgct

SEQ ID NO: 4495989 - DNA, 18 bp, Homo sapiens
catatatgctgtatttct

SEQ ID NO: 4495990 - DNA, 19 bp, Homo sapiens
catatatgctgtatttctt

SEQ ID NO: 4495991 - DNA, 14 bp, Homo sapiens
catatattgaggtt

SEQ ID NO: 4495992 - DNA, 21 bp, Homo sapiens
catatatttgcagtatgaact

SEQ ID NO: 4495993 - DNA, 12 bp, Homo sapiens
catatcaaatag

SEQ ID NO: 4495994 - DNA, 14 bp, Homo sapiens
catatcaaatgaaa

SEQ ID NO: 4495995 - DNA, 17 bp, Homo sapiens
catatcaaatgaaacag

SEQ ID NO: 4495996 - DNA, 17 bp, Homo sapiens
catatcatccacacatg

SEQ ID NO: 4495997 - DNA, 20 bp, Homo sapiens
catatcattaaacaaataaa

SEQ ID NO: 4495998 - DNA, 15 bp, Homo sapiens
catatcatttcttaa

SEQ ID NO: 4495999 - DNA, 17 bp, Homo sapiens
catatcctttggtcctg

SEQ ID NO: 4496000 - DNA, 18 bp, Homo sapiens
catatcctttggtcctgg

SEQ ID NO: 4496001 - DNA, 22 bp, Homo sapiens
catatcctttggtcctggtgct

SEQ ID NO: 4496002 - DNA, 15 bp, Homo sapiens
catatctaactttgt

SEQ ID NO: 4496003 - DNA, 14 bp, Homo sapiens
catatctctgccat

SEQ ID NO: 4496004 - DNA, 22 bp, Homo sapiens
catatggattgccaagtcagca

SEQ ID NO: 4496005 - DNA, 16 bp, Homo sapiens
catatggcccagtgtc

SEQ ID NO: 4496006 - DNA, 20 bp, Homo sapiens
catatgggatattcccaagc

SEQ ID NO: 4496007 - DNA, 22 bp, Homo sapiens
catatgggtgggattttgcaaa

SEQ ID NO: 4496008 - DNA, 23 bp, Homo sapiens
catatgtcagtgtaaatccttgt

SEQ ID NO: 4496009 - DNA, 14 bp, Homo sapiens
catatgtgtaaaga

SEQ ID NO: 4496010 - DNA, 16 bp, Homo sapiens
catatgttgaatactt

SEQ ID NO: 4496011 - DNA, 22 bp, Homo sapiens
catatgttttccacataaattt

SEQ ID NO: 4496012 - DNA, 23 bp, Homo sapiens
catatgttttccacataaatttt

SEQ ID NO: 4496013 - DNA, 19 bp, Homo sapiens
catattaatataagtttct

SEQ ID NO: 4496014 - DNA, 19 bp, Homo sapiens
catattactccacaccttt

SEQ ID NO: 4496015 - DNA, 21 bp, Homo sapiens
catattattttagtgtgtaaa

SEQ ID NO: 4496016 - DNA, 14 bp, Homo sapiens
catattatttttaa

SEQ ID NO: 4496017 - DNA, 15 bp, Homo sapiens
catattcaactattc

SEQ ID NO: 4496018 - DNA, 21 bp, Homo sapiens
catattctaacttattaaatt

SEQ ID NO: 4496019 - DNA, 20 bp, Homo sapiens
catattgaaaagcacagagg

SEQ ID NO: 4496020 - DNA, 21 bp, Homo sapiens
catattgagcacttgctgtat

SEQ ID NO: 4496021 - DNA, 17 bp, Homo sapiens
catattgatctttttat

SEQ ID NO: 4496022 - DNA, 19 bp, Homo sapiens
catattgtaaaacaggtag

SEQ ID NO: 4496023 - DNA, 13 bp, Homo sapiens
catattgttgaaa

SEQ ID NO: 4496024 - DNA, 22 bp, Homo sapiens
catattgttttaaaataagaat

SEQ ID NO: 4496025 - DNA, 10 bp, Homo sapiens
catatttaat

SEQ ID NO: 4496026 - DNA, 15 bp, Homo sapiens
catatttaatgtttt

SEQ ID NO: 4496027 - DNA, 22 bp, Homo sapiens
catatttaatgttttaaatgta

SEQ ID NO: 4496028 - DNA, 13 bp, Homo sapiens
catatttagctgt

SEQ ID NO: 4496029 - DNA, 21 bp, Homo sapiens
catatttagctgttttggaac

SEQ ID NO: 4496030 - DNA, 21 bp, Homo sapiens
catatttattgcattgctggt

SEQ ID NO: 4496031 - DNA, 20 bp, Homo sapiens
catatttatttttacctgct

SEQ ID NO: 4496032 - DNA, 23 bp, Homo sapiens
catatttatttttacctgctttt

SEQ ID NO: 4496033 - DNA, 18 bp, Homo sapiens
catatttgctaagaatgt

SEQ ID NO: 4496034 - DNA, 17 bp, Homo sapiens
catatttgtatgttttt

SEQ ID NO: 4496035 - DNA, 23 bp, Homo sapiens
catatttgtatgtttttctgtat

SEQ ID NO: 4496036 - DNA, 19 bp, Homo sapiens
catattttaaaatttgttc

SEQ ID NO: 4496037 - DNA, 19 bp, Homo sapiens
catattttaatcattattt

SEQ ID NO: 4496038 - DNA, 18 bp, Homo sapiens
catattttcaccatttga

SEQ ID NO: 4496039 - DNA, 18 bp, Homo sapiens
catattttttatgatgga

SEQ ID NO: 4496040 - DNA, 21 bp, Homo sapiens
catattttttatgatggagca

SEQ ID NO: 4496041 - DNA, 15 bp, Homo sapiens
catcaaaatgctttt

SEQ ID NO: 4496042 - DNA, 11 bp, Homo sapiens
catcaaagact

SEQ ID NO: 4496043 - DNA, 14 bp, Homo sapiens
catcaaagcttctt

SEQ ID NO: 4496044 - DNA, 22 bp, Homo sapiens
catcaaaggaatataagaaaag

SEQ ID NO: 4496045 - DNA, 20 bp, Homo sapiens
catcaaagtggtaaatactg

SEQ ID NO: 4496046 - DNA, 16 bp, Homo sapiens
catcaacattccaggg

SEQ ID NO: 4496047 - DNA, 22 bp, Homo sapiens
catcaactcccaacttcttcct

SEQ ID NO: 4496048 - DNA, 11 bp, Homo sapiens
cataaagtcag

SEQ ID NO: 4496049 - DNA, 21 bp, Homo sapiens
cataaagttgataaagatttt

SEQ ID NO: 4496050 - DNA, 14 bp, Homo sapiens
cataaagttgtatt

SEQ ID NO: 4496051 - DNA, 15 bp, Homo sapiens
cataaatactgtcaa

SEQ ID NO: 4496052 - DNA, 16 bp, Homo sapiens
cataaatcacagaaaa

SEQ ID NO: 4496053 - DNA, 18 bp, Homo sapiens
cataaatcatgttgttgt

SEQ ID NO: 4496054 - DNA, 20 bp, Homo sapiens
cataaatgcataatttatgg

SEQ ID NO: 4496055 - DNA, 16 bp, Homo sapiens
cataaattttaattca

SEQ ID NO: 4496056 - DNA, 17 bp, Homo sapiens
cataacaattcctctac

SEQ ID NO: 4496057 - DNA, 16 bp, Homo sapiens
cataacagtgcagggc

SEQ ID NO: 4496058 - DNA, 23 bp, Homo sapiens
cataacctgtctcacctggactt

SEQ ID NO: 4496059 - DNA, 21 bp, Homo sapiens
cataacggttaagaaagcact

SEQ ID NO: 4496060 - DNA, 23 bp, Homo sapiens
cataacggttaagaaagcactta

SEQ ID NO: 4496061 - DNA, 11 bp, Homo sapiens
cataactgaaa

SEQ ID NO: 4496062 - DNA, 18 bp, Homo sapiens
cataactgcttcttggag

SEQ ID NO: 4496063 - DNA, 21 bp, Homo sapiens
cataactgcttcttggagctt

SEQ ID NO: 4496064 - DNA, 18 bp, Homo sapiens
cataagagagatgagaaa

SEQ ID NO: 4496065 - DNA, 18 bp, Homo sapiens
cataagcaatcattttat

SEQ ID NO: 4496066 - DNA, 14 bp, Homo sapiens
cataagctactgcc

SEQ ID NO: 4496067 - DNA, 16 bp, Homo sapiens
cataagctactgccat

SEQ ID NO: 4496068 - DNA, 20 bp, Homo sapiens
cataagctactgccatcctg

SEQ ID NO: 4496069 - DNA, 21 bp, Homo sapiens
cataaggagttagaaccacag

SEQ ID NO: 4496070 - DNA, 15 bp, Homo sapiens
cataaggatgacttt

SEQ ID NO: 4496071 - DNA, 22 bp, Homo sapiens
cataaggtctggtaactgcaga

SEQ ID NO: 4496072 - DNA, 15 bp, Homo sapiens
cataagtatttcaaa

SEQ ID NO: 4496073 - DNA, 16 bp, Homo sapiens
cataagtttaactgta

SEQ ID NO: 4496074 - DNA, 13 bp, Homo sapiens
cataataaacctt

SEQ ID NO: 4496075 - DNA, 15 bp, Homo sapiens
cataataaattttct

SEQ ID NO: 4496076 - DNA, 13 bp, Homo sapiens
cataatcattacc

SEQ ID NO: 4496077 - DNA, 16 bp, Homo sapiens
cataatctgaaaacat

SEQ ID NO: 4496078 - DNA, 15 bp, Homo sapiens
cataatcttctgcct

SEQ ID NO: 4496079 - DNA, 20 bp, Homo sapiens
cataatgcattcttctctgt

SEQ ID NO: 4496080 - DNA, 23 bp, Homo sapiens
cataatgctttggaaaaatgggt

SEQ ID NO: 4496081 - DNA, 23 bp, Homo sapiens
cataatgggccactgaaatctgt

SEQ ID NO: 4496082 - DNA, 18 bp, Homo sapiens
cataatgtttctggattt

SEQ ID NO: 4496083 - DNA, 18 bp, Homo sapiens
cataattagatccattaa

SEQ ID NO: 4496084 - DNA, 13 bp, Homo sapiens
cataattatgaaa

SEQ ID NO: 4496085 - DNA, 20 bp, Homo sapiens
cataattcagaactaaattt

SEQ ID NO: 4496086 - DNA, 11 bp, Homo sapiens
cataattccta

SEQ ID NO: 4496087 - DNA, 18 bp, Homo sapiens
cataatttagttgtttct

SEQ ID NO: 4496088 - DNA, 12 bp, Homo sapiens
cataatttctgt

SEQ ID NO: 4496089 - DNA, 17 bp, Homo sapiens
catacaaactctcacca

SEQ ID NO: 4496090 - DNA, 17 bp, Homo sapiens
catacaaatttataaag

SEQ ID NO: 4496091 - DNA, 21 bp, Homo sapiens
catacaagtcatggtcacagt

SEQ ID NO: 4496092 - DNA, 13 bp, Homo sapiens
catacaatgtatg

SEQ ID NO: 4496093 - DNA, 15 bp, Homo sapiens
catacacacagcagt

SEQ ID NO: 4496094 - DNA, 23 bp, Homo sapiens
catacacagaggagtgcagcctt

SEQ ID NO: 4496095 - DNA, 19 bp, Homo sapiens
catacacatggtaacattg

SEQ ID NO: 4496096 - DNA, 14 bp, Homo sapiens
catacaccagaaga

SEQ ID NO: 4496097 - DNA, 14 bp, Homo sapiens
catacacctcgtca

SEQ ID NO: 4496098 - DNA, 20 bp, Homo sapiens
catacactttgttgcaagat

SEQ ID NO: 4496099 - DNA, 13 bp, Homo sapiens
catacagcctcta

SEQ ID NO: 4496100 - DNA, 14 bp, Homo sapiens
catacagcctctac

SEQ ID NO: 4496101 - DNA, 21 bp, Homo sapiens
catacaggatttgaactcaga

SEQ ID NO: 4496102 - DNA, 12 bp, Homo sapiens
catacagttttc

SEQ ID NO: 4496103 - DNA, 13 bp, Homo sapiens
catacagttttca

SEQ ID NO: 4496104 - DNA, 23 bp, Homo sapiens
catacagttttcattgattatat

SEQ ID NO: 4496105 - DNA, 18 bp, Homo sapiens
catacatgatacattttt

SEQ ID NO: 4496106 - DNA, 22 bp, Homo sapiens
catacatgtatctggtttgtca

SEQ ID NO: 4496107 - DNA, 19 bp, Homo sapiens
catacattggttttgaaat

SEQ ID NO: 4496108 - DNA, 21 bp, Homo sapiens
catacgaaaaagtgattgtga

SEQ ID NO: 4496109 - DNA, 22 bp, Homo sapiens
catacgaaaaagtgattgtgaa

SEQ ID NO: 4496110 - DNA, 23 bp, Homo sapiens
catacgaaaaagtgattgtgaag

SEQ ID NO: 4496111 - DNA, 16 bp, Homo sapiens
cagggtagcaggtacc

SEQ ID NO: 4496112 - DNA, 21 bp, Homo sapiens
cagggtcataagtggggagag

SEQ ID NO: 4496113 - DNA, 21 bp, Homo sapiens
cagggtccaggaatggtgctt

SEQ ID NO: 4496114 - DNA, 22 bp, Homo sapiens
cagggtcctctcttccacagtg

SEQ ID NO: 4496115 - DNA, 23 bp, Homo sapiens
cagggtcctctcttccacagtgg

SEQ ID NO: 4496116 - DNA, 23 bp, Homo sapiens
cagggtccttttgacactgctct

SEQ ID NO: 4496117 - DNA, 20 bp, Homo sapiens
cagggtcttgctctgtcccc

SEQ ID NO: 4496118 - DNA, 19 bp, Homo sapiens
cagggtggccacacaggca

SEQ ID NO: 4496119 - DNA, 22 bp, Homo sapiens
cagggtggccacacctctatcc

SEQ ID NO: 4496120 - DNA, 21 bp, Homo sapiens
cagggtggcgtccactcggct

SEQ ID NO: 4496121 - DNA, 17 bp, Homo sapiens
cagggtgggatggagga

SEQ ID NO: 4496122 - DNA, 20 bp, Homo sapiens
cagggtgggatggaggagaa

SEQ ID NO: 4496123 - DNA, 20 bp, Homo sapiens
cagggtggggggtgacagtg

SEQ ID NO: 4496124 - DNA, 23 bp, Homo sapiens
cagggtgggtgagctctcaggcc

SEQ ID NO: 4496125 - DNA, 23 bp, Homo sapiens
cagggttctcttagcaactcaga

SEQ ID NO: 4496126 - DNA, 19 bp, Homo sapiens
cagggttgaccccagagga

SEQ ID NO: 4496127 - DNA, 13 bp, Homo sapiens
cagggttgggccc

SEQ ID NO: 4496128 - DNA, 15 bp, Homo sapiens
cagggttgggcccag

SEQ ID NO: 4496129 - DNA, 22 bp, Homo sapiens
cagggtttacccagtgggacag

SEQ ID NO: 4496130 - DNA, 14 bp, Homo sapiens
caggtaacactaca

SEQ ID NO: 4496131 - DNA, 18 bp, Homo sapiens
caggtaataaaagctttg

SEQ ID NO: 4496132 - DNA, 15 bp, Homo sapiens
caggtaatacaaact

SEQ ID NO: 4496133 - DNA, 13 bp, Homo sapiens
caggtaatgtgaa

SEQ ID NO: 4496134 - DNA, 16 bp, Homo sapiens
caggtaatttaaattg

SEQ ID NO: 4496135 - DNA, 13 bp, Homo sapiens
caggtacacctcc

SEQ ID NO: 4496136 - DNA, 14 bp, Homo sapiens
caggtacacctccc

SEQ ID NO: 4496137 - DNA, 16 bp, Homo sapiens
caggtaccagctgcgc

SEQ ID NO: 4496138 - DNA, 17 bp, Homo sapiens
caggtaccagctgcgct

SEQ ID NO: 4496139 - DNA, 22 bp, Homo sapiens
caggtagaattatctaatttat

SEQ ID NO: 4496140 - DNA, 22 bp, Homo sapiens
caggtagcacagattttgaatc

SEQ ID NO: 4496141 - DNA, 15 bp, Homo sapiens
caggtagcctgctgg

SEQ ID NO: 4496142 - DNA, 23 bp, Homo sapiens
caggtagttgcaattgaattaaa

SEQ ID NO: 4496143 - DNA, 15 bp, Homo sapiens
caggtatccaaaaat

SEQ ID NO: 4496144 - DNA, 17 bp, Homo sapiens
caggtattaatcttgga

SEQ ID NO: 4496145 - DNA, 16 bp, Homo sapiens
caggtcagccactgtt

SEQ ID NO: 4496146 - DNA, 21 bp, Homo sapiens
caggtcagcgcggtcctgact

SEQ ID NO: 4496147 - DNA, 21 bp, Homo sapiens
caggtcagggaggatctgttc

SEQ ID NO: 4496148 - DNA, 19 bp, Homo sapiens
caggtcagttgtaataaat

SEQ ID NO: 4496149 - DNA, 16 bp, Homo sapiens
caggtcccagcccctc

SEQ ID NO: 4496150 - DNA, 22 bp, Homo sapiens
caggtcccagcccctcctccct

SEQ ID NO: 4496151 - DNA, 20 bp, Homo sapiens
caggtcccagccccttttcc

SEQ ID NO: 4496152 - DNA, 19 bp, Homo sapiens
caggtccgtagctcccctg

SEQ ID NO: 4496153 - DNA, 18 bp, Homo sapiens
caggtcctgcccatgtgt

SEQ ID NO: 4496154 - DNA, 22 bp, Homo sapiens
caggtcctgcccatgtgtcccc

SEQ ID NO: 4496155 - DNA, 15 bp, Homo sapiens
caggtctccacctgc

SEQ ID NO: 4496156 - DNA, 15 bp, Homo sapiens
caggtctgcctggtt

SEQ ID NO: 4496157 - DNA, 17 bp, Homo sapiens
caggtctgcctggttcc

SEQ ID NO: 4496158 - DNA, 19 bp, Homo sapiens
caggtgacacgcttctgag

SEQ ID NO: 4496159 - DNA, 22 bp, Homo sapiens
caggtgacacgcttctgagcag

SEQ ID NO: 4496160 - DNA, 23 bp, Homo sapiens
caggtgacacgcttctgagcagg

SEQ ID NO: 4496161 - DNA, 15 bp, Homo sapiens
caggtgacagtggct

SEQ ID NO: 4496162 - DNA, 20 bp, Homo sapiens
caggtgacagtggctgctct

SEQ ID NO: 4496163 - DNA, 21 bp, Homo sapiens
caggtgacagtggctgctctg

SEQ ID NO: 4496164 - DNA, 17 bp, Homo sapiens
caggtgacctcctgcag

SEQ ID NO: 4496165 - DNA, 17 bp, Homo sapiens
caggtgccgacactgag

SEQ ID NO: 4496166 - DNA, 17 bp, Homo sapiens
caggtgcctttcaaatt

SEQ ID NO: 4496167 - DNA, 20 bp, Homo sapiens
caggtgctaatttgttttgg

SEQ ID NO: 4496168 - DNA, 21 bp, Homo sapiens
caggtgctacacccttttcca

SEQ ID NO: 4496169 - DNA, 15 bp, Homo sapiens
caggtgctattgtta

SEQ ID NO: 4496170 - DNA, 15 bp, Homo sapiens
caggtggacgctgca

SEQ ID NO: 4496171 - DNA, 19 bp, Homo sapiens
caggtggacgctgcagacc

SEQ ID NO: 4496172 - DNA, 17 bp, Homo sapiens
caggtggagagcactag

SEQ ID NO: 4496173 - DNA, 15 bp, Homo sapiens
caggtggaggcaaca

SEQ ID NO: 4496174 - DNA, 13 bp, Homo sapiens
caggtggcacctg

SEQ ID NO: 4496175 - DNA, 14 bp, Homo sapiens
caggtggcacctgc

SEQ ID NO: 4496176 - DNA, 15 bp, Homo sapiens
caggtggcctggagg

SEQ ID NO: 4496177 - DNA, 15 bp, Homo sapiens
caggtggctgaccca

SEQ ID NO: 4496178 - DNA, 16 bp, Homo sapiens
caggtggctgacccag

SEQ ID NO: 4496179 - DNA, 18 bp, Homo sapiens
cagtggcctacaaatcag

SEQ ID NO: 4496180 - DNA, 21 bp, Homo sapiens
cagtggcctgatctctgctcc

SEQ ID NO: 4496181 - DNA, 22 bp, Homo sapiens
cagtggcctgatctctgctccc

SEQ ID NO: 4496182 - DNA, 11 bp, Homo sapiens
cagtggcctta

SEQ ID NO: 4496183 - DNA, 18 bp, Homo sapiens
cagtggcgcaatctcagc

SEQ ID NO: 4496184 - DNA, 20 bp, Homo sapiens
cagtggcgcattctaggctc

SEQ ID NO: 4496185 - DNA, 17 bp, Homo sapiens
cagtggcgggcccactc

SEQ ID NO: 4496186 - DNA, 21 bp, Homo sapiens
cagtggcttcatctgtcaagt

SEQ ID NO: 4496187 - DNA, 13 bp, Homo sapiens
cagtgggacagag

SEQ ID NO: 4496188 - DNA, 16 bp, Homo sapiens
cagtgggactgtggtg

SEQ ID NO: 4496189 - DNA, 14 bp, Homo sapiens
cagtgggagaaaac

SEQ ID NO: 4496190 - DNA, 20 bp, Homo sapiens
cagtgggtctctgtgtgtgt

SEQ ID NO: 4496191 - DNA, 15 bp, Homo sapiens
cagtggtgaaatctt

SEQ ID NO: 4496192 - DNA, 21 bp, Homo sapiens
cagtggtgaaatcttgtttgt

SEQ ID NO: 4496193 - DNA, 19 bp, Homo sapiens
cagtgtaatccaggggtgt

SEQ ID NO: 4496194 - DNA, 20 bp, Homo sapiens
cagtgtagattttatagtgt

SEQ ID NO: 4496195 - DNA, 19 bp, Homo sapiens
cagtgtctgcctttaaata

SEQ ID NO: 4496196 - DNA, 19 bp, Homo sapiens
cagtgtctttctagccata

SEQ ID NO: 4496197 - DNA, 18 bp, Homo sapiens
cagtgtctttctttggtg

SEQ ID NO: 4496198 - DNA, 19 bp, Homo sapiens
cagtgtgaggccagggcag

SEQ ID NO: 4496199 - DNA, 14 bp, Homo sapiens
cagtgtggagaccc

SEQ ID NO: 4496200 - DNA, 18 bp, Homo sapiens
cagtgtggagaccctgcc

SEQ ID NO: 4496201 - DNA, 19 bp, Homo sapiens
cagtgtggaggccactgtt

SEQ ID NO: 4496202 - DNA, 20 bp, Homo sapiens
cagtgtggaggccactgttt

SEQ ID NO: 4496203 - DNA, 19 bp, Homo sapiens
cagtgttaaatgtgatgaa

SEQ ID NO: 4496204 - DNA, 19 bp, Homo sapiens
cagtgttagggaagggcct

SEQ ID NO: 4496205 - DNA, 23 bp, Homo sapiens
cagtgttagtgctggtcagagag

SEQ ID NO: 4496206 - DNA, 18 bp, Homo sapiens
cagtgttcctgaagctgc

SEQ ID NO: 4496207 - DNA, 23 bp, Homo sapiens
cagtgttcctgaagctgctgtgt

SEQ ID NO: 4496208 - DNA, 17 bp, Homo sapiens
cagtgttgggttttttt

SEQ ID NO: 4496209 - DNA, 14 bp, Homo sapiens
cagtgtttaaaact

SEQ ID NO: 4496210 - DNA, 15 bp, Homo sapiens
cagtgtttaatgtaa

SEQ ID NO: 4496211 - DNA, 11 bp, Homo sapiens
cagtgtttatg

SEQ ID NO: 4496212 - DNA, 23 bp, Homo sapiens
cagtgtttatgtgctattaatat

SEQ ID NO: 4496213 - DNA, 16 bp, Homo sapiens
cagttaaaaaaaattt

SEQ ID NO: 4496214 - DNA, 12 bp, Homo sapiens
cagttaaagatt

SEQ ID NO: 4496215 - DNA, 13 bp, Homo sapiens
cagttaaagatta

SEQ ID NO: 4496216 - DNA, 24 bp, Homo sapiens
cagttaactattgcatttatatgt

SEQ ID NO: 4496217 - DNA, 17 bp, Homo sapiens
cagttactcagccctgg

SEQ ID NO: 4496218 - DNA, 21 bp, Homo sapiens
cagttacttaatgaccatgtt

SEQ ID NO: 4496219 - DNA, 17 bp, Homo sapiens
cagttataaaattaaaa

SEQ ID NO: 4496220 - DNA, 15 bp, Homo sapiens
cagttataagcgtat

SEQ ID NO: 4496221 - DNA, 19 bp, Homo sapiens
cagttatacagttataaaa

SEQ ID NO: 4496222 - DNA, 17 bp, Homo sapiens
cagttatggtgatgact

SEQ ID NO: 4496223 - DNA, 19 bp, Homo sapiens
cagttatggtgatgactta

SEQ ID NO: 4496224 - DNA, 13 bp, Homo sapiens
cagttattattct

SEQ ID NO: 4496225 - DNA, 14 bp, Homo sapiens
cagttatttctgtt

SEQ ID NO: 4496226 - DNA, 21 bp, Homo sapiens
cagttcaacctggtggcacca

SEQ ID NO: 4496227 - DNA, 22 bp, Homo sapiens
cagttcaacctggtggcaccag

SEQ ID NO: 4496228 - DNA, 22 bp, Homo sapiens
cagttcacttctttgcagagcc

SEQ ID NO: 4496229 - DNA, 23 bp, Homo sapiens
cagttcacttctttgcagagcct

SEQ ID NO: 4496230 - DNA, 17 bp, Homo sapiens
cagttcagtgttgcatg

SEQ ID NO: 4496231 - DNA, 23 bp, Homo sapiens
cagttccagccttctctcaagga

SEQ ID NO: 4496232 - DNA, 19 bp, Homo sapiens
cagttcccttggcctcaga

SEQ ID NO: 4496233 - DNA, 14 bp, Homo sapiens
cagttcctcgccct

SEQ ID NO: 4496234 - DNA, 18 bp, Homo sapiens
cagttcctcgccctgggt

SEQ ID NO: 4496235 - DNA, 18 bp, Homo sapiens
cagttctctcccttcctc

SEQ ID NO: 4496236 - DNA, 12 bp, Homo sapiens
cagttctctgtg

SEQ ID NO: 4496237 - DNA, 17 bp, Homo sapiens
cagttctgcaaatagaa

SEQ ID NO: 4496238 - DNA, 17 bp, Homo sapiens
cagggaatgcagcagga

SEQ ID NO: 4496239 - DNA, 13 bp, Homo sapiens
cagggacaaagaa

SEQ ID NO: 4496240 - DNA, 16 bp, Homo sapiens
cagggacaccagccag

SEQ ID NO: 4496241 - DNA, 19 bp, Homo sapiens
cagggacaccagccaggct

SEQ ID NO: 4496242 - DNA, 19 bp, Homo sapiens
cagggacagagacacctgc

SEQ ID NO: 4496243 - DNA, 20 bp, Homo sapiens
cagggacagagacacctgca

SEQ ID NO: 4496244 - DNA, 21 bp, Homo sapiens
cagggacagagacacctgcac

SEQ ID NO: 4496245 - DNA, 22 bp, Homo sapiens
cagggacagagacacctgcacc

SEQ ID NO: 4496246 - DNA, 20 bp, Homo sapiens
cagggacatgccctgtgtgg

SEQ ID NO: 4496247 - DNA, 18 bp, Homo sapiens
cagggaccactgggtgag

SEQ ID NO: 4496248 - DNA, 22 bp, Homo sapiens
cagggaccactgggtgagagag

SEQ ID NO: 4496249 - DNA, 19 bp, Homo sapiens
cagggaccggtgctgcagg

SEQ ID NO: 4496250 - DNA, 19 bp, Homo sapiens
cagggacctgctgctcagt

SEQ ID NO: 4496251 - DNA, 18 bp, Homo sapiens
cagggactgttcctgtct

SEQ ID NO: 4496252 - DNA, 21 bp, Homo sapiens
cagggagaagtagctagtagc

SEQ ID NO: 4496253 - DNA, 18 bp, Homo sapiens
cagggagacatctgcacc

SEQ ID NO: 4496254 - DNA, 19 bp, Homo sapiens
cagggagacatctgcaccc

SEQ ID NO: 4496255 - DNA, 18 bp, Homo sapiens
cagggagcagggaaggcc

SEQ ID NO: 4496256 - DNA, 19 bp, Homo sapiens
cagggagcagtacacaact

SEQ ID NO: 4496257 - DNA, 14 bp, Homo sapiens
cagggaggctcccg

SEQ ID NO: 4496258 - DNA, 15 bp, Homo sapiens
cagggaggctcccgg

SEQ ID NO: 4496259 - DNA, 23 bp, Homo sapiens
cagggaggctcccggggcctgga

SEQ ID NO: 4496260 - DNA, 18 bp, Homo sapiens
cagggaggggaggcagat

SEQ ID NO: 4496261 - DNA, 23 bp, Homo sapiens
cagggagtccagggtttctctgc

SEQ ID NO: 4496262 - DNA, 16 bp, Homo sapiens
cagggatattgcctta

SEQ ID NO: 4496263 - DNA, 19 bp, Homo sapiens
cagggatcacagaccacag

SEQ ID NO: 4496264 - DNA, 23 bp, Homo sapiens
cagggatcacagaccacaggaag

SEQ ID NO: 4496265 - DNA, 15 bp, Homo sapiens
cagggatgctgggct

SEQ ID NO: 4496266 - DNA, 13 bp, Homo sapiens
cagggatggggga

SEQ ID NO: 4496267 - DNA, 21 bp, Homo sapiens
cagggatgggggatgggccag

SEQ ID NO: 4496268 - DNA, 23 bp, Homo sapiens
cagggattctgggcttggggtgt

SEQ ID NO: 4496269 - DNA, 14 bp, Homo sapiens
cagggcactgccag

SEQ ID NO: 4496270 - DNA, 15 bp, Homo sapiens
cagggcactgccagc

SEQ ID NO: 4496271 - DNA, 16 bp, Homo sapiens
cagggcactgccagcc

SEQ ID NO: 4496272 - DNA, 17 bp, Homo sapiens
cagggcactgccagccc

SEQ ID NO: 4496273 - DNA, 22 bp, Homo sapiens
cagggcactgccagcccacccc

SEQ ID NO: 4496274 - DNA, 13 bp, Homo sapiens
cagggcagagtga

SEQ ID NO: 4496275 - DNA, 22 bp, Homo sapiens
cagggcagcctcgcggtcttgg

SEQ ID NO: 4496276 - DNA, 20 bp, Homo sapiens
cagggcagctgggcccaacc

SEQ ID NO: 4496277 - DNA, 21 bp, Homo sapiens
cagggcagctgggcccaaccc

SEQ ID NO: 4496278 - DNA, 18 bp, Homo sapiens
cagggccacgctccagct

SEQ ID NO: 4496279 - DNA, 22 bp, Homo sapiens
cagggccacgctccagctgccc

SEQ ID NO: 4496280 - DNA, 16 bp, Homo sapiens
cagggccacgtgccag

SEQ ID NO: 4496281 - DNA, 18 bp, Homo sapiens
cagggccacgtgccaggc

SEQ ID NO: 4496282 - DNA, 20 bp, Homo sapiens
cagggccacgtgccaggccc

SEQ ID NO: 4496283 - DNA, 21 bp, Homo sapiens
cagggccacgtgccaggcccg

SEQ ID NO: 4496284 - DNA, 16 bp, Homo sapiens
cagggccaggcctctg

SEQ ID NO: 4496285 - DNA, 18 bp, Homo sapiens
cagggccaggcctctgct

SEQ ID NO: 4496286 - DNA, 15 bp, Homo sapiens
cagggccatgtgctg

SEQ ID NO: 4496287 - DNA, 20 bp, Homo sapiens
cagggcccccaataaaccag

SEQ ID NO: 4496288 - DNA, 21 bp, Homo sapiens
cagggcccccaataaaccagt

SEQ ID NO: 4496289 - DNA, 22 bp, Homo sapiens
cagggcccccaataaaccagtg

SEQ ID NO: 4496290 - DNA, 17 bp, Homo sapiens
cagggccccccaactgt

SEQ ID NO: 4496291 - DNA, 15 bp, Homo sapiens
cagggcctcaggcac

SEQ ID NO: 4496292 - DNA, 14 bp, Homo sapiens
cagggcctctgcgg

SEQ ID NO: 4496293 - DNA, 21 bp, Homo sapiens
cagggcctctgcggagcacac

SEQ ID NO: 4496294 - DNA, 23 bp, Homo sapiens
cagggcctgaaacccgccctcag

SEQ ID NO: 4496295 - DNA, 21 bp, Homo sapiens
cagggcctgacttgagccact

SEQ ID NO: 4496296 - DNA, 13 bp, Homo sapiens
cagggcctggagc

SEQ ID NO: 4496297 - DNA, 16 bp, Homo sapiens
cagggcctggagcccc

SEQ ID NO: 4496298 - DNA, 14 bp, Homo sapiens
cagggcctggctcc

SEQ ID NO: 4496299 - DNA, 15 bp, Homo sapiens
cagggcctggctcca

SEQ ID NO: 4496300 - DNA, 14 bp, Homo sapiens
cagggccttgccca

SEQ ID NO: 4496301 - DNA, 17 bp, Homo sapiens
cagggcgagctgcagga

SEQ ID NO: 4496302 - DNA, 17 bp, Homo sapiens
cagggcgggcagagggc

SEQ ID NO: 4496303 - DNA, 22 bp, Homo sapiens
cagggcgggcagagggctggag

SEQ ID NO: 4496304 - DNA, 17 bp, Homo sapiens
cagggctccaggagcct

SEQ ID NO: 4496305 - DNA, 19 bp, Homo sapiens
cagggctccaggagcctca

SEQ ID NO: 4496306 - DNA, 21 bp, Homo sapiens
cagggctcccaggggtctccc

SEQ ID NO: 4496307 - DNA, 12 bp, Homo sapiens
cagggctctccc

SEQ ID NO: 4496308 - DNA, 13 bp, Homo sapiens
cagggctcttcca

SEQ ID NO: 4496309 - DNA, 24 bp, Homo sapiens
cagggctgctccccaacacctgcc

SEQ ID NO: 4496310 - DNA, 15 bp, Homo sapiens
cagagtggagtctga

SEQ ID NO: 4496311 - DNA, 19 bp, Homo sapiens
cagagtggagtctgagtct

SEQ ID NO: 4496312 - DNA, 12 bp, Homo sapiens
cagagtggccca

SEQ ID NO: 4496313 - DNA, 12 bp, Homo sapiens
cagagtggcctg

SEQ ID NO: 4496314 - DNA, 13 bp, Homo sapiens
cagagtggcctgg

SEQ ID NO: 4496315 - DNA, 16 bp, Homo sapiens
cagagtggcctggcca

SEQ ID NO: 4496316 - DNA, 17 bp, Homo sapiens
cagagtggcctggccag

SEQ ID NO: 4496317 - DNA, 18 bp, Homo sapiens
cagagtggcctggccagg

SEQ ID NO: 4496318 - DNA, 23 bp, Homo sapiens
cagagtggcctggccaggagctc

SEQ ID NO: 4496319 - DNA, 20 bp, Homo sapiens
cagagtggtttccaatgtgt

SEQ ID NO: 4496320 - DNA, 17 bp, Homo sapiens
cagagttaaatctcaaa

SEQ ID NO: 4496321 - DNA, 19 bp, Homo sapiens
cagagttacagttctgtgg

SEQ ID NO: 4496322 - DNA, 20 bp, Homo sapiens
cagagttgctgcaaacctga

SEQ ID NO: 4496323 - DNA, 14 bp, Homo sapiens
cagataaacagtag

SEQ ID NO: 4496324 - DNA, 22 bp, Homo sapiens
cagataactgaaaattatttaa

SEQ ID NO: 4496325 - DNA, 15 bp, Homo sapiens
cagataacttcttta

SEQ ID NO: 4496326 - DNA, 16 bp, Homo sapiens
cagataacttctttag

SEQ ID NO: 4496327 - DNA, 14 bp, Homo sapiens
cagataatgtgaaa

SEQ ID NO: 4496328 - DNA, 16 bp, Homo sapiens
cagatataactgtctt

SEQ ID NO: 4496329 - DNA, 18 bp, Homo sapiens
cagatataactgtcttgt

SEQ ID NO: 4496330 - DNA, 18 bp, Homo sapiens
cagatatactttgtggac

SEQ ID NO: 4496331 - DNA, 15 bp, Homo sapiens
cagatatcagtgtct

SEQ ID NO: 4496332 - DNA, 21 bp, Homo sapiens
cagatatcgagagtttctatg

SEQ ID NO: 4496333 - DNA, 20 bp, Homo sapiens
cagatatcttggacaaatca

SEQ ID NO: 4496334 - DNA, 15 bp, Homo sapiens
cagatatgcttacta

SEQ ID NO: 4496335 - DNA, 12 bp, Homo sapiens
cagatcaggaga

SEQ ID NO: 4496336 - DNA, 16 bp, Homo sapiens
cagatcagtaaagaac

SEQ ID NO: 4496337 - DNA, 18 bp, Homo sapiens
cagatcccaggcccctgg

SEQ ID NO: 4496338 - DNA, 21 bp, Homo sapiens
cagatcccaggcccctggagg

SEQ ID NO: 4496339 - DNA, 12 bp, Homo sapiens
cagatccccagc

SEQ ID NO: 4496340 - DNA, 20 bp, Homo sapiens
cagatccccagcccctcctc

SEQ ID NO: 4496341 - DNA, 21 bp, Homo sapiens
cagatccccagcccctcctcc

SEQ ID NO: 4496342 - DNA, 23 bp, Homo sapiens
cagatcctgttacttgcttcagt

SEQ ID NO: 4496343 - DNA, 15 bp, Homo sapiens
cagatcgatcctgga

SEQ ID NO: 4496344 - DNA, 18 bp, Homo sapiens
cagatctggtcccttgca

SEQ ID NO: 4496345 - DNA, 12 bp, Homo sapiens
cagatctgtgcc

SEQ ID NO: 4496346 - DNA, 18 bp, Homo sapiens
cagatctgtgccccatgc

SEQ ID NO: 4496347 - DNA, 20 bp, Homo sapiens
cagatctgtgccccatgcct

SEQ ID NO: 4496348 - DNA, 21 bp, Homo sapiens
cagatctgtgccccatgcctg

SEQ ID NO: 4496349 - DNA, 22 bp, Homo sapiens
cagatcttccgtggtcagagtg

SEQ ID NO: 4496350 - DNA, 12 bp, Homo sapiens
cagatgaataaa

SEQ ID NO: 4496351 - DNA, 14 bp, Homo sapiens
cagatgaggtcaac

SEQ ID NO: 4496352 - DNA, 15 bp, Homo sapiens
cagatgatctctcca

SEQ ID NO: 4496353 - DNA, 16 bp, Homo sapiens
cagatgcaacctcact

SEQ ID NO: 4496354 - DNA, 17 bp, Homo sapiens
cagatgcagggctgcag

SEQ ID NO: 4496355 - DNA, 18 bp, Homo sapiens
cagatgccccagagctgt

SEQ ID NO: 4496356 - DNA, 12 bp, Homo sapiens
cagatgcccgag

SEQ ID NO: 4496357 - DNA, 12 bp, Homo sapiens
cagatgcctggt

SEQ ID NO: 4496358 - DNA, 14 bp, Homo sapiens
cagatgcgtgccca

SEQ ID NO: 4496359 - DNA, 21 bp, Homo sapiens
cagatgctgaattgagaataa

SEQ ID NO: 4496360 - DNA, 18 bp, Homo sapiens
cagatgctggtggaggaa

SEQ ID NO: 4496361 - DNA, 20 bp, Homo sapiens
cagatgctggtggaggaagg

SEQ ID NO: 4496362 - DNA, 22 bp, Homo sapiens
cagatgcttgcggcaaaaggaa

SEQ ID NO: 4496363 - DNA, 21 bp, Homo sapiens
cagatggaaaattcatttttt

SEQ ID NO: 4496364 - DNA, 14 bp, Homo sapiens
cagatggagcccat

SEQ ID NO: 4496365 - DNA, 17 bp, Homo sapiens
cagatggcccctccact

SEQ ID NO: 4496366 - DNA, 20 bp, Homo sapiens
cagatgggcaaaccctggtg

SEQ ID NO: 4496367 - DNA, 13 bp, Homo sapiens
cagatggtgtcat

SEQ ID NO: 4496368 - DNA, 12 bp, Homo sapiens
cagatgtaaaga

SEQ ID NO: 4496369 - DNA, 16 bp, Homo sapiens
cagatgtaatgttttc

SEQ ID NO: 4496370 - DNA, 11 bp, Homo sapiens
cagatgtgaaa

SEQ ID NO: 4496371 - DNA, 16 bp, Homo sapiens
cagatgtgagccaccg

SEQ ID NO: 4496372 - DNA, 23 bp, Homo sapiens
cagatgtgagccaccgtgcctgg

SEQ ID NO: 4496373 - DNA, 18 bp, Homo sapiens
cagatgtgctataatctg

SEQ ID NO: 4496374 - DNA, 22 bp, Homo sapiens
cagatgtgctataatctgtttt

SEQ ID NO: 4496375 - DNA, 20 bp, Homo sapiens
cagatgttaaaataaatggt

SEQ ID NO: 4496376 - DNA, 22 bp, Homo sapiens
cagatgtttgttttcaaaatac

SEQ ID NO: 4496377 - DNA, 13 bp, Homo sapiens
cagattacactga

SEQ ID NO: 4496378 - DNA, 11 bp, Homo sapiens
cagattacagg

SEQ ID NO: 4496379 - DNA, 20 bp, Homo sapiens
cagattacaggaatgaagaa

SEQ ID NO: 4496380 - DNA, 21 bp, Homo sapiens
cagattacaggaatgaagaac

SEQ ID NO: 4496381 - DNA, 21 bp, Homo sapiens
cagattactgctttaatcaga

SEQ ID NO: 4496382 - DNA, 15 bp, Homo sapiens
cagattcaggccagc

SEQ ID NO: 4496383 - DNA, 14 bp, Homo sapiens
cagattcctttccc

SEQ ID NO: 4496384 - DNA, 16 bp, Homo sapiens
cagattcctttccctt

SEQ ID NO: 4496385 - DNA, 22 bp, Homo sapiens
cagattgatagggagttttaaa

SEQ ID NO: 4496386 - DNA, 17 bp, Homo sapiens
cagattgcttaaaagca

SEQ ID NO: 4496387 - DNA, 18 bp, Homo sapiens
cagattggctcacactga

SEQ ID NO: 4496388 - DNA, 20 bp, Homo sapiens
cagattggctcacactgaga

SEQ ID NO: 4496389 - DNA, 22 bp, Homo sapiens
cagattggctcacactgagaat

SEQ ID NO: 4496390 - DNA, 18 bp, Homo sapiens
cagattgtggaatgttgg

SEQ ID NO: 4496391 - DNA, 20 bp, Homo sapiens
cagatttaacctgttatttc

SEQ ID NO: 4496392 - DNA, 17 bp, Homo sapiens
cagatttagtgaaagct

SEQ ID NO: 4496393 - DNA, 20 bp, Homo sapiens
cagatttagtgaaagctaga

SEQ ID NO: 4496394 - DNA, 15 bp, Homo sapiens
cagatttctgaggaa

SEQ ID NO: 4496395 - DNA, 22 bp, Homo sapiens
cagatttgggggaattaacaaa

SEQ ID NO: 4496396 - DNA, 14 bp, Homo sapiens
cagatttgtctttt

SEQ ID NO: 4496397 - DNA, 21 bp, Homo sapiens
cagattttaaattttatgtca

SEQ ID NO: 4496398 - DNA, 22 bp, Homo sapiens
cagattttcagcaaactctttt

SEQ ID NO: 4496399 - DNA, 20 bp, Homo sapiens
cagattttgataactgttta

SEQ ID NO: 4496400 - DNA, 19 bp, Homo sapiens
cagatttttatgttttctt

SEQ ID NO: 4496401 - DNA, 20 bp, Homo sapiens
cagcaaactcttttcccact

SEQ ID NO: 4496402 - DNA, 15 bp, Homo sapiens
cagcaaagaaaaaaa

SEQ ID NO: 4496403 - DNA, 13 bp, Homo sapiens
cagcaaagcagca

SEQ ID NO: 4496404 - DNA, 14 bp, Homo sapiens
cagcaaagcagcag

SEQ ID NO: 4496405 - DNA, 13 bp, Homo sapiens
cagcaaatatatg

SEQ ID NO: 4496406 - DNA, 14 bp, Homo sapiens
cagcaaattttcag

SEQ ID NO: 4496407 - DNA, 14 bp, Homo sapiens
cagcaacagcctac

SEQ ID NO: 4496408 - DNA, 10 bp, Homo sapiens
cagcaaccct

SEQ ID NO: 4496409 - DNA, 18 bp, Homo sapiens
cagcaacccttcctgctg

SEQ ID NO: 4496410 - DNA, 24 bp, Homo sapiens
cagcaacccttcctgctgctgcta

SEQ ID NO: 4496411 - DNA, 20 bp, Homo sapiens
cagcaacggcacagctaatt

SEQ ID NO: 4496412 - DNA, 10 bp, Homo sapiens
cagcaactcc

SEQ ID NO: 4496413 - DNA, 13 bp, Homo sapiens
caggaagccagag

SEQ ID NO: 4496414 - DNA, 16 bp, Homo sapiens
caggaagccagagccc

SEQ ID NO: 4496415 - DNA, 16 bp, Homo sapiens
caggaagcccaggagc

SEQ ID NO: 4496416 - DNA, 15 bp, Homo sapiens
caggaagccgtcctg

SEQ ID NO: 4496417 - DNA, 16 bp, Homo sapiens
caggaaggactatgaa

SEQ ID NO: 4496418 - DNA, 12 bp, Homo sapiens
caggaaggagag

SEQ ID NO: 4496419 - DNA, 14 bp, Homo sapiens
caggaaggagagcc

SEQ ID NO: 4496420 - DNA, 16 bp, Homo sapiens
caggaaggaggggaga

SEQ ID NO: 4496421 - DNA, 13 bp, Homo sapiens
caggaaggcagaa

SEQ ID NO: 4496422 - DNA, 22 bp, Homo sapiens
caggaagggaaagcgggcagcc

SEQ ID NO: 4496423 - DNA, 21 bp, Homo sapiens
caggaagggcaggaaggagag

SEQ ID NO: 4496424 - DNA, 16 bp, Homo sapiens
caggaagtccagccac

SEQ ID NO: 4496425 - DNA, 19 bp, Homo sapiens
caggaatatctgttcccag

SEQ ID NO: 4496426 - DNA, 15 bp, Homo sapiens
caggaatcacccctc

SEQ ID NO: 4496427 - DNA, 20 bp, Homo sapiens
caggaatcacccctctgccc

SEQ ID NO: 4496428 - DNA, 21 bp, Homo sapiens
caggaatcacccctctgcccc

SEQ ID NO: 4496429 - DNA, 16 bp, Homo sapiens
caggaatcagtttaaa

SEQ ID NO: 4496430 - DNA, 21 bp, Homo sapiens
caggaatgccaaggagacatc

SEQ ID NO: 4496431 - DNA, 15 bp, Homo sapiens
caggaatttaagaat

SEQ ID NO: 4496432 - DNA, 16 bp, Homo sapiens
caggaatttaagaatt

SEQ ID NO: 4496433 - DNA, 18 bp, Homo sapiens
caggacactaccctgaga

SEQ ID NO: 4496434 - DNA, 14 bp, Homo sapiens
caggacagaacagt

SEQ ID NO: 4496435 - DNA, 12 bp, Homo sapiens
caggacagctcc

SEQ ID NO: 4496436 - DNA, 12 bp, Homo sapiens
caggacaggccc

SEQ ID NO: 4496437 - DNA, 12 bp, Homo sapiens
caggacatttct

SEQ ID NO: 4496438 - DNA, 18 bp, Homo sapiens
caggacatttctctaaga

SEQ ID NO: 4496439 - DNA, 15 bp, Homo sapiens
caggacccagaggaa

SEQ ID NO: 4496440 - DNA, 13 bp, Homo sapiens
caggacccagtgg

SEQ ID NO: 4496441 - DNA, 23 bp, Homo sapiens
caggacccagtggtcagcaggtg

SEQ ID NO: 4496442 - DNA, 19 bp, Homo sapiens
caggacgaaaaagaggcat

SEQ ID NO: 4496443 - DNA, 12 bp, Homo sapiens
caggacgccact

SEQ ID NO: 4496444 - DNA, 14 bp, Homo sapiens
caggacgccactca

SEQ ID NO: 4496445 - DNA, 16 bp, Homo sapiens
caggacggctcctcag

SEQ ID NO: 4496446 - DNA, 21 bp, Homo sapiens
caggacggctcctcagagcgc

SEQ ID NO: 4496447 - DNA, 23 bp, Homo sapiens
caggacggctcctcagagcgcca

SEQ ID NO: 4496448 - DNA, 21 bp, Homo sapiens
caggactccaggcccaaggct

SEQ ID NO: 4496449 - DNA, 21 bp, Homo sapiens
caggactccctcctcacctct

SEQ ID NO: 4496450 - DNA, 13 bp, Homo sapiens
caggactctgcgg

SEQ ID NO: 4496451 - DNA, 17 bp, Homo sapiens
caggactctgcgggagg

SEQ ID NO: 4496452 - DNA, 20 bp, Homo sapiens
caggactctgcgggaggctg

SEQ ID NO: 4496453 - DNA, 22 bp, Homo sapiens
caggactctgcgggaggctggg

SEQ ID NO: 4496454 - DNA, 19 bp, Homo sapiens
caggactgaattgtcccca

SEQ ID NO: 4496455 - DNA, 13 bp, Homo sapiens
caggactgcacag

SEQ ID NO: 4496456 - DNA, 12 bp, Homo sapiens
caggactgggcc

SEQ ID NO: 4496457 - DNA, 23 bp, Homo sapiens
caggagaaatgcatccattcctc

SEQ ID NO: 4496458 - DNA, 11 bp, Homo sapiens
caggagaacca

SEQ ID NO: 4496459 - DNA, 17 bp, Homo sapiens
caggagaaccactacat

SEQ ID NO: 4496460 - DNA, 21 bp, Homo sapiens
caggagaaggccaattcctat

SEQ ID NO: 4496461 - DNA, 23 bp, Homo sapiens
caggagaaggggctttgtgacca

SEQ ID NO: 4496462 - DNA, 21 bp, Homo sapiens
caggagactttacaaaccttt

SEQ ID NO: 4496463 - DNA, 15 bp, Homo sapiens
caggagagagcagca

SEQ ID NO: 4496464 - DNA, 15 bp, Homo sapiens
caggagagccagccc

SEQ ID NO: 4496465 - DNA, 19 bp, Homo sapiens
caggagagccagccctccc

SEQ ID NO: 4496466 - DNA, 22 bp, Homo sapiens
caggagatcgagaccatcctgg

SEQ ID NO: 4496467 - DNA, 14 bp, Homo sapiens
caggagatggaggg

SEQ ID NO: 4496468 - DNA, 18 bp, Homo sapiens
caggagatgggtccaggg

SEQ ID NO: 4496469 - DNA, 21 bp, Homo sapiens
caggagattggatttgctgtg

SEQ ID NO: 4496470 - DNA, 12 bp, Homo sapiens
caggagcctagc

SEQ ID NO: 4496471 - DNA, 20 bp, Homo sapiens
caggagcctagcggagccca

SEQ ID NO: 4496472 - DNA, 22 bp, Homo sapiens
caggagcctagcggagcccagc

SEQ ID NO: 4496473 - DNA, 16 bp, Homo sapiens
caggagcctcactggg

SEQ ID NO: 4496474 - DNA, 15 bp, Homo sapiens
caggagcctcatcca

SEQ ID NO: 4496475 - DNA, 23 bp, Homo sapiens
caggagcctcatccagcctcaga

SEQ ID NO: 4496476 - DNA, 14 bp, Homo sapiens
caggagcctggtcc

SEQ ID NO: 4496477 - DNA, 20 bp, Homo sapiens
caggagcctggtccttccct

SEQ ID NO: 4496478 - DNA, 12 bp, Homo sapiens
caggagctcttc

SEQ ID NO: 4496479 - DNA, 15 bp, Homo sapiens
caggagctcttcagg

SEQ ID NO: 4496480 - DNA, 22 bp, Homo sapiens
caggagctcttcaggcctccct

SEQ ID NO: 4496481 - DNA, 23 bp, Homo sapiens
caggagctcttcaggcctccctc

SEQ ID NO: 4496482 - DNA, 20 bp, Homo sapiens
caggagcttgggcagtgccc

SEQ ID NO: 4496483 - DNA, 19 bp, Homo sapiens
caggaggaaaaggcttggt

SEQ ID NO: 4496484 - DNA, 21 bp, Homo sapiens
caggaggagaaaagaaatgca

SEQ ID NO: 4496485 - DNA, 14 bp, Homo sapiens
caggaggagctgcc

SEQ ID NO: 4496486 - DNA, 18 bp, Homo sapiens
caggaggattgcctttaa

SEQ ID NO: 4496487 - DNA, 13 bp, Homo sapiens
caggaggctgaga

SEQ ID NO: 4496488 - DNA, 17 bp, Homo sapiens
caggaggctgagacagg

SEQ ID NO: 4496489 - DNA, 19 bp, Homo sapiens
caggaggctgagacaggag

SEQ ID NO: 4496490 - DNA, 16 bp, Homo sapiens
caggaggctgaggcag

SEQ ID NO: 4496491 - DNA, 21 bp, Homo sapiens
caggaggctgaggcagaagaa

SEQ ID NO: 4496492 - DNA, 18 bp, Homo sapiens
caggaggctttttcagtg

SEQ ID NO: 4496493 - DNA, 16 bp, Homo sapiens
caggagggagggtggc

SEQ ID NO: 4496494 - DNA, 16 bp, Homo sapiens
caggaggggaaacatc

SEQ ID NO: 4496495 - DNA, 20 bp, Homo sapiens
caggaggtggaggttgcagt

SEQ ID NO: 4496496 - DNA, 12 bp, Homo sapiens
caggagtccaga

SEQ ID NO: 4496497 - DNA, 16 bp, Homo sapiens
caggagtccagacccc

SEQ ID NO: 4496498 - DNA, 15 bp, Homo sapiens
caggagtccagcccc

SEQ ID NO: 4496499 - DNA, 16 bp, Homo sapiens
caggagtccagcccct

SEQ ID NO: 4496500 - DNA, 21 bp, Homo sapiens
caggagtccagcccctcctcc

SEQ ID NO: 4496501 - DNA, 14 bp, Homo sapiens
caggagtccaggcc

SEQ ID NO: 4496502 - DNA, 15 bp, Homo sapiens
caggagtccctgcca

SEQ ID NO: 4496503 - DNA, 13 bp, Homo sapiens
caggagtctgcca

SEQ ID NO: 4496504 - DNA, 16 bp, Homo sapiens
caggagtgtcctgccc

SEQ ID NO: 4496505 - DNA, 13 bp, Homo sapiens
caggagttctgaa

SEQ ID NO: 4496506 - DNA, 21 bp, Homo sapiens
caggagtttgagaccaggctg

SEQ ID NO: 4496507 - DNA, 23 bp, Homo sapiens
caggagtttgagaccaggctggg

SEQ ID NO: 4496508 - DNA, 18 bp, Homo sapiens
caggagtttgaggctgca

SEQ ID NO: 4496509 - DNA, 18 bp, Homo sapiens
caggagttttactgcctg

SEQ ID NO: 4496510 - DNA, 19 bp, Homo sapiens
caggagttttactgcctgt

SEQ ID NO: 4496511 - DNA, 17 bp, Homo sapiens
caggataaagttattct

SEQ ID NO: 4496512 - DNA, 15 bp, Homo sapiens
caggatactggcaca

SEQ ID NO: 4496513 - DNA, 16 bp, Homo sapiens
caggatcccaggggcc

SEQ ID NO: 4496514 - DNA, 22 bp, Homo sapiens
caggatctgtctgtgcacatgc

SEQ ID NO: 4496515 - DNA, 15 bp, Homo sapiens
caggatctttgactg

SEQ ID NO: 4496516 - DNA, 15 bp, Homo sapiens
caggatgaggacaga

SEQ ID NO: 4496517 - DNA, 16 bp, Homo sapiens
caggatgaggacagag

SEQ ID NO: 4496518 - DNA, 19 bp, Homo sapiens
caggatgaggacagagggc

SEQ ID NO: 4496519 - DNA, 15 bp, Homo sapiens
caggatggcctttcc

SEQ ID NO: 4496520 - DNA, 21 bp, Homo sapiens
caggatggtctcgatctcctg

SEQ ID NO: 4496521 - DNA, 21 bp, Homo sapiens
caggatgtggcttatgagata

SEQ ID NO: 4496522 - DNA, 18 bp, Homo sapiens
caggattacagtgtagct

SEQ ID NO: 4496523 - DNA, 16 bp, Homo sapiens
caggattttaatcttt

SEQ ID NO: 4496524 - DNA, 15 bp, Homo sapiens
caggcacacacagcc

SEQ ID NO: 4496525 - DNA, 18 bp, Homo sapiens
caggcacacacagcccct

SEQ ID NO: 4496526 - DNA, 14 bp, Homo sapiens
caggcacacactgt

SEQ ID NO: 4496527 - DNA, 23 bp, Homo sapiens
caggcacacactgtgctttctat

SEQ ID NO: 4496528 - DNA, 12 bp, Homo sapiens
caggcacacagc

SEQ ID NO: 4496529 - DNA, 17 bp, Homo sapiens
caggcacacagcagccc

SEQ ID NO: 4496530 - DNA, 13 bp, Homo sapiens
caggcacacagct

SEQ ID NO: 4496531 - DNA, 20 bp, Homo sapiens
caggcacacagctactctcc

SEQ ID NO: 4496532 - DNA, 20 bp, Homo sapiens
caggcacatacacctcgtca

SEQ ID NO: 4496533 - DNA, 22 bp, Homo sapiens
caggcacatacacctcgtcaag

SEQ ID NO: 4496534 - DNA, 15 bp, Homo sapiens
caggcaccaaaagaa

SEQ ID NO: 4496535 - DNA, 19 bp, Homo sapiens
caggcacccgtccccacac

SEQ ID NO: 4496536 - DNA, 14 bp, Homo sapiens
caggcaccctcagg

SEQ ID NO: 4496537 - DNA, 16 bp, Homo sapiens
caggcaccctcaggga

SEQ ID NO: 4496538 - DNA, 24 bp, Homo sapiens
caggcaccgccacgtcccagcatc

SEQ ID NO: 4496539 - DNA, 16 bp, Homo sapiens
caggcacgaacccacc

SEQ ID NO: 4496540 - DNA, 20 bp, Homo sapiens
caggcactgagaatgatagt

SEQ ID NO: 4496541 - DNA, 23 bp, Homo sapiens
caggcactgagataccagcgagg

SEQ ID NO: 4496542 - DNA, 20 bp, Homo sapiens
caggcagagctggagccccc

SEQ ID NO: 4496543 - DNA, 17 bp, Homo sapiens
caggcagatctgtgccc

SEQ ID NO: 4496544 - DNA, 19 bp, Homo sapiens
caggcagatctgtgcccca

SEQ ID NO: 4496545 - DNA, 21 bp, Homo sapiens
caggcagatctgtgccccatg

SEQ ID NO: 4496546 - DNA, 13 bp, Homo sapiens
caggcagccagcc

SEQ ID NO: 4496547 - DNA, 15 bp, Homo sapiens
caggcagcccagcag

SEQ ID NO: 4496548 - DNA, 10 bp, Homo sapiens
caggcagctc

SEQ ID NO: 4496549 - DNA, 21 bp, Homo sapiens
caggcagcttctactcctgcc

SEQ ID NO: 4496550 - DNA, 13 bp, Homo sapiens
caggcaggaacaa

SEQ ID NO: 4496551 - DNA, 18 bp, Homo sapiens
caggcaggaagggcagga

SEQ ID NO: 4496552 - DNA, 19 bp, Homo sapiens
caggcaggaagggcaggaa

SEQ ID NO: 4496553 - DNA, 15 bp, Homo sapiens
caggcagggcctggc

SEQ ID NO: 4496554 - DNA, 17 bp, Homo sapiens
caggcagggcctggctc

SEQ ID NO: 4496555 - DNA, 17 bp, Homo sapiens
caggcaggtcacagaaa

SEQ ID NO: 4496556 - DNA, 19 bp, Homo sapiens
caggcaggtcacagaaagg

SEQ ID NO: 4496557 - DNA, 20 bp, Homo sapiens
caggcaggtcacagaaaggc

SEQ ID NO: 4496558 - DNA, 13 bp, Homo sapiens
caggcagtctctc

SEQ ID NO: 4496559 - DNA, 18 bp, Homo sapiens
caggcatagaggcttctc

SEQ ID NO: 4496560 - DNA, 18 bp, Homo sapiens
caggcattggctcagccc

SEQ ID NO: 4496561 - DNA, 17 bp, Homo sapiens
caggcatttagccctca

SEQ ID NO: 4496562 - DNA, 18 bp, Homo sapiens
caggccaagggaccaggt

SEQ ID NO: 4496563 - DNA, 15 bp, Homo sapiens
caggccaaggtctga

SEQ ID NO: 4496564 - DNA, 19 bp, Homo sapiens
caggccaaggtctgagcca

SEQ ID NO: 4496565 - DNA, 20 bp, Homo sapiens
caggccaaggtctgagccac

SEQ ID NO: 4496566 - DNA, 11 bp, Homo sapiens
caggccacaga

SEQ ID NO: 4496567 - DNA, 17 bp, Homo sapiens
caggccacagagaacct

SEQ ID NO: 4496568 - DNA, 21 bp, Homo sapiens
caggccacagagaacctgagt

SEQ ID NO: 4496569 - DNA, 16 bp, Homo sapiens
caggccagatggcccc

SEQ ID NO: 4496570 - DNA, 14 bp, Homo sapiens
caggccagcccagc

SEQ ID NO: 4496571 - DNA, 16 bp, Homo sapiens
caggccagcctccgag

SEQ ID NO: 4496572 - DNA, 12 bp, Homo sapiens
caggccagctca

SEQ ID NO: 4496573 - DNA, 16 bp, Homo sapiens
caggccagctcaggaa

SEQ ID NO: 4496574 - DNA, 13 bp, Homo sapiens
caggccagctgcg

SEQ ID NO: 4496575 - DNA, 20 bp, Homo sapiens
caggccagctgcggccaggc

SEQ ID NO: 4496576 - DNA, 15 bp, Homo sapiens
caggccatttttggt

SEQ ID NO: 4496577 - DNA, 15 bp, Homo sapiens
caggcccactcccca

SEQ ID NO: 4496578 - DNA, 16 bp, Homo sapiens
caggcccactccccag

SEQ ID NO: 4496579 - DNA, 16 bp, Homo sapiens
caggcccagctgctcc

SEQ ID NO: 4496580 - DNA, 17 bp, Homo sapiens
caggcccagctgctccc

SEQ ID NO: 4496581 - DNA, 22 bp, Homo sapiens
caggcccagctgctcccctgga

SEQ ID NO: 4496582 - DNA, 16 bp, Homo sapiens
caggccccagacaggg

SEQ ID NO: 4496583 - DNA, 21 bp, Homo sapiens
caggcccccaacccctcctcc

SEQ ID NO: 4496584 - DNA, 17 bp, Homo sapiens
caggcccccagcccctc

SEQ ID NO: 4496585 - DNA, 19 bp, Homo sapiens
caggcccccagcccctcct

SEQ ID NO: 4496586 - DNA, 20 bp, Homo sapiens
caggcccccagcccctcctc

SEQ ID NO: 4496587 - DNA, 21 bp, Homo sapiens
caggccccgaggacccagacc

SEQ ID NO: 4496588 - DNA, 18 bp, Homo sapiens
caggccccgcttgtccag

SEQ ID NO: 4496589 - DNA, 22 bp, Homo sapiens
caggccccgcttgtccagcgcc

SEQ ID NO: 4496590 - DNA, 16 bp, Homo sapiens
caggcccctggaggct

SEQ ID NO: 4496591 - DNA, 15 bp, Homo sapiens
caggcccgagcgcct

SEQ ID NO: 4496592 - DNA, 16 bp, Homo sapiens
caggcccgagcgcctg

SEQ ID NO: 4496593 - DNA, 22 bp, Homo sapiens
caggcccgagcgcctgcgttcc

SEQ ID NO: 4496594 - DNA, 16 bp, Homo sapiens
caggcccggggctggc

SEQ ID NO: 4496595 - DNA, 22 bp, Homo sapiens
caggcccgtcagcatcactgat

SEQ ID NO: 4496596 - DNA, 23 bp, Homo sapiens
caggcccgtcagcatcactgatg

SEQ ID NO: 4496597 - DNA, 15 bp, Homo sapiens
caggccctccagtgg

SEQ ID NO: 4496598 - DNA, 20 bp, Homo sapiens
caggccctccagtgggctga

SEQ ID NO: 4496599 - DNA, 22 bp, Homo sapiens
caggccctccctgtctccaggg

SEQ ID NO: 4496600 - DNA, 23 bp, Homo sapiens
caggccctccctgtctccagggc

SEQ ID NO: 4496601 - DNA, 18 bp, Homo sapiens
caggccctgactcctctg

SEQ ID NO: 4496602 - DNA, 21 bp, Homo sapiens
caggccctgactcctctggct

SEQ ID NO: 4496603 - DNA, 22 bp, Homo sapiens
caggccctgactcctctggctt

SEQ ID NO: 4496604 - DNA, 19 bp, Homo sapiens
caggcctccctctctcttc

SEQ ID NO: 4496605 - DNA, 23 bp, Homo sapiens
caggcctccctctctcttctgct

SEQ ID NO: 4496606 - DNA, 15 bp, Homo sapiens
caggcctctgctggc

SEQ ID NO: 4496607 - DNA, 19 bp, Homo sapiens
caggcctctggttgcctcc

SEQ ID NO: 4496608 - DNA, 23 bp, Homo sapiens
caggcctgagatttcatctgctc

SEQ ID NO: 4496609 - DNA, 22 bp, Homo sapiens
caggcctgcgggcccctggtga

SEQ ID NO: 4496610 - DNA, 23 bp, Homo sapiens
caggcctgcgggcccctggtgat

SEQ ID NO: 4496611 - DNA, 12 bp, Homo sapiens
caggcctgtcca

SEQ ID NO: 4496612 - DNA, 18 bp, Homo sapiens
caggcctgtccaccctgc

SEQ ID NO: 4496613 - DNA, 11 bp, Homo sapiens
caggccttgtc

SEQ ID NO: 4496614 - DNA, 19 bp, Homo sapiens
caggcgcctataatcccag

SEQ ID NO: 4496615 - DNA, 15 bp, Homo sapiens
caggcgcctgccatc

SEQ ID NO: 4496616 - DNA, 16 bp, Homo sapiens
caggcgctgcatacag

SEQ ID NO: 4496617 - DNA, 13 bp, Homo sapiens
caggctaattttt

SEQ ID NO: 4496618 - DNA, 15 bp, Homo sapiens
caggctagaacctgg

SEQ ID NO: 4496619 - DNA, 16 bp, Homo sapiens
caggctagccctgccc

SEQ ID NO: 4496620 - DNA, 22 bp, Homo sapiens
caggctcactgccaggccagcc

SEQ ID NO: 4496621 - DNA, 23 bp, Homo sapiens
caggctcactgccaggccagcct

SEQ ID NO: 4496622 - DNA, 15 bp, Homo sapiens
caggctcagagggtg

SEQ ID NO: 4496623 - DNA, 15 bp, Homo sapiens
caggctctcctggct

SEQ ID NO: 4496624 - DNA, 14 bp, Homo sapiens
caggctctgtgctg

SEQ ID NO: 4496625 - DNA, 21 bp, Homo sapiens
caggctctgtgctgaccctcc

SEQ ID NO: 4496626 - DNA, 23 bp, Homo sapiens
caggctctgtgctgaccctcctg

SEQ ID NO: 4496627 - DNA, 23 bp, Homo sapiens
caggctgagaactcgttcacctc

SEQ ID NO: 4496628 - DNA, 17 bp, Homo sapiens
caggctgagagccggcc

SEQ ID NO: 4496629 - DNA, 18 bp, Homo sapiens
caggctgcagtggctccc

SEQ ID NO: 4496630 - DNA, 22 bp, Homo sapiens
caggctgccaaggccagagtgg

SEQ ID NO: 4496631 - DNA, 12 bp, Homo sapiens
caggctgccagt

SEQ ID NO: 4496632 - DNA, 14 bp, Homo sapiens
caggctgccagtgc

SEQ ID NO: 4496633 - DNA, 16 bp, Homo sapiens
caggctgccagtgcct

SEQ ID NO: 4496634 - DNA, 19 bp, Homo sapiens
caggctgccagtgcctggg

SEQ ID NO: 4496635 - DNA, 21 bp, Homo sapiens
caggctgctggcgcctctgca

SEQ ID NO: 4496636 - DNA, 22 bp, Homo sapiens
caggctgcttcaatcccagcct

SEQ ID NO: 4496637 - DNA, 12 bp, Homo sapiens
caggctgcttgg

SEQ ID NO: 4496638 - DNA, 19 bp, Homo sapiens
caggctggaagatagctgt

SEQ ID NO: 4496639 - DNA, 19 bp, Homo sapiens
caggctggactgcagtggc

SEQ ID NO: 4496640 - DNA, 15 bp, Homo sapiens
caggctggagacccc

SEQ ID NO: 4496641 - DNA, 14 bp, Homo sapiens
caggctggccagtg

SEQ ID NO: 4496642 - DNA, 22 bp, Homo sapiens
caggctgggccatgtccaaaga

SEQ ID NO: 4496643 - DNA, 21 bp, Homo sapiens
caggctggtttgcaagaatga

SEQ ID NO: 4496644 - DNA, 12 bp, Homo sapiens
caggctgttctc

SEQ ID NO: 4496645 - DNA, 13 bp, Homo sapiens
caggctgttctca

SEQ ID NO: 4496646 - DNA, 13 bp, Homo sapiens
caggctgtttcag

SEQ ID NO: 4496647 - DNA, 14 bp, Homo sapiens
caggctttatgtac

SEQ ID NO: 4496648 - DNA, 16 bp, Homo sapiens
cagggaaacagcctct

SEQ ID NO: 4496649 - DNA, 17 bp, Homo sapiens
cagggaaacagcctctc

SEQ ID NO: 4496650 - DNA, 18 bp, Homo sapiens
cagggaacattggagctg

SEQ ID NO: 4496651 - DNA, 19 bp, Homo sapiens
cagggaacattggagctga

SEQ ID NO: 4496652 - DNA, 19 bp, Homo sapiens
cagggaagctcacacatcc

SEQ ID NO: 4496653 - DNA, 18 bp, Homo sapiens
cagggaaggtggccacag

SEQ ID NO: 4496654 - DNA, 16 bp, Homo sapiens
cagaggggacgctgag

SEQ ID NO: 4496655 - DNA, 19 bp, Homo sapiens
cagaggggacgctgaggaa

SEQ ID NO: 4496656 - DNA, 20 bp, Homo sapiens
cagaggggacgctgaggaag

SEQ ID NO: 4496657 - DNA, 13 bp, Homo sapiens
cagaggggccagc

SEQ ID NO: 4496658 - DNA, 19 bp, Homo sapiens
cagagggtgtggctttcca

SEQ ID NO: 4496659 - DNA, 22 bp, Homo sapiens
cagaggtaactatcaatattta

SEQ ID NO: 4496660 - DNA, 18 bp, Homo sapiens
cagaggtccaggtcccag

SEQ ID NO: 4496661 - DNA, 20 bp, Homo sapiens
cagaggtccaggtcccagcc

SEQ ID NO: 4496662 - DNA, 17 bp, Homo sapiens
cagaggtgctaaattgt

SEQ ID NO: 4496663 - DNA, 20 bp, Homo sapiens
cagaggtgggatcctccctc

SEQ ID NO: 4496664 - DNA, 21 bp, Homo sapiens
cagagtcaccttttctgtggc

SEQ ID NO: 4496665 - DNA, 18 bp, Homo sapiens
cagagtcagaggagaaga

SEQ ID NO: 4496666 - DNA, 18 bp, Homo sapiens
cagagtccctgcctggac

SEQ ID NO: 4496667 - DNA, 21 bp, Homo sapiens
cagacttccaaatcctggaag

SEQ ID NO: 4496668 - DNA, 23 bp, Homo sapiens
cagacttccaaatcctggaagga

SEQ ID NO: 4496669 - DNA, 22 bp, Homo sapiens
cagacttcccacggctcctcga

SEQ ID NO: 4496670 - DNA, 14 bp, Homo sapiens
cagacttctggcct

SEQ ID NO: 4496671 - DNA, 20 bp, Homo sapiens
cagacttgccaggctccctt

SEQ ID NO: 4496672 - DNA, 23 bp, Homo sapiens
cagactttctttttctacatgtg

SEQ ID NO: 4496673 - DNA, 21 bp, Homo sapiens
cagactttgtgttcatttcat

SEQ ID NO: 4496674 - DNA, 20 bp, Homo sapiens
cagagaaaaatgctccccac

SEQ ID NO: 4496675 - DNA, 20 bp, Homo sapiens
cagagaaatctaagctgtgt

SEQ ID NO: 4496676 - DNA, 20 bp, Homo sapiens
cactgcagtcacctcttcta

SEQ ID NO: 4496677 - DNA, 18 bp, Homo sapiens
cacttctgggcttcatct

SEQ ID NO: 4496678 - DNA, 23 bp, Homo sapiens
cacctgctcccagtcctgcctga

SEQ ID NO: 4496679 - DNA, 18 bp, Homo sapiens
cacctggaaactgctcag

SEQ ID NO: 4496680 - DNA, 19 bp, Homo sapiens
cacctggaaactgctcaga

SEQ ID NO: 4496681 - DNA, 18 bp, Homo sapiens
cacctggactgaccctgc

SEQ ID NO: 4496682 - DNA, 23 bp, Homo sapiens
cacctggactgagccaaggaggc

SEQ ID NO: 4496683 - DNA, 22 bp, Homo sapiens
cacctggcatggtgcagggaga

SEQ ID NO: 4496684 - DNA, 22 bp, Homo sapiens
cacctggccccatgtctctcag

SEQ ID NO: 4496685 - DNA, 23 bp, Homo sapiens
cacctggctctgtggcgagccat

SEQ ID NO: 4496686 - DNA, 19 bp, Homo sapiens
cacctggctgaggttcctc

SEQ ID NO: 4496687 - DNA, 16 bp, Homo sapiens
caccccgacttttgtt

SEQ ID NO: 4496688 - DNA, 14 bp, Homo sapiens
caccccgccttggc

SEQ ID NO: 4496689 - DNA, 15 bp, Homo sapiens
caccccgggctctct

SEQ ID NO: 4496690 - DNA, 16 bp, Homo sapiens
cacccctccggccccg

SEQ ID NO: 4496691 - DNA, 18 bp, Homo sapiens
cacccctcgccacctttc

SEQ ID NO: 4496692 - DNA, 21 bp, Homo sapiens
cacccctctgcccctgcagct

SEQ ID NO: 4496693 - DNA, 22 bp, Homo sapiens
cacccctgagttgggcagccag

SEQ ID NO: 4496694 - DNA, 13 bp, Homo sapiens
cacccctgccccc

SEQ ID NO: 4496695 - DNA, 14 bp, Homo sapiens
cacccctgccccca

SEQ ID NO: 4496696 - DNA, 12 bp, Homo sapiens
cacccctgcctc

SEQ ID NO: 4496697 - DNA, 14 bp, Homo sapiens
cacccctgcctcca

SEQ ID NO: 4496698 - DNA, 20 bp, Homo sapiens
cacccctgcctccaccctct

SEQ ID NO: 4496699 - DNA, 13 bp, Homo sapiens
caccccttcctgt

SEQ ID NO: 4496700 - DNA, 23 bp, Homo sapiens
caccccttcctgtctcactcttc

SEQ ID NO: 4496701 - DNA, 20 bp, Homo sapiens
cacagcctcccctgccaggg

SEQ ID NO: 4496702 - DNA, 15 bp, Homo sapiens
cacagcctcctctgt

SEQ ID NO: 4496703 - DNA, 15 bp, Homo sapiens
cacagcctgtccctg

SEQ ID NO: 4496704 - DNA, 16 bp, Homo sapiens
cacagcgtccctggcg

SEQ ID NO: 4496705 - DNA, 18 bp, Homo sapiens
cacagcgtccctggcgca

SEQ ID NO: 4496706 - DNA, 22 bp, Homo sapiens
cacagcgtccctggcgcaggtg

SEQ ID NO: 4496707 - DNA, 14 bp, Homo sapiens
cacagctcccaccc

SEQ ID NO: 4496708 - DNA, 16 bp, Homo sapiens
cacagctgagcactta

SEQ ID NO: 4496709 - DNA, 15 bp, Homo sapiens
cacagctgctggaga

SEQ ID NO: 4496710 - DNA, 16 bp, Homo sapiens
cacagctgctggagaa

SEQ ID NO: 4496711 - DNA, 18 bp, Homo sapiens
cacagctgctgttctcag

SEQ ID NO: 4496712 - DNA, 24 bp, Homo sapiens
cacagctgctgttctcaggacagc

SEQ ID NO: 4496713 - DNA, 16 bp, Homo sapiens
cacagctggcctggtt

SEQ ID NO: 4496714 - DNA, 13 bp, Homo sapiens
cacagctggggcc

SEQ ID NO: 4496715 - DNA, 16 bp, Homo sapiens
cacagctggggccggt

SEQ ID NO: 4496716 - DNA, 16 bp, Homo sapiens
cacagcttagatttca

SEQ ID NO: 4496717 - DNA, 16 bp, Homo sapiens
cacaggaaaagaattt

SEQ ID NO: 4496718 - DNA, 15 bp, Homo sapiens
cacaggacatttctc

SEQ ID NO: 4496719 - DNA, 16 bp, Homo sapiens
cacaggagtgtcctct

SEQ ID NO: 4496720 - DNA, 20 bp, Homo sapiens
cacaggagtgtcctcttccc

SEQ ID NO: 4496721 - DNA, 20 bp, Homo sapiens
cacaggcagggcctggctcc

SEQ ID NO: 4496722 - DNA, 13 bp, Homo sapiens
caataacaagcat

SEQ ID NO: 4496723 - DNA, 18 bp, Homo sapiens
caataacaagcatgcata

SEQ ID NO: 4496724 - DNA, 22 bp, Homo sapiens
caataacactgtattttaatgt

SEQ ID NO: 4496725 - DNA, 12 bp, Homo sapiens
caataactctgg

SEQ ID NO: 4496726 - DNA, 16 bp, Homo sapiens
caataactgaaaatga

SEQ ID NO: 4496727 - DNA, 13 bp, Homo sapiens
caataacttttat

SEQ ID NO: 4496728 - DNA, 14 bp, Homo sapiens
caataagaaaatgt

SEQ ID NO: 4496729 - DNA, 13 bp, Homo sapiens
caataatatattt

SEQ ID NO: 4496730 - DNA, 16 bp, Homo sapiens
caataatatattttct

SEQ ID NO: 4496731 - DNA, 20 bp, Homo sapiens
caataatatattttctgttt

SEQ ID NO: 4496732 - DNA, 18 bp, Homo sapiens
caataatgatcaaagttt

SEQ ID NO: 4496733 - DNA, 19 bp, Homo sapiens
caataatgatcaaagtttt

SEQ ID NO: 4496734 - DNA, 23 bp, Homo sapiens
caataatgcagtatggtacattt

SEQ ID NO: 4496735 - DNA, 22 bp, Homo sapiens
caatacaaattgaggacttaat

SEQ ID NO: 4496736 - DNA, 15 bp, Homo sapiens
caatacaatgtacaa

SEQ ID NO: 4496737 - DNA, 18 bp, Homo sapiens
caatacaatgtacaatta

SEQ ID NO: 4496738 - DNA, 17 bp, Homo sapiens
caatacactagttgttt

SEQ ID NO: 4496739 - DNA, 16 bp, Homo sapiens
caatacattaaaataa

SEQ ID NO: 4496740 - DNA, 23 bp, Homo sapiens
caatagatttaggagcagaaatg

SEQ ID NO: 4496741 - DNA, 23 bp, Homo sapiens
caatagcactttcattgccagtg

SEQ ID NO: 4496742 - DNA, 14 bp, Homo sapiens
caatagcagttata

SEQ ID NO: 4496743 - DNA, 16 bp, Homo sapiens
caatagcagttataac

SEQ ID NO: 4496744 - DNA, 20 bp, Homo sapiens
caatagcagttataacagat

SEQ ID NO: 4496745 - DNA, 23 bp, Homo sapiens
caatagccgatatcagaatttgt

SEQ ID NO: 4496746 - DNA, 15 bp, Homo sapiens
caataggcaaattaa

SEQ ID NO: 4496747 - DNA, 19 bp, Homo sapiens
caatagtattaactattag

SEQ ID NO: 4496748 - DNA, 15 bp, Homo sapiens
caatagtatttctcc

SEQ ID NO: 4496749 - DNA, 18 bp, Homo sapiens
caatagtggcataccaaa

SEQ ID NO: 4496750 - DNA, 15 bp, Homo sapiens
caatagttgaattag

SEQ ID NO: 4496751 - DNA, 16 bp, Homo sapiens
caatagttttttactt

SEQ ID NO: 4496752 - DNA, 13 bp, Homo sapiens
caatataagaagc

SEQ ID NO: 4496753 - DNA, 20 bp, Homo sapiens
caatatatagctggcaagaa

SEQ ID NO: 4496754 - DNA, 22 bp, Homo sapiens
caatatatagtgggtacatcaa

SEQ ID NO: 4496755 - DNA, 22 bp, Homo sapiens
caacggggggctcctgcccagg

SEQ ID NO: 4496756 - DNA, 15 bp, Homo sapiens
caacgtagcctgggc

SEQ ID NO: 4496757 - DNA, 19 bp, Homo sapiens
caacgtcccctccgccgtg

SEQ ID NO: 4496758 - DNA, 17 bp, Homo sapiens
caacgtggcttaattgt

SEQ ID NO: 4496759 - DNA, 15 bp, Homo sapiens
caactaacaatgcct

SEQ ID NO: 4496760 - DNA, 17 bp, Homo sapiens
caactaacaatgccttg

SEQ ID NO: 4496761 - DNA, 16 bp, Homo sapiens
caactacaacttctcc

SEQ ID NO: 4496762 - DNA, 15 bp, Homo sapiens
caactacagtctaaa

SEQ ID NO: 4496763 - DNA, 15 bp, Homo sapiens
caactacctgagcta

SEQ ID NO: 4496764 - DNA, 20 bp, Homo sapiens
caactactcagctctcctgc

SEQ ID NO: 4496765 - DNA, 13 bp, Homo sapiens
caactattcttca

SEQ ID NO: 4496766 - DNA, 23 bp, Homo sapiens
caactcagagaaaaatgctcccc

SEQ ID NO: 4496767 - DNA, 12 bp, Homo sapiens
caactcattcca

SEQ ID NO: 4496768 - DNA, 14 bp, Homo sapiens
caactcattccaga

SEQ ID NO: 4496769 - DNA, 16 bp, Homo sapiens
caactcattccagatc

SEQ ID NO: 4496770 - DNA, 13 bp, Homo sapiens
caactcccacgac

SEQ ID NO: 4496771 - DNA, 17 bp, Homo sapiens
caactccgcccagcctc

SEQ ID NO: 4496772 - DNA, 14 bp, Homo sapiens
caactcctggaagc

SEQ ID NO: 4496773 - DNA, 17 bp, Homo sapiens
caactcctggaagctgt

SEQ ID NO: 4496774 - DNA, 19 bp, Homo sapiens
caactcctttcagccacat

SEQ ID NO: 4496775 - DNA, 16 bp, Homo sapiens
caactctacccctgct

SEQ ID NO: 4496776 - DNA, 14 bp, Homo sapiens
caactctcccaaag

SEQ ID NO: 4496777 - DNA, 15 bp, Homo sapiens
caactctccccagtg

SEQ ID NO: 4496778 - DNA, 21 bp, Homo sapiens
caactctccccagtgcctgcc

SEQ ID NO: 4496779 - DNA, 22 bp, Homo sapiens
caactctccccagtgcctgcca

SEQ ID NO: 4496780 - DNA, 17 bp, Homo sapiens
caactcttatttctttc

SEQ ID NO: 4496781 - DNA, 22 bp, Homo sapiens
caactcttatttctttccttta

SEQ ID NO: 4496782 - DNA, 13 bp, Homo sapiens
caactctttgtta

SEQ ID NO: 4496783 - DNA, 15 bp, Homo sapiens
caactgaaaatgaat

SEQ ID NO: 4496784 - DNA, 18 bp, Homo sapiens
caactgaatgaggtcagc

SEQ ID NO: 4496785 - DNA, 15 bp, Homo sapiens
caactgcataacctt

SEQ ID NO: 4496786 - DNA, 14 bp, Homo sapiens
caactgccccaggg

SEQ ID NO: 4496787 - DNA, 15 bp, Homo sapiens
caactgcctactcca

SEQ ID NO: 4496788 - DNA, 23 bp, Homo sapiens
caactgcctcgaaacacagaaac

SEQ ID NO: 4496789 - DNA, 13 bp, Homo sapiens
caactgctccagc

SEQ ID NO: 4496790 - DNA, 18 bp, Homo sapiens
caactgctccagcctctg

SEQ ID NO: 4496791 - DNA, 23 bp, Homo sapiens
caactgctccagcctctgccgct

SEQ ID NO: 4496792 - DNA, 16 bp, Homo sapiens
caactggagttcctta

SEQ ID NO: 4496793 - DNA, 23 bp, Homo sapiens
caactggagttccttatccctct

SEQ ID NO: 4496794 - DNA, 18 bp, Homo sapiens
caactggccctatttaga

SEQ ID NO: 4496795 - DNA, 23 bp, Homo sapiens
caactggccctatttagatgata

SEQ ID NO: 4496796 - DNA, 22 bp, Homo sapiens
caactgtggtagctccagcgat

SEQ ID NO: 4496797 - DNA, 22 bp, Homo sapiens
caactgtgtgattaaaaggtat

SEQ ID NO: 4496798 - DNA, 21 bp, Homo sapiens
caactgtttcagaaaacataa

SEQ ID NO: 4496799 - DNA, 18 bp, Homo sapiens
caacttacaaaaacactt

SEQ ID NO: 4496800 - DNA, 19 bp, Homo sapiens
caacttagatctctcctgc

SEQ ID NO: 4496801 - DNA, 14 bp, Homo sapiens
caagcctgcctccc

SEQ ID NO: 4496802 - DNA, 16 bp, Homo sapiens
caagcctgtgcaaaaa

SEQ ID NO: 4496803 - DNA, 12 bp, Homo sapiens
caagcctgtggg

SEQ ID NO: 4496804 - DNA, 14 bp, Homo sapiens
caagcctgtgggag

SEQ ID NO: 4496805 - DNA, 14 bp, Homo sapiens
caagccttactcac

SEQ ID NO: 4496806 - DNA, 20 bp, Homo sapiens
caagccttactcacctctct

SEQ ID NO: 4496807 - DNA, 23 bp, Homo sapiens
caagccttactcacctctctcta

SEQ ID NO: 4496808 - DNA, 20 bp, Homo sapiens
caagcgaggtcaacagagaa

SEQ ID NO: 4496809 - DNA, 16 bp, Homo sapiens
caagcgtgttctcagc

SEQ ID NO: 4496810 - DNA, 22 bp, Homo sapiens
caagctaaccttatcctgcatt

SEQ ID NO: 4496811 - DNA, 16 bp, Homo sapiens
caagctagaacctgga

SEQ ID NO: 4496812 - DNA, 15 bp, Homo sapiens
caagctagccagagg

SEQ ID NO: 4496813 - DNA, 21 bp, Homo sapiens
caagctcacagttcctcgccc

SEQ ID NO: 4496814 - DNA, 22 bp, Homo sapiens
caagctcacagttcctcgccct

SEQ ID NO: 4496815 - DNA, 19 bp, Homo sapiens
caagctcaggtcctgctgc

SEQ ID NO: 4496816 - DNA, 17 bp, Homo sapiens
caagctcatccctggac

SEQ ID NO: 4496817 - DNA, 17 bp, Homo sapiens
caagctccgcctcccgg

SEQ ID NO: 4496818 - DNA, 13 bp, Homo sapiens
caagctgaaattt

SEQ ID NO: 4496819 - DNA, 14 bp, Homo sapiens
caagctgaaatttt

SEQ ID NO: 4496820 - DNA, 17 bp, Homo sapiens
caagctgcactgtgaac

SEQ ID NO: 4496821 - DNA, 12 bp, Homo sapiens
caagctgcccag

SEQ ID NO: 4496822 - DNA, 17 bp, Homo sapiens
caagctgcccagccctg

SEQ ID NO: 4496823 - DNA, 19 bp, Homo sapiens
caagctgcccagccctggc

SEQ ID NO: 4496824 - DNA, 21 bp, Homo sapiens
caagctgcccagccctggccc

SEQ ID NO: 4496825 - DNA, 15 bp, Homo sapiens
caagctgggccccag

SEQ ID NO: 4496826 - DNA, 19 bp, Homo sapiens
caagctgggccccagccca

SEQ ID NO: 4496827 - DNA, 18 bp, Homo sapiens
caagctgtataaacagaa

SEQ ID NO: 4496828 - DNA, 20 bp, Homo sapiens
caagctgttatttcttccct

SEQ ID NO: 4496829 - DNA, 13 bp, Homo sapiens
caagctttaaatt

SEQ ID NO: 4496830 - DNA, 13 bp, Homo sapiens
caaggaaaaagaa

SEQ ID NO: 4496831 - DNA, 18 bp, Homo sapiens
caaggaaaggctcattta

SEQ ID NO: 4496832 - DNA, 23 bp, Homo sapiens
caaggaaaggctcatttaaaaca

SEQ ID NO: 4496833 - DNA, 19 bp, Homo sapiens
caaggaagtagaaacaaaa

SEQ ID NO: 4496834 - DNA, 15 bp, Homo sapiens
caaggaatttcttaa

SEQ ID NO: 4496835 - DNA, 18 bp, Homo sapiens
caaggaatttcttaactt

SEQ ID NO: 4496836 - DNA, 12 bp, Homo sapiens
caaggacaggag

SEQ ID NO: 4496837 - DNA, 17 bp, Homo sapiens
caaggacaggagcctgg

SEQ ID NO: 4496838 - DNA, 22 bp, Homo sapiens
caaggacatggtgagtctattt

SEQ ID NO: 4496839 - DNA, 14 bp, Homo sapiens
caaggaccaggact

SEQ ID NO: 4496840 - DNA, 16 bp, Homo sapiens
caaggaccaggactcc

SEQ ID NO: 4496841 - DNA, 21 bp, Homo sapiens
caaggaccaggactccctcct

SEQ ID NO: 4496842 - DNA, 12 bp, Homo sapiens
caaggacccagg

SEQ ID NO: 4496843 - DNA, 13 bp, Homo sapiens
caaggacccaggc

SEQ ID NO: 4496844 - DNA, 15 bp, Homo sapiens
caaggactttgtaca

SEQ ID NO: 4496845 - DNA, 16 bp, Homo sapiens
caaggactttgtacat

SEQ ID NO: 4496846 - DNA, 14 bp, Homo sapiens
caaggagaacaaat

SEQ ID NO: 4496847 - DNA, 12 bp, Homo sapiens
caaggaggaaaa

SEQ ID NO: 4496848 - DNA, 13 bp, Homo sapiens
caaggaggaaaaa

SEQ ID NO: 4496849 - DNA, 14 bp, Homo sapiens
caaggaggaaaaac

SEQ ID NO: 4496850 - DNA, 20 bp, Homo sapiens
caaggaggaaaaacagacaa

SEQ ID NO: 4496851 - DNA, 15 bp, Homo sapiens
caaggagtttattac

SEQ ID NO: 4496852 - DNA, 16 bp, Homo sapiens
caaggagtttattaca

SEQ ID NO: 4496853 - DNA, 22 bp, Homo sapiens
caaggagtttattacaatgtat

SEQ ID NO: 4496854 - DNA, 24 bp, Homo sapiens
caaggagtttgagaccagcttagc

SEQ ID NO: 4496855 - DNA, 18 bp, Homo sapiens
caaggataccttcttatt

SEQ ID NO: 4496856 - DNA, 12 bp, Homo sapiens
caaggatgctca

SEQ ID NO: 4496857 - DNA, 14 bp, Homo sapiens
caaggattgaaaat

SEQ ID NO: 4496858 - DNA, 15 bp, Homo sapiens
caaggattgaaaatt

SEQ ID NO: 4496859 - DNA, 13 bp, Homo sapiens
caaggcagggacc

SEQ ID NO: 4496860 - DNA, 18 bp, Homo sapiens
caaggcataatgtaattt

SEQ ID NO: 4496861 - DNA, 20 bp, Homo sapiens
caaggcattcagcagtttct

SEQ ID NO: 4496862 - DNA, 17 bp, Homo sapiens
caaggcatttgtctttg

SEQ ID NO: 4496863 - DNA, 19 bp, Homo sapiens
caaggccagagtggcctgg

SEQ ID NO: 4496864 - DNA, 22 bp, Homo sapiens
caaggccagagtggcctggcca

SEQ ID NO: 4496865 - DNA, 17 bp, Homo sapiens
caaggccagtccccatt

SEQ ID NO: 4496866 - DNA, 22 bp, Homo sapiens
caaggcctaccccagttcctag

SEQ ID NO: 4496867 - DNA, 14 bp, Homo sapiens
caaggcggtacact

SEQ ID NO: 4496868 - DNA, 17 bp, Homo sapiens
caaggctcatctttctg

SEQ ID NO: 4496869 - DNA, 13 bp, Homo sapiens
caaggctctctct

SEQ ID NO: 4496870 - DNA, 22 bp, Homo sapiens
caaggctgagacagtgaatttg

SEQ ID NO: 4496871 - DNA, 17 bp, Homo sapiens
caaggctgattaaacca

SEQ ID NO: 4496872 - DNA, 16 bp, Homo sapiens
caagggaaaagtctct

SEQ ID NO: 4496873 - DNA, 16 bp, Homo sapiens
caagggaaaggggtgc

SEQ ID NO: 4496874 - DNA, 21 bp, Homo sapiens
caagggaaaggggtgctttta

SEQ ID NO: 4496875 - DNA, 22 bp, Homo sapiens
caagggaccaggtttgcaggag

SEQ ID NO: 4496876 - DNA, 13 bp, Homo sapiens
caagggaccttca

SEQ ID NO: 4496877 - DNA, 15 bp, Homo sapiens
caagggaccttcatg

SEQ ID NO: 4496878 - DNA, 20 bp, Homo sapiens
caagggcactgtgatacagt

SEQ ID NO: 4496879 - DNA, 21 bp, Homo sapiens
caagggcactgtgatacagtt

SEQ ID NO: 4496880 - DNA, 21 bp, Homo sapiens
caaattgtgcttctccccaga

SEQ ID NO: 4496881 - DNA, 12 bp, Homo sapiens
caaattgtttac

SEQ ID NO: 4496882 - DNA, 19 bp, Homo sapiens
caaatttaaaactgttgga

SEQ ID NO: 4496883 - DNA, 21 bp, Homo sapiens
caaatttagaaactaattgac

SEQ ID NO: 4496884 - DNA, 22 bp, Homo sapiens
caaatttagaaactaattgact

SEQ ID NO: 4496885 - DNA, 14 bp, Homo sapiens
caaatttcatttca

SEQ ID NO: 4496886 - DNA, 16 bp, Homo sapiens
caaatttcatttcaca

SEQ ID NO: 4496887 - DNA, 20 bp, Homo sapiens
caaatttcatttcacatttt

SEQ ID NO: 4496888 - DNA, 19 bp, Homo sapiens
caaatttctataaatttaa

SEQ ID NO: 4496889 - DNA, 21 bp, Homo sapiens
caaatttctataaatttaaga

SEQ ID NO: 4496890 - DNA, 11 bp, Homo sapiens
caaatttgatg

SEQ ID NO: 4496891 - DNA, 22 bp, Homo sapiens
caaatttggccttaagaactgt

SEQ ID NO: 4496892 - DNA, 24 bp, Homo sapiens
caaatttggccttaagaactgtgt

SEQ ID NO: 4496893 - DNA, 16 bp, Homo sapiens
caaattttcagaaggt

SEQ ID NO: 4496894 - DNA, 14 bp, Homo sapiens
caaattttctggtg

SEQ ID NO: 4496895 - DNA, 19 bp, Homo sapiens
caaattttgcacttttttg

SEQ ID NO: 4496896 - DNA, 17 bp, Homo sapiens
caaattttttaaaagag

SEQ ID NO: 4496897 - DNA, 13 bp, Homo sapiens
caaattttttaat

SEQ ID NO: 4496898 - DNA, 15 bp, Homo sapiens
caaattttttgactt

SEQ ID NO: 4496899 - DNA, 13 bp, Homo sapiens
caacaaaaaatac

SEQ ID NO: 4496900 - DNA, 17 bp, Homo sapiens
caacaaaaaatacatta

SEQ ID NO: 4496901 - DNA, 20 bp, Homo sapiens
caacaaagaaacaaagatgt

SEQ ID NO: 4496902 - DNA, 21 bp, Homo sapiens
caacaaagacatgctttccat

SEQ ID NO: 4496903 - DNA, 23 bp, Homo sapiens
caacaaagacatgctttccattt

SEQ ID NO: 4496904 - DNA, 22 bp, Homo sapiens
caacaacaaaaaatacattata

SEQ ID NO: 4496905 - DNA, 15 bp, Homo sapiens
caacaacaattggta

SEQ ID NO: 4496906 - DNA, 18 bp, Homo sapiens
caacaacctcaactgcct

SEQ ID NO: 4496907 - DNA, 16 bp, Homo sapiens
caacaagaaggtttct

SEQ ID NO: 4496908 - DNA, 14 bp, Homo sapiens
caacaagttgcctc

SEQ ID NO: 4496909 - DNA, 19 bp, Homo sapiens
caacaatagtgacaccagt

SEQ ID NO: 4496910 - DNA, 16 bp, Homo sapiens
caacaatttatgaatt

SEQ ID NO: 4496911 - DNA, 14 bp, Homo sapiens
caacacagaggcag

SEQ ID NO: 4496912 - DNA, 20 bp, Homo sapiens
caacacatcaggaaagagag

SEQ ID NO: 4496913 - DNA, 16 bp, Homo sapiens
caacaccttcctcctg

SEQ ID NO: 4496914 - DNA, 23 bp, Homo sapiens
caacactggtgtgacctgagggc

SEQ ID NO: 4496915 - DNA, 17 bp, Homo sapiens
caacagaaagagggaca

SEQ ID NO: 4496916 - DNA, 16 bp, Homo sapiens
caacagcaaaggaact

SEQ ID NO: 4496917 - DNA, 18 bp, Homo sapiens
caacagcacacaggcagc

SEQ ID NO: 4496918 - DNA, 23 bp, Homo sapiens
caacagcacacaggcagccagcc

SEQ ID NO: 4496919 - DNA, 23 bp, Homo sapiens
caacagcgttcctagagaagaca

SEQ ID NO: 4496920 - DNA, 21 bp, Homo sapiens
caacaggaatcaagagctgcc

SEQ ID NO: 4496921 - DNA, 21 bp, Homo sapiens
caacagggccatgtgctgccc

SEQ ID NO: 4496922 - DNA, 22 bp, Homo sapiens
caacagggccatgtgctgccct

SEQ ID NO: 4496923 - DNA, 18 bp, Homo sapiens
caacaggggcacaagccc

SEQ ID NO: 4496924 - DNA, 15 bp, Homo sapiens
caacagtaaaccact

SEQ ID NO: 4496925 - DNA, 22 bp, Homo sapiens
caacagttctgagctgtaattt

SEQ ID NO: 4496926 - DNA, 11 bp, Homo sapiens
caacagttgta

SEQ ID NO: 4496927 - DNA, 20 bp, Homo sapiens
caacatacgggaagtttatt

SEQ ID NO: 4496928 - DNA, 17 bp, Homo sapiens
caacatcccattgccct

SEQ ID NO: 4496929 - DNA, 23 bp, Homo sapiens
caaagctgctaaatctcctattt

SEQ ID NO: 4496930 - DNA, 22 bp, Homo sapiens
caaaggaaaatagtaatgtttt

SEQ ID NO: 4496931 - DNA, 16 bp, Homo sapiens
caaaggaagtctagga

SEQ ID NO: 4496932 - DNA, 14 bp, Homo sapiens
caaaggaagtttta

SEQ ID NO: 4496933 - DNA, 22 bp, Homo sapiens
caaaggaatataagaaaagtaa

SEQ ID NO: 4496934 - DNA, 19 bp, Homo sapiens
caaaggaccgttttgtatt

SEQ ID NO: 4496935 - DNA, 14 bp, Homo sapiens
caaaggagacatat

SEQ ID NO: 4496936 - DNA, 15 bp, Homo sapiens
caaaggagacatatc

SEQ ID NO: 4496937 - DNA, 15 bp, Homo sapiens
caaaggcaagcactt

SEQ ID NO: 4496938 - DNA, 13 bp, Homo sapiens
caaaggcccccta

SEQ ID NO: 4496939 - DNA, 13 bp, Homo sapiens
caaaggccctggg

SEQ ID NO: 4496940 - DNA, 20 bp, Homo sapiens
caaagggccatcgttcatcc

SEQ ID NO: 4496941 - DNA, 13 bp, Homo sapiens
caaagggtgctag

SEQ ID NO: 4496942 - DNA, 23 bp, Homo sapiens
caaaggtccgcaccctgtcctgc

SEQ ID NO: 4496943 - DNA, 18 bp, Homo sapiens
caaaggttcagaaaatta

SEQ ID NO: 4496944 - DNA, 11 bp, Homo sapiens
caaagtactgt

SEQ ID NO: 4496945 - DNA, 14 bp, Homo sapiens
caaagtactgtaag

SEQ ID NO: 4496946 - DNA, 17 bp, Homo sapiens
caaagtactgtaagaat

SEQ ID NO: 4496947 - DNA, 16 bp, Homo sapiens
caaagtattgtaaatt

SEQ ID NO: 4496948 - DNA, 17 bp, Homo sapiens
caaagtattgtaaatta

SEQ ID NO: 4496949 - DNA, 22 bp, Homo sapiens
caaagtattgtaaattatattt

SEQ ID NO: 4496950 - DNA, 23 bp, Homo sapiens
caaagtccccctcctcagccagc

SEQ ID NO: 4496951 - DNA, 23 bp, Homo sapiens
caaagtcctttttttccatcttt

SEQ ID NO: 4496952 - DNA, 20 bp, Homo sapiens
caaagtctcatagctttgga

SEQ ID NO: 4496953 - DNA, 11 bp, Homo sapiens
caaagtgaact

SEQ ID NO: 4496954 - DNA, 18 bp, Homo sapiens
caaagtgcccatggtggc

SEQ ID NO: 4496955 - DNA, 20 bp, Homo sapiens
caaagtgctgggattaaggc

SEQ ID NO: 4496956 - DNA, 11 bp, Homo sapiens
caaagtggaac

SEQ ID NO: 4496957 - DNA, 15 bp, Homo sapiens
caaagtggaattaaa

SEQ ID NO: 4496958 - DNA, 17 bp, Homo sapiens
caaagtggtaaatactg

SEQ ID NO: 4496959 - DNA, 19 bp, Homo sapiens
caaagtggtaaatactgtg

SEQ ID NO: 4496960 - DNA, 20 bp, Homo sapiens
caaagtggtaaatactgtga

SEQ ID NO: 4496961 - DNA, 21 bp, Homo sapiens
caaagttccacttccaggtct

SEQ ID NO: 4496962 - DNA, 15 bp, Homo sapiens
caaagttctcagagc

SEQ ID NO: 4496963 - DNA, 20 bp, Homo sapiens
caaagttctcagagctctcg

SEQ ID NO: 4496964 - DNA, 13 bp, Homo sapiens
caaagtttaataa

SEQ ID NO: 4496965 - DNA, 23 bp, Homo sapiens
caaagtttacagatgtttttaat

SEQ ID NO: 4496966 - DNA, 17 bp, Homo sapiens
caaagtttcagagtata

SEQ ID NO: 4496967 - DNA, 18 bp, Homo sapiens
caaagtttcagagtatat

SEQ ID NO: 4496968 - DNA, 12 bp, Homo sapiens
caaagttttaca

SEQ ID NO: 4496969 - DNA, 21 bp, Homo sapiens
caaataaaacatggccagcaa

SEQ ID NO: 4496970 - DNA, 15 bp, Homo sapiens
caaataaaattattt

SEQ ID NO: 4496971 - DNA, 12 bp, Homo sapiens
caaataaacact

SEQ ID NO: 4496972 - DNA, 18 bp, Homo sapiens
caaataaatagttgctct

SEQ ID NO: 4496973 - DNA, 18 bp, Homo sapiens
caaataagggaataaaat

SEQ ID NO: 4496974 - DNA, 19 bp, Homo sapiens
caaataagtcatctgatga

SEQ ID NO: 4496975 - DNA, 23 bp, Homo sapiens
caaataatgatcgaaaaaataat

SEQ ID NO: 4496976 - DNA, 13 bp, Homo sapiens
caaataatgcttt

SEQ ID NO: 4496977 - DNA, 16 bp, Homo sapiens
caaataatgtctctgt

SEQ ID NO: 4496978 - DNA, 18 bp, Homo sapiens
caaatactgtatattcag

SEQ ID NO: 4496979 - DNA, 22 bp, Homo sapiens
caaatacttagcaaaaagtggg

SEQ ID NO: 4496980 - DNA, 13 bp, Homo sapiens
caaatagaaaaca

SEQ ID NO: 4496981 - DNA, 18 bp, Homo sapiens
caaatagccacaattata

SEQ ID NO: 4496982 - DNA, 23 bp, Homo sapiens
caaataggatgtactgttgaaaa

SEQ ID NO: 4496983 - DNA, 23 bp, Homo sapiens
caaaatctgtgacctgtcagaat

SEQ ID NO: 4496984 - DNA, 19 bp, Homo sapiens
caaaatgacatctttttaa

SEQ ID NO: 4496985 - DNA, 23 bp, Homo sapiens
caaaatgatagacatataccaaa

SEQ ID NO: 4496986 - DNA, 16 bp, Homo sapiens
caaaatggatacataa

SEQ ID NO: 4496987 - DNA, 19 bp, Homo sapiens
caaaatgtacttaaatgag

SEQ ID NO: 4496988 - DNA, 18 bp, Homo sapiens
caaaatgtagaatattca

SEQ ID NO: 4496989 - DNA, 16 bp, Homo sapiens
caaaatgtatgtctgg

SEQ ID NO: 4496990 - DNA, 14 bp, Homo sapiens
caaaatgtgtttca

SEQ ID NO: 4496991 - DNA, 19 bp, Homo sapiens
caaaatgtgtttcagccgt

SEQ ID NO: 4496992 - DNA, 17 bp, Homo sapiens
caaaatgttggtcattt

SEQ ID NO: 4496993 - DNA, 18 bp, Homo sapiens
caaaatgttggtcatttt

SEQ ID NO: 4496994 - DNA, 16 bp, Homo sapiens
caaaattaaatctaga

SEQ ID NO: 4496995 - DNA, 15 bp, Homo sapiens
caaaattcaaagcat

SEQ ID NO: 4496996 - DNA, 17 bp, Homo sapiens
caaaattcaaagcatgg

SEQ ID NO: 4496997 - DNA, 18 bp, Homo sapiens
caaaattcatttctaatt

SEQ ID NO: 4496998 - DNA, 19 bp, Homo sapiens
caaaattcatttctaatta

SEQ ID NO: 4496999 - DNA, 17 bp, Homo sapiens
caaaattgcaaatcttg

SEQ ID NO: 4497000 - DNA, 14 bp, Homo sapiens
caaaatttcacagt

SEQ ID NO: 4497001 - DNA, 23 bp, Homo sapiens
caaaatttgactaattttacatg

SEQ ID NO: 4497002 - DNA, 22 bp, Homo sapiens
caaaatttgctgccaaatgcgt

SEQ ID NO: 4497003 - DNA, 16 bp, Homo sapiens
caaaattttaaaaaag

SEQ ID NO: 4497004 - DNA, 14 bp, Homo sapiens
caaacaaaatttct

SEQ ID NO: 4497005 - DNA, 12 bp, Homo sapiens
caaacaataaag

SEQ ID NO: 4497006 - DNA, 14 bp, Homo sapiens
caaacacaattcta

SEQ ID NO: 4497007 - DNA, 16 bp, Homo sapiens
caaacacagccctgga

SEQ ID NO: 4497008 - DNA, 18 bp, Homo sapiens
caaacacataatttctgt

SEQ ID NO: 4497009 - DNA, 14 bp, Homo sapiens
caaacacattataa

SEQ ID NO: 4497010 - DNA, 13 bp, Homo sapiens
caaacacccagag

SEQ ID NO: 4497011 - DNA, 14 bp, Homo sapiens
caaacactgtgatt

SEQ ID NO: 4497012 - DNA, 12 bp, Homo sapiens
caaacagaaaaa

SEQ ID NO: 4497013 - DNA, 14 bp, Homo sapiens
caaacagagtatgt

SEQ ID NO: 4497014 - DNA, 13 bp, Homo sapiens
caaacagatgttt

SEQ ID NO: 4497015 - DNA, 13 bp, Homo sapiens
caaacaggacagc

SEQ ID NO: 4497016 - DNA, 19 bp, Homo sapiens
caaacagggcctctgcgga

SEQ ID NO: 4497017 - DNA, 12 bp, Homo sapiens
caaacagtattt

SEQ ID NO: 4497018 - DNA, 15 bp, Homo sapiens
caaacagtatttctg

SEQ ID NO: 4497019 - DNA, 21 bp, Homo sapiens
caaacatgaccctaaatcttg

SEQ ID NO: 4497020 - DNA, 17 bp, Homo sapiens
caaacatggagaaatct

SEQ ID NO: 4497021 - DNA, 14 bp, Homo sapiens
caaacatgtattta

SEQ ID NO: 4497022 - DNA, 20 bp, Homo sapiens
caaacatgttgtttgtttta

SEQ ID NO: 4497023 - DNA, 22 bp, Homo sapiens
caaacattcgtgagctggggac

SEQ ID NO: 4497024 - DNA, 18 bp, Homo sapiens
caaacattttctggccag

SEQ ID NO: 4497025 - DNA, 17 bp, Homo sapiens
caaaccaaattttaatt

SEQ ID NO: 4497026 - DNA, 22 bp, Homo sapiens
caaaccacgcctcttgaccagg

SEQ ID NO: 4497027 - DNA, 14 bp, Homo sapiens
caaaccagcttcat

SEQ ID NO: 4497028 - DNA, 23 bp, Homo sapiens
caaaccaggacactaccctgaga

SEQ ID NO: 4497029 - DNA, 14 bp, Homo sapiens
caaaccattgctct

SEQ ID NO: 4497030 - DNA, 16 bp, Homo sapiens
caaacccagtctcaga

SEQ ID NO: 4497031 - DNA, 17 bp, Homo sapiens
caaacccagtctcagac

SEQ ID NO: 4497032 - DNA, 18 bp, Homo sapiens
caaaccccacttcccctc

SEQ ID NO: 4497033 - DNA, 18 bp, Homo sapiens
caaaccccagccccaact

SEQ ID NO: 4497034 - DNA, 19 bp, Homo sapiens
caaaccctggtgctttcct

SEQ ID NO: 4497035 - DNA, 16 bp, Homo sapiens
caaacccttaactgac

SEQ ID NO: 4497036 - DNA, 15 bp, Homo sapiens
caaacctcctgtcag

SEQ ID NO: 4497037 - DNA, 15 bp, Homo sapiens
caaaccttcctggga

SEQ ID NO: 4497038 - DNA, 16 bp, Homo sapiens
caaacgacagaggagc

SEQ ID NO: 4497039 - DNA, 21 bp, Homo sapiens
caaacgctaaagagcccttgc

SEQ ID NO: 4497040 - DNA, 22 bp, Homo sapiens
caaacgctaaagagcccttgcc

SEQ ID NO: 4497041 - DNA, 14 bp, Homo sapiens
atgacagtaatatt

SEQ ID NO: 4497042 - DNA, 23 bp, Homo sapiens
atgacagtgggcagcacctttct

SEQ ID NO: 4497043 - DNA, 18 bp, Homo sapiens
atgacataacagtgcagg

SEQ ID NO: 4497044 - DNA, 13 bp, Homo sapiens
atgacatattttt

SEQ ID NO: 4497045 - DNA, 15 bp, Homo sapiens
atgacatctttttaa

SEQ ID NO: 4497046 - DNA, 19 bp, Homo sapiens
atgacatctttttaaagct

SEQ ID NO: 4497047 - DNA, 14 bp, Homo sapiens
atgaccagggatgc

SEQ ID NO: 4497048 - DNA, 22 bp, Homo sapiens
atgaccagggatgctgggctgg

SEQ ID NO: 4497049 - DNA, 19 bp, Homo sapiens
atgaccatgttatattgct

SEQ ID NO: 4497050 - DNA, 18 bp, Homo sapiens
atgacctagttttccatg

SEQ ID NO: 4497051 - DNA, 14 bp, Homo sapiens
atgacgggatgctc

SEQ ID NO: 4497052 - DNA, 19 bp, Homo sapiens
atgacgggttgtgagactt

SEQ ID NO: 4497053 - DNA, 15 bp, Homo sapiens
atgactatgtaaact

SEQ ID NO: 4497054 - DNA, 14 bp, Homo sapiens
atgactctttattg

SEQ ID NO: 4497055 - DNA, 18 bp, Homo sapiens
atgactctttattgtctg

SEQ ID NO: 4497056 - DNA, 20 bp, Homo sapiens
atgactctttctgaaggaag

SEQ ID NO: 4497057 - DNA, 13 bp, Homo sapiens
atgactggctcct

SEQ ID NO: 4497058 - DNA, 19 bp, Homo sapiens
atgactggtggtgagagac

SEQ ID NO: 4497059 - DNA, 22 bp, Homo sapiens
atgacttagcgtcaagacattt

SEQ ID NO: 4497060 - DNA, 20 bp, Homo sapiens
atgacttatttctgctctgg

SEQ ID NO: 4497061 - DNA, 20 bp, Homo sapiens
atgacttccttatttctgaa

SEQ ID NO: 4497062 - DNA, 18 bp, Homo sapiens
atgacttgggtttaacaa

SEQ ID NO: 4497063 - DNA, 18 bp, Homo sapiens
atgactttttataaaatg

SEQ ID NO: 4497064 - DNA, 11 bp, Homo sapiens
atgagaaactg

SEQ ID NO: 4497065 - DNA, 14 bp, Homo sapiens
atgagaaactgcat

SEQ ID NO: 4497066 - DNA, 23 bp, Homo sapiens
atgagaaagcatttcttttctct

SEQ ID NO: 4497067 - DNA, 11 bp, Homo sapiens
atgagaaagga

SEQ ID NO: 4497068 - DNA, 19 bp, Homo sapiens
atgagaaaggacagagcca

SEQ ID NO: 4497069 - DNA, 20 bp, Homo sapiens
atgagaaaggacagagccag

SEQ ID NO: 4497070 - DNA, 13 bp, Homo sapiens
atgagaagaatag

SEQ ID NO: 4497071 - DNA, 15 bp, Homo sapiens
atgagaaggcagcca

SEQ ID NO: 4497072 - DNA, 16 bp, Homo sapiens
atgagaatgacagcct

SEQ ID NO: 4497073 - DNA, 20 bp, Homo sapiens
atgagacagggtcttgctct

SEQ ID NO: 4497074 - DNA, 23 bp, Homo sapiens
atgagacagggtcttgctctgtc

SEQ ID NO: 4497075 - DNA, 15 bp, Homo sapiens
atgagactctagggt

SEQ ID NO: 4497076 - DNA, 13 bp, Homo sapiens
atgagattgaatt

SEQ ID NO: 4497077 - DNA, 17 bp, Homo sapiens
atgagcaaccacattta

SEQ ID NO: 4497078 - DNA, 22 bp, Homo sapiens
atgagcaaccacatttagaaat

SEQ ID NO: 4497079 - DNA, 17 bp, Homo sapiens
atgagcacatctctctg

SEQ ID NO: 4497080 - DNA, 19 bp, Homo sapiens
atgagcagagagcaaagga

SEQ ID NO: 4497081 - DNA, 14 bp, Homo sapiens
atgagcaggagctt

SEQ ID NO: 4497082 - DNA, 15 bp, Homo sapiens
atgagcaggagcttg

SEQ ID NO: 4497083 - DNA, 17 bp, Homo sapiens
atgagcaggagcttggg

SEQ ID NO: 4497084 - DNA, 22 bp, Homo sapiens
atgagccctggctcccacctgt

SEQ ID NO: 4497085 - DNA, 22 bp, Homo sapiens
atgagccgcccaaggccttccc

SEQ ID NO: 4497086 - DNA, 22 bp, Homo sapiens
atgagctattaaaactcagcct

SEQ ID NO: 4497087 - DNA, 22 bp, Homo sapiens
atgagcttcaatataagaagca

SEQ ID NO: 4497088 - DNA, 17 bp, Homo sapiens
atgaggagagaaaatat

SEQ ID NO: 4497089 - DNA, 12 bp, Homo sapiens
atgaggagggga

SEQ ID NO: 4497090 - DNA, 23 bp, Homo sapiens
atgaggaggggagcgtctgggaa

SEQ ID NO: 4497091 - DNA, 15 bp, Homo sapiens
atgaggaggggaggg

SEQ ID NO: 4497092 - DNA, 12 bp, Homo sapiens
atgaggagggtg

SEQ ID NO: 4497093 - DNA, 14 bp, Homo sapiens
atgaggagggtggg

SEQ ID NO: 4497094 - DNA, 22 bp, Homo sapiens
atgaggagggtgggggagggag

SEQ ID NO: 4497095 - DNA, 19 bp, Homo sapiens
atgaggagtaaaattcagt

SEQ ID NO: 4497096 - DNA, 16 bp, Homo sapiens
atgaggccatctcagg

SEQ ID NO: 4497097 - DNA, 16 bp, Homo sapiens
atgagggagatgccat

SEQ ID NO: 4497098 - DNA, 14 bp, Homo sapiens
atgaggggaagcca

SEQ ID NO: 4497099 - DNA, 16 bp, Homo sapiens
atgaggggaagccatt

SEQ ID NO: 4497100 - DNA, 23 bp, Homo sapiens
atgaggggaagccattttccagt

SEQ ID NO: 4497101 - DNA, 21 bp, Homo sapiens
atgaggggcttcctgggtcct

SEQ ID NO: 4497102 - DNA, 14 bp, Homo sapiens
atgagggtgtttcc

SEQ ID NO: 4497103 - DNA, 20 bp, Homo sapiens
atgagggtgtttcctctaaa

SEQ ID NO: 4497104 - DNA, 16 bp, Homo sapiens
atgaggtatcttcttt

SEQ ID NO: 4497105 - DNA, 22 bp, Homo sapiens
atgaggtgggaggtggaagaag

SEQ ID NO: 4497106 - DNA, 18 bp, Homo sapiens
atgagtaaactgaggccc

SEQ ID NO: 4497107 - DNA, 22 bp, Homo sapiens
atgagtcagtgaagtctagaat

SEQ ID NO: 4497108 - DNA, 17 bp, Homo sapiens
atgagtctacctgagca

SEQ ID NO: 4497109 - DNA, 18 bp, Homo sapiens
atgagttaactgtgaaat

SEQ ID NO: 4497110 - DNA, 22 bp, Homo sapiens
atgagttaactgtgaaatacca

SEQ ID NO: 4497111 - DNA, 18 bp, Homo sapiens
atgagttacttagaatgc

SEQ ID NO: 4497112 - DNA, 16 bp, Homo sapiens
atgagttagaggagaa

SEQ ID NO: 4497113 - DNA, 18 bp, Homo sapiens
atgagttggacttcagtc

SEQ ID NO: 4497114 - DNA, 22 bp, Homo sapiens
atgagttgttttcagactcaga

SEQ ID NO: 4497115 - DNA, 12 bp, Homo sapiens
atgagtttaaaa

SEQ ID NO: 4497116 - DNA, 12 bp, Homo sapiens
atgagtttgtat

SEQ ID NO: 4497117 - DNA, 14 bp, Homo sapiens
atgataaagacttt

SEQ ID NO: 4497118 - DNA, 14 bp, Homo sapiens
atgataaagagaca

SEQ ID NO: 4497119 - DNA, 20 bp, Homo sapiens
atgataaagagacagtgata

SEQ ID NO: 4497120 - DNA, 23 bp, Homo sapiens
atgataagacattttgtttttac

SEQ ID NO: 4497121 - DNA, 12 bp, Homo sapiens
atgataatgaac

SEQ ID NO: 4497122 - DNA, 15 bp, Homo sapiens
atgataccagcagca

SEQ ID NO: 4497123 - DNA, 23 bp, Homo sapiens
atgataccagcagcaactgaaaa

SEQ ID NO: 4497124 - DNA, 14 bp, Homo sapiens
atgatactgattat

SEQ ID NO: 4497125 - DNA, 22 bp, Homo sapiens
atgatagaaagaataaaatgtt

SEQ ID NO: 4497126 - DNA, 15 bp, Homo sapiens
atgatagttgaatgt

SEQ ID NO: 4497127 - DNA, 17 bp, Homo sapiens
atgatataactttagaa

SEQ ID NO: 4497128 - DNA, 13 bp, Homo sapiens
atgatatgcatgt

SEQ ID NO: 4497129 - DNA, 15 bp, Homo sapiens
atttttgcttttaga

SEQ ID NO: 4497130 - DNA, 18 bp, Homo sapiens
atttttgcttttagaaaa

SEQ ID NO: 4497131 - DNA, 20 bp, Homo sapiens
atttttgcttttagaaaagg

SEQ ID NO: 4497132 - DNA, 15 bp, Homo sapiens
atttttgtagtagcg

SEQ ID NO: 4497133 - DNA, 21 bp, Homo sapiens
atttttgtcattgattaaatt

SEQ ID NO: 4497134 - DNA, 14 bp, Homo sapiens
atttttgtcttgtg

SEQ ID NO: 4497135 - DNA, 20 bp, Homo sapiens
atttttgttactctcttcca

SEQ ID NO: 4497136 - DNA, 16 bp, Homo sapiens
atttttgttagcaaag

SEQ ID NO: 4497137 - DNA, 14 bp, Homo sapiens
attttttaaaaaag

SEQ ID NO: 4497138 - DNA, 19 bp, Homo sapiens
attttttaaaaaagcttaa

SEQ ID NO: 4497139 - DNA, 16 bp, Homo sapiens
attttttaataaactg

SEQ ID NO: 4497140 - DNA, 14 bp, Homo sapiens
attttttaatgtgc

SEQ ID NO: 4497141 - DNA, 14 bp, Homo sapiens
attttttacttgaa

SEQ ID NO: 4497142 - DNA, 21 bp, Homo sapiens
attttttacttgaatcagatg

SEQ ID NO: 4497143 - DNA, 15 bp, Homo sapiens
attttttattatttt

SEQ ID NO: 4497144 - DNA, 14 bp, Homo sapiens
attttttccaaaat

SEQ ID NO: 4497145 - DNA, 18 bp, Homo sapiens
attttttcttctgaagat

SEQ ID NO: 4497146 - DNA, 12 bp, Homo sapiens
attttttgactt

SEQ ID NO: 4497147 - DNA, 23 bp, Homo sapiens
attttttgactttttttgtatgt

SEQ ID NO: 4497148 - DNA, 20 bp, Homo sapiens
attttttggtggtgaaattg

SEQ ID NO: 4497149 - DNA, 14 bp, Homo sapiens
attttttgtataat

SEQ ID NO: 4497150 - DNA, 15 bp, Homo sapiens
atttttttaaaatca

SEQ ID NO: 4497151 - DNA, 22 bp, Homo sapiens
atttttttaaaatcactaacat

SEQ ID NO: 4497152 - DNA, 16 bp, Homo sapiens
atttttttatgctctt

SEQ ID NO: 4497153 - DNA, 12 bp, Homo sapiens
atttttttcctg

SEQ ID NO: 4497154 - DNA, 12 bp, Homo sapiens
atttttttctac

SEQ ID NO: 4497155 - DNA, 22 bp, Homo sapiens
attttttttaattgaaaagaag

SEQ ID NO: 4497156 - DNA, 16 bp, Homo sapiens
attttttttcaaatgt

SEQ ID NO: 4497157 - DNA, 14 bp, Homo sapiens
atttttttttctaa

SEQ ID NO: 4497158 - DNA, 18 bp, Homo sapiens
attttttttttttgaaaa

SEQ ID NO: 4497159 - DNA, 20 bp, Homo sapiens
caaaaaaaaaaaaaaagtgt

SEQ ID NO: 4497160 - DNA, 19 bp, Homo sapiens
caaaaaaaaaaaaaaatta

SEQ ID NO: 4497161 - DNA, 20 bp, Homo sapiens
caaaaaaaaaaaaaaattag

SEQ ID NO: 4497162 - DNA, 20 bp, Homo sapiens
caaaaaaaagaaaatgtctt

SEQ ID NO: 4497163 - DNA, 19 bp, Homo sapiens
caaaaaaaatttagccggg

SEQ ID NO: 4497164 - DNA, 13 bp, Homo sapiens
caaaaaaaggaag

SEQ ID NO: 4497165 - DNA, 16 bp, Homo sapiens
caaaaaaatgttcatt

SEQ ID NO: 4497166 - DNA, 18 bp, Homo sapiens
caaaaaagtccaatttta

SEQ ID NO: 4497167 - DNA, 11 bp, Homo sapiens
caaaaaataca

SEQ ID NO: 4497168 - DNA, 13 bp, Homo sapiens
caaaaaatcatgt

SEQ ID NO: 4497169 - DNA, 18 bp, Homo sapiens
caaaaaatcatgtttatt

SEQ ID NO: 4497170 - DNA, 20 bp, Homo sapiens
caaaaacaaaattagccggg

SEQ ID NO: 4497171 - DNA, 19 bp, Homo sapiens
caaaaacaagtaaatatat

SEQ ID NO: 4497172 - DNA, 20 bp, Homo sapiens
caaaaacaagtaaatatata

SEQ ID NO: 4497173 - DNA, 17 bp, Homo sapiens
caaaaacacagcaaggg

SEQ ID NO: 4497174 - DNA, 13 bp, Homo sapiens
caaaaacagcctc

SEQ ID NO: 4497175 - DNA, 14 bp, Homo sapiens
caaaaacagcctca

SEQ ID NO: 4497176 - DNA, 16 bp, Homo sapiens
caaaaacagcctcaca

SEQ ID NO: 4497177 - DNA, 22 bp, Homo sapiens
caaaaacagcctcacagaagaa

SEQ ID NO: 4497178 - DNA, 13 bp, Homo sapiens
caaaaacaggcag

SEQ ID NO: 4497179 - DNA, 14 bp, Homo sapiens
caaaaagaccagac

SEQ ID NO: 4497180 - DNA, 15 bp, Homo sapiens
caaaaagaccagact

SEQ ID NO: 4497181 - DNA, 13 bp, Homo sapiens
caaaaagcagaag

SEQ ID NO: 4497182 - DNA, 13 bp, Homo sapiens
caaaaagctaatg

SEQ ID NO: 4497183 - DNA, 16 bp, Homo sapiens
caaaaagctctgaaaa

SEQ ID NO: 4497184 - DNA, 24 bp, Homo sapiens
caaaaaggagccttttgctctctg

SEQ ID NO: 4497185 - DNA, 21 bp, Homo sapiens
caaaaataaaaaatctgaaga

SEQ ID NO: 4497186 - DNA, 12 bp, Homo sapiens
caaaaataaatt

SEQ ID NO: 4497187 - DNA, 12 bp, Homo sapiens
caaaaatagaaa

SEQ ID NO: 4497188 - DNA, 14 bp, Homo sapiens
caaaaatagaaatt

SEQ ID NO: 4497189 - DNA, 21 bp, Homo sapiens
caaaaatagtcaaaaattaaa

SEQ ID NO: 4497190 - DNA, 20 bp, Homo sapiens
caaaaatctcccagtgacaa

SEQ ID NO: 4497191 - DNA, 14 bp, Homo sapiens
atcttttattcttt

SEQ ID NO: 4497192 - DNA, 19 bp, Homo sapiens
atcttttctagagacacat

SEQ ID NO: 4497193 - DNA, 13 bp, Homo sapiens
atcttttcttatt

SEQ ID NO: 4497194 - DNA, 17 bp, Homo sapiens
atcttttgaattcttga

SEQ ID NO: 4497195 - DNA, 23 bp, Homo sapiens
atcttttgatatgcatatttgtt

SEQ ID NO: 4497196 - DNA, 13 bp, Homo sapiens
atcttttgtatta

SEQ ID NO: 4497197 - DNA, 22 bp, Homo sapiens
atcttttgtattaagaaaggaa

SEQ ID NO: 4497198 - DNA, 16 bp, Homo sapiens
atcttttgtttccttt

SEQ ID NO: 4497199 - DNA, 22 bp, Homo sapiens
atcttttgtttccttttttccc

SEQ ID NO: 4497200 - DNA, 23 bp, Homo sapiens
atcttttgtttccttttttccca

SEQ ID NO: 4497201 - DNA, 14 bp, Homo sapiens
atctttttatcatg

SEQ ID NO: 4497202 - DNA, 22 bp, Homo sapiens
atctttttatcccatttagtgt

SEQ ID NO: 4497203 - DNA, 23 bp, Homo sapiens
atctttttatcccatttagtgtg

SEQ ID NO: 4497204 - DNA, 14 bp, Homo sapiens
atctttttgcttct

SEQ ID NO: 4497205 - DNA, 17 bp, Homo sapiens
atctttttgcttctact

SEQ ID NO: 4497206 - DNA, 17 bp, Homo sapiens
atgaaaaagaagaatct

SEQ ID NO: 4497207 - DNA, 17 bp, Homo sapiens
atgaaaaagctgcttct

SEQ ID NO: 4497208 - DNA, 13 bp, Homo sapiens
atgaaaacatgta

SEQ ID NO: 4497209 - DNA, 23 bp, Homo sapiens
atgaaaactagcattacattatt

SEQ ID NO: 4497210 - DNA, 20 bp, Homo sapiens
atgaaaactcatgatcaaga

SEQ ID NO: 4497211 - DNA, 21 bp, Homo sapiens
atgaaaactcatgatcaagat

SEQ ID NO: 4497212 - DNA, 13 bp, Homo sapiens
atgaaaagacaag

SEQ ID NO: 4497213 - DNA, 12 bp, Homo sapiens
atgaaaaggaat

SEQ ID NO: 4497214 - DNA, 22 bp, Homo sapiens
atgaaaataactgaatttggag

SEQ ID NO: 4497215 - DNA, 17 bp, Homo sapiens
atgaaaatacaacttaa

SEQ ID NO: 4497216 - DNA, 22 bp, Homo sapiens
atgaaaatatagacattctcac

SEQ ID NO: 4497217 - DNA, 15 bp, Homo sapiens
atgaaaatgagccct

SEQ ID NO: 4497218 - DNA, 14 bp, Homo sapiens
atgaaaatgtccat

SEQ ID NO: 4497219 - DNA, 14 bp, Homo sapiens
atgaaaattgtatt

SEQ ID NO: 4497220 - DNA, 15 bp, Homo sapiens
atgaaaattgtatta

SEQ ID NO: 4497221 - DNA, 13 bp, Homo sapiens
atgaaaattttaa

SEQ ID NO: 4497222 - DNA, 16 bp, Homo sapiens
atgaaacaatgaaatt

SEQ ID NO: 4497223 - DNA, 14 bp, Homo sapiens
atgaaagggaaact

SEQ ID NO: 4497224 - DNA, 21 bp, Homo sapiens
atgaaagggaaactgggaaac

SEQ ID NO: 4497225 - DNA, 23 bp, Homo sapiens
atgaaatatatattgtaaagaag

SEQ ID NO: 4497226 - DNA, 17 bp, Homo sapiens
atgaaatatatgtgaaa

SEQ ID NO: 4497227 - DNA, 13 bp, Homo sapiens
atgaaatgaatga

SEQ ID NO: 4497228 - DNA, 12 bp, Homo sapiens
atgaaatgtgtt

SEQ ID NO: 4497229 - DNA, 22 bp, Homo sapiens
atgaaatgtgttttgtcttttt

SEQ ID NO: 4497230 - DNA, 23 bp, Homo sapiens
atgaaatgtgttttgtctttttt

SEQ ID NO: 4497231 - DNA, 15 bp, Homo sapiens
atgaaatgttaacaa

SEQ ID NO: 4497232 - DNA, 16 bp, Homo sapiens
atgaacaaaattattt

SEQ ID NO: 4497233 - DNA, 17 bp, Homo sapiens
atgaacaaaattatttg

SEQ ID NO: 4497234 - DNA, 13 bp, Homo sapiens
atgaacaatgtat

SEQ ID NO: 4497235 - DNA, 13 bp, Homo sapiens
atgaacaattgct

SEQ ID NO: 4497236 - DNA, 19 bp, Homo sapiens
atgaacagcttgccaggga

SEQ ID NO: 4497237 - DNA, 15 bp, Homo sapiens
atgaacatgttcctg

SEQ ID NO: 4497238 - DNA, 12 bp, Homo sapiens
atgaacattgta

SEQ ID NO: 4497239 - DNA, 15 bp, Homo sapiens
atgaacattgtactg

SEQ ID NO: 4497240 - DNA, 18 bp, Homo sapiens
atgaacattgtactgttg

SEQ ID NO: 4497241 - DNA, 23 bp, Homo sapiens
atgaacattgtactgttgcttta

SEQ ID NO: 4497242 - DNA, 13 bp, Homo sapiens
atgaacccttcct

SEQ ID NO: 4497243 - DNA, 22 bp, Homo sapiens
atgaacccttcctgagctttat

SEQ ID NO: 4497244 - DNA, 19 bp, Homo sapiens
atgaagaaagggaggccca

SEQ ID NO: 4497245 - DNA, 15 bp, Homo sapiens
atgaagaacataaaa

SEQ ID NO: 4497246 - DNA, 14 bp, Homo sapiens
atgaagaactgagg

SEQ ID NO: 4497247 - DNA, 18 bp, Homo sapiens
atgaagatgtagaggaga

SEQ ID NO: 4497248 - DNA, 23 bp, Homo sapiens
atgaagcaattagtctgaaactg

SEQ ID NO: 4497249 - DNA, 11 bp, Homo sapiens
atgaagccttt

SEQ ID NO: 4497250 - DNA, 14 bp, Homo sapiens
atgaagccttttga

SEQ ID NO: 4497251 - DNA, 17 bp, Homo sapiens
atgaagccttttgaaag

SEQ ID NO: 4497252 - DNA, 20 bp, Homo sapiens
atgaagccttttgaaaggga

SEQ ID NO: 4497253 - DNA, 15 bp, Homo sapiens
atgaagctacctcaa

SEQ ID NO: 4497254 - DNA, 14 bp, Homo sapiens
atgaagctgacaat

SEQ ID NO: 4497255 - DNA, 17 bp, Homo sapiens
atgaagctgagcttttg

SEQ ID NO: 4497256 - DNA, 13 bp, Homo sapiens
atgaagctgttgt

SEQ ID NO: 4497257 - DNA, 15 bp, Homo sapiens
atgaagggaaattgt

SEQ ID NO: 4497258 - DNA, 19 bp, Homo sapiens
atgaagggaaattgtttat

SEQ ID NO: 4497259 - DNA, 20 bp, Homo sapiens
atgaaggtaatattgataag

SEQ ID NO: 4497260 - DNA, 18 bp, Homo sapiens
atgaaggttttcatttgc

SEQ ID NO: 4497261 - DNA, 21 bp, Homo sapiens
atgaagtactcatacatgtta

SEQ ID NO: 4497262 - DNA, 16 bp, Homo sapiens
atgaagtattacatga

SEQ ID NO: 4497263 - DNA, 18 bp, Homo sapiens
atgaagtcgttgtgaggg

SEQ ID NO: 4497264 - DNA, 18 bp, Homo sapiens
atgaagtttatattatca

SEQ ID NO: 4497265 - DNA, 14 bp, Homo sapiens
atgaagtttttaaa

SEQ ID NO: 4497266 - DNA, 17 bp, Homo sapiens
atgaagtttttaaaaat

SEQ ID NO: 4497267 - DNA, 15 bp, Homo sapiens
atgaataaagaatgc

SEQ ID NO: 4497268 - DNA, 17 bp, Homo sapiens
atgaataaagaatgcca

SEQ ID NO: 4497269 - DNA, 17 bp, Homo sapiens
atgaataaagcctttgt

SEQ ID NO: 4497270 - DNA, 18 bp, Homo sapiens
atgaataaagcctttgta

SEQ ID NO: 4497271 - DNA, 14 bp, Homo sapiens
atgaataacattta

SEQ ID NO: 4497272 - DNA, 16 bp, Homo sapiens
atgaataacatttaaa

SEQ ID NO: 4497273 - DNA, 17 bp, Homo sapiens
atgaataacatttaaat

SEQ ID NO: 4497274 - DNA, 20 bp, Homo sapiens
atgaataagtgtaagtaaat

SEQ ID NO: 4497275 - DNA, 17 bp, Homo sapiens
atctggtcccttgcagc

SEQ ID NO: 4497276 - DNA, 13 bp, Homo sapiens
atctggtcttttt

SEQ ID NO: 4497277 - DNA, 14 bp, Homo sapiens
atctggtgatttct

SEQ ID NO: 4497278 - DNA, 14 bp, Homo sapiens
atctggtgcctcct

SEQ ID NO: 4497279 - DNA, 17 bp, Homo sapiens
atctgtaatgatactga

SEQ ID NO: 4497280 - DNA, 18 bp, Homo sapiens
atctgtataatactttgt

SEQ ID NO: 4497281 - DNA, 24 bp, Homo sapiens
atctgtataatactttgtatacaa

SEQ ID NO: 4497282 - DNA, 22 bp, Homo sapiens
atctgtatttaatggtttttat

SEQ ID NO: 4497283 - DNA, 18 bp, Homo sapiens
atctgtcacaccagccat

SEQ ID NO: 4497284 - DNA, 17 bp, Homo sapiens
atctgtcagtgtttgta

SEQ ID NO: 4497285 - DNA, 16 bp, Homo sapiens
atctgtcattatattc

SEQ ID NO: 4497286 - DNA, 18 bp, Homo sapiens
atctgtcattatattcta

SEQ ID NO: 4497287 - DNA, 18 bp, Homo sapiens
atctgtccaaaggaggct

SEQ ID NO: 4497288 - DNA, 21 bp, Homo sapiens
atctgtccaaaggaggctggc

SEQ ID NO: 4497289 - DNA, 23 bp, Homo sapiens
atctgtccaaaggaggctggcag

SEQ ID NO: 4497290 - DNA, 22 bp, Homo sapiens
atctgtctgccaacctaaaact

SEQ ID NO: 4497291 - DNA, 15 bp, Homo sapiens
atctgtctgtgcaca

SEQ ID NO: 4497292 - DNA, 17 bp, Homo sapiens
atctgtctgtgcacatg

SEQ ID NO: 4497293 - DNA, 18 bp, Homo sapiens
atctgtctgtgcacatgc

SEQ ID NO: 4497294 - DNA, 22 bp, Homo sapiens
atctgtctgtggcaaaagttta

SEQ ID NO: 4497295 - DNA, 17 bp, Homo sapiens
atctgtcttgacttttt

SEQ ID NO: 4497296 - DNA, 21 bp, Homo sapiens
atctgtgacctgtcagaataa

SEQ ID NO: 4497297 - DNA, 23 bp, Homo sapiens
atctgtgacctgtcagaataaaa

SEQ ID NO: 4497298 - DNA, 15 bp, Homo sapiens
atctgtgccccatgc

SEQ ID NO: 4497299 - DNA, 16 bp, Homo sapiens
atctgtgcttctaata

SEQ ID NO: 4497300 - DNA, 18 bp, Homo sapiens
atctgtgctttccagctc

SEQ ID NO: 4497301 - DNA, 15 bp, Homo sapiens
atctgtgggatgctg

SEQ ID NO: 4497302 - DNA, 22 bp, Homo sapiens
atctgtgggcatggtcaaaggc

SEQ ID NO: 4497303 - DNA, 13 bp, Homo sapiens
atctgtgtcttgt

SEQ ID NO: 4497304 - DNA, 20 bp, Homo sapiens
atctgtgtgaaactttcatt

SEQ ID NO: 4497305 - DNA, 18 bp, Homo sapiens
atctgtgtgcatatttgt

SEQ ID NO: 4497306 - DNA, 22 bp, Homo sapiens
atctgttcccagcccctcctcc

SEQ ID NO: 4497307 - DNA, 16 bp, Homo sapiens
atctgttccttggcag

SEQ ID NO: 4497308 - DNA, 12 bp, Homo sapiens
atctgtttctct

SEQ ID NO: 4497309 - DNA, 17 bp, Homo sapiens
atctgtttctctgctgt

SEQ ID NO: 4497310 - DNA, 14 bp, Homo sapiens
atctgttttacagg

SEQ ID NO: 4497311 - DNA, 20 bp, Homo sapiens
atctgttttacaggaaacaa

SEQ ID NO: 4497312 - DNA, 17 bp, Homo sapiens
atctgttttgaaggcaa

SEQ ID NO: 4497313 - DNA, 13 bp, Homo sapiens
atctgtttttaaa

SEQ ID NO: 4497314 - DNA, 20 bp, Homo sapiens
atcttaaaagctatcttcat

SEQ ID NO: 4497315 - DNA, 19 bp, Homo sapiens
atcttaaaccttaagatac

SEQ ID NO: 4497316 - DNA, 13 bp, Homo sapiens
atcttaaagacaa

SEQ ID NO: 4497317 - DNA, 20 bp, Homo sapiens
atcttaaattcatttctaga

SEQ ID NO: 4497318 - DNA, 21 bp, Homo sapiens
atcttaaattcatttctagac

SEQ ID NO: 4497319 - DNA, 21 bp, Homo sapiens
atcttaagcatgtcaattcat

SEQ ID NO: 4497320 - DNA, 13 bp, Homo sapiens
atcttaattgcaa

SEQ ID NO: 4497321 - DNA, 18 bp, Homo sapiens
atcttagataacttcttg

SEQ ID NO: 4497322 - DNA, 12 bp, Homo sapiens
atcttagtggtt

SEQ ID NO: 4497323 - DNA, 15 bp, Homo sapiens
atcttagttctgtat

SEQ ID NO: 4497324 - DNA, 15 bp, Homo sapiens
atcttatattggttt

SEQ ID NO: 4497325 - DNA, 12 bp, Homo sapiens
atcttattgctt

SEQ ID NO: 4497326 - DNA, 13 bp, Homo sapiens
atcttatttagga

SEQ ID NO: 4497327 - DNA, 12 bp, Homo sapiens
atcttatttatt

SEQ ID NO: 4497328 - DNA, 17 bp, Homo sapiens
atcttatttttcctgtc

SEQ ID NO: 4497329 - DNA, 17 bp, Homo sapiens
atcttcactagaagccg

SEQ ID NO: 4497330 - DNA, 22 bp, Homo sapiens
atcttcactgtatatgtaaatt

SEQ ID NO: 4497331 - DNA, 16 bp, Homo sapiens
atcttcagaactgccc

SEQ ID NO: 4497332 - DNA, 19 bp, Homo sapiens
atcttcagaactgcccttg

SEQ ID NO: 4497333 - DNA, 21 bp, Homo sapiens
atcttcagaactgcccttgct

SEQ ID NO: 4497334 - DNA, 14 bp, Homo sapiens
atcttcatgtaaat

SEQ ID NO: 4497335 - DNA, 14 bp, Homo sapiens
atcttcccacagga

SEQ ID NO: 4497336 - DNA, 23 bp, Homo sapiens
atcttccttaatcctattttcat

SEQ ID NO: 4497337 - DNA, 21 bp, Homo sapiens
atcttcgttagtaatctgtat

SEQ ID NO: 4497338 - DNA, 14 bp, Homo sapiens
atcttctactttta

SEQ ID NO: 4497339 - DNA, 19 bp, Homo sapiens
atcttctacttttaactaa

SEQ ID NO: 4497340 - DNA, 23 bp, Homo sapiens
atcttctcccccacggtatccta

SEQ ID NO: 4497341 - DNA, 16 bp, Homo sapiens
atcttctgccttctca

SEQ ID NO: 4497342 - DNA, 22 bp, Homo sapiens
atcttctggtttaaacttgttt

SEQ ID NO: 4497343 - DNA, 11 bp, Homo sapiens
atcttcttaac

SEQ ID NO: 4497344 - DNA, 19 bp, Homo sapiens
atcttcttaacagtttagt

SEQ ID NO: 4497345 - DNA, 16 bp, Homo sapiens
atcttctttattattc

SEQ ID NO: 4497346 - DNA, 22 bp, Homo sapiens
atcttgaaattaagaaggcaaa

SEQ ID NO: 4497347 - DNA, 19 bp, Homo sapiens
atcttgaatactctgccct

SEQ ID NO: 4497348 - DNA, 16 bp, Homo sapiens
atcttgaatttcatgc

SEQ ID NO: 4497349 - DNA, 12 bp, Homo sapiens
atcttgatcttt

SEQ ID NO: 4497350 - DNA, 19 bp, Homo sapiens
atcttgatctttgagccca

SEQ ID NO: 4497351 - DNA, 16 bp, Homo sapiens
atcttgcccactggcc

SEQ ID NO: 4497352 - DNA, 15 bp, Homo sapiens
atcttgccttctggt

SEQ ID NO: 4497353 - DNA, 19 bp, Homo sapiens
atcttgctaccagtattta

SEQ ID NO: 4497354 - DNA, 19 bp, Homo sapiens
atctaccttttctggcaaa

SEQ ID NO: 4497355 - DNA, 19 bp, Homo sapiens
atctactaattccacacct

SEQ ID NO: 4497356 - DNA, 23 bp, Homo sapiens
atctactggaaatgtagcactta

SEQ ID NO: 4497357 - DNA, 20 bp, Homo sapiens
atctacttctgtaattgtgt

SEQ ID NO: 4497358 - DNA, 23 bp, Homo sapiens
atctacttctgtaattgtgtgga

SEQ ID NO: 4497359 - DNA, 14 bp, Homo sapiens
atctacttgcctca

SEQ ID NO: 4497360 - DNA, 13 bp, Homo sapiens
atctagaagatgt

SEQ ID NO: 4497361 - DNA, 15 bp, Homo sapiens
atctagaagatgtgt

SEQ ID NO: 4497362 - DNA, 19 bp, Homo sapiens
atctagaagatgtgtaaac

SEQ ID NO: 4497363 - DNA, 23 bp, Homo sapiens
atctagaagatgtgtaaacaggt

SEQ ID NO: 4497364 - DNA, 23 bp, Homo sapiens
atctagaattcactgagttttgt

SEQ ID NO: 4497365 - DNA, 16 bp, Homo sapiens
atctagcatttatttc

SEQ ID NO: 4497366 - DNA, 16 bp, Homo sapiens
atctaggatgtgatga

SEQ ID NO: 4497367 - DNA, 17 bp, Homo sapiens
atctaggatgtgatgat

SEQ ID NO: 4497368 - DNA, 22 bp, Homo sapiens
atctaggcatttcattatgctt

SEQ ID NO: 4497369 - DNA, 17 bp, Homo sapiens
atctagtcacaaagact

SEQ ID NO: 4497370 - DNA, 15 bp, Homo sapiens
atctataaactataa

SEQ ID NO: 4497371 - DNA, 15 bp, Homo sapiens
atctataacataaag

SEQ ID NO: 4497372 - DNA, 22 bp, Homo sapiens
atctatacctgccttttaagtt

SEQ ID NO: 4497373 - DNA, 12 bp, Homo sapiens
atctatataaaa

SEQ ID NO: 4497374 - DNA, 15 bp, Homo sapiens
atctatattaaatga

SEQ ID NO: 4497375 - DNA, 13 bp, Homo sapiens
atctatccctgcg

SEQ ID NO: 4497376 - DNA, 14 bp, Homo sapiens
atctatctacaaag

SEQ ID NO: 4497377 - DNA, 16 bp, Homo sapiens
atctatctacaaagaa

SEQ ID NO: 4497378 - DNA, 14 bp, Homo sapiens
atctatctatttga

SEQ ID NO: 4497379 - DNA, 16 bp, Homo sapiens
atctatctatttgagg

SEQ ID NO: 4497380 - DNA, 21 bp, Homo sapiens
atctatctggtgatttctagc

SEQ ID NO: 4497381 - DNA, 23 bp, Homo sapiens
atctatctggtgatttctagctc

SEQ ID NO: 4497382 - DNA, 20 bp, Homo sapiens
atctatggctttaaataaat

SEQ ID NO: 4497383 - DNA, 22 bp, Homo sapiens
atctatggctttaaataaatta

SEQ ID NO: 4497384 - DNA, 16 bp, Homo sapiens
atctatggttctaaat

SEQ ID NO: 4497385 - DNA, 20 bp, Homo sapiens
atctatgtttcatcttgttt

SEQ ID NO: 4497386 - DNA, 24 bp, Homo sapiens
atctattcttctgaccatctagtg

SEQ ID NO: 4497387 - DNA, 12 bp, Homo sapiens
atctatttacat

SEQ ID NO: 4497388 - DNA, 14 bp, Homo sapiens
atctatttgaataa

SEQ ID NO: 4497389 - DNA, 20 bp, Homo sapiens
atctatttgaataaattatg

SEQ ID NO: 4497390 - DNA, 13 bp, Homo sapiens
atctatttgtaca

SEQ ID NO: 4497391 - DNA, 17 bp, Homo sapiens
atctattttattttatt

SEQ ID NO: 4497392 - DNA, 14 bp, Homo sapiens
atctattttggatt

SEQ ID NO: 4497393 - DNA, 21 bp, Homo sapiens
atctcaaggggcccagcctcc

SEQ ID NO: 4497394 - DNA, 14 bp, Homo sapiens
atctcaatcttggt

SEQ ID NO: 4497395 - DNA, 17 bp, Homo sapiens
atctcaattgaaagctt

SEQ ID NO: 4497396 - DNA, 17 bp, Homo sapiens
atctcacaggctgagaa

SEQ ID NO: 4497397 - DNA, 17 bp, Homo sapiens
atctcactttgtaaata

SEQ ID NO: 4497398 - DNA, 19 bp, Homo sapiens
atctcactttgtaaataaa

SEQ ID NO: 4497399 - DNA, 15 bp, Homo sapiens
atctcagaccctgct

SEQ ID NO: 4497400 - DNA, 16 bp, Homo sapiens
atctcagaccctgctt

SEQ ID NO: 4497401 - DNA, 18 bp, Homo sapiens
atctcagagtccactgtg

SEQ ID NO: 4497402 - DNA, 20 bp, Homo sapiens
atctcagatcagtgtaccat

SEQ ID NO: 4497403 - DNA, 19 bp, Homo sapiens
atctcagatgttaaaataa

SEQ ID NO: 4497404 - DNA, 22 bp, Homo sapiens
atctcagattcttcactggtga

SEQ ID NO: 4497405 - DNA, 14 bp, Homo sapiens
atctcaggagatgg

SEQ ID NO: 4497406 - DNA, 17 bp, Homo sapiens
atctcagtgaagaatac

SEQ ID NO: 4497407 - DNA, 20 bp, Homo sapiens
atctcagtgaagaatacttc

SEQ ID NO: 4497408 - DNA, 15 bp, Homo sapiens
atctcagtgctttcc

SEQ ID NO: 4497409 - DNA, 16 bp, Homo sapiens
atctcatcatgtctat

SEQ ID NO: 4497410 - DNA, 18 bp, Homo sapiens
atctcatgccagtgcctt

SEQ ID NO: 4497411 - DNA, 16 bp, Homo sapiens
atctcatgtatcatct

SEQ ID NO: 4497412 - DNA, 13 bp, Homo sapiens
atctcatttaagg

SEQ ID NO: 4497413 - DNA, 16 bp, Homo sapiens
atctcatttaagggaa

SEQ ID NO: 4497414 - DNA, 23 bp, Homo sapiens
atctccaatggaaagcttttcag

SEQ ID NO: 4497415 - DNA, 22 bp, Homo sapiens
atctcccaggccccaggggaga

SEQ ID NO: 4497416 - DNA, 19 bp, Homo sapiens
atctcccattttggaattt

SEQ ID NO: 4497417 - DNA, 12 bp, Homo sapiens
atctcccctcaa

SEQ ID NO: 4497418 - DNA, 14 bp, Homo sapiens
atctccctccccag

SEQ ID NO: 4497419 - DNA, 20 bp, Homo sapiens
atctccctccccagaaacag

SEQ ID NO: 4497420 - DNA, 12 bp, Homo sapiens
atctccctgccg

SEQ ID NO: 4497421 - DNA, 14 bp, Homo sapiens
atctccctgcctgg

SEQ ID NO: 4497422 - DNA, 20 bp, Homo sapiens
atctcccttctcatctcccc

SEQ ID NO: 4497423 - DNA, 21 bp, Homo sapiens
atctcccttctcatctcccca

SEQ ID NO: 4497424 - DNA, 19 bp, Homo sapiens
atctccgcctccacactga

SEQ ID NO: 4497425 - DNA, 14 bp, Homo sapiens
atctcctatttttt

SEQ ID NO: 4497426 - DNA, 20 bp, Homo sapiens
atctcctgccttcctcctgg

SEQ ID NO: 4497427 - DNA, 14 bp, Homo sapiens
atctctcaaaacaa

SEQ ID NO: 4497428 - DNA, 18 bp, Homo sapiens
atctctccccatatataa

SEQ ID NO: 4497429 - DNA, 12 bp, Homo sapiens
atctctcctggc

SEQ ID NO: 4497430 - DNA, 14 bp, Homo sapiens
atctctcctggcct

SEQ ID NO: 4497431 - DNA, 23 bp, Homo sapiens
atctctctgccctctccctgtgt

SEQ ID NO: 4497432 - DNA, 13 bp, Homo sapiens
atctctctggggc

SEQ ID NO: 4497433 - DNA, 16 bp, Homo sapiens
atctctctggggccct

SEQ ID NO: 4497434 - DNA, 22 bp, Homo sapiens
atctctctggggccctgggcct

SEQ ID NO: 4497435 - DNA, 13 bp, Homo sapiens
atctctctgtctt

SEQ ID NO: 4497436 - DNA, 14 bp, Homo sapiens
atctctctgtcttt

SEQ ID NO: 4497437 - DNA, 18 bp, Homo sapiens
atctctcttgtcctcttc

SEQ ID NO: 4497438 - DNA, 19 bp, Homo sapiens
atctctcttgtcctcttct

SEQ ID NO: 4497439 - DNA, 21 bp, Homo sapiens
atctctcttgtcctcttctgc

SEQ ID NO: 4497440 - DNA, 21 bp, Homo sapiens
atctctgctccctgcaagctc

SEQ ID NO: 4497441 - DNA, 12 bp, Homo sapiens
atctctgctggg

SEQ ID NO: 4497442 - DNA, 20 bp, Homo sapiens
atctctgtgtgttttctttg

SEQ ID NO: 4497443 - DNA, 23 bp, Homo sapiens
atctcttaaattgggttcatgat

SEQ ID NO: 4497444 - DNA, 23 bp, Homo sapiens
atctcttaagacagcatgtgtta

SEQ ID NO: 4497445 - DNA, 16 bp, Homo sapiens
atctcttacatcagta

SEQ ID NO: 4497446 - DNA, 13 bp, Homo sapiens
atctcttagctcc

SEQ ID NO: 4497447 - DNA, 19 bp, Homo sapiens
atctcttcatgcttgacat

SEQ ID NO: 4497448 - DNA, 14 bp, Homo sapiens
atctcttccccaga

SEQ ID NO: 4497449 - DNA, 15 bp, Homo sapiens
atctcttccccagag

SEQ ID NO: 4497450 - DNA, 12 bp, Homo sapiens
atctcttccttg

SEQ ID NO: 4497451 - DNA, 12 bp, Homo sapiens
atctcttctgca

SEQ ID NO: 4497452 - DNA, 13 bp, Homo sapiens
atctcttctgcaa

SEQ ID NO: 4497453 - DNA, 23 bp, Homo sapiens
atctcttctgcaagcctcatgcc

SEQ ID NO: 4497454 - DNA, 16 bp, Homo sapiens
atctcttctggtgttg

SEQ ID NO: 4497455 - DNA, 18 bp, Homo sapiens
atctcttctggtgttgac

SEQ ID NO: 4497456 - DNA, 15 bp, Homo sapiens
atctcttcttataca

SEQ ID NO: 4497457 - DNA, 17 bp, Homo sapiens
atctcttcttatacaga

SEQ ID NO: 4497458 - DNA, 13 bp, Homo sapiens
atctcttggaaaa

SEQ ID NO: 4497459 - DNA, 22 bp, Homo sapiens
atctcttggaaaataagacaat

SEQ ID NO: 4497460 - DNA, 12 bp, Homo sapiens
atctctttccct

SEQ ID NO: 4497461 - DNA, 14 bp, Homo sapiens
atctctttctctct

SEQ ID NO: 4497462 - DNA, 16 bp, Homo sapiens
atctgaaaatagcaac

SEQ ID NO: 4497463 - DNA, 18 bp, Homo sapiens
atctgaaattcaaaatgc

SEQ ID NO: 4497464 - DNA, 21 bp, Homo sapiens
atctgaagagctattatataa

SEQ ID NO: 4497465 - DNA, 22 bp, Homo sapiens
atctgaagaggcttctcctgtt

SEQ ID NO: 4497466 - DNA, 18 bp, Homo sapiens
atctgaatgatcctgtct

SEQ ID NO: 4497467 - DNA, 15 bp, Homo sapiens
atctgaatgtaattt

SEQ ID NO: 4497468 - DNA, 17 bp, Homo sapiens
atctgaatgtaatttgt

SEQ ID NO: 4497469 - DNA, 19 bp, Homo sapiens
atctgaatttttaaacaag

SEQ ID NO: 4497470 - DNA, 17 bp, Homo sapiens
atctgacccactttgta

SEQ ID NO: 4497471 - DNA, 18 bp, Homo sapiens
atctgacccactttgtaa

SEQ ID NO: 4497472 - DNA, 21 bp, Homo sapiens
atctgaccctatgggtctagg

SEQ ID NO: 4497473 - DNA, 20 bp, Homo sapiens
atctgagaggccacagtgca

SEQ ID NO: 4497474 - DNA, 12 bp, Homo sapiens
atctgagcaagg

SEQ ID NO: 4497475 - DNA, 19 bp, Homo sapiens
atccctgcggcctccacac

SEQ ID NO: 4497476 - DNA, 17 bp, Homo sapiens
atccctgcttgcccgct

SEQ ID NO: 4497477 - DNA, 17 bp, Homo sapiens
atccctggacttctggg

SEQ ID NO: 4497478 - DNA, 12 bp, Homo sapiens
atccctgtgagg

SEQ ID NO: 4497479 - DNA, 20 bp, Homo sapiens
atcccttaatatcctaaaca

SEQ ID NO: 4497480 - DNA, 14 bp, Homo sapiens
atcccttcatatca

SEQ ID NO: 4497481 - DNA, 16 bp, Homo sapiens
atccgtattgaatttg

SEQ ID NO: 4497482 - DNA, 21 bp, Homo sapiens
atccgtctttggcctcctcca

SEQ ID NO: 4497483 - DNA, 13 bp, Homo sapiens
atccgtgttgcag

SEQ ID NO: 4497484 - DNA, 14 bp, Homo sapiens
atcctaaacatcat

SEQ ID NO: 4497485 - DNA, 14 bp, Homo sapiens
atcctaaactctct

SEQ ID NO: 4497486 - DNA, 18 bp, Homo sapiens
atcctaaactctctagct

SEQ ID NO: 4497487 - DNA, 22 bp, Homo sapiens
atcctaaggctgtccacgtact

SEQ ID NO: 4497488 - DNA, 15 bp, Homo sapiens
atcctaatttctcct

SEQ ID NO: 4497489 - DNA, 19 bp, Homo sapiens
atcctagagtcttaaagca

SEQ ID NO: 4497490 - DNA, 19 bp, Homo sapiens
atcctataagcttaaatag

SEQ ID NO: 4497491 - DNA, 21 bp, Homo sapiens
atcctattttcataatttttc

SEQ ID NO: 4497492 - DNA, 12 bp, Homo sapiens
atcctcaatcca

SEQ ID NO: 4497493 - DNA, 20 bp, Homo sapiens
atcctcagccgagaaattgg

SEQ ID NO: 4497494 - DNA, 21 bp, Homo sapiens
atcctcatatggcccagtgtc

SEQ ID NO: 4497495 - DNA, 17 bp, Homo sapiens
atcctcccattgcccag

SEQ ID NO: 4497496 - DNA, 20 bp, Homo sapiens
atcctccctccacctcaaga

SEQ ID NO: 4497497 - DNA, 14 bp, Homo sapiens
atcctcctgcctca

SEQ ID NO: 4497498 - DNA, 15 bp, Homo sapiens
atcctcctgcctcag

SEQ ID NO: 4497499 - DNA, 17 bp, Homo sapiens
atcctcctgcctcagcc

SEQ ID NO: 4497500 - DNA, 20 bp, Homo sapiens
atcctcctgcctcagccttc

SEQ ID NO: 4497501 - DNA, 14 bp, Homo sapiens
atcctctggctggc

SEQ ID NO: 4497502 - DNA, 19 bp, Homo sapiens
atcctgaactttctccctc

SEQ ID NO: 4497503 - DNA, 24 bp, Homo sapiens
atcctgaccagctgctccgaggac

SEQ ID NO: 4497504 - DNA, 17 bp, Homo sapiens
atcctgactctgccccc

SEQ ID NO: 4497505 - DNA, 19 bp, Homo sapiens
atcctgactctgccccctg

SEQ ID NO: 4497506 - DNA, 16 bp, Homo sapiens
atcctgcaattccact

SEQ ID NO: 4497507 - DNA, 13 bp, Homo sapiens
atcctgcacccca

SEQ ID NO: 4497508 - DNA, 17 bp, Homo sapiens
atcctgcaccccagcat

SEQ ID NO: 4497509 - DNA, 11 bp, Homo sapiens
atcctgcactc

SEQ ID NO: 4497510 - DNA, 15 bp, Homo sapiens
atcctgcagggcttc

SEQ ID NO: 4497511 - DNA, 20 bp, Homo sapiens
atcctgcccaaaatgtgaag

SEQ ID NO: 4497512 - DNA, 15 bp, Homo sapiens
atcctgccctggagg

SEQ ID NO: 4497513 - DNA, 22 bp, Homo sapiens
atcctgccttagagccaggcac

SEQ ID NO: 4497514 - DNA, 19 bp, Homo sapiens
atcctgcggaaggaattca

SEQ ID NO: 4497515 - DNA, 15 bp, Homo sapiens
atcctgctcttttgt

SEQ ID NO: 4497516 - DNA, 19 bp, Homo sapiens
atcctgctcttttgtgatg

SEQ ID NO: 4497517 - DNA, 20 bp, Homo sapiens
atcctgctcttttgtgatga

SEQ ID NO: 4497518 - DNA, 19 bp, Homo sapiens
atcctggaaggacacagtg

SEQ ID NO: 4497519 - DNA, 21 bp, Homo sapiens
atcctggaaggacacagtgat

SEQ ID NO: 4497520 - DNA, 23 bp, Homo sapiens
atcctggaaggacacagtgatga

SEQ ID NO: 4497521 - DNA, 16 bp, Homo sapiens
atcctggattcactca

SEQ ID NO: 4497522 - DNA, 20 bp, Homo sapiens
atcctggattcactcactca

SEQ ID NO: 4497523 - DNA, 23 bp, Homo sapiens
atcctggcttgaaaaacagctct

SEQ ID NO: 4497524 - DNA, 19 bp, Homo sapiens
atcctgtctctaaaaagaa

SEQ ID NO: 4497525 - DNA, 22 bp, Homo sapiens
atcctgtgtttcattacttgaa

SEQ ID NO: 4497526 - DNA, 20 bp, Homo sapiens
atcagaaaggaaaaacaaac

SEQ ID NO: 4497527 - DNA, 17 bp, Homo sapiens
atcagaaatcctctgtt

SEQ ID NO: 4497528 - DNA, 13 bp, Homo sapiens
atcagaagaaagg

SEQ ID NO: 4497529 - DNA, 14 bp, Homo sapiens
atcagaagaaaggc

SEQ ID NO: 4497530 - DNA, 16 bp, Homo sapiens
atcagaagactttaat

SEQ ID NO: 4497531 - DNA, 12 bp, Homo sapiens
atcagaaggaga

SEQ ID NO: 4497532 - DNA, 14 bp, Homo sapiens
atcagaccctaccc

SEQ ID NO: 4497533 - DNA, 20 bp, Homo sapiens
atcagaccctaccccaccac

SEQ ID NO: 4497534 - DNA, 21 bp, Homo sapiens
atcagactagccactcctgcc

SEQ ID NO: 4497535 - DNA, 15 bp, Homo sapiens
atcagactctagaaa

SEQ ID NO: 4497536 - DNA, 14 bp, Homo sapiens
atcagagggctgat

SEQ ID NO: 4497537 - DNA, 15 bp, Homo sapiens
atcagataatgccac

SEQ ID NO: 4497538 - DNA, 21 bp, Homo sapiens
atcagatctggggcagcaccc

SEQ ID NO: 4497539 - DNA, 21 bp, Homo sapiens
atcagatgctgaattgagaat

SEQ ID NO: 4497540 - DNA, 14 bp, Homo sapiens
atcagatgctggtg

SEQ ID NO: 4497541 - DNA, 16 bp, Homo sapiens
atcagatggtgtcatt

SEQ ID NO: 4497542 - DNA, 19 bp, Homo sapiens
atcagatggtgtcatttag

SEQ ID NO: 4497543 - DNA, 23 bp, Homo sapiens
atcagcaaagaaaaaaaaaaaag

SEQ ID NO: 4497544 - DNA, 15 bp, Homo sapiens
atcagcatctgacag

SEQ ID NO: 4497545 - DNA, 21 bp, Homo sapiens
atcagccccgcctgtcacaat

SEQ ID NO: 4497546 - DNA, 10 bp, Homo sapiens
atcagccctg

SEQ ID NO: 4497547 - DNA, 20 bp, Homo sapiens
atcagcctcatgactttata

SEQ ID NO: 4497548 - DNA, 13 bp, Homo sapiens
atcagctctgcct

SEQ ID NO: 4497549 - DNA, 22 bp, Homo sapiens
atcagctgctgaaacaacaaat

SEQ ID NO: 4497550 - DNA, 21 bp, Homo sapiens
atcagctttgataattgtgta

SEQ ID NO: 4497551 - DNA, 14 bp, Homo sapiens
atcagcttttctga

SEQ ID NO: 4497552 - DNA, 20 bp, Homo sapiens
atcaggaattctaaataaat

SEQ ID NO: 4497553 - DNA, 18 bp, Homo sapiens
atcaggacccagaggaag

SEQ ID NO: 4497554 - DNA, 20 bp, Homo sapiens
atcaggacccagaggaaggg

SEQ ID NO: 4497555 - DNA, 15 bp, Homo sapiens
atcaggagagcaagg

SEQ ID NO: 4497556 - DNA, 13 bp, Homo sapiens
atcaggaggaagt

SEQ ID NO: 4497557 - DNA, 16 bp, Homo sapiens
atcaggccattgtccc

SEQ ID NO: 4497558 - DNA, 13 bp, Homo sapiens
atcaggctagccc

SEQ ID NO: 4497559 - DNA, 20 bp, Homo sapiens
atcaggctagccctgccctc

SEQ ID NO: 4497560 - DNA, 18 bp, Homo sapiens
atcagggcggcctcccag

SEQ ID NO: 4497561 - DNA, 23 bp, Homo sapiens
atcaggtaactaactgcatacac

SEQ ID NO: 4497562 - DNA, 17 bp, Homo sapiens
atcagtaaaattatact

SEQ ID NO: 4497563 - DNA, 19 bp, Homo sapiens
atcagtaaaattatactgt

SEQ ID NO: 4497564 - DNA, 21 bp, Homo sapiens
atcagtaaagtacctttatgt

SEQ ID NO: 4497565 - DNA, 23 bp, Homo sapiens
atcagtagttcacatacaaatca

SEQ ID NO: 4497566 - DNA, 19 bp, Homo sapiens
atcagtatattttctgtat

SEQ ID NO: 4497567 - DNA, 23 bp, Homo sapiens
atcagtatattttctgtatttaa

SEQ ID NO: 4497568 - DNA, 13 bp, Homo sapiens
atcagtattctga

SEQ ID NO: 4497569 - DNA, 15 bp, Homo sapiens
atcagtattctgaca

SEQ ID NO: 4497570 - DNA, 19 bp, Homo sapiens
atcagtattctgacatgta

SEQ ID NO: 4497571 - DNA, 23 bp, Homo sapiens
atcagtattctgacatgtaagaa

SEQ ID NO: 4497572 - DNA, 13 bp, Homo sapiens
atcagtcaagctg

SEQ ID NO: 4497573 - DNA, 16 bp, Homo sapiens
atcagtctcagaatgt

SEQ ID NO: 4497574 - DNA, 15 bp, Homo sapiens
atcagtgataattgg

SEQ ID NO: 4497575 - DNA, 15 bp, Homo sapiens
atcagtgctccctca

SEQ ID NO: 4497576 - DNA, 22 bp, Homo sapiens
atcagtgctctgtaaaacacac

SEQ ID NO: 4497577 - DNA, 14 bp, Homo sapiens
atcagtgtttatgt

SEQ ID NO: 4497578 - DNA, 15 bp, Homo sapiens
atcagttactcagcc

SEQ ID NO: 4497579 - DNA, 19 bp, Homo sapiens
atcagttactcagccctgg

SEQ ID NO: 4497580 - DNA, 22 bp, Homo sapiens
atcagttatacagttataaaat

SEQ ID NO: 4497581 - DNA, 21 bp, Homo sapiens
atcagttcattagaaatattt

SEQ ID NO: 4497582 - DNA, 17 bp, Homo sapiens
atcagttccagccttct

SEQ ID NO: 4497583 - DNA, 16 bp, Homo sapiens
atcagtttaaaagcac

SEQ ID NO: 4497584 - DNA, 21 bp, Homo sapiens
atcataaatcttcttattaaa

SEQ ID NO: 4497585 - DNA, 24 bp, Homo sapiens
atcataaggagttggtgtaatcat

SEQ ID NO: 4497586 - DNA, 16 bp, Homo sapiens
atagttattaaatgtt

SEQ ID NO: 4497587 - DNA, 21 bp, Homo sapiens
atagttattaaatgtttcaaa

SEQ ID NO: 4497588 - DNA, 21 bp, Homo sapiens
atagttcagaatttagtgtat

SEQ ID NO: 4497589 - DNA, 17 bp, Homo sapiens
atagttctgtaataaaa

SEQ ID NO: 4497590 - DNA, 18 bp, Homo sapiens
atagttctgtaataaaac

SEQ ID NO: 4497591 - DNA, 21 bp, Homo sapiens
atagttgcatagcagtatatg

SEQ ID NO: 4497592 - DNA, 21 bp, Homo sapiens
atagttgcttttgaaggaata

SEQ ID NO: 4497593 - DNA, 18 bp, Homo sapiens
atagttgtagacaaagta

SEQ ID NO: 4497594 - DNA, 19 bp, Homo sapiens
atagttgtagacaaagtac

SEQ ID NO: 4497595 - DNA, 22 bp, Homo sapiens
atagtttatttctgtgaaagaa

SEQ ID NO: 4497596 - DNA, 18 bp, Homo sapiens
atagtttggatatgtaaa

SEQ ID NO: 4497597 - DNA, 15 bp, Homo sapiens
atagttttactttta

SEQ ID NO: 4497598 - DNA, 23 bp, Homo sapiens
atagttttcttcctttgaaagac

SEQ ID NO: 4497599 - DNA, 19 bp, Homo sapiens
atagttttttacttctctt

SEQ ID NO: 4497600 - DNA, 16 bp, Homo sapiens
atataaaaaatcatgc

SEQ ID NO: 4497601 - DNA, 19 bp, Homo sapiens
atataaaagatcttgcaga

SEQ ID NO: 4497602 - DNA, 13 bp, Homo sapiens
atataaaataact

SEQ ID NO: 4497603 - DNA, 23 bp, Homo sapiens
atataaacatatttttatacttt

SEQ ID NO: 4497604 - DNA, 13 bp, Homo sapiens
atataaagaatat

SEQ ID NO: 4497605 - DNA, 14 bp, Homo sapiens
atataaagaatata

SEQ ID NO: 4497606 - DNA, 15 bp, Homo sapiens
atataaagaatatat

SEQ ID NO: 4497607 - DNA, 18 bp, Homo sapiens
atataaagaatatatata

SEQ ID NO: 4497608 - DNA, 13 bp, Homo sapiens
atataaagtatag

SEQ ID NO: 4497609 - DNA, 20 bp, Homo sapiens
atataaagtattctttttct

SEQ ID NO: 4497610 - DNA, 13 bp, Homo sapiens
atataaatatatg

SEQ ID NO: 4497611 - DNA, 23 bp, Homo sapiens
atataaatatattttctttctag

SEQ ID NO: 4497612 - DNA, 14 bp, Homo sapiens
atataaatgtgtgt

SEQ ID NO: 4497613 - DNA, 16 bp, Homo sapiens
atataaatgtgtgtat

SEQ ID NO: 4497614 - DNA, 14 bp, Homo sapiens
atataaatgtttat

SEQ ID NO: 4497615 - DNA, 21 bp, Homo sapiens
atataaatgtttatattgttt

SEQ ID NO: 4497616 - DNA, 22 bp, Homo sapiens
atataaattcactttcattttt

SEQ ID NO: 4497617 - DNA, 14 bp, Homo sapiens
atataactatttta

SEQ ID NO: 4497618 - DNA, 19 bp, Homo sapiens
atataactattttaaatat

SEQ ID NO: 4497619 - DNA, 17 bp, Homo sapiens
atataactgtatttgaa

SEQ ID NO: 4497620 - DNA, 20 bp, Homo sapiens
atataactgtatttgaaata

SEQ ID NO: 4497621 - DNA, 13 bp, Homo sapiens
atataactgtctt

SEQ ID NO: 4497622 - DNA, 14 bp, Homo sapiens
atataactgtcttg

SEQ ID NO: 4497623 - DNA, 18 bp, Homo sapiens
atataactgtcttgtttc

SEQ ID NO: 4497624 - DNA, 19 bp, Homo sapiens
atataactgtcttgtttca

SEQ ID NO: 4497625 - DNA, 22 bp, Homo sapiens
atataactgtcttgtttcagtg

SEQ ID NO: 4497626 - DNA, 11 bp, Homo sapiens
atataagaaaa

SEQ ID NO: 4497627 - DNA, 12 bp, Homo sapiens
atataagctttt

SEQ ID NO: 4497628 - DNA, 22 bp, Homo sapiens
atataagtaaagtgattaaagt

SEQ ID NO: 4497629 - DNA, 15 bp, Homo sapiens
atagacattctcaca

SEQ ID NO: 4497630 - DNA, 16 bp, Homo sapiens
atagacattctcacat

SEQ ID NO: 4497631 - DNA, 22 bp, Homo sapiens
atagaccactgggtttggcaaa

SEQ ID NO: 4497632 - DNA, 18 bp, Homo sapiens
atagacctctagtagctg

SEQ ID NO: 4497633 - DNA, 17 bp, Homo sapiens
atagactagagaaaccg

SEQ ID NO: 4497634 - DNA, 13 bp, Homo sapiens
atagagaatgttc

SEQ ID NO: 4497635 - DNA, 17 bp, Homo sapiens
atagagaatgttccaga

SEQ ID NO: 4497636 - DNA, 20 bp, Homo sapiens
atagagcaaaatcaacatga

SEQ ID NO: 4497637 - DNA, 22 bp, Homo sapiens
atagaggatggtcttacagcag

SEQ ID NO: 4497638 - DNA, 18 bp, Homo sapiens
atagaggcttctccgcca

SEQ ID NO: 4497639 - DNA, 18 bp, Homo sapiens
atagaggtgatgctgcta

SEQ ID NO: 4497640 - DNA, 20 bp, Homo sapiens
atagataagagtagaaactg

SEQ ID NO: 4497641 - DNA, 19 bp, Homo sapiens
atagatgtcttttatagtg

SEQ ID NO: 4497642 - DNA, 21 bp, Homo sapiens
atagatgtcttttatagtgga

SEQ ID NO: 4497643 - DNA, 14 bp, Homo sapiens
atagatgtgtggac

SEQ ID NO: 4497644 - DNA, 12 bp, Homo sapiens
atagatgtttga

SEQ ID NO: 4497645 - DNA, 15 bp, Homo sapiens
atagattattataaa

SEQ ID NO: 4497646 - DNA, 16 bp, Homo sapiens
atagattattataaac

SEQ ID NO: 4497647 - DNA, 13 bp, Homo sapiens
atagattcacctg

SEQ ID NO: 4497648 - DNA, 15 bp, Homo sapiens
atagattcacctgta

SEQ ID NO: 4497649 - DNA, 19 bp, Homo sapiens
atagattcacctgtaaaac

SEQ ID NO: 4497650 - DNA, 14 bp, Homo sapiens
atagattgcaaata

SEQ ID NO: 4497651 - DNA, 21 bp, Homo sapiens
atagattgcaaatattggtta

SEQ ID NO: 4497652 - DNA, 22 bp, Homo sapiens
atagattgccccataacatagt

SEQ ID NO: 4497653 - DNA, 19 bp, Homo sapiens
atagatttaggagcagaaa

SEQ ID NO: 4497654 - DNA, 16 bp, Homo sapiens
atagatttctcctctt

SEQ ID NO: 4497655 - DNA, 16 bp, Homo sapiens
atagcaaaaatgtttt

SEQ ID NO: 4497656 - DNA, 19 bp, Homo sapiens
atagcaaaagaagaagttt

SEQ ID NO: 4497657 - DNA, 11 bp, Homo sapiens
atagcaataac

SEQ ID NO: 4497658 - DNA, 17 bp, Homo sapiens
atagcaataactgaaaa

SEQ ID NO: 4497659 - DNA, 22 bp, Homo sapiens
atagcactggtttgtttctcaa

SEQ ID NO: 4497660 - DNA, 15 bp, Homo sapiens
atagcactttcattg

SEQ ID NO: 4497661 - DNA, 12 bp, Homo sapiens
atagcagaaaga

SEQ ID NO: 4497662 - DNA, 16 bp, Homo sapiens
atagcagttataacag

SEQ ID NO: 4497663 - DNA, 20 bp, Homo sapiens
atagcagttataacagatgt

SEQ ID NO: 4497664 - DNA, 21 bp, Homo sapiens
atagcataaaatgaaatgcta

SEQ ID NO: 4497665 - DNA, 13 bp, Homo sapiens
atagccacatttg

SEQ ID NO: 4497666 - DNA, 16 bp, Homo sapiens
atagccacatttggaa

SEQ ID NO: 4497667 - DNA, 23 bp, Homo sapiens
atagccacatttggaatactttt

SEQ ID NO: 4497668 - DNA, 16 bp, Homo sapiens
atacatcacatcttat

SEQ ID NO: 4497669 - DNA, 15 bp, Homo sapiens
atacatgagaaagat

SEQ ID NO: 4497670 - DNA, 16 bp, Homo sapiens
atacatgatacatttt

SEQ ID NO: 4497671 - DNA, 18 bp, Homo sapiens
atacatgctaagagaagt

SEQ ID NO: 4497672 - DNA, 22 bp, Homo sapiens
atacatgctaagagaagtagaa

SEQ ID NO: 4497673 - DNA, 20 bp, Homo sapiens
atacatggaatcgaagtgtt

SEQ ID NO: 4497674 - DNA, 16 bp, Homo sapiens
atacatggtttaaagt

SEQ ID NO: 4497675 - DNA, 13 bp, Homo sapiens
atacattaaaata

SEQ ID NO: 4497676 - DNA, 15 bp, Homo sapiens
atacattaaaataac

SEQ ID NO: 4497677 - DNA, 15 bp, Homo sapiens
atacattaaggagca

SEQ ID NO: 4497678 - DNA, 22 bp, Homo sapiens
atacatttgtggtcacatgctt

SEQ ID NO: 4497679 - DNA, 18 bp, Homo sapiens
atacattttataatgatg

SEQ ID NO: 4497680 - DNA, 22 bp, Homo sapiens
atacattttataatgatgaact

SEQ ID NO: 4497681 - DNA, 18 bp, Homo sapiens
ataccaaggtacaactgt

SEQ ID NO: 4497682 - DNA, 19 bp, Homo sapiens
ataccaagttgatacttga

SEQ ID NO: 4497683 - DNA, 19 bp, Homo sapiens
ataccaatgaaaaaatgta

SEQ ID NO: 4497684 - DNA, 15 bp, Homo sapiens
ataccacaagacatt

SEQ ID NO: 4497685 - DNA, 13 bp, Homo sapiens
ataccacaagcct

SEQ ID NO: 4497686 - DNA, 19 bp, Homo sapiens
ataccagcagcaactgaaa

SEQ ID NO: 4497687 - DNA, 17 bp, Homo sapiens
atacccaacagtttatt

SEQ ID NO: 4497688 - DNA, 22 bp, Homo sapiens
atacccaacagtttatttttat

SEQ ID NO: 4497689 - DNA, 14 bp, Homo sapiens
atacccacccagaa

SEQ ID NO: 4497690 - DNA, 15 bp, Homo sapiens
ataccccaaattgtg

SEQ ID NO: 4497691 - DNA, 23 bp, Homo sapiens
ataccccgtctctactaaaaata

SEQ ID NO: 4497692 - DNA, 14 bp, Homo sapiens
atacctcaattttt

SEQ ID NO: 4497693 - DNA, 23 bp, Homo sapiens
atacctgattgatcacacagtgt

SEQ ID NO: 4497694 - DNA, 11 bp, Homo sapiens
atacctggagc

SEQ ID NO: 4497695 - DNA, 22 bp, Homo sapiens
atacctgttcctttttctgggt

SEQ ID NO: 4497696 - DNA, 18 bp, Homo sapiens
ataccttatatatgcact

SEQ ID NO: 4497697 - DNA, 13 bp, Homo sapiens
ataccttcttatt

SEQ ID NO: 4497698 - DNA, 19 bp, Homo sapiens
ataccttttctcacaaaaa

SEQ ID NO: 4497699 - DNA, 20 bp, Homo sapiens
atacgaaaaagtgattgtga

SEQ ID NO: 4497700 - DNA, 22 bp, Homo sapiens
atacgaaaaagtgattgtgaag

SEQ ID NO: 4497701 - DNA, 16 bp, Homo sapiens
atacgagagcagaggt

SEQ ID NO: 4497702 - DNA, 16 bp, Homo sapiens
ataatagtcaatttct

SEQ ID NO: 4497703 - DNA, 12 bp, Homo sapiens
ataatatagctt

SEQ ID NO: 4497704 - DNA, 15 bp, Homo sapiens
ataatatattgtgtt

SEQ ID NO: 4497705 - DNA, 17 bp, Homo sapiens
ataatatattgtgttga

SEQ ID NO: 4497706 - DNA, 14 bp, Homo sapiens
ataatatatttctt

SEQ ID NO: 4497707 - DNA, 13 bp, Homo sapiens
ataatatcattta

SEQ ID NO: 4497708 - DNA, 22 bp, Homo sapiens
ataatatgtttagttttacatt

SEQ ID NO: 4497709 - DNA, 12 bp, Homo sapiens
ataatattcagc

SEQ ID NO: 4497710 - DNA, 12 bp, Homo sapiens
ataatattgaaa

SEQ ID NO: 4497711 - DNA, 14 bp, Homo sapiens
ataatattgaaaat

SEQ ID NO: 4497712 - DNA, 16 bp, Homo sapiens
ataatattgtttttct

SEQ ID NO: 4497713 - DNA, 20 bp, Homo sapiens
ataatatttcaagtgcctag

SEQ ID NO: 4497714 - DNA, 15 bp, Homo sapiens
ataatatttctgaaa

SEQ ID NO: 4497715 - DNA, 17 bp, Homo sapiens
ataatcaaatacatttt

SEQ ID NO: 4497716 - DNA, 21 bp, Homo sapiens
ataatcaaatgatttcatatt

SEQ ID NO: 4497717 - DNA, 19 bp, Homo sapiens
ataatcatcaagtaataca

SEQ ID NO: 4497718 - DNA, 14 bp, Homo sapiens
ataatcatgctcat

SEQ ID NO: 4497719 - DNA, 14 bp, Homo sapiens
ataatcattacctt

SEQ ID NO: 4497720 - DNA, 14 bp, Homo sapiens
ataatcccagcatt

SEQ ID NO: 4497721 - DNA, 14 bp, Homo sapiens
ataatcccagctac

SEQ ID NO: 4497722 - DNA, 17 bp, Homo sapiens
ataatctatattaaatg

SEQ ID NO: 4497723 - DNA, 14 bp, Homo sapiens
ataatctatttaca

SEQ ID NO: 4497724 - DNA, 18 bp, Homo sapiens
ataatctctccattcccg

SEQ ID NO: 4497725 - DNA, 14 bp, Homo sapiens
ataatcttctgcct

SEQ ID NO: 4497726 - DNA, 21 bp, Homo sapiens
ataatgaaaataaaacacacc

SEQ ID NO: 4497727 - DNA, 13 bp, Homo sapiens
ataatgaacagaa

SEQ ID NO: 4497728 - DNA, 15 bp, Homo sapiens
ataatgacttttaaa

SEQ ID NO: 4497729 - DNA, 15 bp, Homo sapiens
ataatgagctattaa

SEQ ID NO: 4497730 - DNA, 10 bp, Homo sapiens
ataatgagga

SEQ ID NO: 4497731 - DNA, 19 bp, Homo sapiens
ataatgatcgaaaaaataa

SEQ ID NO: 4497732 - DNA, 20 bp, Homo sapiens
ataatgatcgaaaaaataat

SEQ ID NO: 4497733 - DNA, 16 bp, Homo sapiens
agtttttcatactgta

SEQ ID NO: 4497734 - DNA, 20 bp, Homo sapiens
agtttttcatactgtacaca

SEQ ID NO: 4497735 - DNA, 15 bp, Homo sapiens
agtttttcattttaa

SEQ ID NO: 4497736 - DNA, 22 bp, Homo sapiens
agtttttggagtgttatgtatt

SEQ ID NO: 4497737 - DNA, 13 bp, Homo sapiens
ataaaaaaaaata

SEQ ID NO: 4497738 - DNA, 13 bp, Homo sapiens
ataaaaaagaaaa

SEQ ID NO: 4497739 - DNA, 19 bp, Homo sapiens
ataaaaaagaaaacttgtg

SEQ ID NO: 4497740 - DNA, 18 bp, Homo sapiens
ataaaaaagtctctattt

SEQ ID NO: 4497741 - DNA, 17 bp, Homo sapiens
ataaaaaatatgtattt

SEQ ID NO: 4497742 - DNA, 13 bp, Homo sapiens
ataaaaaatctga

SEQ ID NO: 4497743 - DNA, 16 bp, Homo sapiens
ataaaaaatctgaaga

SEQ ID NO: 4497744 - DNA, 17 bp, Homo sapiens
ataaaaaatctgaagag

SEQ ID NO: 4497745 - DNA, 23 bp, Homo sapiens
ataaaaaattaacttagttttta

SEQ ID NO: 4497746 - DNA, 19 bp, Homo sapiens
ataaaaacacaccttaaaa

SEQ ID NO: 4497747 - DNA, 19 bp, Homo sapiens
ataaaaacattttgaagtg

SEQ ID NO: 4497748 - DNA, 16 bp, Homo sapiens
ataaaaactgatttgc

SEQ ID NO: 4497749 - DNA, 22 bp, Homo sapiens
ataaaaagaggatgatttcaga

SEQ ID NO: 4497750 - DNA, 19 bp, Homo sapiens
ataaaaagataatctcagt

SEQ ID NO: 4497751 - DNA, 15 bp, Homo sapiens
ataaaaataaataga

SEQ ID NO: 4497752 - DNA, 19 bp, Homo sapiens
ataaaaatataaattgtac

SEQ ID NO: 4497753 - DNA, 17 bp, Homo sapiens
ataaaaatgatctaaac

SEQ ID NO: 4497754 - DNA, 13 bp, Homo sapiens
ataaaaatgcatt

SEQ ID NO: 4497755 - DNA, 15 bp, Homo sapiens
aggctacagaactaa

SEQ ID NO: 4497756 - DNA, 13 bp, Homo sapiens
aggctacagctcc

SEQ ID NO: 4497757 - DNA, 12 bp, Homo sapiens
aggctacagggc

SEQ ID NO: 4497758 - DNA, 14 bp, Homo sapiens
aggctacagggcca

SEQ ID NO: 4497759 - DNA, 14 bp, Homo sapiens
aggctactgttctt

SEQ ID NO: 4497760 - DNA, 16 bp, Homo sapiens
aggctagagacagatg

SEQ ID NO: 4497761 - DNA, 22 bp, Homo sapiens
aggctagagacagatgctggtg

SEQ ID NO: 4497762 - DNA, 16 bp, Homo sapiens
aggctagccctgccct

SEQ ID NO: 4497763 - DNA, 15 bp, Homo sapiens
aggctagcttctgct

SEQ ID NO: 4497764 - DNA, 18 bp, Homo sapiens
aggctagcttctgctttt

SEQ ID NO: 4497765 - DNA, 19 bp, Homo sapiens
aggctagggtggggagaga

SEQ ID NO: 4497766 - DNA, 19 bp, Homo sapiens
aggctatcctgctgaaagt

SEQ ID NO: 4497767 - DNA, 21 bp, Homo sapiens
aggctatggggatagatgtgt

SEQ ID NO: 4497768 - DNA, 22 bp, Homo sapiens
aggctatggggatagatgtgtg

SEQ ID NO: 4497769 - DNA, 23 bp, Homo sapiens
aggctcaaaaacttgatcacatg

SEQ ID NO: 4497770 - DNA, 16 bp, Homo sapiens
aggctcaagtttttat

SEQ ID NO: 4497771 - DNA, 12 bp, Homo sapiens
aggctcactgcc

SEQ ID NO: 4497772 - DNA, 14 bp, Homo sapiens
aggctcactgccag

SEQ ID NO: 4497773 - DNA, 16 bp, Homo sapiens
aggctcactgccaggc

SEQ ID NO: 4497774 - DNA, 19 bp, Homo sapiens
aggctcactgccaggccag

SEQ ID NO: 4497775 - DNA, 21 bp, Homo sapiens
aggctcactgccaggccagcc

SEQ ID NO: 4497776 - DNA, 19 bp, Homo sapiens
aggctcagactgggcactg

SEQ ID NO: 4497777 - DNA, 14 bp, Homo sapiens
aggctcagagatgt

SEQ ID NO: 4497778 - DNA, 21 bp, Homo sapiens
aggctcagagatgtgcaccca

SEQ ID NO: 4497779 - DNA, 20 bp, Homo sapiens
aggctcagtggtgggagaga

SEQ ID NO: 4497780 - DNA, 22 bp, Homo sapiens
aggctcatctttctgcccggct

SEQ ID NO: 4497781 - DNA, 15 bp, Homo sapiens
aggctcatttaaaac

SEQ ID NO: 4497782 - DNA, 16 bp, Homo sapiens
aggctcatttaaaaca

SEQ ID NO: 4497783 - DNA, 18 bp, Homo sapiens
aggctcatttaaaacagg

SEQ ID NO: 4497784 - DNA, 20 bp, Homo sapiens
aggctccagctctggcacag

SEQ ID NO: 4497785 - DNA, 15 bp, Homo sapiens
aggctccccgcctcc

SEQ ID NO: 4497786 - DNA, 18 bp, Homo sapiens
aggctccccgcctccact

SEQ ID NO: 4497787 - DNA, 22 bp, Homo sapiens
aggctcccggggcctggacagg

SEQ ID NO: 4497788 - DNA, 18 bp, Homo sapiens
aggctccgggcaccaggg

SEQ ID NO: 4497789 - DNA, 19 bp, Homo sapiens
aggctccgggcaccagggg

SEQ ID NO: 4497790 - DNA, 23 bp, Homo sapiens
aggctccgggcaccaggggccaa

SEQ ID NO: 4497791 - DNA, 12 bp, Homo sapiens
aggctcctcctt

SEQ ID NO: 4497792 - DNA, 19 bp, Homo sapiens
aggctcctccttgcccaga

SEQ ID NO: 4497793 - DNA, 22 bp, Homo sapiens
aggctctcccctctcgccccat

SEQ ID NO: 4497794 - DNA, 20 bp, Homo sapiens
aggctctcgctgccctgtgg

SEQ ID NO: 4497795 - DNA, 17 bp, Homo sapiens
aggctctgtgctgaccc

SEQ ID NO: 4497796 - DNA, 18 bp, Homo sapiens
aggctctgtgctgaccct

SEQ ID NO: 4497797 - DNA, 19 bp, Homo sapiens
aggctcttatgtgtgcctt

SEQ ID NO: 4497798 - DNA, 20 bp, Homo sapiens
aggctgagaaggaacaggga

SEQ ID NO: 4497799 - DNA, 17 bp, Homo sapiens
aggctgagacaggagaa

SEQ ID NO: 4497800 - DNA, 15 bp, Homo sapiens
aggctgaggcagaag

SEQ ID NO: 4497801 - DNA, 15 bp, Homo sapiens
aggctgaggcaggag

SEQ ID NO: 4497802 - DNA, 13 bp, Homo sapiens
aggctgaggtggt

SEQ ID NO: 4497803 - DNA, 15 bp, Homo sapiens
aggctgatgggcaaa

SEQ ID NO: 4497804 - DNA, 19 bp, Homo sapiens
aggctgcagaggcacctca

SEQ ID NO: 4497805 - DNA, 18 bp, Homo sapiens
aggctgcagtcagccctg

SEQ ID NO: 4497806 - DNA, 16 bp, Homo sapiens
aggctgcagtggctcc

SEQ ID NO: 4497807 - DNA, 22 bp, Homo sapiens
aggctgcagtggctcccctgcc

SEQ ID NO: 4497808 - DNA, 14 bp, Homo sapiens
aggctgccagtgcc

SEQ ID NO: 4497809 - DNA, 15 bp, Homo sapiens
aggctgccagtgcct

SEQ ID NO: 4497810 - DNA, 19 bp, Homo sapiens
aggctgccagtgcctgggt

SEQ ID NO: 4497811 - DNA, 12 bp, Homo sapiens
aggctgcccccg

SEQ ID NO: 4497812 - DNA, 22 bp, Homo sapiens
aggctgcccccggccccctggt

SEQ ID NO: 4497813 - DNA, 18 bp, Homo sapiens
aggctgcctcctgccctt

SEQ ID NO: 4497814 - DNA, 15 bp, Homo sapiens
aggctgctggcgcct

SEQ ID NO: 4497815 - DNA, 20 bp, Homo sapiens
aggctgctggcgcctctgca

SEQ ID NO: 4497816 - DNA, 14 bp, Homo sapiens
aggctggaaatggt

SEQ ID NO: 4497817 - DNA, 20 bp, Homo sapiens
aggctggactgcagtggcct

SEQ ID NO: 4497818 - DNA, 15 bp, Homo sapiens
aggctggagaccccc

SEQ ID NO: 4497819 - DNA, 13 bp, Homo sapiens
aggctggaggcag

SEQ ID NO: 4497820 - DNA, 14 bp, Homo sapiens
aggctggaggcagg

SEQ ID NO: 4497821 - DNA, 15 bp, Homo sapiens
aggctggaggcaggg

SEQ ID NO: 4497822 - DNA, 15 bp, Homo sapiens
aggctggcaggtatg

SEQ ID NO: 4497823 - DNA, 17 bp, Homo sapiens
aggctggccagtgctgc

SEQ ID NO: 4497824 - DNA, 18 bp, Homo sapiens
aggctgggaactcatctg

SEQ ID NO: 4497825 - DNA, 19 bp, Homo sapiens
aggctgggagtccctacct

SEQ ID NO: 4497826 - DNA, 13 bp, Homo sapiens
aggctggggaggt

SEQ ID NO: 4497827 - DNA, 20 bp, Homo sapiens
aggctggggaggtgctgggg

SEQ ID NO: 4497828 - DNA, 19 bp, Homo sapiens
aggctggggccccatcttg

SEQ ID NO: 4497829 - DNA, 22 bp, Homo sapiens
aggctggggccccatcttgatc

SEQ ID NO: 4497830 - DNA, 12 bp, Homo sapiens
aggctgggtcct

SEQ ID NO: 4497831 - DNA, 19 bp, Homo sapiens
aggctgggtcctgccagct

SEQ ID NO: 4497832 - DNA, 19 bp, Homo sapiens
aggctggtaagagaagtga

SEQ ID NO: 4497833 - DNA, 20 bp, Homo sapiens
aggctgtaactgagagaaag

SEQ ID NO: 4497834 - DNA, 19 bp, Homo sapiens
aggctgtgctccgccatgg

SEQ ID NO: 4497835 - DNA, 16 bp, Homo sapiens
aggctgtgtgtcttct

SEQ ID NO: 4497836 - DNA, 18 bp, Homo sapiens
aggctgtgtgtcttctgc

SEQ ID NO: 4497837 - DNA, 22 bp, Homo sapiens
aggctgtgtgtcttctgcccca

SEQ ID NO: 4497838 - DNA, 19 bp, Homo sapiens
aggctgttaaatacaggaa

SEQ ID NO: 4497839 - DNA, 12 bp, Homo sapiens
aggctgttctca

SEQ ID NO: 4497840 - DNA, 12 bp, Homo sapiens
aggctgttctgt

SEQ ID NO: 4497841 - DNA, 19 bp, Homo sapiens
aggctgtttttggctgttt

SEQ ID NO: 4497842 - DNA, 10 bp, Homo sapiens
aggcttcctg

SEQ ID NO: 4497843 - DNA, 22 bp, Homo sapiens
aggcttctccgccagcctcctc

SEQ ID NO: 4497844 - DNA, 18 bp, Homo sapiens
aggcttctcctgttttat

SEQ ID NO: 4497845 - DNA, 16 bp, Homo sapiens
aggcttcttcagatca

SEQ ID NO: 4497846 - DNA, 22 bp, Homo sapiens
aggcttcttcagatcagtgctt

SEQ ID NO: 4497847 - DNA, 16 bp, Homo sapiens
aggcttgaaggccagc

SEQ ID NO: 4497848 - DNA, 21 bp, Homo sapiens
aggcttgggatttgctgtgta

SEQ ID NO: 4497849 - DNA, 21 bp, Homo sapiens
aggcttgttccaatgccacat

SEQ ID NO: 4497850 - DNA, 13 bp, Homo sapiens
aggctttaaaagt

SEQ ID NO: 4497851 - DNA, 19 bp, Homo sapiens
aggcttttctcaggagctt

SEQ ID NO: 4497852 - DNA, 15 bp, Homo sapiens
aggctttttcagtga

SEQ ID NO: 4497853 - DNA, 22 bp, Homo sapiens
agttggcttctgtttctagttg

SEQ ID NO: 4497854 - DNA, 16 bp, Homo sapiens
agttgggcagccagga

SEQ ID NO: 4497855 - DNA, 21 bp, Homo sapiens
agttgggtagaaaaattatta

SEQ ID NO: 4497856 - DNA, 16 bp, Homo sapiens
agttggtttggatttt

SEQ ID NO: 4497857 - DNA, 16 bp, Homo sapiens
agttgtagacaaagta

SEQ ID NO: 4497858 - DNA, 20 bp, Homo sapiens
agttgtatttaacagaaatt

SEQ ID NO: 4497859 - DNA, 22 bp, Homo sapiens
agttgtatttaacagaaattgt

SEQ ID NO: 4497860 - DNA, 16 bp, Homo sapiens
agttgtcaaagaagct

SEQ ID NO: 4497861 - DNA, 21 bp, Homo sapiens
agttgtcctcagccaaggaaa

SEQ ID NO: 4497862 - DNA, 14 bp, Homo sapiens
agttgtctctcttc

SEQ ID NO: 4497863 - DNA, 12 bp, Homo sapiens
agttgtgctaaa

SEQ ID NO: 4497864 - DNA, 14 bp, Homo sapiens
agttgtgcttgttt

SEQ ID NO: 4497865 - DNA, 14 bp, Homo sapiens
agttgtgggcaaca

SEQ ID NO: 4497866 - DNA, 21 bp, Homo sapiens
agttgtgtgaataccccaaga

SEQ ID NO: 4497867 - DNA, 16 bp, Homo sapiens
agttgttaataaaagt

SEQ ID NO: 4497868 - DNA, 17 bp, Homo sapiens
agttgttatttattgaa

SEQ ID NO: 4497869 - DNA, 13 bp, Homo sapiens
agttgttgactgt

SEQ ID NO: 4497870 - DNA, 15 bp, Homo sapiens
agttgttgccctggg

SEQ ID NO: 4497871 - DNA, 10 bp, Homo sapiens
agtaatttat

SEQ ID NO: 4497872 - DNA, 19 bp, Homo sapiens
agtaatttattgtctgtct

SEQ ID NO: 4497873 - DNA, 15 bp, Homo sapiens
agtctctatttaaat

SEQ ID NO: 4497874 - DNA, 20 bp, Homo sapiens
agtctctatttaaattcttt

SEQ ID NO: 4497875 - DNA, 21 bp, Homo sapiens
agtctctatttaaattctttt

SEQ ID NO: 4497876 - DNA, 22 bp, Homo sapiens
agtctcttagaatttgtttcat

SEQ ID NO: 4497877 - DNA, 17 bp, Homo sapiens
agggcgggcagagggct

SEQ ID NO: 4497878 - DNA, 19 bp, Homo sapiens
agggcgggcagagggctgg

SEQ ID NO: 4497879 - DNA, 16 bp, Homo sapiens
agggcgtgactcaccc

SEQ ID NO: 4497880 - DNA, 14 bp, Homo sapiens
agggcgtgaggaac

SEQ ID NO: 4497881 - DNA, 20 bp, Homo sapiens
agggctaaaaaggtcctgta

SEQ ID NO: 4497882 - DNA, 23 bp, Homo sapiens
agggctaagagctagcgctgccg

SEQ ID NO: 4497883 - DNA, 18 bp, Homo sapiens
agggctaccctgagctga

SEQ ID NO: 4497884 - DNA, 20 bp, Homo sapiens
agggctaccctgagctgagg

SEQ ID NO: 4497885 - DNA, 21 bp, Homo sapiens
agggctaccctgagctgaggc

SEQ ID NO: 4497886 - DNA, 22 bp, Homo sapiens
agggctaccctgagctgaggca

SEQ ID NO: 4497887 - DNA, 23 bp, Homo sapiens
agggctaccctgagctgaggcag

SEQ ID NO: 4497888 - DNA, 17 bp, Homo sapiens
agggctagaacctagaa

SEQ ID NO: 4497889 - DNA, 22 bp, Homo sapiens
agggctagaacctagaagggct

SEQ ID NO: 4497890 - DNA, 19 bp, Homo sapiens
agggctagaacctggagaa

SEQ ID NO: 4497891 - DNA, 13 bp, Homo sapiens
agggtgggagtgg

SEQ ID NO: 4497892 - DNA, 17 bp, Homo sapiens
agggtgggatggaggag

SEQ ID NO: 4497893 - DNA, 20 bp, Homo sapiens
agggtgggtgagctctcagg

SEQ ID NO: 4497894 - DNA, 21 bp, Homo sapiens
agggtgggtgagctctcaggc

SEQ ID NO: 4497895 - DNA, 20 bp, Homo sapiens
agggtgtatagtgttcacaa

SEQ ID NO: 4497896 - DNA, 16 bp, Homo sapiens
agggtgtggctttcca

SEQ ID NO: 4497897 - DNA, 21 bp, Homo sapiens
agggtgtggctttccaggcac

SEQ ID NO: 4497898 - DNA, 11 bp, Homo sapiens
agggtgtgtga

SEQ ID NO: 4497899 - DNA, 12 bp, Homo sapiens
agggtgtttcct

SEQ ID NO: 4497900 - DNA, 16 bp, Homo sapiens
agggtgtttcctctaa

SEQ ID NO: 4497901 - DNA, 17 bp, Homo sapiens
agggtgtttcctctaaa

SEQ ID NO: 4497902 - DNA, 14 bp, Homo sapiens
agggttctgcctct

SEQ ID NO: 4497903 - DNA, 20 bp, Homo sapiens
agggttctgcctctccaggc

SEQ ID NO: 4497904 - DNA, 18 bp, Homo sapiens
agggttctgcttttaagt

SEQ ID NO: 4497905 - DNA, 16 bp, Homo sapiens
agggttgcttgcttgc

SEQ ID NO: 4497906 - DNA, 20 bp, Homo sapiens
agggtttatgtttaggatgt

SEQ ID NO: 4497907 - DNA, 12 bp, Homo sapiens
agggtttctctg

SEQ ID NO: 4497908 - DNA, 15 bp, Homo sapiens
agggtttggacagac

SEQ ID NO: 4497909 - DNA, 18 bp, Homo sapiens
agggtttgtaatacttta

SEQ ID NO: 4497910 - DNA, 17 bp, Homo sapiens
aggtaaaacaactacat

SEQ ID NO: 4497911 - DNA, 15 bp, Homo sapiens
aggtaaaatgtattt

SEQ ID NO: 4497912 - DNA, 19 bp, Homo sapiens
aggtaaaatgtatttttct

SEQ ID NO: 4497913 - DNA, 19 bp, Homo sapiens
aggtaaagggcaaataatg

SEQ ID NO: 4497914 - DNA, 14 bp, Homo sapiens
aggtaaatcccaca

SEQ ID NO: 4497915 - DNA, 16 bp, Homo sapiens
aggtaaatcccacatc

SEQ ID NO: 4497916 - DNA, 22 bp, Homo sapiens
aggtaacaagagtatgtggcaa

SEQ ID NO: 4497917 - DNA, 19 bp, Homo sapiens
aggtaacacgggaatcaca

SEQ ID NO: 4497918 - DNA, 18 bp, Homo sapiens
aggtaactaactgcatac

SEQ ID NO: 4497919 - DNA, 22 bp, Homo sapiens
aggtaactatcaatatttaagt

SEQ ID NO: 4497920 - DNA, 18 bp, Homo sapiens
aggtaaggaaaaggattt

SEQ ID NO: 4497921 - DNA, 13 bp, Homo sapiens
aggtaagtttttt

SEQ ID NO: 4497922 - DNA, 24 bp, Homo sapiens
aggtaataaaagctttgactccct

SEQ ID NO: 4497923 - DNA, 14 bp, Homo sapiens
aggtaattattgct

SEQ ID NO: 4497924 - DNA, 17 bp, Homo sapiens
aggtaattccttagaga

SEQ ID NO: 4497925 - DNA, 19 bp, Homo sapiens
aggtacacctccccctgcg

SEQ ID NO: 4497926 - DNA, 21 bp, Homo sapiens
aggtacacctccccctgcgcc

SEQ ID NO: 4497927 - DNA, 21 bp, Homo sapiens
aggtaccactgatttggagat

SEQ ID NO: 4497928 - DNA, 16 bp, Homo sapiens
aggtaccgtctacatt

SEQ ID NO: 4497929 - DNA, 19 bp, Homo sapiens
aggtacgatgacagtgttc

SEQ ID NO: 4497930 - DNA, 13 bp, Homo sapiens
aggtagaaaaagg

SEQ ID NO: 4497931 - DNA, 22 bp, Homo sapiens
aggtagaattatctaatttata

SEQ ID NO: 4497932 - DNA, 18 bp, Homo sapiens
aggtagattttacagaga

SEQ ID NO: 4497933 - DNA, 15 bp, Homo sapiens
aggtagcctgctggt

SEQ ID NO: 4497934 - DNA, 18 bp, Homo sapiens
aggtaggctgcaaaatta

SEQ ID NO: 4497935 - DNA, 13 bp, Homo sapiens
aggtagtgggctc

SEQ ID NO: 4497936 - DNA, 19 bp, Homo sapiens
aggtagttgggtagaaaaa

SEQ ID NO: 4497937 - DNA, 23 bp, Homo sapiens
aggtagttgggtagaaaaattat

SEQ ID NO: 4497938 - DNA, 22 bp, Homo sapiens
aggtatggaagggtttgtggct

SEQ ID NO: 4497939 - DNA, 22 bp, Homo sapiens
aggtattacaagtaatgtaaag

SEQ ID NO: 4497940 - DNA, 19 bp, Homo sapiens
aggtatttttttaaatcaa

SEQ ID NO: 4497941 - DNA, 14 bp, Homo sapiens
aggtcaacattgtt

SEQ ID NO: 4497942 - DNA, 15 bp, Homo sapiens
aggtcaagtaataaa

SEQ ID NO: 4497943 - DNA, 20 bp, Homo sapiens
aggtcaataacactgtattt

SEQ ID NO: 4497944 - DNA, 12 bp, Homo sapiens
aggtcaccagca

SEQ ID NO: 4497945 - DNA, 16 bp, Homo sapiens
aggtcagcatgtctat

SEQ ID NO: 4497946 - DNA, 15 bp, Homo sapiens
aggtcagccactgtt

SEQ ID NO: 4497947 - DNA, 16 bp, Homo sapiens
aggtcaggacggctcc

SEQ ID NO: 4497948 - DNA, 23 bp, Homo sapiens
aggtcaggacggctcctcagagc

SEQ ID NO: 4497949 - DNA, 16 bp, Homo sapiens
aggtcagttgtaataa

SEQ ID NO: 4497950 - DNA, 23 bp, Homo sapiens
aggtcattaaaacagaagcaaat

SEQ ID NO: 4497951 - DNA, 15 bp, Homo sapiens
aggtccagacccact

SEQ ID NO: 4497952 - DNA, 13 bp, Homo sapiens
aggtccaggcccc

SEQ ID NO: 4497953 - DNA, 16 bp, Homo sapiens
aggtccaggcccccaa

SEQ ID NO: 4497954 - DNA, 23 bp, Homo sapiens
aggtccaggcccccaacccctcc

SEQ ID NO: 4497955 - DNA, 17 bp, Homo sapiens
aggtccaggtcccagcc

SEQ ID NO: 4497956 - DNA, 17 bp, Homo sapiens
aggtcccacgccaggcc

SEQ ID NO: 4497957 - DNA, 15 bp, Homo sapiens
aggtcccagcccctc

SEQ ID NO: 4497958 - DNA, 18 bp, Homo sapiens
aggtcccagcccctcctc

SEQ ID NO: 4497959 - DNA, 21 bp, Homo sapiens
aggtcccagcccctcctccct

SEQ ID NO: 4497960 - DNA, 23 bp, Homo sapiens
aggtcccagcccctcctccctca

SEQ ID NO: 4497961 - DNA, 19 bp, Homo sapiens
aggtccgtagctcccctgg

SEQ ID NO: 4497962 - DNA, 12 bp, Homo sapiens
aggtcctctcag

SEQ ID NO: 4497963 - DNA, 23 bp, Homo sapiens
aggtcctgcccatgtgtcccctc

SEQ ID NO: 4497964 - DNA, 20 bp, Homo sapiens
aggtctcataggttgagcaa

SEQ ID NO: 4497965 - DNA, 15 bp, Homo sapiens
aggtctcatctccca

SEQ ID NO: 4497966 - DNA, 18 bp, Homo sapiens
aggtctcatctcccaggc

SEQ ID NO: 4497967 - DNA, 23 bp, Homo sapiens
aggtctcatctcccaggccccag

SEQ ID NO: 4497968 - DNA, 18 bp, Homo sapiens
aggtctcattgcttctga

SEQ ID NO: 4497969 - DNA, 12 bp, Homo sapiens
aggtctgagccc

SEQ ID NO: 4497970 - DNA, 15 bp, Homo sapiens
aggtctgagccctgg

SEQ ID NO: 4497971 - DNA, 11 bp, Homo sapiens
aggtctgcctg

SEQ ID NO: 4497972 - DNA, 21 bp, Homo sapiens
aggtcttcatcgaatctacta

SEQ ID NO: 4497973 - DNA, 13 bp, Homo sapiens
aggtctttctctc

SEQ ID NO: 4497974 - DNA, 14 bp, Homo sapiens
aggtctttctctca

SEQ ID NO: 4497975 - DNA, 12 bp, Homo sapiens
aggtcttttcaa

SEQ ID NO: 4497976 - DNA, 14 bp, Homo sapiens
aggtcttttcaaat

SEQ ID NO: 4497977 - DNA, 17 bp, Homo sapiens
aggtcttttgagggcta

SEQ ID NO: 4497978 - DNA, 23 bp, Homo sapiens
aggtctttttttttcttcattgt

SEQ ID NO: 4497979 - DNA, 14 bp, Homo sapiens
aggtgaaagggagc

SEQ ID NO: 4497980 - DNA, 15 bp, Homo sapiens
aggtgaacaaggtaa

SEQ ID NO: 4497981 - DNA, 18 bp, Homo sapiens
aggtgacagtggctgctc

SEQ ID NO: 4497982 - DNA, 13 bp, Homo sapiens
aggtgagaaattt

SEQ ID NO: 4497983 - DNA, 18 bp, Homo sapiens
aggtgatatttttcttat

SEQ ID NO: 4497984 - DNA, 13 bp, Homo sapiens
aggtgatgctgct

SEQ ID NO: 4497985 - DNA, 12 bp, Homo sapiens
aggtgcaggtgc

SEQ ID NO: 4497986 - DNA, 21 bp, Homo sapiens
aggtgccatggaagaggctac

SEQ ID NO: 4497987 - DNA, 21 bp, Homo sapiens
aggtgcccagaataagttatt

SEQ ID NO: 4497988 - DNA, 19 bp, Homo sapiens
aggtgcctgtgaggcaggg

SEQ ID NO: 4497989 - DNA, 20 bp, Homo sapiens
aggtgcctgtgaggcagggg

SEQ ID NO: 4497990 - DNA, 21 bp, Homo sapiens
aggtgcctgtgaggcaggggc

SEQ ID NO: 4497991 - DNA, 22 bp, Homo sapiens
aggtgccttcttattctcactc

SEQ ID NO: 4497992 - DNA, 15 bp, Homo sapiens
aggtgcctttcaaat

SEQ ID NO: 4497993 - DNA, 22 bp, Homo sapiens
aggtgcgcgccaccgtgcctgg

SEQ ID NO: 4497994 - DNA, 23 bp, Homo sapiens
aggtgctaatttgttttggatat

SEQ ID NO: 4497995 - DNA, 18 bp, Homo sapiens
aggtgctacaaaaacaca

SEQ ID NO: 4497996 - DNA, 19 bp, Homo sapiens
aggtgctacaaaaacacag

SEQ ID NO: 4497997 - DNA, 20 bp, Homo sapiens
aggtgctacacccttttcca

SEQ ID NO: 4497998 - DNA, 21 bp, Homo sapiens
aggtgctacacccttttccag

SEQ ID NO: 4497999 - DNA, 23 bp, Homo sapiens
aggtgctgatgtcaaagtgtaac

SEQ ID NO: 4498000 - DNA, 16 bp, Homo sapiens
agggaaaattgcccca

SEQ ID NO: 4498001 - DNA, 17 bp, Homo sapiens
agggaaacagcctctct

SEQ ID NO: 4498002 - DNA, 19 bp, Homo sapiens
agggaaacagcctctctct

SEQ ID NO: 4498003 - DNA, 12 bp, Homo sapiens
agggaaaccttt

SEQ ID NO: 4498004 - DNA, 19 bp, Homo sapiens
agggaaactaagattcttt

SEQ ID NO: 4498005 - DNA, 15 bp, Homo sapiens
agggaaactggctga

SEQ ID NO: 4498006 - DNA, 19 bp, Homo sapiens
agggaaagatgtagaaaga

SEQ ID NO: 4498007 - DNA, 16 bp, Homo sapiens
agggaaatgtacactt

SEQ ID NO: 4498008 - DNA, 13 bp, Homo sapiens
agggaacagacag

SEQ ID NO: 4498009 - DNA, 14 bp, Homo sapiens
agggaacagacagg

SEQ ID NO: 4498010 - DNA, 18 bp, Homo sapiens
agggaacagacaggagaa

SEQ ID NO: 4498011 - DNA, 19 bp, Homo sapiens
agggaacagacaggagaaa

SEQ ID NO: 4498012 - DNA, 20 bp, Homo sapiens
agggaacagacaggagaaat

SEQ ID NO: 4498013 - DNA, 23 bp, Homo sapiens
agggaagaaaactatcctgcggg

SEQ ID NO: 4498014 - DNA, 19 bp, Homo sapiens
agggaagagacagcccagg

SEQ ID NO: 4498015 - DNA, 13 bp, Homo sapiens
agggaagctggcc

SEQ ID NO: 4498016 - DNA, 18 bp, Homo sapiens
agggaaggacagtccctg

SEQ ID NO: 4498017 - DNA, 22 bp, Homo sapiens
agggaaggacagtccctgctgg

SEQ ID NO: 4498018 - DNA, 17 bp, Homo sapiens
aggagtgcagccttctc

SEQ ID NO: 4498019 - DNA, 16 bp, Homo sapiens
aggagtgcccccggga

SEQ ID NO: 4498020 - DNA, 15 bp, Homo sapiens
aggagtgtcctgccc

SEQ ID NO: 4498021 - DNA, 18 bp, Homo sapiens
aggagtgtcctgcccatg

SEQ ID NO: 4498022 - DNA, 16 bp, Homo sapiens
aggagtgtcctggctg

SEQ ID NO: 4498023 - DNA, 20 bp, Homo sapiens
aggagttagaaccacagcag

SEQ ID NO: 4498024 - DNA, 23 bp, Homo sapiens
aggagttagaaccacagcagaca

SEQ ID NO: 4498025 - DNA, 19 bp, Homo sapiens
aggagttcaagaccagcct

SEQ ID NO: 4498026 - DNA, 20 bp, Homo sapiens
aggagtttattacaatgtat

SEQ ID NO: 4498027 - DNA, 22 bp, Homo sapiens
aggagtttattacaatgtatct

SEQ ID NO: 4498028 - DNA, 20 bp, Homo sapiens
aggagtttcctaaaagttca

SEQ ID NO: 4498029 - DNA, 21 bp, Homo sapiens
aggagtttgagaccagcttag

SEQ ID NO: 4498030 - DNA, 19 bp, Homo sapiens
aggagtttgagaccaggct

SEQ ID NO: 4498031 - DNA, 17 bp, Homo sapiens
aggagtttgaggctgca

SEQ ID NO: 4498032 - DNA, 21 bp, Homo sapiens
aggagttttaagtccagcttg

SEQ ID NO: 4498033 - DNA, 13 bp, Homo sapiens
aggatacatttaa

SEQ ID NO: 4498034 - DNA, 18 bp, Homo sapiens
aggatacatttaataaaa

SEQ ID NO: 4498035 - DNA, 16 bp, Homo sapiens
aggataccttcttatt

SEQ ID NO: 4498036 - DNA, 17 bp, Homo sapiens
aggatagctaactgtaa

SEQ ID NO: 4498037 - DNA, 20 bp, Homo sapiens
aggatagctaactgtaaatc

SEQ ID NO: 4498038 - DNA, 23 bp, Homo sapiens
aggatataagagggctttttaaa

SEQ ID NO: 4498039 - DNA, 15 bp, Homo sapiens
aggatatcagagctg

SEQ ID NO: 4498040 - DNA, 19 bp, Homo sapiens
aggatatgattaatattat

SEQ ID NO: 4498041 - DNA, 14 bp, Homo sapiens
aggatcacctgagg

SEQ ID NO: 4498042 - DNA, 15 bp, Homo sapiens
aggatcacctgaggt

SEQ ID NO: 4498043 - DNA, 19 bp, Homo sapiens
aggatcactttaggcctgg

SEQ ID NO: 4498044 - DNA, 13 bp, Homo sapiens
aggatcatctgaa

SEQ ID NO: 4498045 - DNA, 15 bp, Homo sapiens
aggatccagagagca

SEQ ID NO: 4498046 - DNA, 19 bp, Homo sapiens
aggatcggactctgcccct

SEQ ID NO: 4498047 - DNA, 19 bp, Homo sapiens
aggatctgctccaacagaa

SEQ ID NO: 4498048 - DNA, 19 bp, Homo sapiens
aggccagcaacattggcac

SEQ ID NO: 4498049 - DNA, 21 bp, Homo sapiens
aggccagcaggcgggctcctt

SEQ ID NO: 4498050 - DNA, 14 bp, Homo sapiens
aggccagcccagcc

SEQ ID NO: 4498051 - DNA, 17 bp, Homo sapiens
aggccagcccagccagg

SEQ ID NO: 4498052 - DNA, 18 bp, Homo sapiens
aggccagcccagccaggc

SEQ ID NO: 4498053 - DNA, 13 bp, Homo sapiens
aggccagccccac

SEQ ID NO: 4498054 - DNA, 21 bp, Homo sapiens
aggccagccccacccaggagg

SEQ ID NO: 4498055 - DNA, 14 bp, Homo sapiens
aggccagcctccga

SEQ ID NO: 4498056 - DNA, 22 bp, Homo sapiens
aggccagcctccgagagggaga

SEQ ID NO: 4498057 - DNA, 13 bp, Homo sapiens
aggccagctcagg

SEQ ID NO: 4498058 - DNA, 14 bp, Homo sapiens
aggccagctcagga

SEQ ID NO: 4498059 - DNA, 16 bp, Homo sapiens
aggccagctcaggaat

SEQ ID NO: 4498060 - DNA, 12 bp, Homo sapiens
aggccagctgcg

SEQ ID NO: 4498061 - DNA, 18 bp, Homo sapiens
aggccagctgcggccagg

SEQ ID NO: 4498062 - DNA, 17 bp, Homo sapiens
aggccaggtgcccagga

SEQ ID NO: 4498063 - DNA, 14 bp, Homo sapiens
aggccagtccccat

SEQ ID NO: 4498064 - DNA, 14 bp, Homo sapiens
aggccatctcagga

SEQ ID NO: 4498065 - DNA, 15 bp, Homo sapiens
aggccatctcaggag

SEQ ID NO: 4498066 - DNA, 19 bp, Homo sapiens
aggccatctcaggagatgg

SEQ ID NO: 4498067 - DNA, 14 bp, Homo sapiens
aggccattctttcc

SEQ ID NO: 4498068 - DNA, 18 bp, Homo sapiens
aggccattgtgaaccaat

SEQ ID NO: 4498069 - DNA, 19 bp, Homo sapiens
aggcccaaagcacttgctt

SEQ ID NO: 4498070 - DNA, 18 bp, Homo sapiens
aggcccaactggttcagg

SEQ ID NO: 4498071 - DNA, 12 bp, Homo sapiens
aggcccactccc

SEQ ID NO: 4498072 - DNA, 15 bp, Homo sapiens
aggcccagctgctcc

SEQ ID NO: 4498073 - DNA, 17 bp, Homo sapiens
aggcccaggagtccagg

SEQ ID NO: 4498074 - DNA, 18 bp, Homo sapiens
aggcccaggagtccaggc

SEQ ID NO: 4498075 - DNA, 15 bp, Homo sapiens
aggcccaggctggga

SEQ ID NO: 4498076 - DNA, 23 bp, Homo sapiens
aggcccatgtatataagtactga

SEQ ID NO: 4498077 - DNA, 19 bp, Homo sapiens
aggcccatttgagaagctg

SEQ ID NO: 4498078 - DNA, 16 bp, Homo sapiens
aggccccacctgaagg

SEQ ID NO: 4498079 - DNA, 11 bp, Homo sapiens
aggccccagac

SEQ ID NO: 4498080 - DNA, 14 bp, Homo sapiens
aggccccagagaga

SEQ ID NO: 4498081 - DNA, 19 bp, Homo sapiens
aggccccagagagaccctg

SEQ ID NO: 4498082 - DNA, 13 bp, Homo sapiens
aggccccagggga

SEQ ID NO: 4498083 - DNA, 14 bp, Homo sapiens
aggccccaggggag

SEQ ID NO: 4498084 - DNA, 21 bp, Homo sapiens
aggcccccaacccctcctccc

SEQ ID NO: 4498085 - DNA, 17 bp, Homo sapiens
aggcccccagcccctcc

SEQ ID NO: 4498086 - DNA, 20 bp, Homo sapiens
aggcccccagcccctcctcc

SEQ ID NO: 4498087 - DNA, 23 bp, Homo sapiens
aggcccccagcccctcctccctc

SEQ ID NO: 4498088 - DNA, 15 bp, Homo sapiens
aggcccccaggtgcc

SEQ ID NO: 4498089 - DNA, 21 bp, Homo sapiens
aggccccgaggacccagaccc

SEQ ID NO: 4498090 - DNA, 20 bp, Homo sapiens
aggccccgccccatgggccc

SEQ ID NO: 4498091 - DNA, 15 bp, Homo sapiens
aggccccgcttgtcc

SEQ ID NO: 4498092 - DNA, 17 bp, Homo sapiens
aggccccggtatgtgat

SEQ ID NO: 4498093 - DNA, 19 bp, Homo sapiens
aggcccctggaggctgcct

SEQ ID NO: 4498094 - DNA, 21 bp, Homo sapiens
aggcccctggaggctgcctcc

SEQ ID NO: 4498095 - DNA, 15 bp, Homo sapiens
aggcccggggctggc

SEQ ID NO: 4498096 - DNA, 19 bp, Homo sapiens
aggcccgtcagcatcactg

SEQ ID NO: 4498097 - DNA, 19 bp, Homo sapiens
aggccctcaatccaccttc

SEQ ID NO: 4498098 - DNA, 20 bp, Homo sapiens
aggccctcaatccaccttca

SEQ ID NO: 4498099 - DNA, 22 bp, Homo sapiens
aggccctccctgtctccagggc

SEQ ID NO: 4498100 - DNA, 17 bp, Homo sapiens
aggccctcgctgccagc

SEQ ID NO: 4498101 - DNA, 22 bp, Homo sapiens
aggccctcgctgccagctctgt

SEQ ID NO: 4498102 - DNA, 16 bp, Homo sapiens
aggccctcgggcccag

SEQ ID NO: 4498103 - DNA, 17 bp, Homo sapiens
aggccctcgggcccagc

SEQ ID NO: 4498104 - DNA, 18 bp, Homo sapiens
aggccctcgggcccagcc

SEQ ID NO: 4498105 - DNA, 19 bp, Homo sapiens
aggccctcgggcccagccc

SEQ ID NO: 4498106 - DNA, 20 bp, Homo sapiens
aggccctgactcctctggct

SEQ ID NO: 4498107 - DNA, 14 bp, Homo sapiens
aggccctgccccca

SEQ ID NO: 4498108 - DNA, 22 bp, Homo sapiens
aggccctgcccccaccccttcc

SEQ ID NO: 4498109 - DNA, 22 bp, Homo sapiens
aggcccttgtcggccccaccag

SEQ ID NO: 4498110 - DNA, 15 bp, Homo sapiens
aggccgagagcctta

SEQ ID NO: 4498111 - DNA, 20 bp, Homo sapiens
aggccgctgttcacccacag

SEQ ID NO: 4498112 - DNA, 14 bp, Homo sapiens
aggccggcccagat

SEQ ID NO: 4498113 - DNA, 16 bp, Homo sapiens
aggccgtcatttcatt

SEQ ID NO: 4498114 - DNA, 14 bp, Homo sapiens
aggccgtgccttgt

SEQ ID NO: 4498115 - DNA, 14 bp, Homo sapiens
aggcctaccccagt

SEQ ID NO: 4498116 - DNA, 18 bp, Homo sapiens
aggcctatttaacaagat

SEQ ID NO: 4498117 - DNA, 19 bp, Homo sapiens
aggcctcaactcctcccat

SEQ ID NO: 4498118 - DNA, 15 bp, Homo sapiens
aggcctccctctctc

SEQ ID NO: 4498119 - DNA, 23 bp, Homo sapiens
aggcctctcggtgctccatctcc

SEQ ID NO: 4498120 - DNA, 15 bp, Homo sapiens
aggcctctctctgct

SEQ ID NO: 4498121 - DNA, 16 bp, Homo sapiens
aggcctctctctgctc

SEQ ID NO: 4498122 - DNA, 18 bp, Homo sapiens
aggcctctctctgctcca

SEQ ID NO: 4498123 - DNA, 16 bp, Homo sapiens
aggcctctgctggctc

SEQ ID NO: 4498124 - DNA, 19 bp, Homo sapiens
aggcctctggttgcctccc

SEQ ID NO: 4498125 - DNA, 21 bp, Homo sapiens
aggcctgagatttcatctgct

SEQ ID NO: 4498126 - DNA, 18 bp, Homo sapiens
aggcctgcaaaccttcct

SEQ ID NO: 4498127 - DNA, 22 bp, Homo sapiens
aggcctgcaaaccttcctggga

SEQ ID NO: 4498128 - DNA, 22 bp, Homo sapiens
aggcctgcctcccacttcactg

SEQ ID NO: 4498129 - DNA, 20 bp, Homo sapiens
aggcctgcgggcccctggtg

SEQ ID NO: 4498130 - DNA, 21 bp, Homo sapiens
aggcctgcgggcccctggtga

SEQ ID NO: 4498131 - DNA, 16 bp, Homo sapiens
aggcctgctagtcact

SEQ ID NO: 4498132 - DNA, 15 bp, Homo sapiens
aggcctgctcaggga

SEQ ID NO: 4498133 - DNA, 18 bp, Homo sapiens
aggcctgctcagggactg

SEQ ID NO: 4498134 - DNA, 20 bp, Homo sapiens
aggcctgctgccagtgcagc

SEQ ID NO: 4498135 - DNA, 13 bp, Homo sapiens
aggcctggcctca

SEQ ID NO: 4498136 - DNA, 16 bp, Homo sapiens
aggcctggcctcatct

SEQ ID NO: 4498137 - DNA, 21 bp, Homo sapiens
aggcctggctggaggagcagc

SEQ ID NO: 4498138 - DNA, 18 bp, Homo sapiens
aggcctggggaggcccta

SEQ ID NO: 4498139 - DNA, 22 bp, Homo sapiens
aggcctgtcccaattctgcccg

SEQ ID NO: 4498140 - DNA, 18 bp, Homo sapiens
aggcctgtccctgggagt

SEQ ID NO: 4498141 - DNA, 14 bp, Homo sapiens
aggccttaacaaac

SEQ ID NO: 4498142 - DNA, 13 bp, Homo sapiens
aggaccctgacct

SEQ ID NO: 4498143 - DNA, 13 bp, Homo sapiens
aggaccgtgccct

SEQ ID NO: 4498144 - DNA, 14 bp, Homo sapiens
aggaccgttttgta

SEQ ID NO: 4498145 - DNA, 18 bp, Homo sapiens
aggacctgtatttaagca

SEQ ID NO: 4498146 - DNA, 23 bp, Homo sapiens
aggaccttctggtggttctgctg

SEQ ID NO: 4498147 - DNA, 16 bp, Homo sapiens
aggacctttctgagga

SEQ ID NO: 4498148 - DNA, 16 bp, Homo sapiens
aggacgccactcattt

SEQ ID NO: 4498149 - DNA, 17 bp, Homo sapiens
aggacgccactcatttc

SEQ ID NO: 4498150 - DNA, 18 bp, Homo sapiens
aggacgccactcatttca

SEQ ID NO: 4498151 - DNA, 19 bp, Homo sapiens
aggacgccactcatttcat

SEQ ID NO: 4498152 - DNA, 15 bp, Homo sapiens
aggacggctcctcag

SEQ ID NO: 4498153 - DNA, 13 bp, Homo sapiens
aggacggctgagc

SEQ ID NO: 4498154 - DNA, 20 bp, Homo sapiens
aggactccaggcccaaggct

SEQ ID NO: 4498155 - DNA, 23 bp, Homo sapiens
aggactccaggcccaaggctccc

SEQ ID NO: 4498156 - DNA, 13 bp, Homo sapiens
aggactccctcct

SEQ ID NO: 4498157 - DNA, 18 bp, Homo sapiens
aggactccctcctcacct

SEQ ID NO: 4498158 - DNA, 17 bp, Homo sapiens
aggactgaattgtcccc

SEQ ID NO: 4498159 - DNA, 20 bp, Homo sapiens
aggactgaattgtccccagt

SEQ ID NO: 4498160 - DNA, 21 bp, Homo sapiens
aggactggtgaatataaatga

SEQ ID NO: 4498161 - DNA, 13 bp, Homo sapiens
aggactggtgcct

SEQ ID NO: 4498162 - DNA, 14 bp, Homo sapiens
aggactgtttcagt

SEQ ID NO: 4498163 - DNA, 15 bp, Homo sapiens
aggacttaaaattag

SEQ ID NO: 4498164 - DNA, 21 bp, Homo sapiens
aggacttaaaattagtctttt

SEQ ID NO: 4498165 - DNA, 15 bp, Homo sapiens
aggacttaaccttga

SEQ ID NO: 4498166 - DNA, 14 bp, Homo sapiens
aggacttctgcagc

SEQ ID NO: 4498167 - DNA, 16 bp, Homo sapiens
aggacttgaaagaaat

SEQ ID NO: 4498168 - DNA, 21 bp, Homo sapiens
aggacttgtctccatgtgtat

SEQ ID NO: 4498169 - DNA, 11 bp, Homo sapiens
aggagaaactg

SEQ ID NO: 4498170 - DNA, 12 bp, Homo sapiens
aggagaaatctg

SEQ ID NO: 4498171 - DNA, 15 bp, Homo sapiens
aggagaaatgcaata

SEQ ID NO: 4498172 - DNA, 14 bp, Homo sapiens
aggagaacaaatat

SEQ ID NO: 4498173 - DNA, 14 bp, Homo sapiens
aggagaaccactac

SEQ ID NO: 4498174 - DNA, 15 bp, Homo sapiens
aggagaaccactaca

SEQ ID NO: 4498175 - DNA, 14 bp, Homo sapiens
aggagaaggggctt

SEQ ID NO: 4498176 - DNA, 23 bp, Homo sapiens
aggagaagtcttctatttattta

SEQ ID NO: 4498177 - DNA, 14 bp, Homo sapiens
aggagaatcacctg

SEQ ID NO: 4498178 - DNA, 20 bp, Homo sapiens
aggagaatcacctgaacccc

SEQ ID NO: 4498179 - DNA, 22 bp, Homo sapiens
aggagaatcacctgaaccccag

SEQ ID NO: 4498180 - DNA, 20 bp, Homo sapiens
aggagaatcacttgaacccg

SEQ ID NO: 4498181 - DNA, 20 bp, Homo sapiens
aggagaatcacttgaacctg

SEQ ID NO: 4498182 - DNA, 16 bp, Homo sapiens
aggagaatccaagcga

SEQ ID NO: 4498183 - DNA, 20 bp, Homo sapiens
aggagaatggtgtgaacccg

SEQ ID NO: 4498184 - DNA, 18 bp, Homo sapiens
aggagacatatcactgct

SEQ ID NO: 4498185 - DNA, 23 bp, Homo sapiens
aggagacattgctctatgtctgc

SEQ ID NO: 4498186 - DNA, 15 bp, Homo sapiens
aggagactcacctct

SEQ ID NO: 4498187 - DNA, 20 bp, Homo sapiens
aggagactttacaaaccttt

SEQ ID NO: 4498188 - DNA, 15 bp, Homo sapiens
aggagagaaaatata

SEQ ID NO: 4498189 - DNA, 21 bp, Homo sapiens
aggagagactcccatgaagcc

SEQ ID NO: 4498190 - DNA, 18 bp, Homo sapiens
aggagagactgagcagcc

SEQ ID NO: 4498191 - DNA, 15 bp, Homo sapiens
aggagagcctgctgc

SEQ ID NO: 4498192 - DNA, 21 bp, Homo sapiens
aggagaggcaacatccaaaat

SEQ ID NO: 4498193 - DNA, 22 bp, Homo sapiens
aggagagttcaagcctgtggga

SEQ ID NO: 4498194 - DNA, 23 bp, Homo sapiens
aggagatcgagaccatcctggct

SEQ ID NO: 4498195 - DNA, 16 bp, Homo sapiens
aggagatgaaactggt

SEQ ID NO: 4498196 - DNA, 19 bp, Homo sapiens
aggagatgaaactggttcc

SEQ ID NO: 4498197 - DNA, 16 bp, Homo sapiens
aggagatgaccaggga

SEQ ID NO: 4498198 - DNA, 17 bp, Homo sapiens
aggagatgaccagggat

SEQ ID NO: 4498199 - DNA, 18 bp, Homo sapiens
aggagatgaccagggatg

SEQ ID NO: 4498200 - DNA, 17 bp, Homo sapiens
aggagatgctccttggg

SEQ ID NO: 4498201 - DNA, 22 bp, Homo sapiens
aggagatgctccttgggccctt

SEQ ID NO: 4498202 - DNA, 15 bp, Homo sapiens
aggagatggagggct

SEQ ID NO: 4498203 - DNA, 20 bp, Homo sapiens
aggagattggatttgctgtg

SEQ ID NO: 4498204 - DNA, 14 bp, Homo sapiens
aggagcagaaagat

SEQ ID NO: 4498205 - DNA, 12 bp, Homo sapiens
aggagcagacca

SEQ ID NO: 4498206 - DNA, 14 bp, Homo sapiens
aggagccaccagtt

SEQ ID NO: 4498207 - DNA, 17 bp, Homo sapiens
aggagccaccagttctc

SEQ ID NO: 4498208 - DNA, 15 bp, Homo sapiens
aggagccccattcct

SEQ ID NO: 4498209 - DNA, 16 bp, Homo sapiens
aggagccccattcctg

SEQ ID NO: 4498210 - DNA, 18 bp, Homo sapiens
aggagcctagcggagccc

SEQ ID NO: 4498211 - DNA, 21 bp, Homo sapiens
aggagcctagcggagcccagc

SEQ ID NO: 4498212 - DNA, 11 bp, Homo sapiens
aggagcctctg

SEQ ID NO: 4498213 - DNA, 15 bp, Homo sapiens
aggagcgagcatgtc

SEQ ID NO: 4498214 - DNA, 19 bp, Homo sapiens
aggagctcttcaggcctcc

SEQ ID NO: 4498215 - DNA, 21 bp, Homo sapiens
aggagctcttcaggcctccct

SEQ ID NO: 4498216 - DNA, 14 bp, Homo sapiens
aggagctgcctctt

SEQ ID NO: 4498217 - DNA, 17 bp, Homo sapiens
aggagctgctggcttgc

SEQ ID NO: 4498218 - DNA, 16 bp, Homo sapiens
aggagctggcctgcgg

SEQ ID NO: 4498219 - DNA, 16 bp, Homo sapiens
aggagctgggaggaaa

SEQ ID NO: 4498220 - DNA, 17 bp, Homo sapiens
aggaggaaaaggcttgg

SEQ ID NO: 4498221 - DNA, 14 bp, Homo sapiens
aggaggaaggcaag

SEQ ID NO: 4498222 - DNA, 13 bp, Homo sapiens
aggaggagctgcc

SEQ ID NO: 4498223 - DNA, 15 bp, Homo sapiens
aggaggattgccttt

SEQ ID NO: 4498224 - DNA, 22 bp, Homo sapiens
aggaggcaagcgtgttctcagc

SEQ ID NO: 4498225 - DNA, 23 bp, Homo sapiens
aggaggcaagcgtgttctcagca

SEQ ID NO: 4498226 - DNA, 13 bp, Homo sapiens
aggaggccacgga

SEQ ID NO: 4498227 - DNA, 22 bp, Homo sapiens
aggaggcctccactccttccat

SEQ ID NO: 4498228 - DNA, 17 bp, Homo sapiens
aggaggcctccatctca

SEQ ID NO: 4498229 - DNA, 22 bp, Homo sapiens
aggaggcctggggaggccctag

SEQ ID NO: 4498230 - DNA, 14 bp, Homo sapiens
aggaggcctgtccc

SEQ ID NO: 4498231 - DNA, 18 bp, Homo sapiens
aggaggcgaataaatgtt

SEQ ID NO: 4498232 - DNA, 19 bp, Homo sapiens
aggaggcgaataaatgttc

SEQ ID NO: 4498233 - DNA, 16 bp, Homo sapiens
aggaggctccagaggg

SEQ ID NO: 4498234 - DNA, 17 bp, Homo sapiens
aggaggctccagagggc

SEQ ID NO: 4498235 - DNA, 18 bp, Homo sapiens
aggaggctccagagggca

SEQ ID NO: 4498236 - DNA, 15 bp, Homo sapiens
aggaggctgagacag

SEQ ID NO: 4498237 - DNA, 17 bp, Homo sapiens
aggaggctgagacagga

SEQ ID NO: 4498238 - DNA, 16 bp, Homo sapiens
aggaggctgaggcaga

SEQ ID NO: 4498239 - DNA, 16 bp, Homo sapiens
aggaggctggtgacag

SEQ ID NO: 4498240 - DNA, 14 bp, Homo sapiens
aggagggagaggga

SEQ ID NO: 4498241 - DNA, 14 bp, Homo sapiens
aggagggcagcaga

SEQ ID NO: 4498242 - DNA, 20 bp, Homo sapiens
aggagggccctacctgattg

SEQ ID NO: 4498243 - DNA, 19 bp, Homo sapiens
aggaggggaaaaaaatgtt

SEQ ID NO: 4498244 - DNA, 21 bp, Homo sapiens
aggaggggagagacaggcagc

SEQ ID NO: 4498245 - DNA, 19 bp, Homo sapiens
aggaggggagcgtctggga

SEQ ID NO: 4498246 - DNA, 14 bp, Homo sapiens
aggagggtgggaag

SEQ ID NO: 4498247 - DNA, 18 bp, Homo sapiens
aggaggtatctagcaatg

SEQ ID NO: 4498248 - DNA, 18 bp, Homo sapiens
aggaggtcacctgccgcc

SEQ ID NO: 4498249 - DNA, 15 bp, Homo sapiens
aggaggtgggccaca

SEQ ID NO: 4498250 - DNA, 16 bp, Homo sapiens
aggagtaaaattcagt

SEQ ID NO: 4498251 - DNA, 21 bp, Homo sapiens
aggagtaaaattcagtttttt

SEQ ID NO: 4498252 - DNA, 22 bp, Homo sapiens
aggagtaccgccagcagctgtc

SEQ ID NO: 4498253 - DNA, 15 bp, Homo sapiens
aggagtcaactggct

SEQ ID NO: 4498254 - DNA, 16 bp, Homo sapiens
aggagtcaactggctg

SEQ ID NO: 4498255 - DNA, 17 bp, Homo sapiens
aggagtcaactggctgg

SEQ ID NO: 4498256 - DNA, 22 bp, Homo sapiens
aggagtcaactggctggccagt

SEQ ID NO: 4498257 - DNA, 15 bp, Homo sapiens
aggagtccagacccc

SEQ ID NO: 4498258 - DNA, 11 bp, Homo sapiens
aggagtccagc

SEQ ID NO: 4498259 - DNA, 21 bp, Homo sapiens
aggagtccagcccctcctccc

SEQ ID NO: 4498260 - DNA, 15 bp, Homo sapiens
aggagtccaggcccc

SEQ ID NO: 4498261 - DNA, 14 bp, Homo sapiens
aggagtctgccact

SEQ ID NO: 4498262 - DNA, 19 bp, Homo sapiens
aggagtctgccacttgtca

SEQ ID NO: 4498263 - DNA, 14 bp, Homo sapiens
aggaagagaagaca

SEQ ID NO: 4498264 - DNA, 17 bp, Homo sapiens
aggaagagccacctgca

SEQ ID NO: 4498265 - DNA, 17 bp, Homo sapiens
aggaagatgggaggtgg

SEQ ID NO: 4498266 - DNA, 17 bp, Homo sapiens
aggaagcaagcttaatg

SEQ ID NO: 4498267 - DNA, 17 bp, Homo sapiens
aggaagcattgtaaaat

SEQ ID NO: 4498268 - DNA, 19 bp, Homo sapiens
aggaagcattgtaaaataa

SEQ ID NO: 4498269 - DNA, 21 bp, Homo sapiens
aggaagcattgtaaaataatt

SEQ ID NO: 4498270 - DNA, 12 bp, Homo sapiens
aggaagccagag

SEQ ID NO: 4498271 - DNA, 22 bp, Homo sapiens
aggaagccgccagtacttgtca

SEQ ID NO: 4498272 - DNA, 15 bp, Homo sapiens
aggaagcgtggggta

SEQ ID NO: 4498273 - DNA, 11 bp, Homo sapiens
aggaaggaaac

SEQ ID NO: 4498274 - DNA, 15 bp, Homo sapiens
aggaaggaacaaaga

SEQ ID NO: 4498275 - DNA, 21 bp, Homo sapiens
aggaaggagactcacctctgc

SEQ ID NO: 4498276 - DNA, 17 bp, Homo sapiens
aggaaggagagcctgct

SEQ ID NO: 4498277 - DNA, 13 bp, Homo sapiens
aggaaggcaagag

SEQ ID NO: 4498278 - DNA, 14 bp, Homo sapiens
aggaaggcaagagg

SEQ ID NO: 4498279 - DNA, 16 bp, Homo sapiens
aggaaggcagcattcc

SEQ ID NO: 4498280 - DNA, 14 bp, Homo sapiens
aggaaggcctgagc

SEQ ID NO: 4498281 - DNA, 14 bp, Homo sapiens
aggaagggctgggc

SEQ ID NO: 4498282 - DNA, 20 bp, Homo sapiens
aggaagggctgggccaccag

SEQ ID NO: 4498283 - DNA, 15 bp, Homo sapiens
aggaagtccagccac

SEQ ID NO: 4498284 - DNA, 16 bp, Homo sapiens
aggaagtggctcagac

SEQ ID NO: 4498285 - DNA, 17 bp, Homo sapiens
aggaagtggctcagacc

SEQ ID NO: 4498286 - DNA, 14 bp, Homo sapiens
aggaagttcagatc

SEQ ID NO: 4498287 - DNA, 19 bp, Homo sapiens
aggaataaataaaaatgga

SEQ ID NO: 4498288 - DNA, 13 bp, Homo sapiens
aggaatacatttt

SEQ ID NO: 4498289 - DNA, 14 bp, Homo sapiens
aggaatagaggaag

SEQ ID NO: 4498290 - DNA, 23 bp, Homo sapiens
aggaatatctgttcccagcccct

SEQ ID NO: 4498291 - DNA, 20 bp, Homo sapiens
aggaatcaagagctgccctc

SEQ ID NO: 4498292 - DNA, 15 bp, Homo sapiens
aggaatcacccctct

SEQ ID NO: 4498293 - DNA, 20 bp, Homo sapiens
aggaatcacccctctgcccc

SEQ ID NO: 4498294 - DNA, 21 bp, Homo sapiens
aggaatcacccctctgcccct

SEQ ID NO: 4498295 - DNA, 15 bp, Homo sapiens
aggaatcagacttca

SEQ ID NO: 4498296 - DNA, 17 bp, Homo sapiens
aggaatcggctggggac

SEQ ID NO: 4498297 - DNA, 23 bp, Homo sapiens
aggaatcggctggggactgctac

SEQ ID NO: 4498298 - DNA, 19 bp, Homo sapiens
aggaatctgtgggtctggg

SEQ ID NO: 4498299 - DNA, 20 bp, Homo sapiens
aggaatctgtttctctgctg

SEQ ID NO: 4498300 - DNA, 22 bp, Homo sapiens
aggaatctgtttctctgctgtc

SEQ ID NO: 4498301 - DNA, 14 bp, Homo sapiens
aggaatgaagaact

SEQ ID NO: 4498302 - DNA, 22 bp, Homo sapiens
aggaatgaagaactgttgccta

SEQ ID NO: 4498303 - DNA, 22 bp, Homo sapiens
aggaatgttaaagtcagtggga

SEQ ID NO: 4498304 - DNA, 16 bp, Homo sapiens
aggaattacgtgctct

SEQ ID NO: 4498305 - DNA, 17 bp, Homo sapiens
aggaattactttattat

SEQ ID NO: 4498306 - DNA, 14 bp, Homo sapiens
aggaattccctgga

SEQ ID NO: 4498307 - DNA, 20 bp, Homo sapiens
aggaattctaaataaatttc

SEQ ID NO: 4498308 - DNA, 17 bp, Homo sapiens
aggaatttaagaatttg

SEQ ID NO: 4498309 - DNA, 17 bp, Homo sapiens
aggaatttactttcttc

SEQ ID NO: 4498310 - DNA, 15 bp, Homo sapiens
aggaatttcttaact

SEQ ID NO: 4498311 - DNA, 21 bp, Homo sapiens
aggaatttgcatccagcagca

SEQ ID NO: 4498312 - DNA, 13 bp, Homo sapiens
aggaatttgtatt

SEQ ID NO: 4498313 - DNA, 14 bp, Homo sapiens
aggacaaaaggaat

SEQ ID NO: 4498314 - DNA, 22 bp, Homo sapiens
aggacaaacgggctcgggtctg

SEQ ID NO: 4498315 - DNA, 16 bp, Homo sapiens
aggacaaataaaacat

SEQ ID NO: 4498316 - DNA, 19 bp, Homo sapiens
aggacaaataaaacatggc

SEQ ID NO: 4498317 - DNA, 18 bp, Homo sapiens
aggacacagttcctggga

SEQ ID NO: 4498318 - DNA, 13 bp, Homo sapiens
aggacagaatgtg

SEQ ID NO: 4498319 - DNA, 14 bp, Homo sapiens
aggacagaatgtgt

SEQ ID NO: 4498320 - DNA, 17 bp, Homo sapiens
aggacagcaaagcagca

SEQ ID NO: 4498321 - DNA, 18 bp, Homo sapiens
aggacaggaaaggcccca

SEQ ID NO: 4498322 - DNA, 13 bp, Homo sapiens
aggacaggagcct

SEQ ID NO: 4498323 - DNA, 14 bp, Homo sapiens
aggacaggagcctg

SEQ ID NO: 4498324 - DNA, 18 bp, Homo sapiens
aggacaggagcctggtcc

SEQ ID NO: 4498325 - DNA, 19 bp, Homo sapiens
aggacagtccctgctgggg

SEQ ID NO: 4498326 - DNA, 22 bp, Homo sapiens
aggacagtccctgctggggaag

SEQ ID NO: 4498327 - DNA, 18 bp, Homo sapiens
aggacagtctggagaagg

SEQ ID NO: 4498328 - DNA, 21 bp, Homo sapiens
aggacagtgcttgatacagga

SEQ ID NO: 4498329 - DNA, 13 bp, Homo sapiens
aggacatcaaagt

SEQ ID NO: 4498330 - DNA, 13 bp, Homo sapiens
aggacatcagcaa

SEQ ID NO: 4498331 - DNA, 15 bp, Homo sapiens
aggacatcagcaaac

SEQ ID NO: 4498332 - DNA, 21 bp, Homo sapiens
aggacatggtgagtctatttt

SEQ ID NO: 4498333 - DNA, 14 bp, Homo sapiens
aggacatttctcta

SEQ ID NO: 4498334 - DNA, 12 bp, Homo sapiens
aggaccagagcg

SEQ ID NO: 4498335 - DNA, 20 bp, Homo sapiens
aggaccagagcggtatctct

SEQ ID NO: 4498336 - DNA, 13 bp, Homo sapiens
aggaccaggactc

SEQ ID NO: 4498337 - DNA, 19 bp, Homo sapiens
aggaccagtcaacctgggc

SEQ ID NO: 4498338 - DNA, 13 bp, Homo sapiens
aggacccagaccc

SEQ ID NO: 4498339 - DNA, 14 bp, Homo sapiens
aggacccaggaaag

SEQ ID NO: 4498340 - DNA, 15 bp, Homo sapiens
aggacccaggcgctg

SEQ ID NO: 4498341 - DNA, 18 bp, Homo sapiens
aggacccaggcgctgcat

SEQ ID NO: 4498342 - DNA, 22 bp, Homo sapiens
aggacccagtggtcagcaggtg

SEQ ID NO: 4498343 - DNA, 23 bp, Homo sapiens
aggacccccgaggggagggcagg

SEQ ID NO: 4498344 - DNA, 21 bp, Homo sapiens
acttctgtaattgtgtggatt

SEQ ID NO: 4498345 - DNA, 21 bp, Homo sapiens
acttctgtcttcacaacagat

SEQ ID NO: 4498346 - DNA, 16 bp, Homo sapiens
acttcttatggaattg

SEQ ID NO: 4498347 - DNA, 15 bp, Homo sapiens
agaaaattagactgt

SEQ ID NO: 4498348 - DNA, 14 bp, Homo sapiens
agaaaattctcctg

SEQ ID NO: 4498349 - DNA, 20 bp, Homo sapiens
agaaaatttttgtagtagcg

SEQ ID NO: 4498350 - DNA, 22 bp, Homo sapiens
agaaaatttttgtagtagcgtt

SEQ ID NO: 4498351 - DNA, 16 bp, Homo sapiens
agctactaaaatcagt

SEQ ID NO: 4498352 - DNA, 13 bp, Homo sapiens
agctactcaggag

SEQ ID NO: 4498353 - DNA, 17 bp, Homo sapiens
agctactcaggaggctg

SEQ ID NO: 4498354 - DNA, 18 bp, Homo sapiens
agctactcaggaggctga

SEQ ID NO: 4498355 - DNA, 22 bp, Homo sapiens
agctactcaggaggctgagaca

SEQ ID NO: 4498356 - DNA, 12 bp, Homo sapiens
agctactgccat

SEQ ID NO: 4498357 - DNA, 13 bp, Homo sapiens
agctactgccatc

SEQ ID NO: 4498358 - DNA, 16 bp, Homo sapiens
agctactgccatcctg

SEQ ID NO: 4498359 - DNA, 22 bp, Homo sapiens
agctactgccatcctggcccag

SEQ ID NO: 4498360 - DNA, 17 bp, Homo sapiens
agctactggaatggtgt

SEQ ID NO: 4498361 - DNA, 14 bp, Homo sapiens
agctactgtagttg

SEQ ID NO: 4498362 - DNA, 15 bp, Homo sapiens
agctactgtgtgtgt

SEQ ID NO: 4498363 - DNA, 20 bp, Homo sapiens
agctactgtgtgtgtgaatg

SEQ ID NO: 4498364 - DNA, 17 bp, Homo sapiens
agctacttgggaggctg

SEQ ID NO: 4498365 - DNA, 11 bp, Homo sapiens
agctagaaatg

SEQ ID NO: 4498366 - DNA, 16 bp, Homo sapiens
agctagaacctggaga

SEQ ID NO: 4498367 - DNA, 18 bp, Homo sapiens
agctagaacctggagagc

SEQ ID NO: 4498368 - DNA, 15 bp, Homo sapiens
agctagaagtgggcc

SEQ ID NO: 4498369 - DNA, 14 bp, Homo sapiens
agctagaattgagt

SEQ ID NO: 4498370 - DNA, 16 bp, Homo sapiens
agctagacacatgaag

SEQ ID NO: 4498371 - DNA, 17 bp, Homo sapiens
agctagacacatgaagg

SEQ ID NO: 4498372 - DNA, 15 bp, Homo sapiens
agctagagaaattct

SEQ ID NO: 4498373 - DNA, 19 bp, Homo sapiens
agctagtagcaatgtgcct

SEQ ID NO: 4498374 - DNA, 13 bp, Homo sapiens
agctagtgccaaa

SEQ ID NO: 4498375 - DNA, 14 bp, Homo sapiens
agctagttaataat

SEQ ID NO: 4498376 - DNA, 16 bp, Homo sapiens
agctagttctcagctt

SEQ ID NO: 4498377 - DNA, 12 bp, Homo sapiens
agctagttttct

SEQ ID NO: 4498378 - DNA, 14 bp, Homo sapiens
agctatcaggaaca

SEQ ID NO: 4498379 - DNA, 16 bp, Homo sapiens
agctatcctttcaaac

SEQ ID NO: 4498380 - DNA, 16 bp, Homo sapiens
agctatcttcatgtaa

SEQ ID NO: 4498381 - DNA, 18 bp, Homo sapiens
agctatcttcatgtaaat

SEQ ID NO: 4498382 - DNA, 22 bp, Homo sapiens
agctatgttatattgaaaaaat

SEQ ID NO: 4498383 - DNA, 19 bp, Homo sapiens
agctattggcaagttttaa

SEQ ID NO: 4498384 - DNA, 13 bp, Homo sapiens
agctatttcatct

SEQ ID NO: 4498385 - DNA, 21 bp, Homo sapiens
agctatttcatctatttttgg

SEQ ID NO: 4498386 - DNA, 20 bp, Homo sapiens
agctattttagaaagctaaa

SEQ ID NO: 4498387 - DNA, 14 bp, Homo sapiens
agctattttcctct

SEQ ID NO: 4498388 - DNA, 13 bp, Homo sapiens
agctattttgtga

SEQ ID NO: 4498389 - DNA, 21 bp, Homo sapiens
agctcaaattccgagtgcaga

SEQ ID NO: 4498390 - DNA, 13 bp, Homo sapiens
agctcactaccct

SEQ ID NO: 4498391 - DNA, 13 bp, Homo sapiens
agctcacttctgg

SEQ ID NO: 4498392 - DNA, 15 bp, Homo sapiens
agctcagacccccac

SEQ ID NO: 4498393 - DNA, 18 bp, Homo sapiens
agctcagacccccactct

SEQ ID NO: 4498394 - DNA, 16 bp, Homo sapiens
agctcagcatttccac

SEQ ID NO: 4498395 - DNA, 19 bp, Homo sapiens
agctcagccccaactcttt

SEQ ID NO: 4498396 - DNA, 22 bp, Homo sapiens
agctcaggaaccgaggcaggga

SEQ ID NO: 4498397 - DNA, 11 bp, Homo sapiens
agctcaggaat

SEQ ID NO: 4498398 - DNA, 20 bp, Homo sapiens
agctcaggaggcgaataaat

SEQ ID NO: 4498399 - DNA, 22 bp, Homo sapiens
agctcaggagtttgagaccagg

SEQ ID NO: 4498400 - DNA, 16 bp, Homo sapiens
agctcaggatatggct

SEQ ID NO: 4498401 - DNA, 15 bp, Homo sapiens
agctcatccctggac

SEQ ID NO: 4498402 - DNA, 12 bp, Homo sapiens
agctccacacgc

SEQ ID NO: 4498403 - DNA, 20 bp, Homo sapiens
agctccacacgccccggtcc

SEQ ID NO: 4498404 - DNA, 20 bp, Homo sapiens
agctccaccctcctggcctc

SEQ ID NO: 4498405 - DNA, 24 bp, Homo sapiens
agctccagcgatggtgctgcccag

SEQ ID NO: 4498406 - DNA, 12 bp, Homo sapiens
agctcccacacc

SEQ ID NO: 4498407 - DNA, 23 bp, Homo sapiens
agctcccacaccgcgtcccagct

SEQ ID NO: 4498408 - DNA, 23 bp, Homo sapiens
agctcccaccccacccccttcag

SEQ ID NO: 4498409 - DNA, 20 bp, Homo sapiens
agctcccattctatgtgtca

SEQ ID NO: 4498410 - DNA, 18 bp, Homo sapiens
agctcccccactcctccc

SEQ ID NO: 4498411 - DNA, 19 bp, Homo sapiens
agctcccctcggagaagag

SEQ ID NO: 4498412 - DNA, 20 bp, Homo sapiens
agctcccctcggagaagagc

SEQ ID NO: 4498413 - DNA, 15 bp, Homo sapiens
agctcccctcttttg

SEQ ID NO: 4498414 - DNA, 12 bp, Homo sapiens
agctcccctggc

SEQ ID NO: 4498415 - DNA, 13 bp, Homo sapiens
agctcccctggct

SEQ ID NO: 4498416 - DNA, 23 bp, Homo sapiens
agctcccctggctggctcctagg

SEQ ID NO: 4498417 - DNA, 14 bp, Homo sapiens
agctccctggcttc

SEQ ID NO: 4498418 - DNA, 23 bp, Homo sapiens
agctccctggcttctgtggggcc

SEQ ID NO: 4498419 - DNA, 17 bp, Homo sapiens
agctccctttctcagga

SEQ ID NO: 4498420 - DNA, 20 bp, Homo sapiens
agctcctccctccagctgcg

SEQ ID NO: 4498421 - DNA, 14 bp, Homo sapiens
agctcctgggaccc

SEQ ID NO: 4498422 - DNA, 18 bp, Homo sapiens
agctcctgggacccttgg

SEQ ID NO: 4498423 - DNA, 19 bp, Homo sapiens
agctcctgggacccttggc

SEQ ID NO: 4498424 - DNA, 20 bp, Homo sapiens
agctcctgggacccttggct

SEQ ID NO: 4498425 - DNA, 20 bp, Homo sapiens
agctcctggggagctcctgg

SEQ ID NO: 4498426 - DNA, 16 bp, Homo sapiens
agctccttaaggctct

SEQ ID NO: 4498427 - DNA, 18 bp, Homo sapiens
agctccttaaggctcttt

SEQ ID NO: 4498428 - DNA, 22 bp, Homo sapiens
agctccttaaggctcttttgta

SEQ ID NO: 4498429 - DNA, 13 bp, Homo sapiens
agctccttcctgg

SEQ ID NO: 4498430 - DNA, 16 bp, Homo sapiens
agctcgatccaaattg

SEQ ID NO: 4498431 - DNA, 19 bp, Homo sapiens
agctctaggctgttctgta

SEQ ID NO: 4498432 - DNA, 21 bp, Homo sapiens
agctctaggctgttctgtagc

SEQ ID NO: 4498433 - DNA, 19 bp, Homo sapiens
agctctagttttcagcctt

SEQ ID NO: 4498434 - DNA, 12 bp, Homo sapiens
agctctcccagt

SEQ ID NO: 4498435 - DNA, 15 bp, Homo sapiens
agctctcccagtgaa

SEQ ID NO: 4498436 - DNA, 14 bp, Homo sapiens
agctctccctctgg

SEQ ID NO: 4498437 - DNA, 17 bp, Homo sapiens
agctctccctctggccc

SEQ ID NO: 4498438 - DNA, 15 bp, Homo sapiens
agctctcctgctgca

SEQ ID NO: 4498439 - DNA, 18 bp, Homo sapiens
agctctcgaggaaagtgg

SEQ ID NO: 4498440 - DNA, 12 bp, Homo sapiens
agctctctggga

SEQ ID NO: 4498441 - DNA, 18 bp, Homo sapiens
agctctctgggacctcct

SEQ ID NO: 4498442 - DNA, 11 bp, Homo sapiens
agctctgaaaa

SEQ ID NO: 4498443 - DNA, 19 bp, Homo sapiens
agctctgaaaccagtgtta

SEQ ID NO: 4498444 - DNA, 19 bp, Homo sapiens
agctctgagccagattaca

SEQ ID NO: 4498445 - DNA, 13 bp, Homo sapiens
agctctgcccccg

SEQ ID NO: 4498446 - DNA, 14 bp, Homo sapiens
agctctgcccccgc

SEQ ID NO: 4498447 - DNA, 19 bp, Homo sapiens
agctctgcccccgcgggtt

SEQ ID NO: 4498448 - DNA, 17 bp, Homo sapiens
agctctgccgcaatggc

SEQ ID NO: 4498449 - DNA, 11 bp, Homo sapiens
agctctgcctc

SEQ ID NO: 4498450 - DNA, 18 bp, Homo sapiens
agctctggctctgcctca

SEQ ID NO: 4498451 - DNA, 20 bp, Homo sapiens
agctctggctctgcctcagg

SEQ ID NO: 4498452 - DNA, 21 bp, Homo sapiens
agctctggctctgcctcagga

SEQ ID NO: 4498453 - DNA, 14 bp, Homo sapiens
agctctggggtggg

SEQ ID NO: 4498454 - DNA, 22 bp, Homo sapiens
agctctggggtgggcagttttt

SEQ ID NO: 4498455 - DNA, 18 bp, Homo sapiens
agctctggttatttttct

SEQ ID NO: 4498456 - DNA, 21 bp, Homo sapiens
agctctggttatttttctctt

SEQ ID NO: 4498457 - DNA, 22 bp, Homo sapiens
agctctgtatcaggacccagag

SEQ ID NO: 4498458 - DNA, 23 bp, Homo sapiens
agctctgtatcaggacccagagg

SEQ ID NO: 4498459 - DNA, 16 bp, Homo sapiens
agctctgtatggtcag

SEQ ID NO: 4498460 - DNA, 22 bp, Homo sapiens
agctctgttccatgcaactgga

SEQ ID NO: 4498461 - DNA, 12 bp, Homo sapiens
agctctgttgaa

SEQ ID NO: 4498462 - DNA, 13 bp, Homo sapiens
agctcttcaggcc

SEQ ID NO: 4498463 - DNA, 15 bp, Homo sapiens
agctcttcaggcctc

SEQ ID NO: 4498464 - DNA, 12 bp, Homo sapiens
agctcttccctt

SEQ ID NO: 4498465 - DNA, 22 bp, Homo sapiens
agctcttttttgtttgtttctt

SEQ ID NO: 4498466 - DNA, 20 bp, Homo sapiens
agctgaaattttagaaatat

SEQ ID NO: 4498467 - DNA, 17 bp, Homo sapiens
agctgaaccacagaaat

SEQ ID NO: 4498468 - DNA, 17 bp, Homo sapiens
agctgaagatccccaac

SEQ ID NO: 4498469 - DNA, 18 bp, Homo sapiens
agctgaagatccccaact

SEQ ID NO: 4498470 - DNA, 18 bp, Homo sapiens
agcttcaacttttctctt

SEQ ID NO: 4498471 - DNA, 18 bp, Homo sapiens
agcttcacagtacccaaa

SEQ ID NO: 4498472 - DNA, 20 bp, Homo sapiens
agcttcacccaccaggccag

SEQ ID NO: 4498473 - DNA, 17 bp, Homo sapiens
agcttcagctatactta

SEQ ID NO: 4498474 - DNA, 16 bp, Homo sapiens
agcttcaggaacctcg

SEQ ID NO: 4498475 - DNA, 15 bp, Homo sapiens
agcttcatccacagc

SEQ ID NO: 4498476 - DNA, 20 bp, Homo sapiens
agcttccacaaaattagaaa

SEQ ID NO: 4498477 - DNA, 17 bp, Homo sapiens
agcttcccaagtagctg

SEQ ID NO: 4498478 - DNA, 14 bp, Homo sapiens
agcttcccatgccg

SEQ ID NO: 4498479 - DNA, 23 bp, Homo sapiens
agcttccctcccgtgtgttctcc

SEQ ID NO: 4498480 - DNA, 13 bp, Homo sapiens
agcttcctgaggg

SEQ ID NO: 4498481 - DNA, 20 bp, Homo sapiens
agcttcgtttattttcaaga

SEQ ID NO: 4498482 - DNA, 19 bp, Homo sapiens
agcttctactcctgcctca

SEQ ID NO: 4498483 - DNA, 18 bp, Homo sapiens
agcttctagacagagttg

SEQ ID NO: 4498484 - DNA, 16 bp, Homo sapiens
agcttctcccaagccc

SEQ ID NO: 4498485 - DNA, 12 bp, Homo sapiens
agcttctctgca

SEQ ID NO: 4498486 - DNA, 19 bp, Homo sapiens
agcttctgcttttctgccc

SEQ ID NO: 4498487 - DNA, 19 bp, Homo sapiens
agcttctgggagatttttt

SEQ ID NO: 4498488 - DNA, 22 bp, Homo sapiens
agcttctgggagatttttttga

SEQ ID NO: 4498489 - DNA, 13 bp, Homo sapiens
agcttctgtctcc

SEQ ID NO: 4498490 - DNA, 14 bp, Homo sapiens
agcttctgtctcca

SEQ ID NO: 4498491 - DNA, 16 bp, Homo sapiens
agcttgaaagttttca

SEQ ID NO: 4498492 - DNA, 16 bp, Homo sapiens
agcttgagaacgtatt

SEQ ID NO: 4498493 - DNA, 24 bp, Homo sapiens
agcttgagccgggcccctgggctt

SEQ ID NO: 4498494 - DNA, 12 bp, Homo sapiens
agcttgcacagc

SEQ ID NO: 4498495 - DNA, 20 bp, Homo sapiens
agcttgccagggatgggcag

SEQ ID NO: 4498496 - DNA, 21 bp, Homo sapiens
agcttgccagggatgggcagc

SEQ ID NO: 4498497 - DNA, 16 bp, Homo sapiens
agcttgccctgttaaa

SEQ ID NO: 4498498 - DNA, 18 bp, Homo sapiens
agcttgccctgttaaaag

SEQ ID NO: 4498499 - DNA, 14 bp, Homo sapiens
agcttgctcttcag

SEQ ID NO: 4498500 - DNA, 22 bp, Homo sapiens
agcttgctcttcagtgggagaa

SEQ ID NO: 4498501 - DNA, 16 bp, Homo sapiens
agcttggagggatgga

SEQ ID NO: 4498502 - DNA, 19 bp, Homo sapiens
agcttgggcagtgccccag

SEQ ID NO: 4498503 - DNA, 15 bp, Homo sapiens
agcttggggacctga

SEQ ID NO: 4498504 - DNA, 16 bp, Homo sapiens
agcttggggagaggga

SEQ ID NO: 4498505 - DNA, 23 bp, Homo sapiens
agcttgggtctctctcggcccct

SEQ ID NO: 4498506 - DNA, 15 bp, Homo sapiens
agctttaaatgacag

SEQ ID NO: 4498507 - DNA, 16 bp, Homo sapiens
agctttaaatgacagt

SEQ ID NO: 4498508 - DNA, 17 bp, Homo sapiens
agctttaaatgacagta

SEQ ID NO: 4498509 - DNA, 12 bp, Homo sapiens
agctttaaatta

SEQ ID NO: 4498510 - DNA, 22 bp, Homo sapiens
agctttaggcagagccataatg

SEQ ID NO: 4498511 - DNA, 22 bp, Homo sapiens
agctttatccccgtttcttgca

SEQ ID NO: 4498512 - DNA, 14 bp, Homo sapiens
agctttatctttgt

SEQ ID NO: 4498513 - DNA, 15 bp, Homo sapiens
agctttatctttgtg

SEQ ID NO: 4498514 - DNA, 10 bp, Homo sapiens
agctttatga

SEQ ID NO: 4498515 - DNA, 13 bp, Homo sapiens
agctttatttcta

SEQ ID NO: 4498516 - DNA, 14 bp, Homo sapiens
agctttatttctag

SEQ ID NO: 4498517 - DNA, 16 bp, Homo sapiens
agctttccctgcctct

SEQ ID NO: 4498518 - DNA, 18 bp, Homo sapiens
agctttcctggtccctca

SEQ ID NO: 4498519 - DNA, 20 bp, Homo sapiens
agctttcctggtccctcacc

SEQ ID NO: 4498520 - DNA, 15 bp, Homo sapiens
agctttgataattgt

SEQ ID NO: 4498521 - DNA, 19 bp, Homo sapiens
agctttgatttagattgag

SEQ ID NO: 4498522 - DNA, 14 bp, Homo sapiens
agctttggaatatt

SEQ ID NO: 4498523 - DNA, 19 bp, Homo sapiens
agctttggacctaatccaa

SEQ ID NO: 4498524 - DNA, 20 bp, Homo sapiens
agctttgggttggagctgtt

SEQ ID NO: 4498525 - DNA, 15 bp, Homo sapiens
agctttgtatgttta

SEQ ID NO: 4498526 - DNA, 15 bp, Homo sapiens
agcttttattccttt

SEQ ID NO: 4498527 - DNA, 23 bp, Homo sapiens
agcttttattcctttgaatattt

SEQ ID NO: 4498528 - DNA, 14 bp, Homo sapiens
agcttttatttctt

SEQ ID NO: 4498529 - DNA, 16 bp, Homo sapiens
agcttttcattttaat

SEQ ID NO: 4498530 - DNA, 14 bp, Homo sapiens
agcttttcccagga

SEQ ID NO: 4498531 - DNA, 19 bp, Homo sapiens
agcttttcttattcctttt

SEQ ID NO: 4498532 - DNA, 21 bp, Homo sapiens
agcttttcttattccttttta

SEQ ID NO: 4498533 - DNA, 20 bp, Homo sapiens
agcttttgatgccaggtgca

SEQ ID NO: 4498534 - DNA, 23 bp, Homo sapiens
agcttttggttaatatgtctttt

SEQ ID NO: 4498535 - DNA, 15 bp, Homo sapiens
agcttttgttctaga

SEQ ID NO: 4498536 - DNA, 18 bp, Homo sapiens
agctttttattattttaa

SEQ ID NO: 4498537 - DNA, 15 bp, Homo sapiens
agctttttattccct

SEQ ID NO: 4498538 - DNA, 17 bp, Homo sapiens
agctttttattccctgc

SEQ ID NO: 4498539 - DNA, 18 bp, Homo sapiens
agctttttattccctgcc

SEQ ID NO: 4498540 - DNA, 12 bp, Homo sapiens
agctttttctca

SEQ ID NO: 4498541 - DNA, 13 bp, Homo sapiens
aggaaaaaaactg

SEQ ID NO: 4498542 - DNA, 13 bp, Homo sapiens
aggaaaaaaactt

SEQ ID NO: 4498543 - DNA, 21 bp, Homo sapiens
aggaaaaaaacttttataaat

SEQ ID NO: 4498544 - DNA, 22 bp, Homo sapiens
aggaaaaagcaagttcgtctgt

SEQ ID NO: 4498545 - DNA, 14 bp, Homo sapiens
aggaaaaatattta

SEQ ID NO: 4498546 - DNA, 13 bp, Homo sapiens
aggaaaacaaaaa

SEQ ID NO: 4498547 - DNA, 15 bp, Homo sapiens
agcctgggtcacaga

SEQ ID NO: 4498548 - DNA, 18 bp, Homo sapiens
agcctggtccttccctga

SEQ ID NO: 4498549 - DNA, 15 bp, Homo sapiens
agcctgtaatcccag

SEQ ID NO: 4498550 - DNA, 18 bp, Homo sapiens
agcctgtccaacatggtg

SEQ ID NO: 4498551 - DNA, 19 bp, Homo sapiens
agcctgtccaacatggtga

SEQ ID NO: 4498552 - DNA, 21 bp, Homo sapiens
agcctgtgcaaaaaaattaaa

SEQ ID NO: 4498553 - DNA, 20 bp, Homo sapiens
agcctgtggatgatcaatcc

SEQ ID NO: 4498554 - DNA, 23 bp, Homo sapiens
agcctgtggatgatcaatccttt

SEQ ID NO: 4498555 - DNA, 11 bp, Homo sapiens
agcctgtggca

SEQ ID NO: 4498556 - DNA, 22 bp, Homo sapiens
agcctgtggcagtaaagagaaa

SEQ ID NO: 4498557 - DNA, 23 bp, Homo sapiens
agcctgtggcagtaaagagaaac

SEQ ID NO: 4498558 - DNA, 24 bp, Homo sapiens
agcctgtggcagtaaagagaaact

SEQ ID NO: 4498559 - DNA, 21 bp, Homo sapiens
agcctgtggcatctttgcctt

SEQ ID NO: 4498560 - DNA, 16 bp, Homo sapiens
agcctgtggccagcag

SEQ ID NO: 4498561 - DNA, 19 bp, Homo sapiens
agcctgtggcggtgcctgg

SEQ ID NO: 4498562 - DNA, 11 bp, Homo sapiens
agcctgtggga

SEQ ID NO: 4498563 - DNA, 17 bp, Homo sapiens
agcctgtgggagtagaa

SEQ ID NO: 4498564 - DNA, 19 bp, Homo sapiens
agcctgtgggtttggtcct

SEQ ID NO: 4498565 - DNA, 22 bp, Homo sapiens
agcctgttccataggaaggctg

SEQ ID NO: 4498566 - DNA, 22 bp, Homo sapiens
agcctgttgggatcgcattgca

SEQ ID NO: 4498567 - DNA, 16 bp, Homo sapiens
agcctgttgtttaagt

SEQ ID NO: 4498568 - DNA, 15 bp, Homo sapiens
agcctgtttctatcc

SEQ ID NO: 4498569 - DNA, 20 bp, Homo sapiens
agcctgtttctatcctgttt

SEQ ID NO: 4498570 - DNA, 18 bp, Homo sapiens
agccttaagcacaattaa

SEQ ID NO: 4498571 - DNA, 16 bp, Homo sapiens
agccttactcacctct

SEQ ID NO: 4498572 - DNA, 17 bp, Homo sapiens
agccttagcagccctgg

SEQ ID NO: 4498573 - DNA, 22 bp, Homo sapiens
agccttagggaagctggcctga

SEQ ID NO: 4498574 - DNA, 17 bp, Homo sapiens
agccttatgtgttacat

SEQ ID NO: 4498575 - DNA, 15 bp, Homo sapiens
agccttcaagtgcca

SEQ ID NO: 4498576 - DNA, 16 bp, Homo sapiens
agccttcagccttaat

SEQ ID NO: 4498577 - DNA, 14 bp, Homo sapiens
agccttccagtttt

SEQ ID NO: 4498578 - DNA, 12 bp, Homo sapiens
agccttcggaca

SEQ ID NO: 4498579 - DNA, 22 bp, Homo sapiens
agccttctaaatgagtcactga

SEQ ID NO: 4498580 - DNA, 18 bp, Homo sapiens
agccttctcagaagcaca

SEQ ID NO: 4498581 - DNA, 24 bp, Homo sapiens
agccttctccatatctccatggcc

SEQ ID NO: 4498582 - DNA, 13 bp, Homo sapiens
agccttctgccac

SEQ ID NO: 4498583 - DNA, 21 bp, Homo sapiens
agccttctgccaccagcccct

SEQ ID NO: 4498584 - DNA, 12 bp, Homo sapiens
agccttgctctc

SEQ ID NO: 4498585 - DNA, 13 bp, Homo sapiens
agccttgctctct

SEQ ID NO: 4498586 - DNA, 19 bp, Homo sapiens
agccttggaaccagcccca

SEQ ID NO: 4498587 - DNA, 21 bp, Homo sapiens
agccttggaaccagccccatc

SEQ ID NO: 4498588 - DNA, 23 bp, Homo sapiens
agccttggaaccagccccatcag

SEQ ID NO: 4498589 - DNA, 19 bp, Homo sapiens
agccttggataatgctgtt

SEQ ID NO: 4498590 - DNA, 23 bp, Homo sapiens
agccttggataatgctgttgcct

SEQ ID NO: 4498591 - DNA, 16 bp, Homo sapiens
agcctttacctgtgaa

SEQ ID NO: 4498592 - DNA, 19 bp, Homo sapiens
agcctttactgtttgatat

SEQ ID NO: 4498593 - DNA, 17 bp, Homo sapiens
agcctttgccgtgagca

SEQ ID NO: 4498594 - DNA, 21 bp, Homo sapiens
agcctttgccgtgagcatgca

SEQ ID NO: 4498595 - DNA, 16 bp, Homo sapiens
agcctttgtggtttag

SEQ ID NO: 4498596 - DNA, 23 bp, Homo sapiens
agcctttgtggtttagttataaa

SEQ ID NO: 4498597 - DNA, 15 bp, Homo sapiens
agcgaacaaccacag

SEQ ID NO: 4498598 - DNA, 19 bp, Homo sapiens
agcgaagtctttgccttct

SEQ ID NO: 4498599 - DNA, 15 bp, Homo sapiens
agcgacagtgagact

SEQ ID NO: 4498600 - DNA, 17 bp, Homo sapiens
agcgacagtgagactct

SEQ ID NO: 4498601 - DNA, 17 bp, Homo sapiens
agcgacatctctgactt

SEQ ID NO: 4498602 - DNA, 20 bp, Homo sapiens
agcgacatctctgactttct

SEQ ID NO: 4498603 - DNA, 17 bp, Homo sapiens
agcgaccacccctgcct

SEQ ID NO: 4498604 - DNA, 21 bp, Homo sapiens
agcgaccacccctgcctccac

SEQ ID NO: 4498605 - DNA, 16 bp, Homo sapiens
agcgagcaagccggca

SEQ ID NO: 4498606 - DNA, 18 bp, Homo sapiens
agcgagcaagccggcaag

SEQ ID NO: 4498607 - DNA, 15 bp, Homo sapiens
agcgagctgggccgg

SEQ ID NO: 4498608 - DNA, 13 bp, Homo sapiens
agcgaggaaagga

SEQ ID NO: 4498609 - DNA, 19 bp, Homo sapiens
agcgaggaaaggattttac

SEQ ID NO: 4498610 - DNA, 23 bp, Homo sapiens
agcgaggtcaacagagaaggcag

SEQ ID NO: 4498611 - DNA, 21 bp, Homo sapiens
agcgatggtgctgcccaggcc

SEQ ID NO: 4498612 - DNA, 19 bp, Homo sapiens
agcgccaggaagccagagc

SEQ ID NO: 4498613 - DNA, 21 bp, Homo sapiens
agcgccaggaagccagagccc

SEQ ID NO: 4498614 - DNA, 17 bp, Homo sapiens
agacagaccacttgcca

SEQ ID NO: 4498615 - DNA, 18 bp, Homo sapiens
agacagaggaaagggctg

SEQ ID NO: 4498616 - DNA, 23 bp, Homo sapiens
agacagaggaaagggctggctcc

SEQ ID NO: 4498617 - DNA, 15 bp, Homo sapiens
agacagaggatgtgg

SEQ ID NO: 4498618 - DNA, 16 bp, Homo sapiens
agacagatgagcagga

SEQ ID NO: 4498619 - DNA, 19 bp, Homo sapiens
agacagatgagcaggagct

SEQ ID NO: 4498620 - DNA, 14 bp, Homo sapiens
agacagatgcccca

SEQ ID NO: 4498621 - DNA, 19 bp, Homo sapiens
agacagatgccccagagct

SEQ ID NO: 4498622 - DNA, 16 bp, Homo sapiens
agacagatgctggtgg

SEQ ID NO: 4498623 - DNA, 16 bp, Homo sapiens
agacagatgttgggag

SEQ ID NO: 4498624 - DNA, 19 bp, Homo sapiens
agacagcagcagcctgcac

SEQ ID NO: 4498625 - DNA, 11 bp, Homo sapiens
agacagcctct

SEQ ID NO: 4498626 - DNA, 20 bp, Homo sapiens
agacagcctgtatcttgggg

SEQ ID NO: 4498627 - DNA, 16 bp, Homo sapiens
agacagcttctctgca

SEQ ID NO: 4498628 - DNA, 22 bp, Homo sapiens
agacagcttctctgcagtaaaa

SEQ ID NO: 4498629 - DNA, 20 bp, Homo sapiens
agacaggaaaatcctctggc

SEQ ID NO: 4498630 - DNA, 16 bp, Homo sapiens
agacaggacagaatgt

SEQ ID NO: 4498631 - DNA, 22 bp, Homo sapiens
agacaggctggaagatagctgt

SEQ ID NO: 4498632 - DNA, 19 bp, Homo sapiens
agacaggctgggtcctgcc

SEQ ID NO: 4498633 - DNA, 16 bp, Homo sapiens
agacagggctgctccc

SEQ ID NO: 4498634 - DNA, 22 bp, Homo sapiens
agacaggggagttgtcaacttg

SEQ ID NO: 4498635 - DNA, 18 bp, Homo sapiens
agacagggtcttgctctg

SEQ ID NO: 4498636 - DNA, 13 bp, Homo sapiens
agacagggtggga

SEQ ID NO: 4498637 - DNA, 17 bp, Homo sapiens
agacagggtgggaggga

SEQ ID NO: 4498638 - DNA, 20 bp, Homo sapiens
agacagggtgggagggagga

SEQ ID NO: 4498639 - DNA, 19 bp, Homo sapiens
agacagggtgggcttcctg

SEQ ID NO: 4498640 - DNA, 20 bp, Homo sapiens
agacagggtgggcttcctgc

SEQ ID NO: 4498641 - DNA, 22 bp, Homo sapiens
agacagggtgggcttcctgccc

SEQ ID NO: 4498642 - DNA, 11 bp, Homo sapiens
agacaggtgag

SEQ ID NO: 4498643 - DNA, 19 bp, Homo sapiens
agacagtcgctcagtctgt

SEQ ID NO: 4498644 - DNA, 16 bp, Homo sapiens
agacagtgccctgaga

SEQ ID NO: 4498645 - DNA, 14 bp, Homo sapiens
agacatataccaaa

SEQ ID NO: 4498646 - DNA, 15 bp, Homo sapiens
agacatatttaactg

SEQ ID NO: 4498647 - DNA, 17 bp, Homo sapiens
agacatcaacagataaa

SEQ ID NO: 4498648 - DNA, 14 bp, Homo sapiens
agacatcagtctcc

SEQ ID NO: 4498649 - DNA, 14 bp, Homo sapiens
agacatctgcaccc

SEQ ID NO: 4498650 - DNA, 17 bp, Homo sapiens
agacatgcccaaaactt

SEQ ID NO: 4498651 - DNA, 18 bp, Homo sapiens
agacatggtgtctcacac

SEQ ID NO: 4498652 - DNA, 18 bp, Homo sapiens
agacatgtctgttctaca

SEQ ID NO: 4498653 - DNA, 20 bp, Homo sapiens
agacatgtctgttctacata

SEQ ID NO: 4498654 - DNA, 15 bp, Homo sapiens
agacattagaaaaaa

SEQ ID NO: 4498655 - DNA, 19 bp, Homo sapiens
agacattagaaaaaaatga

SEQ ID NO: 4498656 - DNA, 19 bp, Homo sapiens
agacattctcacataagcc

SEQ ID NO: 4498657 - DNA, 20 bp, Homo sapiens
agacattctcgcttccctga

SEQ ID NO: 4498658 - DNA, 21 bp, Homo sapiens
agacattctcgcttccctgaa

SEQ ID NO: 4498659 - DNA, 17 bp, Homo sapiens
agacattctgttggagt

SEQ ID NO: 4498660 - DNA, 14 bp, Homo sapiens
agacattcttttaa

SEQ ID NO: 4498661 - DNA, 22 bp, Homo sapiens
agacattgctctatgtctgcct

SEQ ID NO: 4498662 - DNA, 13 bp, Homo sapiens
agacatttatata

SEQ ID NO: 4498663 - DNA, 13 bp, Homo sapiens
agacatttatctt

SEQ ID NO: 4498664 - DNA, 12 bp, Homo sapiens
agacatttcaaa

SEQ ID NO: 4498665 - DNA, 17 bp, Homo sapiens
agacatttgccttttgt

SEQ ID NO: 4498666 - DNA, 22 bp, Homo sapiens
agacatttgctgaactcagcac

SEQ ID NO: 4498667 - DNA, 13 bp, Homo sapiens
agacatttttcat

SEQ ID NO: 4498668 - DNA, 19 bp, Homo sapiens
agacattttttaaaagcct

SEQ ID NO: 4498669 - DNA, 24 bp, Homo sapiens
agaccaaatctcagttgtttgctt

SEQ ID NO: 4498670 - DNA, 14 bp, Homo sapiens
agaccaaatgtagt

SEQ ID NO: 4498671 - DNA, 13 bp, Homo sapiens
agaccacaggaag

SEQ ID NO: 4498672 - DNA, 18 bp, Homo sapiens
agaccacccatatcatgc

SEQ ID NO: 4498673 - DNA, 15 bp, Homo sapiens
agaccagagctgtct

SEQ ID NO: 4498674 - DNA, 18 bp, Homo sapiens
agaccagcctgggcaaca

SEQ ID NO: 4498675 - DNA, 15 bp, Homo sapiens
agaccagcctgtcca

SEQ ID NO: 4498676 - DNA, 15 bp, Homo sapiens
agaccagggtggcca

SEQ ID NO: 4498677 - DNA, 22 bp, Homo sapiens
agaccagggtggccacacaggc

SEQ ID NO: 4498678 - DNA, 21 bp, Homo sapiens
agaccatccattctcctcagt

SEQ ID NO: 4498679 - DNA, 15 bp, Homo sapiens
agaccatcctggcta

SEQ ID NO: 4498680 - DNA, 15 bp, Homo sapiens
agaccatgggaaatg

SEQ ID NO: 4498681 - DNA, 12 bp, Homo sapiens
agaccatttgta

SEQ ID NO: 4498682 - DNA, 17 bp, Homo sapiens
agacccaaaaggcagaa

SEQ ID NO: 4498683 - DNA, 19 bp, Homo sapiens
agacccaaaaggcagaagc

SEQ ID NO: 4498684 - DNA, 21 bp, Homo sapiens
agacccaacagcaaaggaact

SEQ ID NO: 4498685 - DNA, 23 bp, Homo sapiens
agacccaacccatgaaggctgga

SEQ ID NO: 4498686 - DNA, 18 bp, Homo sapiens
agacccagccctcatccc

SEQ ID NO: 4498687 - DNA, 11 bp, Homo sapiens
agacccaggag

SEQ ID NO: 4498688 - DNA, 15 bp, Homo sapiens
agacccaggagtcca

SEQ ID NO: 4498689 - DNA, 18 bp, Homo sapiens
agacccaggagtccagac

SEQ ID NO: 4498690 - DNA, 21 bp, Homo sapiens
agacccaggagtccagcccct

SEQ ID NO: 4498691 - DNA, 19 bp, Homo sapiens
agaccccaagaggaagttc

SEQ ID NO: 4498692 - DNA, 18 bp, Homo sapiens
agaccccagctggggcgc

SEQ ID NO: 4498693 - DNA, 12 bp, Homo sapiens
agacccccactc

SEQ ID NO: 4498694 - DNA, 12 bp, Homo sapiens
agacccccaggc

SEQ ID NO: 4498695 - DNA, 15 bp, Homo sapiens
agacccccaggcctg

SEQ ID NO: 4498696 - DNA, 21 bp, Homo sapiens
agaccccccagcccctcctcc

SEQ ID NO: 4498697 - DNA, 23 bp, Homo sapiens
agaccccccagcccctcctccct

SEQ ID NO: 4498698 - DNA, 23 bp, Homo sapiens
agaccccgaggtaggggtgggga

SEQ ID NO: 4498699 - DNA, 20 bp, Homo sapiens
agacccctcagccccagccc

SEQ ID NO: 4498700 - DNA, 13 bp, Homo sapiens
agacccctttgag

SEQ ID NO: 4498701 - DNA, 16 bp, Homo sapiens
agaccctaccccacca

SEQ ID NO: 4498702 - DNA, 12 bp, Homo sapiens
agaccctcgggc

SEQ ID NO: 4498703 - DNA, 19 bp, Homo sapiens
agaccctcgggccccatcc

SEQ ID NO: 4498704 - DNA, 18 bp, Homo sapiens
agaccctcttgcccatcc

SEQ ID NO: 4498705 - DNA, 19 bp, Homo sapiens
agaccctcttgcccatcct

SEQ ID NO: 4498706 - DNA, 20 bp, Homo sapiens
agaccctgaggccctgggct

SEQ ID NO: 4498707 - DNA, 22 bp, Homo sapiens
agaccctgccacagccagagga

SEQ ID NO: 4498708 - DNA, 22 bp, Homo sapiens
agaccctgcttaggatggggga

SEQ ID NO: 4498709 - DNA, 20 bp, Homo sapiens
agaccctgggtgggctctgt

SEQ ID NO: 4498710 - DNA, 22 bp, Homo sapiens
agaccctgtctcaaagcataaa

SEQ ID NO: 4498711 - DNA, 18 bp, Homo sapiens
agactttctttttctaca

SEQ ID NO: 4498712 - DNA, 19 bp, Homo sapiens
agactttctttttctacat

SEQ ID NO: 4498713 - DNA, 22 bp, Homo sapiens
agactttgctaaagacatgaag

SEQ ID NO: 4498714 - DNA, 16 bp, Homo sapiens
agacttttatgtgaga

SEQ ID NO: 4498715 - DNA, 13 bp, Homo sapiens
agactttttggtg

SEQ ID NO: 4498716 - DNA, 19 bp, Homo sapiens
agactttttggtggatgta

SEQ ID NO: 4498717 - DNA, 12 bp, Homo sapiens
agagaaaatata

SEQ ID NO: 4498718 - DNA, 18 bp, Homo sapiens
agagaaaatgagaaagga

SEQ ID NO: 4498719 - DNA, 20 bp, Homo sapiens
agagaaaatgagaaaggaca

SEQ ID NO: 4498720 - DNA, 22 bp, Homo sapiens
agagaaacactgaaaagaagga

SEQ ID NO: 4498721 - DNA, 21 bp, Homo sapiens
agagaaaccgtcctctttttc

SEQ ID NO: 4498722 - DNA, 16 bp, Homo sapiens
agagaaacttcaaagt

SEQ ID NO: 4498723 - DNA, 19 bp, Homo sapiens
agagaaactttgtgctaca

SEQ ID NO: 4498724 - DNA, 10 bp, Homo sapiens
agagaaagaa

SEQ ID NO: 4498725 - DNA, 23 bp, Homo sapiens
agagaaagaaagggaaactggct

SEQ ID NO: 4498726 - DNA, 13 bp, Homo sapiens
agagaaagagaac

SEQ ID NO: 4498727 - DNA, 19 bp, Homo sapiens
agagaaagcatattgactt

SEQ ID NO: 4498728 - DNA, 18 bp, Homo sapiens
agagaaatcagctgctat

SEQ ID NO: 4498729 - DNA, 22 bp, Homo sapiens
agagaacagtattgggcaggag

SEQ ID NO: 4498730 - DNA, 14 bp, Homo sapiens
agagaacgcagccc

SEQ ID NO: 4498731 - DNA, 12 bp, Homo sapiens
agagaactaaag

SEQ ID NO: 4498732 - DNA, 19 bp, Homo sapiens
agagaactaaagctggaga

SEQ ID NO: 4498733 - DNA, 16 bp, Homo sapiens
agagaagagggcccag

SEQ ID NO: 4498734 - DNA, 18 bp, Homo sapiens
agagaagagggcccagcc

SEQ ID NO: 4498735 - DNA, 18 bp, Homo sapiens
agagaagatgcctgttaa

SEQ ID NO: 4498736 - DNA, 20 bp, Homo sapiens
agagaagccacgctgtcctc

SEQ ID NO: 4498737 - DNA, 15 bp, Homo sapiens
agaacgcaccccact

SEQ ID NO: 4498738 - DNA, 22 bp, Homo sapiens
agaacgcagccctagagcctgc

SEQ ID NO: 4498739 - DNA, 23 bp, Homo sapiens
agaacgcagccctagagcctgcc

SEQ ID NO: 4498740 - DNA, 13 bp, Homo sapiens
agaacgtggtcag

SEQ ID NO: 4498741 - DNA, 15 bp, Homo sapiens
agaactaactttggt

SEQ ID NO: 4498742 - DNA, 18 bp, Homo sapiens
agaactacaaacaaaatt

SEQ ID NO: 4498743 - DNA, 23 bp, Homo sapiens
agaactacaaacaaaatttctat

SEQ ID NO: 4498744 - DNA, 17 bp, Homo sapiens
agaactagaatttgatt

SEQ ID NO: 4498745 - DNA, 17 bp, Homo sapiens
agaactagccaaaccag

SEQ ID NO: 4498746 - DNA, 14 bp, Homo sapiens
agaactcatttgaa

SEQ ID NO: 4498747 - DNA, 16 bp, Homo sapiens
agaactctctggaagc

SEQ ID NO: 4498748 - DNA, 14 bp, Homo sapiens
agaactctttcaaa

SEQ ID NO: 4498749 - DNA, 16 bp, Homo sapiens
agaactgaaaaattac

SEQ ID NO: 4498750 - DNA, 15 bp, Homo sapiens
agaactgaactgtaa

SEQ ID NO: 4498751 - DNA, 17 bp, Homo sapiens
agaactgaattttggga

SEQ ID NO: 4498752 - DNA, 12 bp, Homo sapiens
agaactgccctt

SEQ ID NO: 4498753 - DNA, 21 bp, Homo sapiens
agaactgcccttgctgcccgc

SEQ ID NO: 4498754 - DNA, 16 bp, Homo sapiens
agaactgtacattgtg

SEQ ID NO: 4498755 - DNA, 22 bp, Homo sapiens
agaactgttgcctaattggaaa

SEQ ID NO: 4498756 - DNA, 15 bp, Homo sapiens
agaacttctgcctct

SEQ ID NO: 4498757 - DNA, 14 bp, Homo sapiens
agaactttcatttt

SEQ ID NO: 4498758 - DNA, 16 bp, Homo sapiens
agaactttcatttttt

SEQ ID NO: 4498759 - DNA, 17 bp, Homo sapiens
agaagaaaacagtacag

SEQ ID NO: 4498760 - DNA, 16 bp, Homo sapiens
agaagaaacttgtaaa

SEQ ID NO: 4498761 - DNA, 13 bp, Homo sapiens
agaagaaagatgt

SEQ ID NO: 4498762 - DNA, 11 bp, Homo sapiens
agaagaaagca

SEQ ID NO: 4498763 - DNA, 14 bp, Homo sapiens
agaagaaataaata

SEQ ID NO: 4498764 - DNA, 16 bp, Homo sapiens
agaagaacaagaaatg

SEQ ID NO: 4498765 - DNA, 20 bp, Homo sapiens
agaagaaccaaatacctcaa

SEQ ID NO: 4498766 - DNA, 23 bp, Homo sapiens
agaagaaccaaatacctcaattt

SEQ ID NO: 4498767 - DNA, 15 bp, Homo sapiens
agaagaagaagaagg

SEQ ID NO: 4498768 - DNA, 14 bp, Homo sapiens
agaagaaggagagc

SEQ ID NO: 4498769 - DNA, 14 bp, Homo sapiens
agaagaagtgtgtc

SEQ ID NO: 4498770 - DNA, 22 bp, Homo sapiens
agaagaatattgtattgttaga

SEQ ID NO: 4498771 - DNA, 22 bp, Homo sapiens
agaagaatttgaagacttcaaa

SEQ ID NO: 4498772 - DNA, 22 bp, Homo sapiens
agaagaattttcagaccccagc

SEQ ID NO: 4498773 - DNA, 13 bp, Homo sapiens
agaagacaggctg

SEQ ID NO: 4498774 - DNA, 11 bp, Homo sapiens
agaagacattt

SEQ ID NO: 4498775 - DNA, 15 bp, Homo sapiens
agaagacattttgtt

SEQ ID NO: 4498776 - DNA, 17 bp, Homo sapiens
agaagacattttgttac

SEQ ID NO: 4498777 - DNA, 15 bp, Homo sapiens
agaagactttaatta

SEQ ID NO: 4498778 - DNA, 18 bp, Homo sapiens
agaagagaaagatgtgtt

SEQ ID NO: 4498779 - DNA, 20 bp, Homo sapiens
agaagagggaaaacagaaaa

SEQ ID NO: 4498780 - DNA, 21 bp, Homo sapiens
agaagagggaaaacagaaaac

SEQ ID NO: 4498781 - DNA, 19 bp, Homo sapiens
agaagagggcccagcccag

SEQ ID NO: 4498782 - DNA, 17 bp, Homo sapiens
agaagagtcaacattga

SEQ ID NO: 4498783 - DNA, 16 bp, Homo sapiens
agaagagttgaggaac

SEQ ID NO: 4498784 - DNA, 19 bp, Homo sapiens
agaagagttgtgcacgcag

SEQ ID NO: 4498785 - DNA, 21 bp, Homo sapiens
agaagcaacctcagtaattta

SEQ ID NO: 4498786 - DNA, 13 bp, Homo sapiens
agaagcaagccag

SEQ ID NO: 4498787 - DNA, 14 bp, Homo sapiens
agaagcaagccaga

SEQ ID NO: 4498788 - DNA, 19 bp, Homo sapiens
agaagcaatctttgaaata

SEQ ID NO: 4498789 - DNA, 13 bp, Homo sapiens
agaagcacttctg

SEQ ID NO: 4498790 - DNA, 16 bp, Homo sapiens
agaagcacttctgctg

SEQ ID NO: 4498791 - DNA, 20 bp, Homo sapiens
agaagcacttctgctgcatc

SEQ ID NO: 4498792 - DNA, 23 bp, Homo sapiens
agaagcagtgagccgcatcttct

SEQ ID NO: 4498793 - DNA, 18 bp, Homo sapiens
agaagccaactatgatta

SEQ ID NO: 4498794 - DNA, 23 bp, Homo sapiens
agaagccaactatgattattaac

SEQ ID NO: 4498795 - DNA, 18 bp, Homo sapiens
agaagccaagggaaaggg

SEQ ID NO: 4498796 - DNA, 13 bp, Homo sapiens
agaagccacagaa

SEQ ID NO: 4498797 - DNA, 22 bp, Homo sapiens
agaagccatatatgaccagaag

SEQ ID NO: 4498798 - DNA, 20 bp, Homo sapiens
agaagccccttccccatggg

SEQ ID NO: 4498799 - DNA, 12 bp, Homo sapiens
agaagcctctgg

SEQ ID NO: 4498800 - DNA, 14 bp, Homo sapiens
agaagcctctggct

SEQ ID NO: 4498801 - DNA, 11 bp, Homo sapiens
agaagcctgca

SEQ ID NO: 4498802 - DNA, 24 bp, Homo sapiens
agaagccttggaaccagccccatc

SEQ ID NO: 4498803 - DNA, 16 bp, Homo sapiens
agaagcgctcatctgg

SEQ ID NO: 4498804 - DNA, 17 bp, Homo sapiens
agaagcggcatagcacc

SEQ ID NO: 4498805 - DNA, 21 bp, Homo sapiens
agaagctgaagatccccaact

SEQ ID NO: 4498806 - DNA, 13 bp, Homo sapiens
agaagctggagga

SEQ ID NO: 4498807 - DNA, 16 bp, Homo sapiens
agaagctggaggacta

SEQ ID NO: 4498808 - DNA, 18 bp, Homo sapiens
agaagcttccacaaaatt

SEQ ID NO: 4498809 - DNA, 14 bp, Homo sapiens
agaaggaaaaagaa

SEQ ID NO: 4498810 - DNA, 19 bp, Homo sapiens
agaaggaaggatgccactt

SEQ ID NO: 4498811 - DNA, 14 bp, Homo sapiens
agaaggagaaggaa

SEQ ID NO: 4498812 - DNA, 22 bp, Homo sapiens
agaaggagtagctgccctttct

SEQ ID NO: 4498813 - DNA, 11 bp, Homo sapiens
agaaggcaaaa

SEQ ID NO: 4498814 - DNA, 15 bp, Homo sapiens
agaaggcaaaaatgt

SEQ ID NO: 4498815 - DNA, 13 bp, Homo sapiens
agaaggcaatatt

SEQ ID NO: 4498816 - DNA, 16 bp, Homo sapiens
agaaggcagcctaggc

SEQ ID NO: 4498817 - DNA, 19 bp, Homo sapiens
agaaggccccagagagacc

SEQ ID NO: 4498818 - DNA, 22 bp, Homo sapiens
agaaggccccagagagaccctg

SEQ ID NO: 4498819 - DNA, 21 bp, Homo sapiens
agaagggctagaacctggagg

SEQ ID NO: 4498820 - DNA, 20 bp, Homo sapiens
agaagggggtggtgtctcca

SEQ ID NO: 4498821 - DNA, 19 bp, Homo sapiens
agaaggtcactactgcatt

SEQ ID NO: 4498822 - DNA, 18 bp, Homo sapiens
agaaggtttctggagcag

SEQ ID NO: 4498823 - DNA, 15 bp, Homo sapiens
agaagtaatcagtat

SEQ ID NO: 4498824 - DNA, 17 bp, Homo sapiens
agaagtagaaatcatag

SEQ ID NO: 4498825 - DNA, 19 bp, Homo sapiens
agaagtatttttttaattt

SEQ ID NO: 4498826 - DNA, 15 bp, Homo sapiens
agaagtcatcttgct

SEQ ID NO: 4498827 - DNA, 15 bp, Homo sapiens
agaagtccacaggac

SEQ ID NO: 4498828 - DNA, 14 bp, Homo sapiens
agaagtcggaatgt

SEQ ID NO: 4498829 - DNA, 22 bp, Homo sapiens
agaagtcttaattgtgtttatt

SEQ ID NO: 4498830 - DNA, 18 bp, Homo sapiens
agaagtcttctatttatt

SEQ ID NO: 4498831 - DNA, 21 bp, Homo sapiens
agaagtcttctatttatttat

SEQ ID NO: 4498832 - DNA, 21 bp, Homo sapiens
agaagtgaaaatctacactcc

SEQ ID NO: 4498833 - DNA, 22 bp, Homo sapiens
agaagtgagtggtgtgactctt

SEQ ID NO: 4498834 - DNA, 14 bp, Homo sapiens
agaagtgctttata

SEQ ID NO: 4498835 - DNA, 15 bp, Homo sapiens
agaagtggaccagga

SEQ ID NO: 4498836 - DNA, 23 bp, Homo sapiens
agaagtggaccaggacaggacca

SEQ ID NO: 4498837 - DNA, 17 bp, Homo sapiens
agaagtgggccaggaca

SEQ ID NO: 4498838 - DNA, 23 bp, Homo sapiens
agaagtgggccaggacaggcccg

SEQ ID NO: 4498839 - DNA, 20 bp, Homo sapiens
agaagttaaaaaacagctgc

SEQ ID NO: 4498840 - DNA, 16 bp, Homo sapiens
agaagttagtttgtat

SEQ ID NO: 4498841 - DNA, 15 bp, Homo sapiens
agaagttgtgctaaa

SEQ ID NO: 4498842 - DNA, 19 bp, Homo sapiens
agaagtttcgaggggtcct

SEQ ID NO: 4498843 - DNA, 15 bp, Homo sapiens
agaagtttgtcaagt

SEQ ID NO: 4498844 - DNA, 13 bp, Homo sapiens
actgtttcagtgt

SEQ ID NO: 4498845 - DNA, 22 bp, Homo sapiens
actgtttcagtgtgagtcagaa

SEQ ID NO: 4498846 - DNA, 22 bp, Homo sapiens
actgtttgatataccaaattaa

SEQ ID NO: 4498847 - DNA, 23 bp, Homo sapiens
actgtttgatataccaaattaaa

SEQ ID NO: 4498848 - DNA, 23 bp, Homo sapiens
actgtttgcacttacagcttttt

SEQ ID NO: 4498849 - DNA, 22 bp, Homo sapiens
actgtttgtttttatttaaatt

SEQ ID NO: 4498850 - DNA, 14 bp, Homo sapiens
actgttttagaaat

SEQ ID NO: 4498851 - DNA, 17 bp, Homo sapiens
acgtcaggcctggcctc

SEQ ID NO: 4498852 - DNA, 21 bp, Homo sapiens
acgtcatcggaggctgggccc

SEQ ID NO: 4498853 - DNA, 16 bp, Homo sapiens
acgtccaaggtggcag

SEQ ID NO: 4498854 - DNA, 21 bp, Homo sapiens
acgtccaggtccgtagctccc

SEQ ID NO: 4498855 - DNA, 20 bp, Homo sapiens
acgtcccagcatccctggag

SEQ ID NO: 4498856 - DNA, 14 bp, Homo sapiens
acgtcccctccgcc

SEQ ID NO: 4498857 - DNA, 19 bp, Homo sapiens
acgtctagctatgctgtat

SEQ ID NO: 4498858 - DNA, 16 bp, Homo sapiens
acgtctcgccaagcag

SEQ ID NO: 4498859 - DNA, 14 bp, Homo sapiens
acgtctggggtgtg

SEQ ID NO: 4498860 - DNA, 19 bp, Homo sapiens
acgtctgtcaggggcttgg

SEQ ID NO: 4498861 - DNA, 12 bp, Homo sapiens
acgtcttccttc

SEQ ID NO: 4498862 - DNA, 19 bp, Homo sapiens
acgtgaacgttttaataat

SEQ ID NO: 4498863 - DNA, 14 bp, Homo sapiens
acgtgaatgtctca

SEQ ID NO: 4498864 - DNA, 14 bp, Homo sapiens
acgtgactgcccca

SEQ ID NO: 4498865 - DNA, 18 bp, Homo sapiens
acgtgactgccccaactc

SEQ ID NO: 4498866 - DNA, 20 bp, Homo sapiens
acgtgactgccccaactcct

SEQ ID NO: 4498867 - DNA, 18 bp, Homo sapiens
acgtgatggtctgagact

SEQ ID NO: 4498868 - DNA, 16 bp, Homo sapiens
acgtgccagctctagt

SEQ ID NO: 4498869 - DNA, 13 bp, Homo sapiens
acgtgccaggccc

SEQ ID NO: 4498870 - DNA, 18 bp, Homo sapiens
acgtgccaggcccggggc

SEQ ID NO: 4498871 - DNA, 14 bp, Homo sapiens
acgtgctcactgtg

SEQ ID NO: 4498872 - DNA, 18 bp, Homo sapiens
acgtgctctgtgggtctc

SEQ ID NO: 4498873 - DNA, 22 bp, Homo sapiens
acgtgtcagaagcctccaagcc

SEQ ID NO: 4498874 - DNA, 13 bp, Homo sapiens
acgttaaagtagg

SEQ ID NO: 4498875 - DNA, 13 bp, Homo sapiens
acgttaggaccag

SEQ ID NO: 4498876 - DNA, 19 bp, Homo sapiens
acgttatatattgtattaa

SEQ ID NO: 4498877 - DNA, 16 bp, Homo sapiens
acgttccttactgcag

SEQ ID NO: 4498878 - DNA, 19 bp, Homo sapiens
acgttccttactgcagaat

SEQ ID NO: 4498879 - DNA, 21 bp, Homo sapiens
acgttccttactgcagaatag

SEQ ID NO: 4498880 - DNA, 12 bp, Homo sapiens
acgttctgattt

SEQ ID NO: 4498881 - DNA, 19 bp, Homo sapiens
acgttggagtttgggctgg

SEQ ID NO: 4498882 - DNA, 20 bp, Homo sapiens
acgttggagtttgggctgga

SEQ ID NO: 4498883 - DNA, 14 bp, Homo sapiens
acgtttaaagttct

SEQ ID NO: 4498884 - DNA, 18 bp, Homo sapiens
acgtttgacaaacacaat

SEQ ID NO: 4498885 - DNA, 16 bp, Homo sapiens
actgccccacatgcat

SEQ ID NO: 4498886 - DNA, 20 bp, Homo sapiens
actgccccacggagacagag

SEQ ID NO: 4498887 - DNA, 12 bp, Homo sapiens
actgccccacgt

SEQ ID NO: 4498888 - DNA, 16 bp, Homo sapiens
actgcccccagaaagc

SEQ ID NO: 4498889 - DNA, 19 bp, Homo sapiens
actgccccccgaggctgct

SEQ ID NO: 4498890 - DNA, 14 bp, Homo sapiens
actgccccctcctg

SEQ ID NO: 4498891 - DNA, 18 bp, Homo sapiens
actgccccctcctgtgta

SEQ ID NO: 4498892 - DNA, 15 bp, Homo sapiens
actgcccctgctgtg

SEQ ID NO: 4498893 - DNA, 12 bp, Homo sapiens
actgccctggct

SEQ ID NO: 4498894 - DNA, 15 bp, Homo sapiens
actgcccttgctgcc

SEQ ID NO: 4498895 - DNA, 23 bp, Homo sapiens
actgcctgtagcaatggccagag

SEQ ID NO: 4498896 - DNA, 19 bp, Homo sapiens
actgcctttagaaaatata

SEQ ID NO: 4498897 - DNA, 22 bp, Homo sapiens
actgcgaagaccctcttgccca

SEQ ID NO: 4498898 - DNA, 17 bp, Homo sapiens
actgcgaggacatcaaa

SEQ ID NO: 4498899 - DNA, 16 bp, Homo sapiens
actgcgggagccagac

SEQ ID NO: 4498900 - DNA, 17 bp, Homo sapiens
actgcgggagctctgta

SEQ ID NO: 4498901 - DNA, 14 bp, Homo sapiens
actgcgtccaccct

SEQ ID NO: 4498902 - DNA, 15 bp, Homo sapiens
actgcgtccaccctg

SEQ ID NO: 4498903 - DNA, 19 bp, Homo sapiens
actgcgtccaccctgagct

SEQ ID NO: 4498904 - DNA, 20 bp, Homo sapiens
actgctaaataaaatttgtt

SEQ ID NO: 4498905 - DNA, 14 bp, Homo sapiens
actgctcagcttct

SEQ ID NO: 4498906 - DNA, 12 bp, Homo sapiens
actgctccagcc

SEQ ID NO: 4498907 - DNA, 14 bp, Homo sapiens
actgctccagcctc

SEQ ID NO: 4498908 - DNA, 15 bp, Homo sapiens
actgctccagcctct

SEQ ID NO: 4498909 - DNA, 16 bp, Homo sapiens
actgctccagcctctg

SEQ ID NO: 4498910 - DNA, 17 bp, Homo sapiens
actgctccagcctctgc

SEQ ID NO: 4498911 - DNA, 13 bp, Homo sapiens
actgctccaggcc

SEQ ID NO: 4498912 - DNA, 20 bp, Homo sapiens
actgctcgtggactgtgctg

SEQ ID NO: 4498913 - DNA, 22 bp, Homo sapiens
actgctctttattgcagaatgt

SEQ ID NO: 4498914 - DNA, 13 bp, Homo sapiens
actgctgattctt

SEQ ID NO: 4498915 - DNA, 14 bp, Homo sapiens
actgctgattcttg

SEQ ID NO: 4498916 - DNA, 15 bp, Homo sapiens
actgctgattcttgt

SEQ ID NO: 4498917 - DNA, 16 bp, Homo sapiens
actgctgattcttgta

SEQ ID NO: 4498918 - DNA, 15 bp, Homo sapiens
actgctgcagattag

SEQ ID NO: 4498919 - DNA, 12 bp, Homo sapiens
actgctgctctc

SEQ ID NO: 4498920 - DNA, 14 bp, Homo sapiens
actgctgctctccc

SEQ ID NO: 4498921 - DNA, 18 bp, Homo sapiens
actgctgctctcccaagg

SEQ ID NO: 4498922 - DNA, 18 bp, Homo sapiens
actgctgctgctgctgcc

SEQ ID NO: 4498923 - DNA, 22 bp, Homo sapiens
actgctgtaaataaatgcttta

SEQ ID NO: 4498924 - DNA, 17 bp, Homo sapiens
actgcttatgaaaagta

SEQ ID NO: 4498925 - DNA, 16 bp, Homo sapiens
actgcttcttggagct

SEQ ID NO: 4498926 - DNA, 23 bp, Homo sapiens
actgcttgaactaggctgagcaa

SEQ ID NO: 4498927 - DNA, 15 bp, Homo sapiens
actgcttgaggaaaa

SEQ ID NO: 4498928 - DNA, 12 bp, Homo sapiens
actgctttctgt

SEQ ID NO: 4498929 - DNA, 17 bp, Homo sapiens
actgctttctgttccaa

SEQ ID NO: 4498930 - DNA, 19 bp, Homo sapiens
actgcttttaaaagtgcac

SEQ ID NO: 4498931 - DNA, 22 bp, Homo sapiens
actgcttttaaaagtgcacatt

SEQ ID NO: 4498932 - DNA, 18 bp, Homo sapiens
actggaaacaaaacagaa

SEQ ID NO: 4498933 - DNA, 15 bp, Homo sapiens
actggaaaggggaga

SEQ ID NO: 4498934 - DNA, 20 bp, Homo sapiens
actggaaaggggagagcctg

SEQ ID NO: 4498935 - DNA, 23 bp, Homo sapiens
actggaaaggggagagcctgctg

SEQ ID NO: 4498936 - DNA, 13 bp, Homo sapiens
actggaagaaagc

SEQ ID NO: 4498937 - DNA, 21 bp, Homo sapiens
actggaagcatgtaggagaat

SEQ ID NO: 4498938 - DNA, 16 bp, Homo sapiens
actggaagctaatttg

SEQ ID NO: 4498939 - DNA, 20 bp, Homo sapiens
actggaagctaatttgcatt

SEQ ID NO: 4498940 - DNA, 21 bp, Homo sapiens
actggaaggaacatggagctg

SEQ ID NO: 4498941 - DNA, 19 bp, Homo sapiens
actggaatataaaacagtc

SEQ ID NO: 4498942 - DNA, 22 bp, Homo sapiens
actggaatggtgttttgtcaga

SEQ ID NO: 4498943 - DNA, 22 bp, Homo sapiens
actggagatgcatcgggaaaga

SEQ ID NO: 4498944 - DNA, 15 bp, Homo sapiens
actggagcaccaggc

SEQ ID NO: 4498945 - DNA, 16 bp, Homo sapiens
actggagcaccaggca

SEQ ID NO: 4498946 - DNA, 19 bp, Homo sapiens
actggagcctgcattatgc

SEQ ID NO: 4498947 - DNA, 20 bp, Homo sapiens
actggaggaggcctgtccca

SEQ ID NO: 4498948 - DNA, 17 bp, Homo sapiens
actggaggttgaagcca

SEQ ID NO: 4498949 - DNA, 19 bp, Homo sapiens
actggaggttgaagccaag

SEQ ID NO: 4498950 - DNA, 23 bp, Homo sapiens
actggagttccttatccctctct

SEQ ID NO: 4498951 - DNA, 13 bp, Homo sapiens
actggataaattg

SEQ ID NO: 4498952 - DNA, 21 bp, Homo sapiens
actggcaaacagggcctctgc

SEQ ID NO: 4498953 - DNA, 19 bp, Homo sapiens
actggcacagttttctgag

SEQ ID NO: 4498954 - DNA, 23 bp, Homo sapiens
actggcactggtggtttttgctc

SEQ ID NO: 4498955 - DNA, 21 bp, Homo sapiens
actggcatggatatagtttta

SEQ ID NO: 4498956 - DNA, 18 bp, Homo sapiens
actggccacccctcccca

SEQ ID NO: 4498957 - DNA, 22 bp, Homo sapiens
actggccagggccacgctccag

SEQ ID NO: 4498958 - DNA, 14 bp, Homo sapiens
actggcccctgggt

SEQ ID NO: 4498959 - DNA, 18 bp, Homo sapiens
actggccgctgagcgccc

SEQ ID NO: 4498960 - DNA, 15 bp, Homo sapiens
actggcctcaaagca

SEQ ID NO: 4498961 - DNA, 22 bp, Homo sapiens
actggcctcaaagcaagcattc

SEQ ID NO: 4498962 - DNA, 13 bp, Homo sapiens
actggcctctccc

SEQ ID NO: 4498963 - DNA, 19 bp, Homo sapiens
actggcgacacgtagcagc

SEQ ID NO: 4498964 - DNA, 22 bp, Homo sapiens
actggcggtcaagtgtggagga

SEQ ID NO: 4498965 - DNA, 19 bp, Homo sapiens
actggcgttcacctccctg

SEQ ID NO: 4498966 - DNA, 12 bp, Homo sapiens
actggctcaccc

SEQ ID NO: 4498967 - DNA, 9 bp, Homo sapiens
actggctga

SEQ ID NO: 4498968 - DNA, 16 bp, Homo sapiens
actggcttccccactc

SEQ ID NO: 4498969 - DNA, 21 bp, Homo sapiens
actggcttttattaatgcact

SEQ ID NO: 4498970 - DNA, 20 bp, Homo sapiens
actgggagccacttctcccc

SEQ ID NO: 4498971 - DNA, 21 bp, Homo sapiens
actgggataactgatttctat

SEQ ID NO: 4498972 - DNA, 22 bp, Homo sapiens
actgggattaagaaaccttgct

SEQ ID NO: 4498973 - DNA, 23 bp, Homo sapiens
actgggattaagaaaccttgctc

SEQ ID NO: 4498974 - DNA, 16 bp, Homo sapiens
actgggcactggggcc

SEQ ID NO: 4498975 - DNA, 19 bp, Homo sapiens
actgggcccgagcctgaac

SEQ ID NO: 4498976 - DNA, 18 bp, Homo sapiens
actggggaggctgaggca

SEQ ID NO: 4498977 - DNA, 19 bp, Homo sapiens
actggggaggctgaggcag

SEQ ID NO: 4498978 - DNA, 15 bp, Homo sapiens
actggggtgccgcct

SEQ ID NO: 4498979 - DNA, 24 bp, Homo sapiens
actggggtgccttcactgggccag

SEQ ID NO: 4498980 - DNA, 14 bp, Homo sapiens
actgggtaatgaaa

SEQ ID NO: 4498981 - DNA, 14 bp, Homo sapiens
actgggtcttcagc

SEQ ID NO: 4498982 - DNA, 20 bp, Homo sapiens
actggtacccgcccttccga

SEQ ID NO: 4498983 - DNA, 20 bp, Homo sapiens
actggtacttagagtttctg

SEQ ID NO: 4498984 - DNA, 21 bp, Homo sapiens
actggtccaaaagattgctga

SEQ ID NO: 4498985 - DNA, 22 bp, Homo sapiens
actggtccaggtcttcagtttc

SEQ ID NO: 4498986 - DNA, 16 bp, Homo sapiens
actggtgaatataaat

SEQ ID NO: 4498987 - DNA, 18 bp, Homo sapiens
actggtgcctggcacagc

SEQ ID NO: 4498988 - DNA, 21 bp, Homo sapiens
acctacagactccatctcttc

SEQ ID NO: 4498989 - DNA, 15 bp, Homo sapiens
acctacagtgtacag

SEQ ID NO: 4498990 - DNA, 18 bp, Homo sapiens
acctacagtgtacagtct

SEQ ID NO: 4498991 - DNA, 20 bp, Homo sapiens
acctacagtgtacagtcttg

SEQ ID NO: 4498992 - DNA, 13 bp, Homo sapiens
acctacatatttg

SEQ ID NO: 4498993 - DNA, 14 bp, Homo sapiens
acctaccaggacag

SEQ ID NO: 4498994 - DNA, 22 bp, Homo sapiens
acctacgagggaggaacacctg

SEQ ID NO: 4498995 - DNA, 13 bp, Homo sapiens
acctactttcttc

SEQ ID NO: 4498996 - DNA, 20 bp, Homo sapiens
acctactttgactttttgca

SEQ ID NO: 4498997 - DNA, 21 bp, Homo sapiens
acctagaacgtgcatccttgt

SEQ ID NO: 4498998 - DNA, 14 bp, Homo sapiens
acctagaagggcta

SEQ ID NO: 4498999 - DNA, 17 bp, Homo sapiens
acctagactctccctgt

SEQ ID NO: 4499000 - DNA, 18 bp, Homo sapiens
acctagctggctctgtga

SEQ ID NO: 4499001 - DNA, 16 bp, Homo sapiens
acctagtccgctgaag

SEQ ID NO: 4499002 - DNA, 19 bp, Homo sapiens
acctatacaacctaactta

SEQ ID NO: 4499003 - DNA, 15 bp, Homo sapiens
acctatctcagccat

SEQ ID NO: 4499004 - DNA, 22 bp, Homo sapiens
acctatgagatggccatgctca

SEQ ID NO: 4499005 - DNA, 15 bp, Homo sapiens
acctattaaaagttg

SEQ ID NO: 4499006 - DNA, 14 bp, Homo sapiens
acctattgaattac

SEQ ID NO: 4499007 - DNA, 16 bp, Homo sapiens
acctattgaattacca

SEQ ID NO: 4499008 - DNA, 12 bp, Homo sapiens
acctatttcttt

SEQ ID NO: 4499009 - DNA, 14 bp, Homo sapiens
acctattttagggt

SEQ ID NO: 4499010 - DNA, 21 bp, Homo sapiens
acctattttagggttctaaat

SEQ ID NO: 4499011 - DNA, 17 bp, Homo sapiens
acctcaacaagaagaat

SEQ ID NO: 4499012 - DNA, 16 bp, Homo sapiens
acctcaacctgtaaat

SEQ ID NO: 4499013 - DNA, 19 bp, Homo sapiens
acctcaacctgtaaattat

SEQ ID NO: 4499014 - DNA, 21 bp, Homo sapiens
acctcaacctgtaaattattt

SEQ ID NO: 4499015 - DNA, 23 bp, Homo sapiens
acctcaacctgtaaattatttta

SEQ ID NO: 4499016 - DNA, 19 bp, Homo sapiens
acctcaagccccatttcct

SEQ ID NO: 4499017 - DNA, 20 bp, Homo sapiens
acctcaagccccatttcctc

SEQ ID NO: 4499018 - DNA, 19 bp, Homo sapiens
acctcaaggtaacaagagt

SEQ ID NO: 4499019 - DNA, 21 bp, Homo sapiens
acctcaatcagtctcagaatg

SEQ ID NO: 4499020 - DNA, 14 bp, Homo sapiens
acctcaccctgcta

SEQ ID NO: 4499021 - DNA, 23 bp, Homo sapiens
acctcactatggtatgctggcca

SEQ ID NO: 4499022 - DNA, 24 bp, Homo sapiens
acctcactatggtatgctggccag

SEQ ID NO: 4499023 - DNA, 16 bp, Homo sapiens
acctcactctttatag

SEQ ID NO: 4499024 - DNA, 12 bp, Homo sapiens
acctcactgtcc

SEQ ID NO: 4499025 - DNA, 14 bp, Homo sapiens
acctcactgtccaa

SEQ ID NO: 4499026 - DNA, 13 bp, Homo sapiens
acctcagcaagct

SEQ ID NO: 4499027 - DNA, 21 bp, Homo sapiens
acctcagcaagctgcccagcc

SEQ ID NO: 4499028 - DNA, 23 bp, Homo sapiens
acctcagcaagctgcccagccct

SEQ ID NO: 4499029 - DNA, 24 bp, Homo sapiens
acctcagcaagctgcccagccctg

SEQ ID NO: 4499030 - DNA, 23 bp, Homo sapiens
acctcagccatgaggagttgctg

SEQ ID NO: 4499031 - DNA, 16 bp, Homo sapiens
accccagaggcagagg

SEQ ID NO: 4499032 - DNA, 17 bp, Homo sapiens
accccagaggcagaggt

SEQ ID NO: 4499033 - DNA, 13 bp, Homo sapiens
accccagagtgtg

SEQ ID NO: 4499034 - DNA, 17 bp, Homo sapiens
accccagcattccagct

SEQ ID NO: 4499035 - DNA, 21 bp, Homo sapiens
accccagcattccagctctgc

SEQ ID NO: 4499036 - DNA, 13 bp, Homo sapiens
accccagcggctg

SEQ ID NO: 4499037 - DNA, 14 bp, Homo sapiens
accccaggccccga

SEQ ID NO: 4499038 - DNA, 15 bp, Homo sapiens
accccaggccccgag

SEQ ID NO: 4499039 - DNA, 12 bp, Homo sapiens
accccagttcct

SEQ ID NO: 4499040 - DNA, 16 bp, Homo sapiens
accccatccagccaga

SEQ ID NO: 4499041 - DNA, 18 bp, Homo sapiens
accccatccctccttaag

SEQ ID NO: 4499042 - DNA, 18 bp, Homo sapiens
acccccaaatttaattaa

SEQ ID NO: 4499043 - DNA, 15 bp, Homo sapiens
acccccacacctcag

SEQ ID NO: 4499044 - DNA, 17 bp, Homo sapiens
acccccacacctcagtt

SEQ ID NO: 4499045 - DNA, 15 bp, Homo sapiens
acccccaccccacac

SEQ ID NO: 4499046 - DNA, 18 bp, Homo sapiens
acccccactctcattccc

SEQ ID NO: 4499047 - DNA, 11 bp, Homo sapiens
acccccagccc

SEQ ID NO: 4499048 - DNA, 14 bp, Homo sapiens
acccccagcccaca

SEQ ID NO: 4499049 - DNA, 18 bp, Homo sapiens
acccccagcccacagagc

SEQ ID NO: 4499050 - DNA, 12 bp, Homo sapiens
acccccagcccc

SEQ ID NO: 4499051 - DNA, 17 bp, Homo sapiens
acccccatgctgccttc

SEQ ID NO: 4499052 - DNA, 22 bp, Homo sapiens
accccccacactcactcctgag

SEQ ID NO: 4499053 - DNA, 15 bp, Homo sapiens
accccccagcactga

SEQ ID NO: 4499054 - DNA, 21 bp, Homo sapiens
accccccagcccctcctccct

SEQ ID NO: 4499055 - DNA, 19 bp, Homo sapiens
acccccctccccaactccc

SEQ ID NO: 4499056 - DNA, 20 bp, Homo sapiens
acccccctccccaactccct

SEQ ID NO: 4499057 - DNA, 18 bp, Homo sapiens
acccccctctctttctct

SEQ ID NO: 4499058 - DNA, 21 bp, Homo sapiens
acccccctctctttctctggt

SEQ ID NO: 4499059 - DNA, 22 bp, Homo sapiens
acccccgagtttggtccctggg

SEQ ID NO: 4499060 - DNA, 13 bp, Homo sapiens
accccctcccacc

SEQ ID NO: 4499061 - DNA, 18 bp, Homo sapiens
accccctcgggtctcctc

SEQ ID NO: 4499062 - DNA, 21 bp, Homo sapiens
accccctcgggtctcctcact

SEQ ID NO: 4499063 - DNA, 19 bp, Homo sapiens
accccctgctccaccagca

SEQ ID NO: 4499064 - DNA, 21 bp, Homo sapiens
accccctgctccaccagcagc

SEQ ID NO: 4499065 - DNA, 22 bp, Homo sapiens
accccctgctccaccagcagca

SEQ ID NO: 4499066 - DNA, 21 bp, Homo sapiens
accccctgtcccattctagat

SEQ ID NO: 4499067 - DNA, 18 bp, Homo sapiens
acccccttcagtgcccac

SEQ ID NO: 4499068 - DNA, 19 bp, Homo sapiens
acccccttctccatccaca

SEQ ID NO: 4499069 - DNA, 14 bp, Homo sapiens
acccccttctctgc

SEQ ID NO: 4499070 - DNA, 16 bp, Homo sapiens
acccccttctctgctc

SEQ ID NO: 4499071 - DNA, 23 bp, Homo sapiens
acccccttctctgctccaccaca

SEQ ID NO: 4499072 - DNA, 15 bp, Homo sapiens
accccgacttttgtt

SEQ ID NO: 4499073 - DNA, 22 bp, Homo sapiens
accccgaggtaggggtggggag

SEQ ID NO: 4499074 - DNA, 14 bp, Homo sapiens
accccgctctgcat

SEQ ID NO: 4499075 - DNA, 23 bp, Homo sapiens
accccgctctgcatgcggcccag

SEQ ID NO: 4499076 - DNA, 18 bp, Homo sapiens
accccgggctctctgctg

SEQ ID NO: 4499077 - DNA, 18 bp, Homo sapiens
accccggggaccctgtga

SEQ ID NO: 4499078 - DNA, 16 bp, Homo sapiens
accccgtctctactaa

SEQ ID NO: 4499079 - DNA, 18 bp, Homo sapiens
acccctcctccctcagac

SEQ ID NO: 4499080 - DNA, 21 bp, Homo sapiens
acccctcctccctcagactca

SEQ ID NO: 4499081 - DNA, 13 bp, Homo sapiens
acccctccttccc

SEQ ID NO: 4499082 - DNA, 20 bp, Homo sapiens
acccctccttccccagaccc

SEQ ID NO: 4499083 - DNA, 21 bp, Homo sapiens
acccctccttccccagaccca

SEQ ID NO: 4499084 - DNA, 13 bp, Homo sapiens
acccctcgcccca

SEQ ID NO: 4499085 - DNA, 14 bp, Homo sapiens
acccctctgcccct

SEQ ID NO: 4499086 - DNA, 22 bp, Homo sapiens
acccctctgcccctgcagctgg

SEQ ID NO: 4499087 - DNA, 18 bp, Homo sapiens
acccctgagccagcaggg

SEQ ID NO: 4499088 - DNA, 12 bp, Homo sapiens
acccctgccccc

SEQ ID NO: 4499089 - DNA, 17 bp, Homo sapiens
acccctgcctccaccct

SEQ ID NO: 4499090 - DNA, 19 bp, Homo sapiens
acccctgctcccattcctc

SEQ ID NO: 4499091 - DNA, 23 bp, Homo sapiens
acccctgctcccattcctccctc

SEQ ID NO: 4499092 - DNA, 13 bp, Homo sapiens
acccctggcctcc

SEQ ID NO: 4499093 - DNA, 22 bp, Homo sapiens
acccctggggctgagtctccag

SEQ ID NO: 4499094 - DNA, 14 bp, Homo sapiens
acccctggttctca

SEQ ID NO: 4499095 - DNA, 14 bp, Homo sapiens
accccttagcctcc

SEQ ID NO: 4499096 - DNA, 19 bp, Homo sapiens
acccgagttcctctgggtt

SEQ ID NO: 4499097 - DNA, 22 bp, Homo sapiens
acccgccgccactaggtgtccc

SEQ ID NO: 4499098 - DNA, 21 bp, Homo sapiens
acccgccgcctcccacggcac

SEQ ID NO: 4499099 - DNA, 22 bp, Homo sapiens
acccggcaggctagaacctggc

SEQ ID NO: 4499100 - DNA, 20 bp, Homo sapiens
accatcttttattctttttt

SEQ ID NO: 4499101 - DNA, 19 bp, Homo sapiens
accatgcactgtaaatatc

SEQ ID NO: 4499102 - DNA, 21 bp, Homo sapiens
accatgccagattctgcctct

SEQ ID NO: 4499103 - DNA, 20 bp, Homo sapiens
accatgcccggctaattttt

SEQ ID NO: 4499104 - DNA, 17 bp, Homo sapiens
accatgcctcactaatt

SEQ ID NO: 4499105 - DNA, 17 bp, Homo sapiens
accatgcctcccagagc

SEQ ID NO: 4499106 - DNA, 20 bp, Homo sapiens
accatgcgtcaggggcctag

SEQ ID NO: 4499107 - DNA, 23 bp, Homo sapiens
accatgctctctcacctgctccc

SEQ ID NO: 4499108 - DNA, 18 bp, Homo sapiens
accatgcttgcctgaagc

SEQ ID NO: 4499109 - DNA, 16 bp, Homo sapiens
accatggccaattcag

SEQ ID NO: 4499110 - DNA, 12 bp, Homo sapiens
accatgtcattt

SEQ ID NO: 4499111 - DNA, 15 bp, Homo sapiens
accatgtcatttcag

SEQ ID NO: 4499112 - DNA, 14 bp, Homo sapiens
accatgtgcaataa

SEQ ID NO: 4499113 - DNA, 23 bp, Homo sapiens
accatgtgcaataagattggtgt

SEQ ID NO: 4499114 - DNA, 18 bp, Homo sapiens
accatgttggcctcttca

SEQ ID NO: 4499115 - DNA, 14 bp, Homo sapiens
accattacctgtac

SEQ ID NO: 4499116 - DNA, 20 bp, Homo sapiens
accattatactttatatctg

SEQ ID NO: 4499117 - DNA, 14 bp, Homo sapiens
accattatgatcaa

SEQ ID NO: 4499118 - DNA, 21 bp, Homo sapiens
accattatggataaagatgag

SEQ ID NO: 4499119 - DNA, 17 bp, Homo sapiens
accattcatctctaaca

SEQ ID NO: 4499120 - DNA, 15 bp, Homo sapiens
accattctcctgcct

SEQ ID NO: 4499121 - DNA, 18 bp, Homo sapiens
accattgaattcttggtt

SEQ ID NO: 4499122 - DNA, 12 bp, Homo sapiens
accattggctgc

SEQ ID NO: 4499123 - DNA, 17 bp, Homo sapiens
accattggggctcccag

SEQ ID NO: 4499124 - DNA, 20 bp, Homo sapiens
accatttaaagaaagaatgc

SEQ ID NO: 4499125 - DNA, 13 bp, Homo sapiens
accatttctgggg

SEQ ID NO: 4499126 - DNA, 20 bp, Homo sapiens
accatttcttggcattggaa

SEQ ID NO: 4499127 - DNA, 18 bp, Homo sapiens
accatttgctactgtaca

SEQ ID NO: 4499128 - DNA, 20 bp, Homo sapiens
accatttgtattaccattac

SEQ ID NO: 4499129 - DNA, 15 bp, Homo sapiens
accatttgttaatat

SEQ ID NO: 4499130 - DNA, 15 bp, Homo sapiens
accattttaaagtta

SEQ ID NO: 4499131 - DNA, 17 bp, Homo sapiens
accatttttcattcact

SEQ ID NO: 4499132 - DNA, 18 bp, Homo sapiens
acccaaaaggcagaagca

SEQ ID NO: 4499133 - DNA, 23 bp, Homo sapiens
acccaaaagtcaaaaggtgcctg

SEQ ID NO: 4499134 - DNA, 22 bp, Homo sapiens
acccaaagcggtccctgtccct

SEQ ID NO: 4499135 - DNA, 20 bp, Homo sapiens
acccaaatgttcatcaatga

SEQ ID NO: 4499136 - DNA, 12 bp, Homo sapiens
acccaacagttt

SEQ ID NO: 4499137 - DNA, 13 bp, Homo sapiens
acccaacagttta

SEQ ID NO: 4499138 - DNA, 16 bp, Homo sapiens
acccaagacatgacat

SEQ ID NO: 4499139 - DNA, 19 bp, Homo sapiens
acccaagcctgctggctgc

SEQ ID NO: 4499140 - DNA, 13 bp, Homo sapiens
acccaaggactga

SEQ ID NO: 4499141 - DNA, 16 bp, Homo sapiens
acccaagtccctgtca

SEQ ID NO: 4499142 - DNA, 14 bp, Homo sapiens
acccaatccaaatg

SEQ ID NO: 4499143 - DNA, 15 bp, Homo sapiens
acccacaagaaatga

SEQ ID NO: 4499144 - DNA, 16 bp, Homo sapiens
acccacacctctgcca

SEQ ID NO: 4499145 - DNA, 15 bp, Homo sapiens
acccacattactttt

SEQ ID NO: 4499146 - DNA, 17 bp, Homo sapiens
acccaccacccccttta

SEQ ID NO: 4499147 - DNA, 13 bp, Homo sapiens
acccaccaggcca

SEQ ID NO: 4499148 - DNA, 12 bp, Homo sapiens
acccaccccaac

SEQ ID NO: 4499149 - DNA, 12 bp, Homo sapiens
acccacccctgc

SEQ ID NO: 4499150 - DNA, 16 bp, Homo sapiens
acccacctctcctgcc

SEQ ID NO: 4499151 - DNA, 18 bp, Homo sapiens
acccacctctcctgccct

SEQ ID NO: 4499152 - DNA, 17 bp, Homo sapiens
acccacctgctgagaga

SEQ ID NO: 4499153 - DNA, 19 bp, Homo sapiens
acccacctgtggggcctgg

SEQ ID NO: 4499154 - DNA, 21 bp, Homo sapiens
acccacctgtggggcctgggg

SEQ ID NO: 4499155 - DNA, 23 bp, Homo sapiens
acccactcggatggaccaacctg

SEQ ID NO: 4499156 - DNA, 18 bp, Homo sapiens
acccactctcctctgcct

SEQ ID NO: 4499157 - DNA, 22 bp, Homo sapiens
acccactttaaaatatctacat

SEQ ID NO: 4499158 - DNA, 21 bp, Homo sapiens
acccactttgtaatttttgct

SEQ ID NO: 4499159 - DNA, 18 bp, Homo sapiens
acccagaatgagacatcc

SEQ ID NO: 4499160 - DNA, 14 bp, Homo sapiens
acccagaatggagc

SEQ ID NO: 4499161 - DNA, 18 bp, Homo sapiens
acccagaatggagcctgc

SEQ ID NO: 4499162 - DNA, 18 bp, Homo sapiens
acccagacagcctgtttc

SEQ ID NO: 4499163 - DNA, 24 bp, Homo sapiens
acccagacagcctgtttctatcct

SEQ ID NO: 4499164 - DNA, 19 bp, Homo sapiens
acaacagttctgagctgta

SEQ ID NO: 4499165 - DNA, 22 bp, Homo sapiens
acaacagttctgagctgtaatt

SEQ ID NO: 4499166 - DNA, 21 bp, Homo sapiens
acaacatcgcaatagtttttt

SEQ ID NO: 4499167 - DNA, 21 bp, Homo sapiens
acaacatgcatgttctcctct

SEQ ID NO: 4499168 - DNA, 19 bp, Homo sapiens
acaacatgtttaataaata

SEQ ID NO: 4499169 - DNA, 13 bp, Homo sapiens
acaacatttatgt

SEQ ID NO: 4499170 - DNA, 22 bp, Homo sapiens
acaacatttctatagccaaaaa

SEQ ID NO: 4499171 - DNA, 20 bp, Homo sapiens
acaaccatgcaaattgtgaa

SEQ ID NO: 4499172 - DNA, 12 bp, Homo sapiens
acaaccctgacc

SEQ ID NO: 4499173 - DNA, 22 bp, Homo sapiens
acaacctccattctattttaga

SEQ ID NO: 4499174 - DNA, 12 bp, Homo sapiens
acaacctggaga

SEQ ID NO: 4499175 - DNA, 15 bp, Homo sapiens
acaactatgaaatcg

SEQ ID NO: 4499176 - DNA, 22 bp, Homo sapiens
acaactcccttaaggtctccaa

SEQ ID NO: 4499177 - DNA, 17 bp, Homo sapiens
acaactgtttgtctttt

SEQ ID NO: 4499178 - DNA, 14 bp, Homo sapiens
acaacttaaataat

SEQ ID NO: 4499179 - DNA, 11 bp, Homo sapiens
acaagaaactg

SEQ ID NO: 4499180 - DNA, 13 bp, Homo sapiens
acaagaaatgaaa

SEQ ID NO: 4499181 - DNA, 15 bp, Homo sapiens
acaagaaatgaaagc

SEQ ID NO: 4499182 - DNA, 16 bp, Homo sapiens
acaagaaatgaaagca

SEQ ID NO: 4499183 - DNA, 22 bp, Homo sapiens
acaagaaatgaaagcagggact

SEQ ID NO: 4499184 - DNA, 17 bp, Homo sapiens
acaagaagcattttgta

SEQ ID NO: 4499185 - DNA, 15 bp, Homo sapiens
acaagaaggaacaat

SEQ ID NO: 4499186 - DNA, 14 bp, Homo sapiens
acaagacatttctt

SEQ ID NO: 4499187 - DNA, 21 bp, Homo sapiens
acaagacatttctttctgttt

SEQ ID NO: 4499188 - DNA, 15 bp, Homo sapiens
acaagacccccagca

SEQ ID NO: 4499189 - DNA, 15 bp, Homo sapiens
acaagagatctacac

SEQ ID NO: 4499190 - DNA, 16 bp, Homo sapiens
acaagagatctacaca

SEQ ID NO: 4499191 - DNA, 17 bp, Homo sapiens
acaagagatctacacat

SEQ ID NO: 4499192 - DNA, 20 bp, Homo sapiens
acaagagatctacacatgtt

SEQ ID NO: 4499193 - DNA, 12 bp, Homo sapiens
acaagagcaaaa

SEQ ID NO: 4499194 - DNA, 21 bp, Homo sapiens
acaagagcactacattcattt

SEQ ID NO: 4499195 - DNA, 14 bp, Homo sapiens
acaagagcagcctg

SEQ ID NO: 4499196 - DNA, 17 bp, Homo sapiens
acaagagcgaaactccg

SEQ ID NO: 4499197 - DNA, 18 bp, Homo sapiens
acaagagggcaagcctct

SEQ ID NO: 4499198 - DNA, 21 bp, Homo sapiens
acaagattcccagagacagga

SEQ ID NO: 4499199 - DNA, 20 bp, Homo sapiens
acaagatttccttgtgcaaa

SEQ ID NO: 4499200 - DNA, 16 bp, Homo sapiens
acaagcatgcataaat

SEQ ID NO: 4499201 - DNA, 17 bp, Homo sapiens
acaagcatgcataaatc

SEQ ID NO: 4499202 - DNA, 12 bp, Homo sapiens
acaagccaagaa

SEQ ID NO: 4499203 - DNA, 20 bp, Homo sapiens
acaagccttactcacctctc

SEQ ID NO: 4499204 - DNA, 21 bp, Homo sapiens
acaagccttactcacctctct

SEQ ID NO: 4499205 - DNA, 14 bp, Homo sapiens
acaagctatgggaa

SEQ ID NO: 4499206 - DNA, 15 bp, Homo sapiens
acaagctcatccctg

SEQ ID NO: 4499207 - DNA, 17 bp, Homo sapiens
acaagctcatccctgga

SEQ ID NO: 4499208 - DNA, 13 bp, Homo sapiens
acaagctgcactg

SEQ ID NO: 4499209 - DNA, 14 bp, Homo sapiens
acaagctgcactgt

SEQ ID NO: 4499210 - DNA, 17 bp, Homo sapiens
acaagcttaaagcttga

SEQ ID NO: 4499211 - DNA, 16 bp, Homo sapiens
acaaggattgaaaatt

SEQ ID NO: 4499212 - DNA, 21 bp, Homo sapiens
acaaggtaggctgcaaaatta

SEQ ID NO: 4499213 - DNA, 15 bp, Homo sapiens
acaaggtgctaacat

SEQ ID NO: 4499214 - DNA, 16 bp, Homo sapiens
acaagtaaatatatat

SEQ ID NO: 4499215 - DNA, 15 bp, Homo sapiens
acaagtaatttcagt

SEQ ID NO: 4499216 - DNA, 16 bp, Homo sapiens
acaagtaatttcagtg

SEQ ID NO: 4499217 - DNA, 13 bp, Homo sapiens
acaagtacttttg

SEQ ID NO: 4499218 - DNA, 15 bp, Homo sapiens
acaagtatataattt

SEQ ID NO: 4499219 - DNA, 17 bp, Homo sapiens
acaagtatttgttaatt

SEQ ID NO: 4499220 - DNA, 17 bp, Homo sapiens
acaagtcatggtcacag

SEQ ID NO: 4499221 - DNA, 18 bp, Homo sapiens
acaagtcatggtcacagt

SEQ ID NO: 4499222 - DNA, 14 bp, Homo sapiens
acaagtcatttttg

SEQ ID NO: 4499223 - DNA, 18 bp, Homo sapiens
acaagtcatttttgtatt

SEQ ID NO: 4499224 - DNA, 21 bp, Homo sapiens
acaagtctgcatttcatatta

SEQ ID NO: 4499225 - DNA, 18 bp, Homo sapiens
acaagtgccgcaaattgt

SEQ ID NO: 4499226 - DNA, 14 bp, Homo sapiens
acaagtggttaaaa

SEQ ID NO: 4499227 - DNA, 19 bp, Homo sapiens
acaagttctatttcttgaa

SEQ ID NO: 4499228 - DNA, 18 bp, Homo sapiens
acaagttttgtttcctca

SEQ ID NO: 4499229 - DNA, 14 bp, Homo sapiens
acaataaaaatgtt

SEQ ID NO: 4499230 - DNA, 12 bp, Homo sapiens
acaataaaatat

SEQ ID NO: 4499231 - DNA, 15 bp, Homo sapiens
acaataaaatattat

SEQ ID NO: 4499232 - DNA, 14 bp, Homo sapiens
acaataaaattttt

SEQ ID NO: 4499233 - DNA, 12 bp, Homo sapiens
acaataaagaat

SEQ ID NO: 4499234 - DNA, 12 bp, Homo sapiens
acaataaagata

SEQ ID NO: 4499235 - DNA, 22 bp, Homo sapiens
acaataaagatacatgattgaa

SEQ ID NO: 4499236 - DNA, 16 bp, Homo sapiens
acaataaattgctaat

SEQ ID NO: 4499237 - DNA, 14 bp, Homo sapiens
acaataacttctta

SEQ ID NO: 4499238 - DNA, 14 bp, Homo sapiens
acaataacttttat

SEQ ID NO: 4499239 - DNA, 14 bp, Homo sapiens
acaatacaatgtac

SEQ ID NO: 4499240 - DNA, 19 bp, Homo sapiens
acaatacaatgtacaatta

SEQ ID NO: 4499241 - DNA, 12 bp, Homo sapiens
acaatacagtat

SEQ ID NO: 4499242 - DNA, 15 bp, Homo sapiens
acaatacagtattat

SEQ ID NO: 4499243 - DNA, 16 bp, Homo sapiens
acaatacagtattata

SEQ ID NO: 4499244 - DNA, 19 bp, Homo sapiens
acaatagggctaaatgttt

SEQ ID NO: 4499245 - DNA, 13 bp, Homo sapiens
acaataggtcttt

SEQ ID NO: 4499246 - DNA, 11 bp, Homo sapiens
acaatagtata

SEQ ID NO: 4499247 - DNA, 14 bp, Homo sapiens
acaatagtatttct

SEQ ID NO: 4499248 - DNA, 18 bp, Homo sapiens
acaatagtatttctcctt

SEQ ID NO: 4499249 - DNA, 14 bp, Homo sapiens
accacaagcatctc

SEQ ID NO: 4499250 - DNA, 17 bp, Homo sapiens
accacaatgtttcttca

SEQ ID NO: 4499251 - DNA, 21 bp, Homo sapiens
accacaatgtttcttcatttc

SEQ ID NO: 4499252 - DNA, 15 bp, Homo sapiens
accacacacagcctg

SEQ ID NO: 4499253 - DNA, 15 bp, Homo sapiens
accacagaaatcaca

SEQ ID NO: 4499254 - DNA, 13 bp, Homo sapiens
accacagcagaca

SEQ ID NO: 4499255 - DNA, 19 bp, Homo sapiens
accacaggaagatgggagg

SEQ ID NO: 4499256 - DNA, 22 bp, Homo sapiens
accacaggaattttaaaaacaa

SEQ ID NO: 4499257 - DNA, 20 bp, Homo sapiens
accacatcctccgtccagcc

SEQ ID NO: 4499258 - DNA, 21 bp, Homo sapiens
accacatcctccgtccagccg

SEQ ID NO: 4499259 - DNA, 20 bp, Homo sapiens
accacatttagaaatgttta

SEQ ID NO: 4499260 - DNA, 17 bp, Homo sapiens
accaccaatcatttcct

SEQ ID NO: 4499261 - DNA, 19 bp, Homo sapiens
accaccaggactgaaagaa

SEQ ID NO: 4499262 - DNA, 15 bp, Homo sapiens
accaccatttaattt

SEQ ID NO: 4499263 - DNA, 19 bp, Homo sapiens
accacccctgcctccaccc

SEQ ID NO: 4499264 - DNA, 19 bp, Homo sapiens
accaccgttcagtcatttt

SEQ ID NO: 4499265 - DNA, 16 bp, Homo sapiens
accacctaggccactc

SEQ ID NO: 4499266 - DNA, 20 bp, Homo sapiens
accacctaggccactcctcc

SEQ ID NO: 4499267 - DNA, 15 bp, Homo sapiens
accaccttcccagct

SEQ ID NO: 4499268 - DNA, 20 bp, Homo sapiens
accaccttcccagctctccc

SEQ ID NO: 4499269 - DNA, 16 bp, Homo sapiens
accacgatgtggccct

SEQ ID NO: 4499270 - DNA, 20 bp, Homo sapiens
accacgatgtggccctggcc

SEQ ID NO: 4499271 - DNA, 21 bp, Homo sapiens
accacgatgtggccctggcct

SEQ ID NO: 4499272 - DNA, 13 bp, Homo sapiens
accacgccatgag

SEQ ID NO: 4499273 - DNA, 18 bp, Homo sapiens
accacggcgtttttttac

SEQ ID NO: 4499274 - DNA, 19 bp, Homo sapiens
accacggcgtttttttaca

SEQ ID NO: 4499275 - DNA, 20 bp, Homo sapiens
accactaggaatcccagagg

SEQ ID NO: 4499276 - DNA, 13 bp, Homo sapiens
accactaggcctg

SEQ ID NO: 4499277 - DNA, 21 bp, Homo sapiens
accactatctccgttccatct

SEQ ID NO: 4499278 - DNA, 22 bp, Homo sapiens
accactatctccgttccatctg

SEQ ID NO: 4499279 - DNA, 16 bp, Homo sapiens
accactcgaggcctgc

SEQ ID NO: 4499280 - DNA, 11 bp, Homo sapiens
accactctaat

SEQ ID NO: 4499281 - DNA, 14 bp, Homo sapiens
accactgaaaaaat

SEQ ID NO: 4499282 - DNA, 17 bp, Homo sapiens
accactgaaaaaatata

SEQ ID NO: 4499283 - DNA, 12 bp, Homo sapiens
accactgatatc

SEQ ID NO: 4499284 - DNA, 14 bp, Homo sapiens
accactgcactcca

SEQ ID NO: 4499285 - DNA, 13 bp, Homo sapiens
accactgcagaag

SEQ ID NO: 4499286 - DNA, 20 bp, Homo sapiens
accactgtacacacccgcct

SEQ ID NO: 4499287 - DNA, 16 bp, Homo sapiens
accacttttctgctgt

SEQ ID NO: 4499288 - DNA, 22 bp, Homo sapiens
accacttttctgctgttgcctc

SEQ ID NO: 4499289 - DNA, 11 bp, Homo sapiens
accacttttgg

SEQ ID NO: 4499290 - DNA, 19 bp, Homo sapiens
accagaacgcaccccactg

SEQ ID NO: 4499291 - DNA, 13 bp, Homo sapiens
accagaactttct

SEQ ID NO: 4499292 - DNA, 14 bp, Homo sapiens
accagaaggaaagc

SEQ ID NO: 4499293 - DNA, 23 bp, Homo sapiens
accagacgtcaggccctgactcc

SEQ ID NO: 4499294 - DNA, 15 bp, Homo sapiens
accagagagagttgt

SEQ ID NO: 4499295 - DNA, 16 bp, Homo sapiens
accagagccgggagga

SEQ ID NO: 4499296 - DNA, 15 bp, Homo sapiens
accagaggaagttat

SEQ ID NO: 4499297 - DNA, 17 bp, Homo sapiens
accagccatcctccctc

SEQ ID NO: 4499298 - DNA, 19 bp, Homo sapiens
accagcccattggccgagc

SEQ ID NO: 4499299 - DNA, 19 bp, Homo sapiens
accagcccccgccccagag

SEQ ID NO: 4499300 - DNA, 16 bp, Homo sapiens
accagcccctccccag

SEQ ID NO: 4499301 - DNA, 16 bp, Homo sapiens
accagccgtattttac

SEQ ID NO: 4499302 - DNA, 14 bp, Homo sapiens
accagcctagcctg

SEQ ID NO: 4499303 - DNA, 14 bp, Homo sapiens
accagcctgaccaa

SEQ ID NO: 4499304 - DNA, 20 bp, Homo sapiens
accagcctggtcaacatagt

SEQ ID NO: 4499305 - DNA, 22 bp, Homo sapiens
accagcctgtccaacatggtga

SEQ ID NO: 4499306 - DNA, 18 bp, Homo sapiens
accagccttgctctcttc

SEQ ID NO: 4499307 - DNA, 20 bp, Homo sapiens
accagccttgctctcttcaa

SEQ ID NO: 4499308 - DNA, 19 bp, Homo sapiens
accagctatctgtcatctc

SEQ ID NO: 4499309 - DNA, 10 bp, Homo sapiens
accagctgca

SEQ ID NO: 4499310 - DNA, 23 bp, Homo sapiens
acaaagcactagagaatgcacag

SEQ ID NO: 4499311 - DNA, 17 bp, Homo sapiens
acaaagcataatcaata

SEQ ID NO: 4499312 - DNA, 16 bp, Homo sapiens
acaaagccccccagct

SEQ ID NO: 4499313 - DNA, 15 bp, Homo sapiens
acaaaggccttaaca

SEQ ID NO: 4499314 - DNA, 15 bp, Homo sapiens
acaaagggccatcgt

SEQ ID NO: 4499315 - DNA, 17 bp, Homo sapiens
acaaagttctcagagct

SEQ ID NO: 4499316 - DNA, 22 bp, Homo sapiens
acaaagttgattaagaaaggaa

SEQ ID NO: 4499317 - DNA, 19 bp, Homo sapiens
acaaagtttcagagtatat

SEQ ID NO: 4499318 - DNA, 20 bp, Homo sapiens
acaaagtttcagagtatatt

SEQ ID NO: 4499319 - DNA, 16 bp, Homo sapiens
acaaataagattaata

SEQ ID NO: 4499320 - DNA, 16 bp, Homo sapiens
acaaatactaaaaaga

SEQ ID NO: 4499321 - DNA, 13 bp, Homo sapiens
acaaatattcaga

SEQ ID NO: 4499322 - DNA, 14 bp, Homo sapiens
acaaatattgtcat

SEQ ID NO: 4499323 - DNA, 15 bp, Homo sapiens
acaaatgacactgca

SEQ ID NO: 4499324 - DNA, 12 bp, Homo sapiens
acaaatgcttta

SEQ ID NO: 4499325 - DNA, 14 bp, Homo sapiens
acaaatgtcattgt

SEQ ID NO: 4499326 - DNA, 13 bp, Homo sapiens
acaaatgtggcca

SEQ ID NO: 4499327 - DNA, 22 bp, Homo sapiens
acaaatgtgtgggtttttaaaa

SEQ ID NO: 4499328 - DNA, 19 bp, Homo sapiens
acaaattcagtctctgaat

SEQ ID NO: 4499329 - DNA, 17 bp, Homo sapiens
acaaatttacagagaca

SEQ ID NO: 4499330 - DNA, 18 bp, Homo sapiens
acaaatttacagagacag

SEQ ID NO: 4499331 - DNA, 20 bp, Homo sapiens
acaaatttggccttaagaac

SEQ ID NO: 4499332 - DNA, 22 bp, Homo sapiens
acaaatttggccttaagaactg

SEQ ID NO: 4499333 - DNA, 23 bp, Homo sapiens
acaaatttggccttaagaactgt

SEQ ID NO: 4499334 - DNA, 15 bp, Homo sapiens
acaaattttgcatat

SEQ ID NO: 4499335 - DNA, 19 bp, Homo sapiens
acaacaaaaaatacattat

SEQ ID NO: 4499336 - DNA, 24 bp, Homo sapiens
acaacaagaaactgtccaaatgct

SEQ ID NO: 4499337 - DNA, 14 bp, Homo sapiens
acaacaatccttct

SEQ ID NO: 4499338 - DNA, 17 bp, Homo sapiens
acaacaccttcctcctg

SEQ ID NO: 4499339 - DNA, 18 bp, Homo sapiens
acaacaccttcctcctgc

SEQ ID NO: 4499340 - DNA, 12 bp, Homo sapiens
acaacagaaaga

SEQ ID NO: 4499341 - DNA, 15 bp, Homo sapiens
acaacagcacacagg

SEQ ID NO: 4499342 - DNA, 23 bp, Homo sapiens
aagcaggaaaaaaggaatattta

SEQ ID NO: 4499343 - DNA, 13 bp, Homo sapiens
aagcaggccactt

SEQ ID NO: 4499344 - DNA, 21 bp, Homo sapiens
aagcaggctggtttgcaagaa

SEQ ID NO: 4499345 - DNA, 19 bp, Homo sapiens
aagcaggtttcaaggaagt

SEQ ID NO: 4499346 - DNA, 17 bp, Homo sapiens
aagcaggtttgttttca

SEQ ID NO: 4499347 - DNA, 20 bp, Homo sapiens
aagcagtatattagtattat

SEQ ID NO: 4499348 - DNA, 14 bp, Homo sapiens
aagcatactttgta

SEQ ID NO: 4499349 - DNA, 18 bp, Homo sapiens
aagcatagctacaatttg

SEQ ID NO: 4499350 - DNA, 21 bp, Homo sapiens
aagcatatataactattttaa

SEQ ID NO: 4499351 - DNA, 20 bp, Homo sapiens
aagcatccattaattaatga

SEQ ID NO: 4499352 - DNA, 13 bp, Homo sapiens
aagcatccctcac

SEQ ID NO: 4499353 - DNA, 13 bp, Homo sapiens
aagcatctggctc

SEQ ID NO: 4499354 - DNA, 15 bp, Homo sapiens
aagcatgaagataaa

SEQ ID NO: 4499355 - DNA, 20 bp, Homo sapiens
aagcatgaataacatttaaa

SEQ ID NO: 4499356 - DNA, 17 bp, Homo sapiens
aagcatgagatttttct

SEQ ID NO: 4499357 - DNA, 19 bp, Homo sapiens
aagcatgcataaatcaatg

SEQ ID NO: 4499358 - DNA, 23 bp, Homo sapiens
aagcatgcataaatcaatggttc

SEQ ID NO: 4499359 - DNA, 19 bp, Homo sapiens
aagcatgccgttctgcacc

SEQ ID NO: 4499360 - DNA, 16 bp, Homo sapiens
aagcatgtaggagaat

SEQ ID NO: 4499361 - DNA, 18 bp, Homo sapiens
aagcatgtttaaaacaaa

SEQ ID NO: 4499362 - DNA, 18 bp, Homo sapiens
aagcattaccactcaggc

SEQ ID NO: 4499363 - DNA, 14 bp, Homo sapiens
aagcattgcctggc

SEQ ID NO: 4499364 - DNA, 15 bp, Homo sapiens
aagcattgtaaaata

SEQ ID NO: 4499365 - DNA, 19 bp, Homo sapiens
aagcattgtaaatgtgctt

SEQ ID NO: 4499366 - DNA, 16 bp, Homo sapiens
aagcatttcatgaaaa

SEQ ID NO: 4499367 - DNA, 19 bp, Homo sapiens
aagcatttcatgaaaaagc

SEQ ID NO: 4499368 - DNA, 21 bp, Homo sapiens
aagcatttcatgaaaaagctg

SEQ ID NO: 4499369 - DNA, 17 bp, Homo sapiens
aagcatttccagcctat

SEQ ID NO: 4499370 - DNA, 13 bp, Homo sapiens
aagcatttgtaca

SEQ ID NO: 4499371 - DNA, 18 bp, Homo sapiens
aagcatttttcaatatat

SEQ ID NO: 4499372 - DNA, 18 bp, Homo sapiens
aagccaaaacaatgttta

SEQ ID NO: 4499373 - DNA, 22 bp, Homo sapiens
aagccaaagaaatgaacattcc

SEQ ID NO: 4499374 - DNA, 23 bp, Homo sapiens
aagccaagggaaaggggtgcttt

SEQ ID NO: 4499375 - DNA, 21 bp, Homo sapiens
aagccacaggaaggaggggag

SEQ ID NO: 4499376 - DNA, 19 bp, Homo sapiens
aagccacaggcctgagatt

SEQ ID NO: 4499377 - DNA, 22 bp, Homo sapiens
aagccacaggcctgagatttca

SEQ ID NO: 4499378 - DNA, 23 bp, Homo sapiens
aagccacgccctccctgctagca

SEQ ID NO: 4499379 - DNA, 22 bp, Homo sapiens
aagccacgctgtcctctcgagc

SEQ ID NO: 4499380 - DNA, 19 bp, Homo sapiens
aagccagacctagcaggct

SEQ ID NO: 4499381 - DNA, 12 bp, Homo sapiens
aagccagagcct

SEQ ID NO: 4499382 - DNA, 20 bp, Homo sapiens
aagccagcgtcctcctctgt

SEQ ID NO: 4499383 - DNA, 12 bp, Homo sapiens
aagccagctttc

SEQ ID NO: 4499384 - DNA, 17 bp, Homo sapiens
aagccagctttccctgc

SEQ ID NO: 4499385 - DNA, 18 bp, Homo sapiens
aagccaggagcagccctg

SEQ ID NO: 4499386 - DNA, 17 bp, Homo sapiens
aagccaggcctggctgg

SEQ ID NO: 4499387 - DNA, 22 bp, Homo sapiens
aagccatatatgaccagaagcc

SEQ ID NO: 4499388 - DNA, 23 bp, Homo sapiens
aagccatatatgaccagaagcct

SEQ ID NO: 4499389 - DNA, 13 bp, Homo sapiens
aagccatcacttc

SEQ ID NO: 4499390 - DNA, 20 bp, Homo sapiens
aagccatcttgagtggtcat

SEQ ID NO: 4499391 - DNA, 23 bp, Homo sapiens
aagccatgagttccagaaagtaa

SEQ ID NO: 4499392 - DNA, 21 bp, Homo sapiens
aagccatgttccccagttcag

SEQ ID NO: 4499393 - DNA, 15 bp, Homo sapiens
aagccattccaaagt

SEQ ID NO: 4499394 - DNA, 14 bp, Homo sapiens
aagcccatcctgac

SEQ ID NO: 4499395 - DNA, 20 bp, Homo sapiens
aagcccatcctgaccagctg

SEQ ID NO: 4499396 - DNA, 14 bp, Homo sapiens
aagcccctgggccc

SEQ ID NO: 4499397 - DNA, 22 bp, Homo sapiens
aagccctcctccccagagctgg

SEQ ID NO: 4499398 - DNA, 13 bp, Homo sapiens
aagccctccttcc

SEQ ID NO: 4499399 - DNA, 13 bp, Homo sapiens
aagccgtcctggc

SEQ ID NO: 4499400 - DNA, 14 bp, Homo sapiens
aagcctaaatttgt

SEQ ID NO: 4499401 - DNA, 17 bp, Homo sapiens
aagcctaagggatcctg

SEQ ID NO: 4499402 - DNA, 22 bp, Homo sapiens
aagcctagtgaaggcttctctc

SEQ ID NO: 4499403 - DNA, 22 bp, Homo sapiens
aagcctcactattacttgaact

SEQ ID NO: 4499404 - DNA, 21 bp, Homo sapiens
aagcctcatcatcagagcctt

SEQ ID NO: 4499405 - DNA, 14 bp, Homo sapiens
aagcctctctcctt

SEQ ID NO: 4499406 - DNA, 23 bp, Homo sapiens
aagcctgatactttagccatcat

SEQ ID NO: 4499407 - DNA, 22 bp, Homo sapiens
aagcctgcacaataaaaatgtt

SEQ ID NO: 4499408 - DNA, 14 bp, Homo sapiens
aagcctgctggctg

SEQ ID NO: 4499409 - DNA, 18 bp, Homo sapiens
aagcctgtgcaaaaaaat

SEQ ID NO: 4499410 - DNA, 22 bp, Homo sapiens
aagcctgtggatgatcaatcct

SEQ ID NO: 4499411 - DNA, 20 bp, Homo sapiens
aagcctgttccataggaagg

SEQ ID NO: 4499412 - DNA, 15 bp, Homo sapiens
aagccttactcacct

SEQ ID NO: 4499413 - DNA, 16 bp, Homo sapiens
aagccttactcacctc

SEQ ID NO: 4499414 - DNA, 17 bp, Homo sapiens
aagccttactcacctct

SEQ ID NO: 4499415 - DNA, 19 bp, Homo sapiens
aagcctttgccgtgagcat

SEQ ID NO: 4499416 - DNA, 21 bp, Homo sapiens
aagcctttgccgtgagcatgc

SEQ ID NO: 4499417 - DNA, 22 bp, Homo sapiens
aagcctttgccgtgagcatgca

SEQ ID NO: 4499418 - DNA, 18 bp, Homo sapiens
aagcgaggtcaacagaga

SEQ ID NO: 4499419 - DNA, 13 bp, Homo sapiens
aagcgctcatctg

SEQ ID NO: 4499420 - DNA, 19 bp, Homo sapiens
aagcggaacatgtgcttca

SEQ ID NO: 4499421 - DNA, 20 bp, Homo sapiens
aagcggccctaagggagtgt

SEQ ID NO: 4499422 - DNA, 21 bp, Homo sapiens
aagcggccctaagggagtgtc

SEQ ID NO: 4499423 - DNA, 15 bp, Homo sapiens
aagcgtgttctcagc

SEQ ID NO: 4499424 - DNA, 16 bp, Homo sapiens
aagcgtgttctcagca

SEQ ID NO: 4499425 - DNA, 18 bp, Homo sapiens
aagcgtgttctcagcaca

SEQ ID NO: 4499426 - DNA, 16 bp, Homo sapiens
aagctaaaacctgagc

SEQ ID NO: 4499427 - DNA, 23 bp, Homo sapiens
aagctaaaatatataatatacta

SEQ ID NO: 4499428 - DNA, 19 bp, Homo sapiens
aagctaaagcagtgtttgc

SEQ ID NO: 4499429 - DNA, 14 bp, Homo sapiens
aagctaatctgcct

SEQ ID NO: 4499430 - DNA, 17 bp, Homo sapiens
aagctacaatattctct

SEQ ID NO: 4499431 - DNA, 22 bp, Homo sapiens
aagctactgtgtgtgtgaatga

SEQ ID NO: 4499432 - DNA, 16 bp, Homo sapiens
aagctagacacatgaa

SEQ ID NO: 4499433 - DNA, 14 bp, Homo sapiens
aattccaaagcaaa

SEQ ID NO: 4499434 - DNA, 18 bp, Homo sapiens
aattccaagaaaatatca

SEQ ID NO: 4499435 - DNA, 16 bp, Homo sapiens
aattccacacctttta

SEQ ID NO: 4499436 - DNA, 20 bp, Homo sapiens
aattccacaccttttattga

SEQ ID NO: 4499437 - DNA, 20 bp, Homo sapiens
aattccactgaaaatttaac

SEQ ID NO: 4499438 - DNA, 19 bp, Homo sapiens
aattccatatgctccagga

SEQ ID NO: 4499439 - DNA, 15 bp, Homo sapiens
aattcccaacatttc

SEQ ID NO: 4499440 - DNA, 16 bp, Homo sapiens
aattccctccccctcc

SEQ ID NO: 4499441 - DNA, 17 bp, Homo sapiens
aattccctccccctcct

SEQ ID NO: 4499442 - DNA, 15 bp, Homo sapiens
aattcctacagcact

SEQ ID NO: 4499443 - DNA, 22 bp, Homo sapiens
aattcctacctcttcacctgac

SEQ ID NO: 4499444 - DNA, 22 bp, Homo sapiens
aattcctatacgcagcgtgctt

SEQ ID NO: 4499445 - DNA, 17 bp, Homo sapiens
aattcctctcaaattca

SEQ ID NO: 4499446 - DNA, 21 bp, Homo sapiens
aattcctctcaaattcagctc

SEQ ID NO: 4499447 - DNA, 17 bp, Homo sapiens
aattcctttacaactaa

SEQ ID NO: 4499448 - DNA, 15 bp, Homo sapiens
aattcgcccgagctg

SEQ ID NO: 4499449 - DNA, 17 bp, Homo sapiens
aattcggtgtgctgcca

SEQ ID NO: 4499450 - DNA, 20 bp, Homo sapiens
aattcggtgtgctgccaact

SEQ ID NO: 4499451 - DNA, 13 bp, Homo sapiens
aattcgtgtgttt

SEQ ID NO: 4499452 - DNA, 22 bp, Homo sapiens
aattcgtgtgtttttttatgaa

SEQ ID NO: 4499453 - DNA, 20 bp, Homo sapiens
aattctaaataaatttccca

SEQ ID NO: 4499454 - DNA, 16 bp, Homo sapiens
aattctaacattaaat

SEQ ID NO: 4499455 - DNA, 18 bp, Homo sapiens
aattctaacattaaatca

SEQ ID NO: 4499456 - DNA, 14 bp, Homo sapiens
aattctaacccaag

SEQ ID NO: 4499457 - DNA, 15 bp, Homo sapiens
aattctactggaaaa

SEQ ID NO: 4499458 - DNA, 18 bp, Homo sapiens
aattctagtattttatct

SEQ ID NO: 4499459 - DNA, 17 bp, Homo sapiens
aattctcccctccctcc

SEQ ID NO: 4499460 - DNA, 21 bp, Homo sapiens
aattctcccctccctccagta

SEQ ID NO: 4499461 - DNA, 16 bp, Homo sapiens
aattctcctgataaaa

SEQ ID NO: 4499462 - DNA, 16 bp, Homo sapiens
aattctggacagacag

SEQ ID NO: 4499463 - DNA, 16 bp, Homo sapiens
aattctgtaatttgaa

SEQ ID NO: 4499464 - DNA, 16 bp, Homo sapiens
aattctgtgccttgtt

SEQ ID NO: 4499465 - DNA, 19 bp, Homo sapiens
aattctgtttttaatgcta

SEQ ID NO: 4499466 - DNA, 21 bp, Homo sapiens
aattcttaaaactataacatt

SEQ ID NO: 4499467 - DNA, 18 bp, Homo sapiens
aattcttcaggtggaaaa

SEQ ID NO: 4499468 - DNA, 23 bp, Homo sapiens
aattcttccttccctccttttaa

SEQ ID NO: 4499469 - DNA, 18 bp, Homo sapiens
aattcttggttgaggaaa

SEQ ID NO: 4499470 - DNA, 14 bp, Homo sapiens
aattcttttgaatt

SEQ ID NO: 4499471 - DNA, 18 bp, Homo sapiens
aattcttttttaaatttt

SEQ ID NO: 4499472 - DNA, 13 bp, Homo sapiens
aattgaaaaaaat

SEQ ID NO: 4499473 - DNA, 15 bp, Homo sapiens
aattgaaacacagag

SEQ ID NO: 4499474 - DNA, 21 bp, Homo sapiens
aattgaacgactgtatattgc

SEQ ID NO: 4499475 - DNA, 19 bp, Homo sapiens
aattgaatagtttatttct

SEQ ID NO: 4499476 - DNA, 20 bp, Homo sapiens
aattgaatagtttatttctg

SEQ ID NO: 4499477 - DNA, 18 bp, Homo sapiens
aattgaatgcaaaccata

SEQ ID NO: 4499478 - DNA, 21 bp, Homo sapiens
aattgacataggcaataataa

SEQ ID NO: 4499479 - DNA, 15 bp, Homo sapiens
aattgacattccttt

SEQ ID NO: 4499480 - DNA, 21 bp, Homo sapiens
aattgactgatgattttcctt

SEQ ID NO: 4499481 - DNA, 14 bp, Homo sapiens
aattgacttattta

SEQ ID NO: 4499482 - DNA, 22 bp, Homo sapiens
aattgagtttaacaataataaa

SEQ ID NO: 4499483 - DNA, 14 bp, Homo sapiens
aattgatattatat

SEQ ID NO: 4499484 - DNA, 16 bp, Homo sapiens
aattgatttgcattga

SEQ ID NO: 4499485 - DNA, 22 bp, Homo sapiens
aattgatttgcattgaacacaa

SEQ ID NO: 4499486 - DNA, 14 bp, Homo sapiens
aattgcaaatcttg

SEQ ID NO: 4499487 - DNA, 17 bp, Homo sapiens
aattgcagtcatttggt

SEQ ID NO: 4499488 - DNA, 23 bp, Homo sapiens
aattgccaacataagttaataga

SEQ ID NO: 4499489 - DNA, 18 bp, Homo sapiens
aattgctaacaattgtta

SEQ ID NO: 4499490 - DNA, 21 bp, Homo sapiens
aattgctctgtgtatatctct

SEQ ID NO: 4499491 - DNA, 23 bp, Homo sapiens
aattgctctttcacaggtagcct

SEQ ID NO: 4499492 - DNA, 21 bp, Homo sapiens
aattgctgaagggcattcttt

SEQ ID NO: 4499493 - DNA, 14 bp, Homo sapiens
aattgctttgaagc

SEQ ID NO: 4499494 - DNA, 14 bp, Homo sapiens
aattgctttgccaa

SEQ ID NO: 4499495 - DNA, 15 bp, Homo sapiens
aattgctttgccaaa

SEQ ID NO: 4499496 - DNA, 20 bp, Homo sapiens
aattgctttgccaaaatacc

SEQ ID NO: 4499497 - DNA, 15 bp, Homo sapiens
aattggaaagcaggt

SEQ ID NO: 4499498 - DNA, 10 bp, Homo sapiens
aattggaatc

SEQ ID NO: 4499499 - DNA, 19 bp, Homo sapiens
aattggagtcgtgttgtca

SEQ ID NO: 4499500 - DNA, 23 bp, Homo sapiens
aattggatacagtacggatttgt

SEQ ID NO: 4499501 - DNA, 16 bp, Homo sapiens
aattggcataatttgt

SEQ ID NO: 4499502 - DNA, 16 bp, Homo sapiens
aattggggaggagggg

SEQ ID NO: 4499503 - DNA, 15 bp, Homo sapiens
aattggggcggagcc

SEQ ID NO: 4499504 - DNA, 13 bp, Homo sapiens
aattgggttcatg

SEQ ID NO: 4499505 - DNA, 21 bp, Homo sapiens
aattggtaaaactcactgtga

SEQ ID NO: 4499506 - DNA, 20 bp, Homo sapiens
aattggtcatggtagatttt

SEQ ID NO: 4499507 - DNA, 21 bp, Homo sapiens
aattgtaaagtaaaagctata

SEQ ID NO: 4499508 - DNA, 20 bp, Homo sapiens
aattgtaaatcctgtgtttc

SEQ ID NO: 4499509 - DNA, 19 bp, Homo sapiens
aattgtatatcattttgcc

SEQ ID NO: 4499510 - DNA, 17 bp, Homo sapiens
aattgtatcaatttgtt

SEQ ID NO: 4499511 - DNA, 18 bp, Homo sapiens
aattgtatcaatttgttt

SEQ ID NO: 4499512 - DNA, 14 bp, Homo sapiens
aattgtcaaaattg

SEQ ID NO: 4499513 - DNA, 19 bp, Homo sapiens
aattgtcactttttatgct

SEQ ID NO: 4499514 - DNA, 18 bp, Homo sapiens
aattgtcccttaaacaaa

SEQ ID NO: 4499515 - DNA, 18 bp, Homo sapiens
aattgtcgaaaagagtct

SEQ ID NO: 4499516 - DNA, 18 bp, Homo sapiens
aattgtctcaacgcctcc

SEQ ID NO: 4499517 - DNA, 21 bp, Homo sapiens
aattgtgcagtactttgtgca

SEQ ID NO: 4499518 - DNA, 16 bp, Homo sapiens
aattgtgcataatgct

SEQ ID NO: 4499519 - DNA, 21 bp, Homo sapiens
aattgtgcataatgctttgga

SEQ ID NO: 4499520 - DNA, 12 bp, Homo sapiens
aattgtgcttct

SEQ ID NO: 4499521 - DNA, 13 bp, Homo sapiens
aattgtgcttctc

SEQ ID NO: 4499522 - DNA, 16 bp, Homo sapiens
aattgtgctttcacca

SEQ ID NO: 4499523 - DNA, 17 bp, Homo sapiens
aattgtgtatatatctt

SEQ ID NO: 4499524 - DNA, 23 bp, Homo sapiens
aattgtgtatatatcttataact

SEQ ID NO: 4499525 - DNA, 22 bp, Homo sapiens
aattgtgtttattttttaaaaa

SEQ ID NO: 4499526 - DNA, 13 bp, Homo sapiens
aattgttctcaga

SEQ ID NO: 4499527 - DNA, 20 bp, Homo sapiens
aattgttgaacaggtgtttt

SEQ ID NO: 4499528 - DNA, 22 bp, Homo sapiens
aattgtttaccatagaaagatg

SEQ ID NO: 4499529 - DNA, 22 bp, Homo sapiens
aattgtttatgtgttatgaaca

SEQ ID NO: 4499530 - DNA, 14 bp, Homo sapiens
aatttgttcttgta

SEQ ID NO: 4499531 - DNA, 12 bp, Homo sapiens
aatttgttgcat

SEQ ID NO: 4499532 - DNA, 21 bp, Homo sapiens
aatttgttggggctttacata

SEQ ID NO: 4499533 - DNA, 15 bp, Homo sapiens
aatttgtttaaatta

SEQ ID NO: 4499534 - DNA, 23 bp, Homo sapiens
aatttgtttaatctacattataa

SEQ ID NO: 4499535 - DNA, 15 bp, Homo sapiens
aatttgtttgtgaca

SEQ ID NO: 4499536 - DNA, 19 bp, Homo sapiens
aatttgtttgtgttcaata

SEQ ID NO: 4499537 - DNA, 23 bp, Homo sapiens
aatttgtttgtgttcaatatcag

SEQ ID NO: 4499538 - DNA, 22 bp, Homo sapiens
aatttgttttgctgagagcata

SEQ ID NO: 4499539 - DNA, 12 bp, Homo sapiens
aattttaaaaaa

SEQ ID NO: 4499540 - DNA, 12 bp, Homo sapiens
aattttaaagta

SEQ ID NO: 4499541 - DNA, 13 bp, Homo sapiens
aattttaacacta

SEQ ID NO: 4499542 - DNA, 19 bp, Homo sapiens
aattttaacactaaccaaa

SEQ ID NO: 4499543 - DNA, 19 bp, Homo sapiens
aattttaacctatgatatt

SEQ ID NO: 4499544 - DNA, 18 bp, Homo sapiens
aattttaattcaagaaat

SEQ ID NO: 4499545 - DNA, 22 bp, Homo sapiens
aattttaattcaagaaatgaca

SEQ ID NO: 4499546 - DNA, 22 bp, Homo sapiens
aattttacgacctgtctgttct

SEQ ID NO: 4499547 - DNA, 18 bp, Homo sapiens
aattttactgtgaaaaaa

SEQ ID NO: 4499548 - DNA, 13 bp, Homo sapiens
aattttagaaata

SEQ ID NO: 4499549 - DNA, 17 bp, Homo sapiens
aattttagaaatattca

SEQ ID NO: 4499550 - DNA, 13 bp, Homo sapiens
aattttagatgta

SEQ ID NO: 4499551 - DNA, 12 bp, Homo sapiens
aattttagtgta

SEQ ID NO: 4499552 - DNA, 14 bp, Homo sapiens
aattttagtgtatt

SEQ ID NO: 4499553 - DNA, 19 bp, Homo sapiens
aattttatatgtaaatgtg

SEQ ID NO: 4499554 - DNA, 13 bp, Homo sapiens
aattttatgtatt

SEQ ID NO: 4499555 - DNA, 13 bp, Homo sapiens
aattttattatta

SEQ ID NO: 4499556 - DNA, 21 bp, Homo sapiens
aattttatttgttctttttct

SEQ ID NO: 4499557 - DNA, 22 bp, Homo sapiens
aattttatttgttctttttctg

SEQ ID NO: 4499558 - DNA, 13 bp, Homo sapiens
aattaaagcctta

SEQ ID NO: 4499559 - DNA, 17 bp, Homo sapiens
aattaaagccttaagca

SEQ ID NO: 4499560 - DNA, 18 bp, Homo sapiens
aattaaagccttaagcac

SEQ ID NO: 4499561 - DNA, 22 bp, Homo sapiens
aattaaagccttaagcacaatt

SEQ ID NO: 4499562 - DNA, 15 bp, Homo sapiens
aattaaatagtgtga

SEQ ID NO: 4499563 - DNA, 19 bp, Homo sapiens
aattaaatatatgtatgta

SEQ ID NO: 4499564 - DNA, 14 bp, Homo sapiens
aattaaatatttat

SEQ ID NO: 4499565 - DNA, 17 bp, Homo sapiens
aattaaatatttcttaa

SEQ ID NO: 4499566 - DNA, 17 bp, Homo sapiens
aattaaatccaataaaa

SEQ ID NO: 4499567 - DNA, 17 bp, Homo sapiens
aattaaatctagacatt

SEQ ID NO: 4499568 - DNA, 14 bp, Homo sapiens
aattaaattaggaa

SEQ ID NO: 4499569 - DNA, 14 bp, Homo sapiens
aattaaatttgatg

SEQ ID NO: 4499570 - DNA, 23 bp, Homo sapiens
aattaagaaggcaaaaatgtaaa

SEQ ID NO: 4499571 - DNA, 19 bp, Homo sapiens
aattaagattctctgccca

SEQ ID NO: 4499572 - DNA, 20 bp, Homo sapiens
aattaaggtacatcattatt

SEQ ID NO: 4499573 - DNA, 19 bp, Homo sapiens
aattaatatattaaaattc

SEQ ID NO: 4499574 - DNA, 17 bp, Homo sapiens
aattaatatctttctgc

SEQ ID NO: 4499575 - DNA, 21 bp, Homo sapiens
aattaatgaaatgataaagac

SEQ ID NO: 4499576 - DNA, 22 bp, Homo sapiens
aattaatgaaatgataaagact

SEQ ID NO: 4499577 - DNA, 16 bp, Homo sapiens
aattaatgcttagtga

SEQ ID NO: 4499578 - DNA, 17 bp, Homo sapiens
aattaatgtaataaagt

SEQ ID NO: 4499579 - DNA, 18 bp, Homo sapiens
aattaatgtaataaagtg

SEQ ID NO: 4499580 - DNA, 13 bp, Homo sapiens
aattaattaggaa

SEQ ID NO: 4499581 - DNA, 23 bp, Homo sapiens
aattaattcctgtttgtctacat

SEQ ID NO: 4499582 - DNA, 17 bp, Homo sapiens
aattaatttgttaatta

SEQ ID NO: 4499583 - DNA, 19 bp, Homo sapiens
aattaatttgttaattaaa

SEQ ID NO: 4499584 - DNA, 14 bp, Homo sapiens
aattacaattttat

SEQ ID NO: 4499585 - DNA, 15 bp, Homo sapiens
aattacaattttatc

SEQ ID NO: 4499586 - DNA, 14 bp, Homo sapiens
aattacagctttta

SEQ ID NO: 4499587 - DNA, 15 bp, Homo sapiens
aattacagcttttat

SEQ ID NO: 4499588 - DNA, 13 bp, Homo sapiens
aattacatatact

SEQ ID NO: 4499589 - DNA, 12 bp, Homo sapiens
aattacatgttt

SEQ ID NO: 4499590 - DNA, 19 bp, Homo sapiens
aattacattttatatgtga

SEQ ID NO: 4499591 - DNA, 21 bp, Homo sapiens
aattaccatgcttcacaatgt

SEQ ID NO: 4499592 - DNA, 16 bp, Homo sapiens
aattaccatttgttaa

SEQ ID NO: 4499593 - DNA, 17 bp, Homo sapiens
aattacctgtgtgagat

SEQ ID NO: 4499594 - DNA, 23 bp, Homo sapiens
aattacgttcttacaagcttaaa

SEQ ID NO: 4499595 - DNA, 16 bp, Homo sapiens
aattactgataaaaat

SEQ ID NO: 4499596 - DNA, 21 bp, Homo sapiens
aattactggaattcttctgca

SEQ ID NO: 4499597 - DNA, 23 bp, Homo sapiens
aattactgtttattaaagtacaa

SEQ ID NO: 4499598 - DNA, 12 bp, Homo sapiens
aattacttaaaa

SEQ ID NO: 4499599 - DNA, 20 bp, Homo sapiens
aattacttacgtatgtttgt

SEQ ID NO: 4499600 - DNA, 20 bp, Homo sapiens
aattacttattggatattca

SEQ ID NO: 4499601 - DNA, 11 bp, Homo sapiens
aattagaaaat

SEQ ID NO: 4499602 - DNA, 19 bp, Homo sapiens
aattagaaaatattctcta

SEQ ID NO: 4499603 - DNA, 15 bp, Homo sapiens
aattagaaaattagt

SEQ ID NO: 4499604 - DNA, 22 bp, Homo sapiens
aattagaatgaatttatcttta

SEQ ID NO: 4499605 - DNA, 16 bp, Homo sapiens
aattagacactttgga

SEQ ID NO: 4499606 - DNA, 17 bp, Homo sapiens
aattagatccattaatt

SEQ ID NO: 4499607 - DNA, 20 bp, Homo sapiens
aattagatccattaatttaa

SEQ ID NO: 4499608 - DNA, 13 bp, Homo sapiens
aattagatttctc

SEQ ID NO: 4499609 - DNA, 20 bp, Homo sapiens
aattaggaataaataaaaat

SEQ ID NO: 4499610 - DNA, 23 bp, Homo sapiens
aattaggctgtaactactttata

SEQ ID NO: 4499611 - DNA, 23 bp, Homo sapiens
aattagtgaaccaaaaatagaaa

SEQ ID NO: 4499612 - DNA, 20 bp, Homo sapiens
aattagtgccacttaatgta

SEQ ID NO: 4499613 - DNA, 12 bp, Homo sapiens
aattataaatgt

SEQ ID NO: 4499614 - DNA, 22 bp, Homo sapiens
aattataaatgtgtttatagct

SEQ ID NO: 4499615 - DNA, 16 bp, Homo sapiens
aattataaggactgca

SEQ ID NO: 4499616 - DNA, 18 bp, Homo sapiens
aattataaggactgcatg

SEQ ID NO: 4499617 - DNA, 13 bp, Homo sapiens
aattatacagtaa

SEQ ID NO: 4499618 - DNA, 18 bp, Homo sapiens
aattatagacctctagta

SEQ ID NO: 4499619 - DNA, 16 bp, Homo sapiens
aattatataaatcatt

SEQ ID NO: 4499620 - DNA, 14 bp, Homo sapiens
aattatataactgt

SEQ ID NO: 4499621 - DNA, 21 bp, Homo sapiens
aattatataactgtatttgaa

SEQ ID NO: 4499622 - DNA, 16 bp, Homo sapiens
aattatatgatatgca

SEQ ID NO: 4499623 - DNA, 17 bp, Homo sapiens
aattatatgatatgcat

SEQ ID NO: 4499624 - DNA, 20 bp, Homo sapiens
aattatatttgtgctatagt

SEQ ID NO: 4499625 - DNA, 13 bp, Homo sapiens
aattatcagcaaa

SEQ ID NO: 4499626 - DNA, 16 bp, Homo sapiens
aattatcagcaaagaa

SEQ ID NO: 4499627 - DNA, 14 bp, Homo sapiens
aattatctaattta

SEQ ID NO: 4499628 - DNA, 19 bp, Homo sapiens
aattatgagaggctgtcat

SEQ ID NO: 4499629 - DNA, 17 bp, Homo sapiens
aattatgccttttttga

SEQ ID NO: 4499630 - DNA, 15 bp, Homo sapiens
aattatggcatttct

SEQ ID NO: 4499631 - DNA, 14 bp, Homo sapiens
aattatgtctcttg

SEQ ID NO: 4499632 - DNA, 15 bp, Homo sapiens
aattatgtgacattt

SEQ ID NO: 4499633 - DNA, 16 bp, Homo sapiens
aattatgttactgtat

SEQ ID NO: 4499634 - DNA, 16 bp, Homo sapiens
aattattaatgaaaat

SEQ ID NO: 4499635 - DNA, 13 bp, Homo sapiens
aattattacttta

SEQ ID NO: 4499636 - DNA, 18 bp, Homo sapiens
aattattactttaaatta

SEQ ID NO: 4499637 - DNA, 20 bp, Homo sapiens
aattattagaacattcactt

SEQ ID NO: 4499638 - DNA, 21 bp, Homo sapiens
aattattagaacattcacttt

SEQ ID NO: 4499639 - DNA, 22 bp, Homo sapiens
aattattataaaaatattaaga

SEQ ID NO: 4499640 - DNA, 15 bp, Homo sapiens
aattattgacactga

SEQ ID NO: 4499641 - DNA, 19 bp, Homo sapiens
aattattgacactgaactt

SEQ ID NO: 4499642 - DNA, 14 bp, Homo sapiens
aattattgatatat

SEQ ID NO: 4499643 - DNA, 17 bp, Homo sapiens
aattattgatatatatt

SEQ ID NO: 4499644 - DNA, 18 bp, Homo sapiens
aattattgatatatatta

SEQ ID NO: 4499645 - DNA, 20 bp, Homo sapiens
aattattgatatatattata

SEQ ID NO: 4499646 - DNA, 17 bp, Homo sapiens
aattattgatgttttca

SEQ ID NO: 4499647 - DNA, 14 bp, Homo sapiens
aattattggcaaag

SEQ ID NO: 4499648 - DNA, 15 bp, Homo sapiens
aattattggcaaagt

SEQ ID NO: 4499649 - DNA, 17 bp, Homo sapiens
aattattggcaaagttt

SEQ ID NO: 4499650 - DNA, 22 bp, Homo sapiens
aattatttaaaccgctaaaaga

SEQ ID NO: 4499651 - DNA, 13 bp, Homo sapiens
aattatttaagat

SEQ ID NO: 4499652 - DNA, 14 bp, Homo sapiens
aattatttacaaaa

SEQ ID NO: 4499653 - DNA, 11 bp, Homo sapiens
aattatttctg

SEQ ID NO: 4499654 - DNA, 18 bp, Homo sapiens
aattattttaaattataa

SEQ ID NO: 4499655 - DNA, 23 bp, Homo sapiens
aattattttatatcatacagttt

SEQ ID NO: 4499656 - DNA, 15 bp, Homo sapiens
aattattttttgcat

SEQ ID NO: 4499657 - DNA, 13 bp, Homo sapiens
aattcaaaaacaa

SEQ ID NO: 4499658 - DNA, 13 bp, Homo sapiens
aattcaaatttgt

SEQ ID NO: 4499659 - DNA, 12 bp, Homo sapiens
aatctcaaaatt

SEQ ID NO: 4499660 - DNA, 13 bp, Homo sapiens
aatctcaaaatta

SEQ ID NO: 4499661 - DNA, 12 bp, Homo sapiens
aatctcaaatag

SEQ ID NO: 4499662 - DNA, 14 bp, Homo sapiens
aatctcagtgcttt

SEQ ID NO: 4499663 - DNA, 15 bp, Homo sapiens
aatctcagtgctttc

SEQ ID NO: 4499664 - DNA, 14 bp, Homo sapiens
aatctcattatttc

SEQ ID NO: 4499665 - DNA, 18 bp, Homo sapiens
aatctcattatttcaaaa

SEQ ID NO: 4499666 - DNA, 18 bp, Homo sapiens
aatctcccattttggaat

SEQ ID NO: 4499667 - DNA, 15 bp, Homo sapiens
aatctcctaaccttg

SEQ ID NO: 4499668 - DNA, 14 bp, Homo sapiens
aatctcctattttt

SEQ ID NO: 4499669 - DNA, 21 bp, Homo sapiens
aatctcctatttttttaaaat

SEQ ID NO: 4499670 - DNA, 22 bp, Homo sapiens
aatctctcatattcgctagtgt

SEQ ID NO: 4499671 - DNA, 18 bp, Homo sapiens
aatctcttcattattctc

SEQ ID NO: 4499672 - DNA, 15 bp, Homo sapiens
aatctctttcccttc

SEQ ID NO: 4499673 - DNA, 12 bp, Homo sapiens
aatctgaatgta

SEQ ID NO: 4499674 - DNA, 18 bp, Homo sapiens
aatctgaatgtaatttgt

SEQ ID NO: 4499675 - DNA, 20 bp, Homo sapiens
aatctgatggccttaatttc

SEQ ID NO: 4499676 - DNA, 23 bp, Homo sapiens
aatctgatggccttaatttcctt

SEQ ID NO: 4499677 - DNA, 17 bp, Homo sapiens
aatctgcattattggaa

SEQ ID NO: 4499678 - DNA, 18 bp, Homo sapiens
aatctgcattattggaat

SEQ ID NO: 4499679 - DNA, 19 bp, Homo sapiens
aatctgctaccaaaacagt

SEQ ID NO: 4499680 - DNA, 19 bp, Homo sapiens
aatctgcttttcctctgcc

SEQ ID NO: 4499681 - DNA, 16 bp, Homo sapiens
aatctggattcatatt

SEQ ID NO: 4499682 - DNA, 17 bp, Homo sapiens
aatctggattcatattt

SEQ ID NO: 4499683 - DNA, 18 bp, Homo sapiens
aatctggattcatattta

SEQ ID NO: 4499684 - DNA, 21 bp, Homo sapiens
aatctgtataatactttgtat

SEQ ID NO: 4499685 - DNA, 19 bp, Homo sapiens
aatctgtcaagagtagtta

SEQ ID NO: 4499686 - DNA, 20 bp, Homo sapiens
aatctgtccaaaggaggctg

SEQ ID NO: 4499687 - DNA, 21 bp, Homo sapiens
aatctgtccaaaggaggctgg

SEQ ID NO: 4499688 - DNA, 21 bp, Homo sapiens
aatctgtgaagcctttatcta

SEQ ID NO: 4499689 - DNA, 16 bp, Homo sapiens
aatctgtgacctgtca

SEQ ID NO: 4499690 - DNA, 22 bp, Homo sapiens
aatctgtgacctgtcagaataa

SEQ ID NO: 4499691 - DNA, 17 bp, Homo sapiens
aatctgtgggtctggga

SEQ ID NO: 4499692 - DNA, 15 bp, Homo sapiens
aatctgtttctctgc

SEQ ID NO: 4499693 - DNA, 17 bp, Homo sapiens
aatctgtttctctgctg

SEQ ID NO: 4499694 - DNA, 23 bp, Homo sapiens
aatctgtttctctgctgtcaact

SEQ ID NO: 4499695 - DNA, 12 bp, Homo sapiens
aatctgttttgg

SEQ ID NO: 4499696 - DNA, 19 bp, Homo sapiens
aatctgtttttacgtatgt

SEQ ID NO: 4499697 - DNA, 19 bp, Homo sapiens
aatcttagtatagtagaaa

SEQ ID NO: 4499698 - DNA, 18 bp, Homo sapiens
aatcttagtgtatgatta

SEQ ID NO: 4499699 - DNA, 21 bp, Homo sapiens
aatcttagtgtatgattactg

SEQ ID NO: 4499700 - DNA, 23 bp, Homo sapiens
aatcttagtgtatgattactggc

SEQ ID NO: 4499701 - DNA, 15 bp, Homo sapiens
aatcttataattgtt

SEQ ID NO: 4499702 - DNA, 17 bp, Homo sapiens
aatcttatgtttccaag

SEQ ID NO: 4499703 - DNA, 14 bp, Homo sapiens
aatcttatttttcc

SEQ ID NO: 4499704 - DNA, 12 bp, Homo sapiens
aatcttctactt

SEQ ID NO: 4499705 - DNA, 18 bp, Homo sapiens
aatcttctacttttaact

SEQ ID NO: 4499706 - DNA, 17 bp, Homo sapiens
aatcttgaaattaagaa

SEQ ID NO: 4499707 - DNA, 13 bp, Homo sapiens
aatcttgcccact

SEQ ID NO: 4499708 - DNA, 14 bp, Homo sapiens
aatcttgcccactg

SEQ ID NO: 4499709 - DNA, 19 bp, Homo sapiens
aatcttgcccactggccgc

SEQ ID NO: 4499710 - DNA, 14 bp, Homo sapiens
aatcttgcttcaga

SEQ ID NO: 4499711 - DNA, 14 bp, Homo sapiens
aatcttgttactgc

SEQ ID NO: 4499712 - DNA, 18 bp, Homo sapiens
aatcttgttactgctgat

SEQ ID NO: 4499713 - DNA, 13 bp, Homo sapiens
aatcttgtttata

SEQ ID NO: 4499714 - DNA, 14 bp, Homo sapiens
aatcttgtttatag

SEQ ID NO: 4499715 - DNA, 20 bp, Homo sapiens
aatcttgtttatagcaaaaa

SEQ ID NO: 4499716 - DNA, 13 bp, Homo sapiens
aatcttgtttgtt

SEQ ID NO: 4499717 - DNA, 23 bp, Homo sapiens
aatcttgttttgaaaataaccta

SEQ ID NO: 4499718 - DNA, 20 bp, Homo sapiens
aatctttacctgtatacagt

SEQ ID NO: 4499719 - DNA, 15 bp, Homo sapiens
aatctttcatgtctt

SEQ ID NO: 4499720 - DNA, 16 bp, Homo sapiens
aatctttcatgtcttg

SEQ ID NO: 4499721 - DNA, 20 bp, Homo sapiens
aatctttcatgtcttgtcat

SEQ ID NO: 4499722 - DNA, 13 bp, Homo sapiens
aatctttgaaata

SEQ ID NO: 4499723 - DNA, 23 bp, Homo sapiens
aatctttgtaccaaaattttaaa

SEQ ID NO: 4499724 - DNA, 21 bp, Homo sapiens
aatcttttacaactgcctcga

SEQ ID NO: 4499725 - DNA, 14 bp, Homo sapiens
aatcttttcttatt

SEQ ID NO: 4499726 - DNA, 23 bp, Homo sapiens
aatgaaaaatctcaattgaaagc

SEQ ID NO: 4499727 - DNA, 23 bp, Homo sapiens
aatgaaaacatgtactacagcta

SEQ ID NO: 4499728 - DNA, 13 bp, Homo sapiens
aatgaaaagagaa

SEQ ID NO: 4499729 - DNA, 17 bp, Homo sapiens
aatgaaaattgtattat

SEQ ID NO: 4499730 - DNA, 15 bp, Homo sapiens
aatgaaaattttaag

SEQ ID NO: 4499731 - DNA, 23 bp, Homo sapiens
aatgaaacagggaaaatgaagct

SEQ ID NO: 4499732 - DNA, 13 bp, Homo sapiens
aatgaaagggaaa

SEQ ID NO: 4499733 - DNA, 17 bp, Homo sapiens
aatgaaagtgatgacat

SEQ ID NO: 4499734 - DNA, 14 bp, Homo sapiens
aatgaaatgccaaa

SEQ ID NO: 4499735 - DNA, 15 bp, Homo sapiens
aatgaaatgtttact

SEQ ID NO: 4499736 - DNA, 23 bp, Homo sapiens
aatgaaatgtttactaagtggac

SEQ ID NO: 4499737 - DNA, 20 bp, Homo sapiens
aatgaaattaacacaaagga

SEQ ID NO: 4499738 - DNA, 14 bp, Homo sapiens
aatgaaattaactg

SEQ ID NO: 4499739 - DNA, 12 bp, Homo sapiens
aatgaacagaac

SEQ ID NO: 4499740 - DNA, 14 bp, Homo sapiens
aatgaacagaacat

SEQ ID NO: 4499741 - DNA, 15 bp, Homo sapiens
aatgaacagaacata

SEQ ID NO: 4499742 - DNA, 21 bp, Homo sapiens
aatgaacatccctttttcaat

SEQ ID NO: 4499743 - DNA, 13 bp, Homo sapiens
aatgaacattcca

SEQ ID NO: 4499744 - DNA, 17 bp, Homo sapiens
aatgaaggttttcattt

SEQ ID NO: 4499745 - DNA, 20 bp, Homo sapiens
aatgaataatgcctttgtaa

SEQ ID NO: 4499746 - DNA, 15 bp, Homo sapiens
aatgaataatggaaa

SEQ ID NO: 4499747 - DNA, 19 bp, Homo sapiens
aatgaatgattaaattatg

SEQ ID NO: 4499748 - DNA, 21 bp, Homo sapiens
aatgaattcctagaattaaac

SEQ ID NO: 4499749 - DNA, 17 bp, Homo sapiens
aatgaatttatctttac

SEQ ID NO: 4499750 - DNA, 20 bp, Homo sapiens
aatgacaacacttaatagca

SEQ ID NO: 4499751 - DNA, 22 bp, Homo sapiens
aatgacacccatgccagagagg

SEQ ID NO: 4499752 - DNA, 19 bp, Homo sapiens
aatgacatctttttaaagc

SEQ ID NO: 4499753 - DNA, 20 bp, Homo sapiens
aatgacatctttttaaagct

SEQ ID NO: 4499754 - DNA, 21 bp, Homo sapiens
aatgacatctttttaaagctt

SEQ ID NO: 4499755 - DNA, 18 bp, Homo sapiens
aatgacatttatatcaca

SEQ ID NO: 4499756 - DNA, 13 bp, Homo sapiens
aatgacatttcac

SEQ ID NO: 4499757 - DNA, 21 bp, Homo sapiens
aatgacatttcactaaaagtc

SEQ ID NO: 4499758 - DNA, 15 bp, Homo sapiens
aatgaccatgttata

SEQ ID NO: 4499759 - DNA, 16 bp, Homo sapiens
aatgactctttctgaa

SEQ ID NO: 4499760 - DNA, 16 bp, Homo sapiens
aatgactgacaaagac

SEQ ID NO: 4499761 - DNA, 14 bp, Homo sapiens
aatgacttatttct

SEQ ID NO: 4499762 - DNA, 20 bp, Homo sapiens
aatgacttatttctgctctg

SEQ ID NO: 4499763 - DNA, 21 bp, Homo sapiens
aatgacttatttctgctctgg

SEQ ID NO: 4499764 - DNA, 23 bp, Homo sapiens
aatgacttgtacaaacagtattt

SEQ ID NO: 4499765 - DNA, 13 bp, Homo sapiens
aatgacttttaaa

SEQ ID NO: 4499766 - DNA, 17 bp, Homo sapiens
aatgacttttaaaattt

SEQ ID NO: 4499767 - DNA, 18 bp, Homo sapiens
aatgacttttaaaatttg

SEQ ID NO: 4499768 - DNA, 17 bp, Homo sapiens
aatgagaaaggacagag

SEQ ID NO: 4499769 - DNA, 13 bp, Homo sapiens
aatgagacatcca

SEQ ID NO: 4499770 - DNA, 15 bp, Homo sapiens
aatgagattgaattt

SEQ ID NO: 4499771 - DNA, 16 bp, Homo sapiens
aatgagattgaatttc

SEQ ID NO: 4499772 - DNA, 17 bp, Homo sapiens
aatgagatttcttattt

SEQ ID NO: 4499773 - DNA, 17 bp, Homo sapiens
aatgttttatactgttt

SEQ ID NO: 4499774 - DNA, 12 bp, Homo sapiens
aatgttttatga

SEQ ID NO: 4499775 - DNA, 17 bp, Homo sapiens
aatgttttccaatattt

SEQ ID NO: 4499776 - DNA, 20 bp, Homo sapiens
aatgttttccaatattttaa

SEQ ID NO: 4499777 - DNA, 13 bp, Homo sapiens
aatgttttctttg

SEQ ID NO: 4499778 - DNA, 22 bp, Homo sapiens
aatgttttgccagccacttacc

SEQ ID NO: 4499779 - DNA, 23 bp, Homo sapiens
aatgttttgtgtgtaaggagtat

SEQ ID NO: 4499780 - DNA, 22 bp, Homo sapiens
aattaaaagaaatatacagttt

SEQ ID NO: 4499781 - DNA, 18 bp, Homo sapiens
aattaaaagcaaatcatt

SEQ ID NO: 4499782 - DNA, 21 bp, Homo sapiens
aattaaaagcaaatcatttgt

SEQ ID NO: 4499783 - DNA, 22 bp, Homo sapiens
aattaaaaggatagtattttta

SEQ ID NO: 4499784 - DNA, 14 bp, Homo sapiens
aattaaacaattta

SEQ ID NO: 4499785 - DNA, 14 bp, Homo sapiens
aattaaactacaga

SEQ ID NO: 4499786 - DNA, 21 bp, Homo sapiens
aattaaacttccaaagaaagt

SEQ ID NO: 4499787 - DNA, 22 bp, Homo sapiens
aattaaacttccaaagaaagtt

SEQ ID NO: 4499788 - DNA, 18 bp, Homo sapiens
aatcaaatgaatgattaa

SEQ ID NO: 4499789 - DNA, 23 bp, Homo sapiens
aatcaaatgaatgattaaattat

SEQ ID NO: 4499790 - DNA, 13 bp, Homo sapiens
aatcaaatgattt

SEQ ID NO: 4499791 - DNA, 13 bp, Homo sapiens
aatcaacttttta

SEQ ID NO: 4499792 - DNA, 14 bp, Homo sapiens
aatcaagagaaact

SEQ ID NO: 4499793 - DNA, 13 bp, Homo sapiens
aatcaagagctgc

SEQ ID NO: 4499794 - DNA, 17 bp, Homo sapiens
aatcaagagctgccctc

SEQ ID NO: 4499795 - DNA, 19 bp, Homo sapiens
aatcaagatttttttcctg

SEQ ID NO: 4499796 - DNA, 18 bp, Homo sapiens
aatcaaggaaaggctcat

SEQ ID NO: 4499797 - DNA, 23 bp, Homo sapiens
aatcaagggcaaaaagtctacat

SEQ ID NO: 4499798 - DNA, 12 bp, Homo sapiens
aatcaataatat

SEQ ID NO: 4499799 - DNA, 20 bp, Homo sapiens
aatcaattactggtccaaaa

SEQ ID NO: 4499800 - DNA, 21 bp, Homo sapiens
aatcacaattttcctgtggaa

SEQ ID NO: 4499801 - DNA, 17 bp, Homo sapiens
aatcacaatttttaatg

SEQ ID NO: 4499802 - DNA, 16 bp, Homo sapiens
aatcacagaaaattta

SEQ ID NO: 4499803 - DNA, 19 bp, Homo sapiens
aatcacagaaaatttaact

SEQ ID NO: 4499804 - DNA, 21 bp, Homo sapiens
aatcacagggaggattgaaaa

SEQ ID NO: 4499805 - DNA, 17 bp, Homo sapiens
aatcacagggcatttaa

SEQ ID NO: 4499806 - DNA, 22 bp, Homo sapiens
aatcacatattttaaaatttgt

SEQ ID NO: 4499807 - DNA, 15 bp, Homo sapiens
aatcacattttgtat

SEQ ID NO: 4499808 - DNA, 21 bp, Homo sapiens
aatcacattttgtatggagtt

SEQ ID NO: 4499809 - DNA, 22 bp, Homo sapiens
aatcacatttttttatgctctt

SEQ ID NO: 4499810 - DNA, 15 bp, Homo sapiens
aatcacccctctgcc

SEQ ID NO: 4499811 - DNA, 18 bp, Homo sapiens
aatcacccctctgcccct

SEQ ID NO: 4499812 - DNA, 20 bp, Homo sapiens
aatcacccctctgcccctgc

SEQ ID NO: 4499813 - DNA, 16 bp, Homo sapiens
aatcacgctttcctga

SEQ ID NO: 4499814 - DNA, 15 bp, Homo sapiens
aatcacgctttttga

SEQ ID NO: 4499815 - DNA, 15 bp, Homo sapiens
aatcactaacattat

SEQ ID NO: 4499816 - DNA, 22 bp, Homo sapiens
aatcactgttgctttgaaaaat

SEQ ID NO: 4499817 - DNA, 15 bp, Homo sapiens
aatcacttaaaggca

SEQ ID NO: 4499818 - DNA, 15 bp, Homo sapiens
aatcagaagaaaggc

SEQ ID NO: 4499819 - DNA, 17 bp, Homo sapiens
aatcagaagtttcctgg

SEQ ID NO: 4499820 - DNA, 17 bp, Homo sapiens
aatcagaataaagttgt

SEQ ID NO: 4499821 - DNA, 17 bp, Homo sapiens
aatcagaattggcataa

SEQ ID NO: 4499822 - DNA, 23 bp, Homo sapiens
aatcagagataaagcttaggtca

SEQ ID NO: 4499823 - DNA, 21 bp, Homo sapiens
aatcagatagatattcctatt

SEQ ID NO: 4499824 - DNA, 19 bp, Homo sapiens
aatcagatggtgtcattta

SEQ ID NO: 4499825 - DNA, 15 bp, Homo sapiens
aatcagcactctgta

SEQ ID NO: 4499826 - DNA, 16 bp, Homo sapiens
aatcagctattttgtg

SEQ ID NO: 4499827 - DNA, 19 bp, Homo sapiens
aatcagcttttgttctaga

SEQ ID NO: 4499828 - DNA, 15 bp, Homo sapiens
aatcaggcttttgtt

SEQ ID NO: 4499829 - DNA, 15 bp, Homo sapiens
aatcagtagaaagct

SEQ ID NO: 4499830 - DNA, 21 bp, Homo sapiens
aatcagtagaaagctaaagtg

SEQ ID NO: 4499831 - DNA, 21 bp, Homo sapiens
aatcagtatattttctgtatt

SEQ ID NO: 4499832 - DNA, 18 bp, Homo sapiens
aatcagttcattagaaat

SEQ ID NO: 4499833 - DNA, 13 bp, Homo sapiens
aatcataaagtca

SEQ ID NO: 4499834 - DNA, 14 bp, Homo sapiens
aatcataaagtcag

SEQ ID NO: 4499835 - DNA, 14 bp, Homo sapiens
aatcatacaaactc

SEQ ID NO: 4499836 - DNA, 20 bp, Homo sapiens
aatcatacaccagaagacaa

SEQ ID NO: 4499837 - DNA, 20 bp, Homo sapiens
aatcatagctggttcacact

SEQ ID NO: 4499838 - DNA, 17 bp, Homo sapiens
aatcatatataataaat

SEQ ID NO: 4499839 - DNA, 14 bp, Homo sapiens
aatcatccctcctt

SEQ ID NO: 4499840 - DNA, 18 bp, Homo sapiens
aatcatccctccttgcct

SEQ ID NO: 4499841 - DNA, 20 bp, Homo sapiens
aatcatctattttgatgcag

SEQ ID NO: 4499842 - DNA, 16 bp, Homo sapiens
aatcatgctcatgtat

SEQ ID NO: 4499843 - DNA, 19 bp, Homo sapiens
aatcatgctcatgtatatt

SEQ ID NO: 4499844 - DNA, 23 bp, Homo sapiens
aatcatgttgatcatgtactttt

SEQ ID NO: 4499845 - DNA, 22 bp, Homo sapiens
aatcatgttgttgtgtgtatat

SEQ ID NO: 4499846 - DNA, 20 bp, Homo sapiens
aatcattaatttcaaaattt

SEQ ID NO: 4499847 - DNA, 14 bp, Homo sapiens
aatcattatgtttc

SEQ ID NO: 4499848 - DNA, 19 bp, Homo sapiens
aatcattatttattaaatt

SEQ ID NO: 4499849 - DNA, 14 bp, Homo sapiens
aatcattatttgag

SEQ ID NO: 4499850 - DNA, 16 bp, Homo sapiens
aatcattgttttgaat

SEQ ID NO: 4499851 - DNA, 18 bp, Homo sapiens
aatcattgttttgaatat

SEQ ID NO: 4499852 - DNA, 15 bp, Homo sapiens
aatcatttgtttaaa

SEQ ID NO: 4499853 - DNA, 17 bp, Homo sapiens
aatcatttgtttaaaaa

SEQ ID NO: 4499854 - DNA, 14 bp, Homo sapiens
aatcatttgtttac

SEQ ID NO: 4499855 - DNA, 13 bp, Homo sapiens
aatcattttagaa

SEQ ID NO: 4499856 - DNA, 19 bp, Homo sapiens
aatcattttaggaaaggat

SEQ ID NO: 4499857 - DNA, 17 bp, Homo sapiens
aatcattttcattccta

SEQ ID NO: 4499858 - DNA, 18 bp, Homo sapiens
aatcattttcattcctaa

SEQ ID NO: 4499859 - DNA, 20 bp, Homo sapiens
aatccaaatggcgtctggaa

SEQ ID NO: 4499860 - DNA, 18 bp, Homo sapiens
aatccaaccattttcatt

SEQ ID NO: 4499861 - DNA, 23 bp, Homo sapiens
aatccaagcgaggtcaacagaga

SEQ ID NO: 4499862 - DNA, 17 bp, Homo sapiens
aatccaatgcactgatg

SEQ ID NO: 4499863 - DNA, 18 bp, Homo sapiens
aatccacatgtttcagag

SEQ ID NO: 4499864 - DNA, 16 bp, Homo sapiens
aatccactaacacttt

SEQ ID NO: 4499865 - DNA, 14 bp, Homo sapiens
aatccaggctgttc

SEQ ID NO: 4499866 - DNA, 16 bp, Homo sapiens
aatccaggctgttctc

SEQ ID NO: 4499867 - DNA, 17 bp, Homo sapiens
aatccaggctgttctca

SEQ ID NO: 4499868 - DNA, 11 bp, Homo sapiens
aatccatgctt

SEQ ID NO: 4499869 - DNA, 16 bp, Homo sapiens
aatccatttatttcat

SEQ ID NO: 4499870 - DNA, 12 bp, Homo sapiens
aatccattttag

SEQ ID NO: 4499871 - DNA, 22 bp, Homo sapiens
aatccattttaggtgataaaat

SEQ ID NO: 4499872 - DNA, 21 bp, Homo sapiens
aatcccaaatttgattgattt

SEQ ID NO: 4499873 - DNA, 16 bp, Homo sapiens
aatcccacccacctca

SEQ ID NO: 4499874 - DNA, 15 bp, Homo sapiens
aatcccaccttccca

SEQ ID NO: 4499875 - DNA, 18 bp, Homo sapiens
aatccccaacatgcactg

SEQ ID NO: 4499876 - DNA, 16 bp, Homo sapiens
aatccccccttcagaa

SEQ ID NO: 4499877 - DNA, 22 bp, Homo sapiens
aatcccttaacagttgtattta

SEQ ID NO: 4499878 - DNA, 16 bp, Homo sapiens
aatcctaaaaaacact

SEQ ID NO: 4499879 - DNA, 21 bp, Homo sapiens
aatcctaatttctcctccctt

SEQ ID NO: 4499880 - DNA, 14 bp, Homo sapiens
aatcctaccttgct

SEQ ID NO: 4499881 - DNA, 21 bp, Homo sapiens
aatcctattctgatgaatctc

SEQ ID NO: 4499882 - DNA, 13 bp, Homo sapiens
aatcctcctgcct

SEQ ID NO: 4499883 - DNA, 16 bp, Homo sapiens
aatcctcctgcctcag

SEQ ID NO: 4499884 - DNA, 17 bp, Homo sapiens
aatcctctgttaatgtg

SEQ ID NO: 4499885 - DNA, 13 bp, Homo sapiens
aatcctgcacaga

SEQ ID NO: 4499886 - DNA, 19 bp, Homo sapiens
aatcctgcccaaaatgtga

SEQ ID NO: 4499887 - DNA, 21 bp, Homo sapiens
aatcctgcccaaaatgtgaag

SEQ ID NO: 4499888 - DNA, 24 bp, Homo sapiens
aatcgccaggactggtgaatataa

SEQ ID NO: 4499889 - DNA, 11 bp, Homo sapiens
aatcggactgc

SEQ ID NO: 4499890 - DNA, 16 bp, Homo sapiens
aatcggactgccaaat

SEQ ID NO: 4499891 - DNA, 17 bp, Homo sapiens
aatctaaaaatcctttt

SEQ ID NO: 4499892 - DNA, 12 bp, Homo sapiens
aatctaaaattt

SEQ ID NO: 4499893 - DNA, 13 bp, Homo sapiens
aatctaaaatttc

SEQ ID NO: 4499894 - DNA, 18 bp, Homo sapiens
aatctaacaataatattt

SEQ ID NO: 4499895 - DNA, 17 bp, Homo sapiens
aatctacattataataa

SEQ ID NO: 4499896 - DNA, 18 bp, Homo sapiens
aatctacattataataaa

SEQ ID NO: 4499897 - DNA, 20 bp, Homo sapiens
aatctactgtatcaataaaa

SEQ ID NO: 4499898 - DNA, 21 bp, Homo sapiens
aatctactgtatcaataaaat

SEQ ID NO: 4499899 - DNA, 23 bp, Homo sapiens
aatctactgtatcaataaaattc

SEQ ID NO: 4499900 - DNA, 13 bp, Homo sapiens
aatctagaagagt

SEQ ID NO: 4499901 - DNA, 21 bp, Homo sapiens
aatctagaggaaaagaaagaa

SEQ ID NO: 4499902 - DNA, 21 bp, Homo sapiens
aatctaggatgggaacaagga

SEQ ID NO: 4499903 - DNA, 18 bp, Homo sapiens
aatctataacataaagaa

SEQ ID NO: 4499904 - DNA, 21 bp, Homo sapiens
aatctataacataaagaataa

SEQ ID NO: 4499905 - DNA, 16 bp, Homo sapiens
aaggaggggaaacaat

SEQ ID NO: 4499906 - DNA, 18 bp, Homo sapiens
aaggaggtgggccacacc

SEQ ID NO: 4499907 - DNA, 19 bp, Homo sapiens
aaggagtgtagcaactaca

SEQ ID NO: 4499908 - DNA, 22 bp, Homo sapiens
aaggagttacagggaagtggtc

SEQ ID NO: 4499909 - DNA, 19 bp, Homo sapiens
aaggataaatcataaagtc

SEQ ID NO: 4499910 - DNA, 19 bp, Homo sapiens
aaggataccttcttattta

SEQ ID NO: 4499911 - DNA, 17 bp, Homo sapiens
aaggatagaagctgcag

SEQ ID NO: 4499912 - DNA, 16 bp, Homo sapiens
aaggatatcagagctg

SEQ ID NO: 4499913 - DNA, 13 bp, Homo sapiens
aaggatcatctga

SEQ ID NO: 4499914 - DNA, 13 bp, Homo sapiens
aaggatccagaga

SEQ ID NO: 4499915 - DNA, 16 bp, Homo sapiens
aaggatccggaaagaa

SEQ ID NO: 4499916 - DNA, 13 bp, Homo sapiens
aaggatgatttta

SEQ ID NO: 4499917 - DNA, 19 bp, Homo sapiens
aaggatgtaaacagtgcct

SEQ ID NO: 4499918 - DNA, 17 bp, Homo sapiens
aaggatgtgattgtgga

SEQ ID NO: 4499919 - DNA, 10 bp, Homo sapiens
aaggatgtgt

SEQ ID NO: 4499920 - DNA, 20 bp, Homo sapiens
aaggattctgttctgcaact

SEQ ID NO: 4499921 - DNA, 23 bp, Homo sapiens
aaggattctgttctgcaactcca

SEQ ID NO: 4499922 - DNA, 13 bp, Homo sapiens
aaggattgaaaat

SEQ ID NO: 4499923 - DNA, 14 bp, Homo sapiens
aaggattttaccaa

SEQ ID NO: 4499924 - DNA, 17 bp, Homo sapiens
aaggattttaccaaagc

SEQ ID NO: 4499925 - DNA, 16 bp, Homo sapiens
aagaataataaaatca

SEQ ID NO: 4499926 - DNA, 22 bp, Homo sapiens
aagaataatcacgctttcctga

SEQ ID NO: 4499927 - DNA, 17 bp, Homo sapiens
aagaatacttctcattt

SEQ ID NO: 4499928 - DNA, 16 bp, Homo sapiens
aagaatacttgaactt

SEQ ID NO: 4499929 - DNA, 12 bp, Homo sapiens
aagaatatatat

SEQ ID NO: 4499930 - DNA, 16 bp, Homo sapiens
aagaatatctggcaaa

SEQ ID NO: 4499931 - DNA, 12 bp, Homo sapiens
aagaatattgta

SEQ ID NO: 4499932 - DNA, 14 bp, Homo sapiens
aagaatatttttag

SEQ ID NO: 4499933 - DNA, 12 bp, Homo sapiens
aagaatcagaga

SEQ ID NO: 4499934 - DNA, 12 bp, Homo sapiens
aagaatctactt

SEQ ID NO: 4499935 - DNA, 16 bp, Homo sapiens
aagaatctagaagatg

SEQ ID NO: 4499936 - DNA, 17 bp, Homo sapiens
aagaatctagaagatgt

SEQ ID NO: 4499937 - DNA, 19 bp, Homo sapiens
aagaatctagaagatgtgt

SEQ ID NO: 4499938 - DNA, 18 bp, Homo sapiens
aagaatgaaatgaatgat

SEQ ID NO: 4499939 - DNA, 18 bp, Homo sapiens
aagaatgactatataatt

SEQ ID NO: 4499940 - DNA, 19 bp, Homo sapiens
aagaatggtggcttctttt

SEQ ID NO: 4499941 - DNA, 18 bp, Homo sapiens
aagaatgttactgcctta

SEQ ID NO: 4499942 - DNA, 16 bp, Homo sapiens
aagaattattttgatg

SEQ ID NO: 4499943 - DNA, 16 bp, Homo sapiens
aagaattccaaagcaa

SEQ ID NO: 4499944 - DNA, 17 bp, Homo sapiens
aagaattgccagtcttt

SEQ ID NO: 4499945 - DNA, 16 bp, Homo sapiens
aagaatttagatctta

SEQ ID NO: 4499946 - DNA, 19 bp, Homo sapiens
aagaatttagatcttatat

SEQ ID NO: 4499947 - DNA, 20 bp, Homo sapiens
aagaatttctgctaaatatc

SEQ ID NO: 4499948 - DNA, 20 bp, Homo sapiens
aagaattttcagaccccagc

SEQ ID NO: 4499949 - DNA, 22 bp, Homo sapiens
aagaattttcagaccccagcgg

SEQ ID NO: 4499950 - DNA, 18 bp, Homo sapiens
aagacaaaacgagtcttt

SEQ ID NO: 4499951 - DNA, 22 bp, Homo sapiens
aagacaaaagtctgtctttcct

SEQ ID NO: 4499952 - DNA, 16 bp, Homo sapiens
aagacaaaataaatgt

SEQ ID NO: 4499953 - DNA, 13 bp, Homo sapiens
aagacaaataaat

SEQ ID NO: 4499954 - DNA, 17 bp, Homo sapiens
aagacaaataaatgatt

SEQ ID NO: 4499955 - DNA, 15 bp, Homo sapiens
aagacaaattttgca

SEQ ID NO: 4499956 - DNA, 13 bp, Homo sapiens
aagacaagaaaat

SEQ ID NO: 4499957 - DNA, 17 bp, Homo sapiens
aagacaatagtatttct

SEQ ID NO: 4499958 - DNA, 21 bp, Homo sapiens
aagacacaaggtgatttcaga

SEQ ID NO: 4499959 - DNA, 18 bp, Homo sapiens
aagacagatgagcaggag

SEQ ID NO: 4499960 - DNA, 19 bp, Homo sapiens
aagacagatgagcaggagc

SEQ ID NO: 4499961 - DNA, 20 bp, Homo sapiens
aagatacactgcactttgtt

SEQ ID NO: 4499962 - DNA, 20 bp, Homo sapiens
aagatactaaggacgttgtt

SEQ ID NO: 4499963 - DNA, 15 bp, Homo sapiens
aagatagctgtgact

SEQ ID NO: 4499964 - DNA, 15 bp, Homo sapiens
aagatagtgtaactt

SEQ ID NO: 4499965 - DNA, 21 bp, Homo sapiens
aagatagtgtaacttgcttaa

SEQ ID NO: 4499966 - DNA, 14 bp, Homo sapiens
aagatatatgtgta

SEQ ID NO: 4499967 - DNA, 14 bp, Homo sapiens
aagatattgaagga

SEQ ID NO: 4499968 - DNA, 19 bp, Homo sapiens
aagatatttgcagtttttc

SEQ ID NO: 4499969 - DNA, 15 bp, Homo sapiens
aagatccccaactgc

SEQ ID NO: 4499970 - DNA, 16 bp, Homo sapiens
aagatccccaactgct

SEQ ID NO: 4499971 - DNA, 20 bp, Homo sapiens
aagatccccaactgctccag

SEQ ID NO: 4499972 - DNA, 15 bp, Homo sapiens
aagatctctttctaa

SEQ ID NO: 4499973 - DNA, 19 bp, Homo sapiens
aagatctctttctaaagac

SEQ ID NO: 4499974 - DNA, 21 bp, Homo sapiens
aagatctgttttgaaggcaaa

SEQ ID NO: 4499975 - DNA, 23 bp, Homo sapiens
aagatgaaggagaggcaacatcc

SEQ ID NO: 4499976 - DNA, 18 bp, Homo sapiens
aagatgagctgcagcccc

SEQ ID NO: 4499977 - DNA, 15 bp, Homo sapiens
aagatggaaatacag

SEQ ID NO: 4499978 - DNA, 12 bp, Homo sapiens
aagatggagggg

SEQ ID NO: 4499979 - DNA, 23 bp, Homo sapiens
aagatggcttccgtgagacacaa

SEQ ID NO: 4499980 - DNA, 19 bp, Homo sapiens
aagatgggcatcttttgta

SEQ ID NO: 4499981 - DNA, 16 bp, Homo sapiens
aagatggtatatttgg

SEQ ID NO: 4499982 - DNA, 17 bp, Homo sapiens
aagatggttaaacattt

SEQ ID NO: 4499983 - DNA, 14 bp, Homo sapiens
aagatgtatatagg

SEQ ID NO: 4499984 - DNA, 18 bp, Homo sapiens
aagatgtatggatttcca

SEQ ID NO: 4499985 - DNA, 23 bp, Homo sapiens
aagatgtctcaggtttgttttgt

SEQ ID NO: 4499986 - DNA, 15 bp, Homo sapiens
aagatgtgaattatt

SEQ ID NO: 4499987 - DNA, 18 bp, Homo sapiens
aagatgtgaattattgac

SEQ ID NO: 4499988 - DNA, 21 bp, Homo sapiens
aagatgtgaattattgacact

SEQ ID NO: 4499989 - DNA, 23 bp, Homo sapiens
aagatgtgaattattgacactga

SEQ ID NO: 4499990 - DNA, 17 bp, Homo sapiens
aagatgtgtaaacaggt

SEQ ID NO: 4499991 - DNA, 18 bp, Homo sapiens
aagattaaatgtgtcatt

SEQ ID NO: 4499992 - DNA, 18 bp, Homo sapiens
aagattaatgtaggatga

SEQ ID NO: 4499993 - DNA, 16 bp, Homo sapiens
aagattatgtgacttg

SEQ ID NO: 4499994 - DNA, 23 bp, Homo sapiens
aagattattgtgacttcactgta

SEQ ID NO: 4499995 - DNA, 17 bp, Homo sapiens
aagattccaaaaagcac

SEQ ID NO: 4499996 - DNA, 19 bp, Homo sapiens
aagattcccagagacagga

SEQ ID NO: 4499997 - DNA, 11 bp, Homo sapiens
aagattctatg

SEQ ID NO: 4499998 - DNA, 23 bp, Homo sapiens
aagattctcgccccttccctctc

SEQ ID NO: 4499999 - DNA, 13 bp, Homo sapiens
aagattctttccc

SEQ ID NO: 4500000 - DNA, 16 bp, Homo sapiens
aagattctttcccaat

SEQ ID NO: 4500001 - DNA, 14 bp, Homo sapiens
aagattcttttaaa

SEQ ID NO: 4500002 - DNA, 14 bp, Homo sapiens
aagattgagaagcc

SEQ ID NO: 4500003 - DNA, 23 bp, Homo sapiens
aagattggtctcccatatgcaga

SEQ ID NO: 4500004 - DNA, 14 bp, Homo sapiens
aagattgtattgct

SEQ ID NO: 4500005 - DNA, 21 bp, Homo sapiens
aagatttaaagtattttaatt

SEQ ID NO: 4500006 - DNA, 18 bp, Homo sapiens
aagatttatacagttgaa

SEQ ID NO: 4500007 - DNA, 12 bp, Homo sapiens
aagatttattat

SEQ ID NO: 4500008 - DNA, 12 bp, Homo sapiens
aagatttattgt

SEQ ID NO: 4500009 - DNA, 20 bp, Homo sapiens
aagatttctagtaggcagca

SEQ ID NO: 4500010 - DNA, 21 bp, Homo sapiens
aagatttgatgggccacaact

SEQ ID NO: 4500011 - DNA, 20 bp, Homo sapiens
aagatttggaagctcttctt

SEQ ID NO: 4500012 - DNA, 14 bp, Homo sapiens
aagatttttcaaaa

SEQ ID NO: 4500013 - DNA, 13 bp, Homo sapiens
aagattttttaat

SEQ ID NO: 4500014 - DNA, 13 bp, Homo sapiens
aagatttttttcc

SEQ ID NO: 4500015 - DNA, 14 bp, Homo sapiens
aagattttttttgt

SEQ ID NO: 4500016 - DNA, 15 bp, Homo sapiens
aagattttttttgta

SEQ ID NO: 4500017 - DNA, 16 bp, Homo sapiens
aagattttttttgtaa

SEQ ID NO: 4500018 - DNA, 19 bp, Homo sapiens
aagattttttttgtaactt

SEQ ID NO: 4500019 - DNA, 20 bp, Homo sapiens
aagattttttttgtaacttc

SEQ ID NO: 4500020 - DNA, 23 bp, Homo sapiens
aagattttttttttaagtgacat

SEQ ID NO: 4500021 - DNA, 13 bp, Homo sapiens
aagcaaaaacaat

SEQ ID NO: 4500022 - DNA, 16 bp, Homo sapiens
aagcaaaagcaaggga

SEQ ID NO: 4500023 - DNA, 20 bp, Homo sapiens
aagcaaaaggctgagaagga

SEQ ID NO: 4500024 - DNA, 15 bp, Homo sapiens
aagcaaaataaaaac

SEQ ID NO: 4500025 - DNA, 18 bp, Homo sapiens
aagcaaaataaaaactat

SEQ ID NO: 4500026 - DNA, 13 bp, Homo sapiens
aagcaaaattatt

SEQ ID NO: 4500027 - DNA, 12 bp, Homo sapiens
aagcaaatactt

SEQ ID NO: 4500028 - DNA, 18 bp, Homo sapiens
aagcaaatacttagcaaa

SEQ ID NO: 4500029 - DNA, 23 bp, Homo sapiens
aagcaaatacttagcaaaaagtg

SEQ ID NO: 4500030 - DNA, 16 bp, Homo sapiens
aagcaaatcatttgtt

SEQ ID NO: 4500031 - DNA, 17 bp, Homo sapiens
aagcaaatcgaatgaaa

SEQ ID NO: 4500032 - DNA, 23 bp, Homo sapiens
aagcaaatggcaaaaccagtagc

SEQ ID NO: 4500033 - DNA, 17 bp, Homo sapiens
aagcaaattgctttttt

SEQ ID NO: 4500034 - DNA, 14 bp, Homo sapiens
aagcaaatttcatt

SEQ ID NO: 4500035 - DNA, 16 bp, Homo sapiens
aagcaacaaccttaaa

SEQ ID NO: 4500036 - DNA, 18 bp, Homo sapiens
aagcaactacaacttctc

SEQ ID NO: 4500037 - DNA, 17 bp, Homo sapiens
aagcaagaatcagagaa

SEQ ID NO: 4500038 - DNA, 15 bp, Homo sapiens
aagcaagatgagctg

SEQ ID NO: 4500039 - DNA, 12 bp, Homo sapiens
aagcaagcaaaa

SEQ ID NO: 4500040 - DNA, 20 bp, Homo sapiens
aagcaagtatatttatttct

SEQ ID NO: 4500041 - DNA, 19 bp, Homo sapiens
aagcaagttcgtctgttgt

SEQ ID NO: 4500042 - DNA, 16 bp, Homo sapiens
aagcaataaatgaatg

SEQ ID NO: 4500043 - DNA, 13 bp, Homo sapiens
aagcaataactat

SEQ ID NO: 4500044 - DNA, 14 bp, Homo sapiens
aagcaatactgttt

SEQ ID NO: 4500045 - DNA, 13 bp, Homo sapiens
aagcaatatgcat

SEQ ID NO: 4500046 - DNA, 16 bp, Homo sapiens
aagcaatccacctgcc

SEQ ID NO: 4500047 - DNA, 18 bp, Homo sapiens
aagcaatccacctgcctt

SEQ ID NO: 4500048 - DNA, 19 bp, Homo sapiens
aagcaatccacctgccttg

SEQ ID NO: 4500049 - DNA, 15 bp, Homo sapiens
aagcaatcctcctgc

SEQ ID NO: 4500050 - DNA, 23 bp, Homo sapiens
gtggcatcacagaccccagctgg

SEQ ID NO: 4500051 - DNA, 14 bp, Homo sapiens
gtggcatccagagt

SEQ ID NO: 4500052 - DNA, 15 bp, Homo sapiens
gtggccacacaggca

SEQ ID NO: 4500053 - DNA, 23 bp, Homo sapiens
gtggccacacaggcagggcctgg

SEQ ID NO: 4500054 - DNA, 20 bp, Homo sapiens
gtggccaggggtgctcctgt

SEQ ID NO: 4500055 - DNA, 15 bp, Homo sapiens
gtggccatccctgtg

SEQ ID NO: 4500056 - DNA, 19 bp, Homo sapiens
gtggcccagagccatactg

SEQ ID NO: 4500057 - DNA, 16 bp, Homo sapiens
gtggcccctcccctgc

SEQ ID NO: 4500058 - DNA, 19 bp, Homo sapiens
gtggcccctcccctgcaga

SEQ ID NO: 4500059 - DNA, 13 bp, Homo sapiens
gtggccctggcct

SEQ ID NO: 4500060 - DNA, 16 bp, Homo sapiens
gtggccctggcctgct

SEQ ID NO: 4500061 - DNA, 23 bp, Homo sapiens
gtggccggtgccagctgcccttg

SEQ ID NO: 4500062 - DNA, 18 bp, Homo sapiens
gtggccgtctcctccctc

SEQ ID NO: 4500063 - DNA, 21 bp, Homo sapiens
gtggcctaacctgccgagagt

SEQ ID NO: 4500064 - DNA, 9 bp, Homo sapiens
gtggcctca

SEQ ID NO: 4500065 - DNA, 11 bp, Homo sapiens
gtggcctcaga

SEQ ID NO: 4500066 - DNA, 12 bp, Homo sapiens
gtggcctcagcc

SEQ ID NO: 4500067 - DNA, 13 bp, Homo sapiens
gtggcctcagccc

SEQ ID NO: 4500068 - DNA, 18 bp, Homo sapiens
gtggcctcagccctcaga

SEQ ID NO: 4500069 - DNA, 13 bp, Homo sapiens
gtggcctccctgc

SEQ ID NO: 4500070 - DNA, 19 bp, Homo sapiens
gtggcctccctgctgtgcc

SEQ ID NO: 4500071 - DNA, 12 bp, Homo sapiens
gtggcctggcca

SEQ ID NO: 4500072 - DNA, 13 bp, Homo sapiens
gtggcctggccag

SEQ ID NO: 4500073 - DNA, 23 bp, Homo sapiens
gtggcgagccatttgtcccaagt

SEQ ID NO: 4500074 - DNA, 17 bp, Homo sapiens
gtggcgggaatgagctg

SEQ ID NO: 4500075 - DNA, 23 bp, Homo sapiens
gtggcgggaatgagctgtgtaaa

SEQ ID NO: 4500076 - DNA, 14 bp, Homo sapiens
gtggcgggcacctg

SEQ ID NO: 4500077 - DNA, 22 bp, Homo sapiens
gtggctagcaaattagaaacac

SEQ ID NO: 4500078 - DNA, 17 bp, Homo sapiens
gtggctagtcagagaga

SEQ ID NO: 4500079 - DNA, 18 bp, Homo sapiens
gtggctcagacccctcag

SEQ ID NO: 4500080 - DNA, 14 bp, Homo sapiens
gtggctcatgcctg

SEQ ID NO: 4500081 - DNA, 14 bp, Homo sapiens
gtggctcccctgcc

SEQ ID NO: 4500082 - DNA, 15 bp, Homo sapiens
gtggctcgctccctg

SEQ ID NO: 4500083 - DNA, 16 bp, Homo sapiens
gtggctctgccctgga

SEQ ID NO: 4500084 - DNA, 19 bp, Homo sapiens
gtggctctgccctggaaag

SEQ ID NO: 4500085 - DNA, 14 bp, Homo sapiens
gtggctgacccagt

SEQ ID NO: 4500086 - DNA, 19 bp, Homo sapiens
gtggctgccacacccaggg

SEQ ID NO: 4500087 - DNA, 16 bp, Homo sapiens
gtggctggctctacct

SEQ ID NO: 4500088 - DNA, 22 bp, Homo sapiens
gtggctgggggcaggagggccc

SEQ ID NO: 4500089 - DNA, 13 bp, Homo sapiens
gtggctggtgtcc

SEQ ID NO: 4500090 - DNA, 14 bp, Homo sapiens
gtggctggtgtccc

SEQ ID NO: 4500091 - DNA, 19 bp, Homo sapiens
gtggctggtgtccccttcc

SEQ ID NO: 4500092 - DNA, 21 bp, Homo sapiens
gtggctggtgtccccttcccc

SEQ ID NO: 4500093 - DNA, 17 bp, Homo sapiens
gtggcttccctgtccca

SEQ ID NO: 4500094 - DNA, 20 bp, Homo sapiens
gtggcttcttttctttgtat

SEQ ID NO: 4500095 - DNA, 17 bp, Homo sapiens
gtgggaacgtgactgcc

SEQ ID NO: 4500096 - DNA, 17 bp, Homo sapiens
gtgggaactcactttcc

SEQ ID NO: 4500097 - DNA, 18 bp, Homo sapiens
gtgggacatggaaaagaa

SEQ ID NO: 4500098 - DNA, 15 bp, Homo sapiens
gtgggaccctcagca

SEQ ID NO: 4500099 - DNA, 22 bp, Homo sapiens
gtgggaccctcagcagctctgg

SEQ ID NO: 4500100 - DNA, 23 bp, Homo sapiens
gtgggaccctcagcagctctggc

SEQ ID NO: 4500101 - DNA, 15 bp, Homo sapiens
gtgggaggcgtgccc

SEQ ID NO: 4500102 - DNA, 14 bp, Homo sapiens
gtgggagtggggcc

SEQ ID NO: 4500103 - DNA, 18 bp, Homo sapiens
gtgggagtggggcctttg

SEQ ID NO: 4500104 - DNA, 13 bp, Homo sapiens
gtgggatcctccc

SEQ ID NO: 4500105 - DNA, 14 bp, Homo sapiens
gtgggatgctgaag

SEQ ID NO: 4500106 - DNA, 14 bp, Homo sapiens
gtgggatggaggag

SEQ ID NO: 4500107 - DNA, 16 bp, Homo sapiens
gtgggatggaggagaa

SEQ ID NO: 4500108 - DNA, 18 bp, Homo sapiens
gtgggccttgctggggac

SEQ ID NO: 4500109 - DNA, 19 bp, Homo sapiens
gtgggcggctcctggtgct

SEQ ID NO: 4500110 - DNA, 18 bp, Homo sapiens
gtgggcgttgggagccta

SEQ ID NO: 4500111 - DNA, 15 bp, Homo sapiens
gtgggcttcctgccc

SEQ ID NO: 4500112 - DNA, 23 bp, Homo sapiens
gtgggcttcctgcccttccctct

SEQ ID NO: 4500113 - DNA, 17 bp, Homo sapiens
gtggggaacggaggagg

SEQ ID NO: 4500114 - DNA, 17 bp, Homo sapiens
gtggggagactgggctg

SEQ ID NO: 4500115 - DNA, 17 bp, Homo sapiens
gtggggagatgcttctc

SEQ ID NO: 4500116 - DNA, 21 bp, Homo sapiens
gtggggagatgcttctctcct

SEQ ID NO: 4500117 - DNA, 12 bp, Homo sapiens
gtggggcccact

SEQ ID NO: 4500118 - DNA, 11 bp, Homo sapiens
gtggggcctgg

SEQ ID NO: 4500119 - DNA, 12 bp, Homo sapiens
gtggggcctggg

SEQ ID NO: 4500120 - DNA, 22 bp, Homo sapiens
gtgggggcagagggcagaggct

SEQ ID NO: 4500121 - DNA, 12 bp, Homo sapiens
gtggggggtgac

SEQ ID NO: 4500122 - DNA, 16 bp, Homo sapiens
gtgggggtctgtgtgt

SEQ ID NO: 4500123 - DNA, 14 bp, Homo sapiens
gtgggggtggagga

SEQ ID NO: 4500124 - DNA, 12 bp, Homo sapiens
gtgggggtggcc

SEQ ID NO: 4500125 - DNA, 12 bp, Homo sapiens
gtgggggtgggt

SEQ ID NO: 4500126 - DNA, 14 bp, Homo sapiens
gtgggggtgggtca

SEQ ID NO: 4500127 - DNA, 19 bp, Homo sapiens
gtggggtaggttgggagaa

SEQ ID NO: 4500128 - DNA, 17 bp, Homo sapiens
gtggggtctccctctcc

SEQ ID NO: 4500129 - DNA, 21 bp, Homo sapiens
gtggggtctccctctcctgcc

SEQ ID NO: 4500130 - DNA, 23 bp, Homo sapiens
gtggggtggagtcgcagaccaga

SEQ ID NO: 4500131 - DNA, 15 bp, Homo sapiens
gtgggtacatcaagt

SEQ ID NO: 4500132 - DNA, 16 bp, Homo sapiens
gtgggtccaggggccc

SEQ ID NO: 4500133 - DNA, 22 bp, Homo sapiens
gtgggtccatgggcagagccca

SEQ ID NO: 4500134 - DNA, 18 bp, Homo sapiens
gtgggtcccgcactctgc

SEQ ID NO: 4500135 - DNA, 18 bp, Homo sapiens
gtgggtctctgtgtgtgt

SEQ ID NO: 4500136 - DNA, 13 bp, Homo sapiens
gtgggtctgggag

SEQ ID NO: 4500137 - DNA, 14 bp, Homo sapiens
gtgggtgagctctc

SEQ ID NO: 4500138 - DNA, 17 bp, Homo sapiens
gtgggtgagctctcagg

SEQ ID NO: 4500139 - DNA, 20 bp, Homo sapiens
gtgggtgcgtaaggatgtgt

SEQ ID NO: 4500140 - DNA, 19 bp, Homo sapiens
gtggtaaggtgtgtactca

SEQ ID NO: 4500141 - DNA, 15 bp, Homo sapiens
gtggtatgtcactca

SEQ ID NO: 4500142 - DNA, 14 bp, Homo sapiens
gtggtcacagctgt

SEQ ID NO: 4500143 - DNA, 15 bp, Homo sapiens
gtggtcagagtgcca

SEQ ID NO: 4500144 - DNA, 21 bp, Homo sapiens
gtggtctataagatgaaacat

SEQ ID NO: 4500145 - DNA, 23 bp, Homo sapiens
gtggtgaaatcccatctctacaa

SEQ ID NO: 4500146 - DNA, 16 bp, Homo sapiens
gtggtgaaatcttgtt

SEQ ID NO: 4500147 - DNA, 22 bp, Homo sapiens
gtggtgacttctgctgctggcc

SEQ ID NO: 4500148 - DNA, 19 bp, Homo sapiens
gtggtgcagccttcccctc

SEQ ID NO: 4500149 - DNA, 21 bp, Homo sapiens
gtggtggcctatttcagctgc

SEQ ID NO: 4500150 - DNA, 14 bp, Homo sapiens
gtggtggctcggga

SEQ ID NO: 4500151 - DNA, 14 bp, Homo sapiens
gtggtgtgatctta

SEQ ID NO: 4500152 - DNA, 18 bp, Homo sapiens
gtggttccccaccgaagt

SEQ ID NO: 4500153 - DNA, 12 bp, Homo sapiens
gtggttcttttt

SEQ ID NO: 4500154 - DNA, 14 bp, Homo sapiens
gtggtttgcagatg

SEQ ID NO: 4500155 - DNA, 20 bp, Homo sapiens
gtggttttatactgaaggaa

SEQ ID NO: 4500156 - DNA, 19 bp, Homo sapiens
gtgtaaaatattttgaatc

SEQ ID NO: 4500157 - DNA, 11 bp, Homo sapiens
gtgtaaaatta

SEQ ID NO: 4500158 - DNA, 14 bp, Homo sapiens
gtgtaaaattaatg

SEQ ID NO: 4500159 - DNA, 15 bp, Homo sapiens
gtgtaaaattaatgt

SEQ ID NO: 4500160 - DNA, 21 bp, Homo sapiens
gtgtaaaattaatgtaataaa

SEQ ID NO: 4500161 - DNA, 13 bp, Homo sapiens
gtgtaaatttgta

SEQ ID NO: 4500162 - DNA, 15 bp, Homo sapiens
gtgtaacttgcttaa

SEQ ID NO: 4500163 - DNA, 22 bp, Homo sapiens
gtgtaagaactgtacattgtga

SEQ ID NO: 4500164 - DNA, 23 bp, Homo sapiens
gtgtaagaactgtacattgtgag

SEQ ID NO: 4500165 - DNA, 18 bp, Homo sapiens
gtgtaataaagtgttttc

SEQ ID NO: 4500166 - DNA, 22 bp, Homo sapiens
gtgtaataaagtgttttcagag

SEQ ID NO: 4500167 - DNA, 20 bp, Homo sapiens
gtgtaatttaaaattgtgat

SEQ ID NO: 4500168 - DNA, 15 bp, Homo sapiens
gtgtaatttgaagat

SEQ ID NO: 4500169 - DNA, 16 bp, Homo sapiens
gtgtacaatgtacaca

SEQ ID NO: 4500170 - DNA, 20 bp, Homo sapiens
gtgtacaatgtacacactgg

SEQ ID NO: 4500171 - DNA, 17 bp, Homo sapiens
gtgttctttcctgccct

SEQ ID NO: 4500172 - DNA, 21 bp, Homo sapiens
gtgttcttttctcctttacca

SEQ ID NO: 4500173 - DNA, 12 bp, Homo sapiens
gtgttgaaaacc

SEQ ID NO: 4500174 - DNA, 15 bp, Homo sapiens
gtgttgaaaaccaaa

SEQ ID NO: 4500175 - DNA, 14 bp, Homo sapiens
gtgttgaggttttt

SEQ ID NO: 4500176 - DNA, 15 bp, Homo sapiens
gtgttggctttgcag

SEQ ID NO: 4500177 - DNA, 14 bp, Homo sapiens
gtgttgggagggat

SEQ ID NO: 4500178 - DNA, 21 bp, Homo sapiens
gtgtttatgaaacagccattt

SEQ ID NO: 4500179 - DNA, 19 bp, Homo sapiens
gtgtttattaaaattctga

SEQ ID NO: 4500180 - DNA, 18 bp, Homo sapiens
gtgtttcacttaatgttt

SEQ ID NO: 4500181 - DNA, 21 bp, Homo sapiens
gtgtttctgtcctgtaactgt

SEQ ID NO: 4500182 - DNA, 16 bp, Homo sapiens
gtgtttctttagtttt

SEQ ID NO: 4500183 - DNA, 16 bp, Homo sapiens
gtgtttgactgtaatg

SEQ ID NO: 4500184 - DNA, 11 bp, Homo sapiens
gtgtttgtgtg

SEQ ID NO: 4500185 - DNA, 14 bp, Homo sapiens
gtgttttactgtca

SEQ ID NO: 4500186 - DNA, 20 bp, Homo sapiens
gtgttttactgtcagattaa

SEQ ID NO: 4500187 - DNA, 12 bp, Homo sapiens
gtgttttcagag

SEQ ID NO: 4500188 - DNA, 13 bp, Homo sapiens
gtgttttcatcat

SEQ ID NO: 4500189 - DNA, 22 bp, Homo sapiens
gtgttttgttttggactctctg

SEQ ID NO: 4500190 - DNA, 12 bp, Homo sapiens
gtgtttttctca

SEQ ID NO: 4500191 - DNA, 13 bp, Homo sapiens
gtgtttttctcca

SEQ ID NO: 4500192 - DNA, 14 bp, Homo sapiens
gtgtttttgggaag

SEQ ID NO: 4500193 - DNA, 15 bp, Homo sapiens
gtgttttttaagatg

SEQ ID NO: 4500194 - DNA, 23 bp, Homo sapiens
gtgttttttctttttttttaagt

SEQ ID NO: 4500195 - DNA, 19 bp, Homo sapiens
gtgtttttttatgaatggg

SEQ ID NO: 4500196 - DNA, 20 bp, Homo sapiens
gttaaaaattaaatatttat

SEQ ID NO: 4500197 - DNA, 21 bp, Homo sapiens
gttaaaactcatcacataaag

SEQ ID NO: 4500198 - DNA, 16 bp, Homo sapiens
gttaaaagatgaaaat

SEQ ID NO: 4500199 - DNA, 13 bp, Homo sapiens
gttaaaataaagc

SEQ ID NO: 4500200 - DNA, 12 bp, Homo sapiens
gttaaaatgtga

SEQ ID NO: 4500201 - DNA, 14 bp, Homo sapiens
gttaaacattgaag

SEQ ID NO: 4500202 - DNA, 23 bp, Homo sapiens
gttaaacggtgcccatcctgcca

SEQ ID NO: 4500203 - DNA, 21 bp, Homo sapiens
gttaaacgtagcatgtggcat

SEQ ID NO: 4500204 - DNA, 13 bp, Homo sapiens
gttaaatcatttg

SEQ ID NO: 4500205 - DNA, 14 bp, Homo sapiens
gttaaatcatttgg

SEQ ID NO: 4500206 - DNA, 19 bp, Homo sapiens
gttaacaatgcctattgta

SEQ ID NO: 4500207 - DNA, 16 bp, Homo sapiens
gttaacctctgctttt

SEQ ID NO: 4500208 - DNA, 18 bp, Homo sapiens
gttaactgttcttggaaa

SEQ ID NO: 4500209 - DNA, 21 bp, Homo sapiens
gttaacttattcaaagagaaa

SEQ ID NO: 4500210 - DNA, 16 bp, Homo sapiens
gttaacttggtcagag

SEQ ID NO: 4500211 - DNA, 16 bp, Homo sapiens
gttaagcacaagacac

SEQ ID NO: 4500212 - DNA, 14 bp, Homo sapiens
gttaagccctggca

SEQ ID NO: 4500213 - DNA, 17 bp, Homo sapiens
gttaagtcctccctgac

SEQ ID NO: 4500214 - DNA, 20 bp, Homo sapiens
gttaatataccccaaattgt

SEQ ID NO: 4500215 - DNA, 19 bp, Homo sapiens
gttaatcttaatgtatatc

SEQ ID NO: 4500216 - DNA, 17 bp, Homo sapiens
gttaatgtatataaaaa

SEQ ID NO: 4500217 - DNA, 14 bp, Homo sapiens
gttaattcatttgg

SEQ ID NO: 4500218 - DNA, 18 bp, Homo sapiens
gttaatttataatgtatt

SEQ ID NO: 4500219 - DNA, 16 bp, Homo sapiens
gttaattttaccttgt

SEQ ID NO: 4500220 - DNA, 22 bp, Homo sapiens
gttaattttgaagtgctgttta

SEQ ID NO: 4500221 - DNA, 20 bp, Homo sapiens
gttaatttttccaactacta

SEQ ID NO: 4500222 - DNA, 21 bp, Homo sapiens
gttaattttttggtacaaaaa

SEQ ID NO: 4500223 - DNA, 17 bp, Homo sapiens
gttacacatttttcaga

SEQ ID NO: 4500224 - DNA, 19 bp, Homo sapiens
gttacagactgaaaggtgt

SEQ ID NO: 4500225 - DNA, 18 bp, Homo sapiens
gttacagagaatttctaa

SEQ ID NO: 4500226 - DNA, 15 bp, Homo sapiens
gttacagttctgtgg

SEQ ID NO: 4500227 - DNA, 18 bp, Homo sapiens
gttacataaggatgactt

SEQ ID NO: 4500228 - DNA, 20 bp, Homo sapiens
gttaccaagtatgaagtata

SEQ ID NO: 4500229 - DNA, 19 bp, Homo sapiens
gttaccaggcactggttgt

SEQ ID NO: 4500230 - DNA, 16 bp, Homo sapiens
gttaccatttacatgt

SEQ ID NO: 4500231 - DNA, 13 bp, Homo sapiens
gttacctgtagat

SEQ ID NO: 4500232 - DNA, 16 bp, Homo sapiens
gttactcagccctggg

SEQ ID NO: 4500233 - DNA, 17 bp, Homo sapiens
gttactctccaacctgg

SEQ ID NO: 4500234 - DNA, 18 bp, Homo sapiens
gttactctccaacctgga

SEQ ID NO: 4500235 - DNA, 21 bp, Homo sapiens
gttactctcttccacatgtta

SEQ ID NO: 4500236 - DNA, 16 bp, Homo sapiens
gttactgctgattctt

SEQ ID NO: 4500237 - DNA, 20 bp, Homo sapiens
gttactgctgattcttgtaa

SEQ ID NO: 4500238 - DNA, 15 bp, Homo sapiens
gttactgtatttttc

SEQ ID NO: 4500239 - DNA, 17 bp, Homo sapiens
gttactgtatttttcag

SEQ ID NO: 4500240 - DNA, 17 bp, Homo sapiens
gttacttagaatgccat

SEQ ID NO: 4500241 - DNA, 22 bp, Homo sapiens
gttacttagaatgccataaaat

SEQ ID NO: 4500242 - DNA, 13 bp, Homo sapiens
gttacttccttat

SEQ ID NO: 4500243 - DNA, 15 bp, Homo sapiens
gttacttcttctctt

SEQ ID NO: 4500244 - DNA, 17 bp, Homo sapiens
gttacttgcttcagtgg

SEQ ID NO: 4500245 - DNA, 15 bp, Homo sapiens
gttagaaaatgactt

SEQ ID NO: 4500246 - DNA, 15 bp, Homo sapiens
gttagaaacattttg

SEQ ID NO: 4500247 - DNA, 21 bp, Homo sapiens
gttagaacactattttcagaa

SEQ ID NO: 4500248 - DNA, 17 bp, Homo sapiens
gttagaaccacagcaga

SEQ ID NO: 4500249 - DNA, 18 bp, Homo sapiens
gttagaaccacagcagac

SEQ ID NO: 4500250 - DNA, 20 bp, Homo sapiens
gttagaagggttacatggtg

SEQ ID NO: 4500251 - DNA, 22 bp, Homo sapiens
gttagaccgctctcttttctgt

SEQ ID NO: 4500252 - DNA, 19 bp, Homo sapiens
gttagacttgtgtgcatgg

SEQ ID NO: 4500253 - DNA, 15 bp, Homo sapiens
gttagagaataaatt

SEQ ID NO: 4500254 - DNA, 15 bp, Homo sapiens
gttagagagaaagag

SEQ ID NO: 4500255 - DNA, 21 bp, Homo sapiens
gttagatctttgtaaatgcat

SEQ ID NO: 4500256 - DNA, 11 bp, Homo sapiens
gttagcaaaga

SEQ ID NO: 4500257 - DNA, 20 bp, Homo sapiens
gttagcactgaactgctttt

SEQ ID NO: 4500258 - DNA, 16 bp, Homo sapiens
gttagcatccaggctg

SEQ ID NO: 4500259 - DNA, 21 bp, Homo sapiens
gttagcatccaggctggccag

SEQ ID NO: 4500260 - DNA, 22 bp, Homo sapiens
gttagcgtttcggccttcataa

SEQ ID NO: 4500261 - DNA, 14 bp, Homo sapiens
gttagctgggaaga

SEQ ID NO: 4500262 - DNA, 14 bp, Homo sapiens
gttaggcagcaagc

SEQ ID NO: 4500263 - DNA, 15 bp, Homo sapiens
gttagtaatctgtat

SEQ ID NO: 4500264 - DNA, 17 bp, Homo sapiens
gttagttaccttatagt

SEQ ID NO: 4500265 - DNA, 23 bp, Homo sapiens
gttagttaccttatagttactgt

SEQ ID NO: 4500266 - DNA, 17 bp, Homo sapiens
gttagtttgtatatatt

SEQ ID NO: 4500267 - DNA, 21 bp, Homo sapiens
gttagtttgtatatattatta

SEQ ID NO: 4500268 - DNA, 14 bp, Homo sapiens
gttataaagataca

SEQ ID NO: 4500269 - DNA, 19 bp, Homo sapiens
gttataaagccttctaaaa

SEQ ID NO: 4500270 - DNA, 18 bp, Homo sapiens
gttataacagatgtgaaa

SEQ ID NO: 4500271 - DNA, 23 bp, Homo sapiens
gttataattttttttaaaataga

SEQ ID NO: 4500272 - DNA, 17 bp, Homo sapiens
gttatacagttataaaa

SEQ ID NO: 4500273 - DNA, 19 bp, Homo sapiens
gttatactgaaccaggcca

SEQ ID NO: 4500274 - DNA, 20 bp, Homo sapiens
gttatactgaaccaggccag

SEQ ID NO: 4500275 - DNA, 14 bp, Homo sapiens
gttatatattgtat

SEQ ID NO: 4500276 - DNA, 23 bp, Homo sapiens
gttatatattgtattaagggcat

SEQ ID NO: 4500277 - DNA, 19 bp, Homo sapiens
gttatattgaaaaaataga

SEQ ID NO: 4500278 - DNA, 10 bp, Homo sapiens
gttatatttc

SEQ ID NO: 4500279 - DNA, 21 bp, Homo sapiens
gttatatttcagatgtaatgt

SEQ ID NO: 4500280 - DNA, 20 bp, Homo sapiens
gttatcaaactgctgtcgtt

SEQ ID NO: 4500281 - DNA, 20 bp, Homo sapiens
gttatcaccgtgggctccct

SEQ ID NO: 4500282 - DNA, 14 bp, Homo sapiens
gttatcatgaattt

SEQ ID NO: 4500283 - DNA, 16 bp, Homo sapiens
gttatcatgaatttta

SEQ ID NO: 4500284 - DNA, 18 bp, Homo sapiens
gttatcatgaattttaaa

SEQ ID NO: 4500285 - DNA, 17 bp, Homo sapiens
gttatcatggaagaaaa

SEQ ID NO: 4500286 - DNA, 19 bp, Homo sapiens
gttatcatggaagaaaagg

SEQ ID NO: 4500287 - DNA, 22 bp, Homo sapiens
gttatccaactattaagatatc

SEQ ID NO: 4500288 - DNA, 22 bp, Homo sapiens
gttatctacctcaaggtaacaa

SEQ ID NO: 4500289 - DNA, 19 bp, Homo sapiens
gttatcttatactgtacaa

SEQ ID NO: 4500290 - DNA, 11 bp, Homo sapiens
gttatgaaaat

SEQ ID NO: 4500291 - DNA, 14 bp, Homo sapiens
gttatgaacatcca

SEQ ID NO: 4500292 - DNA, 13 bp, Homo sapiens
gtgtacagactct

SEQ ID NO: 4500293 - DNA, 13 bp, Homo sapiens
gtgtacagtcttg

SEQ ID NO: 4500294 - DNA, 16 bp, Homo sapiens
gtgtacagtcttgtat

SEQ ID NO: 4500295 - DNA, 22 bp, Homo sapiens
gtgtacagtcttgtattaagtt

SEQ ID NO: 4500296 - DNA, 12 bp, Homo sapiens
gtgtaccaagtg

SEQ ID NO: 4500297 - DNA, 15 bp, Homo sapiens
gtgtagatttgaaaa

SEQ ID NO: 4500298 - DNA, 17 bp, Homo sapiens
gtgtagctgcaaaaata

SEQ ID NO: 4500299 - DNA, 13 bp, Homo sapiens
gtgtaggtgactt

SEQ ID NO: 4500300 - DNA, 13 bp, Homo sapiens
gtgtataggaatt

SEQ ID NO: 4500301 - DNA, 17 bp, Homo sapiens
gtgtataggaatttgta

SEQ ID NO: 4500302 - DNA, 21 bp, Homo sapiens
gtgtatagtgttcacaaactg

SEQ ID NO: 4500303 - DNA, 22 bp, Homo sapiens
gtgtatagtgttcacaaactgt

SEQ ID NO: 4500304 - DNA, 23 bp, Homo sapiens
gtgtatagtgttcacaaactgtg

SEQ ID NO: 4500305 - DNA, 16 bp, Homo sapiens
gtgtatatatcttata

SEQ ID NO: 4500306 - DNA, 19 bp, Homo sapiens
gtgtatatatgtgtgccct

SEQ ID NO: 4500307 - DNA, 15 bp, Homo sapiens
gtgtatcagtgttta

SEQ ID NO: 4500308 - DNA, 14 bp, Homo sapiens
gtgtattaaacctt

SEQ ID NO: 4500309 - DNA, 16 bp, Homo sapiens
gtgtattaacatgcaa

SEQ ID NO: 4500310 - DNA, 19 bp, Homo sapiens
gtgtattaacatgcaataa

SEQ ID NO: 4500311 - DNA, 20 bp, Homo sapiens
gtgtattgagtcttaactgt

SEQ ID NO: 4500312 - DNA, 22 bp, Homo sapiens
gtgtattgagtcttaactgtat

SEQ ID NO: 4500313 - DNA, 12 bp, Homo sapiens
gtgtatttattt

SEQ ID NO: 4500314 - DNA, 16 bp, Homo sapiens
gtgtcaaataaacact

SEQ ID NO: 4500315 - DNA, 16 bp, Homo sapiens
gtgtcaagtgcctgca

SEQ ID NO: 4500316 - DNA, 18 bp, Homo sapiens
gtgtcaagttgtgcttgt

SEQ ID NO: 4500317 - DNA, 10 bp, Homo sapiens
gtgtcacagt

SEQ ID NO: 4500318 - DNA, 23 bp, Homo sapiens
gtgtcacagttcttggtgactgt

SEQ ID NO: 4500319 - DNA, 20 bp, Homo sapiens
gtgtcagagcccagcccagg

SEQ ID NO: 4500320 - DNA, 14 bp, Homo sapiens
gtgtcaggctgctg

SEQ ID NO: 4500321 - DNA, 19 bp, Homo sapiens
gtgtcaggctgctggcgcc

SEQ ID NO: 4500322 - DNA, 20 bp, Homo sapiens
gtgtcatcctcacagtgaac

SEQ ID NO: 4500323 - DNA, 20 bp, Homo sapiens
gtgtcatttccggctgctgt

SEQ ID NO: 4500324 - DNA, 12 bp, Homo sapiens
gtgtcattttct

SEQ ID NO: 4500325 - DNA, 13 bp, Homo sapiens
gtgtccacctggc

SEQ ID NO: 4500326 - DNA, 20 bp, Homo sapiens
gtgtccccaacgtcccctcc

SEQ ID NO: 4500327 - DNA, 21 bp, Homo sapiens
gtgtccccaacgtcccctccg

SEQ ID NO: 4500328 - DNA, 21 bp, Homo sapiens
gtgtccccagcctacctctcc

SEQ ID NO: 4500329 - DNA, 22 bp, Homo sapiens
gtgtcccccccaggccttgtcc

SEQ ID NO: 4500330 - DNA, 15 bp, Homo sapiens
gtgtccccttcccct

SEQ ID NO: 4500331 - DNA, 19 bp, Homo sapiens
gtgtcctctccctgccaag

SEQ ID NO: 4500332 - DNA, 13 bp, Homo sapiens
gtgtcctgaggcc

SEQ ID NO: 4500333 - DNA, 19 bp, Homo sapiens
gtgtccttgcacctgcatc

SEQ ID NO: 4500334 - DNA, 14 bp, Homo sapiens
gtgtctcagcctct

SEQ ID NO: 4500335 - DNA, 18 bp, Homo sapiens
gtgtctccaaccccccag

SEQ ID NO: 4500336 - DNA, 16 bp, Homo sapiens
gtgtctccccgtgtcc

SEQ ID NO: 4500337 - DNA, 21 bp, Homo sapiens
gtgtctgtgccctccaaagag

SEQ ID NO: 4500338 - DNA, 15 bp, Homo sapiens
gtgtcttccctgcct

SEQ ID NO: 4500339 - DNA, 16 bp, Homo sapiens
gtgtctttctaagaaa

SEQ ID NO: 4500340 - DNA, 22 bp, Homo sapiens
gtgtctttctttggtgcctttc

SEQ ID NO: 4500341 - DNA, 21 bp, Homo sapiens
gtgtcttttctgtagagcata

SEQ ID NO: 4500342 - DNA, 18 bp, Homo sapiens
gtgtgaacctacctgcct

SEQ ID NO: 4500343 - DNA, 20 bp, Homo sapiens
gtgtgaactcaccctgggag

SEQ ID NO: 4500344 - DNA, 13 bp, Homo sapiens
gtgtgaacttttc

SEQ ID NO: 4500345 - DNA, 17 bp, Homo sapiens
gtgtgaataccccaaga

SEQ ID NO: 4500346 - DNA, 13 bp, Homo sapiens
gtgtgaatgaaca

SEQ ID NO: 4500347 - DNA, 15 bp, Homo sapiens
gtgtgacctgagggc

SEQ ID NO: 4500348 - DNA, 19 bp, Homo sapiens
gtgtgactctagcaaggct

SEQ ID NO: 4500349 - DNA, 14 bp, Homo sapiens
gtgtgaggccaggg

SEQ ID NO: 4500350 - DNA, 22 bp, Homo sapiens
gtgtgcaactaactgactctgt

SEQ ID NO: 4500351 - DNA, 23 bp, Homo sapiens
gtgtgcaactaactgactctgtt

SEQ ID NO: 4500352 - DNA, 23 bp, Homo sapiens
gtgtgcacatctacatgccatgc

SEQ ID NO: 4500353 - DNA, 24 bp, Homo sapiens
gtgtgcacatctacatgccatgcc

SEQ ID NO: 4500354 - DNA, 15 bp, Homo sapiens
gtgtgccaagccctg

SEQ ID NO: 4500355 - DNA, 19 bp, Homo sapiens
gtgtgccaagccctggccc

SEQ ID NO: 4500356 - DNA, 15 bp, Homo sapiens
gtgtgccctggactg

SEQ ID NO: 4500357 - DNA, 20 bp, Homo sapiens
gtgtgctgggcagagggagg

SEQ ID NO: 4500358 - DNA, 17 bp, Homo sapiens
gtgtgctttttttgtgt

SEQ ID NO: 4500359 - DNA, 12 bp, Homo sapiens
gtgtggagcacg

SEQ ID NO: 4500360 - DNA, 11 bp, Homo sapiens
gtgtggcctca

SEQ ID NO: 4500361 - DNA, 17 bp, Homo sapiens
gtgtggcctcagccctc

SEQ ID NO: 4500362 - DNA, 13 bp, Homo sapiens
gtgtggctgagga

SEQ ID NO: 4500363 - DNA, 15 bp, Homo sapiens
gtgtggctgaggagg

SEQ ID NO: 4500364 - DNA, 17 bp, Homo sapiens
gtgtggctggtgtcccc

SEQ ID NO: 4500365 - DNA, 18 bp, Homo sapiens
gtgtggctggtgtcccct

SEQ ID NO: 4500366 - DNA, 12 bp, Homo sapiens
gtgtggctgtgc

SEQ ID NO: 4500367 - DNA, 11 bp, Homo sapiens
gtgtggctttc

SEQ ID NO: 4500368 - DNA, 19 bp, Homo sapiens
gtgtgggggacggcttctc

SEQ ID NO: 4500369 - DNA, 14 bp, Homo sapiens
gtgtgggtctgtgt

SEQ ID NO: 4500370 - DNA, 14 bp, Homo sapiens
gtgtgtaatttaaa

SEQ ID NO: 4500371 - DNA, 15 bp, Homo sapiens
gtgtgtactcagggc

SEQ ID NO: 4500372 - DNA, 23 bp, Homo sapiens
gtgtgtatgtgtgtttctgtcct

SEQ ID NO: 4500373 - DNA, 15 bp, Homo sapiens
gtgtgtatttgctaa

SEQ ID NO: 4500374 - DNA, 20 bp, Homo sapiens
gtgtgtcacccttaggccag

SEQ ID NO: 4500375 - DNA, 19 bp, Homo sapiens
gtgtgtccacgactgtctc

SEQ ID NO: 4500376 - DNA, 14 bp, Homo sapiens
gtgtgtccagagtg

SEQ ID NO: 4500377 - DNA, 15 bp, Homo sapiens
gtgtgtgccaagccc

SEQ ID NO: 4500378 - DNA, 19 bp, Homo sapiens
gtgtgtgccaagccctggc

SEQ ID NO: 4500379 - DNA, 13 bp, Homo sapiens
gtgtgtggcaggg

SEQ ID NO: 4500380 - DNA, 13 bp, Homo sapiens
gtgtgtgtatgtg

SEQ ID NO: 4500381 - DNA, 13 bp, Homo sapiens
gtgtgtgtgaatg

SEQ ID NO: 4500382 - DNA, 13 bp, Homo sapiens
gtgtgtgtgcaca

SEQ ID NO: 4500383 - DNA, 15 bp, Homo sapiens
gtgtgtgtggcaggg

SEQ ID NO: 4500384 - DNA, 13 bp, Homo sapiens
gtgtgtgtgtggc

SEQ ID NO: 4500385 - DNA, 18 bp, Homo sapiens
gtgtgttatttccccagc

SEQ ID NO: 4500386 - DNA, 23 bp, Homo sapiens
gtgtgttatttccccagccacag

SEQ ID NO: 4500387 - DNA, 11 bp, Homo sapiens
gtgtgttcaag

SEQ ID NO: 4500388 - DNA, 12 bp, Homo sapiens
gtgtgttgtgtg

SEQ ID NO: 4500389 - DNA, 14 bp, Homo sapiens
gtgtgttgtgtgtg

SEQ ID NO: 4500390 - DNA, 23 bp, Homo sapiens
gtgtgtttccagatcgatcctgg

SEQ ID NO: 4500391 - DNA, 19 bp, Homo sapiens
gtgtgtttctgtcctgtaa

SEQ ID NO: 4500392 - DNA, 22 bp, Homo sapiens
gtgttaaacactacacatttga

SEQ ID NO: 4500393 - DNA, 20 bp, Homo sapiens
gtgttaatacatcacatctt

SEQ ID NO: 4500394 - DNA, 21 bp, Homo sapiens
gtgttacacagcccaagagga

SEQ ID NO: 4500395 - DNA, 16 bp, Homo sapiens
gtgttacattattcca

SEQ ID NO: 4500396 - DNA, 21 bp, Homo sapiens
gtgttactaaaaaaaagatga

SEQ ID NO: 4500397 - DNA, 23 bp, Homo sapiens
gtgttactagcctcaaaatacat

SEQ ID NO: 4500398 - DNA, 15 bp, Homo sapiens
gtgttactgtaattc

SEQ ID NO: 4500399 - DNA, 19 bp, Homo sapiens
gtgttactgtaattcctca

SEQ ID NO: 4500400 - DNA, 12 bp, Homo sapiens
gtgttatctacc

SEQ ID NO: 4500401 - DNA, 14 bp, Homo sapiens
gtgttatgtatttc

SEQ ID NO: 4500402 - DNA, 17 bp, Homo sapiens
gtgttatttccccagcc

SEQ ID NO: 4500403 - DNA, 16 bp, Homo sapiens
gtgttcaatattttct

SEQ ID NO: 4500404 - DNA, 22 bp, Homo sapiens
gtgttcacagacctcagcaggg

SEQ ID NO: 4500405 - DNA, 17 bp, Homo sapiens
gtgttcccatttcagct

SEQ ID NO: 4500406 - DNA, 19 bp, Homo sapiens
gtgttccccttccactgag

SEQ ID NO: 4500407 - DNA, 16 bp, Homo sapiens
gtgttcccgtgcctgg

SEQ ID NO: 4500408 - DNA, 22 bp, Homo sapiens
gtgttcctatattccaggttta

SEQ ID NO: 4500409 - DNA, 13 bp, Homo sapiens
gtgttctcagcac

SEQ ID NO: 4500410 - DNA, 16 bp, Homo sapiens
gtgttctgggctgggg

SEQ ID NO: 4500411 - DNA, 13 bp, Homo sapiens
gtgttctttcctg

SEQ ID NO: 4500412 - DNA, 15 bp, Homo sapiens
gtgttctttcctgcc

SEQ ID NO: 4500413 - DNA, 21 bp, Homo sapiens
gttcttgggggaggccacccc

SEQ ID NO: 4500414 - DNA, 22 bp, Homo sapiens
gttcttgggggaggccacccca

SEQ ID NO: 4500415 - DNA, 18 bp, Homo sapiens
gttcttggtgactgtccc

SEQ ID NO: 4500416 - DNA, 12 bp, Homo sapiens
gttcttgtattt

SEQ ID NO: 4500417 - DNA, 13 bp, Homo sapiens
gttctttcctgcc

SEQ ID NO: 4500418 - DNA, 14 bp, Homo sapiens
gttctttgctgccc

SEQ ID NO: 4500419 - DNA, 19 bp, Homo sapiens
gttcttttctcctttacca

SEQ ID NO: 4500420 - DNA, 21 bp, Homo sapiens
gttgaaaggttttttttcagt

SEQ ID NO: 4500421 - DNA, 16 bp, Homo sapiens
gttgaaatatgatgtt

SEQ ID NO: 4500422 - DNA, 12 bp, Homo sapiens
gttgaacttttt

SEQ ID NO: 4500423 - DNA, 18 bp, Homo sapiens
gttgaactttttttaagg

SEQ ID NO: 4500424 - DNA, 20 bp, Homo sapiens
gttgaagagacagagacaag

SEQ ID NO: 4500425 - DNA, 14 bp, Homo sapiens
gttgaataaaaata

SEQ ID NO: 4500426 - DNA, 13 bp, Homo sapiens
gttgaatactttt

SEQ ID NO: 4500427 - DNA, 21 bp, Homo sapiens
gttgaataggaaataaaatta

SEQ ID NO: 4500428 - DNA, 15 bp, Homo sapiens
gttgaatatttaaag

SEQ ID NO: 4500429 - DNA, 19 bp, Homo sapiens
gttgaatccagcacgtctg

SEQ ID NO: 4500430 - DNA, 14 bp, Homo sapiens
gttgaatgctgctt

SEQ ID NO: 4500431 - DNA, 17 bp, Homo sapiens
gttgacatatttaatgt

SEQ ID NO: 4500432 - DNA, 20 bp, Homo sapiens
gttgacatatttaatgtttt

SEQ ID NO: 4500433 - DNA, 14 bp, Homo sapiens
gttgaccccagagg

SEQ ID NO: 4500434 - DNA, 19 bp, Homo sapiens
gttgacttatagtacatga

SEQ ID NO: 4500435 - DNA, 21 bp, Homo sapiens
gttgagaatcactgctccagg

SEQ ID NO: 4500436 - DNA, 19 bp, Homo sapiens
gttgagaatcccaaatttg

SEQ ID NO: 4500437 - DNA, 12 bp, Homo sapiens
gttgagacagag

SEQ ID NO: 4500438 - DNA, 12 bp, Homo sapiens
gttgagagccag

SEQ ID NO: 4500439 - DNA, 13 bp, Homo sapiens
gttgagagccagt

SEQ ID NO: 4500440 - DNA, 20 bp, Homo sapiens
gttgagccatgctacagtta

SEQ ID NO: 4500441 - DNA, 18 bp, Homo sapiens
gttgagcgtgcgcactgc

SEQ ID NO: 4500442 - DNA, 19 bp, Homo sapiens
gttgagcgtgcgcactgca

SEQ ID NO: 4500443 - DNA, 20 bp, Homo sapiens
gttgagcgtgcgcactgcat

SEQ ID NO: 4500444 - DNA, 21 bp, Homo sapiens
gttgaggagtttcctaaaagt

SEQ ID NO: 4500445 - DNA, 19 bp, Homo sapiens
gttgagggaacagacagga

SEQ ID NO: 4500446 - DNA, 21 bp, Homo sapiens
gttgataaaccaaaaacattt

SEQ ID NO: 4500447 - DNA, 18 bp, Homo sapiens
gttgatattgtttgctgt

SEQ ID NO: 4500448 - DNA, 20 bp, Homo sapiens
gttgattccttgagtttcat

SEQ ID NO: 4500449 - DNA, 13 bp, Homo sapiens
gttgattgtatgt

SEQ ID NO: 4500450 - DNA, 23 bp, Homo sapiens
gttgatttcagcacctacagtgt

SEQ ID NO: 4500451 - DNA, 15 bp, Homo sapiens
gttgcaagatgtgaa

SEQ ID NO: 4500452 - DNA, 16 bp, Homo sapiens
gttgcaagatgtgaat

SEQ ID NO: 4500453 - DNA, 15 bp, Homo sapiens
gttgcaaggccgctg

SEQ ID NO: 4500454 - DNA, 16 bp, Homo sapiens
gttgcaccatctgctt

SEQ ID NO: 4500455 - DNA, 17 bp, Homo sapiens
gttgcaccatctgcttg

SEQ ID NO: 4500456 - DNA, 14 bp, Homo sapiens
gttgcacccagccc

SEQ ID NO: 4500457 - DNA, 17 bp, Homo sapiens
gttgcacccagccctgg

SEQ ID NO: 4500458 - DNA, 14 bp, Homo sapiens
gttgcactgaacag

SEQ ID NO: 4500459 - DNA, 15 bp, Homo sapiens
gttgcactgaacagg

SEQ ID NO: 4500460 - DNA, 15 bp, Homo sapiens
gttgcactgtttgca

SEQ ID NO: 4500461 - DNA, 21 bp, Homo sapiens
gttgcactgtttgcatgcgcc

SEQ ID NO: 4500462 - DNA, 14 bp, Homo sapiens
gttgcactttgtag

SEQ ID NO: 4500463 - DNA, 13 bp, Homo sapiens
gttgcagtgagct

SEQ ID NO: 4500464 - DNA, 17 bp, Homo sapiens
gttgcagtgagctgaga

SEQ ID NO: 4500465 - DNA, 23 bp, Homo sapiens
gttgcatagcagtatatgttaat

SEQ ID NO: 4500466 - DNA, 18 bp, Homo sapiens
gttgcattaattgtgctg

SEQ ID NO: 4500467 - DNA, 16 bp, Homo sapiens
gttgccaaagctggtc

SEQ ID NO: 4500468 - DNA, 15 bp, Homo sapiens
gttgccaacagttgt

SEQ ID NO: 4500469 - DNA, 19 bp, Homo sapiens
gttgccacagtagaactgt

SEQ ID NO: 4500470 - DNA, 14 bp, Homo sapiens
gttgccagaggccc

SEQ ID NO: 4500471 - DNA, 21 bp, Homo sapiens
gttgcccaaggttgcacagca

SEQ ID NO: 4500472 - DNA, 13 bp, Homo sapiens
gttgccgtgctcc

SEQ ID NO: 4500473 - DNA, 21 bp, Homo sapiens
gttgcctaagcattgcctggc

SEQ ID NO: 4500474 - DNA, 16 bp, Homo sapiens
gttgcctaattggaaa

SEQ ID NO: 4500475 - DNA, 17 bp, Homo sapiens
gttgcctaattggaaag

SEQ ID NO: 4500476 - DNA, 22 bp, Homo sapiens
gttgcctacctagctgcatcta

SEQ ID NO: 4500477 - DNA, 17 bp, Homo sapiens
gttgccttatttctcat

SEQ ID NO: 4500478 - DNA, 15 bp, Homo sapiens
gttgctcgcttttcc

SEQ ID NO: 4500479 - DNA, 16 bp, Homo sapiens
gttgctgagccagctg

SEQ ID NO: 4500480 - DNA, 23 bp, Homo sapiens
gttgctttgaaaaatctcattat

SEQ ID NO: 4500481 - DNA, 11 bp, Homo sapiens
gttgctttgtt

SEQ ID NO: 4500482 - DNA, 21 bp, Homo sapiens
gttgcttttgaaggaatacaa

SEQ ID NO: 4500483 - DNA, 18 bp, Homo sapiens
gttgcttttgcacctacg

SEQ ID NO: 4500484 - DNA, 14 bp, Homo sapiens
gttggaaatgtgtt

SEQ ID NO: 4500485 - DNA, 17 bp, Homo sapiens
gttggaaatgtgttttt

SEQ ID NO: 4500486 - DNA, 16 bp, Homo sapiens
gttggactctcaggga

SEQ ID NO: 4500487 - DNA, 14 bp, Homo sapiens
gttggacttcagtc

SEQ ID NO: 4500488 - DNA, 20 bp, Homo sapiens
gttggaggtggggaaggctt

SEQ ID NO: 4500489 - DNA, 20 bp, Homo sapiens
gttggcagaaatacagtctt

SEQ ID NO: 4500490 - DNA, 13 bp, Homo sapiens
gttggcaggccca

SEQ ID NO: 4500491 - DNA, 14 bp, Homo sapiens
gttggcaggcccac

SEQ ID NO: 4500492 - DNA, 15 bp, Homo sapiens
gttggcatagctctg

SEQ ID NO: 4500493 - DNA, 18 bp, Homo sapiens
gttggcatagctctgggg

SEQ ID NO: 4500494 - DNA, 14 bp, Homo sapiens
gttggccatggtga

SEQ ID NO: 4500495 - DNA, 15 bp, Homo sapiens
gttggcctcttcagg

SEQ ID NO: 4500496 - DNA, 20 bp, Homo sapiens
gttggcctcttcaggcctgc

SEQ ID NO: 4500497 - DNA, 13 bp, Homo sapiens
gttggctgttcca

SEQ ID NO: 4500498 - DNA, 15 bp, Homo sapiens
gttggctttttgaaa

SEQ ID NO: 4500499 - DNA, 14 bp, Homo sapiens
gttggcttttttcc

SEQ ID NO: 4500500 - DNA, 21 bp, Homo sapiens
gttgggagaatgtcagtatgt

SEQ ID NO: 4500501 - DNA, 16 bp, Homo sapiens
gttgggagcctagctc

SEQ ID NO: 4500502 - DNA, 18 bp, Homo sapiens
gttgggaggatacagagg

SEQ ID NO: 4500503 - DNA, 21 bp, Homo sapiens
gttgggaggatacagaggaga

SEQ ID NO: 4500504 - DNA, 18 bp, Homo sapiens
gttgggatcgcattgcat

SEQ ID NO: 4500505 - DNA, 15 bp, Homo sapiens
gttgggcccagatct

SEQ ID NO: 4500506 - DNA, 16 bp, Homo sapiens
gttgggcgtgctacct

SEQ ID NO: 4500507 - DNA, 16 bp, Homo sapiens
gttggggcttcacagc

SEQ ID NO: 4500508 - DNA, 18 bp, Homo sapiens
gttgggggtgtggctctg

SEQ ID NO: 4500509 - DNA, 19 bp, Homo sapiens
gttgggggtgtggctctgc

SEQ ID NO: 4500510 - DNA, 17 bp, Homo sapiens
gttgggtagaaaaatta

SEQ ID NO: 4500511 - DNA, 16 bp, Homo sapiens
gttgggtttttgctgt

SEQ ID NO: 4500512 - DNA, 18 bp, Homo sapiens
gttggtgaccagtttctt

SEQ ID NO: 4500513 - DNA, 20 bp, Homo sapiens
gttggtgaccagtttcttaa

SEQ ID NO: 4500514 - DNA, 14 bp, Homo sapiens
gttggtgtgttttt

SEQ ID NO: 4500515 - DNA, 15 bp, Homo sapiens
gttggtgtgtttttg

SEQ ID NO: 4500516 - DNA, 21 bp, Homo sapiens
gttggtgttctaagactctgt

SEQ ID NO: 4500517 - DNA, 13 bp, Homo sapiens
gttggtttcattt

SEQ ID NO: 4500518 - DNA, 12 bp, Homo sapiens
gttgtaaagtat

SEQ ID NO: 4500519 - DNA, 18 bp, Homo sapiens
gttgtaaataatttattt

SEQ ID NO: 4500520 - DNA, 18 bp, Homo sapiens
gttgtacaagctcaggag

SEQ ID NO: 4500521 - DNA, 23 bp, Homo sapiens
gttgtacctcttttgcttgccaa

SEQ ID NO: 4500522 - DNA, 18 bp, Homo sapiens
gttgtatcagcacgtgtg

SEQ ID NO: 4500523 - DNA, 18 bp, Homo sapiens
gttgtatcatactcttct

SEQ ID NO: 4500524 - DNA, 15 bp, Homo sapiens
gttgtatctacagta

SEQ ID NO: 4500525 - DNA, 20 bp, Homo sapiens
gttgtattcctgcctttgat

SEQ ID NO: 4500526 - DNA, 21 bp, Homo sapiens
gttgtattgcatgcaatttga

SEQ ID NO: 4500527 - DNA, 15 bp, Homo sapiens
gttgtatttcaaata

SEQ ID NO: 4500528 - DNA, 20 bp, Homo sapiens
gttgtcacagtcttgtgaac

SEQ ID NO: 4500529 - DNA, 22 bp, Homo sapiens
gttgtgaaagagttgaagacag

SEQ ID NO: 4500530 - DNA, 15 bp, Homo sapiens
gttgtgtatattaca

SEQ ID NO: 4500531 - DNA, 16 bp, Homo sapiens
gttgtgtatattacac

SEQ ID NO: 4500532 - DNA, 22 bp, Homo sapiens
gttgtgtctgtgccctccaaag

SEQ ID NO: 4500533 - DNA, 23 bp, Homo sapiens
gttgtgtctgtgccctccaaaga

SEQ ID NO: 4500534 - DNA, 17 bp, Homo sapiens
gttatgactatgtaaac

SEQ ID NO: 4500535 - DNA, 16 bp, Homo sapiens
gttatgcactttaaat

SEQ ID NO: 4500536 - DNA, 13 bp, Homo sapiens
gttatgctgtgac

SEQ ID NO: 4500537 - DNA, 16 bp, Homo sapiens
gttatggtgatgactt

SEQ ID NO: 4500538 - DNA, 17 bp, Homo sapiens
gttatggtgatgactta

SEQ ID NO: 4500539 - DNA, 13 bp, Homo sapiens
gttattaaatgta

SEQ ID NO: 4500540 - DNA, 16 bp, Homo sapiens
gttattaatgtttctt

SEQ ID NO: 4500541 - DNA, 22 bp, Homo sapiens
gttattagagattacctcctga

SEQ ID NO: 4500542 - DNA, 20 bp, Homo sapiens
gttattataacataaaagca

SEQ ID NO: 4500543 - DNA, 14 bp, Homo sapiens
gttattcaaatgaa

SEQ ID NO: 4500544 - DNA, 23 bp, Homo sapiens
gttattgcagtttatcattcaag

SEQ ID NO: 4500545 - DNA, 17 bp, Homo sapiens
gttatttgtaatagatg

SEQ ID NO: 4500546 - DNA, 17 bp, Homo sapiens
gttatttgtttaccact

SEQ ID NO: 4500547 - DNA, 12 bp, Homo sapiens
gttattttctac

SEQ ID NO: 4500548 - DNA, 12 bp, Homo sapiens
gttcaaaatcat

SEQ ID NO: 4500549 - DNA, 18 bp, Homo sapiens
gttcaagaagtaatcagt

SEQ ID NO: 4500550 - DNA, 14 bp, Homo sapiens
gttcaagcacactg

SEQ ID NO: 4500551 - DNA, 19 bp, Homo sapiens
gttcaagcacactggaata

SEQ ID NO: 4500552 - DNA, 17 bp, Homo sapiens
gttcaagtgattctctt

SEQ ID NO: 4500553 - DNA, 15 bp, Homo sapiens
gttcaagtgcgtgac

SEQ ID NO: 4500554 - DNA, 23 bp, Homo sapiens
gttcaatctggattcatatttaa

SEQ ID NO: 4500555 - DNA, 22 bp, Homo sapiens
gttcaatctgtgaagcctttat

SEQ ID NO: 4500556 - DNA, 15 bp, Homo sapiens
gttcaatgaaataaa

SEQ ID NO: 4500557 - DNA, 13 bp, Homo sapiens
gttcacaaactgt

SEQ ID NO: 4500558 - DNA, 15 bp, Homo sapiens
gttcacaaactgtga

SEQ ID NO: 4500559 - DNA, 16 bp, Homo sapiens
gttcacaaactgtgaa

SEQ ID NO: 4500560 - DNA, 21 bp, Homo sapiens
gttcacgccattctcctgcct

SEQ ID NO: 4500561 - DNA, 13 bp, Homo sapiens
gttcactgcattc

SEQ ID NO: 4500562 - DNA, 15 bp, Homo sapiens
gttcagaaaattaaa

SEQ ID NO: 4500563 - DNA, 18 bp, Homo sapiens
gttcagaattaagcagaa

SEQ ID NO: 4500564 - DNA, 12 bp, Homo sapiens
gttcagaattta

SEQ ID NO: 4500565 - DNA, 13 bp, Homo sapiens
gttcagcacttgt

SEQ ID NO: 4500566 - DNA, 14 bp, Homo sapiens
gttcagcccctcct

SEQ ID NO: 4500567 - DNA, 20 bp, Homo sapiens
gttcagcccctcctctgcca

SEQ ID NO: 4500568 - DNA, 23 bp, Homo sapiens
gttcagcccctcctctgccacct

SEQ ID NO: 4500569 - DNA, 16 bp, Homo sapiens
gttcagcggagctgac

SEQ ID NO: 4500570 - DNA, 19 bp, Homo sapiens
gttcaggcccggcagggcg

SEQ ID NO: 4500571 - DNA, 21 bp, Homo sapiens
gttcagtgtcgggaattttcc

SEQ ID NO: 4500572 - DNA, 20 bp, Homo sapiens
gttcataacagtgccattgt

SEQ ID NO: 4500573 - DNA, 24 bp, Homo sapiens
gttcataacagtgccattgtcttt

SEQ ID NO: 4500574 - DNA, 22 bp, Homo sapiens
gttcatagagttcccatgaact

SEQ ID NO: 4500575 - DNA, 17 bp, Homo sapiens
gttcatatttattgatt

SEQ ID NO: 4500576 - DNA, 18 bp, Homo sapiens
gttcatcaccatttcctc

SEQ ID NO: 4500577 - DNA, 16 bp, Homo sapiens
gttcatcgattttcta

SEQ ID NO: 4500578 - DNA, 22 bp, Homo sapiens
gttcatcttgtacaaactttgt

SEQ ID NO: 4500579 - DNA, 23 bp, Homo sapiens
gttcatgatagaaagaataaaat

SEQ ID NO: 4500580 - DNA, 15 bp, Homo sapiens
gttcatgcagctgtg

SEQ ID NO: 4500581 - DNA, 16 bp, Homo sapiens
gttcattagaaatatt

SEQ ID NO: 4500582 - DNA, 12 bp, Homo sapiens
gttcatttccta

SEQ ID NO: 4500583 - DNA, 14 bp, Homo sapiens
gttccacattctct

SEQ ID NO: 4500584 - DNA, 15 bp, Homo sapiens
gttccacctgccaca

SEQ ID NO: 4500585 - DNA, 12 bp, Homo sapiens
gttccactaacc

SEQ ID NO: 4500586 - DNA, 17 bp, Homo sapiens
gttccagaacagccctc

SEQ ID NO: 4500587 - DNA, 21 bp, Homo sapiens
gttccagaacagccctcggcc

SEQ ID NO: 4500588 - DNA, 19 bp, Homo sapiens
gttccagccaaagcatgcc

SEQ ID NO: 4500589 - DNA, 12 bp, Homo sapiens
gttccagctctt

SEQ ID NO: 4500590 - DNA, 20 bp, Homo sapiens
gttccatgttctatttttga

SEQ ID NO: 4500591 - DNA, 18 bp, Homo sapiens
gttccattatgaaaatct

SEQ ID NO: 4500592 - DNA, 22 bp, Homo sapiens
gttcccaagaaaggaaaccttt

SEQ ID NO: 4500593 - DNA, 11 bp, Homo sapiens
gttcccagccc

SEQ ID NO: 4500594 - DNA, 12 bp, Homo sapiens
gttcccagcccc

SEQ ID NO: 4500595 - DNA, 15 bp, Homo sapiens
gttcccagcccctcc

SEQ ID NO: 4500596 - DNA, 15 bp, Homo sapiens
gttcccagcccctgc

SEQ ID NO: 4500597 - DNA, 17 bp, Homo sapiens
gttcccagcccctgcag

SEQ ID NO: 4500598 - DNA, 18 bp, Homo sapiens
gttcccgggagctgggcc

SEQ ID NO: 4500599 - DNA, 21 bp, Homo sapiens
gttcccgggagctgggccctg

SEQ ID NO: 4500600 - DNA, 22 bp, Homo sapiens
gttcccgggagctgggccctgc

SEQ ID NO: 4500601 - DNA, 15 bp, Homo sapiens
gttcccgtgcctggg

SEQ ID NO: 4500602 - DNA, 19 bp, Homo sapiens
gttccctatttttctctcc

SEQ ID NO: 4500603 - DNA, 17 bp, Homo sapiens
gttccctcctagctctc

SEQ ID NO: 4500604 - DNA, 19 bp, Homo sapiens
gttccctcctagctctccc

SEQ ID NO: 4500605 - DNA, 12 bp, Homo sapiens
gttcccttggcc

SEQ ID NO: 4500606 - DNA, 18 bp, Homo sapiens
gttcccttggcctcagaa

SEQ ID NO: 4500607 - DNA, 19 bp, Homo sapiens
gttccctttccttccatcc

SEQ ID NO: 4500608 - DNA, 20 bp, Homo sapiens
gttccctttgtctttcaaac

SEQ ID NO: 4500609 - DNA, 19 bp, Homo sapiens
gttccgtgggaccctcagc

SEQ ID NO: 4500610 - DNA, 20 bp, Homo sapiens
gttcctcccctgtagggttt

SEQ ID NO: 4500611 - DNA, 12 bp, Homo sapiens
gttcctctgggt

SEQ ID NO: 4500612 - DNA, 16 bp, Homo sapiens
gttcctctgtacagca

SEQ ID NO: 4500613 - DNA, 18 bp, Homo sapiens
gttcctgaagctgctgtg

SEQ ID NO: 4500614 - DNA, 22 bp, Homo sapiens
gttcctgagacacccgattcct

SEQ ID NO: 4500615 - DNA, 22 bp, Homo sapiens
gttcctggccttctgaactcca

SEQ ID NO: 4500616 - DNA, 14 bp, Homo sapiens
gttccttactgcag

SEQ ID NO: 4500617 - DNA, 18 bp, Homo sapiens
gttccttggccatgcaga

SEQ ID NO: 4500618 - DNA, 22 bp, Homo sapiens
gttccttttttcaatatgcaag

SEQ ID NO: 4500619 - DNA, 21 bp, Homo sapiens
gttcgaaatagatatcctctc

SEQ ID NO: 4500620 - DNA, 22 bp, Homo sapiens
gttcgaaatagatatcctctcc

SEQ ID NO: 4500621 - DNA, 17 bp, Homo sapiens
gttcgatacctggagca

SEQ ID NO: 4500622 - DNA, 20 bp, Homo sapiens
gttcgcatggtcacacactg

SEQ ID NO: 4500623 - DNA, 18 bp, Homo sapiens
gttcggatttggggtgga

SEQ ID NO: 4500624 - DNA, 22 bp, Homo sapiens
gttcgtttccatcatgtctgta

SEQ ID NO: 4500625 - DNA, 14 bp, Homo sapiens
gttctaagactctg

SEQ ID NO: 4500626 - DNA, 16 bp, Homo sapiens
gttctaagtctttcca

SEQ ID NO: 4500627 - DNA, 21 bp, Homo sapiens
gttctaattaagaaaactatt

SEQ ID NO: 4500628 - DNA, 19 bp, Homo sapiens
gttctagacttccccatcc

SEQ ID NO: 4500629 - DNA, 21 bp, Homo sapiens
gttctagacttccccatcccg

SEQ ID NO: 4500630 - DNA, 16 bp, Homo sapiens
gttctataaatgaatg

SEQ ID NO: 4500631 - DNA, 18 bp, Homo sapiens
gttctataagtgaggaag

SEQ ID NO: 4500632 - DNA, 20 bp, Homo sapiens
gttctcaagaatctagaaga

SEQ ID NO: 4500633 - DNA, 19 bp, Homo sapiens
gttctcagcttgcagctgg

SEQ ID NO: 4500634 - DNA, 11 bp, Homo sapiens
gttctcatctt

SEQ ID NO: 4500635 - DNA, 19 bp, Homo sapiens
gttctcatgggtggcactc

SEQ ID NO: 4500636 - DNA, 18 bp, Homo sapiens
gttctccagtcattatgt

SEQ ID NO: 4500637 - DNA, 15 bp, Homo sapiens
gttctccctttctct

SEQ ID NO: 4500638 - DNA, 18 bp, Homo sapiens
gttctccctttctctctc

SEQ ID NO: 4500639 - DNA, 22 bp, Homo sapiens
gttctccctttctctctcctct

SEQ ID NO: 4500640 - DNA, 18 bp, Homo sapiens
gttctccgggtgtggcct

SEQ ID NO: 4500641 - DNA, 21 bp, Homo sapiens
gttctgcaaatagaaaacagg

SEQ ID NO: 4500642 - DNA, 14 bp, Homo sapiens
gttctgctccatac

SEQ ID NO: 4500643 - DNA, 22 bp, Homo sapiens
gttctgctctggttgtttctgt

SEQ ID NO: 4500644 - DNA, 16 bp, Homo sapiens
gttctgcttttaagtt

SEQ ID NO: 4500645 - DNA, 15 bp, Homo sapiens
gttctggactctgcc

SEQ ID NO: 4500646 - DNA, 16 bp, Homo sapiens
gttctggactctgccc

SEQ ID NO: 4500647 - DNA, 16 bp, Homo sapiens
gttctgggcatggcag

SEQ ID NO: 4500648 - DNA, 21 bp, Homo sapiens
gttctgggcatggcagggcca

SEQ ID NO: 4500649 - DNA, 14 bp, Homo sapiens
gttctgggctgggg

SEQ ID NO: 4500650 - DNA, 21 bp, Homo sapiens
gttctgggctggggccacctt

SEQ ID NO: 4500651 - DNA, 21 bp, Homo sapiens
gttctgggtgataattttgaa

SEQ ID NO: 4500652 - DNA, 21 bp, Homo sapiens
gttctgtgacccatctgtagt

SEQ ID NO: 4500653 - DNA, 18 bp, Homo sapiens
gttctgtggttcctctgc

SEQ ID NO: 4500654 - DNA, 14 bp, Homo sapiens
gttgtgtggcccag

SEQ ID NO: 4500655 - DNA, 17 bp, Homo sapiens
gttgtgtgtatatgtat

SEQ ID NO: 4500656 - DNA, 15 bp, Homo sapiens
gttgttaataaaagt

SEQ ID NO: 4500657 - DNA, 17 bp, Homo sapiens
gttgtttctgttccaaa

SEQ ID NO: 4500658 - DNA, 17 bp, Homo sapiens
gttgtttgtaaatgcct

SEQ ID NO: 4500659 - DNA, 16 bp, Homo sapiens
gtttaaaaatcaactt

SEQ ID NO: 4500660 - DNA, 13 bp, Homo sapiens
gtttaaaagaaaa

SEQ ID NO: 4500661 - DNA, 16 bp, Homo sapiens
gtttaaaatcatttct

SEQ ID NO: 4500662 - DNA, 22 bp, Homo sapiens
gtttaaacacttatcttctgga

SEQ ID NO: 4500663 - DNA, 17 bp, Homo sapiens
gtttaaacccaagtgct

SEQ ID NO: 4500664 - DNA, 19 bp, Homo sapiens
gtttaaacccaagtgctgc

SEQ ID NO: 4500665 - DNA, 13 bp, Homo sapiens
gtttaaagaaagt

SEQ ID NO: 4500666 - DNA, 14 bp, Homo sapiens
gtttaaagaaagtg

SEQ ID NO: 4500667 - DNA, 15 bp, Homo sapiens
gtttaaagaaagtgt

SEQ ID NO: 4500668 - DNA, 22 bp, Homo sapiens
gtttaaagtcacatccctgtaa

SEQ ID NO: 4500669 - DNA, 13 bp, Homo sapiens
gtttaaagttctg

SEQ ID NO: 4500670 - DNA, 20 bp, Homo sapiens
gtttaaagttctgtgtattt

SEQ ID NO: 4500671 - DNA, 14 bp, Homo sapiens
gtttaaatgccaaa

SEQ ID NO: 4500672 - DNA, 15 bp, Homo sapiens
gtttaaatgccaaaa

SEQ ID NO: 4500673 - DNA, 12 bp, Homo sapiens
gtttaaatgtat

SEQ ID NO: 4500674 - DNA, 18 bp, Homo sapiens
gtttaaccttaaaattaa

SEQ ID NO: 4500675 - DNA, 17 bp, Homo sapiens
gtttaagccaaaacaat

SEQ ID NO: 4500676 - DNA, 21 bp, Homo sapiens
gtttaagggtggaaaaatgcc

SEQ ID NO: 4500677 - DNA, 22 bp, Homo sapiens
gtttaagtcattttttacttga

SEQ ID NO: 4500678 - DNA, 15 bp, Homo sapiens
gtttaatattgagaa

SEQ ID NO: 4500679 - DNA, 17 bp, Homo sapiens
gtttaatattgagaaag

SEQ ID NO: 4500680 - DNA, 16 bp, Homo sapiens
gtttaatcccagcact

SEQ ID NO: 4500681 - DNA, 18 bp, Homo sapiens
gtttaatcccagcacttt

SEQ ID NO: 4500682 - DNA, 17 bp, Homo sapiens
gtttaatggtagtttta

SEQ ID NO: 4500683 - DNA, 20 bp, Homo sapiens
gtttaatggtagttttacag

SEQ ID NO: 4500684 - DNA, 19 bp, Homo sapiens
gtttacaaaatcaggtaac

SEQ ID NO: 4500685 - DNA, 22 bp, Homo sapiens
gtttacatagtctgaagtgaag

SEQ ID NO: 4500686 - DNA, 22 bp, Homo sapiens
gtttactagggatccctcatct

SEQ ID NO: 4500687 - DNA, 14 bp, Homo sapiens
gtttactccatgtt

SEQ ID NO: 4500688 - DNA, 17 bp, Homo sapiens
gtttagaggaggcaaca

SEQ ID NO: 4500689 - DNA, 21 bp, Homo sapiens
gtttagaggaggcaacactga

SEQ ID NO: 4500690 - DNA, 18 bp, Homo sapiens
gtttagatagggctgggc

SEQ ID NO: 4500691 - DNA, 19 bp, Homo sapiens
gtttagttataaaaggctt

SEQ ID NO: 4500692 - DNA, 16 bp, Homo sapiens
gtttagtttgcattta

SEQ ID NO: 4500693 - DNA, 15 bp, Homo sapiens
gtttagttttacact

SEQ ID NO: 4500694 - DNA, 20 bp, Homo sapiens
gtttatacagttttaaagaa

SEQ ID NO: 4500695 - DNA, 19 bp, Homo sapiens
gtttatatggaagaaagta

SEQ ID NO: 4500696 - DNA, 14 bp, Homo sapiens
gtttatatgtgttg

SEQ ID NO: 4500697 - DNA, 23 bp, Homo sapiens
gtttatcaacttcgctagaaaaa

SEQ ID NO: 4500698 - DNA, 14 bp, Homo sapiens
gtttatcatgaagc

SEQ ID NO: 4500699 - DNA, 17 bp, Homo sapiens
gtttatcattcaagtgt

SEQ ID NO: 4500700 - DNA, 20 bp, Homo sapiens
gtttatcattcaagtgtaaa

SEQ ID NO: 4500701 - DNA, 14 bp, Homo sapiens
gtttatgattccac

SEQ ID NO: 4500702 - DNA, 22 bp, Homo sapiens
gtttatggcctcagctgcctca

SEQ ID NO: 4500703 - DNA, 13 bp, Homo sapiens
gtttatgtaatag

SEQ ID NO: 4500704 - DNA, 19 bp, Homo sapiens
gtttatgtaatagttctat

SEQ ID NO: 4500705 - DNA, 16 bp, Homo sapiens
gtttatgtgtgtgtgt

SEQ ID NO: 4500706 - DNA, 14 bp, Homo sapiens
gtttattaaatgct

SEQ ID NO: 4500707 - DNA, 15 bp, Homo sapiens
gtttattaaatgctt

SEQ ID NO: 4500708 - DNA, 15 bp, Homo sapiens
gtttattaaattgca

SEQ ID NO: 4500709 - DNA, 22 bp, Homo sapiens
gtttattaatcttagtgtatga

SEQ ID NO: 4500710 - DNA, 19 bp, Homo sapiens
gtttattacaatgtatctt

SEQ ID NO: 4500711 - DNA, 22 bp, Homo sapiens
gtttattccttctgtagtgtat

SEQ ID NO: 4500712 - DNA, 21 bp, Homo sapiens
gtttattgagtttgtaggtaa

SEQ ID NO: 4500713 - DNA, 19 bp, Homo sapiens
gtttattgtttgatgtttt

SEQ ID NO: 4500714 - DNA, 16 bp, Homo sapiens
gtttatttcatgtggt

SEQ ID NO: 4500715 - DNA, 13 bp, Homo sapiens
gtttatttctgtg

SEQ ID NO: 4500716 - DNA, 22 bp, Homo sapiens
gtttattttcattctgccaaag

SEQ ID NO: 4500717 - DNA, 23 bp, Homo sapiens
gtttattttgagtcctaggactt

SEQ ID NO: 4500718 - DNA, 17 bp, Homo sapiens
gtttatttttctgttac

SEQ ID NO: 4500719 - DNA, 13 bp, Homo sapiens
gtttcaaaataga

SEQ ID NO: 4500720 - DNA, 14 bp, Homo sapiens
gtttcaaaatagac

SEQ ID NO: 4500721 - DNA, 20 bp, Homo sapiens
gtttcaaaatagacaagttt

SEQ ID NO: 4500722 - DNA, 13 bp, Homo sapiens
gtttcaaatgtgc

SEQ ID NO: 4500723 - DNA, 17 bp, Homo sapiens
gtttcaacccaactgac

SEQ ID NO: 4500724 - DNA, 16 bp, Homo sapiens
gtttcaattgcatctc

SEQ ID NO: 4500725 - DNA, 17 bp, Homo sapiens
gtttcaattgcatctcc

SEQ ID NO: 4500726 - DNA, 22 bp, Homo sapiens
gtttcaattgcatctcccagat

SEQ ID NO: 4500727 - DNA, 14 bp, Homo sapiens
gtttcacagaaaat

SEQ ID NO: 4500728 - DNA, 17 bp, Homo sapiens
gtttcacttaatgtttc

SEQ ID NO: 4500729 - DNA, 13 bp, Homo sapiens
gtttcagatgagg

SEQ ID NO: 4500730 - DNA, 21 bp, Homo sapiens
gtttcagtgtcaaataaacac

SEQ ID NO: 4500731 - DNA, 13 bp, Homo sapiens
gtttcatctattt

SEQ ID NO: 4500732 - DNA, 15 bp, Homo sapiens
gtttcatgtatgtat

SEQ ID NO: 4500733 - DNA, 18 bp, Homo sapiens
gtttcattacttgaatgt

SEQ ID NO: 4500734 - DNA, 15 bp, Homo sapiens
gtttcatttcttatc

SEQ ID NO: 4500735 - DNA, 17 bp, Homo sapiens
gtttccaatgtgttcaa

SEQ ID NO: 4500736 - DNA, 13 bp, Homo sapiens
gtttccaggaaaa

SEQ ID NO: 4500737 - DNA, 14 bp, Homo sapiens
gtttccaggaaaat

SEQ ID NO: 4500738 - DNA, 14 bp, Homo sapiens
gtttccatagttta

SEQ ID NO: 4500739 - DNA, 17 bp, Homo sapiens
gtttccatcatgtctgt

SEQ ID NO: 4500740 - DNA, 20 bp, Homo sapiens
gtttccccaataaagccttt

SEQ ID NO: 4500741 - DNA, 19 bp, Homo sapiens
gtttccccactaataaagt

SEQ ID NO: 4500742 - DNA, 18 bp, Homo sapiens
gtttccctcccaacagag

SEQ ID NO: 4500743 - DNA, 17 bp, Homo sapiens
gtttccgaatctctttc

SEQ ID NO: 4500744 - DNA, 15 bp, Homo sapiens
gtttcctaaaagttc

SEQ ID NO: 4500745 - DNA, 16 bp, Homo sapiens
gtttcctatttaatac

SEQ ID NO: 4500746 - DNA, 14 bp, Homo sapiens
gtttccttttttcc

SEQ ID NO: 4500747 - DNA, 16 bp, Homo sapiens
gtttctatcaaccttc

SEQ ID NO: 4500748 - DNA, 16 bp, Homo sapiens
gtttctattctgtcag

SEQ ID NO: 4500749 - DNA, 22 bp, Homo sapiens
gtttctcaagcgctatccacag

SEQ ID NO: 4500750 - DNA, 15 bp, Homo sapiens
gtttctccttttcct

SEQ ID NO: 4500751 - DNA, 13 bp, Homo sapiens
gtttctctgctgt

SEQ ID NO: 4500752 - DNA, 17 bp, Homo sapiens
gtttctgactctgagct

SEQ ID NO: 4500753 - DNA, 20 bp, Homo sapiens
gtttctgcattcatttttat

SEQ ID NO: 4500754 - DNA, 16 bp, Homo sapiens
gtttctggaagactgc

SEQ ID NO: 4500755 - DNA, 15 bp, Homo sapiens
gtttctgtcctgtaa

SEQ ID NO: 4500756 - DNA, 13 bp, Homo sapiens
gtttcttattcaa

SEQ ID NO: 4500757 - DNA, 11 bp, Homo sapiens
gtttcttcttc

SEQ ID NO: 4500758 - DNA, 23 bp, Homo sapiens
gtttcttcttcatgcttttgctt

SEQ ID NO: 4500759 - DNA, 14 bp, Homo sapiens
gtttcttgtgtaga

SEQ ID NO: 4500760 - DNA, 22 bp, Homo sapiens
gtttcttgtgtagatttgaaaa

SEQ ID NO: 4500761 - DNA, 13 bp, Homo sapiens
gtttcttgtttat

SEQ ID NO: 4500762 - DNA, 13 bp, Homo sapiens
gtttctttcccca

SEQ ID NO: 4500763 - DNA, 15 bp, Homo sapiens
gtttctttcttcctc

SEQ ID NO: 4500764 - DNA, 14 bp, Homo sapiens
gtttctttgtgttg

SEQ ID NO: 4500765 - DNA, 22 bp, Homo sapiens
gtttcttttttttttttttaca

SEQ ID NO: 4500766 - DNA, 15 bp, Homo sapiens
gtttgaaaagcaata

SEQ ID NO: 4500767 - DNA, 19 bp, Homo sapiens
gtttgaaattctgaatttg

SEQ ID NO: 4500768 - DNA, 21 bp, Homo sapiens
gtttgaaattctgaatttgca

SEQ ID NO: 4500769 - DNA, 22 bp, Homo sapiens
gtttgaaattctgaatttgcaa

SEQ ID NO: 4500770 - DNA, 21 bp, Homo sapiens
gtttgaacacgaaagaaatgt

SEQ ID NO: 4500771 - DNA, 17 bp, Homo sapiens
gtttgaattcctcctct

SEQ ID NO: 4500772 - DNA, 21 bp, Homo sapiens
gtttgaattcctcctctattt

SEQ ID NO: 4500773 - DNA, 16 bp, Homo sapiens
gtttgactagatgatg

SEQ ID NO: 4500774 - DNA, 18 bp, Homo sapiens
gtttgactagatgatgga

SEQ ID NO: 4500775 - DNA, 15 bp, Homo sapiens
taaaaaaccacatgg

SEQ ID NO: 4500776 - DNA, 15 bp, Homo sapiens
taaaaaactgtataa

SEQ ID NO: 4500777 - DNA, 18 bp, Homo sapiens
taaaaaagctcttttaat

SEQ ID NO: 4500778 - DNA, 16 bp, Homo sapiens
taaaaaagtctctatt

SEQ ID NO: 4500779 - DNA, 22 bp, Homo sapiens
taaaaaagtctctatttaaatt

SEQ ID NO: 4500780 - DNA, 18 bp, Homo sapiens
taaaaaatattttctctg

SEQ ID NO: 4500781 - DNA, 22 bp, Homo sapiens
taaaaaatcatgccagtatttt

SEQ ID NO: 4500782 - DNA, 15 bp, Homo sapiens
taaaaaatctgaaga

SEQ ID NO: 4500783 - DNA, 17 bp, Homo sapiens
taaaaaatctgaagagg

SEQ ID NO: 4500784 - DNA, 16 bp, Homo sapiens
taaaaaatggagctca

SEQ ID NO: 4500785 - DNA, 22 bp, Homo sapiens
taaaaaatgtgtgtattcttaa

SEQ ID NO: 4500786 - DNA, 23 bp, Homo sapiens
taaaaaatgtgtgtattcttaaa

SEQ ID NO: 4500787 - DNA, 18 bp, Homo sapiens
taaaaaattaaaaatgaa

SEQ ID NO: 4500788 - DNA, 13 bp, Homo sapiens
taaaaaatttgta

SEQ ID NO: 4500789 - DNA, 18 bp, Homo sapiens
taaaaacattttgaagtg

SEQ ID NO: 4500790 - DNA, 14 bp, Homo sapiens
taaaaacctttttg

SEQ ID NO: 4500791 - DNA, 20 bp, Homo sapiens
taaaaactagaggtgagaaa

SEQ ID NO: 4500792 - DNA, 17 bp, Homo sapiens
taaaaactgacttaatg

SEQ ID NO: 4500793 - DNA, 23 bp, Homo sapiens
taaaaagaggatgatttcagaag

SEQ ID NO: 4500794 - DNA, 19 bp, Homo sapiens
taaaaagagtaatttcatt

SEQ ID NO: 4500795 - DNA, 20 bp, Homo sapiens
taaaaagattgaagtatttt

SEQ ID NO: 4500796 - DNA, 10 bp, Homo sapiens
taaaaaggaa

SEQ ID NO: 4500797 - DNA, 20 bp, Homo sapiens
taaaaataaaacatcataaa

SEQ ID NO: 4500798 - DNA, 21 bp, Homo sapiens
taaaaataaatagaaaagtag

SEQ ID NO: 4500799 - DNA, 14 bp, Homo sapiens
taaaaataccttct

SEQ ID NO: 4500800 - DNA, 19 bp, Homo sapiens
taaaaatattgtttctgca

SEQ ID NO: 4500801 - DNA, 14 bp, Homo sapiens
taaaaatcaacttt

SEQ ID NO: 4500802 - DNA, 15 bp, Homo sapiens
taaaaatcaactttt

SEQ ID NO: 4500803 - DNA, 15 bp, Homo sapiens
taaaaatctcttttc

SEQ ID NO: 4500804 - DNA, 11 bp, Homo sapiens
taaaaatgaag

SEQ ID NO: 4500805 - DNA, 16 bp, Homo sapiens
taaaaatgatattgct

SEQ ID NO: 4500806 - DNA, 15 bp, Homo sapiens
taaaaattaaatatt

SEQ ID NO: 4500807 - DNA, 17 bp, Homo sapiens
taaaaattacatatata

SEQ ID NO: 4500808 - DNA, 10 bp, Homo sapiens
taaaacaaaa

SEQ ID NO: 4500809 - DNA, 14 bp, Homo sapiens
taaaacaaaatttg

SEQ ID NO: 4500810 - DNA, 21 bp, Homo sapiens
taaaacaaaatttgactaatt

SEQ ID NO: 4500811 - DNA, 18 bp, Homo sapiens
taaaacaaataaatatga

SEQ ID NO: 4500812 - DNA, 17 bp, Homo sapiens
taaaacaacagctcgat

SEQ ID NO: 4500813 - DNA, 21 bp, Homo sapiens
taaaacaattctgtgacatac

SEQ ID NO: 4500814 - DNA, 14 bp, Homo sapiens
taaaacagaagcaa

SEQ ID NO: 4500815 - DNA, 15 bp, Homo sapiens
taaaacagacactgg

SEQ ID NO: 4500816 - DNA, 19 bp, Homo sapiens
taaaacagacactggcatg

SEQ ID NO: 4500817 - DNA, 17 bp, Homo sapiens
taaaacaggcaaagttt

SEQ ID NO: 4500818 - DNA, 21 bp, Homo sapiens
taaaacaggtagaattatcta

SEQ ID NO: 4500819 - DNA, 20 bp, Homo sapiens
taaaacattacttatttaac

SEQ ID NO: 4500820 - DNA, 14 bp, Homo sapiens
taaaacatttattt

SEQ ID NO: 4500821 - DNA, 18 bp, Homo sapiens
taaaacatttgtttcccc

SEQ ID NO: 4500822 - DNA, 15 bp, Homo sapiens
taaaacattttgact

SEQ ID NO: 4500823 - DNA, 13 bp, Homo sapiens
taaaaccaaagag

SEQ ID NO: 4500824 - DNA, 15 bp, Homo sapiens
taaaaccacagcagt

SEQ ID NO: 4500825 - DNA, 14 bp, Homo sapiens
taaaacgcaccaat

SEQ ID NO: 4500826 - DNA, 19 bp, Homo sapiens
taaaactaggctcaaaata

SEQ ID NO: 4500827 - DNA, 13 bp, Homo sapiens
taaaactataaca

SEQ ID NO: 4500828 - DNA, 21 bp, Homo sapiens
taaaactataacattatataa

SEQ ID NO: 4500829 - DNA, 13 bp, Homo sapiens
taaaactatgtgt

SEQ ID NO: 4500830 - DNA, 16 bp, Homo sapiens
taaaactatttgtata

SEQ ID NO: 4500831 - DNA, 16 bp, Homo sapiens
taaaactcactgtgat

SEQ ID NO: 4500832 - DNA, 15 bp, Homo sapiens
taaaactcatcacat

SEQ ID NO: 4500833 - DNA, 20 bp, Homo sapiens
taaaactgcgaggacatcaa

SEQ ID NO: 4500834 - DNA, 16 bp, Homo sapiens
taaaactgtcactgtt

SEQ ID NO: 4500835 - DNA, 16 bp, Homo sapiens
taaaacttaaaaacaa

SEQ ID NO: 4500836 - DNA, 15 bp, Homo sapiens
taaaactttgaagtt

SEQ ID NO: 4500837 - DNA, 21 bp, Homo sapiens
taaaactttgaagttagcttt

SEQ ID NO: 4500838 - DNA, 15 bp, Homo sapiens
taaaagaaaaaatga

SEQ ID NO: 4500839 - DNA, 13 bp, Homo sapiens
taaaagaaacttt

SEQ ID NO: 4500840 - DNA, 14 bp, Homo sapiens
taaaagaaatcttg

SEQ ID NO: 4500841 - DNA, 23 bp, Homo sapiens
taaaagaatattttaacttcctt

SEQ ID NO: 4500842 - DNA, 15 bp, Homo sapiens
taaaagacatgcatt

SEQ ID NO: 4500843 - DNA, 12 bp, Homo sapiens
taaaagcaaaaa

SEQ ID NO: 4500844 - DNA, 17 bp, Homo sapiens
taaaagcaaaaaagaaa

SEQ ID NO: 4500845 - DNA, 23 bp, Homo sapiens
taaaagcaaaaaagaaaaccttt

SEQ ID NO: 4500846 - DNA, 15 bp, Homo sapiens
taaaagcaaatcatt

SEQ ID NO: 4500847 - DNA, 17 bp, Homo sapiens
taaaagcaattccaacc

SEQ ID NO: 4500848 - DNA, 15 bp, Homo sapiens
taaaagcaattctga

SEQ ID NO: 4500849 - DNA, 16 bp, Homo sapiens
taaaagcaattctgac

SEQ ID NO: 4500850 - DNA, 18 bp, Homo sapiens
taaaagcaattctgactg

SEQ ID NO: 4500851 - DNA, 13 bp, Homo sapiens
taaaagcacgaca

SEQ ID NO: 4500852 - DNA, 16 bp, Homo sapiens
taaaagcatgtatagt

SEQ ID NO: 4500853 - DNA, 19 bp, Homo sapiens
taaaagcatttttattata

SEQ ID NO: 4500854 - DNA, 14 bp, Homo sapiens
taaaagcctgctca

SEQ ID NO: 4500855 - DNA, 12 bp, Homo sapiens
taaaagccttcc

SEQ ID NO: 4500856 - DNA, 15 bp, Homo sapiens
taaaaggatagtatt

SEQ ID NO: 4500857 - DNA, 21 bp, Homo sapiens
taaaaggtggagtttctctgt

SEQ ID NO: 4500858 - DNA, 18 bp, Homo sapiens
taaaaggtgttgtaatgg

SEQ ID NO: 4500859 - DNA, 18 bp, Homo sapiens
taaaagtcattattcctg

SEQ ID NO: 4500860 - DNA, 22 bp, Homo sapiens
taaaagtgggcttgattctgca

SEQ ID NO: 4500861 - DNA, 15 bp, Homo sapiens
taaaagtgtgtaaat

SEQ ID NO: 4500862 - DNA, 20 bp, Homo sapiens
taaaagtgtgtaaatgctta

SEQ ID NO: 4500863 - DNA, 14 bp, Homo sapiens
taaaagttcataac

SEQ ID NO: 4500864 - DNA, 20 bp, Homo sapiens
taaaagtttgaaaagcaata

SEQ ID NO: 4500865 - DNA, 15 bp, Homo sapiens
taaaataaaatgaaa

SEQ ID NO: 4500866 - DNA, 16 bp, Homo sapiens
taaaataaaatgaaaa

SEQ ID NO: 4500867 - DNA, 21 bp, Homo sapiens
taaaataaaatgaaaattgta

SEQ ID NO: 4500868 - DNA, 15 bp, Homo sapiens
taaaataaaatgcct

SEQ ID NO: 4500869 - DNA, 21 bp, Homo sapiens
taaaataaagcttacatagtt

SEQ ID NO: 4500870 - DNA, 16 bp, Homo sapiens
taaaataactaaaatg

SEQ ID NO: 4500871 - DNA, 13 bp, Homo sapiens
taaaataagcatt

SEQ ID NO: 4500872 - DNA, 20 bp, Homo sapiens
taaaataattatataactgt

SEQ ID NO: 4500873 - DNA, 21 bp, Homo sapiens
taaaatacacactcaaatcaa

SEQ ID NO: 4500874 - DNA, 14 bp, Homo sapiens
taaaatagaaaaag

SEQ ID NO: 4500875 - DNA, 22 bp, Homo sapiens
taaaatagaaattttgtaagaa

SEQ ID NO: 4500876 - DNA, 17 bp, Homo sapiens
taaaatagcaaaagaag

SEQ ID NO: 4500877 - DNA, 14 bp, Homo sapiens
taaaatagcaataa

SEQ ID NO: 4500878 - DNA, 19 bp, Homo sapiens
taaaatagcaataactgaa

SEQ ID NO: 4500879 - DNA, 20 bp, Homo sapiens
taaaataggattattttaaa

SEQ ID NO: 4500880 - DNA, 17 bp, Homo sapiens
taaaatatatagtgaaa

SEQ ID NO: 4500881 - DNA, 16 bp, Homo sapiens
taaaatatatctggaa

SEQ ID NO: 4500882 - DNA, 14 bp, Homo sapiens
taaaatatctattt

SEQ ID NO: 4500883 - DNA, 14 bp, Homo sapiens
taaaatatctccaa

SEQ ID NO: 4500884 - DNA, 22 bp, Homo sapiens
taaaatatgtgaagttttcctt

SEQ ID NO: 4500885 - DNA, 20 bp, Homo sapiens
taaaatattttgaatcaata

SEQ ID NO: 4500886 - DNA, 15 bp, Homo sapiens
taaaatcacgttaaa

SEQ ID NO: 4500887 - DNA, 16 bp, Homo sapiens
taaaatcactaacatt

SEQ ID NO: 4500888 - DNA, 20 bp, Homo sapiens
taaaatcagctattttgtga

SEQ ID NO: 4500889 - DNA, 18 bp, Homo sapiens
taaaatcatttctgcatc

SEQ ID NO: 4500890 - DNA, 15 bp, Homo sapiens
taaaatccattttag

SEQ ID NO: 4500891 - DNA, 20 bp, Homo sapiens
taaaatccctctaatttctc

SEQ ID NO: 4500892 - DNA, 15 bp, Homo sapiens
taaaatctaaaattt

SEQ ID NO: 4500893 - DNA, 12 bp, Homo sapiens
taaaatgaatct

SEQ ID NO: 4500894 - DNA, 13 bp, Homo sapiens
taaaatgagtttg

SEQ ID NO: 4500895 - DNA, 23 bp, Homo sapiens
taaaatgagtttgtattattaca

SEQ ID NO: 4500896 - DNA, 17 bp, Homo sapiens
gtttgactttttggaat

SEQ ID NO: 4500897 - DNA, 16 bp, Homo sapiens
gtttgagctcagaccc

SEQ ID NO: 4500898 - DNA, 12 bp, Homo sapiens
gtttgaggctgc

SEQ ID NO: 4500899 - DNA, 22 bp, Homo sapiens
gtttgcacaagttccctggaga

SEQ ID NO: 4500900 - DNA, 11 bp, Homo sapiens
gtttgcaggag

SEQ ID NO: 4500901 - DNA, 18 bp, Homo sapiens
gtttgcaggagcccccct

SEQ ID NO: 4500902 - DNA, 23 bp, Homo sapiens
gtttgccccgggatattatagaa

SEQ ID NO: 4500903 - DNA, 23 bp, Homo sapiens
gtttgcctaaaacaatctaaaac

SEQ ID NO: 4500904 - DNA, 20 bp, Homo sapiens
gtttgcctgcagtttcttgt

SEQ ID NO: 4500905 - DNA, 20 bp, Homo sapiens
gtttgctaatgtttccatag

SEQ ID NO: 4500906 - DNA, 19 bp, Homo sapiens
gtttgctccaccttcatat

SEQ ID NO: 4500907 - DNA, 17 bp, Homo sapiens
gtttgctgattatttat

SEQ ID NO: 4500908 - DNA, 13 bp, Homo sapiens
gtttgctgtgaac

SEQ ID NO: 4500909 - DNA, 14 bp, Homo sapiens
gtttgcttaaaata

SEQ ID NO: 4500910 - DNA, 22 bp, Homo sapiens
gtttgcttaaaatatgtgaagt

SEQ ID NO: 4500911 - DNA, 16 bp, Homo sapiens
gtttggaatattaaaa

SEQ ID NO: 4500912 - DNA, 14 bp, Homo sapiens
gtttggacagctga

SEQ ID NO: 4500913 - DNA, 23 bp, Homo sapiens
gtttggactttgtatactttaaa

SEQ ID NO: 4500914 - DNA, 22 bp, Homo sapiens
gtttgggctggagctcctccct

SEQ ID NO: 4500915 - DNA, 20 bp, Homo sapiens
gtttggggatcgatgtgctc

SEQ ID NO: 4500916 - DNA, 17 bp, Homo sapiens
gtttgggtttttttcct

SEQ ID NO: 4500917 - DNA, 16 bp, Homo sapiens
gtttggtagttagcca

SEQ ID NO: 4500918 - DNA, 16 bp, Homo sapiens
gtttggtgcaaagtat

SEQ ID NO: 4500919 - DNA, 14 bp, Homo sapiens
gtttgtaaatgcct

SEQ ID NO: 4500920 - DNA, 15 bp, Homo sapiens
gtttgtaaatgcctc

SEQ ID NO: 4500921 - DNA, 19 bp, Homo sapiens
gtttgtacatatcaaatag

SEQ ID NO: 4500922 - DNA, 22 bp, Homo sapiens
gtttgtagtgccactgttgttt

SEQ ID NO: 4500923 - DNA, 22 bp, Homo sapiens
gtttgtgagcatgggtgtgccc

SEQ ID NO: 4500924 - DNA, 16 bp, Homo sapiens
gtttgtggcctcagaa

SEQ ID NO: 4500925 - DNA, 23 bp, Homo sapiens
gtttgtggggtgacgggactcag

SEQ ID NO: 4500926 - DNA, 14 bp, Homo sapiens
gtttgtgtgcatga

SEQ ID NO: 4500927 - DNA, 14 bp, Homo sapiens
gtttgtgtgtttca

SEQ ID NO: 4500928 - DNA, 12 bp, Homo sapiens
gtttgttccttt

SEQ ID NO: 4500929 - DNA, 12 bp, Homo sapiens
gtttgttctccg

SEQ ID NO: 4500930 - DNA, 19 bp, Homo sapiens
gtttgttgagctggtaaca

SEQ ID NO: 4500931 - DNA, 21 bp, Homo sapiens
gtttgttgagctggtaacatc

SEQ ID NO: 4500932 - DNA, 18 bp, Homo sapiens
gtttgtttacaaaatcag

SEQ ID NO: 4500933 - DNA, 14 bp, Homo sapiens
gtttgtttctttgt

SEQ ID NO: 4500934 - DNA, 15 bp, Homo sapiens
gtttgttttgtgaat

SEQ ID NO: 4500935 - DNA, 20 bp, Homo sapiens
gttttaaagttcattgcaat

SEQ ID NO: 4500936 - DNA, 13 bp, Homo sapiens
gttttaaatgtac

SEQ ID NO: 4500937 - DNA, 20 bp, Homo sapiens
gttttaacaatccattcaca

SEQ ID NO: 4500938 - DNA, 15 bp, Homo sapiens
gttttaactgtggat

SEQ ID NO: 4500939 - DNA, 17 bp, Homo sapiens
gttttaactttaataca

SEQ ID NO: 4500940 - DNA, 19 bp, Homo sapiens
gttttaactttaatacagc

SEQ ID NO: 4500941 - DNA, 11 bp, Homo sapiens
gttttacaata

SEQ ID NO: 4500942 - DNA, 17 bp, Homo sapiens
gttttacactaggaaac

SEQ ID NO: 4500943 - DNA, 12 bp, Homo sapiens
gttttacattgt

SEQ ID NO: 4500944 - DNA, 13 bp, Homo sapiens
gttttacatttta

SEQ ID NO: 4500945 - DNA, 13 bp, Homo sapiens
gttttacttttaa

SEQ ID NO: 4500946 - DNA, 16 bp, Homo sapiens
gttttataggcagctg

SEQ ID NO: 4500947 - DNA, 18 bp, Homo sapiens
gttttatgccccattgga

SEQ ID NO: 4500948 - DNA, 15 bp, Homo sapiens
gttttatttacattt

SEQ ID NO: 4500949 - DNA, 14 bp, Homo sapiens
gttttcaaaatact

SEQ ID NO: 4500950 - DNA, 16 bp, Homo sapiens
gttttcaacaattggt

SEQ ID NO: 4500951 - DNA, 18 bp, Homo sapiens
gttttcagaagaaataaa

SEQ ID NO: 4500952 - DNA, 17 bp, Homo sapiens
gttttcagactcagact

SEQ ID NO: 4500953 - DNA, 20 bp, Homo sapiens
gttttcatcatttcagccaa

SEQ ID NO: 4500954 - DNA, 16 bp, Homo sapiens
gttttcatttggttca

SEQ ID NO: 4500955 - DNA, 17 bp, Homo sapiens
gttttcatttggttcat

SEQ ID NO: 4500956 - DNA, 15 bp, Homo sapiens
gttttccacataaat

SEQ ID NO: 4500957 - DNA, 22 bp, Homo sapiens
gttttccttgctatttcaataa

SEQ ID NO: 4500958 - DNA, 17 bp, Homo sapiens
gttttctgagaaagact

SEQ ID NO: 4500959 - DNA, 11 bp, Homo sapiens
gttttctgtag

SEQ ID NO: 4500960 - DNA, 12 bp, Homo sapiens
gttttctgtaga

SEQ ID NO: 4500961 - DNA, 16 bp, Homo sapiens
gttttctttcctcctt

SEQ ID NO: 4500962 - DNA, 18 bp, Homo sapiens
gttttctttcctcctttc

SEQ ID NO: 4500963 - DNA, 18 bp, Homo sapiens
gttttgaagctactgtgt

SEQ ID NO: 4500964 - DNA, 19 bp, Homo sapiens
gttttgaataaattttcaa

SEQ ID NO: 4500965 - DNA, 21 bp, Homo sapiens
gttttgagctactggattctt

SEQ ID NO: 4500966 - DNA, 22 bp, Homo sapiens
gttttgatgtttgtggcctcag

SEQ ID NO: 4500967 - DNA, 12 bp, Homo sapiens
gttttgccagcc

SEQ ID NO: 4500968 - DNA, 14 bp, Homo sapiens
gttttgctgagagc

SEQ ID NO: 4500969 - DNA, 14 bp, Homo sapiens
gttttggactctct

SEQ ID NO: 4500970 - DNA, 16 bp, Homo sapiens
gttttggactctctgt

SEQ ID NO: 4500971 - DNA, 22 bp, Homo sapiens
gttttggactctctgtggtccc

SEQ ID NO: 4500972 - DNA, 19 bp, Homo sapiens
gttttgtaccagtgaattt

SEQ ID NO: 4500973 - DNA, 16 bp, Homo sapiens
gttttgtcagacttcc

SEQ ID NO: 4500974 - DNA, 19 bp, Homo sapiens
gttttgtggattaaacctt

SEQ ID NO: 4500975 - DNA, 13 bp, Homo sapiens
gttttgttaatat

SEQ ID NO: 4500976 - DNA, 13 bp, Homo sapiens
gttttgttgtttg

SEQ ID NO: 4500977 - DNA, 13 bp, Homo sapiens
gttttgtttcact

SEQ ID NO: 4500978 - DNA, 19 bp, Homo sapiens
gtttttaatcgtttttgtt

SEQ ID NO: 4500979 - DNA, 12 bp, Homo sapiens
gtttttaatgta

SEQ ID NO: 4500980 - DNA, 13 bp, Homo sapiens
gtttttaatgtat

SEQ ID NO: 4500981 - DNA, 14 bp, Homo sapiens
gtttttaatttgat

SEQ ID NO: 4500982 - DNA, 13 bp, Homo sapiens
gtttttactgaat

SEQ ID NO: 4500983 - DNA, 18 bp, Homo sapiens
gtttttagaatgttgaaa

SEQ ID NO: 4500984 - DNA, 20 bp, Homo sapiens
gtttttagcatgttcctcct

SEQ ID NO: 4500985 - DNA, 15 bp, Homo sapiens
gtttttattctgtat

SEQ ID NO: 4500986 - DNA, 18 bp, Homo sapiens
gtttttattgtaaaacaa

SEQ ID NO: 4500987 - DNA, 18 bp, Homo sapiens
gtttttatttcttttaga

SEQ ID NO: 4500988 - DNA, 14 bp, Homo sapiens
gtttttatttttgt

SEQ ID NO: 4500989 - DNA, 12 bp, Homo sapiens
gtttttcacatt

SEQ ID NO: 4500990 - DNA, 17 bp, Homo sapiens
gtttttcatactgtaca

SEQ ID NO: 4500991 - DNA, 18 bp, Homo sapiens
gtttttcattaaataaat

SEQ ID NO: 4500992 - DNA, 23 bp, Homo sapiens
gtttttcccacgtctaactggaa

SEQ ID NO: 4500993 - DNA, 15 bp, Homo sapiens
gtttttccctcccca

SEQ ID NO: 4500994 - DNA, 19 bp, Homo sapiens
gtttttccctccccagaat

SEQ ID NO: 4500995 - DNA, 18 bp, Homo sapiens
gtttttcctatcatgtta

SEQ ID NO: 4500996 - DNA, 12 bp, Homo sapiens
gtttttcctcat

SEQ ID NO: 4500997 - DNA, 12 bp, Homo sapiens
gtttttcctccc

SEQ ID NO: 4500998 - DNA, 12 bp, Homo sapiens
gtttttgcattt

SEQ ID NO: 4500999 - DNA, 15 bp, Homo sapiens
gtttttgcatttttg

SEQ ID NO: 4501000 - DNA, 15 bp, Homo sapiens
gtttttggtttctta

SEQ ID NO: 4501001 - DNA, 18 bp, Homo sapiens
gtttttggtttttaaaac

SEQ ID NO: 4501002 - DNA, 15 bp, Homo sapiens
gtttttgttcaaagc

SEQ ID NO: 4501003 - DNA, 16 bp, Homo sapiens
gtttttgttttaagga

SEQ ID NO: 4501004 - DNA, 23 bp, Homo sapiens
gttttttactttggtttagtctt

SEQ ID NO: 4501005 - DNA, 18 bp, Homo sapiens
gttttttcaaaatagaaa

SEQ ID NO: 4501006 - DNA, 9 bp, Homo sapiens
gttttttgt

SEQ ID NO: 4501007 - DNA, 18 bp, Homo sapiens
gtttttttacaacattca

SEQ ID NO: 4501008 - DNA, 13 bp, Homo sapiens
gtttttttccagt

SEQ ID NO: 4501009 - DNA, 15 bp, Homo sapiens
gttttttttttaaaa

SEQ ID NO: 4501010 - DNA, 22 bp, Homo sapiens
taaaaaaaaaaaaaatgttctt

SEQ ID NO: 4501011 - DNA, 19 bp, Homo sapiens
taaaaaaaaaaaatcattt

SEQ ID NO: 4501012 - DNA, 18 bp, Homo sapiens
taaaaaaaaaaagattgt

SEQ ID NO: 4501013 - DNA, 15 bp, Homo sapiens
taaaaaaaaaagtca

SEQ ID NO: 4501014 - DNA, 15 bp, Homo sapiens
taaaaaaaaattgta

SEQ ID NO: 4501015 - DNA, 20 bp, Homo sapiens
taaaaaaactggccttttga

SEQ ID NO: 4501016 - DNA, 12 bp, Homo sapiens
taaaaaaagtag

SEQ ID NO: 4501017 - DNA, 11 bp, Homo sapiens
taaaaaacaac

SEQ ID NO: 4501018 - DNA, 16 bp, Homo sapiens
taaaatgattgtagta

SEQ ID NO: 4501019 - DNA, 16 bp, Homo sapiens
taaaatgcaatatttg

SEQ ID NO: 4501020 - DNA, 14 bp, Homo sapiens
taaaatgcaccaat

SEQ ID NO: 4501021 - DNA, 20 bp, Homo sapiens
taaaatgcccatttcgaaga

SEQ ID NO: 4501022 - DNA, 17 bp, Homo sapiens
taaaatgcctcagctat

SEQ ID NO: 4501023 - DNA, 16 bp, Homo sapiens
taaaatgctttaaaaa

SEQ ID NO: 4501024 - DNA, 14 bp, Homo sapiens
taaaatggaataac

SEQ ID NO: 4501025 - DNA, 15 bp, Homo sapiens
taaaatggaataaca

SEQ ID NO: 4501026 - DNA, 18 bp, Homo sapiens
taaaatggaataacatat

SEQ ID NO: 4501027 - DNA, 20 bp, Homo sapiens
taaaatggaataacatatca

SEQ ID NO: 4501028 - DNA, 9 bp, Homo sapiens
taaaatggt

SEQ ID NO: 4501029 - DNA, 14 bp, Homo sapiens
taaaatggttatgt

SEQ ID NO: 4501030 - DNA, 13 bp, Homo sapiens
taaaatgtatctg

SEQ ID NO: 4501031 - DNA, 18 bp, Homo sapiens
taaaatgtatctgcatat

SEQ ID NO: 4501032 - DNA, 13 bp, Homo sapiens
taaaatgtatttt

SEQ ID NO: 4501033 - DNA, 17 bp, Homo sapiens
taaaatgtatttttcta

SEQ ID NO: 4501034 - DNA, 16 bp, Homo sapiens
taaaatgtctttccaa

SEQ ID NO: 4501035 - DNA, 19 bp, Homo sapiens
taaaatgtgaaaaactaat

SEQ ID NO: 4501036 - DNA, 22 bp, Homo sapiens
taaaatgttcacttttgacaaa

SEQ ID NO: 4501037 - DNA, 12 bp, Homo sapiens
taaaatgtttaa

SEQ ID NO: 4501038 - DNA, 19 bp, Homo sapiens
taaaattaatgtaataaag

SEQ ID NO: 4501039 - DNA, 20 bp, Homo sapiens
taaaattaatgtaataaagt

SEQ ID NO: 4501040 - DNA, 21 bp, Homo sapiens
taaaattaatgtaataaagtg

SEQ ID NO: 4501041 - DNA, 17 bp, Homo sapiens
taaaattaggttaaacg

SEQ ID NO: 4501042 - DNA, 13 bp, Homo sapiens
taaaattagtctt

SEQ ID NO: 4501043 - DNA, 21 bp, Homo sapiens
taaaattagtcttttgtaata

SEQ ID NO: 4501044 - DNA, 21 bp, Homo sapiens
taaaattatatagctgctcct

SEQ ID NO: 4501045 - DNA, 19 bp, Homo sapiens
taaaattatgttactgtat

SEQ ID NO: 4501046 - DNA, 15 bp, Homo sapiens
taaaattatttcatg

SEQ ID NO: 4501047 - DNA, 22 bp, Homo sapiens
taaaattcaaaaacaaaattag

SEQ ID NO: 4501048 - DNA, 14 bp, Homo sapiens
taaaattcatttct

SEQ ID NO: 4501049 - DNA, 15 bp, Homo sapiens
taaaattctgtaatt

SEQ ID NO: 4501050 - DNA, 14 bp, Homo sapiens
taaaattgaatagt

SEQ ID NO: 4501051 - DNA, 22 bp, Homo sapiens
taaaattgaatagtttatttct

SEQ ID NO: 4501052 - DNA, 23 bp, Homo sapiens
taaaattgagttcttcctgtaat

SEQ ID NO: 4501053 - DNA, 23 bp, Homo sapiens
taaaattgcagtttcatgtatgt

SEQ ID NO: 4501054 - DNA, 19 bp, Homo sapiens
taaaattggtatatttgaa

SEQ ID NO: 4501055 - DNA, 16 bp, Homo sapiens
taaaattgtgatgtgt

SEQ ID NO: 4501056 - DNA, 13 bp, Homo sapiens
taaaattgtgcat

SEQ ID NO: 4501057 - DNA, 18 bp, Homo sapiens
taaaattgtgcataatgc

SEQ ID NO: 4501058 - DNA, 22 bp, Homo sapiens
taaaattgtgcataatgctttg

SEQ ID NO: 4501059 - DNA, 16 bp, Homo sapiens
taaaatttatttgcaa

SEQ ID NO: 4501060 - DNA, 21 bp, Homo sapiens
taaaatttcataattctgaaa

SEQ ID NO: 4501061 - DNA, 21 bp, Homo sapiens
taaaatttgtagaattgaaaa

SEQ ID NO: 4501062 - DNA, 15 bp, Homo sapiens
taaaatttgttgcat

SEQ ID NO: 4501063 - DNA, 22 bp, Homo sapiens
taaaattttggaatatttgctt

SEQ ID NO: 4501064 - DNA, 18 bp, Homo sapiens
taaaattttgtgttcctt

SEQ ID NO: 4501065 - DNA, 18 bp, Homo sapiens
taaacaaaatttcacagt

SEQ ID NO: 4501066 - DNA, 23 bp, Homo sapiens
taaacaatctttcatgtcttgtc

SEQ ID NO: 4501067 - DNA, 18 bp, Homo sapiens
taaacaatttattttatt

SEQ ID NO: 4501068 - DNA, 18 bp, Homo sapiens
taaacacaggctgtcctt

SEQ ID NO: 4501069 - DNA, 16 bp, Homo sapiens
taaacactacacattt

SEQ ID NO: 4501070 - DNA, 20 bp, Homo sapiens
taaacacttatcttctggat

SEQ ID NO: 4501071 - DNA, 21 bp, Homo sapiens
taaacacttatcttctggatt

SEQ ID NO: 4501072 - DNA, 22 bp, Homo sapiens
taaacacttatcttctggatta

SEQ ID NO: 4501073 - DNA, 13 bp, Homo sapiens
taaacagaaaact

SEQ ID NO: 4501074 - DNA, 20 bp, Homo sapiens
taaacagaaaactcccaata

SEQ ID NO: 4501075 - DNA, 16 bp, Homo sapiens
taaacagaaattattt

SEQ ID NO: 4501076 - DNA, 12 bp, Homo sapiens
taaacagaagca

SEQ ID NO: 4501077 - DNA, 17 bp, Homo sapiens
taaacagacaggaattt

SEQ ID NO: 4501078 - DNA, 22 bp, Homo sapiens
taaacaggtatttttttaaatc

SEQ ID NO: 4501079 - DNA, 13 bp, Homo sapiens
taaacagtgcctg

SEQ ID NO: 4501080 - DNA, 17 bp, Homo sapiens
taaacagtgcctgctga

SEQ ID NO: 4501081 - DNA, 14 bp, Homo sapiens
taaacagttatttc

SEQ ID NO: 4501082 - DNA, 22 bp, Homo sapiens
taaacataaaaactgatttgct

SEQ ID NO: 4501083 - DNA, 13 bp, Homo sapiens
taaacataattat

SEQ ID NO: 4501084 - DNA, 19 bp, Homo sapiens
taaacatatttttatactt

SEQ ID NO: 4501085 - DNA, 20 bp, Homo sapiens
taaacatgtcacaatacagt

SEQ ID NO: 4501086 - DNA, 21 bp, Homo sapiens
taaacattattttttatttct

SEQ ID NO: 4501087 - DNA, 18 bp, Homo sapiens
taaacattgaagtaatga

SEQ ID NO: 4501088 - DNA, 15 bp, Homo sapiens
taaaccaaaaacatt

SEQ ID NO: 4501089 - DNA, 17 bp, Homo sapiens
taaaccaaaaacatttg

SEQ ID NO: 4501090 - DNA, 18 bp, Homo sapiens
taaaccaaaaacatttga

SEQ ID NO: 4501091 - DNA, 21 bp, Homo sapiens
taaaccaagattatgtgactt

SEQ ID NO: 4501092 - DNA, 14 bp, Homo sapiens
taaacccaaaatat

SEQ ID NO: 4501093 - DNA, 15 bp, Homo sapiens
taaacccaaaatata

SEQ ID NO: 4501094 - DNA, 17 bp, Homo sapiens
taaacccatacaatgta

SEQ ID NO: 4501095 - DNA, 18 bp, Homo sapiens
taaacccatacaatgtat

SEQ ID NO: 4501096 - DNA, 23 bp, Homo sapiens
taaacccatattgtaaaacaggt

SEQ ID NO: 4501097 - DNA, 23 bp, Homo sapiens
taaaccctttagtgctttgtgat

SEQ ID NO: 4501098 - DNA, 17 bp, Homo sapiens
taaaccgctaaaagaaa

SEQ ID NO: 4501099 - DNA, 14 bp, Homo sapiens
taaaccttaatatt

SEQ ID NO: 4501100 - DNA, 13 bp, Homo sapiens
taaaccttatgaa

SEQ ID NO: 4501101 - DNA, 13 bp, Homo sapiens
taaacctttccat

SEQ ID NO: 4501102 - DNA, 15 bp, Homo sapiens
taaacggattccaaa

SEQ ID NO: 4501103 - DNA, 16 bp, Homo sapiens
taaacggcccaggcca

SEQ ID NO: 4501104 - DNA, 18 bp, Homo sapiens
taaacggcccaggccagg

SEQ ID NO: 4501105 - DNA, 14 bp, Homo sapiens
taaacgtagcatgt

SEQ ID NO: 4501106 - DNA, 17 bp, Homo sapiens
taaactaaaaactaaca

SEQ ID NO: 4501107 - DNA, 17 bp, Homo sapiens
taaactaaagtatggta

SEQ ID NO: 4501108 - DNA, 13 bp, Homo sapiens
taaactaaatgtg

SEQ ID NO: 4501109 - DNA, 23 bp, Homo sapiens
taaactacagaatattaaatatt

SEQ ID NO: 4501110 - DNA, 17 bp, Homo sapiens
taaactactatttttct

SEQ ID NO: 4501111 - DNA, 19 bp, Homo sapiens
taaactactatttttcttt

SEQ ID NO: 4501112 - DNA, 22 bp, Homo sapiens
taaactactatttttctttcca

SEQ ID NO: 4501113 - DNA, 17 bp, Homo sapiens
taaactagtttaagggt

SEQ ID NO: 4501114 - DNA, 14 bp, Homo sapiens
taaactattcttaa

SEQ ID NO: 4501115 - DNA, 12 bp, Homo sapiens
taaactctctag

SEQ ID NO: 4501116 - DNA, 13 bp, Homo sapiens
taaactctctagc

SEQ ID NO: 4501117 - DNA, 20 bp, Homo sapiens
taaactctctagcttaagtg

SEQ ID NO: 4501118 - DNA, 18 bp, Homo sapiens
taaactctgcatccagag

SEQ ID NO: 4501119 - DNA, 12 bp, Homo sapiens
taaactgtgcac

SEQ ID NO: 4501120 - DNA, 15 bp, Homo sapiens
taaactgtgtacata

SEQ ID NO: 4501121 - DNA, 17 bp, Homo sapiens
taaactgtgtattccaa

SEQ ID NO: 4501122 - DNA, 22 bp, Homo sapiens
taaactgtgtattccaagacat

SEQ ID NO: 4501123 - DNA, 13 bp, Homo sapiens
taaacttcagcaa

SEQ ID NO: 4501124 - DNA, 15 bp, Homo sapiens
taaacttggaatcaa

SEQ ID NO: 4501125 - DNA, 13 bp, Homo sapiens
taaacttgtgaat

SEQ ID NO: 4501126 - DNA, 14 bp, Homo sapiens
taaacttgtgtatt

SEQ ID NO: 4501127 - DNA, 17 bp, Homo sapiens
taaacttgtttgctgtg

SEQ ID NO: 4501128 - DNA, 14 bp, Homo sapiens
taaactttctccat

SEQ ID NO: 4501129 - DNA, 18 bp, Homo sapiens
taaactttctccatttaa

SEQ ID NO: 4501130 - DNA, 15 bp, Homo sapiens
taaactttttaaaat

SEQ ID NO: 4501131 - DNA, 17 bp, Homo sapiens
taaactttttaaaatac

SEQ ID NO: 4501132 - DNA, 14 bp, Homo sapiens
taaagaaaaacaaa

SEQ ID NO: 4501133 - DNA, 15 bp, Homo sapiens
taaagaaaaacaaac

SEQ ID NO: 4501134 - DNA, 16 bp, Homo sapiens
taaagaaaggaaaaga

SEQ ID NO: 4501135 - DNA, 17 bp, Homo sapiens
taaagaaagtgtatttg

SEQ ID NO: 4501136 - DNA, 20 bp, Homo sapiens
taaagaaagtgtatttggaa

SEQ ID NO: 4501137 - DNA, 15 bp, Homo sapiens
taaagaaattcaaga

SEQ ID NO: 4501138 - DNA, 16 bp, Homo sapiens
taaagaaattcaagaa

SEQ ID NO: 4501139 - DNA, 18 bp, Homo sapiens
taaatatcagtattctga

SEQ ID NO: 4501140 - DNA, 16 bp, Homo sapiens
taaatatccatttatc

SEQ ID NO: 4501141 - DNA, 18 bp, Homo sapiens
taaatatccatttatctt

SEQ ID NO: 4501142 - DNA, 23 bp, Homo sapiens
taaatatccatttatcttttgta

SEQ ID NO: 4501143 - DNA, 13 bp, Homo sapiens
taaatatgtcaga

SEQ ID NO: 4501144 - DNA, 16 bp, Homo sapiens
taaatatgtcagatgt

SEQ ID NO: 4501145 - DNA, 18 bp, Homo sapiens
taaatattgctaaaagca

SEQ ID NO: 4501146 - DNA, 21 bp, Homo sapiens
taaatattgctaaaagcatgt

SEQ ID NO: 4501147 - DNA, 17 bp, Homo sapiens
taaatattgcttcaatt

SEQ ID NO: 4501148 - DNA, 20 bp, Homo sapiens
taaatattgcttcaatttca

SEQ ID NO: 4501149 - DNA, 20 bp, Homo sapiens
taaatatttgttacttttag

SEQ ID NO: 4501150 - DNA, 14 bp, Homo sapiens
taaatattttaaag

SEQ ID NO: 4501151 - DNA, 21 bp, Homo sapiens
taaatcacgctttttgaaaaa

SEQ ID NO: 4501152 - DNA, 22 bp, Homo sapiens
taaatcacgctttttgaaaaag

SEQ ID NO: 4501153 - DNA, 15 bp, Homo sapiens
taaatcataaagtca

SEQ ID NO: 4501154 - DNA, 17 bp, Homo sapiens
taaatcataaagtcagt

SEQ ID NO: 4501155 - DNA, 16 bp, Homo sapiens
taaatcatgatgctag

SEQ ID NO: 4501156 - DNA, 19 bp, Homo sapiens
taaatcattttaggaaagg

SEQ ID NO: 4501157 - DNA, 22 bp, Homo sapiens
taaatcctgtgtttcattactt

SEQ ID NO: 4501158 - DNA, 17 bp, Homo sapiens
taaatctcctatttttt

SEQ ID NO: 4501159 - DNA, 15 bp, Homo sapiens
taaatctgattaatc

SEQ ID NO: 4501160 - DNA, 22 bp, Homo sapiens
taaatctggggaagaggtttta

SEQ ID NO: 4501161 - DNA, 16 bp, Homo sapiens
taaatcttagtgttca

SEQ ID NO: 4501162 - DNA, 16 bp, Homo sapiens
taaatctttttgcttc

SEQ ID NO: 4501163 - DNA, 20 bp, Homo sapiens
taaatctttttgcttctact

SEQ ID NO: 4501164 - DNA, 23 bp, Homo sapiens
taaatgaagaaagggaggcccag

SEQ ID NO: 4501165 - DNA, 16 bp, Homo sapiens
taaatgaatattttga

SEQ ID NO: 4501166 - DNA, 18 bp, Homo sapiens
taaatgagggtttctgat

SEQ ID NO: 4501167 - DNA, 23 bp, Homo sapiens
taaatgagggtttctgatctgta

SEQ ID NO: 4501168 - DNA, 15 bp, Homo sapiens
taaatgagttactta

SEQ ID NO: 4501169 - DNA, 16 bp, Homo sapiens
taaatgattatattca

SEQ ID NO: 4501170 - DNA, 15 bp, Homo sapiens
taaatgatttaaatt

SEQ ID NO: 4501171 - DNA, 12 bp, Homo sapiens
taaatgcaataa

SEQ ID NO: 4501172 - DNA, 15 bp, Homo sapiens
taaatgcataattta

SEQ ID NO: 4501173 - DNA, 20 bp, Homo sapiens
taaatgcataatttatggtc

SEQ ID NO: 4501174 - DNA, 20 bp, Homo sapiens
taaatgccaaaatgtactta

SEQ ID NO: 4501175 - DNA, 17 bp, Homo sapiens
taaatgcctcttaaatt

SEQ ID NO: 4501176 - DNA, 16 bp, Homo sapiens
taaatgctcatacaca

SEQ ID NO: 4501177 - DNA, 19 bp, Homo sapiens
taaatgctgttcttacaca

SEQ ID NO: 4501178 - DNA, 17 bp, Homo sapiens
taaatgcttaaatttca

SEQ ID NO: 4501179 - DNA, 19 bp, Homo sapiens
taaatgcttcattgaaagc

SEQ ID NO: 4501180 - DNA, 14 bp, Homo sapiens
taaatggaataatt

SEQ ID NO: 4501181 - DNA, 20 bp, Homo sapiens
taaatgtaagttgagaaaaa

SEQ ID NO: 4501182 - DNA, 21 bp, Homo sapiens
taaatgtacagacatatttaa

SEQ ID NO: 4501183 - DNA, 15 bp, Homo sapiens
taaatgtattttaca

SEQ ID NO: 4501184 - DNA, 19 bp, Homo sapiens
taaatgtgcaatagaaggt

SEQ ID NO: 4501185 - DNA, 16 bp, Homo sapiens
taaatgtgcttttaaa

SEQ ID NO: 4501186 - DNA, 20 bp, Homo sapiens
taaatgtggattttgtagat

SEQ ID NO: 4501187 - DNA, 12 bp, Homo sapiens
taaatgtgtatt

SEQ ID NO: 4501188 - DNA, 14 bp, Homo sapiens
taaatgtgtgtatg

SEQ ID NO: 4501189 - DNA, 16 bp, Homo sapiens
taaatgtgtgtatgtg

SEQ ID NO: 4501190 - DNA, 20 bp, Homo sapiens
taaatgtgttagcactgata

SEQ ID NO: 4501191 - DNA, 17 bp, Homo sapiens
taaatgttacttctgat

SEQ ID NO: 4501192 - DNA, 20 bp, Homo sapiens
taaatgttcttggtgtttga

SEQ ID NO: 4501193 - DNA, 14 bp, Homo sapiens
taaatgtttcaaaa

SEQ ID NO: 4501194 - DNA, 18 bp, Homo sapiens
taaatgtttcaaaataga

SEQ ID NO: 4501195 - DNA, 19 bp, Homo sapiens
taaatgtttcaaaatagac

SEQ ID NO: 4501196 - DNA, 14 bp, Homo sapiens
taaattaaacaatt

SEQ ID NO: 4501197 - DNA, 14 bp, Homo sapiens
taaattaaatatat

SEQ ID NO: 4501198 - DNA, 21 bp, Homo sapiens
taaattaagatcctaaactct

SEQ ID NO: 4501199 - DNA, 11 bp, Homo sapiens
taaattaatat

SEQ ID NO: 4501200 - DNA, 15 bp, Homo sapiens
taaattaatatcttt

SEQ ID NO: 4501201 - DNA, 22 bp, Homo sapiens
taaattaatttgttaattaaat

SEQ ID NO: 4501202 - DNA, 13 bp, Homo sapiens
taaattacaattt

SEQ ID NO: 4501203 - DNA, 14 bp, Homo sapiens
taaattacagcttt

SEQ ID NO: 4501204 - DNA, 16 bp, Homo sapiens
taaattacagctttta

SEQ ID NO: 4501205 - DNA, 17 bp, Homo sapiens
taaattacagcttttat

SEQ ID NO: 4501206 - DNA, 21 bp, Homo sapiens
taaattacagcttttatggat

SEQ ID NO: 4501207 - DNA, 23 bp, Homo sapiens
taaattacagcttttatggatga

SEQ ID NO: 4501208 - DNA, 18 bp, Homo sapiens
taaattacctttacatat

SEQ ID NO: 4501209 - DNA, 16 bp, Homo sapiens
taaattagaaaatatt

SEQ ID NO: 4501210 - DNA, 11 bp, Homo sapiens
taaattagaat

SEQ ID NO: 4501211 - DNA, 17 bp, Homo sapiens
taaattaggaataaata

SEQ ID NO: 4501212 - DNA, 15 bp, Homo sapiens
taaattataaggact

SEQ ID NO: 4501213 - DNA, 16 bp, Homo sapiens
taaattatatgatatg

SEQ ID NO: 4501214 - DNA, 19 bp, Homo sapiens
taaattatgaatattaaag

SEQ ID NO: 4501215 - DNA, 14 bp, Homo sapiens
taaattatggcatt

SEQ ID NO: 4501216 - DNA, 21 bp, Homo sapiens
taaattatgtgaccataatgt

SEQ ID NO: 4501217 - DNA, 19 bp, Homo sapiens
taaattattactttaaatt

SEQ ID NO: 4501218 - DNA, 23 bp, Homo sapiens
taaattattactttaaattatat

SEQ ID NO: 4501219 - DNA, 19 bp, Homo sapiens
taaattattttatatcata

SEQ ID NO: 4501220 - DNA, 16 bp, Homo sapiens
taaattcacaaacttt

SEQ ID NO: 4501221 - DNA, 20 bp, Homo sapiens
taaattcacattttctcaaa

SEQ ID NO: 4501222 - DNA, 15 bp, Homo sapiens
taaattccactgaaa

SEQ ID NO: 4501223 - DNA, 16 bp, Homo sapiens
taaattccactgaaaa

SEQ ID NO: 4501224 - DNA, 18 bp, Homo sapiens
taaattccactgaaaatt

SEQ ID NO: 4501225 - DNA, 20 bp, Homo sapiens
taaattccactgaaaattta

SEQ ID NO: 4501226 - DNA, 17 bp, Homo sapiens
taaattcccaacttctc

SEQ ID NO: 4501227 - DNA, 20 bp, Homo sapiens
taaattgctttctatatctt

SEQ ID NO: 4501228 - DNA, 13 bp, Homo sapiens
taaattggaaagc

SEQ ID NO: 4501229 - DNA, 16 bp, Homo sapiens
taaattgggttcatga

SEQ ID NO: 4501230 - DNA, 13 bp, Homo sapiens
taaattgtaaaac

SEQ ID NO: 4501231 - DNA, 15 bp, Homo sapiens
taaattgtctttaaa

SEQ ID NO: 4501232 - DNA, 18 bp, Homo sapiens
taaattgtctttaaaaac

SEQ ID NO: 4501233 - DNA, 15 bp, Homo sapiens
taaattgttgtttca

SEQ ID NO: 4501234 - DNA, 14 bp, Homo sapiens
taaatttaagaaaa

SEQ ID NO: 4501235 - DNA, 16 bp, Homo sapiens
taaatttaagaaaaca

SEQ ID NO: 4501236 - DNA, 22 bp, Homo sapiens
taaatttaagcttaagccataa

SEQ ID NO: 4501237 - DNA, 19 bp, Homo sapiens
taaatttatcacattgaat

SEQ ID NO: 4501238 - DNA, 13 bp, Homo sapiens
taaatttcagaat

SEQ ID NO: 4501239 - DNA, 20 bp, Homo sapiens
taaatttcgcttcttagaac

SEQ ID NO: 4501240 - DNA, 15 bp, Homo sapiens
taaatttctgccaag

SEQ ID NO: 4501241 - DNA, 18 bp, Homo sapiens
taaatttcttatgtgaca

SEQ ID NO: 4501242 - DNA, 17 bp, Homo sapiens
taaatttgacttttctg

SEQ ID NO: 4501243 - DNA, 18 bp, Homo sapiens
taaatttgacttttctgt

SEQ ID NO: 4501244 - DNA, 22 bp, Homo sapiens
taaatttggtgccgatgttgaa

SEQ ID NO: 4501245 - DNA, 11 bp, Homo sapiens
taaattttaat

SEQ ID NO: 4501246 - DNA, 19 bp, Homo sapiens
taaattttaattcaagaaa

SEQ ID NO: 4501247 - DNA, 15 bp, Homo sapiens
taaattttagtacat

SEQ ID NO: 4501248 - DNA, 17 bp, Homo sapiens
taaattttagtacattt

SEQ ID NO: 4501249 - DNA, 20 bp, Homo sapiens
taaattttatgtcatagaaa

SEQ ID NO: 4501250 - DNA, 18 bp, Homo sapiens
taaattttcaaatcctta

SEQ ID NO: 4501251 - DNA, 18 bp, Homo sapiens
taaatttttaggcaaaga

SEQ ID NO: 4501252 - DNA, 14 bp, Homo sapiens
taacaaaaaatgta

SEQ ID NO: 4501253 - DNA, 16 bp, Homo sapiens
taacaaaaaatgtaat

SEQ ID NO: 4501254 - DNA, 19 bp, Homo sapiens
taacaaaatgtatgtctgg

SEQ ID NO: 4501255 - DNA, 22 bp, Homo sapiens
taacaaacgtaatttgttatat

SEQ ID NO: 4501256 - DNA, 19 bp, Homo sapiens
taacaagaactttaaattg

SEQ ID NO: 4501257 - DNA, 19 bp, Homo sapiens
taacaagatgtttcatttt

SEQ ID NO: 4501258 - DNA, 22 bp, Homo sapiens
taacaagcaaggatatcagagc

SEQ ID NO: 4501259 - DNA, 19 bp, Homo sapiens
taaagaagaaacttgtaaa

SEQ ID NO: 4501260 - DNA, 12 bp, Homo sapiens
taaagaatactt

SEQ ID NO: 4501261 - DNA, 15 bp, Homo sapiens
taaagaatcattatt

SEQ ID NO: 4501262 - DNA, 16 bp, Homo sapiens
taaagaattttcatcc

SEQ ID NO: 4501263 - DNA, 16 bp, Homo sapiens
taaagacaaataaatg

SEQ ID NO: 4501264 - DNA, 16 bp, Homo sapiens
taaagacatgaagcca

SEQ ID NO: 4501265 - DNA, 15 bp, Homo sapiens
taaagactaagtagc

SEQ ID NO: 4501266 - DNA, 23 bp, Homo sapiens
taaagactaggatattgaatgtg

SEQ ID NO: 4501267 - DNA, 17 bp, Homo sapiens
taaagactgagcagaac

SEQ ID NO: 4501268 - DNA, 13 bp, Homo sapiens
taaagacttttat

SEQ ID NO: 4501269 - DNA, 19 bp, Homo sapiens
taaagagcccttgcctccc

SEQ ID NO: 4501270 - DNA, 21 bp, Homo sapiens
taaagagcccttgcctcccca

SEQ ID NO: 4501271 - DNA, 18 bp, Homo sapiens
taaagaggcatcttttct

SEQ ID NO: 4501272 - DNA, 22 bp, Homo sapiens
taaagaggcatcttttctagag

SEQ ID NO: 4501273 - DNA, 19 bp, Homo sapiens
taaagagtacactcagcca

SEQ ID NO: 4501274 - DNA, 22 bp, Homo sapiens
taaagagtacactcagccactg

SEQ ID NO: 4501275 - DNA, 20 bp, Homo sapiens
taaagataacccttattcca

SEQ ID NO: 4501276 - DNA, 22 bp, Homo sapiens
taaagataatcgaagcaaaagt

SEQ ID NO: 4501277 - DNA, 16 bp, Homo sapiens
taaagatatggagaat

SEQ ID NO: 4501278 - DNA, 18 bp, Homo sapiens
taaagatatttttatctt

SEQ ID NO: 4501279 - DNA, 22 bp, Homo sapiens
taaagatatttttatctttata

SEQ ID NO: 4501280 - DNA, 15 bp, Homo sapiens
taaagattctcacat

SEQ ID NO: 4501281 - DNA, 18 bp, Homo sapiens
taaagatttatttagcta

SEQ ID NO: 4501282 - DNA, 20 bp, Homo sapiens
taaagatttatttagctatt

SEQ ID NO: 4501283 - DNA, 17 bp, Homo sapiens
taaagatttctagtagg

SEQ ID NO: 4501284 - DNA, 13 bp, Homo sapiens
taaagatttgctt

SEQ ID NO: 4501285 - DNA, 17 bp, Homo sapiens
taaagcagtatttttct

SEQ ID NO: 4501286 - DNA, 21 bp, Homo sapiens
taaagcatcaccactcatttt

SEQ ID NO: 4501287 - DNA, 14 bp, Homo sapiens
taaagccttaagca

SEQ ID NO: 4501288 - DNA, 15 bp, Homo sapiens
taaagccttaagcac

SEQ ID NO: 4501289 - DNA, 20 bp, Homo sapiens
taaagccttaagcacaatta

SEQ ID NO: 4501290 - DNA, 20 bp, Homo sapiens
taaagcctttgatgcacaaa

SEQ ID NO: 4501291 - DNA, 18 bp, Homo sapiens
taaagcctttgtatcttt

SEQ ID NO: 4501292 - DNA, 21 bp, Homo sapiens
taaagcgtttgcacagatcaa

SEQ ID NO: 4501293 - DNA, 16 bp, Homo sapiens
taaagctaaaaatatt

SEQ ID NO: 4501294 - DNA, 17 bp, Homo sapiens
taaagctcaaatgaaat

SEQ ID NO: 4501295 - DNA, 18 bp, Homo sapiens
taaagctcaaatgaaatg

SEQ ID NO: 4501296 - DNA, 19 bp, Homo sapiens
taaagctggtttaatgttt

SEQ ID NO: 4501297 - DNA, 16 bp, Homo sapiens
taaagcttccgggaaa

SEQ ID NO: 4501298 - DNA, 13 bp, Homo sapiens
taaagcttgattt

SEQ ID NO: 4501299 - DNA, 18 bp, Homo sapiens
taaagcttgatttgatct

SEQ ID NO: 4501300 - DNA, 17 bp, Homo sapiens
taaagctttatctttgt

SEQ ID NO: 4501301 - DNA, 19 bp, Homo sapiens
taaagctttatctttgtgt

SEQ ID NO: 4501302 - DNA, 13 bp, Homo sapiens
taaaggaaaacaa

SEQ ID NO: 4501303 - DNA, 14 bp, Homo sapiens
taaaggactgtaat

SEQ ID NO: 4501304 - DNA, 19 bp, Homo sapiens
taaaggatcagctggttca

SEQ ID NO: 4501305 - DNA, 16 bp, Homo sapiens
taaaggatccagagag

SEQ ID NO: 4501306 - DNA, 16 bp, Homo sapiens
taaaggatgtgattgt

SEQ ID NO: 4501307 - DNA, 15 bp, Homo sapiens
taaaggcacaaatag

SEQ ID NO: 4501308 - DNA, 15 bp, Homo sapiens
taaaggcagctgcct

SEQ ID NO: 4501309 - DNA, 19 bp, Homo sapiens
taaaggcagctgcctctgc

SEQ ID NO: 4501310 - DNA, 23 bp, Homo sapiens
taaaggcagctgcctctgctccc

SEQ ID NO: 4501311 - DNA, 24 bp, Homo sapiens
taaaggcagctgcctctgctccct

SEQ ID NO: 4501312 - DNA, 18 bp, Homo sapiens
taaaggccgtcatttcat

SEQ ID NO: 4501313 - DNA, 21 bp, Homo sapiens
taaagggaccagcccttcatg

SEQ ID NO: 4501314 - DNA, 23 bp, Homo sapiens
taaagggagaagagggaaaacag

SEQ ID NO: 4501315 - DNA, 21 bp, Homo sapiens
taaagggcccaatgaattatt

SEQ ID NO: 4501316 - DNA, 14 bp, Homo sapiens
taaagggtcaggcc

SEQ ID NO: 4501317 - DNA, 20 bp, Homo sapiens
taaaggtggtgaggcaataa

SEQ ID NO: 4501318 - DNA, 16 bp, Homo sapiens
taaagtaaacttgtgt

SEQ ID NO: 4501319 - DNA, 18 bp, Homo sapiens
taaagtatagagagaagt

SEQ ID NO: 4501320 - DNA, 21 bp, Homo sapiens
taaagtattccaccttaaatt

SEQ ID NO: 4501321 - DNA, 13 bp, Homo sapiens
taaagtattcttc

SEQ ID NO: 4501322 - DNA, 10 bp, Homo sapiens
taaagtattt

SEQ ID NO: 4501323 - DNA, 24 bp, Homo sapiens
taaagtatttataaaaatataaat

SEQ ID NO: 4501324 - DNA, 14 bp, Homo sapiens
taaagtattttaat

SEQ ID NO: 4501325 - DNA, 15 bp, Homo sapiens
taaagtcagatggaa

SEQ ID NO: 4501326 - DNA, 17 bp, Homo sapiens
taaagtcagatggaaaa

SEQ ID NO: 4501327 - DNA, 21 bp, Homo sapiens
taaagtcagttgctcaaaaag

SEQ ID NO: 4501328 - DNA, 21 bp, Homo sapiens
taaagtgggttattctggagt

SEQ ID NO: 4501329 - DNA, 22 bp, Homo sapiens
taaagtgggttattctggagtt

SEQ ID NO: 4501330 - DNA, 16 bp, Homo sapiens
taaagttatatttcag

SEQ ID NO: 4501331 - DNA, 17 bp, Homo sapiens
taaagttcattgcaatt

SEQ ID NO: 4501332 - DNA, 23 bp, Homo sapiens
taaagttctgtactcaaatgtag

SEQ ID NO: 4501333 - DNA, 13 bp, Homo sapiens
taaagttctgtgt

SEQ ID NO: 4501334 - DNA, 14 bp, Homo sapiens
taaagttcttattt

SEQ ID NO: 4501335 - DNA, 16 bp, Homo sapiens
taaagttgaatattat

SEQ ID NO: 4501336 - DNA, 17 bp, Homo sapiens
taaagttgaatattata

SEQ ID NO: 4501337 - DNA, 16 bp, Homo sapiens
taaagttgataaagat

SEQ ID NO: 4501338 - DNA, 17 bp, Homo sapiens
taaagttggtattaata

SEQ ID NO: 4501339 - DNA, 17 bp, Homo sapiens
taaagttggttggataa

SEQ ID NO: 4501340 - DNA, 16 bp, Homo sapiens
taaagttgtttcccac

SEQ ID NO: 4501341 - DNA, 14 bp, Homo sapiens
taaagttttagggt

SEQ ID NO: 4501342 - DNA, 17 bp, Homo sapiens
taaagttttgcaacaat

SEQ ID NO: 4501343 - DNA, 17 bp, Homo sapiens
taaataaaaacaaagtt

SEQ ID NO: 4501344 - DNA, 16 bp, Homo sapiens
taaataaaaagaaagg

SEQ ID NO: 4501345 - DNA, 15 bp, Homo sapiens
taaataaaaatgcat

SEQ ID NO: 4501346 - DNA, 21 bp, Homo sapiens
taaataaaaatgcattgaaca

SEQ ID NO: 4501347 - DNA, 12 bp, Homo sapiens
taaataaaacat

SEQ ID NO: 4501348 - DNA, 16 bp, Homo sapiens
taaataaaacatcact

SEQ ID NO: 4501349 - DNA, 14 bp, Homo sapiens
taaataaaagcaca

SEQ ID NO: 4501350 - DNA, 22 bp, Homo sapiens
taaataaaagcacaagtacttt

SEQ ID NO: 4501351 - DNA, 20 bp, Homo sapiens
taaataaaatttgttgcata

SEQ ID NO: 4501352 - DNA, 22 bp, Homo sapiens
taaataaactatttatatcaca

SEQ ID NO: 4501353 - DNA, 11 bp, Homo sapiens
taaataaatgt

SEQ ID NO: 4501354 - DNA, 13 bp, Homo sapiens
taaataaatttga

SEQ ID NO: 4501355 - DNA, 16 bp, Homo sapiens
taaataaatttgactt

SEQ ID NO: 4501356 - DNA, 13 bp, Homo sapiens
taaataacacaga

SEQ ID NO: 4501357 - DNA, 18 bp, Homo sapiens
taaataacacagatattg

SEQ ID NO: 4501358 - DNA, 22 bp, Homo sapiens
taaataagaaacaactctttga

SEQ ID NO: 4501359 - DNA, 16 bp, Homo sapiens
taaataagatgattta

SEQ ID NO: 4501360 - DNA, 17 bp, Homo sapiens
taaataaggaaaagctt

SEQ ID NO: 4501361 - DNA, 17 bp, Homo sapiens
taaataatttaactacc

SEQ ID NO: 4501362 - DNA, 12 bp, Homo sapiens
taaatacaatgg

SEQ ID NO: 4501363 - DNA, 19 bp, Homo sapiens
taaatacacatagcatgta

SEQ ID NO: 4501364 - DNA, 21 bp, Homo sapiens
taaatacacttcctgcttaaa

SEQ ID NO: 4501365 - DNA, 17 bp, Homo sapiens
taaatacaggaaacagt

SEQ ID NO: 4501366 - DNA, 23 bp, Homo sapiens
taaatacagtcttccatttgcaa

SEQ ID NO: 4501367 - DNA, 19 bp, Homo sapiens
taaatactctacttacagt

SEQ ID NO: 4501368 - DNA, 13 bp, Homo sapiens
taaatactgcaaa

SEQ ID NO: 4501369 - DNA, 15 bp, Homo sapiens
taaatactgtgaaat

SEQ ID NO: 4501370 - DNA, 16 bp, Homo sapiens
taaatagcactttttg

SEQ ID NO: 4501371 - DNA, 17 bp, Homo sapiens
taaatagcatttggaaa

SEQ ID NO: 4501372 - DNA, 15 bp, Homo sapiens
taaataggaaagttt

SEQ ID NO: 4501373 - DNA, 13 bp, Homo sapiens
taaatagtatttc

SEQ ID NO: 4501374 - DNA, 13 bp, Homo sapiens
taaatagttgctc

SEQ ID NO: 4501375 - DNA, 21 bp, Homo sapiens
taaatataccactctttacct

SEQ ID NO: 4501376 - DNA, 12 bp, Homo sapiens
taaatatatcta

SEQ ID NO: 4501377 - DNA, 14 bp, Homo sapiens
taaatatatgtatg

SEQ ID NO: 4501378 - DNA, 20 bp, Homo sapiens
taaatatatgtatgtaaaaa

SEQ ID NO: 4501379 - DNA, 16 bp, Homo sapiens
taaatatattttcttt

SEQ ID NO: 4501380 - DNA, 14 bp, Homo sapiens
taatagtactatta

SEQ ID NO: 4501381 - DNA, 17 bp, Homo sapiens
taatagtactattaaca

SEQ ID NO: 4501382 - DNA, 20 bp, Homo sapiens
taatagtctagaatgttatt

SEQ ID NO: 4501383 - DNA, 16 bp, Homo sapiens
taatagttctatcctt

SEQ ID NO: 4501384 - DNA, 16 bp, Homo sapiens
taatagtttttcactt

SEQ ID NO: 4501385 - DNA, 13 bp, Homo sapiens
taatataaatata

SEQ ID NO: 4501386 - DNA, 16 bp, Homo sapiens
taatataaatgttgct

SEQ ID NO: 4501387 - DNA, 19 bp, Homo sapiens
taatataccccaaattgtg

SEQ ID NO: 4501388 - DNA, 19 bp, Homo sapiens
taatatagaaaaaaacatt

SEQ ID NO: 4501389 - DNA, 16 bp, Homo sapiens
taatatagctgagact

SEQ ID NO: 4501390 - DNA, 11 bp, Homo sapiens
taatatataat

SEQ ID NO: 4501391 - DNA, 18 bp, Homo sapiens
taatatataatttaatgt

SEQ ID NO: 4501392 - DNA, 20 bp, Homo sapiens
taatatatcctgaaagcatt

SEQ ID NO: 4501393 - DNA, 12 bp, Homo sapiens
taatatatttat

SEQ ID NO: 4501394 - DNA, 17 bp, Homo sapiens
taatatatttatatact

SEQ ID NO: 4501395 - DNA, 19 bp, Homo sapiens
taatatatttatatacttt

SEQ ID NO: 4501396 - DNA, 13 bp, Homo sapiens
taatatattttct

SEQ ID NO: 4501397 - DNA, 21 bp, Homo sapiens
taatatcaaatgcagtatatt

SEQ ID NO: 4501398 - DNA, 16 bp, Homo sapiens
taatatcactcattaa

SEQ ID NO: 4501399 - DNA, 17 bp, Homo sapiens
taatatcactcattaat

SEQ ID NO: 4501400 - DNA, 15 bp, Homo sapiens
taatatctaaagtta

SEQ ID NO: 4501401 - DNA, 21 bp, Homo sapiens
taatatctaaagttatatttc

SEQ ID NO: 4501402 - DNA, 13 bp, Homo sapiens
taatatctttcag

SEQ ID NO: 4501403 - DNA, 14 bp, Homo sapiens
taatatctttcagt

SEQ ID NO: 4501404 - DNA, 15 bp, Homo sapiens
taatatctttcagtt

SEQ ID NO: 4501405 - DNA, 15 bp, Homo sapiens
taatatctttctgca

SEQ ID NO: 4501406 - DNA, 19 bp, Homo sapiens
taatatctttctgcacaca

SEQ ID NO: 4501407 - DNA, 22 bp, Homo sapiens
taatatgagcttcaatataaga

SEQ ID NO: 4501408 - DNA, 23 bp, Homo sapiens
taatatgagcttcaatataagaa

SEQ ID NO: 4501409 - DNA, 15 bp, Homo sapiens
taatatgattataca

SEQ ID NO: 4501410 - DNA, 16 bp, Homo sapiens
taatatgattatacaa

SEQ ID NO: 4501411 - DNA, 13 bp, Homo sapiens
taatatggaacct

SEQ ID NO: 4501412 - DNA, 12 bp, Homo sapiens
taatatgtcttt

SEQ ID NO: 4501413 - DNA, 13 bp, Homo sapiens
taatatgtctttt

SEQ ID NO: 4501414 - DNA, 19 bp, Homo sapiens
taatattacctaatgaaag

SEQ ID NO: 4501415 - DNA, 22 bp, Homo sapiens
taatattacctaatgaaagtga

SEQ ID NO: 4501416 - DNA, 18 bp, Homo sapiens
taatattcagccagctta

SEQ ID NO: 4501417 - DNA, 20 bp, Homo sapiens
taatattcagccagcttaaa

SEQ ID NO: 4501418 - DNA, 14 bp, Homo sapiens
taatattgagaaag

SEQ ID NO: 4501419 - DNA, 19 bp, Homo sapiens
taatattgtttttctttct

SEQ ID NO: 4501420 - DNA, 16 bp, Homo sapiens
taatatttacaatgta

SEQ ID NO: 4501421 - DNA, 16 bp, Homo sapiens
taatattttacataca

SEQ ID NO: 4501422 - DNA, 11 bp, Homo sapiens
taatcaagaga

SEQ ID NO: 4501423 - DNA, 15 bp, Homo sapiens
taatcaagagaaact

SEQ ID NO: 4501424 - DNA, 22 bp, Homo sapiens
taatcaagagaaacttcaaagt

SEQ ID NO: 4501425 - DNA, 21 bp, Homo sapiens
taatcaccctaccaactttac

SEQ ID NO: 4501426 - DNA, 15 bp, Homo sapiens
taatcacgctttcct

SEQ ID NO: 4501427 - DNA, 17 bp, Homo sapiens
taatcacgctttcctga

SEQ ID NO: 4501428 - DNA, 22 bp, Homo sapiens
taatcagattgcttaaaagcat

SEQ ID NO: 4501429 - DNA, 15 bp, Homo sapiens
taatcatacaaactc

SEQ ID NO: 4501430 - DNA, 18 bp, Homo sapiens
taatcatacaaactctca

SEQ ID NO: 4501431 - DNA, 18 bp, Homo sapiens
taatcatcaagtaataca

SEQ ID NO: 4501432 - DNA, 17 bp, Homo sapiens
taatcatgctcatgtat

SEQ ID NO: 4501433 - DNA, 19 bp, Homo sapiens
taatcatgctcatgtatat

SEQ ID NO: 4501434 - DNA, 16 bp, Homo sapiens
taatcattatttgaga

SEQ ID NO: 4501435 - DNA, 13 bp, Homo sapiens
taatcattcattt

SEQ ID NO: 4501436 - DNA, 18 bp, Homo sapiens
taatcattttaaattcca

SEQ ID NO: 4501437 - DNA, 19 bp, Homo sapiens
taatcattttaaattccac

SEQ ID NO: 4501438 - DNA, 17 bp, Homo sapiens
taatcattttcattcct

SEQ ID NO: 4501439 - DNA, 18 bp, Homo sapiens
taatcattttcattccta

SEQ ID NO: 4501440 - DNA, 14 bp, Homo sapiens
taatcccagcactt

SEQ ID NO: 4501441 - DNA, 21 bp, Homo sapiens
taatcccagcactttgggagg

SEQ ID NO: 4501442 - DNA, 14 bp, Homo sapiens
taatcccagctact

SEQ ID NO: 4501443 - DNA, 19 bp, Homo sapiens
taatccgaatctctttttg

SEQ ID NO: 4501444 - DNA, 21 bp, Homo sapiens
taatccgaatctctttttgct

SEQ ID NO: 4501445 - DNA, 15 bp, Homo sapiens
taatccttgataata

SEQ ID NO: 4501446 - DNA, 16 bp, Homo sapiens
taatccttgataatat

SEQ ID NO: 4501447 - DNA, 14 bp, Homo sapiens
taatccttttcctt

SEQ ID NO: 4501448 - DNA, 20 bp, Homo sapiens
taatccttttccttatttgc

SEQ ID NO: 4501449 - DNA, 18 bp, Homo sapiens
taatcgaagcaaaagtaa

SEQ ID NO: 4501450 - DNA, 16 bp, Homo sapiens
taatcggcccacagct

SEQ ID NO: 4501451 - DNA, 22 bp, Homo sapiens
taatcggcccacagctcccacc

SEQ ID NO: 4501452 - DNA, 16 bp, Homo sapiens
taatcgtttttgtttt

SEQ ID NO: 4501453 - DNA, 23 bp, Homo sapiens
taatctactgtatcaataaaatt

SEQ ID NO: 4501454 - DNA, 14 bp, Homo sapiens
taatctatttacat

SEQ ID NO: 4501455 - DNA, 16 bp, Homo sapiens
taatctcagtgctttc

SEQ ID NO: 4501456 - DNA, 21 bp, Homo sapiens
taatctcctctgctcattaaa

SEQ ID NO: 4501457 - DNA, 14 bp, Homo sapiens
taatctcttcttat

SEQ ID NO: 4501458 - DNA, 12 bp, Homo sapiens
taatctgcctgg

SEQ ID NO: 4501459 - DNA, 19 bp, Homo sapiens
taatctgcctggttttatt

SEQ ID NO: 4501460 - DNA, 13 bp, Homo sapiens
taatcttagtgta

SEQ ID NO: 4501461 - DNA, 15 bp, Homo sapiens
taatcttataattgt

SEQ ID NO: 4501462 - DNA, 14 bp, Homo sapiens
taatcttctgcctt

SEQ ID NO: 4501463 - DNA, 21 bp, Homo sapiens
taatctttcaaaccagcttca

SEQ ID NO: 4501464 - DNA, 23 bp, Homo sapiens
taatgaaaataaaacacacctcg

SEQ ID NO: 4501465 - DNA, 13 bp, Homo sapiens
taatgaaacaaag

SEQ ID NO: 4501466 - DNA, 19 bp, Homo sapiens
taatgaaatgataaagact

SEQ ID NO: 4501467 - DNA, 21 bp, Homo sapiens
taatgaaatgataaagacttt

SEQ ID NO: 4501468 - DNA, 17 bp, Homo sapiens
taatgaagaaagtggaa

SEQ ID NO: 4501469 - DNA, 23 bp, Homo sapiens
taatgaagaaagtggaaaacaag

SEQ ID NO: 4501470 - DNA, 14 bp, Homo sapiens
taatgaagaatcac

SEQ ID NO: 4501471 - DNA, 17 bp, Homo sapiens
taatgaagtattacatg

SEQ ID NO: 4501472 - DNA, 22 bp, Homo sapiens
taatgacaacacttaatagcaa

SEQ ID NO: 4501473 - DNA, 15 bp, Homo sapiens
taatgaccatgttat

SEQ ID NO: 4501474 - DNA, 14 bp, Homo sapiens
taatgacttttaaa

SEQ ID NO: 4501475 - DNA, 14 bp, Homo sapiens
taatgagaatagaa

SEQ ID NO: 4501476 - DNA, 15 bp, Homo sapiens
taatgagaatagaaa

SEQ ID NO: 4501477 - DNA, 16 bp, Homo sapiens
taatgagcatttcctt

SEQ ID NO: 4501478 - DNA, 13 bp, Homo sapiens
taatgagtttaaa

SEQ ID NO: 4501479 - DNA, 14 bp, Homo sapiens
taatgataaaacac

SEQ ID NO: 4501480 - DNA, 18 bp, Homo sapiens
taatgataactaaaatcc

SEQ ID NO: 4501481 - DNA, 18 bp, Homo sapiens
taatgatcgaaaaaataa

SEQ ID NO: 4501482 - DNA, 20 bp, Homo sapiens
taatgatcgaaaaaataatt

SEQ ID NO: 4501483 - DNA, 22 bp, Homo sapiens
taatgatgacaaaaaatgtttt

SEQ ID NO: 4501484 - DNA, 23 bp, Homo sapiens
taatgattaagggacatttctat

SEQ ID NO: 4501485 - DNA, 16 bp, Homo sapiens
taatgattcaaatgtt

SEQ ID NO: 4501486 - DNA, 23 bp, Homo sapiens
taatgcactctgggtctggccag

SEQ ID NO: 4501487 - DNA, 14 bp, Homo sapiens
taatgcactttcta

SEQ ID NO: 4501488 - DNA, 19 bp, Homo sapiens
taatgcattcttctctgtt

SEQ ID NO: 4501489 - DNA, 21 bp, Homo sapiens
taatgcattgttgtaaagtat

SEQ ID NO: 4501490 - DNA, 23 bp, Homo sapiens
taatgcctagcagagaactgcct

SEQ ID NO: 4501491 - DNA, 21 bp, Homo sapiens
taatgccttactcttcttgaa

SEQ ID NO: 4501492 - DNA, 14 bp, Homo sapiens
taatgcctttttgg

SEQ ID NO: 4501493 - DNA, 17 bp, Homo sapiens
taatgctatttgaacaa

SEQ ID NO: 4501494 - DNA, 14 bp, Homo sapiens
taatgctgttgcct

SEQ ID NO: 4501495 - DNA, 16 bp, Homo sapiens
taatgctttctgagtg

SEQ ID NO: 4501496 - DNA, 24 bp, Homo sapiens
taatgctttggaaaaatgggtctt

SEQ ID NO: 4501497 - DNA, 19 bp, Homo sapiens
taatggaagtgtatttatt

SEQ ID NO: 4501498 - DNA, 20 bp, Homo sapiens
taatggcagcagaaaacttg

SEQ ID NO: 4501499 - DNA, 19 bp, Homo sapiens
taatggcagctagtgcctt

SEQ ID NO: 4501500 - DNA, 20 bp, Homo sapiens
taatggcagctagtgccttt

SEQ ID NO: 4501501 - DNA, 19 bp, Homo sapiens
taacaagcatgcataaatc

SEQ ID NO: 4501502 - DNA, 22 bp, Homo sapiens
taacaagcatgcataaatcaat

SEQ ID NO: 4501503 - DNA, 18 bp, Homo sapiens
taacaatacatgagaaag

SEQ ID NO: 4501504 - DNA, 21 bp, Homo sapiens
taacaatacatgagaaagatg

SEQ ID NO: 4501505 - DNA, 17 bp, Homo sapiens
taacaatccattcacaa

SEQ ID NO: 4501506 - DNA, 18 bp, Homo sapiens
taacaatgcctattgtaa

SEQ ID NO: 4501507 - DNA, 20 bp, Homo sapiens
taacaattaattgtcttgca

SEQ ID NO: 4501508 - DNA, 13 bp, Homo sapiens
taacaattcctct

SEQ ID NO: 4501509 - DNA, 14 bp, Homo sapiens
taacacaaaggaag

SEQ ID NO: 4501510 - DNA, 12 bp, Homo sapiens
taacactaataa

SEQ ID NO: 4501511 - DNA, 16 bp, Homo sapiens
taacactaatatattt

SEQ ID NO: 4501512 - DNA, 23 bp, Homo sapiens
taacactaatatatttaaaaata

SEQ ID NO: 4501513 - DNA, 21 bp, Homo sapiens
taacactttagttatattcac

SEQ ID NO: 4501514 - DNA, 21 bp, Homo sapiens
taacactttccagcctatagc

SEQ ID NO: 4501515 - DNA, 17 bp, Homo sapiens
taacagaaattgtatat

SEQ ID NO: 4501516 - DNA, 16 bp, Homo sapiens
taacagagaaatagag

SEQ ID NO: 4501517 - DNA, 18 bp, Homo sapiens
taacagagctaagaaata

SEQ ID NO: 4501518 - DNA, 23 bp, Homo sapiens
taacagatgtgaaaatatacttg

SEQ ID NO: 4501519 - DNA, 15 bp, Homo sapiens
taacagccttttcct

SEQ ID NO: 4501520 - DNA, 18 bp, Homo sapiens
taacagggagaagtagct

SEQ ID NO: 4501521 - DNA, 15 bp, Homo sapiens
taacagggcagaaat

SEQ ID NO: 4501522 - DNA, 22 bp, Homo sapiens
taacaggtctagaaaaccagct

SEQ ID NO: 4501523 - DNA, 17 bp, Homo sapiens
taacagtgccattgtct

SEQ ID NO: 4501524 - DNA, 18 bp, Homo sapiens
taacagtgccattgtctt

SEQ ID NO: 4501525 - DNA, 19 bp, Homo sapiens
taacagtgccattgtcttt

SEQ ID NO: 4501526 - DNA, 21 bp, Homo sapiens
taacagtgccattgtctttat

SEQ ID NO: 4501527 - DNA, 22 bp, Homo sapiens
taacagtgccattgtctttata

SEQ ID NO: 4501528 - DNA, 23 bp, Homo sapiens
taacagtgccattgtctttatat

SEQ ID NO: 4501529 - DNA, 19 bp, Homo sapiens
taacagttgtatttaacag

SEQ ID NO: 4501530 - DNA, 23 bp, Homo sapiens
taacagttgtatttaacagaaat

SEQ ID NO: 4501531 - DNA, 15 bp, Homo sapiens
taacataaagaataa

SEQ ID NO: 4501532 - DNA, 19 bp, Homo sapiens
taacatcaatggctttgta

SEQ ID NO: 4501533 - DNA, 23 bp, Homo sapiens
taacatcttgaatactctgccct

SEQ ID NO: 4501534 - DNA, 20 bp, Homo sapiens
taacatctttattgaaattc

SEQ ID NO: 4501535 - DNA, 13 bp, Homo sapiens
taacatgcaataa

SEQ ID NO: 4501536 - DNA, 15 bp, Homo sapiens
taacatgcaataaca

SEQ ID NO: 4501537 - DNA, 17 bp, Homo sapiens
taacatgcaataacaag

SEQ ID NO: 4501538 - DNA, 15 bp, Homo sapiens
taacatgtaggaagt

SEQ ID NO: 4501539 - DNA, 22 bp, Homo sapiens
taacatgtcctgcctattatct

SEQ ID NO: 4501540 - DNA, 15 bp, Homo sapiens
taacattaaatcaca

SEQ ID NO: 4501541 - DNA, 16 bp, Homo sapiens
taacattatataacaa

SEQ ID NO: 4501542 - DNA, 16 bp, Homo sapiens
taacattatattgcaa

SEQ ID NO: 4501543 - DNA, 20 bp, Homo sapiens
taacattcctaaaatgcttc

SEQ ID NO: 4501544 - DNA, 13 bp, Homo sapiens
taacatttaaatt

SEQ ID NO: 4501545 - DNA, 14 bp, Homo sapiens
taacatttaaattc

SEQ ID NO: 4501546 - DNA, 12 bp, Homo sapiens
taacattttaca

SEQ ID NO: 4501547 - DNA, 15 bp, Homo sapiens
taacattttttaccc

SEQ ID NO: 4501548 - DNA, 21 bp, Homo sapiens
taaccaacagaacccacagta

SEQ ID NO: 4501549 - DNA, 18 bp, Homo sapiens
taaccacttcgcacacac

SEQ ID NO: 4501550 - DNA, 20 bp, Homo sapiens
taaccagacacatactcatt

SEQ ID NO: 4501551 - DNA, 22 bp, Homo sapiens
taaccagacacatactcatttt

SEQ ID NO: 4501552 - DNA, 20 bp, Homo sapiens
taaccagccagatcctcttg

SEQ ID NO: 4501553 - DNA, 23 bp, Homo sapiens
taaccagccctgcacgacccctg

SEQ ID NO: 4501554 - DNA, 16 bp, Homo sapiens
taaccagtacttctaa

SEQ ID NO: 4501555 - DNA, 17 bp, Homo sapiens
taaccagtacttctaag

SEQ ID NO: 4501556 - DNA, 14 bp, Homo sapiens
taaccatccccaac

SEQ ID NO: 4501557 - DNA, 16 bp, Homo sapiens
taaccatccccaactc

SEQ ID NO: 4501558 - DNA, 14 bp, Homo sapiens
taacccacctctcc

SEQ ID NO: 4501559 - DNA, 22 bp, Homo sapiens
taacccacctctcctgccctgt

SEQ ID NO: 4501560 - DNA, 12 bp, Homo sapiens
taaccccaggcc

SEQ ID NO: 4501561 - DNA, 13 bp, Homo sapiens
taaccccaggccc

SEQ ID NO: 4501562 - DNA, 14 bp, Homo sapiens
taaccccaggcccc

SEQ ID NO: 4501563 - DNA, 21 bp, Homo sapiens
taaccccagggcactgccagc

SEQ ID NO: 4501564 - DNA, 12 bp, Homo sapiens
taacccctttcc

SEQ ID NO: 4501565 - DNA, 13 bp, Homo sapiens
taacccctttcct

SEQ ID NO: 4501566 - DNA, 20 bp, Homo sapiens
taacctagttaaagaaagga

SEQ ID NO: 4501567 - DNA, 16 bp, Homo sapiens
taacctcgggcctgct

SEQ ID NO: 4501568 - DNA, 17 bp, Homo sapiens
taacctgttatttctat

SEQ ID NO: 4501569 - DNA, 20 bp, Homo sapiens
taaccttaaaattgatatta

SEQ ID NO: 4501570 - DNA, 13 bp, Homo sapiens
taaccttagagct

SEQ ID NO: 4501571 - DNA, 21 bp, Homo sapiens
taaccttatcctgcattgtta

SEQ ID NO: 4501572 - DNA, 14 bp, Homo sapiens
taacggtgctaaaa

SEQ ID NO: 4501573 - DNA, 23 bp, Homo sapiens
taactaaaatgtatctaagaata

SEQ ID NO: 4501574 - DNA, 13 bp, Homo sapiens
taactaaatgctc

SEQ ID NO: 4501575 - DNA, 19 bp, Homo sapiens
taactaaattttaaagcca

SEQ ID NO: 4501576 - DNA, 16 bp, Homo sapiens
taactaacatgtcctg

SEQ ID NO: 4501577 - DNA, 15 bp, Homo sapiens
taactacatctgcct

SEQ ID NO: 4501578 - DNA, 16 bp, Homo sapiens
taactacatctgcctc

SEQ ID NO: 4501579 - DNA, 14 bp, Homo sapiens
taactactttataa

SEQ ID NO: 4501580 - DNA, 15 bp, Homo sapiens
taactaggctcagag

SEQ ID NO: 4501581 - DNA, 16 bp, Homo sapiens
taactaggctcagaga

SEQ ID NO: 4501582 - DNA, 19 bp, Homo sapiens
taactaggctcagagatgt

SEQ ID NO: 4501583 - DNA, 20 bp, Homo sapiens
taactataagatacaataaa

SEQ ID NO: 4501584 - DNA, 13 bp, Homo sapiens
taactatgtaata

SEQ ID NO: 4501585 - DNA, 18 bp, Homo sapiens
taactattcctgtgtaaa

SEQ ID NO: 4501586 - DNA, 23 bp, Homo sapiens
taactattgcatttatatgtacc

SEQ ID NO: 4501587 - DNA, 18 bp, Homo sapiens
taactatttttcctcatt

SEQ ID NO: 4501588 - DNA, 18 bp, Homo sapiens
taactatttttttcaaag

SEQ ID NO: 4501589 - DNA, 23 bp, Homo sapiens
taactcaaggataccttcttatt

SEQ ID NO: 4501590 - DNA, 14 bp, Homo sapiens
taactccactgctt

SEQ ID NO: 4501591 - DNA, 14 bp, Homo sapiens
taactcctgtccct

SEQ ID NO: 4501592 - DNA, 14 bp, Homo sapiens
taactctctttatg

SEQ ID NO: 4501593 - DNA, 21 bp, Homo sapiens
taactctgcactactcctctg

SEQ ID NO: 4501594 - DNA, 16 bp, Homo sapiens
taactctgcatagaca

SEQ ID NO: 4501595 - DNA, 18 bp, Homo sapiens
taactctgtataatagag

SEQ ID NO: 4501596 - DNA, 13 bp, Homo sapiens
taactctttgaaa

SEQ ID NO: 4501597 - DNA, 16 bp, Homo sapiens
taactgaaggagaagg

SEQ ID NO: 4501598 - DNA, 13 bp, Homo sapiens
taactgaatttgg

SEQ ID NO: 4501599 - DNA, 15 bp, Homo sapiens
taactgactctgtta

SEQ ID NO: 4501600 - DNA, 17 bp, Homo sapiens
taactgattaaaaatac

SEQ ID NO: 4501601 - DNA, 19 bp, Homo sapiens
taactgattacctgccaat

SEQ ID NO: 4501602 - DNA, 19 bp, Homo sapiens
taactgatttctatggctt

SEQ ID NO: 4501603 - DNA, 21 bp, Homo sapiens
taactgatttctatggctttc

SEQ ID NO: 4501604 - DNA, 16 bp, Homo sapiens
taactgcatttttaga

SEQ ID NO: 4501605 - DNA, 17 bp, Homo sapiens
taactgccgtaatttaa

SEQ ID NO: 4501606 - DNA, 14 bp, Homo sapiens
taactgctttctgt

SEQ ID NO: 4501607 - DNA, 17 bp, Homo sapiens
taactgctttctgttcc

SEQ ID NO: 4501608 - DNA, 20 bp, Homo sapiens
taactgggtaatgaaacaaa

SEQ ID NO: 4501609 - DNA, 20 bp, Homo sapiens
taactgtatatttgtatgat

SEQ ID NO: 4501610 - DNA, 12 bp, Homo sapiens
taactgtatttg

SEQ ID NO: 4501611 - DNA, 23 bp, Homo sapiens
taactgtccgtagtatcagagat

SEQ ID NO: 4501612 - DNA, 13 bp, Homo sapiens
taactgtcttgtt

SEQ ID NO: 4501613 - DNA, 20 bp, Homo sapiens
taactgtcttgtttcagtga

SEQ ID NO: 4501614 - DNA, 20 bp, Homo sapiens
taactgttacagtaatgtca

SEQ ID NO: 4501615 - DNA, 19 bp, Homo sapiens
taactgttagtattaacta

SEQ ID NO: 4501616 - DNA, 19 bp, Homo sapiens
taactgtttatatgtgttg

SEQ ID NO: 4501617 - DNA, 22 bp, Homo sapiens
taacttaaaaaactgcatccca

SEQ ID NO: 4501618 - DNA, 17 bp, Homo sapiens
taacttattacctcagg

SEQ ID NO: 4501619 - DNA, 17 bp, Homo sapiens
taacttattcaaagaga

SEQ ID NO: 4501620 - DNA, 15 bp, Homo sapiens
taacttcatattaat

SEQ ID NO: 4501621 - DNA, 20 bp, Homo sapiens
taacttccactgttaaaata

SEQ ID NO: 4501622 - DNA, 20 bp, Homo sapiens
taacttcctgtgcctttcct

SEQ ID NO: 4501623 - DNA, 21 bp, Homo sapiens
taacttccttggactcatttt

SEQ ID NO: 4501624 - DNA, 17 bp, Homo sapiens
taacttcgaatatatct

SEQ ID NO: 4501625 - DNA, 19 bp, Homo sapiens
taacttcttatggaattga

SEQ ID NO: 4501626 - DNA, 14 bp, Homo sapiens
taacttcttgaaaa

SEQ ID NO: 4501627 - DNA, 17 bp, Homo sapiens
taacttcttgaaaaaga

SEQ ID NO: 4501628 - DNA, 17 bp, Homo sapiens
taacttgaaaagaaaac

SEQ ID NO: 4501629 - DNA, 22 bp, Homo sapiens
taacttgagagtagatggtttg

SEQ ID NO: 4501630 - DNA, 20 bp, Homo sapiens
taacttgcttaaatttctta

SEQ ID NO: 4501631 - DNA, 21 bp, Homo sapiens
taacttgtattttgtcacttt

SEQ ID NO: 4501632 - DNA, 23 bp, Homo sapiens
taactttcgaccgactttcccca

SEQ ID NO: 4501633 - DNA, 13 bp, Homo sapiens
taactttctctta

SEQ ID NO: 4501634 - DNA, 13 bp, Homo sapiens
taactttctgggt

SEQ ID NO: 4501635 - DNA, 20 bp, Homo sapiens
taacttttgtaaatacacat

SEQ ID NO: 4501636 - DNA, 13 bp, Homo sapiens
taacttttgtttt

SEQ ID NO: 4501637 - DNA, 21 bp, Homo sapiens
taacttttgtttttttttgtt

SEQ ID NO: 4501638 - DNA, 17 bp, Homo sapiens
taactttttgtttttat

SEQ ID NO: 4501639 - DNA, 21 bp, Homo sapiens
taactttttgtttttatttct

SEQ ID NO: 4501640 - DNA, 17 bp, Homo sapiens
taagaaaaaaagcaaaa

SEQ ID NO: 4501641 - DNA, 16 bp, Homo sapiens
taagaaaaaaagcaca

SEQ ID NO: 4501642 - DNA, 21 bp, Homo sapiens
taagaaaaaaagcacaaagtt

SEQ ID NO: 4501643 - DNA, 15 bp, Homo sapiens
taagaaaaacaataa

SEQ ID NO: 4501644 - DNA, 14 bp, Homo sapiens
taagaaaaaggaaa

SEQ ID NO: 4501645 - DNA, 12 bp, Homo sapiens
taagaaaagtaa

SEQ ID NO: 4501646 - DNA, 14 bp, Homo sapiens
taagaaaatgttac

SEQ ID NO: 4501647 - DNA, 13 bp, Homo sapiens
taagaaacactca

SEQ ID NO: 4501648 - DNA, 19 bp, Homo sapiens
taagaaaccttgctctcct

SEQ ID NO: 4501649 - DNA, 20 bp, Homo sapiens
taagaaaggaagcattgtaa

SEQ ID NO: 4501650 - DNA, 13 bp, Homo sapiens
taagaaaggaagt

SEQ ID NO: 4501651 - DNA, 18 bp, Homo sapiens
taagaacaaaagcgaccc

SEQ ID NO: 4501652 - DNA, 12 bp, Homo sapiens
taagaacagatc

SEQ ID NO: 4501653 - DNA, 18 bp, Homo sapiens
taagaaccattgatttaa

SEQ ID NO: 4501654 - DNA, 12 bp, Homo sapiens
taagaactgtac

SEQ ID NO: 4501655 - DNA, 12 bp, Homo sapiens
taagaactgtgt

SEQ ID NO: 4501656 - DNA, 14 bp, Homo sapiens
taagaagacatttt

SEQ ID NO: 4501657 - DNA, 16 bp, Homo sapiens
taagaagcaatctttg

SEQ ID NO: 4501658 - DNA, 15 bp, Homo sapiens
taagaaggcaatatt

SEQ ID NO: 4501659 - DNA, 22 bp, Homo sapiens
taagaagggtgggagtggggcc

SEQ ID NO: 4501660 - DNA, 18 bp, Homo sapiens
taagaagtgaaaatctac

SEQ ID NO: 4501661 - DNA, 16 bp, Homo sapiens
taagaatatttttaga

SEQ ID NO: 4501662 - DNA, 23 bp, Homo sapiens
taagaatatttttagactatttc

SEQ ID NO: 4501663 - DNA, 22 bp, Homo sapiens
taagaatgtcaggaatttaaga

SEQ ID NO: 4501664 - DNA, 17 bp, Homo sapiens
taagaattattttgatg

SEQ ID NO: 4501665 - DNA, 20 bp, Homo sapiens
taagaattcaaatttgtaat

SEQ ID NO: 4501666 - DNA, 16 bp, Homo sapiens
taagaattcagacatc

SEQ ID NO: 4501667 - DNA, 13 bp, Homo sapiens
taagaatttctgc

SEQ ID NO: 4501668 - DNA, 23 bp, Homo sapiens
taagaatttgaggtctacattct

SEQ ID NO: 4501669 - DNA, 17 bp, Homo sapiens
taagaatttgtttaaat

SEQ ID NO: 4501670 - DNA, 20 bp, Homo sapiens
taagaatttgtttaaattag

SEQ ID NO: 4501671 - DNA, 16 bp, Homo sapiens
taagacaagaacattc

SEQ ID NO: 4501672 - DNA, 16 bp, Homo sapiens
taagacaagagatcta

SEQ ID NO: 4501673 - DNA, 20 bp, Homo sapiens
taagacaatagtatttctcc

SEQ ID NO: 4501674 - DNA, 22 bp, Homo sapiens
taagacaatggaccctttttgt

SEQ ID NO: 4501675 - DNA, 17 bp, Homo sapiens
taagacagcatgtgtta

SEQ ID NO: 4501676 - DNA, 16 bp, Homo sapiens
taagacatgatttcct

SEQ ID NO: 4501677 - DNA, 17 bp, Homo sapiens
taagacatgatttcctt

SEQ ID NO: 4501678 - DNA, 20 bp, Homo sapiens
taagacatgatttccttgaa

SEQ ID NO: 4501679 - DNA, 20 bp, Homo sapiens
taagacattttgtttttact

SEQ ID NO: 4501680 - DNA, 22 bp, Homo sapiens
taagacattttgtttttactgt

SEQ ID NO: 4501681 - DNA, 14 bp, Homo sapiens
taagacatttttca

SEQ ID NO: 4501682 - DNA, 16 bp, Homo sapiens
taagacatttttcatt

SEQ ID NO: 4501683 - DNA, 14 bp, Homo sapiens
taagacgtgaatgt

SEQ ID NO: 4501684 - DNA, 13 bp, Homo sapiens
taagactactaag

SEQ ID NO: 4501685 - DNA, 23 bp, Homo sapiens
taagactcgcggcaggttctctt

SEQ ID NO: 4501686 - DNA, 22 bp, Homo sapiens
taagactctgtgtggctgtgca

SEQ ID NO: 4501687 - DNA, 14 bp, Homo sapiens
taagactgctgcag

SEQ ID NO: 4501688 - DNA, 20 bp, Homo sapiens
taagagaaaagagagaaaca

SEQ ID NO: 4501689 - DNA, 15 bp, Homo sapiens
taagagaagttgtaa

SEQ ID NO: 4501690 - DNA, 18 bp, Homo sapiens
taagagacagttctctgt

SEQ ID NO: 4501691 - DNA, 15 bp, Homo sapiens
taagagatgggacta

SEQ ID NO: 4501692 - DNA, 18 bp, Homo sapiens
taagagctagcgctgccg

SEQ ID NO: 4501693 - DNA, 21 bp, Homo sapiens
taagagctattttagaaagct

SEQ ID NO: 4501694 - DNA, 16 bp, Homo sapiens
taagagggctttttaa

SEQ ID NO: 4501695 - DNA, 13 bp, Homo sapiens
taagataaaataa

SEQ ID NO: 4501696 - DNA, 21 bp, Homo sapiens
taagatacactgcactttgtt

SEQ ID NO: 4501697 - DNA, 22 bp, Homo sapiens
taagatacactgcactttgttt

SEQ ID NO: 4501698 - DNA, 16 bp, Homo sapiens
taagatagtgtaactt

SEQ ID NO: 4501699 - DNA, 15 bp, Homo sapiens
taagatatttgcagt

SEQ ID NO: 4501700 - DNA, 22 bp, Homo sapiens
taagatatttgcagtttttcat

SEQ ID NO: 4501701 - DNA, 15 bp, Homo sapiens
taagatccagaaata

SEQ ID NO: 4501702 - DNA, 15 bp, Homo sapiens
taagatcctaaactc

SEQ ID NO: 4501703 - DNA, 21 bp, Homo sapiens
taagatgagcaaccacattta

SEQ ID NO: 4501704 - DNA, 16 bp, Homo sapiens
taagatgtacatttaa

SEQ ID NO: 4501705 - DNA, 17 bp, Homo sapiens
taagatgtacatttaat

SEQ ID NO: 4501706 - DNA, 23 bp, Homo sapiens
taagattaataagatttttcaaa

SEQ ID NO: 4501707 - DNA, 16 bp, Homo sapiens
taagattatctgggga

SEQ ID NO: 4501708 - DNA, 15 bp, Homo sapiens
taagattcttttaaa

SEQ ID NO: 4501709 - DNA, 18 bp, Homo sapiens
taagattgcgcctgagat

SEQ ID NO: 4501710 - DNA, 23 bp, Homo sapiens
taagattggtgttcgtttccatc

SEQ ID NO: 4501711 - DNA, 19 bp, Homo sapiens
taagattgttattaaatgt

SEQ ID NO: 4501712 - DNA, 21 bp, Homo sapiens
taagatttagttgagttattc

SEQ ID NO: 4501713 - DNA, 17 bp, Homo sapiens
taagatttctttatgtg

SEQ ID NO: 4501714 - DNA, 23 bp, Homo sapiens
taagatttgtgtttttctttttc

SEQ ID NO: 4501715 - DNA, 23 bp, Homo sapiens
taagcaaaaacaaaaagaaaaga

SEQ ID NO: 4501716 - DNA, 17 bp, Homo sapiens
taagcaacttgcttcta

SEQ ID NO: 4501717 - DNA, 18 bp, Homo sapiens
taagcaatggtaattgtg

SEQ ID NO: 4501718 - DNA, 22 bp, Homo sapiens
taagcaccagtgggactgtggt

SEQ ID NO: 4501719 - DNA, 24 bp, Homo sapiens
taagcaccagtgggactgtggtga

SEQ ID NO: 4501720 - DNA, 20 bp, Homo sapiens
taagcagaccactgataaaa

SEQ ID NO: 4501721 - DNA, 17 bp, Homo sapiens
taagcaggtttgttttc

SEQ ID NO: 4501722 - DNA, 12 bp, Homo sapiens
taagcagtatat

SEQ ID NO: 4501723 - DNA, 21 bp, Homo sapiens
taagcagtatattagtattat

SEQ ID NO: 4501724 - DNA, 14 bp, Homo sapiens
taagcataatctga

SEQ ID NO: 4501725 - DNA, 19 bp, Homo sapiens
taagcatactttgtaaata

SEQ ID NO: 4501726 - DNA, 17 bp, Homo sapiens
taagcatgtgtcccagg

SEQ ID NO: 4501727 - DNA, 19 bp, Homo sapiens
taagcattaccactcaggc

SEQ ID NO: 4501728 - DNA, 14 bp, Homo sapiens
taagcattgcctgg

SEQ ID NO: 4501729 - DNA, 12 bp, Homo sapiens
taagccaaagaa

SEQ ID NO: 4501730 - DNA, 20 bp, Homo sapiens
taagccaaagaaatgaacat

SEQ ID NO: 4501731 - DNA, 17 bp, Homo sapiens
taagccacttaaaatgt

SEQ ID NO: 4501732 - DNA, 21 bp, Homo sapiens
taagccagacatcaacagata

SEQ ID NO: 4501733 - DNA, 13 bp, Homo sapiens
taagccagagcct

SEQ ID NO: 4501734 - DNA, 15 bp, Homo sapiens
taagccagagcctgg

SEQ ID NO: 4501735 - DNA, 13 bp, Homo sapiens
taagccaggcctg

SEQ ID NO: 4501736 - DNA, 17 bp, Homo sapiens
taagccaggcctggctg

SEQ ID NO: 4501737 - DNA, 18 bp, Homo sapiens
taagcccacagtatattt

SEQ ID NO: 4501738 - DNA, 16 bp, Homo sapiens
taagcctaaaagtggg

SEQ ID NO: 4501739 - DNA, 20 bp, Homo sapiens
taagcctttgccgtgagcat

SEQ ID NO: 4501740 - DNA, 16 bp, Homo sapiens
taagctactgccatcc

SEQ ID NO: 4501741 - DNA, 18 bp, Homo sapiens
taagctactgccatcctg

SEQ ID NO: 4501742 - DNA, 20 bp, Homo sapiens
taagctcaggatatggctta

SEQ ID NO: 4501743 - DNA, 23 bp, Homo sapiens
taagctgcaaatctgatggcctt

SEQ ID NO: 4501744 - DNA, 22 bp, Homo sapiens
taagctgttcctgttcagtaat

SEQ ID NO: 4501745 - DNA, 19 bp, Homo sapiens
taagcttaacatttcatgt

SEQ ID NO: 4501746 - DNA, 12 bp, Homo sapiens
taagcttttatt

SEQ ID NO: 4501747 - DNA, 13 bp, Homo sapiens
taagctttttgga

SEQ ID NO: 4501748 - DNA, 22 bp, Homo sapiens
taaggaaacttctgatgtttat

SEQ ID NO: 4501749 - DNA, 18 bp, Homo sapiens
taaggaaactttttaatt

SEQ ID NO: 4501750 - DNA, 20 bp, Homo sapiens
taaggaaatattaagagcta

SEQ ID NO: 4501751 - DNA, 14 bp, Homo sapiens
taaggaaccaacaa

SEQ ID NO: 4501752 - DNA, 15 bp, Homo sapiens
taaggaaccttcctt

SEQ ID NO: 4501753 - DNA, 19 bp, Homo sapiens
taaggaaccttccttcctg

SEQ ID NO: 4501754 - DNA, 19 bp, Homo sapiens
taaggaagtatcagcacta

SEQ ID NO: 4501755 - DNA, 13 bp, Homo sapiens
taaggactgcatg

SEQ ID NO: 4501756 - DNA, 22 bp, Homo sapiens
taaggagagttcaagcctgtgg

SEQ ID NO: 4501757 - DNA, 18 bp, Homo sapiens
taaggagattctgtgtat

SEQ ID NO: 4501758 - DNA, 20 bp, Homo sapiens
taaggaggggaaaaaaatgt

SEQ ID NO: 4501759 - DNA, 14 bp, Homo sapiens
taaggagtatacca

SEQ ID NO: 4501760 - DNA, 13 bp, Homo sapiens
taaggatgtgtga

SEQ ID NO: 4501761 - DNA, 19 bp, Homo sapiens
taaggattctgaagtttta

SEQ ID NO: 4501762 - DNA, 12 bp, Homo sapiens
taaggcagctga

SEQ ID NO: 4501763 - DNA, 21 bp, Homo sapiens
taaggcaggaggatcacttga

SEQ ID NO: 4501764 - DNA, 15 bp, Homo sapiens
taaggcagtagttct

SEQ ID NO: 4501765 - DNA, 16 bp, Homo sapiens
taaggcccactgtaat

SEQ ID NO: 4501766 - DNA, 23 bp, Homo sapiens
taaggccttttatgtaatttctt

SEQ ID NO: 4501767 - DNA, 13 bp, Homo sapiens
taaggctcctcct

SEQ ID NO: 4501768 - DNA, 17 bp, Homo sapiens
taagggaaaagataaag

SEQ ID NO: 4501769 - DNA, 15 bp, Homo sapiens
taagggacatttcta

SEQ ID NO: 4501770 - DNA, 20 bp, Homo sapiens
taagggagggaaggggaatg

SEQ ID NO: 4501771 - DNA, 13 bp, Homo sapiens
taagggcatttta

SEQ ID NO: 4501772 - DNA, 16 bp, Homo sapiens
taagggcccaggtcag

SEQ ID NO: 4501773 - DNA, 22 bp, Homo sapiens
taagggcttgtttttcttcagc

SEQ ID NO: 4501774 - DNA, 18 bp, Homo sapiens
taaggtacaagaagcatt

SEQ ID NO: 4501775 - DNA, 13 bp, Homo sapiens
taaggtacatcat

SEQ ID NO: 4501776 - DNA, 17 bp, Homo sapiens
taaggtacatcattatt

SEQ ID NO: 4501777 - DNA, 19 bp, Homo sapiens
taaggtacatcattattgt

SEQ ID NO: 4501778 - DNA, 21 bp, Homo sapiens
taaggtacatcattattgtag

SEQ ID NO: 4501779 - DNA, 22 bp, Homo sapiens
taaggtacatcattattgtagt

SEQ ID NO: 4501780 - DNA, 16 bp, Homo sapiens
taaggtcattaaaaca

SEQ ID NO: 4501781 - DNA, 22 bp, Homo sapiens
taaggtctcatgctgttgctgc

SEQ ID NO: 4501782 - DNA, 13 bp, Homo sapiens
taaggtgccttct

SEQ ID NO: 4501783 - DNA, 17 bp, Homo sapiens
taaggtgcttgctcccc

SEQ ID NO: 4501784 - DNA, 23 bp, Homo sapiens
taaggtgggagaattgcttgagc

SEQ ID NO: 4501785 - DNA, 18 bp, Homo sapiens
taaggttacctttgttcc

SEQ ID NO: 4501786 - DNA, 16 bp, Homo sapiens
taagtaaaaccacagc

SEQ ID NO: 4501787 - DNA, 12 bp, Homo sapiens
taagtaaatgta

SEQ ID NO: 4501788 - DNA, 19 bp, Homo sapiens
taagtaatatcaaagcatt

SEQ ID NO: 4501789 - DNA, 16 bp, Homo sapiens
taagtaatatctttca

SEQ ID NO: 4501790 - DNA, 12 bp, Homo sapiens
taagtaattatg

SEQ ID NO: 4501791 - DNA, 15 bp, Homo sapiens
taagtaatttagaag

SEQ ID NO: 4501792 - DNA, 17 bp, Homo sapiens
taagtaatttagaagat

SEQ ID NO: 4501793 - DNA, 16 bp, Homo sapiens
taagtactgtttacca

SEQ ID NO: 4501794 - DNA, 16 bp, Homo sapiens
taagtagcattcatgt

SEQ ID NO: 4501795 - DNA, 14 bp, Homo sapiens
taagtataaacctt

SEQ ID NO: 4501796 - DNA, 19 bp, Homo sapiens
taagtatgttttttatgtt

SEQ ID NO: 4501797 - DNA, 13 bp, Homo sapiens
taagtatttcaaa

SEQ ID NO: 4501798 - DNA, 19 bp, Homo sapiens
taagtccctgtcacctctt

SEQ ID NO: 4501799 - DNA, 22 bp, Homo sapiens
taagtctatctggtattaaatg

SEQ ID NO: 4501800 - DNA, 16 bp, Homo sapiens
taagtctgatgttctt

SEQ ID NO: 4501801 - DNA, 10 bp, Homo sapiens
taagtgacat

SEQ ID NO: 4501802 - DNA, 19 bp, Homo sapiens
taagtgcctcacatttttt

SEQ ID NO: 4501803 - DNA, 16 bp, Homo sapiens
taagtgcctccaagtt

SEQ ID NO: 4501804 - DNA, 20 bp, Homo sapiens
taagtgcctccaagttcaaa

SEQ ID NO: 4501805 - DNA, 13 bp, Homo sapiens
taagtggctgctg

SEQ ID NO: 4501806 - DNA, 22 bp, Homo sapiens
taagtggttctttggttccagt

SEQ ID NO: 4501807 - DNA, 13 bp, Homo sapiens
taagtgtgtataa

SEQ ID NO: 4501808 - DNA, 19 bp, Homo sapiens
taagtgtgtataaaacatt

SEQ ID NO: 4501809 - DNA, 18 bp, Homo sapiens
taagtgttcattttaagt

SEQ ID NO: 4501810 - DNA, 20 bp, Homo sapiens
taagttaatgtatataaaaa

SEQ ID NO: 4501811 - DNA, 21 bp, Homo sapiens
taagttacacatttttcagat

SEQ ID NO: 4501812 - DNA, 16 bp, Homo sapiens
taagttatgtgtgtgg

SEQ ID NO: 4501813 - DNA, 12 bp, Homo sapiens
taagttattgca

SEQ ID NO: 4501814 - DNA, 14 bp, Homo sapiens
taagttattgcagt

SEQ ID NO: 4501815 - DNA, 18 bp, Homo sapiens
taagttattttacctgtt

SEQ ID NO: 4501816 - DNA, 12 bp, Homo sapiens
taagttcttatg

SEQ ID NO: 4501817 - DNA, 20 bp, Homo sapiens
taagttgacaccacttagat

SEQ ID NO: 4501818 - DNA, 17 bp, Homo sapiens
taagttgtcaaagaagc

SEQ ID NO: 4501819 - DNA, 12 bp, Homo sapiens
taagttgtctgt

SEQ ID NO: 4501820 - DNA, 16 bp, Homo sapiens
taagtttctttagaaa

SEQ ID NO: 4501821 - DNA, 20 bp, Homo sapiens
taagtttgcaacatttattg

SEQ ID NO: 4501822 - DNA, 23 bp, Homo sapiens
taagtttttctctttttcagaca

SEQ ID NO: 4501823 - DNA, 13 bp, Homo sapiens
taataaaaagatt

SEQ ID NO: 4501824 - DNA, 13 bp, Homo sapiens
taataaaataagt

SEQ ID NO: 4501825 - DNA, 13 bp, Homo sapiens
taataaaatatct

SEQ ID NO: 4501826 - DNA, 16 bp, Homo sapiens
taataaagaagctact

SEQ ID NO: 4501827 - DNA, 13 bp, Homo sapiens
taataaagtattc

SEQ ID NO: 4501828 - DNA, 12 bp, Homo sapiens
taataaagtgaa

SEQ ID NO: 4501829 - DNA, 21 bp, Homo sapiens
taataaagtgaactttgtttt

SEQ ID NO: 4501830 - DNA, 16 bp, Homo sapiens
taataaagtgttttca

SEQ ID NO: 4501831 - DNA, 19 bp, Homo sapiens
taataaagtgttttcagag

SEQ ID NO: 4501832 - DNA, 20 bp, Homo sapiens
taataaagtgttttcagagc

SEQ ID NO: 4501833 - DNA, 21 bp, Homo sapiens
taataaatctaggatgtgatg

SEQ ID NO: 4501834 - DNA, 22 bp, Homo sapiens
taataactttctctgtgaaagc

SEQ ID NO: 4501835 - DNA, 15 bp, Homo sapiens
taataagtgacaaat

SEQ ID NO: 4501836 - DNA, 15 bp, Homo sapiens
taataatatcaaaga

SEQ ID NO: 4501837 - DNA, 17 bp, Homo sapiens
taataatcattttagaa

SEQ ID NO: 4501838 - DNA, 18 bp, Homo sapiens
taataatcattttagaat

SEQ ID NO: 4501839 - DNA, 18 bp, Homo sapiens
taataatgccaatgaaca

SEQ ID NO: 4501840 - DNA, 19 bp, Homo sapiens
taataatgccaatgaacat

SEQ ID NO: 4501841 - DNA, 14 bp, Homo sapiens
taataatgtacaga

SEQ ID NO: 4501842 - DNA, 18 bp, Homo sapiens
taataatttttgctgaat

SEQ ID NO: 4501843 - DNA, 14 bp, Homo sapiens
taatacaaactaat

SEQ ID NO: 4501844 - DNA, 21 bp, Homo sapiens
taatacagcaacaatttatga

SEQ ID NO: 4501845 - DNA, 13 bp, Homo sapiens
taatacaggaaat

SEQ ID NO: 4501846 - DNA, 20 bp, Homo sapiens
taatacatcacatcttattt

SEQ ID NO: 4501847 - DNA, 21 bp, Homo sapiens
taatacgtgccagatataact

SEQ ID NO: 4501848 - DNA, 14 bp, Homo sapiens
taatactaccttga

SEQ ID NO: 4501849 - DNA, 15 bp, Homo sapiens
taatactaccttgaa

SEQ ID NO: 4501850 - DNA, 13 bp, Homo sapiens
taatactttttaa

SEQ ID NO: 4501851 - DNA, 14 bp, Homo sapiens
taatagaaatgcat

SEQ ID NO: 4501852 - DNA, 12 bp, Homo sapiens
taatagaacttg

SEQ ID NO: 4501853 - DNA, 17 bp, Homo sapiens
taatagaggagctgctt

SEQ ID NO: 4501854 - DNA, 22 bp, Homo sapiens
taatagatggggcatataataa

SEQ ID NO: 4501855 - DNA, 14 bp, Homo sapiens
taatagatgtttga

SEQ ID NO: 4501856 - DNA, 22 bp, Homo sapiens
taatagatgtttgatagatttt

SEQ ID NO: 4501857 - DNA, 17 bp, Homo sapiens
taatagccaaagatttc

SEQ ID NO: 4501858 - DNA, 15 bp, Homo sapiens
taataggcattttaa

SEQ ID NO: 4501859 - DNA, 18 bp, Homo sapiens
taataggcattttaagta

SEQ ID NO: 4501860 - DNA, 21 bp, Homo sapiens
taataggcattttaagtaaaa

SEQ ID NO: 4501861 - DNA, 18 bp, Homo sapiens
taatagggaaaattctaa

SEQ ID NO: 4501862 - DNA, 16 bp, Homo sapiens
taatttgtttccagca

SEQ ID NO: 4501863 - DNA, 22 bp, Homo sapiens
taattttacatgtttataaatc

SEQ ID NO: 4501864 - DNA, 13 bp, Homo sapiens
taattttactcac

SEQ ID NO: 4501865 - DNA, 16 bp, Homo sapiens
taattttagtttttca

SEQ ID NO: 4501866 - DNA, 19 bp, Homo sapiens
taattttattttaaaattt

SEQ ID NO: 4501867 - DNA, 17 bp, Homo sapiens
taattttcctaataaag

SEQ ID NO: 4501868 - DNA, 22 bp, Homo sapiens
taattttctctttgtatgtctg

SEQ ID NO: 4501869 - DNA, 18 bp, Homo sapiens
taattttgaagtgctgtt

SEQ ID NO: 4501870 - DNA, 22 bp, Homo sapiens
taattttgaagtgctgtttatt

SEQ ID NO: 4501871 - DNA, 20 bp, Homo sapiens
taattttgacactgaaataa

SEQ ID NO: 4501872 - DNA, 12 bp, Homo sapiens
taattttgcaaa

SEQ ID NO: 4501873 - DNA, 18 bp, Homo sapiens
taatttttatttcttcct

SEQ ID NO: 4501874 - DNA, 21 bp, Homo sapiens
taatttttgatactaagcatt

SEQ ID NO: 4501875 - DNA, 17 bp, Homo sapiens
taattttttttaaaata

SEQ ID NO: 4501876 - DNA, 13 bp, Homo sapiens
tacaaaaacactt

SEQ ID NO: 4501877 - DNA, 14 bp, Homo sapiens
tacaaaaataaatt

SEQ ID NO: 4501878 - DNA, 17 bp, Homo sapiens
tacaaaaataaatttat

SEQ ID NO: 4501879 - DNA, 12 bp, Homo sapiens
tacaaaacttta

SEQ ID NO: 4501880 - DNA, 21 bp, Homo sapiens
tacaaaagaagggctggtatt

SEQ ID NO: 4501881 - DNA, 16 bp, Homo sapiens
tacaaaatatttaagt

SEQ ID NO: 4501882 - DNA, 10 bp, Homo sapiens
tacaaaatca

SEQ ID NO: 4501883 - DNA, 12 bp, Homo sapiens
tacaaaatttat

SEQ ID NO: 4501884 - DNA, 15 bp, Homo sapiens
tacaaaattttaaca

SEQ ID NO: 4501885 - DNA, 17 bp, Homo sapiens
tacaaacgtttgacaaa

SEQ ID NO: 4501886 - DNA, 21 bp, Homo sapiens
tacaaacgtttgacaaacaca

SEQ ID NO: 4501887 - DNA, 13 bp, Homo sapiens
tacaaactctcac

SEQ ID NO: 4501888 - DNA, 20 bp, Homo sapiens
tacaaacttttaagatttct

SEQ ID NO: 4501889 - DNA, 13 bp, Homo sapiens
tacaaagaaaaat

SEQ ID NO: 4501890 - DNA, 15 bp, Homo sapiens
tacaaagaaaaatta

SEQ ID NO: 4501891 - DNA, 16 bp, Homo sapiens
tacaaaggcatgtttt

SEQ ID NO: 4501892 - DNA, 22 bp, Homo sapiens
tacaaatcagaagtcatcttgc

SEQ ID NO: 4501893 - DNA, 15 bp, Homo sapiens
tacaaatcagtaatt

SEQ ID NO: 4501894 - DNA, 12 bp, Homo sapiens
tacaaatgaaaa

SEQ ID NO: 4501895 - DNA, 16 bp, Homo sapiens
tacaaatgacactgca

SEQ ID NO: 4501896 - DNA, 19 bp, Homo sapiens
tacaaatttataaaggtct

SEQ ID NO: 4501897 - DNA, 24 bp, Homo sapiens
tacaaatttggccttaagaactgt

SEQ ID NO: 4501898 - DNA, 16 bp, Homo sapiens
tacaaattttttaatt

SEQ ID NO: 4501899 - DNA, 14 bp, Homo sapiens
tacaacatttatgt

SEQ ID NO: 4501900 - DNA, 11 bp, Homo sapiens
tacaaccctga

SEQ ID NO: 4501901 - DNA, 15 bp, Homo sapiens
tacaaccttcattta

SEQ ID NO: 4501902 - DNA, 18 bp, Homo sapiens
tacaactaaataacacag

SEQ ID NO: 4501903 - DNA, 20 bp, Homo sapiens
tacaactcattccagatccc

SEQ ID NO: 4501904 - DNA, 14 bp, Homo sapiens
tacaacttcaagtg

SEQ ID NO: 4501905 - DNA, 16 bp, Homo sapiens
tacaactttttaaata

SEQ ID NO: 4501906 - DNA, 15 bp, Homo sapiens
tacaagaagcatttt

SEQ ID NO: 4501907 - DNA, 23 bp, Homo sapiens
tacaagagaaaaagcagaggcca

SEQ ID NO: 4501908 - DNA, 23 bp, Homo sapiens
tacaagagcagcctgtggcatct

SEQ ID NO: 4501909 - DNA, 14 bp, Homo sapiens
tacaagatattatt

SEQ ID NO: 4501910 - DNA, 20 bp, Homo sapiens
tacaagatattattaatttt

SEQ ID NO: 4501911 - DNA, 21 bp, Homo sapiens
tacaagcaagcaaaattattt

SEQ ID NO: 4501912 - DNA, 16 bp, Homo sapiens
tacaagcctgcacaat

SEQ ID NO: 4501913 - DNA, 16 bp, Homo sapiens
tacaagcttaaagctt

SEQ ID NO: 4501914 - DNA, 21 bp, Homo sapiens
tacaaggccccaaggtttaca

SEQ ID NO: 4501915 - DNA, 18 bp, Homo sapiens
tacaagggtctagggaga

SEQ ID NO: 4501916 - DNA, 12 bp, Homo sapiens
tacaagtaatgt

SEQ ID NO: 4501917 - DNA, 14 bp, Homo sapiens
tacaagtaatgtaa

SEQ ID NO: 4501918 - DNA, 12 bp, Homo sapiens
tacaagtaattt

SEQ ID NO: 4501919 - DNA, 15 bp, Homo sapiens
tacaagtataacagt

SEQ ID NO: 4501920 - DNA, 19 bp, Homo sapiens
tacaagtcatggtcacagt

SEQ ID NO: 4501921 - DNA, 20 bp, Homo sapiens
tacaagtcatggtcacagta

SEQ ID NO: 4501922 - DNA, 13 bp, Homo sapiens
tacaagttagaaa

SEQ ID NO: 4501923 - DNA, 15 bp, Homo sapiens
tacaagttagaaaac

SEQ ID NO: 4501924 - DNA, 16 bp, Homo sapiens
tacaagttatagtact

SEQ ID NO: 4501925 - DNA, 13 bp, Homo sapiens
tacaataaaacaa

SEQ ID NO: 4501926 - DNA, 20 bp, Homo sapiens
tacaataaaacaaataaata

SEQ ID NO: 4501927 - DNA, 22 bp, Homo sapiens
tacaataaaacaaataaatatg

SEQ ID NO: 4501928 - DNA, 23 bp, Homo sapiens
tacaataaattgctaatgttgct

SEQ ID NO: 4501929 - DNA, 13 bp, Homo sapiens
tacaatacaatgt

SEQ ID NO: 4501930 - DNA, 16 bp, Homo sapiens
tacaatacaatgtaca

SEQ ID NO: 4501931 - DNA, 16 bp, Homo sapiens
tacaatagtatacatt

SEQ ID NO: 4501932 - DNA, 20 bp, Homo sapiens
tacaatcttggagctgcttg

SEQ ID NO: 4501933 - DNA, 16 bp, Homo sapiens
tacaatggaataaatt

SEQ ID NO: 4501934 - DNA, 12 bp, Homo sapiens
tacaatgtacaa

SEQ ID NO: 4501935 - DNA, 18 bp, Homo sapiens
tacaatgtacaattatgt

SEQ ID NO: 4501936 - DNA, 21 bp, Homo sapiens
tacaatgtatctttattaaaa

SEQ ID NO: 4501937 - DNA, 22 bp, Homo sapiens
tacaatgtatctttattaaaac

SEQ ID NO: 4501938 - DNA, 14 bp, Homo sapiens
tacaatgtatgtac

SEQ ID NO: 4501939 - DNA, 18 bp, Homo sapiens
tacaatgtatgtacaata

SEQ ID NO: 4501940 - DNA, 13 bp, Homo sapiens
tacaatgtattaa

SEQ ID NO: 4501941 - DNA, 18 bp, Homo sapiens
tacaattaaaaaaaaaga

SEQ ID NO: 4501942 - DNA, 22 bp, Homo sapiens
tacaattaaaaaaaaagatctg

SEQ ID NO: 4501943 - DNA, 15 bp, Homo sapiens
tacaatttcaactac

SEQ ID NO: 4501944 - DNA, 22 bp, Homo sapiens
tacaatttgcacaatatttctt

SEQ ID NO: 4501945 - DNA, 16 bp, Homo sapiens
tacaattttaaagttc

SEQ ID NO: 4501946 - DNA, 18 bp, Homo sapiens
tacaattttaaagttctt

SEQ ID NO: 4501947 - DNA, 12 bp, Homo sapiens
tacaattttatc

SEQ ID NO: 4501948 - DNA, 17 bp, Homo sapiens
tacaatttttatttctt

SEQ ID NO: 4501949 - DNA, 17 bp, Homo sapiens
tacaattttttatcatg

SEQ ID NO: 4501950 - DNA, 22 bp, Homo sapiens
tacacaaagctttcttttctaa

SEQ ID NO: 4501951 - DNA, 14 bp, Homo sapiens
tacacaataagcaa

SEQ ID NO: 4501952 - DNA, 17 bp, Homo sapiens
tacacacccgcctgaca

SEQ ID NO: 4501953 - DNA, 19 bp, Homo sapiens
tacacagagaaatacaaaa

SEQ ID NO: 4501954 - DNA, 22 bp, Homo sapiens
tacacagagaaatacaaaataa

SEQ ID NO: 4501955 - DNA, 18 bp, Homo sapiens
tacacagaggagtgcagc

SEQ ID NO: 4501956 - DNA, 24 bp, Homo sapiens
tacacagatatatacacacagtgg

SEQ ID NO: 4501957 - DNA, 13 bp, Homo sapiens
tacacagtcagct

SEQ ID NO: 4501958 - DNA, 21 bp, Homo sapiens
tacacagtgagactgtacata

SEQ ID NO: 4501959 - DNA, 23 bp, Homo sapiens
tacacagtgagactgtacataat

SEQ ID NO: 4501960 - DNA, 23 bp, Homo sapiens
tacacatagcaggggcaccttcc

SEQ ID NO: 4501961 - DNA, 22 bp, Homo sapiens
tacacatagttctgtaataaaa

SEQ ID NO: 4501962 - DNA, 17 bp, Homo sapiens
tacacatgttgccttgc

SEQ ID NO: 4501963 - DNA, 17 bp, Homo sapiens
tacacattgctacctca

SEQ ID NO: 4501964 - DNA, 23 bp, Homo sapiens
tacacatttcttaaaacacatga

SEQ ID NO: 4501965 - DNA, 19 bp, Homo sapiens
tacaccaatgaaaacatgt

SEQ ID NO: 4501966 - DNA, 21 bp, Homo sapiens
tacaccaatgaaaacatgtac

SEQ ID NO: 4501967 - DNA, 15 bp, Homo sapiens
tacacccttttccag

SEQ ID NO: 4501968 - DNA, 20 bp, Homo sapiens
tacacctcctttaagattta

SEQ ID NO: 4501969 - DNA, 20 bp, Homo sapiens
tacacgcatgatggagctga

SEQ ID NO: 4501970 - DNA, 17 bp, Homo sapiens
tacacgtctggaccccg

SEQ ID NO: 4501971 - DNA, 13 bp, Homo sapiens
tacacgtgcctgt

SEQ ID NO: 4501972 - DNA, 21 bp, Homo sapiens
tacactataatataaaacctg

SEQ ID NO: 4501973 - DNA, 19 bp, Homo sapiens
tacactcaagcatgaagat

SEQ ID NO: 4501974 - DNA, 15 bp, Homo sapiens
tacactcagccactg

SEQ ID NO: 4501975 - DNA, 19 bp, Homo sapiens
tacactcctctatcatgca

SEQ ID NO: 4501976 - DNA, 13 bp, Homo sapiens
tacactctcctgg

SEQ ID NO: 4501977 - DNA, 18 bp, Homo sapiens
tacactctcctgggcccc

SEQ ID NO: 4501978 - DNA, 15 bp, Homo sapiens
tacactctgctgttt

SEQ ID NO: 4501979 - DNA, 23 bp, Homo sapiens
tacactctgctgtttgacacctc

SEQ ID NO: 4501980 - DNA, 22 bp, Homo sapiens
tacactgcactttgtttagaaa

SEQ ID NO: 4501981 - DNA, 14 bp, Homo sapiens
tacactttgttgca

SEQ ID NO: 4501982 - DNA, 21 bp, Homo sapiens
taatggctgataattttaaat

SEQ ID NO: 4501983 - DNA, 15 bp, Homo sapiens
taatgggtatattga

SEQ ID NO: 4501984 - DNA, 20 bp, Homo sapiens
taatgggtatattgataaat

SEQ ID NO: 4501985 - DNA, 18 bp, Homo sapiens
taatggtagttttacagt

SEQ ID NO: 4501986 - DNA, 17 bp, Homo sapiens
taatggtgaaaacgtct

SEQ ID NO: 4501987 - DNA, 14 bp, Homo sapiens
taatggtttttatt

SEQ ID NO: 4501988 - DNA, 12 bp, Homo sapiens
taatgtaaagat

SEQ ID NO: 4501989 - DNA, 13 bp, Homo sapiens
taatgtaaataaa

SEQ ID NO: 4501990 - DNA, 16 bp, Homo sapiens
taatgtaaataaaaca

SEQ ID NO: 4501991 - DNA, 13 bp, Homo sapiens
taatgtaataaag

SEQ ID NO: 4501992 - DNA, 15 bp, Homo sapiens
taatgtaataaagtg

SEQ ID NO: 4501993 - DNA, 21 bp, Homo sapiens
taatgtacagaggaagctgtt

SEQ ID NO: 4501994 - DNA, 16 bp, Homo sapiens
taatgtactgaattct

SEQ ID NO: 4501995 - DNA, 17 bp, Homo sapiens
taatgtactgaattctt

SEQ ID NO: 4501996 - DNA, 20 bp, Homo sapiens
taatgtactgaattctttat

SEQ ID NO: 4501997 - DNA, 19 bp, Homo sapiens
taatgtactgatttcagta

SEQ ID NO: 4501998 - DNA, 13 bp, Homo sapiens
taatgtatataaa

SEQ ID NO: 4501999 - DNA, 15 bp, Homo sapiens
taatgtatctatttg

SEQ ID NO: 4502000 - DNA, 16 bp, Homo sapiens
taatgtatttgaaaat

SEQ ID NO: 4502001 - DNA, 21 bp, Homo sapiens
taatgtcaccaccttcccagc

SEQ ID NO: 4502002 - DNA, 14 bp, Homo sapiens
taatgtcagcttat

SEQ ID NO: 4502003 - DNA, 16 bp, Homo sapiens
taatgtcataaagtga

SEQ ID NO: 4502004 - DNA, 14 bp, Homo sapiens
taatgtctcacttt

SEQ ID NO: 4502005 - DNA, 11 bp, Homo sapiens
taatgtctctg

SEQ ID NO: 4502006 - DNA, 19 bp, Homo sapiens
taatgtctctgtgagactc

SEQ ID NO: 4502007 - DNA, 15 bp, Homo sapiens
taatgtgatcatatg

SEQ ID NO: 4502008 - DNA, 18 bp, Homo sapiens
taatgtgcagaaaatatt

SEQ ID NO: 4502009 - DNA, 21 bp, Homo sapiens
taatgtgcccaaagctctgaa

SEQ ID NO: 4502010 - DNA, 18 bp, Homo sapiens
taatgtgctctgtacctg

SEQ ID NO: 4502011 - DNA, 15 bp, Homo sapiens
taatgtgtctgtgtt

SEQ ID NO: 4502012 - DNA, 18 bp, Homo sapiens
taatgttacatagtaaat

SEQ ID NO: 4502013 - DNA, 17 bp, Homo sapiens
taatgttcattttgaaa

SEQ ID NO: 4502014 - DNA, 14 bp, Homo sapiens
taatgtttactata

SEQ ID NO: 4502015 - DNA, 19 bp, Homo sapiens
taatgtttactatatagaa

SEQ ID NO: 4502016 - DNA, 15 bp, Homo sapiens
taatgtttattaaat

SEQ ID NO: 4502017 - DNA, 17 bp, Homo sapiens
taatgtttattaaatgc

SEQ ID NO: 4502018 - DNA, 18 bp, Homo sapiens
taatgttttctttgcaaa

SEQ ID NO: 4502019 - DNA, 20 bp, Homo sapiens
taatgttttctttgcaaagt

SEQ ID NO: 4502020 - DNA, 20 bp, Homo sapiens
taattaaaaactttaaagat

SEQ ID NO: 4502021 - DNA, 23 bp, Homo sapiens
taattaaagccttaagcacaatt

SEQ ID NO: 4502022 - DNA, 19 bp, Homo sapiens
taattaaatgaacttatgt

SEQ ID NO: 4502023 - DNA, 19 bp, Homo sapiens
taattaaccttactaatta

SEQ ID NO: 4502024 - DNA, 15 bp, Homo sapiens
taattaagcagaaac

SEQ ID NO: 4502025 - DNA, 15 bp, Homo sapiens
taattaataactttc

SEQ ID NO: 4502026 - DNA, 20 bp, Homo sapiens
taattaatatattaaaattc

SEQ ID NO: 4502027 - DNA, 15 bp, Homo sapiens
taattaattgtcatt

SEQ ID NO: 4502028 - DNA, 20 bp, Homo sapiens
taattaatttggagcacaaa

SEQ ID NO: 4502029 - DNA, 20 bp, Homo sapiens
taattagatccattaattta

SEQ ID NO: 4502030 - DNA, 13 bp, Homo sapiens
taattaggaatta

SEQ ID NO: 4502031 - DNA, 21 bp, Homo sapiens
taattagtgccacttaatgta

SEQ ID NO: 4502032 - DNA, 22 bp, Homo sapiens
taattagtgccacttaatgtat

SEQ ID NO: 4502033 - DNA, 16 bp, Homo sapiens
taattataaaaaatta

SEQ ID NO: 4502034 - DNA, 17 bp, Homo sapiens
taattatataactgtat

SEQ ID NO: 4502035 - DNA, 15 bp, Homo sapiens
taattatcagttggt

SEQ ID NO: 4502036 - DNA, 14 bp, Homo sapiens
taattatgaaaact

SEQ ID NO: 4502037 - DNA, 18 bp, Homo sapiens
taattattgatgttttca

SEQ ID NO: 4502038 - DNA, 19 bp, Homo sapiens
taattatttctaacactag

SEQ ID NO: 4502039 - DNA, 20 bp, Homo sapiens
taattcaaggaatttcttaa

SEQ ID NO: 4502040 - DNA, 13 bp, Homo sapiens
taattcaataaaa

SEQ ID NO: 4502041 - DNA, 22 bp, Homo sapiens
taattcacagtgctcttttctc

SEQ ID NO: 4502042 - DNA, 18 bp, Homo sapiens
taattcagaactaaattt

SEQ ID NO: 4502043 - DNA, 17 bp, Homo sapiens
taattcaggcatatttt

SEQ ID NO: 4502044 - DNA, 14 bp, Homo sapiens
taattcaggttttt

SEQ ID NO: 4502045 - DNA, 14 bp, Homo sapiens
taattcatatctaa

SEQ ID NO: 4502046 - DNA, 15 bp, Homo sapiens
taattcatatctaaa

SEQ ID NO: 4502047 - DNA, 19 bp, Homo sapiens
taattcccaacatttctta

SEQ ID NO: 4502048 - DNA, 16 bp, Homo sapiens
taattcctacagcact

SEQ ID NO: 4502049 - DNA, 15 bp, Homo sapiens
taattcctcttttta

SEQ ID NO: 4502050 - DNA, 17 bp, Homo sapiens
taattcttaaaactata

SEQ ID NO: 4502051 - DNA, 22 bp, Homo sapiens
taattcttaaaactataacatt

SEQ ID NO: 4502052 - DNA, 15 bp, Homo sapiens
taattcttccttccc

SEQ ID NO: 4502053 - DNA, 22 bp, Homo sapiens
taattgcatgaaaatagctatt

SEQ ID NO: 4502054 - DNA, 14 bp, Homo sapiens
taattgcatttaaa

SEQ ID NO: 4502055 - DNA, 14 bp, Homo sapiens
taattgctttgcca

SEQ ID NO: 4502056 - DNA, 15 bp, Homo sapiens
taattggatttccta

SEQ ID NO: 4502057 - DNA, 13 bp, Homo sapiens
taattgtaaactg

SEQ ID NO: 4502058 - DNA, 18 bp, Homo sapiens
taattgtaaactgtacta

SEQ ID NO: 4502059 - DNA, 15 bp, Homo sapiens
taattgtaattccaa

SEQ ID NO: 4502060 - DNA, 14 bp, Homo sapiens
taattgtactgtgt

SEQ ID NO: 4502061 - DNA, 23 bp, Homo sapiens
taattgtgaataaaaattgatga

SEQ ID NO: 4502062 - DNA, 14 bp, Homo sapiens
taattgtgtttatt

SEQ ID NO: 4502063 - DNA, 16 bp, Homo sapiens
taattgttctcagaat

SEQ ID NO: 4502064 - DNA, 17 bp, Homo sapiens
taattgttctcagaatc

SEQ ID NO: 4502065 - DNA, 15 bp, Homo sapiens
taatttaaaattgtg

SEQ ID NO: 4502066 - DNA, 20 bp, Homo sapiens
taatttaaaattgtgatgtg

SEQ ID NO: 4502067 - DNA, 19 bp, Homo sapiens
taatttaacaccctttaga

SEQ ID NO: 4502068 - DNA, 14 bp, Homo sapiens
taatttaatgtaaa

SEQ ID NO: 4502069 - DNA, 16 bp, Homo sapiens
taatttaatgtaaata

SEQ ID NO: 4502070 - DNA, 20 bp, Homo sapiens
taatttaatgtaaataaaac

SEQ ID NO: 4502071 - DNA, 14 bp, Homo sapiens
taatttaattgctt

SEQ ID NO: 4502072 - DNA, 18 bp, Homo sapiens
taatttaattgctttgaa

SEQ ID NO: 4502073 - DNA, 17 bp, Homo sapiens
taatttacttaagtgtt

SEQ ID NO: 4502074 - DNA, 14 bp, Homo sapiens
taatttagaaaact

SEQ ID NO: 4502075 - DNA, 15 bp, Homo sapiens
taatttagaaaactt

SEQ ID NO: 4502076 - DNA, 17 bp, Homo sapiens
taatttagaaaacttta

SEQ ID NO: 4502077 - DNA, 21 bp, Homo sapiens
taatttagaaaactttaaagc

SEQ ID NO: 4502078 - DNA, 15 bp, Homo sapiens
taatttagaaatcat

SEQ ID NO: 4502079 - DNA, 20 bp, Homo sapiens
taatttagaagatattattt

SEQ ID NO: 4502080 - DNA, 21 bp, Homo sapiens
taatttagagataggaaactg

SEQ ID NO: 4502081 - DNA, 17 bp, Homo sapiens
taatttagtttcatata

SEQ ID NO: 4502082 - DNA, 21 bp, Homo sapiens
taatttataatgtatttgaaa

SEQ ID NO: 4502083 - DNA, 22 bp, Homo sapiens
taatttatagtaatgagtttaa

SEQ ID NO: 4502084 - DNA, 20 bp, Homo sapiens
taatttattgtctgtctaca

SEQ ID NO: 4502085 - DNA, 15 bp, Homo sapiens
taatttatttcatcc

SEQ ID NO: 4502086 - DNA, 20 bp, Homo sapiens
taatttcaaatctgtaatta

SEQ ID NO: 4502087 - DNA, 22 bp, Homo sapiens
taatttcagctagttaataatt

SEQ ID NO: 4502088 - DNA, 14 bp, Homo sapiens
taatttcagttcta

SEQ ID NO: 4502089 - DNA, 10 bp, Homo sapiens
taatttcctt

SEQ ID NO: 4502090 - DNA, 15 bp, Homo sapiens
taatttctgaagaag

SEQ ID NO: 4502091 - DNA, 17 bp, Homo sapiens
taatttctttaaatgtg

SEQ ID NO: 4502092 - DNA, 17 bp, Homo sapiens
taatttctttttttcct

SEQ ID NO: 4502093 - DNA, 20 bp, Homo sapiens
taatttgatgaggtattttt

SEQ ID NO: 4502094 - DNA, 20 bp, Homo sapiens
taatttgatgcccaatatat

SEQ ID NO: 4502095 - DNA, 17 bp, Homo sapiens
taatttgcattaaattc

SEQ ID NO: 4502096 - DNA, 20 bp, Homo sapiens
taatttgcattaaattcaca

SEQ ID NO: 4502097 - DNA, 21 bp, Homo sapiens
taatttggtagatgacaaata

SEQ ID NO: 4502098 - DNA, 13 bp, Homo sapiens
taatttgtaaagt

SEQ ID NO: 4502099 - DNA, 15 bp, Homo sapiens
taatttgtcttagtt

SEQ ID NO: 4502100 - DNA, 14 bp, Homo sapiens
taatttgtgtaata

SEQ ID NO: 4502101 - DNA, 20 bp, Homo sapiens
taatttgtgtaataaagtgt

SEQ ID NO: 4502102 - DNA, 15 bp, Homo sapiens
taatttgttatatca

SEQ ID NO: 4502103 - DNA, 21 bp, Homo sapiens
taccaaatgaaatgccaaagg

SEQ ID NO: 4502104 - DNA, 19 bp, Homo sapiens
taccaaattaaaaaaaaat

SEQ ID NO: 4502105 - DNA, 14 bp, Homo sapiens
taccaactttactg

SEQ ID NO: 4502106 - DNA, 17 bp, Homo sapiens
taccaagtatgaagtat

SEQ ID NO: 4502107 - DNA, 13 bp, Homo sapiens
taccaatgaaaaa

SEQ ID NO: 4502108 - DNA, 15 bp, Homo sapiens
taccaatgaaaaaat

SEQ ID NO: 4502109 - DNA, 21 bp, Homo sapiens
taccaatgctcttttcacagc

SEQ ID NO: 4502110 - DNA, 18 bp, Homo sapiens
taccaatgtgttttctgt

SEQ ID NO: 4502111 - DNA, 18 bp, Homo sapiens
taccacagctatttagaa

SEQ ID NO: 4502112 - DNA, 16 bp, Homo sapiens
taccacgccttgacct

SEQ ID NO: 4502113 - DNA, 19 bp, Homo sapiens
taccacttgaatttattga

SEQ ID NO: 4502114 - DNA, 21 bp, Homo sapiens
taccagagccttcaagtgcca

SEQ ID NO: 4502115 - DNA, 23 bp, Homo sapiens
taccagcagcaactgaaaatgaa

SEQ ID NO: 4502116 - DNA, 15 bp, Homo sapiens
taccagccagcctca

SEQ ID NO: 4502117 - DNA, 15 bp, Homo sapiens
taccagcgaggaggc

SEQ ID NO: 4502118 - DNA, 22 bp, Homo sapiens
taccagctgcgcttgcttttct

SEQ ID NO: 4502119 - DNA, 17 bp, Homo sapiens
taccagcttttaaccat

SEQ ID NO: 4502120 - DNA, 16 bp, Homo sapiens
taccaggacagaactt

SEQ ID NO: 4502121 - DNA, 17 bp, Homo sapiens
taccaggcaccaaaaga

SEQ ID NO: 4502122 - DNA, 12 bp, Homo sapiens
taccagtattta

SEQ ID NO: 4502123 - DNA, 18 bp, Homo sapiens
taccagtatttagaagcc

SEQ ID NO: 4502124 - DNA, 19 bp, Homo sapiens
taccagtgaatttttgcaa

SEQ ID NO: 4502125 - DNA, 23 bp, Homo sapiens
taccagtgaatttttgcaataat

SEQ ID NO: 4502126 - DNA, 16 bp, Homo sapiens
taccatacataaactg

SEQ ID NO: 4502127 - DNA, 13 bp, Homo sapiens
taccatcagctct

SEQ ID NO: 4502128 - DNA, 14 bp, Homo sapiens
taccatcagctctg

SEQ ID NO: 4502129 - DNA, 17 bp, Homo sapiens
taccatcatctctgaag

SEQ ID NO: 4502130 - DNA, 22 bp, Homo sapiens
taccatggttctgcctcctggc

SEQ ID NO: 4502131 - DNA, 17 bp, Homo sapiens
taccatttacatgtttt

SEQ ID NO: 4502132 - DNA, 14 bp, Homo sapiens
taccatttgtgtct

SEQ ID NO: 4502133 - DNA, 12 bp, Homo sapiens
tacccacccaga

SEQ ID NO: 4502134 - DNA, 18 bp, Homo sapiens
tacccagagaagcccctt

SEQ ID NO: 4502135 - DNA, 16 bp, Homo sapiens
tacccagcaaatgggc

SEQ ID NO: 4502136 - DNA, 21 bp, Homo sapiens
taccccaaattgtgtatatat

SEQ ID NO: 4502137 - DNA, 19 bp, Homo sapiens
taccccaagactcccatga

SEQ ID NO: 4502138 - DNA, 21 bp, Homo sapiens
taccccagactagatgtagta

SEQ ID NO: 4502139 - DNA, 18 bp, Homo sapiens
taccccagttcctagcac

SEQ ID NO: 4502140 - DNA, 22 bp, Homo sapiens
tacccctgctcccattcctccc

SEQ ID NO: 4502141 - DNA, 16 bp, Homo sapiens
tacccgctgtggccgg

SEQ ID NO: 4502142 - DNA, 14 bp, Homo sapiens
taccctaaccaagt

SEQ ID NO: 4502143 - DNA, 16 bp, Homo sapiens
taccctaaccaagttc

SEQ ID NO: 4502144 - DNA, 18 bp, Homo sapiens
taccctcccaccagaacg

SEQ ID NO: 4502145 - DNA, 14 bp, Homo sapiens
taccctcccacccc

SEQ ID NO: 4502146 - DNA, 15 bp, Homo sapiens
taccctcccaccccc

SEQ ID NO: 4502147 - DNA, 18 bp, Homo sapiens
taccctcctgcactgttt

SEQ ID NO: 4502148 - DNA, 17 bp, Homo sapiens
taccctgagctgaggca

SEQ ID NO: 4502149 - DNA, 23 bp, Homo sapiens
taccctgagctgcagctgagcct

SEQ ID NO: 4502150 - DNA, 21 bp, Homo sapiens
taccctgggaaggcctcttgg

SEQ ID NO: 4502151 - DNA, 13 bp, Homo sapiens
tacccttaattac

SEQ ID NO: 4502152 - DNA, 17 bp, Homo sapiens
tacccttaattacttaa

SEQ ID NO: 4502153 - DNA, 21 bp, Homo sapiens
tacccttgtgagagcccattc

SEQ ID NO: 4502154 - DNA, 21 bp, Homo sapiens
tacccttttcctttgtggttt

SEQ ID NO: 4502155 - DNA, 17 bp, Homo sapiens
taccggagagagaatgt

SEQ ID NO: 4502156 - DNA, 22 bp, Homo sapiens
tacctaacgaagtatccttcag

SEQ ID NO: 4502157 - DNA, 13 bp, Homo sapiens
tacctacatattt

SEQ ID NO: 4502158 - DNA, 22 bp, Homo sapiens
tacctacatatttgtatgtttt

SEQ ID NO: 4502159 - DNA, 21 bp, Homo sapiens
tacctacatgctgaaaaatat

SEQ ID NO: 4502160 - DNA, 16 bp, Homo sapiens
tacctactttcttcag

SEQ ID NO: 4502161 - DNA, 14 bp, Homo sapiens
tacctactttgact

SEQ ID NO: 4502162 - DNA, 15 bp, Homo sapiens
tacctagctggctct

SEQ ID NO: 4502163 - DNA, 15 bp, Homo sapiens
tacctagtgtttact

SEQ ID NO: 4502164 - DNA, 18 bp, Homo sapiens
tacctcaacaagaagaat

SEQ ID NO: 4502165 - DNA, 17 bp, Homo sapiens
tacctcaacctgtaaat

SEQ ID NO: 4502166 - DNA, 19 bp, Homo sapiens
tacctcaacctgtaaatta

SEQ ID NO: 4502167 - DNA, 21 bp, Homo sapiens
tacctcaagccccatttcctc

SEQ ID NO: 4502168 - DNA, 20 bp, Homo sapiens
tacctcaaggtaacaagagt

SEQ ID NO: 4502169 - DNA, 14 bp, Homo sapiens
tacctcaatttttg

SEQ ID NO: 4502170 - DNA, 15 bp, Homo sapiens
tacctcaatttttgt

SEQ ID NO: 4502171 - DNA, 16 bp, Homo sapiens
tacctcaggaaagaat

SEQ ID NO: 4502172 - DNA, 18 bp, Homo sapiens
tacctcaggaaagaatag

SEQ ID NO: 4502173 - DNA, 18 bp, Homo sapiens
tacctcaggtgccaaccc

SEQ ID NO: 4502174 - DNA, 17 bp, Homo sapiens
tacctcagtgctcctgg

SEQ ID NO: 4502175 - DNA, 21 bp, Homo sapiens
tacctcagtggatcttcagaa

SEQ ID NO: 4502176 - DNA, 13 bp, Homo sapiens
tacctcctgccca

SEQ ID NO: 4502177 - DNA, 14 bp, Homo sapiens
tacctctctgtcat

SEQ ID NO: 4502178 - DNA, 17 bp, Homo sapiens
tacctctgagaagacac

SEQ ID NO: 4502179 - DNA, 13 bp, Homo sapiens
tacctgaaaacac

SEQ ID NO: 4502180 - DNA, 20 bp, Homo sapiens
tacctgaaaacactgtgcac

SEQ ID NO: 4502181 - DNA, 23 bp, Homo sapiens
tacctgattgatcacacagtgtt

SEQ ID NO: 4502182 - DNA, 17 bp, Homo sapiens
tacctgattgtattttt

SEQ ID NO: 4502183 - DNA, 15 bp, Homo sapiens
tacctgccttttaag

SEQ ID NO: 4502184 - DNA, 10 bp, Homo sapiens
tacctgctgc

SEQ ID NO: 4502185 - DNA, 19 bp, Homo sapiens
tacctgctgcttctccaaa

SEQ ID NO: 4502186 - DNA, 20 bp, Homo sapiens
tacctgtatacagtgcagag

SEQ ID NO: 4502187 - DNA, 23 bp, Homo sapiens
tacctgtcaaaaattttgaatgt

SEQ ID NO: 4502188 - DNA, 16 bp, Homo sapiens
taccttatttattttt

SEQ ID NO: 4502189 - DNA, 18 bp, Homo sapiens
taccttatttatttttgt

SEQ ID NO: 4502190 - DNA, 21 bp, Homo sapiens
taccttatttatttttgtgta

SEQ ID NO: 4502191 - DNA, 15 bp, Homo sapiens
taccttcaatactta

SEQ ID NO: 4502192 - DNA, 19 bp, Homo sapiens
taccttccatacacagagg

SEQ ID NO: 4502193 - DNA, 20 bp, Homo sapiens
taccttctatgtattagtgt

SEQ ID NO: 4502194 - DNA, 12 bp, Homo sapiens
taccttctttca

SEQ ID NO: 4502195 - DNA, 15 bp, Homo sapiens
taccttgaaaggaag

SEQ ID NO: 4502196 - DNA, 16 bp, Homo sapiens
taccttgcttttgctt

SEQ ID NO: 4502197 - DNA, 21 bp, Homo sapiens
taccttgcttttgcttctaga

SEQ ID NO: 4502198 - DNA, 18 bp, Homo sapiens
taccttttaccagctttt

SEQ ID NO: 4502199 - DNA, 20 bp, Homo sapiens
taccttttctcttttctttc

SEQ ID NO: 4502200 - DNA, 18 bp, Homo sapiens
tacctttttatatttaaa

SEQ ID NO: 4502201 - DNA, 23 bp, Homo sapiens
taccttttttgttttttcaaaat

SEQ ID NO: 4502202 - DNA, 22 bp, Homo sapiens
tacgaaatacgttaggaggaca

SEQ ID NO: 4502203 - DNA, 18 bp, Homo sapiens
tacgaatcttatttttcc

SEQ ID NO: 4502204 - DNA, 19 bp, Homo sapiens
tacgaatcttatttttcct

SEQ ID NO: 4502205 - DNA, 19 bp, Homo sapiens
tacgagagcagaggtctcc

SEQ ID NO: 4502206 - DNA, 19 bp, Homo sapiens
tacgagggaggaacacctg

SEQ ID NO: 4502207 - DNA, 21 bp, Homo sapiens
tacgagggaggaacacctgat

SEQ ID NO: 4502208 - DNA, 19 bp, Homo sapiens
tacgatcaagttgttgact

SEQ ID NO: 4502209 - DNA, 22 bp, Homo sapiens
tacgcactggacagcatcagaa

SEQ ID NO: 4502210 - DNA, 19 bp, Homo sapiens
tacgctgaggcctgggagt

SEQ ID NO: 4502211 - DNA, 13 bp, Homo sapiens
tacgtataaatat

SEQ ID NO: 4502212 - DNA, 20 bp, Homo sapiens
tacgtataaatatcagtatt

SEQ ID NO: 4502213 - DNA, 21 bp, Homo sapiens
tacgtatgcatttttttagtt

SEQ ID NO: 4502214 - DNA, 16 bp, Homo sapiens
tacgtatttaatagca

SEQ ID NO: 4502215 - DNA, 14 bp, Homo sapiens
tacgtatttttctg

SEQ ID NO: 4502216 - DNA, 19 bp, Homo sapiens
tacgtgccagatataactg

SEQ ID NO: 4502217 - DNA, 20 bp, Homo sapiens
tacgtgccagatataactgt

SEQ ID NO: 4502218 - DNA, 23 bp, Homo sapiens
tacgtgccagatataactgtctt

SEQ ID NO: 4502219 - DNA, 18 bp, Homo sapiens
tacgtgctctgtgggtct

SEQ ID NO: 4502220 - DNA, 14 bp, Homo sapiens
tacgttatatattg

SEQ ID NO: 4502221 - DNA, 19 bp, Homo sapiens
tacgttctgctatatttgt

SEQ ID NO: 4502222 - DNA, 16 bp, Homo sapiens
tacgtttgaagtctga

SEQ ID NO: 4502223 - DNA, 17 bp, Homo sapiens
tacactttttacagcag

SEQ ID NO: 4502224 - DNA, 13 bp, Homo sapiens
tacagaaggcaaa

SEQ ID NO: 4502225 - DNA, 16 bp, Homo sapiens
tacagaatattaaata

SEQ ID NO: 4502226 - DNA, 22 bp, Homo sapiens
tacagaatccttatttcctcat

SEQ ID NO: 4502227 - DNA, 21 bp, Homo sapiens
tacagaatgcggcctctgaga

SEQ ID NO: 4502228 - DNA, 17 bp, Homo sapiens
tacagacctcagtttta

SEQ ID NO: 4502229 - DNA, 12 bp, Homo sapiens
tacagactgaaa

SEQ ID NO: 4502230 - DNA, 11 bp, Homo sapiens
tacagaggaga

SEQ ID NO: 4502231 - DNA, 16 bp, Homo sapiens
tacagataacttcttt

SEQ ID NO: 4502232 - DNA, 13 bp, Homo sapiens
tacagatccccag

SEQ ID NO: 4502233 - DNA, 21 bp, Homo sapiens
tacagatccccagcccctcct

SEQ ID NO: 4502234 - DNA, 19 bp, Homo sapiens
tacagcaacaatttatgaa

SEQ ID NO: 4502235 - DNA, 20 bp, Homo sapiens
tacagcaacaatttatgaat

SEQ ID NO: 4502236 - DNA, 17 bp, Homo sapiens
tacagcaagatgtttct

SEQ ID NO: 4502237 - DNA, 18 bp, Homo sapiens
tacagcactactgggtgt

SEQ ID NO: 4502238 - DNA, 19 bp, Homo sapiens
tacagcactactgggtgtc

SEQ ID NO: 4502239 - DNA, 13 bp, Homo sapiens
tacagcagcaata

SEQ ID NO: 4502240 - DNA, 20 bp, Homo sapiens
tacagccaagttgtgacagt

SEQ ID NO: 4502241 - DNA, 17 bp, Homo sapiens
tacagcccttgcactcc

SEQ ID NO: 4502242 - DNA, 23 bp, Homo sapiens
tacagccgtcccgcgttcaagac

SEQ ID NO: 4502243 - DNA, 20 bp, Homo sapiens
tacagcggctcccctctgct

SEQ ID NO: 4502244 - DNA, 18 bp, Homo sapiens
tacagctatatttgatta

SEQ ID NO: 4502245 - DNA, 22 bp, Homo sapiens
tacagcttttatggatgattaa

SEQ ID NO: 4502246 - DNA, 17 bp, Homo sapiens
tacaggaatgaagaact

SEQ ID NO: 4502247 - DNA, 20 bp, Homo sapiens
tacaggatttgaactcagat

SEQ ID NO: 4502248 - DNA, 15 bp, Homo sapiens
tacaggcagtctctc

SEQ ID NO: 4502249 - DNA, 18 bp, Homo sapiens
tacaggcctcttcctgtt

SEQ ID NO: 4502250 - DNA, 14 bp, Homo sapiens
tacaggcgcccgcc

SEQ ID NO: 4502251 - DNA, 23 bp, Homo sapiens
tacagggaggctcccggggcctg

SEQ ID NO: 4502252 - DNA, 12 bp, Homo sapiens
tacaggggaggg

SEQ ID NO: 4502253 - DNA, 18 bp, Homo sapiens
tacagggtagcaggtacc

SEQ ID NO: 4502254 - DNA, 12 bp, Homo sapiens
tacagggtggcc

SEQ ID NO: 4502255 - DNA, 17 bp, Homo sapiens
tacaggtagtgggctca

SEQ ID NO: 4502256 - DNA, 19 bp, Homo sapiens
tacaggtgtgaaccactgt

SEQ ID NO: 4502257 - DNA, 12 bp, Homo sapiens
tacagtaaatgt

SEQ ID NO: 4502258 - DNA, 13 bp, Homo sapiens
tacagtaatgaaa

SEQ ID NO: 4502259 - DNA, 21 bp, Homo sapiens
tacagtaatgaaatgtttact

SEQ ID NO: 4502260 - DNA, 18 bp, Homo sapiens
tacagtacacagatacct

SEQ ID NO: 4502261 - DNA, 18 bp, Homo sapiens
tacagtaggagcccagct

SEQ ID NO: 4502262 - DNA, 19 bp, Homo sapiens
tacagtattatagacaaaa

SEQ ID NO: 4502263 - DNA, 14 bp, Homo sapiens
tacagtctaaagct

SEQ ID NO: 4502264 - DNA, 15 bp, Homo sapiens
tacagtctgtcatga

SEQ ID NO: 4502265 - DNA, 19 bp, Homo sapiens
tacagtcttccatttgcaa

SEQ ID NO: 4502266 - DNA, 20 bp, Homo sapiens
tacagtcttccatttgcaag

SEQ ID NO: 4502267 - DNA, 22 bp, Homo sapiens
tacagtcttccatttgcaaggg

SEQ ID NO: 4502268 - DNA, 21 bp, Homo sapiens
tacagtgcagagccttctcag

SEQ ID NO: 4502269 - DNA, 22 bp, Homo sapiens
tacagtgcatagttgtagacaa

SEQ ID NO: 4502270 - DNA, 11 bp, Homo sapiens
tacagtggttt

SEQ ID NO: 4502271 - DNA, 13 bp, Homo sapiens
tacagtgtacagt

SEQ ID NO: 4502272 - DNA, 22 bp, Homo sapiens
tacagttacttaatgaccatgt

SEQ ID NO: 4502273 - DNA, 14 bp, Homo sapiens
tacagttctgtggt

SEQ ID NO: 4502274 - DNA, 17 bp, Homo sapiens
tacagttgaaataactg

SEQ ID NO: 4502275 - DNA, 19 bp, Homo sapiens
tacagttgaaataactgga

SEQ ID NO: 4502276 - DNA, 17 bp, Homo sapiens
tacagttgagctcaggt

SEQ ID NO: 4502277 - DNA, 16 bp, Homo sapiens
tacagtttgacttttt

SEQ ID NO: 4502278 - DNA, 21 bp, Homo sapiens
tacagttttaactgtggatat

SEQ ID NO: 4502279 - DNA, 14 bp, Homo sapiens
tacagttttcattg

SEQ ID NO: 4502280 - DNA, 14 bp, Homo sapiens
tacataaagactaa

SEQ ID NO: 4502281 - DNA, 18 bp, Homo sapiens
tacataactcctgtccct

SEQ ID NO: 4502282 - DNA, 22 bp, Homo sapiens
tacataactcctgtcccttttc

SEQ ID NO: 4502283 - DNA, 20 bp, Homo sapiens
tacataaggatgactttttt

SEQ ID NO: 4502284 - DNA, 16 bp, Homo sapiens
tacataattgcatgaa

SEQ ID NO: 4502285 - DNA, 18 bp, Homo sapiens
tacatacagaggtaacta

SEQ ID NO: 4502286 - DNA, 20 bp, Homo sapiens
tacataccacgctagggctg

SEQ ID NO: 4502287 - DNA, 19 bp, Homo sapiens
tacatactttatcaatgtg

SEQ ID NO: 4502288 - DNA, 19 bp, Homo sapiens
tacatagtgctgctgtgtg

SEQ ID NO: 4502289 - DNA, 14 bp, Homo sapiens
tacatatagcagct

SEQ ID NO: 4502290 - DNA, 21 bp, Homo sapiens
tacatatcctttggtcctggt

SEQ ID NO: 4502291 - DNA, 17 bp, Homo sapiens
tacatatgagaatatac

SEQ ID NO: 4502292 - DNA, 21 bp, Homo sapiens
tacatatgagaatatacctta

SEQ ID NO: 4502293 - DNA, 13 bp, Homo sapiens
tacatatttgtat

SEQ ID NO: 4502294 - DNA, 16 bp, Homo sapiens
tacatatttgtatgtt

SEQ ID NO: 4502295 - DNA, 16 bp, Homo sapiens
tacatcaacaagaaga

SEQ ID NO: 4502296 - DNA, 17 bp, Homo sapiens
tacatcaagtccatctg

SEQ ID NO: 4502297 - DNA, 21 bp, Homo sapiens
tacatcaagtccatctgacaa

SEQ ID NO: 4502298 - DNA, 15 bp, Homo sapiens
tacatcacatcttat

SEQ ID NO: 4502299 - DNA, 17 bp, Homo sapiens
tacatcacatcttattt

SEQ ID NO: 4502300 - DNA, 17 bp, Homo sapiens
tacatcagactctagaa

SEQ ID NO: 4502301 - DNA, 18 bp, Homo sapiens
tacatcagactctagaaa

SEQ ID NO: 4502302 - DNA, 14 bp, Homo sapiens
tacatcagtttgtt

SEQ ID NO: 4502303 - DNA, 22 bp, Homo sapiens
tacatcatgctggaacctgcaa

SEQ ID NO: 4502304 - DNA, 14 bp, Homo sapiens
tacatcattattgt

SEQ ID NO: 4502305 - DNA, 22 bp, Homo sapiens
tacatctattttggattgtata

SEQ ID NO: 4502306 - DNA, 19 bp, Homo sapiens
tacatctccttgatcatgt

SEQ ID NO: 4502307 - DNA, 19 bp, Homo sapiens
tacatctgcaatatgaatt

SEQ ID NO: 4502308 - DNA, 13 bp, Homo sapiens
tacatctgcctta

SEQ ID NO: 4502309 - DNA, 21 bp, Homo sapiens
tacatcttctttggaaataaa

SEQ ID NO: 4502310 - DNA, 20 bp, Homo sapiens
tacatgatacatttttattt

SEQ ID NO: 4502311 - DNA, 14 bp, Homo sapiens
tacatgcacagtca

SEQ ID NO: 4502312 - DNA, 17 bp, Homo sapiens
tacatgcagcccatgcc

SEQ ID NO: 4502313 - DNA, 22 bp, Homo sapiens
tacatgcagcccatgcccacct

SEQ ID NO: 4502314 - DNA, 19 bp, Homo sapiens
tacatggtgtaaatattag

SEQ ID NO: 4502315 - DNA, 15 bp, Homo sapiens
tacatgtctagagaa

SEQ ID NO: 4502316 - DNA, 21 bp, Homo sapiens
tacatgtgagatagttttcat

SEQ ID NO: 4502317 - DNA, 18 bp, Homo sapiens
tacatgttggaaatgtgt

SEQ ID NO: 4502318 - DNA, 15 bp, Homo sapiens
tacatgttttttcat

SEQ ID NO: 4502319 - DNA, 15 bp, Homo sapiens
tacattaaacaatga

SEQ ID NO: 4502320 - DNA, 16 bp, Homo sapiens
tacattaacggtgcta

SEQ ID NO: 4502321 - DNA, 17 bp, Homo sapiens
tacattaacggtgctaa

SEQ ID NO: 4502322 - DNA, 23 bp, Homo sapiens
tacattaattattattgctgttg

SEQ ID NO: 4502323 - DNA, 15 bp, Homo sapiens
tacattattccaatg

SEQ ID NO: 4502324 - DNA, 11 bp, Homo sapiens
tacattgctta

SEQ ID NO: 4502325 - DNA, 12 bp, Homo sapiens
tacattgcttaa

SEQ ID NO: 4502326 - DNA, 15 bp, Homo sapiens
tacattgcttaaaat

SEQ ID NO: 4502327 - DNA, 12 bp, Homo sapiens
tacattgtcttg

SEQ ID NO: 4502328 - DNA, 23 bp, Homo sapiens
tacattgtcttgatgttttttct

SEQ ID NO: 4502329 - DNA, 23 bp, Homo sapiens
tacatttaaaccttttattataa

SEQ ID NO: 4502330 - DNA, 15 bp, Homo sapiens
tacatttaataatat

SEQ ID NO: 4502331 - DNA, 18 bp, Homo sapiens
tacatttcacattattct

SEQ ID NO: 4502332 - DNA, 16 bp, Homo sapiens
tacatttctctgagca

SEQ ID NO: 4502333 - DNA, 18 bp, Homo sapiens
tacatttcttttaaaata

SEQ ID NO: 4502334 - DNA, 13 bp, Homo sapiens
tacatttgcaatt

SEQ ID NO: 4502335 - DNA, 19 bp, Homo sapiens
tacatttggttatgttgat

SEQ ID NO: 4502336 - DNA, 11 bp, Homo sapiens
tacattttaaa

SEQ ID NO: 4502337 - DNA, 17 bp, Homo sapiens
tacattttataatgatg

SEQ ID NO: 4502338 - DNA, 13 bp, Homo sapiens
tacattttattct

SEQ ID NO: 4502339 - DNA, 16 bp, Homo sapiens
tacatttttcagcagc

SEQ ID NO: 4502340 - DNA, 20 bp, Homo sapiens
tacattttttgggcagcaat

SEQ ID NO: 4502341 - DNA, 13 bp, Homo sapiens
taccaaaaattag

SEQ ID NO: 4502342 - DNA, 11 bp, Homo sapiens
taccaaaataa

SEQ ID NO: 4502343 - DNA, 20 bp, Homo sapiens
taccaaatgaaatgccaaag

SEQ ID NO: 4502344 - DNA, 22 bp, Homo sapiens
tactgtgtgtgtgaatgaacac

SEQ ID NO: 4502345 - DNA, 23 bp, Homo sapiens
tactgtgtgtgtgaatgaacact

SEQ ID NO: 4502346 - DNA, 17 bp, Homo sapiens
tactgttctcaacatac

SEQ ID NO: 4502347 - DNA, 21 bp, Homo sapiens
tactgttctcaacatactgta

SEQ ID NO: 4502348 - DNA, 23 bp, Homo sapiens
tactgttctcaacatactgtaat

SEQ ID NO: 4502349 - DNA, 21 bp, Homo sapiens
tactgttcttgacaatcatct

SEQ ID NO: 4502350 - DNA, 23 bp, Homo sapiens
tactgttgaaaaagataaagagt

SEQ ID NO: 4502351 - DNA, 15 bp, Homo sapiens
tactgttgctttaat

SEQ ID NO: 4502352 - DNA, 14 bp, Homo sapiens
tactgtttacagtt

SEQ ID NO: 4502353 - DNA, 19 bp, Homo sapiens
tactgtttgcccattttca

SEQ ID NO: 4502354 - DNA, 18 bp, Homo sapiens
tactgttttgaataaatt

SEQ ID NO: 4502355 - DNA, 12 bp, Homo sapiens
tacttaaatgag

SEQ ID NO: 4502356 - DNA, 15 bp, Homo sapiens
tacttaacatttcat

SEQ ID NO: 4502357 - DNA, 19 bp, Homo sapiens
tacttaagtgttcatttta

SEQ ID NO: 4502358 - DNA, 13 bp, Homo sapiens
tacttacattcca

SEQ ID NO: 4502359 - DNA, 16 bp, Homo sapiens
tacttagaatgccata

SEQ ID NO: 4502360 - DNA, 21 bp, Homo sapiens
tacttagaatgccataaaatt

SEQ ID NO: 4502361 - DNA, 18 bp, Homo sapiens
tacttatactaaattatg

SEQ ID NO: 4502362 - DNA, 18 bp, Homo sapiens
tacttatctctcaaaaca

SEQ ID NO: 4502363 - DNA, 13 bp, Homo sapiens
tacttatttaact

SEQ ID NO: 4502364 - DNA, 14 bp, Homo sapiens
tacttatttaactg

SEQ ID NO: 4502365 - DNA, 20 bp, Homo sapiens
tacttcactatacaaacaaa

SEQ ID NO: 4502366 - DNA, 12 bp, Homo sapiens
tacttcctctgt

SEQ ID NO: 4502367 - DNA, 18 bp, Homo sapiens
tacttcctctgtgaactg

SEQ ID NO: 4502368 - DNA, 15 bp, Homo sapiens
tacttcctgagtggc

SEQ ID NO: 4502369 - DNA, 16 bp, Homo sapiens
tacttctgtaattgtg

SEQ ID NO: 4502370 - DNA, 17 bp, Homo sapiens
tacttctgtaattgtgt

SEQ ID NO: 4502371 - DNA, 20 bp, Homo sapiens
tacttctgtaattgtgtgga

SEQ ID NO: 4502372 - DNA, 12 bp, Homo sapiens
tacttcttctgt

SEQ ID NO: 4502373 - DNA, 18 bp, Homo sapiens
tacttgaaaccagtattt

SEQ ID NO: 4502374 - DNA, 23 bp, Homo sapiens
tacttgaaaccagtatttaagct

SEQ ID NO: 4502375 - DNA, 15 bp, Homo sapiens
tacttgaacaaaagg

SEQ ID NO: 4502376 - DNA, 13 bp, Homo sapiens
tacttgaacttgt

SEQ ID NO: 4502377 - DNA, 16 bp, Homo sapiens
tacttgaactttccaa

SEQ ID NO: 4502378 - DNA, 17 bp, Homo sapiens
tacttgaactttccaaa

SEQ ID NO: 4502379 - DNA, 18 bp, Homo sapiens
tacttgaataaccatctg

SEQ ID NO: 4502380 - DNA, 23 bp, Homo sapiens
tacttgaatcagatggtgtcatt

SEQ ID NO: 4502381 - DNA, 13 bp, Homo sapiens
tacttgaatgtag

SEQ ID NO: 4502382 - DNA, 22 bp, Homo sapiens
tacttgagaccaacttttcaat

SEQ ID NO: 4502383 - DNA, 20 bp, Homo sapiens
tacttgcagctcccattcta

SEQ ID NO: 4502384 - DNA, 16 bp, Homo sapiens
tacttggaactaggct

SEQ ID NO: 4502385 - DNA, 12 bp, Homo sapiens
tacttgggaggc

SEQ ID NO: 4502386 - DNA, 15 bp, Homo sapiens
tacttgttcatttgg

SEQ ID NO: 4502387 - DNA, 14 bp, Homo sapiens
tacttgtttaacat

SEQ ID NO: 4502388 - DNA, 12 bp, Homo sapiens
tactttaaatta

SEQ ID NO: 4502389 - DNA, 17 bp, Homo sapiens
tactttaaattatatga

SEQ ID NO: 4502390 - DNA, 21 bp, Homo sapiens
tactttagaagcctgcataat

SEQ ID NO: 4502391 - DNA, 21 bp, Homo sapiens
tactttagatggcaagcatgt

SEQ ID NO: 4502392 - DNA, 13 bp, Homo sapiens
tactttatatctt

SEQ ID NO: 4502393 - DNA, 15 bp, Homo sapiens
tactttatatcttgt

SEQ ID NO: 4502394 - DNA, 17 bp, Homo sapiens
tactttatatcttgttt

SEQ ID NO: 4502395 - DNA, 21 bp, Homo sapiens
tactttatcatgaatgctttt

SEQ ID NO: 4502396 - DNA, 16 bp, Homo sapiens
tactttattataaaat

SEQ ID NO: 4502397 - DNA, 12 bp, Homo sapiens
tactttcaagta

SEQ ID NO: 4502398 - DNA, 18 bp, Homo sapiens
tactttcatcttaaacta

SEQ ID NO: 4502399 - DNA, 15 bp, Homo sapiens
tactttctatgtgac

SEQ ID NO: 4502400 - DNA, 18 bp, Homo sapiens
tactttctcccagtatgt

SEQ ID NO: 4502401 - DNA, 14 bp, Homo sapiens
tactttgacttttt

SEQ ID NO: 4502402 - DNA, 12 bp, Homo sapiens
tactttgcattg

SEQ ID NO: 4502403 - DNA, 16 bp, Homo sapiens
tactttgcattgtctg

SEQ ID NO: 4502404 - DNA, 17 bp, Homo sapiens
tactttggaattcttag

SEQ ID NO: 4502405 - DNA, 17 bp, Homo sapiens
tactttggcaatttcct

SEQ ID NO: 4502406 - DNA, 20 bp, Homo sapiens
tactttggggctaatttaac

SEQ ID NO: 4502407 - DNA, 13 bp, Homo sapiens
tactttgtagact

SEQ ID NO: 4502408 - DNA, 19 bp, Homo sapiens
tactttgtagactgtttca

SEQ ID NO: 4502409 - DNA, 13 bp, Homo sapiens
tactttgtctttt

SEQ ID NO: 4502410 - DNA, 15 bp, Homo sapiens
tactttgtgcattct

SEQ ID NO: 4502411 - DNA, 14 bp, Homo sapiens
tacttttaaactgt

SEQ ID NO: 4502412 - DNA, 21 bp, Homo sapiens
tacttttaaactgtgtacata

SEQ ID NO: 4502413 - DNA, 19 bp, Homo sapiens
tacttttaaataaattatg

SEQ ID NO: 4502414 - DNA, 14 bp, Homo sapiens
tacttttctaaaat

SEQ ID NO: 4502415 - DNA, 19 bp, Homo sapiens
tacttttctaaaatctaaa

SEQ ID NO: 4502416 - DNA, 22 bp, Homo sapiens
tacttttctgtttagttttaca

SEQ ID NO: 4502417 - DNA, 13 bp, Homo sapiens
tacttttgagtat

SEQ ID NO: 4502418 - DNA, 18 bp, Homo sapiens
tactttttaaaaataact

SEQ ID NO: 4502419 - DNA, 14 bp, Homo sapiens
tactttttaaatgt

SEQ ID NO: 4502420 - DNA, 18 bp, Homo sapiens
tactttttaaattacctt

SEQ ID NO: 4502421 - DNA, 22 bp, Homo sapiens
tactttttcatgaaaatggagt

SEQ ID NO: 4502422 - DNA, 13 bp, Homo sapiens
tactttttctaat

SEQ ID NO: 4502423 - DNA, 14 bp, Homo sapiens
tactttttctaatg

SEQ ID NO: 4502424 - DNA, 18 bp, Homo sapiens
tacttttttaaatatttt

SEQ ID NO: 4502425 - DNA, 20 bp, Homo sapiens
tacttttttaaatattttct

SEQ ID NO: 4502426 - DNA, 23 bp, Homo sapiens
tacttttttaaatattttctatt

SEQ ID NO: 4502427 - DNA, 23 bp, Homo sapiens
tagaaaaaagtagcaaatgttta

SEQ ID NO: 4502428 - DNA, 14 bp, Homo sapiens
tagaaaaagggtca

SEQ ID NO: 4502429 - DNA, 21 bp, Homo sapiens
tagaaaaagggtcaatgctat

SEQ ID NO: 4502430 - DNA, 19 bp, Homo sapiens
tagaaaaagtcaatgtact

SEQ ID NO: 4502431 - DNA, 15 bp, Homo sapiens
tagaaaaataaaaat

SEQ ID NO: 4502432 - DNA, 17 bp, Homo sapiens
tagaaaaatctcattcc

SEQ ID NO: 4502433 - DNA, 18 bp, Homo sapiens
tagaaaaattattagaac

SEQ ID NO: 4502434 - DNA, 13 bp, Homo sapiens
tagaaaaatttca

SEQ ID NO: 4502435 - DNA, 17 bp, Homo sapiens
tagaaaacccaagtttt

SEQ ID NO: 4502436 - DNA, 15 bp, Homo sapiens
tagaaaactttaaag

SEQ ID NO: 4502437 - DNA, 17 bp, Homo sapiens
tagaaaagtgaattgaa

SEQ ID NO: 4502438 - DNA, 14 bp, Homo sapiens
tagaaaatataagt

SEQ ID NO: 4502439 - DNA, 16 bp, Homo sapiens
tagaaaatattctcta

SEQ ID NO: 4502440 - DNA, 15 bp, Homo sapiens
tagaaaatcttagta

SEQ ID NO: 4502441 - DNA, 17 bp, Homo sapiens
tagaaaatgacttattt

SEQ ID NO: 4502442 - DNA, 20 bp, Homo sapiens
tagaaaatgacttatttctg

SEQ ID NO: 4502443 - DNA, 22 bp, Homo sapiens
tagaaaatgacttatttctgct

SEQ ID NO: 4502444 - DNA, 19 bp, Homo sapiens
tagaaaattagtgaccatt

SEQ ID NO: 4502445 - DNA, 22 bp, Homo sapiens
tagaaaattagtgaccattatt

SEQ ID NO: 4502446 - DNA, 15 bp, Homo sapiens
tagaaaattcataac

SEQ ID NO: 4502447 - DNA, 22 bp, Homo sapiens
tagaaaatttgttattttgcaa

SEQ ID NO: 4502448 - DNA, 23 bp, Homo sapiens
tagaaaattttatgtattttaaa

SEQ ID NO: 4502449 - DNA, 16 bp, Homo sapiens
tagaaacagtgcaaca

SEQ ID NO: 4502450 - DNA, 22 bp, Homo sapiens
tagaaacgtaaactatgaccta

SEQ ID NO: 4502451 - DNA, 19 bp, Homo sapiens
tagaaactaattgacttta

SEQ ID NO: 4502452 - DNA, 16 bp, Homo sapiens
tagaaacttaaacaca

SEQ ID NO: 4502453 - DNA, 15 bp, Homo sapiens
tagaaacttccaaat

SEQ ID NO: 4502454 - DNA, 18 bp, Homo sapiens
tagaaagaataaaatgtt

SEQ ID NO: 4502455 - DNA, 19 bp, Homo sapiens
tagaaagaataaaatgttt

SEQ ID NO: 4502456 - DNA, 18 bp, Homo sapiens
tagaaagacatctgcctg

SEQ ID NO: 4502457 - DNA, 14 bp, Homo sapiens
tagaaagagttcta

SEQ ID NO: 4502458 - DNA, 16 bp, Homo sapiens
tagaaagagttctatg

SEQ ID NO: 4502459 - DNA, 19 bp, Homo sapiens
tagaaagcatccattaatt

SEQ ID NO: 4502460 - DNA, 23 bp, Homo sapiens
tagaaagcatccattaattaatg

SEQ ID NO: 4502461 - DNA, 13 bp, Homo sapiens
tagaaagctaaat

SEQ ID NO: 4502462 - DNA, 15 bp, Homo sapiens
tagaaagctaaatga

SEQ ID NO: 4502463 - DNA, 18 bp, Homo sapiens
tagaaagctgacattgcc

SEQ ID NO: 4502464 - DNA, 14 bp, Homo sapiens
tagaaataaattac

SEQ ID NO: 4502465 - DNA, 15 bp, Homo sapiens
tacgtttttctggtg

SEQ ID NO: 4502466 - DNA, 16 bp, Homo sapiens
tactaaaaatacaaaa

SEQ ID NO: 4502467 - DNA, 12 bp, Homo sapiens
tactaacctccc

SEQ ID NO: 4502468 - DNA, 22 bp, Homo sapiens
tactaagtggactggtgtcata

SEQ ID NO: 4502469 - DNA, 20 bp, Homo sapiens
tactaatagaataaaggcag

SEQ ID NO: 4502470 - DNA, 23 bp, Homo sapiens
tactaatagaataaaggcagttt

SEQ ID NO: 4502471 - DNA, 16 bp, Homo sapiens
tactaattccacacct

SEQ ID NO: 4502472 - DNA, 13 bp, Homo sapiens
tactacaatagtt

SEQ ID NO: 4502473 - DNA, 19 bp, Homo sapiens
tactacagctatatttgat

SEQ ID NO: 4502474 - DNA, 21 bp, Homo sapiens
tactacagtcaagatagaaag

SEQ ID NO: 4502475 - DNA, 12 bp, Homo sapiens
tactactttgtt

SEQ ID NO: 4502476 - DNA, 19 bp, Homo sapiens
tactactttgttaggattt

SEQ ID NO: 4502477 - DNA, 18 bp, Homo sapiens
tactagagatattttgta

SEQ ID NO: 4502478 - DNA, 21 bp, Homo sapiens
tactagtcaccagagacttta

SEQ ID NO: 4502479 - DNA, 14 bp, Homo sapiens
tactataatcaaat

SEQ ID NO: 4502480 - DNA, 16 bp, Homo sapiens
tactataatcaaatga

SEQ ID NO: 4502481 - DNA, 17 bp, Homo sapiens
tactataatcaaatgat

SEQ ID NO: 4502482 - DNA, 21 bp, Homo sapiens
tactataatcaaatgatttca

SEQ ID NO: 4502483 - DNA, 16 bp, Homo sapiens
tactatagcaaagtag

SEQ ID NO: 4502484 - DNA, 17 bp, Homo sapiens
tactatagcaaagtagt

SEQ ID NO: 4502485 - DNA, 12 bp, Homo sapiens
tactatagtacc

SEQ ID NO: 4502486 - DNA, 16 bp, Homo sapiens
tactatagtaccagta

SEQ ID NO: 4502487 - DNA, 14 bp, Homo sapiens
tactatgatcagaa

SEQ ID NO: 4502488 - DNA, 15 bp, Homo sapiens
tactatgcagtatct

SEQ ID NO: 4502489 - DNA, 15 bp, Homo sapiens
tactattaagcaaga

SEQ ID NO: 4502490 - DNA, 17 bp, Homo sapiens
tactcaaactccattct

SEQ ID NO: 4502491 - DNA, 13 bp, Homo sapiens
tactcaagtacca

SEQ ID NO: 4502492 - DNA, 18 bp, Homo sapiens
tactcacctctctctaag

SEQ ID NO: 4502493 - DNA, 16 bp, Homo sapiens
tactcagcagcagaga

SEQ ID NO: 4502494 - DNA, 17 bp, Homo sapiens
tactcagcagccctcct

SEQ ID NO: 4502495 - DNA, 19 bp, Homo sapiens
tactcagcagccctcctca

SEQ ID NO: 4502496 - DNA, 20 bp, Homo sapiens
tactcagcagccctcctcac

SEQ ID NO: 4502497 - DNA, 12 bp, Homo sapiens
tactcagccctg

SEQ ID NO: 4502498 - DNA, 15 bp, Homo sapiens
tactcattagaatta

SEQ ID NO: 4502499 - DNA, 14 bp, Homo sapiens
tactcatttttcat

SEQ ID NO: 4502500 - DNA, 17 bp, Homo sapiens
tactccacaccttttat

SEQ ID NO: 4502501 - DNA, 23 bp, Homo sapiens
tactcccacagcagccccaggag

SEQ ID NO: 4502502 - DNA, 15 bp, Homo sapiens
tactcctagaagaac

SEQ ID NO: 4502503 - DNA, 17 bp, Homo sapiens
tactcctagaagaacca

SEQ ID NO: 4502504 - DNA, 21 bp, Homo sapiens
tactcctagaagaaccaaata

SEQ ID NO: 4502505 - DNA, 13 bp, Homo sapiens
tactcctattttt

SEQ ID NO: 4502506 - DNA, 13 bp, Homo sapiens
tactcctcagacg

SEQ ID NO: 4502507 - DNA, 12 bp, Homo sapiens
tactcctctgca

SEQ ID NO: 4502508 - DNA, 13 bp, Homo sapiens
tactcctgcctca

SEQ ID NO: 4502509 - DNA, 22 bp, Homo sapiens
tactcgtgcattaaaatttctt

SEQ ID NO: 4502510 - DNA, 23 bp, Homo sapiens
tactctaaagcttctataaaata

SEQ ID NO: 4502511 - DNA, 18 bp, Homo sapiens
tactctaccatggttctg

SEQ ID NO: 4502512 - DNA, 15 bp, Homo sapiens
tactctccccacgag

SEQ ID NO: 4502513 - DNA, 16 bp, Homo sapiens
tactctgccctctaga

SEQ ID NO: 4502514 - DNA, 21 bp, Homo sapiens
tactctggaatgtttttccct

SEQ ID NO: 4502515 - DNA, 22 bp, Homo sapiens
tactcttaaatcatttggttaa

SEQ ID NO: 4502516 - DNA, 14 bp, Homo sapiens
tactcttgatttca

SEQ ID NO: 4502517 - DNA, 17 bp, Homo sapiens
tactctttctctcccct

SEQ ID NO: 4502518 - DNA, 15 bp, Homo sapiens
tactctttctgtata

SEQ ID NO: 4502519 - DNA, 17 bp, Homo sapiens
tactctttgaaagcttt

SEQ ID NO: 4502520 - DNA, 14 bp, Homo sapiens
tactctttgctttg

SEQ ID NO: 4502521 - DNA, 16 bp, Homo sapiens
tactctttgctttgta

SEQ ID NO: 4502522 - DNA, 19 bp, Homo sapiens
tactgaactacatgcataa

SEQ ID NO: 4502523 - DNA, 19 bp, Homo sapiens
tactgaaggaaaaacacaa

SEQ ID NO: 4502524 - DNA, 20 bp, Homo sapiens
tactgaaggaaaaacacaag

SEQ ID NO: 4502525 - DNA, 23 bp, Homo sapiens
tactgaaggaaaaacacaagcaa

SEQ ID NO: 4502526 - DNA, 11 bp, Homo sapiens
tactgaatgat

SEQ ID NO: 4502527 - DNA, 16 bp, Homo sapiens
tactgaatgttagaag

SEQ ID NO: 4502528 - DNA, 16 bp, Homo sapiens
tactgaatttttttgt

SEQ ID NO: 4502529 - DNA, 17 bp, Homo sapiens
tactgacagaagttatt

SEQ ID NO: 4502530 - DNA, 14 bp, Homo sapiens
tactgacagggagc

SEQ ID NO: 4502531 - DNA, 13 bp, Homo sapiens
tactgacttggat

SEQ ID NO: 4502532 - DNA, 20 bp, Homo sapiens
tactgagaaaagcctctcca

SEQ ID NO: 4502533 - DNA, 14 bp, Homo sapiens
tactgattgaatgt

SEQ ID NO: 4502534 - DNA, 19 bp, Homo sapiens
tactgatttcagtaagtct

SEQ ID NO: 4502535 - DNA, 22 bp, Homo sapiens
tactgatttgggctgaatgtat

SEQ ID NO: 4502536 - DNA, 21 bp, Homo sapiens
tactgcaaatcaggcttttgt

SEQ ID NO: 4502537 - DNA, 23 bp, Homo sapiens
tactgcaaatcaggcttttgttt

SEQ ID NO: 4502538 - DNA, 19 bp, Homo sapiens
tactgcactccagcctggg

SEQ ID NO: 4502539 - DNA, 15 bp, Homo sapiens
tactgcatacttttt

SEQ ID NO: 4502540 - DNA, 21 bp, Homo sapiens
tactgcatactttttaaatgt

SEQ ID NO: 4502541 - DNA, 10 bp, Homo sapiens
tactgcctgt

SEQ ID NO: 4502542 - DNA, 12 bp, Homo sapiens
tactgccttaat

SEQ ID NO: 4502543 - DNA, 16 bp, Homo sapiens
tactgctgattcttgt

SEQ ID NO: 4502544 - DNA, 22 bp, Homo sapiens
tactgctgattcttgtaaatct

SEQ ID NO: 4502545 - DNA, 13 bp, Homo sapiens
tactgctgctgct

SEQ ID NO: 4502546 - DNA, 21 bp, Homo sapiens
tactgcttctctttgtgcagt

SEQ ID NO: 4502547 - DNA, 20 bp, Homo sapiens
tactggaaatgtagcactta

SEQ ID NO: 4502548 - DNA, 21 bp, Homo sapiens
tactggaaatgtagcacttac

SEQ ID NO: 4502549 - DNA, 16 bp, Homo sapiens
tactggaattcttctg

SEQ ID NO: 4502550 - DNA, 19 bp, Homo sapiens
tactggacaatcttatgtt

SEQ ID NO: 4502551 - DNA, 13 bp, Homo sapiens
tactggagcctgc

SEQ ID NO: 4502552 - DNA, 18 bp, Homo sapiens
tactggcctttttcattt

SEQ ID NO: 4502553 - DNA, 14 bp, Homo sapiens
tactgggctaagga

SEQ ID NO: 4502554 - DNA, 22 bp, Homo sapiens
tactggggaggctgaggcagga

SEQ ID NO: 4502555 - DNA, 17 bp, Homo sapiens
tactgggtgtcatttca

SEQ ID NO: 4502556 - DNA, 23 bp, Homo sapiens
tactggtccaaaagattgctgaa

SEQ ID NO: 4502557 - DNA, 20 bp, Homo sapiens
tactggtgtagtgtgtcagc

SEQ ID NO: 4502558 - DNA, 22 bp, Homo sapiens
tactggtgtcaccctttgccta

SEQ ID NO: 4502559 - DNA, 14 bp, Homo sapiens
tactggttcattgt

SEQ ID NO: 4502560 - DNA, 12 bp, Homo sapiens
tactgtaagaat

SEQ ID NO: 4502561 - DNA, 19 bp, Homo sapiens
tactgtaagaataatttat

SEQ ID NO: 4502562 - DNA, 20 bp, Homo sapiens
tactgtaagaataatttata

SEQ ID NO: 4502563 - DNA, 13 bp, Homo sapiens
tactgtaattcct

SEQ ID NO: 4502564 - DNA, 15 bp, Homo sapiens
tactgtacaataaaa

SEQ ID NO: 4502565 - DNA, 14 bp, Homo sapiens
tactgtacacattt

SEQ ID NO: 4502566 - DNA, 13 bp, Homo sapiens
tactgtactatcc

SEQ ID NO: 4502567 - DNA, 23 bp, Homo sapiens
tactgtagttgtcacagtcttgt

SEQ ID NO: 4502568 - DNA, 20 bp, Homo sapiens
tactgtataacattaagaaa

SEQ ID NO: 4502569 - DNA, 15 bp, Homo sapiens
tactgtatattcagg

SEQ ID NO: 4502570 - DNA, 16 bp, Homo sapiens
tactgtatcaataaaa

SEQ ID NO: 4502571 - DNA, 19 bp, Homo sapiens
tactgtatcaataaaattc

SEQ ID NO: 4502572 - DNA, 20 bp, Homo sapiens
tactgtatcaataaaattct

SEQ ID NO: 4502573 - DNA, 22 bp, Homo sapiens
tactgtatcaataaaattctgt

SEQ ID NO: 4502574 - DNA, 14 bp, Homo sapiens
tactgtatcaattt

SEQ ID NO: 4502575 - DNA, 18 bp, Homo sapiens
tactgtatgtttttactg

SEQ ID NO: 4502576 - DNA, 19 bp, Homo sapiens
tactgtatgtttttactga

SEQ ID NO: 4502577 - DNA, 17 bp, Homo sapiens
tactgtattttgtattg

SEQ ID NO: 4502578 - DNA, 21 bp, Homo sapiens
tactgtatttttcagaaatca

SEQ ID NO: 4502579 - DNA, 15 bp, Homo sapiens
tactgtcaaacaata

SEQ ID NO: 4502580 - DNA, 23 bp, Homo sapiens
tactgtcatcctcaaagaaagtg

SEQ ID NO: 4502581 - DNA, 13 bp, Homo sapiens
tactgtctgtatc

SEQ ID NO: 4502582 - DNA, 15 bp, Homo sapiens
tactgtcttactatt

SEQ ID NO: 4502583 - DNA, 22 bp, Homo sapiens
tactgtgcatccgcctgaaagt

SEQ ID NO: 4502584 - DNA, 17 bp, Homo sapiens
tactgtgggcaatttag

SEQ ID NO: 4502585 - DNA, 16 bp, Homo sapiens
tactgtgtaatataaa

SEQ ID NO: 4502586 - DNA, 23 bp, Homo sapiens
tagatagggctgggcaaggaaaa

SEQ ID NO: 4502587 - DNA, 14 bp, Homo sapiens
tagatatcctctcc

SEQ ID NO: 4502588 - DNA, 14 bp, Homo sapiens
tagatattgctact

SEQ ID NO: 4502589 - DNA, 19 bp, Homo sapiens
tagatatttcgaccctggg

SEQ ID NO: 4502590 - DNA, 20 bp, Homo sapiens
tagatccattaatttaaatg

SEQ ID NO: 4502591 - DNA, 17 bp, Homo sapiens
tagatcctaagatgtgt

SEQ ID NO: 4502592 - DNA, 18 bp, Homo sapiens
tagatcctgcaccccagc

SEQ ID NO: 4502593 - DNA, 14 bp, Homo sapiens
tagatctctcctgc

SEQ ID NO: 4502594 - DNA, 17 bp, Homo sapiens
tagatcttatattggtt

SEQ ID NO: 4502595 - DNA, 20 bp, Homo sapiens
tagatgaatgtcagttgtta

SEQ ID NO: 4502596 - DNA, 15 bp, Homo sapiens
tagatgacaaatatt

SEQ ID NO: 4502597 - DNA, 22 bp, Homo sapiens
tagatgattttttgaaagttaa

SEQ ID NO: 4502598 - DNA, 17 bp, Homo sapiens
tagatgcttagtgtgaa

SEQ ID NO: 4502599 - DNA, 20 bp, Homo sapiens
tagatggcaagcatgtaact

SEQ ID NO: 4502600 - DNA, 18 bp, Homo sapiens
tagatggttacactgtta

SEQ ID NO: 4502601 - DNA, 18 bp, Homo sapiens
tagatgtaacctacaatt

SEQ ID NO: 4502602 - DNA, 20 bp, Homo sapiens
tagatgtatttttgatgtat

SEQ ID NO: 4502603 - DNA, 18 bp, Homo sapiens
tagatgtgcccttttata

SEQ ID NO: 4502604 - DNA, 21 bp, Homo sapiens
tagatgttctaagtctttcca

SEQ ID NO: 4502605 - DNA, 22 bp, Homo sapiens
tagattaagcttttcattttaa

SEQ ID NO: 4502606 - DNA, 14 bp, Homo sapiens
tagattacatctgc

SEQ ID NO: 4502607 - DNA, 18 bp, Homo sapiens
tagattacatctgcctta

SEQ ID NO: 4502608 - DNA, 19 bp, Homo sapiens
tagattacatctgccttaa

SEQ ID NO: 4502609 - DNA, 16 bp, Homo sapiens
tagattactgatgtga

SEQ ID NO: 4502610 - DNA, 15 bp, Homo sapiens
tagattattataaac

SEQ ID NO: 4502611 - DNA, 17 bp, Homo sapiens
tagattcacctgtaaaa

SEQ ID NO: 4502612 - DNA, 15 bp, Homo sapiens
tagattgagaaatgt

SEQ ID NO: 4502613 - DNA, 14 bp, Homo sapiens
tagattgattgtat

SEQ ID NO: 4502614 - DNA, 23 bp, Homo sapiens
tagattgattgtattgttgaaaa

SEQ ID NO: 4502615 - DNA, 19 bp, Homo sapiens
tagatttcatagttcagaa

SEQ ID NO: 4502616 - DNA, 20 bp, Homo sapiens
tagatttcatagttcagaat

SEQ ID NO: 4502617 - DNA, 23 bp, Homo sapiens
tagatttcatagttcagaattta

SEQ ID NO: 4502618 - DNA, 13 bp, Homo sapiens
tagatttctgaca

SEQ ID NO: 4502619 - DNA, 15 bp, Homo sapiens
tagatttgaaaaact

SEQ ID NO: 4502620 - DNA, 15 bp, Homo sapiens
tagatttgaaaattg

SEQ ID NO: 4502621 - DNA, 23 bp, Homo sapiens
tagatttgtgcaaacatggagaa

SEQ ID NO: 4502622 - DNA, 15 bp, Homo sapiens
tagcaaaaatgtttt

SEQ ID NO: 4502623 - DNA, 17 bp, Homo sapiens
tagcaaagcaaaaggct

SEQ ID NO: 4502624 - DNA, 15 bp, Homo sapiens
tagcaaagtaacatt

SEQ ID NO: 4502625 - DNA, 23 bp, Homo sapiens
tagcaaatcagtatattttctgt

SEQ ID NO: 4502626 - DNA, 23 bp, Homo sapiens
tagcaaatgacagatttctgtaa

SEQ ID NO: 4502627 - DNA, 15 bp, Homo sapiens
tagcaaatgtttact

SEQ ID NO: 4502628 - DNA, 21 bp, Homo sapiens
tagcaactacagtctaaagct

SEQ ID NO: 4502629 - DNA, 16 bp, Homo sapiens
tagcaagcttttgctc

SEQ ID NO: 4502630 - DNA, 22 bp, Homo sapiens
tagcaatacagggaggctcccg

SEQ ID NO: 4502631 - DNA, 12 bp, Homo sapiens
tagcaatggcca

SEQ ID NO: 4502632 - DNA, 20 bp, Homo sapiens
tagcaatggccagagcctct

SEQ ID NO: 4502633 - DNA, 19 bp, Homo sapiens
tagcaatgtaaaaatggtt

SEQ ID NO: 4502634 - DNA, 17 bp, Homo sapiens
tagcaatgtgccttgat

SEQ ID NO: 4502635 - DNA, 19 bp, Homo sapiens
tagcacagaggcctgactg

SEQ ID NO: 4502636 - DNA, 17 bp, Homo sapiens
tagcacagattttgaat

SEQ ID NO: 4502637 - DNA, 22 bp, Homo sapiens
tagcacagattttgaatctgtg

SEQ ID NO: 4502638 - DNA, 18 bp, Homo sapiens
tagcacgtttaaagttct

SEQ ID NO: 4502639 - DNA, 20 bp, Homo sapiens
tagcacgtttaaagttctgt

SEQ ID NO: 4502640 - DNA, 18 bp, Homo sapiens
tagcactgccccacatgc

SEQ ID NO: 4502641 - DNA, 19 bp, Homo sapiens
tagcactgccccacatgca

SEQ ID NO: 4502642 - DNA, 23 bp, Homo sapiens
tagcacttacgtaaaacatttgt

SEQ ID NO: 4502643 - DNA, 14 bp, Homo sapiens
tagcagcaggctca

SEQ ID NO: 4502644 - DNA, 15 bp, Homo sapiens
tagcagccctggatg

SEQ ID NO: 4502645 - DNA, 19 bp, Homo sapiens
tagcagcgctcgctgacag

SEQ ID NO: 4502646 - DNA, 22 bp, Homo sapiens
tagcaggactgaattgtcccca

SEQ ID NO: 4502647 - DNA, 17 bp, Homo sapiens
tagcaggctgttccatg

SEQ ID NO: 4502648 - DNA, 16 bp, Homo sapiens
tagcagggatgttcct

SEQ ID NO: 4502649 - DNA, 22 bp, Homo sapiens
tagcaggggaattccctccccc

SEQ ID NO: 4502650 - DNA, 23 bp, Homo sapiens
tagcagtattgttcgttctgata

SEQ ID NO: 4502651 - DNA, 13 bp, Homo sapiens
tagcagttataac

SEQ ID NO: 4502652 - DNA, 16 bp, Homo sapiens
tagcagttataacaga

SEQ ID NO: 4502653 - DNA, 20 bp, Homo sapiens
tagcagttataacagatgtg

SEQ ID NO: 4502654 - DNA, 22 bp, Homo sapiens
tagcagttataacagatgtgaa

SEQ ID NO: 4502655 - DNA, 23 bp, Homo sapiens
tagcagttataacagatgtgaaa

SEQ ID NO: 4502656 - DNA, 14 bp, Homo sapiens
tagcagttctgcaa

SEQ ID NO: 4502657 - DNA, 17 bp, Homo sapiens
tagcagttctgcaaata

SEQ ID NO: 4502658 - DNA, 17 bp, Homo sapiens
tagcataaaaaccacat

SEQ ID NO: 4502659 - DNA, 13 bp, Homo sapiens
tagcataaggtct

SEQ ID NO: 4502660 - DNA, 15 bp, Homo sapiens
tagcataaggtctgg

SEQ ID NO: 4502661 - DNA, 17 bp, Homo sapiens
tagcatgaacgccaagg

SEQ ID NO: 4502662 - DNA, 22 bp, Homo sapiens
tagcattacccccaacctcatt

SEQ ID NO: 4502663 - DNA, 14 bp, Homo sapiens
tagcattctttgga

SEQ ID NO: 4502664 - DNA, 22 bp, Homo sapiens
tagcatttatttctctggcaaa

SEQ ID NO: 4502665 - DNA, 15 bp, Homo sapiens
tagccaaagatttca

SEQ ID NO: 4502666 - DNA, 23 bp, Homo sapiens
tagccaaagatttcatatctaac

SEQ ID NO: 4502667 - DNA, 16 bp, Homo sapiens
tagccacagctgctgt

SEQ ID NO: 4502668 - DNA, 14 bp, Homo sapiens
tagccagcgtttat

SEQ ID NO: 4502669 - DNA, 17 bp, Homo sapiens
tagcccaagaggtctga

SEQ ID NO: 4502670 - DNA, 13 bp, Homo sapiens
tagcccagagtga

SEQ ID NO: 4502671 - DNA, 12 bp, Homo sapiens
tagccccctcat

SEQ ID NO: 4502672 - DNA, 16 bp, Homo sapiens
tagcccgcctgccagt

SEQ ID NO: 4502673 - DNA, 19 bp, Homo sapiens
tagcccgcctgccagtcct

SEQ ID NO: 4502674 - DNA, 12 bp, Homo sapiens
tagccctgccct

SEQ ID NO: 4502675 - DNA, 21 bp, Homo sapiens
tagccctgccctcccaagtcc

SEQ ID NO: 4502676 - DNA, 14 bp, Homo sapiens
tagccgagagcctg

SEQ ID NO: 4502677 - DNA, 22 bp, Homo sapiens
tagccgatatcagaatttgtgt

SEQ ID NO: 4502678 - DNA, 15 bp, Homo sapiens
tagccgggcatggtg

SEQ ID NO: 4502679 - DNA, 23 bp, Homo sapiens
tagcctcacggggttggctgttc

SEQ ID NO: 4502680 - DNA, 12 bp, Homo sapiens
tagcctccctga

SEQ ID NO: 4502681 - DNA, 23 bp, Homo sapiens
tagcctcctcctgggctccagag

SEQ ID NO: 4502682 - DNA, 15 bp, Homo sapiens
tagcctctcccaccc

SEQ ID NO: 4502683 - DNA, 18 bp, Homo sapiens
tagcctgaattgctttct

SEQ ID NO: 4502684 - DNA, 23 bp, Homo sapiens
tagcctgcagaagtaagcctcat

SEQ ID NO: 4502685 - DNA, 18 bp, Homo sapiens
tagcggagcccagcctgg

SEQ ID NO: 4502686 - DNA, 15 bp, Homo sapiens
tagcggccctggagg

SEQ ID NO: 4502687 - DNA, 21 bp, Homo sapiens
tagcgtcaagacatttgctga

SEQ ID NO: 4502688 - DNA, 19 bp, Homo sapiens
tagctaaacggattccaaa

SEQ ID NO: 4502689 - DNA, 20 bp, Homo sapiens
tagctaaacggattccaaag

SEQ ID NO: 4502690 - DNA, 17 bp, Homo sapiens
tagctaaattcagggag

SEQ ID NO: 4502691 - DNA, 19 bp, Homo sapiens
tagctaacagttgccacat

SEQ ID NO: 4502692 - DNA, 14 bp, Homo sapiens
tagctaagtacaca

SEQ ID NO: 4502693 - DNA, 15 bp, Homo sapiens
tagctaagtacacaa

SEQ ID NO: 4502694 - DNA, 15 bp, Homo sapiens
tagctacaatttgtt

SEQ ID NO: 4502695 - DNA, 16 bp, Homo sapiens
tagctacaatttgttt

SEQ ID NO: 4502696 - DNA, 23 bp, Homo sapiens
tagctacaatttgtttttgcatt

SEQ ID NO: 4502697 - DNA, 12 bp, Homo sapiens
tagctacactga

SEQ ID NO: 4502698 - DNA, 20 bp, Homo sapiens
tagctacaggaagcacccca

SEQ ID NO: 4502699 - DNA, 22 bp, Homo sapiens
tagctactaaatatatattatg

SEQ ID NO: 4502700 - DNA, 19 bp, Homo sapiens
tagctagaagtgggccagg

SEQ ID NO: 4502701 - DNA, 20 bp, Homo sapiens
tagctagaagtgggccagga

SEQ ID NO: 4502702 - DNA, 14 bp, Homo sapiens
tagctatgctgtat

SEQ ID NO: 4502703 - DNA, 16 bp, Homo sapiens
tagctatgctgtatct

SEQ ID NO: 4502704 - DNA, 15 bp, Homo sapiens
tagctattactggat

SEQ ID NO: 4502705 - DNA, 15 bp, Homo sapiens
tagctcaattagtgt

SEQ ID NO: 4502706 - DNA, 16 bp, Homo sapiens
tagaaataaattactt

SEQ ID NO: 4502707 - DNA, 22 bp, Homo sapiens
tagaaatagctccgtggagcag

SEQ ID NO: 4502708 - DNA, 14 bp, Homo sapiens
tagaaatattttaa

SEQ ID NO: 4502709 - DNA, 16 bp, Homo sapiens
tagaaatcattttgca

SEQ ID NO: 4502710 - DNA, 22 bp, Homo sapiens
tagaaatgcataccagtaattg

SEQ ID NO: 4502711 - DNA, 16 bp, Homo sapiens
tagaaattacctgtgg

SEQ ID NO: 4502712 - DNA, 18 bp, Homo sapiens
tagaaattacctgtggat

SEQ ID NO: 4502713 - DNA, 16 bp, Homo sapiens
tagaaattagatttgt

SEQ ID NO: 4502714 - DNA, 18 bp, Homo sapiens
tagaaattttgtaagaag

SEQ ID NO: 4502715 - DNA, 22 bp, Homo sapiens
tagaaattttgtaagaaggcaa

SEQ ID NO: 4502716 - DNA, 14 bp, Homo sapiens
tagaacactatttt

SEQ ID NO: 4502717 - DNA, 22 bp, Homo sapiens
tagaacatggagagctagaacc

SEQ ID NO: 4502718 - DNA, 17 bp, Homo sapiens
tagaaccaagaagggct

SEQ ID NO: 4502719 - DNA, 15 bp, Homo sapiens
tagaaccacagcaga

SEQ ID NO: 4502720 - DNA, 15 bp, Homo sapiens
tagaaccactatgaa

SEQ ID NO: 4502721 - DNA, 13 bp, Homo sapiens
tagaacctagaag

SEQ ID NO: 4502722 - DNA, 23 bp, Homo sapiens
tagaacctagagaagctaaaacc

SEQ ID NO: 4502723 - DNA, 16 bp, Homo sapiens
tagaacgtgcatcctt

SEQ ID NO: 4502724 - DNA, 22 bp, Homo sapiens
tagaacgtgcatccttgtaata

SEQ ID NO: 4502725 - DNA, 14 bp, Homo sapiens
tagaactagccaaa

SEQ ID NO: 4502726 - DNA, 19 bp, Homo sapiens
tagaactctgaaatgaaga

SEQ ID NO: 4502727 - DNA, 17 bp, Homo sapiens
tagaactgaactgtaac

SEQ ID NO: 4502728 - DNA, 22 bp, Homo sapiens
tagaactggagaggctagaacc

SEQ ID NO: 4502729 - DNA, 15 bp, Homo sapiens
tagaactgtctgtga

SEQ ID NO: 4502730 - DNA, 21 bp, Homo sapiens
tagaacttcatggatcagatc

SEQ ID NO: 4502731 - DNA, 16 bp, Homo sapiens
tagaactttgtatttt

SEQ ID NO: 4502732 - DNA, 16 bp, Homo sapiens
tagaagaaagatgttt

SEQ ID NO: 4502733 - DNA, 20 bp, Homo sapiens
tagaagaaccaaatacctca

SEQ ID NO: 4502734 - DNA, 21 bp, Homo sapiens
tagaagaaccaaatacctcaa

SEQ ID NO: 4502735 - DNA, 22 bp, Homo sapiens
tagaagagaagagccatcttgg

SEQ ID NO: 4502736 - DNA, 14 bp, Homo sapiens
tagaagatgtgtaa

SEQ ID NO: 4502737 - DNA, 22 bp, Homo sapiens
tagaagatgtgtaaacaggtat

SEQ ID NO: 4502738 - DNA, 15 bp, Homo sapiens
tagaagccaagggaa

SEQ ID NO: 4502739 - DNA, 12 bp, Homo sapiens
tagaagcctgca

SEQ ID NO: 4502740 - DNA, 19 bp, Homo sapiens
tagaagcgctcatctggct

SEQ ID NO: 4502741 - DNA, 14 bp, Homo sapiens
tagaagctggagga

SEQ ID NO: 4502742 - DNA, 24 bp, Homo sapiens
tagaagcttcagcaggaggcaagc

SEQ ID NO: 4502743 - DNA, 20 bp, Homo sapiens
tagaaggaagtgtgtttgcc

SEQ ID NO: 4502744 - DNA, 20 bp, Homo sapiens
tagaagtccacagacatctt

SEQ ID NO: 4502745 - DNA, 16 bp, Homo sapiens
tagaagtggaccagga

SEQ ID NO: 4502746 - DNA, 16 bp, Homo sapiens
tagaagtgggccagga

SEQ ID NO: 4502747 - DNA, 22 bp, Homo sapiens
tagaataaaggcagttttctaa

SEQ ID NO: 4502748 - DNA, 14 bp, Homo sapiens
tagaataaatgaag

SEQ ID NO: 4502749 - DNA, 21 bp, Homo sapiens
tagaatagggggatataatac

SEQ ID NO: 4502750 - DNA, 19 bp, Homo sapiens
tagaatgaatttatcttta

SEQ ID NO: 4502751 - DNA, 16 bp, Homo sapiens
tagaatgccggttaaa

SEQ ID NO: 4502752 - DNA, 19 bp, Homo sapiens
tagaatgttattgtgtata

SEQ ID NO: 4502753 - DNA, 12 bp, Homo sapiens
tagaatgttgaa

SEQ ID NO: 4502754 - DNA, 19 bp, Homo sapiens
tagaatgttttcaaatgtt

SEQ ID NO: 4502755 - DNA, 13 bp, Homo sapiens
tagaattaaaatt

SEQ ID NO: 4502756 - DNA, 15 bp, Homo sapiens
tagaattaccatttg

SEQ ID NO: 4502757 - DNA, 19 bp, Homo sapiens
tagaattaccatttgttaa

SEQ ID NO: 4502758 - DNA, 16 bp, Homo sapiens
tagaattatctaattt

SEQ ID NO: 4502759 - DNA, 13 bp, Homo sapiens
tagaattgcattg

SEQ ID NO: 4502760 - DNA, 15 bp, Homo sapiens
tagaattgcattgac

SEQ ID NO: 4502761 - DNA, 16 bp, Homo sapiens
tagaatttcctgtaat

SEQ ID NO: 4502762 - DNA, 14 bp, Homo sapiens
tagacaaaaagtat

SEQ ID NO: 4502763 - DNA, 15 bp, Homo sapiens
tagacaaaaagtata

SEQ ID NO: 4502764 - DNA, 14 bp, Homo sapiens
tagacaaagtacat

SEQ ID NO: 4502765 - DNA, 13 bp, Homo sapiens
tagacaagttttg

SEQ ID NO: 4502766 - DNA, 16 bp, Homo sapiens
tagacaatcattgttt

SEQ ID NO: 4502767 - DNA, 20 bp, Homo sapiens
tagacaatcattgttttgaa

SEQ ID NO: 4502768 - DNA, 19 bp, Homo sapiens
tagacaattcctccagaga

SEQ ID NO: 4502769 - DNA, 18 bp, Homo sapiens
tagacaattgaggtaagt

SEQ ID NO: 4502770 - DNA, 16 bp, Homo sapiens
tagacacaatttcatt

SEQ ID NO: 4502771 - DNA, 21 bp, Homo sapiens
tagacacaatttcatttccag

SEQ ID NO: 4502772 - DNA, 22 bp, Homo sapiens
tagacacatgaaggtaaataaa

SEQ ID NO: 4502773 - DNA, 15 bp, Homo sapiens
tagacacatttaagg

SEQ ID NO: 4502774 - DNA, 18 bp, Homo sapiens
tagacagagttgcttaat

SEQ ID NO: 4502775 - DNA, 21 bp, Homo sapiens
tagacagagttgcttaatgaa

SEQ ID NO: 4502776 - DNA, 14 bp, Homo sapiens
tagacatctgtcct

SEQ ID NO: 4502777 - DNA, 15 bp, Homo sapiens
tagacattctcacat

SEQ ID NO: 4502778 - DNA, 19 bp, Homo sapiens
tagacatttgtaaatgtaa

SEQ ID NO: 4502779 - DNA, 23 bp, Homo sapiens
tagaccatttatctgggattatg

SEQ ID NO: 4502780 - DNA, 16 bp, Homo sapiens
tagaccctgggtgggc

SEQ ID NO: 4502781 - DNA, 22 bp, Homo sapiens
tagaccttttttttttttccaa

SEQ ID NO: 4502782 - DNA, 13 bp, Homo sapiens
tagactagagaaa

SEQ ID NO: 4502783 - DNA, 14 bp, Homo sapiens
tagactataaatgt

SEQ ID NO: 4502784 - DNA, 21 bp, Homo sapiens
tagactcatggtgtgttacac

SEQ ID NO: 4502785 - DNA, 16 bp, Homo sapiens
tagactctagtattta

SEQ ID NO: 4502786 - DNA, 17 bp, Homo sapiens
tagactgtgattcagaa

SEQ ID NO: 4502787 - DNA, 18 bp, Homo sapiens
tagactgtgccagaggcc

SEQ ID NO: 4502788 - DNA, 19 bp, Homo sapiens
tagactgttactttggcaa

SEQ ID NO: 4502789 - DNA, 14 bp, Homo sapiens
tagacttccccatc

SEQ ID NO: 4502790 - DNA, 14 bp, Homo sapiens
tagacttgctccct

SEQ ID NO: 4502791 - DNA, 15 bp, Homo sapiens
tagacttgctccctc

SEQ ID NO: 4502792 - DNA, 20 bp, Homo sapiens
tagacttgctccctctccaa

SEQ ID NO: 4502793 - DNA, 19 bp, Homo sapiens
tagagaaaccgtcctcttt

SEQ ID NO: 4502794 - DNA, 22 bp, Homo sapiens
tagagaaaccgtcctctttttc

SEQ ID NO: 4502795 - DNA, 20 bp, Homo sapiens
tagagaacacgcgtatttac

SEQ ID NO: 4502796 - DNA, 17 bp, Homo sapiens
tagagaacgcagcccta

SEQ ID NO: 4502797 - DNA, 18 bp, Homo sapiens
tagagaatccgtattgaa

SEQ ID NO: 4502798 - DNA, 14 bp, Homo sapiens
tagagaatgcacag

SEQ ID NO: 4502799 - DNA, 12 bp, Homo sapiens
tagagacacatt

SEQ ID NO: 4502800 - DNA, 16 bp, Homo sapiens
tagagacagatgctgg

SEQ ID NO: 4502801 - DNA, 18 bp, Homo sapiens
tagagacagatgctggtg

SEQ ID NO: 4502802 - DNA, 20 bp, Homo sapiens
tagagagtctccaagagaac

SEQ ID NO: 4502803 - DNA, 21 bp, Homo sapiens
tagagatattttgtaaaatgt

SEQ ID NO: 4502804 - DNA, 19 bp, Homo sapiens
tagagattacctcctgaga

SEQ ID NO: 4502805 - DNA, 17 bp, Homo sapiens
tagagcaaaatcaacat

SEQ ID NO: 4502806 - DNA, 21 bp, Homo sapiens
tagagcaaaatcaacatgact

SEQ ID NO: 4502807 - DNA, 14 bp, Homo sapiens
tagagcaaagccat

SEQ ID NO: 4502808 - DNA, 21 bp, Homo sapiens
tagagccaggcacacactgtg

SEQ ID NO: 4502809 - DNA, 17 bp, Homo sapiens
tagagcctgcctggagc

SEQ ID NO: 4502810 - DNA, 18 bp, Homo sapiens
tagagcctgcctggagcg

SEQ ID NO: 4502811 - DNA, 15 bp, Homo sapiens
tagagctttttaata

SEQ ID NO: 4502812 - DNA, 18 bp, Homo sapiens
tagaggccagccccaccc

SEQ ID NO: 4502813 - DNA, 20 bp, Homo sapiens
tagaggccagccccacccag

SEQ ID NO: 4502814 - DNA, 20 bp, Homo sapiens
tagaggcttctccgccagcc

SEQ ID NO: 4502815 - DNA, 23 bp, Homo sapiens
tagaggcttctccgccagcctcc

SEQ ID NO: 4502816 - DNA, 23 bp, Homo sapiens
tagaggggagacattagaaaaaa

SEQ ID NO: 4502817 - DNA, 16 bp, Homo sapiens
tagaggggctgcaggg

SEQ ID NO: 4502818 - DNA, 20 bp, Homo sapiens
tagagtaacgagaagtgctt

SEQ ID NO: 4502819 - DNA, 14 bp, Homo sapiens
tagagtaatgatgt

SEQ ID NO: 4502820 - DNA, 16 bp, Homo sapiens
tagagtaatgatgtaa

SEQ ID NO: 4502821 - DNA, 18 bp, Homo sapiens
tagagtcaactacacaaa

SEQ ID NO: 4502822 - DNA, 19 bp, Homo sapiens
tagagttttattcctttcc

SEQ ID NO: 4502823 - DNA, 23 bp, Homo sapiens
tagataacaagacctcagtgcct

SEQ ID NO: 4502824 - DNA, 17 bp, Homo sapiens
tagataacttcttgaaa

SEQ ID NO: 4502825 - DNA, 17 bp, Homo sapiens
tagataatatttctgaa

SEQ ID NO: 4502826 - DNA, 15 bp, Homo sapiens
tagtaatgttttata

SEQ ID NO: 4502827 - DNA, 14 bp, Homo sapiens
tagtaattgacatg

SEQ ID NO: 4502828 - DNA, 23 bp, Homo sapiens
tagtaatttattgtctgtctaca

SEQ ID NO: 4502829 - DNA, 14 bp, Homo sapiens
tagtaccaaaataa

SEQ ID NO: 4502830 - DNA, 19 bp, Homo sapiens
tagtacttcttctgtaata

SEQ ID NO: 4502831 - DNA, 16 bp, Homo sapiens
tagtagaaagtggaaa

SEQ ID NO: 4502832 - DNA, 19 bp, Homo sapiens
tagtagcaatgtgccttga

SEQ ID NO: 4502833 - DNA, 20 bp, Homo sapiens
tagtagcagtgattgtctta

SEQ ID NO: 4502834 - DNA, 22 bp, Homo sapiens
tagtagtcaaaaacaaagctga

SEQ ID NO: 4502835 - DNA, 13 bp, Homo sapiens
tagtatcaaaaga

SEQ ID NO: 4502836 - DNA, 16 bp, Homo sapiens
tagtatggcctgacag

SEQ ID NO: 4502837 - DNA, 21 bp, Homo sapiens
tagtatggcctgacagctctg

SEQ ID NO: 4502838 - DNA, 22 bp, Homo sapiens
tagtattatcttgttcaggaaa

SEQ ID NO: 4502839 - DNA, 14 bp, Homo sapiens
tagtattatgtcac

SEQ ID NO: 4502840 - DNA, 14 bp, Homo sapiens
tagtattcaggcac

SEQ ID NO: 4502841 - DNA, 18 bp, Homo sapiens
tagtatttaactacatct

SEQ ID NO: 4502842 - DNA, 20 bp, Homo sapiens
tagtatttaactacatctgc

SEQ ID NO: 4502843 - DNA, 18 bp, Homo sapiens
tagtatttctcctttgca

SEQ ID NO: 4502844 - DNA, 20 bp, Homo sapiens
tagtatttctcctttgcaat

SEQ ID NO: 4502845 - DNA, 21 bp, Homo sapiens
tagtattttaggtgctgttat

SEQ ID NO: 4502846 - DNA, 13 bp, Homo sapiens
tagtatttttatc

SEQ ID NO: 4502847 - DNA, 18 bp, Homo sapiens
tagtcaccagagacttta

SEQ ID NO: 4502848 - DNA, 17 bp, Homo sapiens
tagtcactggaaattga

SEQ ID NO: 4502849 - DNA, 20 bp, Homo sapiens
tagtcatttaggatccatgc

SEQ ID NO: 4502850 - DNA, 19 bp, Homo sapiens
tagtccatcaccatttctt

SEQ ID NO: 4502851 - DNA, 20 bp, Homo sapiens
tagtcccatttttctcttgc

SEQ ID NO: 4502852 - DNA, 15 bp, Homo sapiens
tagtccccagagctc

SEQ ID NO: 4502853 - DNA, 18 bp, Homo sapiens
tagtccccagagctcccc

SEQ ID NO: 4502854 - DNA, 14 bp, Homo sapiens
tagtcccttcccct

SEQ ID NO: 4502855 - DNA, 20 bp, Homo sapiens
tagtcccttcccctccctgg

SEQ ID NO: 4502856 - DNA, 10 bp, Homo sapiens
tagtccttgg

SEQ ID NO: 4502857 - DNA, 15 bp, Homo sapiens
tagtctatcagcatc

SEQ ID NO: 4502858 - DNA, 17 bp, Homo sapiens
tagtctatgtgattctg

SEQ ID NO: 4502859 - DNA, 23 bp, Homo sapiens
tagtctgtgtgggactgtacaca

SEQ ID NO: 4502860 - DNA, 22 bp, Homo sapiens
tagtcttccacaaaaaatactt

SEQ ID NO: 4502861 - DNA, 20 bp, Homo sapiens
tagtcttgaaatgaaaggga

SEQ ID NO: 4502862 - DNA, 11 bp, Homo sapiens
tagtcttggaa

SEQ ID NO: 4502863 - DNA, 17 bp, Homo sapiens
tagtctttgtttacatg

SEQ ID NO: 4502864 - DNA, 24 bp, Homo sapiens
tagtctttgtttacatgagttcaa

SEQ ID NO: 4502865 - DNA, 21 bp, Homo sapiens
tagtctttttttccttccttt

SEQ ID NO: 4502866 - DNA, 20 bp, Homo sapiens
tagtgaaccaaaaatagaaa

SEQ ID NO: 4502867 - DNA, 21 bp, Homo sapiens
tagtgaaccaaaaatagaaat

SEQ ID NO: 4502868 - DNA, 22 bp, Homo sapiens
tagtgaagtgttaatacatcac

SEQ ID NO: 4502869 - DNA, 16 bp, Homo sapiens
tagtgaccattattca

SEQ ID NO: 4502870 - DNA, 17 bp, Homo sapiens
tagtgcaaaaactgtaa

SEQ ID NO: 4502871 - DNA, 18 bp, Homo sapiens
tagtgcaaaaactgtaaa

SEQ ID NO: 4502872 - DNA, 15 bp, Homo sapiens
tagtgcaacttagat

SEQ ID NO: 4502873 - DNA, 17 bp, Homo sapiens
tagtgcatttttaaact

SEQ ID NO: 4502874 - DNA, 19 bp, Homo sapiens
tagtgcatttttaaacttg

SEQ ID NO: 4502875 - DNA, 23 bp, Homo sapiens
tagtgcatttttaaacttgaaat

SEQ ID NO: 4502876 - DNA, 14 bp, Homo sapiens
tagtggaaaaacac

SEQ ID NO: 4502877 - DNA, 19 bp, Homo sapiens
tagtggcataccaaatggc

SEQ ID NO: 4502878 - DNA, 15 bp, Homo sapiens
tagtgggtacatcaa

SEQ ID NO: 4502879 - DNA, 13 bp, Homo sapiens
tagtgtaagaact

SEQ ID NO: 4502880 - DNA, 17 bp, Homo sapiens
tagtgtaagaactgtac

SEQ ID NO: 4502881 - DNA, 15 bp, Homo sapiens
tagtgtatgattact

SEQ ID NO: 4502882 - DNA, 14 bp, Homo sapiens
tagtgtattaatca

SEQ ID NO: 4502883 - DNA, 16 bp, Homo sapiens
tagtgtcctatgcaat

SEQ ID NO: 4502884 - DNA, 18 bp, Homo sapiens
tagtgtctggatcagtaa

SEQ ID NO: 4502885 - DNA, 15 bp, Homo sapiens
tagtgtgtaaaatta

SEQ ID NO: 4502886 - DNA, 16 bp, Homo sapiens
tagtgtgtaaaattaa

SEQ ID NO: 4502887 - DNA, 12 bp, Homo sapiens
tagtgtgttgtg

SEQ ID NO: 4502888 - DNA, 20 bp, Homo sapiens
tagtgtgttgtgctttcaag

SEQ ID NO: 4502889 - DNA, 18 bp, Homo sapiens
tagtgttaatgactcttt

SEQ ID NO: 4502890 - DNA, 20 bp, Homo sapiens
tagtgttcaaaacaaaatga

SEQ ID NO: 4502891 - DNA, 15 bp, Homo sapiens
tagtgttcacaaact

SEQ ID NO: 4502892 - DNA, 20 bp, Homo sapiens
tagtgttgtccctactttct

SEQ ID NO: 4502893 - DNA, 21 bp, Homo sapiens
tagtgtttggacagctgataa

SEQ ID NO: 4502894 - DNA, 14 bp, Homo sapiens
tagttaaaaattaa

SEQ ID NO: 4502895 - DNA, 20 bp, Homo sapiens
tagttaaaaattaaatattt

SEQ ID NO: 4502896 - DNA, 14 bp, Homo sapiens
tagttaaaactcat

SEQ ID NO: 4502897 - DNA, 17 bp, Homo sapiens
tagttaaagaaaggaaa

SEQ ID NO: 4502898 - DNA, 18 bp, Homo sapiens
tagttaaagaaaggaaaa

SEQ ID NO: 4502899 - DNA, 21 bp, Homo sapiens
tagttaaagaaaggaaaagaa

SEQ ID NO: 4502900 - DNA, 19 bp, Homo sapiens
tagttaagacatgatttcc

SEQ ID NO: 4502901 - DNA, 14 bp, Homo sapiens
tagttaatataaat

SEQ ID NO: 4502902 - DNA, 18 bp, Homo sapiens
tagttaccttatagttac

SEQ ID NO: 4502903 - DNA, 20 bp, Homo sapiens
tagttactaaaatttacaca

SEQ ID NO: 4502904 - DNA, 18 bp, Homo sapiens
tagttactgtgtaattag

SEQ ID NO: 4502905 - DNA, 16 bp, Homo sapiens
tagttagatctttgta

SEQ ID NO: 4502906 - DNA, 22 bp, Homo sapiens
tagttataaaaggctttagtag

SEQ ID NO: 4502907 - DNA, 14 bp, Homo sapiens
tagttattaaatgt

SEQ ID NO: 4502908 - DNA, 15 bp, Homo sapiens
tagttattaaatgtt

SEQ ID NO: 4502909 - DNA, 14 bp, Homo sapiens
tagttattttatag

SEQ ID NO: 4502910 - DNA, 23 bp, Homo sapiens
tagttcagaatttagtgtatcca

SEQ ID NO: 4502911 - DNA, 22 bp, Homo sapiens
tagttcagcatccgcaggtgct

SEQ ID NO: 4502912 - DNA, 20 bp, Homo sapiens
tagttctatccttttgcctg

SEQ ID NO: 4502913 - DNA, 14 bp, Homo sapiens
tagttctgccagga

SEQ ID NO: 4502914 - DNA, 16 bp, Homo sapiens
tagttctgtgcctccc

SEQ ID NO: 4502915 - DNA, 18 bp, Homo sapiens
tagttctgtgcctccccc

SEQ ID NO: 4502916 - DNA, 23 bp, Homo sapiens
tagttcttgggggaggccacccc

SEQ ID NO: 4502917 - DNA, 20 bp, Homo sapiens
tagttctttcctccccctgc

SEQ ID NO: 4502918 - DNA, 18 bp, Homo sapiens
tagttgcaaagagacatt

SEQ ID NO: 4502919 - DNA, 21 bp, Homo sapiens
tagttgcaaagagacatttca

SEQ ID NO: 4502920 - DNA, 17 bp, Homo sapiens
tagttggcagaaataca

SEQ ID NO: 4502921 - DNA, 20 bp, Homo sapiens
tagttgggtagaaaaattat

SEQ ID NO: 4502922 - DNA, 15 bp, Homo sapiens
tagttgtgtttcaac

SEQ ID NO: 4502923 - DNA, 18 bp, Homo sapiens
tagttgttggtctgtagc

SEQ ID NO: 4502924 - DNA, 21 bp, Homo sapiens
tagttgtttctagactataaa

SEQ ID NO: 4502925 - DNA, 18 bp, Homo sapiens
tagtttaagggtggaaaa

SEQ ID NO: 4502926 - DNA, 12 bp, Homo sapiens
tagtttacacac

SEQ ID NO: 4502927 - DNA, 12 bp, Homo sapiens
tagtttatctta

SEQ ID NO: 4502928 - DNA, 13 bp, Homo sapiens
tagtttatttctg

SEQ ID NO: 4502929 - DNA, 22 bp, Homo sapiens
tagtttatttctgtgaaagaag

SEQ ID NO: 4502930 - DNA, 23 bp, Homo sapiens
tagtttgaaagttgtacatgata

SEQ ID NO: 4502931 - DNA, 14 bp, Homo sapiens
tagtttgaatgttt

SEQ ID NO: 4502932 - DNA, 21 bp, Homo sapiens
tagtttgattattcagtgtca

SEQ ID NO: 4502933 - DNA, 21 bp, Homo sapiens
tagtttgcatttaagaattgc

SEQ ID NO: 4502934 - DNA, 18 bp, Homo sapiens
tagtttgttcttcagatt

SEQ ID NO: 4502935 - DNA, 13 bp, Homo sapiens
tagttttacacta

SEQ ID NO: 4502936 - DNA, 21 bp, Homo sapiens
tagttttcttcctttgaaaga

SEQ ID NO: 4502937 - DNA, 14 bp, Homo sapiens
tagttttgtataca

SEQ ID NO: 4502938 - DNA, 21 bp, Homo sapiens
tagtttttaaaatttatttgc

SEQ ID NO: 4502939 - DNA, 22 bp, Homo sapiens
tagtttttaaaatttatttgca

SEQ ID NO: 4502940 - DNA, 22 bp, Homo sapiens
tagtttttaacaatctaacaat

SEQ ID NO: 4502941 - DNA, 16 bp, Homo sapiens
tagtttttaattaaaa

SEQ ID NO: 4502942 - DNA, 15 bp, Homo sapiens
tagtttttatatgtt

SEQ ID NO: 4502943 - DNA, 14 bp, Homo sapiens
tagtttttcacttt

SEQ ID NO: 4502944 - DNA, 14 bp, Homo sapiens
tagtttttcattaa

SEQ ID NO: 4502945 - DNA, 21 bp, Homo sapiens
tagtttttcctatcatgttaa

SEQ ID NO: 4502946 - DNA, 11 bp, Homo sapiens
tagctccagcg

SEQ ID NO: 4502947 - DNA, 21 bp, Homo sapiens
tagctcctgccacatggagcc

SEQ ID NO: 4502948 - DNA, 22 bp, Homo sapiens
tagctctggggtgggcagtttt

SEQ ID NO: 4502949 - DNA, 22 bp, Homo sapiens
tagctcttttttgtttgtttct

SEQ ID NO: 4502950 - DNA, 22 bp, Homo sapiens
tagctggctctgtgagggtgct

SEQ ID NO: 4502951 - DNA, 14 bp, Homo sapiens
tagctgggactaca

SEQ ID NO: 4502952 - DNA, 23 bp, Homo sapiens
tagctgtacttcttgaatataaa

SEQ ID NO: 4502953 - DNA, 18 bp, Homo sapiens
tagctgtagagtccttgg

SEQ ID NO: 4502954 - DNA, 20 bp, Homo sapiens
tagctgtagagtccttggca

SEQ ID NO: 4502955 - DNA, 21 bp, Homo sapiens
tagctgtagttttccctgcac

SEQ ID NO: 4502956 - DNA, 15 bp, Homo sapiens
tagcttcaggaacct

SEQ ID NO: 4502957 - DNA, 21 bp, Homo sapiens
tagcttcagtcattaaattac

SEQ ID NO: 4502958 - DNA, 20 bp, Homo sapiens
tagcttctcttctttctgaa

SEQ ID NO: 4502959 - DNA, 16 bp, Homo sapiens
tagcttctgcttttct

SEQ ID NO: 4502960 - DNA, 16 bp, Homo sapiens
tagctttagaccctgg

SEQ ID NO: 4502961 - DNA, 21 bp, Homo sapiens
tagctttcttcccgtaaaaac

SEQ ID NO: 4502962 - DNA, 14 bp, Homo sapiens
tagctttgtatttt

SEQ ID NO: 4502963 - DNA, 14 bp, Homo sapiens
tagcttttatctgc

SEQ ID NO: 4502964 - DNA, 18 bp, Homo sapiens
tagctttttattatttta

SEQ ID NO: 4502965 - DNA, 15 bp, Homo sapiens
taggaaaaaaactgg

SEQ ID NO: 4502966 - DNA, 23 bp, Homo sapiens
taggaaaaaaactgggataactg

SEQ ID NO: 4502967 - DNA, 18 bp, Homo sapiens
taggaaaatgcttattga

SEQ ID NO: 4502968 - DNA, 11 bp, Homo sapiens
taggaaaggat

SEQ ID NO: 4502969 - DNA, 18 bp, Homo sapiens
taggaaataaaattaatg

SEQ ID NO: 4502970 - DNA, 23 bp, Homo sapiens
taggaaatggctttgtgattcaa

SEQ ID NO: 4502971 - DNA, 21 bp, Homo sapiens
taggaagacacattatcttct

SEQ ID NO: 4502972 - DNA, 16 bp, Homo sapiens
taggaaggctgtgata

SEQ ID NO: 4502973 - DNA, 22 bp, Homo sapiens
taggaagttgacttatagtaca

SEQ ID NO: 4502974 - DNA, 14 bp, Homo sapiens
taggaatagaggaa

SEQ ID NO: 4502975 - DNA, 20 bp, Homo sapiens
taggaatcccagaggtggga

SEQ ID NO: 4502976 - DNA, 17 bp, Homo sapiens
taggaatgtgaaagcac

SEQ ID NO: 4502977 - DNA, 23 bp, Homo sapiens
taggaattactttattataaaat

SEQ ID NO: 4502978 - DNA, 12 bp, Homo sapiens
taggaattgacc

SEQ ID NO: 4502979 - DNA, 13 bp, Homo sapiens
taggacaagtttt

SEQ ID NO: 4502980 - DNA, 13 bp, Homo sapiens
taggaccagagcg

SEQ ID NO: 4502981 - DNA, 20 bp, Homo sapiens
taggacttaaccttgaaatg

SEQ ID NO: 4502982 - DNA, 21 bp, Homo sapiens
taggagaaagcttaatatatt

SEQ ID NO: 4502983 - DNA, 14 bp, Homo sapiens
taggagcagagctc

SEQ ID NO: 4502984 - DNA, 11 bp, Homo sapiens
taggagcctgc

SEQ ID NO: 4502985 - DNA, 18 bp, Homo sapiens
taggagctgggaggaaaa

SEQ ID NO: 4502986 - DNA, 19 bp, Homo sapiens
taggaggacaaaaggaatg

SEQ ID NO: 4502987 - DNA, 18 bp, Homo sapiens
taggatagctaactgtaa

SEQ ID NO: 4502988 - DNA, 21 bp, Homo sapiens
taggatagctaactgtaaatc

SEQ ID NO: 4502989 - DNA, 14 bp, Homo sapiens
taggatgaacaatg

SEQ ID NO: 4502990 - DNA, 18 bp, Homo sapiens
taggatgaacaatgtata

SEQ ID NO: 4502991 - DNA, 19 bp, Homo sapiens
taggatgggaacaaggaag

SEQ ID NO: 4502992 - DNA, 23 bp, Homo sapiens
taggatgggaacaaggaaggaaa

SEQ ID NO: 4502993 - DNA, 18 bp, Homo sapiens
taggatggggctcccagc

SEQ ID NO: 4502994 - DNA, 16 bp, Homo sapiens
taggatggttctgtga

SEQ ID NO: 4502995 - DNA, 17 bp, Homo sapiens
taggatttatttaaaat

SEQ ID NO: 4502996 - DNA, 22 bp, Homo sapiens
taggattttcacattcttggct

SEQ ID NO: 4502997 - DNA, 15 bp, Homo sapiens
taggattttctcaag

SEQ ID NO: 4502998 - DNA, 21 bp, Homo sapiens
taggcacttttattttcattg

SEQ ID NO: 4502999 - DNA, 21 bp, Homo sapiens
taggcagagccataatggact

SEQ ID NO: 4503000 - DNA, 12 bp, Homo sapiens
taggcagcaagc

SEQ ID NO: 4503001 - DNA, 15 bp, Homo sapiens
taggcagctgtcctg

SEQ ID NO: 4503002 - DNA, 19 bp, Homo sapiens
taggcagctgtcctgtgat

SEQ ID NO: 4503003 - DNA, 14 bp, Homo sapiens
taggcaggacctgt

SEQ ID NO: 4503004 - DNA, 21 bp, Homo sapiens
taggcagggggccctgcccca

SEQ ID NO: 4503005 - DNA, 19 bp, Homo sapiens
taggcagtagcctcctcct

SEQ ID NO: 4503006 - DNA, 21 bp, Homo sapiens
taggcatgtcccacccacccg

SEQ ID NO: 4503007 - DNA, 12 bp, Homo sapiens
taggcatttcct

SEQ ID NO: 4503008 - DNA, 19 bp, Homo sapiens
taggccaccccctatcctc

SEQ ID NO: 4503009 - DNA, 19 bp, Homo sapiens
taggccacgtccaggtccg

SEQ ID NO: 4503010 - DNA, 13 bp, Homo sapiens
taggccactcctc

SEQ ID NO: 4503011 - DNA, 18 bp, Homo sapiens
taggcctgaaatgacatt

SEQ ID NO: 4503012 - DNA, 21 bp, Homo sapiens
taggcctgaaatgacatttca

SEQ ID NO: 4503013 - DNA, 15 bp, Homo sapiens
taggcctgtcccttg

SEQ ID NO: 4503014 - DNA, 13 bp, Homo sapiens
taggctagggtgg

SEQ ID NO: 4503015 - DNA, 16 bp, Homo sapiens
taggctagggtgggga

SEQ ID NO: 4503016 - DNA, 17 bp, Homo sapiens
taggctattaaaaaagt

SEQ ID NO: 4503017 - DNA, 20 bp, Homo sapiens
taggctcttatgtgtgcctt

SEQ ID NO: 4503018 - DNA, 21 bp, Homo sapiens
taggctgtaactactttataa

SEQ ID NO: 4503019 - DNA, 20 bp, Homo sapiens
taggcttcaggttgcattgg

SEQ ID NO: 4503020 - DNA, 14 bp, Homo sapiens
taggctttttaatc

SEQ ID NO: 4503021 - DNA, 20 bp, Homo sapiens
tagggaaaatggatatagaa

SEQ ID NO: 4503022 - DNA, 20 bp, Homo sapiens
tagggaagaaaactatcctg

SEQ ID NO: 4503023 - DNA, 19 bp, Homo sapiens
tagggaagctggcctgaga

SEQ ID NO: 4503024 - DNA, 14 bp, Homo sapiens
tagggaagggcctg

SEQ ID NO: 4503025 - DNA, 14 bp, Homo sapiens
tagggaagttttat

SEQ ID NO: 4503026 - DNA, 18 bp, Homo sapiens
tagggacccctcgcccca

SEQ ID NO: 4503027 - DNA, 22 bp, Homo sapiens
tagggacccctcgccccagcct

SEQ ID NO: 4503028 - DNA, 14 bp, Homo sapiens
tagggagagaagat

SEQ ID NO: 4503029 - DNA, 15 bp, Homo sapiens
tagggcaattggaac

SEQ ID NO: 4503030 - DNA, 16 bp, Homo sapiens
tagggccaagcccagc

SEQ ID NO: 4503031 - DNA, 17 bp, Homo sapiens
tagggctaaatgtttaa

SEQ ID NO: 4503032 - DNA, 19 bp, Homo sapiens
tagggctgggcaaggaaaa

SEQ ID NO: 4503033 - DNA, 21 bp, Homo sapiens
tagggctgggcaaggaaaaag

SEQ ID NO: 4503034 - DNA, 15 bp, Homo sapiens
taggggtttctgttg

SEQ ID NO: 4503035 - DNA, 15 bp, Homo sapiens
tagggtaaggtgcct

SEQ ID NO: 4503036 - DNA, 20 bp, Homo sapiens
tagggtcactttgccattat

SEQ ID NO: 4503037 - DNA, 19 bp, Homo sapiens
tagggtgggtaagaaagcc

SEQ ID NO: 4503038 - DNA, 13 bp, Homo sapiens
tagggttctaaat

SEQ ID NO: 4503039 - DNA, 16 bp, Homo sapiens
tagggtttggacagac

SEQ ID NO: 4503040 - DNA, 17 bp, Homo sapiens
taggtatgatctcttct

SEQ ID NO: 4503041 - DNA, 23 bp, Homo sapiens
taggtcaataacactgtatttta

SEQ ID NO: 4503042 - DNA, 17 bp, Homo sapiens
taggtcgttttccaaag

SEQ ID NO: 4503043 - DNA, 15 bp, Homo sapiens
taggtctcctcaggg

SEQ ID NO: 4503044 - DNA, 16 bp, Homo sapiens
taggtgataaaatttt

SEQ ID NO: 4503045 - DNA, 22 bp, Homo sapiens
taggtgctacaaaaacacagca

SEQ ID NO: 4503046 - DNA, 14 bp, Homo sapiens
taggtgtccccaac

SEQ ID NO: 4503047 - DNA, 21 bp, Homo sapiens
taggtgtctgccttcacaaat

SEQ ID NO: 4503048 - DNA, 20 bp, Homo sapiens
taggttaaaaaaaaaagtca

SEQ ID NO: 4503049 - DNA, 14 bp, Homo sapiens
taggttaaagctaa

SEQ ID NO: 4503050 - DNA, 18 bp, Homo sapiens
taggttaaagctaaactg

SEQ ID NO: 4503051 - DNA, 19 bp, Homo sapiens
taggttaaagctaaactga

SEQ ID NO: 4503052 - DNA, 12 bp, Homo sapiens
taggttgttacc

SEQ ID NO: 4503053 - DNA, 17 bp, Homo sapiens
tagtaaaatgttttcat

SEQ ID NO: 4503054 - DNA, 18 bp, Homo sapiens
tagtaaaatttatttcat

SEQ ID NO: 4503055 - DNA, 17 bp, Homo sapiens
tagtaaacatatgttcc

SEQ ID NO: 4503056 - DNA, 23 bp, Homo sapiens
tagtaaactattcttaataaaac

SEQ ID NO: 4503057 - DNA, 13 bp, Homo sapiens
tagtaaataaaca

SEQ ID NO: 4503058 - DNA, 22 bp, Homo sapiens
tagtaaatcacgctttttgaaa

SEQ ID NO: 4503059 - DNA, 11 bp, Homo sapiens
tagtaaatgtt

SEQ ID NO: 4503060 - DNA, 18 bp, Homo sapiens
tagtaacttcttatggaa

SEQ ID NO: 4503061 - DNA, 14 bp, Homo sapiens
tagtaagatctctt

SEQ ID NO: 4503062 - DNA, 14 bp, Homo sapiens
tagtaagtgccttc

SEQ ID NO: 4503063 - DNA, 23 bp, Homo sapiens
tagtaagttaatgtatataaaaa

SEQ ID NO: 4503064 - DNA, 18 bp, Homo sapiens
tagtaagttcagcacttg

SEQ ID NO: 4503065 - DNA, 14 bp, Homo sapiens
tagtaatagcctgg

SEQ ID NO: 4503066 - DNA, 21 bp, Homo sapiens
tatacttgaacaaaagggtca

SEQ ID NO: 4503067 - DNA, 23 bp, Homo sapiens
tatacttgaacaaaagggtcaga

SEQ ID NO: 4503068 - DNA, 14 bp, Homo sapiens
tatacttgaatgaa

SEQ ID NO: 4503069 - DNA, 20 bp, Homo sapiens
tatacttgactctaatatga

SEQ ID NO: 4503070 - DNA, 14 bp, Homo sapiens
tatactttaaataa

SEQ ID NO: 4503071 - DNA, 18 bp, Homo sapiens
tatactttactttttcca

SEQ ID NO: 4503072 - DNA, 18 bp, Homo sapiens
tatactttatatctgtaa

SEQ ID NO: 4503073 - DNA, 13 bp, Homo sapiens
tatactttattga

SEQ ID NO: 4503074 - DNA, 12 bp, Homo sapiens
tatactttttca

SEQ ID NO: 4503075 - DNA, 16 bp, Homo sapiens
tatagaaaaaaacatt

SEQ ID NO: 4503076 - DNA, 13 bp, Homo sapiens
tatagaaaatctt

SEQ ID NO: 4503077 - DNA, 18 bp, Homo sapiens
tatagaactgaatgagaa

SEQ ID NO: 4503078 - DNA, 13 bp, Homo sapiens
tatagaacttcat

SEQ ID NO: 4503079 - DNA, 17 bp, Homo sapiens
tatagaacttcatggat

SEQ ID NO: 4503080 - DNA, 22 bp, Homo sapiens
tatagaacttcatggatcagat

SEQ ID NO: 4503081 - DNA, 13 bp, Homo sapiens
tatagacaaaaga

SEQ ID NO: 4503082 - DNA, 20 bp, Homo sapiens
tatagacaaaagaataagac

SEQ ID NO: 4503083 - DNA, 17 bp, Homo sapiens
tatagacattctcacat

SEQ ID NO: 4503084 - DNA, 22 bp, Homo sapiens
tatagagacaggacagaatgtg

SEQ ID NO: 4503085 - DNA, 19 bp, Homo sapiens
tatagagataaatagaaat

SEQ ID NO: 4503086 - DNA, 15 bp, Homo sapiens
tatagatataatgaa

SEQ ID NO: 4503087 - DNA, 22 bp, Homo sapiens
tatagatgtcagcaattaggca

SEQ ID NO: 4503088 - DNA, 16 bp, Homo sapiens
tatagcaacaacaatt

SEQ ID NO: 4503089 - DNA, 14 bp, Homo sapiens
tatagccaatataa

SEQ ID NO: 4503090 - DNA, 17 bp, Homo sapiens
tatagccaatataacta

SEQ ID NO: 4503091 - DNA, 14 bp, Homo sapiens
tatagctaagtaca

SEQ ID NO: 4503092 - DNA, 22 bp, Homo sapiens
tatagctacaggaagcacccca

SEQ ID NO: 4503093 - DNA, 21 bp, Homo sapiens
tatagctgagactacaagtgt

SEQ ID NO: 4503094 - DNA, 19 bp, Homo sapiens
tatagcttccagattacaa

SEQ ID NO: 4503095 - DNA, 14 bp, Homo sapiens
tataggaattgacc

SEQ ID NO: 4503096 - DNA, 19 bp, Homo sapiens
tataggaattgacccacaa

SEQ ID NO: 4503097 - DNA, 18 bp, Homo sapiens
tataggaatttgtatttt

SEQ ID NO: 4503098 - DNA, 19 bp, Homo sapiens
tataggatttatttaaaat

SEQ ID NO: 4503099 - DNA, 21 bp, Homo sapiens
tataggatttatttaaaatag

SEQ ID NO: 4503100 - DNA, 19 bp, Homo sapiens
tataggcatacctcctatg

SEQ ID NO: 4503101 - DNA, 21 bp, Homo sapiens
tataggcctgtcccttgcctc

SEQ ID NO: 4503102 - DNA, 15 bp, Homo sapiens
tataggggatacttg

SEQ ID NO: 4503103 - DNA, 16 bp, Homo sapiens
tataggtgctacaaaa

SEQ ID NO: 4503104 - DNA, 20 bp, Homo sapiens
tataggtgctacaaaaacac

SEQ ID NO: 4503105 - DNA, 23 bp, Homo sapiens
tataggtgctacaaaaacacagc

SEQ ID NO: 4503106 - DNA, 18 bp, Homo sapiens
tatagtaactataagata

SEQ ID NO: 4503107 - DNA, 15 bp, Homo sapiens
tatagtaatgagttt

SEQ ID NO: 4503108 - DNA, 12 bp, Homo sapiens
tatagtacatga

SEQ ID NO: 4503109 - DNA, 14 bp, Homo sapiens
tatagtacatgata

SEQ ID NO: 4503110 - DNA, 16 bp, Homo sapiens
tatagtacatgataaa

SEQ ID NO: 4503111 - DNA, 23 bp, Homo sapiens
tatagtagaaagacatctgcctg

SEQ ID NO: 4503112 - DNA, 24 bp, Homo sapiens
tatagtagaaagacatctgcctgt

SEQ ID NO: 4503113 - DNA, 20 bp, Homo sapiens
tatagtcccactacttgtgg

SEQ ID NO: 4503114 - DNA, 13 bp, Homo sapiens
tatagtgaaacat

SEQ ID NO: 4503115 - DNA, 13 bp, Homo sapiens
tatagtgaagtgt

SEQ ID NO: 4503116 - DNA, 15 bp, Homo sapiens
tatagtgaagtgtta

SEQ ID NO: 4503117 - DNA, 18 bp, Homo sapiens
tatagtgatgtaatcttg

SEQ ID NO: 4503118 - DNA, 18 bp, Homo sapiens
tatagtgcacaaaatgaa

SEQ ID NO: 4503119 - DNA, 15 bp, Homo sapiens
tatagtggaaaaaca

SEQ ID NO: 4503120 - DNA, 17 bp, Homo sapiens
tatagtgggtacatcaa

SEQ ID NO: 4503121 - DNA, 21 bp, Homo sapiens
tatagtgttcacaaactgtga

SEQ ID NO: 4503122 - DNA, 20 bp, Homo sapiens
tatagtttggaaataaaaat

SEQ ID NO: 4503123 - DNA, 15 bp, Homo sapiens
tatagttttactttt

SEQ ID NO: 4503124 - DNA, 11 bp, Homo sapiens
tatataaaaat

SEQ ID NO: 4503125 - DNA, 12 bp, Homo sapiens
tatataaaaatg

SEQ ID NO: 4503126 - DNA, 15 bp, Homo sapiens
tatataaaaatggct

SEQ ID NO: 4503127 - DNA, 19 bp, Homo sapiens
tatataaaactaaggcttt

SEQ ID NO: 4503128 - DNA, 17 bp, Homo sapiens
tatataaaacttaaaaa

SEQ ID NO: 4503129 - DNA, 18 bp, Homo sapiens
tatataaagaatatatat

SEQ ID NO: 4503130 - DNA, 19 bp, Homo sapiens
tatataaagaatatatata

SEQ ID NO: 4503131 - DNA, 16 bp, Homo sapiens
tatataaatatatttt

SEQ ID NO: 4503132 - DNA, 12 bp, Homo sapiens
tatataacaaaa

SEQ ID NO: 4503133 - DNA, 16 bp, Homo sapiens
tatataaggtaatgta

SEQ ID NO: 4503134 - DNA, 17 bp, Homo sapiens
tatataaggtaatgtag

SEQ ID NO: 4503135 - DNA, 14 bp, Homo sapiens
tatataataaagta

SEQ ID NO: 4503136 - DNA, 15 bp, Homo sapiens
tatataataaatact

SEQ ID NO: 4503137 - DNA, 13 bp, Homo sapiens
tatataataaatt

SEQ ID NO: 4503138 - DNA, 17 bp, Homo sapiens
tatataatcatgctcat

SEQ ID NO: 4503139 - DNA, 18 bp, Homo sapiens
tatataatttactttgta

SEQ ID NO: 4503140 - DNA, 17 bp, Homo sapiens
tatatacacattagaaa

SEQ ID NO: 4503141 - DNA, 18 bp, Homo sapiens
tatatactttttcatgaa

SEQ ID NO: 4503142 - DNA, 19 bp, Homo sapiens
tatatagatgtcagcaatt

SEQ ID NO: 4503143 - DNA, 21 bp, Homo sapiens
tatatagccaatataactatc

SEQ ID NO: 4503144 - DNA, 11 bp, Homo sapiens
tatatatatat

SEQ ID NO: 4503145 - DNA, 15 bp, Homo sapiens
tatatatatttctag

SEQ ID NO: 4503146 - DNA, 20 bp, Homo sapiens
tatatatctatctatttgag

SEQ ID NO: 4503147 - DNA, 21 bp, Homo sapiens
tatatatctgctgtccagaca

SEQ ID NO: 4503148 - DNA, 21 bp, Homo sapiens
tatatatgcacttaatttgtt

SEQ ID NO: 4503149 - DNA, 19 bp, Homo sapiens
tatatatggatcagaggag

SEQ ID NO: 4503150 - DNA, 10 bp, Homo sapiens
tatatattat

SEQ ID NO: 4503151 - DNA, 14 bp, Homo sapiens
tatatattataaaa

SEQ ID NO: 4503152 - DNA, 18 bp, Homo sapiens
tatatattataagttgac

SEQ ID NO: 4503153 - DNA, 19 bp, Homo sapiens
tatatattatgtgaagaat

SEQ ID NO: 4503154 - DNA, 20 bp, Homo sapiens
tatatattatgtgaagaatt

SEQ ID NO: 4503155 - DNA, 14 bp, Homo sapiens
tatatattctatta

SEQ ID NO: 4503156 - DNA, 13 bp, Homo sapiens
tatatattgtaaa

SEQ ID NO: 4503157 - DNA, 17 bp, Homo sapiens
tatatcagcttttctga

SEQ ID NO: 4503158 - DNA, 13 bp, Homo sapiens
tatatcatgcaaa

SEQ ID NO: 4503159 - DNA, 22 bp, Homo sapiens
tatatctagaactatcattttt

SEQ ID NO: 4503160 - DNA, 19 bp, Homo sapiens
tatatctatctatttgagg

SEQ ID NO: 4503161 - DNA, 16 bp, Homo sapiens
tatatctcttggaaaa

SEQ ID NO: 4503162 - DNA, 16 bp, Homo sapiens
tatatctgtaatgata

SEQ ID NO: 4503163 - DNA, 15 bp, Homo sapiens
tatatcttgtttaca

SEQ ID NO: 4503164 - DNA, 16 bp, Homo sapiens
tatatcttgtttacaa

SEQ ID NO: 4503165 - DNA, 17 bp, Homo sapiens
tatatcttgtttacaat

SEQ ID NO: 4503166 - DNA, 20 bp, Homo sapiens
tatatgaaataagtaaatgt

SEQ ID NO: 4503167 - DNA, 14 bp, Homo sapiens
tatatgaccagaag

SEQ ID NO: 4503168 - DNA, 17 bp, Homo sapiens
tatatgaccagaagcct

SEQ ID NO: 4503169 - DNA, 20 bp, Homo sapiens
tatatgagaagaatagccta

SEQ ID NO: 4503170 - DNA, 22 bp, Homo sapiens
tatatgatgagcagacttctcg

SEQ ID NO: 4503171 - DNA, 15 bp, Homo sapiens
tatatgcaatgtcca

SEQ ID NO: 4503172 - DNA, 21 bp, Homo sapiens
tatatgcacaaaactactttt

SEQ ID NO: 4503173 - DNA, 12 bp, Homo sapiens
tatatgctgtat

SEQ ID NO: 4503174 - DNA, 15 bp, Homo sapiens
tatatggaagaaagt

SEQ ID NO: 4503175 - DNA, 16 bp, Homo sapiens
tatatggaagaaagta

SEQ ID NO: 4503176 - DNA, 14 bp, Homo sapiens
tatatggatcagag

SEQ ID NO: 4503177 - DNA, 16 bp, Homo sapiens
tatatggcaaatagcc

SEQ ID NO: 4503178 - DNA, 15 bp, Homo sapiens
tatatggcatttgca

SEQ ID NO: 4503179 - DNA, 18 bp, Homo sapiens
tatatggtccactggttt

SEQ ID NO: 4503180 - DNA, 14 bp, Homo sapiens
tatatgtaaatgtg

SEQ ID NO: 4503181 - DNA, 16 bp, Homo sapiens
tatatgtaaatgtgtt

SEQ ID NO: 4503182 - DNA, 12 bp, Homo sapiens
tatatgtacatg

SEQ ID NO: 4503183 - DNA, 11 bp, Homo sapiens
tatatgtattt

SEQ ID NO: 4503184 - DNA, 23 bp, Homo sapiens
tatatgtatttaagatgtacatt

SEQ ID NO: 4503185 - DNA, 13 bp, Homo sapiens
tatatgtgaaaca

SEQ ID NO: 4503186 - DNA, 16 bp, Homo sapiens
tatatgtgtatacata

SEQ ID NO: 4503187 - DNA, 22 bp, Homo sapiens
tataaaaaagaaaacttgtgtt

SEQ ID NO: 4503188 - DNA, 13 bp, Homo sapiens
tataaaaaatatg

SEQ ID NO: 4503189 - DNA, 14 bp, Homo sapiens
tataaaaaatatgt

SEQ ID NO: 4503190 - DNA, 15 bp, Homo sapiens
tataaaaaatatgta

SEQ ID NO: 4503191 - DNA, 20 bp, Homo sapiens
tataaaaaccccaaactgtt

SEQ ID NO: 4503192 - DNA, 14 bp, Homo sapiens
tataaaaatggctt

SEQ ID NO: 4503193 - DNA, 19 bp, Homo sapiens
tataaaaattatcaaaaag

SEQ ID NO: 4503194 - DNA, 17 bp, Homo sapiens
tataaaacctgatatat

SEQ ID NO: 4503195 - DNA, 15 bp, Homo sapiens
tataaaataactaaa

SEQ ID NO: 4503196 - DNA, 14 bp, Homo sapiens
tataaacagaactc

SEQ ID NO: 4503197 - DNA, 15 bp, Homo sapiens
tataaacatattttt

SEQ ID NO: 4503198 - DNA, 14 bp, Homo sapiens
tataaagagagata

SEQ ID NO: 4503199 - DNA, 21 bp, Homo sapiens
tataaagctacaatattctct

SEQ ID NO: 4503200 - DNA, 19 bp, Homo sapiens
tataaagctgttcttgaaa

SEQ ID NO: 4503201 - DNA, 15 bp, Homo sapiens
tataaagtatagaga

SEQ ID NO: 4503202 - DNA, 15 bp, Homo sapiens
tataaagtattcttt

SEQ ID NO: 4503203 - DNA, 18 bp, Homo sapiens
tataaagtattctttttc

SEQ ID NO: 4503204 - DNA, 20 bp, Homo sapiens
tataaagttcagatgtttca

SEQ ID NO: 4503205 - DNA, 22 bp, Homo sapiens
tataaatacacttcctgcttaa

SEQ ID NO: 4503206 - DNA, 17 bp, Homo sapiens
tataaatatattttctt

SEQ ID NO: 4503207 - DNA, 21 bp, Homo sapiens
tataaatatattttctttcta

SEQ ID NO: 4503208 - DNA, 18 bp, Homo sapiens
tataaatatcagtattct

SEQ ID NO: 4503209 - DNA, 21 bp, Homo sapiens
tataaatatcagtattctgac

SEQ ID NO: 4503210 - DNA, 23 bp, Homo sapiens
tataaatatcagtattctgacat

SEQ ID NO: 4503211 - DNA, 22 bp, Homo sapiens
tataaatctggggaagaggttt

SEQ ID NO: 4503212 - DNA, 17 bp, Homo sapiens
tataaatgatgattgaa

SEQ ID NO: 4503213 - DNA, 14 bp, Homo sapiens
tataaatgtacatc

SEQ ID NO: 4503214 - DNA, 14 bp, Homo sapiens
tataaatgtgtgta

SEQ ID NO: 4503215 - DNA, 14 bp, Homo sapiens
tataaattaaatat

SEQ ID NO: 4503216 - DNA, 23 bp, Homo sapiens
tataaattaaatatatgtatgta

SEQ ID NO: 4503217 - DNA, 15 bp, Homo sapiens
tataaattattactt

SEQ ID NO: 4503218 - DNA, 22 bp, Homo sapiens
tataaattgtctttaaaaactg

SEQ ID NO: 4503219 - DNA, 21 bp, Homo sapiens
tataaattttttttgtttcat

SEQ ID NO: 4503220 - DNA, 22 bp, Homo sapiens
tataacacttaggactagaaga

SEQ ID NO: 4503221 - DNA, 16 bp, Homo sapiens
tataacagtgtttaaa

SEQ ID NO: 4503222 - DNA, 15 bp, Homo sapiens
tataacataaaagca

SEQ ID NO: 4503223 - DNA, 20 bp, Homo sapiens
tataacattatataacaaaa

SEQ ID NO: 4503224 - DNA, 20 bp, Homo sapiens
tataacctagttaaagaaag

SEQ ID NO: 4503225 - DNA, 19 bp, Homo sapiens
tataacgtgttcaatattt

SEQ ID NO: 4503226 - DNA, 22 bp, Homo sapiens
tataactcaaggataccttctt

SEQ ID NO: 4503227 - DNA, 20 bp, Homo sapiens
tataactgtcttgtttcagt

SEQ ID NO: 4503228 - DNA, 22 bp, Homo sapiens
tataactgttttagaaattggt

SEQ ID NO: 4503229 - DNA, 13 bp, Homo sapiens
tataagaaaagta

SEQ ID NO: 4503230 - DNA, 22 bp, Homo sapiens
tataagaaaagtaatgaagaat

SEQ ID NO: 4503231 - DNA, 20 bp, Homo sapiens
tataagaagcaatctttgaa

SEQ ID NO: 4503232 - DNA, 20 bp, Homo sapiens
tataagagggctttttaaat

SEQ ID NO: 4503233 - DNA, 22 bp, Homo sapiens
tataagagggctttttaaattt

SEQ ID NO: 4503234 - DNA, 22 bp, Homo sapiens
tataagattccaaaaagcacat

SEQ ID NO: 4503235 - DNA, 22 bp, Homo sapiens
tataagccacttgtcttgaaaa

SEQ ID NO: 4503236 - DNA, 18 bp, Homo sapiens
tataagcccttaataata

SEQ ID NO: 4503237 - DNA, 13 bp, Homo sapiens
tataagcttaaat

SEQ ID NO: 4503238 - DNA, 14 bp, Homo sapiens
tataaggaagattt

SEQ ID NO: 4503239 - DNA, 23 bp, Homo sapiens
tataaggagagttcaagcctgtg

SEQ ID NO: 4503240 - DNA, 14 bp, Homo sapiens
tataaggtaatgta

SEQ ID NO: 4503241 - DNA, 22 bp, Homo sapiens
tataagttgacctttatttatt

SEQ ID NO: 4503242 - DNA, 14 bp, Homo sapiens
tataagttgctgta

SEQ ID NO: 4503243 - DNA, 16 bp, Homo sapiens
tataataaaatttctt

SEQ ID NO: 4503244 - DNA, 11 bp, Homo sapiens
tataatacata

SEQ ID NO: 4503245 - DNA, 15 bp, Homo sapiens
tataatactttgtat

SEQ ID NO: 4503246 - DNA, 20 bp, Homo sapiens
tataatactttgtatacaag

SEQ ID NO: 4503247 - DNA, 21 bp, Homo sapiens
tataatactttgtatacaagt

SEQ ID NO: 4503248 - DNA, 16 bp, Homo sapiens
tataatattgaaaatt

SEQ ID NO: 4503249 - DNA, 14 bp, Homo sapiens
tataatcaaatgat

SEQ ID NO: 4503250 - DNA, 16 bp, Homo sapiens
tataatcaaatgattt

SEQ ID NO: 4503251 - DNA, 14 bp, Homo sapiens
tataatcagaatgg

SEQ ID NO: 4503252 - DNA, 15 bp, Homo sapiens
tataatcatgctcat

SEQ ID NO: 4503253 - DNA, 15 bp, Homo sapiens
tataatctcttctta

SEQ ID NO: 4503254 - DNA, 21 bp, Homo sapiens
tataatctcttcttatacaga

SEQ ID NO: 4503255 - DNA, 16 bp, Homo sapiens
tataatgacttttaaa

SEQ ID NO: 4503256 - DNA, 18 bp, Homo sapiens
tataatgacttttaaaat

SEQ ID NO: 4503257 - DNA, 23 bp, Homo sapiens
tataatgattaagggacatttct

SEQ ID NO: 4503258 - DNA, 12 bp, Homo sapiens
tataatgctttc

SEQ ID NO: 4503259 - DNA, 13 bp, Homo sapiens
tataatgctttct

SEQ ID NO: 4503260 - DNA, 13 bp, Homo sapiens
tataatgtatttg

SEQ ID NO: 4503261 - DNA, 21 bp, Homo sapiens
tataatgtatttgaaaattac

SEQ ID NO: 4503262 - DNA, 16 bp, Homo sapiens
tataatgtgaaatgta

SEQ ID NO: 4503263 - DNA, 16 bp, Homo sapiens
tataatgtgtctgtgt

SEQ ID NO: 4503264 - DNA, 21 bp, Homo sapiens
tataatgtgtgctttattgaa

SEQ ID NO: 4503265 - DNA, 20 bp, Homo sapiens
tataatgtttattaaatgct

SEQ ID NO: 4503266 - DNA, 16 bp, Homo sapiens
tataattctcattaaa

SEQ ID NO: 4503267 - DNA, 16 bp, Homo sapiens
tataattgtactgtgt

SEQ ID NO: 4503268 - DNA, 19 bp, Homo sapiens
tataatttaataaaaagga

SEQ ID NO: 4503269 - DNA, 20 bp, Homo sapiens
tataatttaataaaaaggaa

SEQ ID NO: 4503270 - DNA, 12 bp, Homo sapiens
tataatttaatg

SEQ ID NO: 4503271 - DNA, 20 bp, Homo sapiens
tataatttaatgtaaataaa

SEQ ID NO: 4503272 - DNA, 16 bp, Homo sapiens
tataatttacctaaga

SEQ ID NO: 4503273 - DNA, 20 bp, Homo sapiens
tatacaaattttcagaaggt

SEQ ID NO: 4503274 - DNA, 21 bp, Homo sapiens
tatacaacctaacttatggac

SEQ ID NO: 4503275 - DNA, 18 bp, Homo sapiens
tatacaactttcatttaa

SEQ ID NO: 4503276 - DNA, 15 bp, Homo sapiens
tatacaagtaatttc

SEQ ID NO: 4503277 - DNA, 21 bp, Homo sapiens
tatacaatgcacttttatgaa

SEQ ID NO: 4503278 - DNA, 14 bp, Homo sapiens
tatacacattagaa

SEQ ID NO: 4503279 - DNA, 19 bp, Homo sapiens
tatacacattagaaatatt

SEQ ID NO: 4503280 - DNA, 19 bp, Homo sapiens
tatacagttataaaattaa

SEQ ID NO: 4503281 - DNA, 18 bp, Homo sapiens
tatacagtttgacttttt

SEQ ID NO: 4503282 - DNA, 16 bp, Homo sapiens
tatacagttttaaaga

SEQ ID NO: 4503283 - DNA, 21 bp, Homo sapiens
tatacatatgagaatatacct

SEQ ID NO: 4503284 - DNA, 15 bp, Homo sapiens
tatacatattgtata

SEQ ID NO: 4503285 - DNA, 16 bp, Homo sapiens
tatacatattgtatat

SEQ ID NO: 4503286 - DNA, 16 bp, Homo sapiens
tatacatcacgttaaa

SEQ ID NO: 4503287 - DNA, 15 bp, Homo sapiens
tatacattgtcttga

SEQ ID NO: 4503288 - DNA, 16 bp, Homo sapiens
tatacattgtcttgat

SEQ ID NO: 4503289 - DNA, 18 bp, Homo sapiens
tataccaatgtgttttct

SEQ ID NO: 4503290 - DNA, 14 bp, Homo sapiens
tatacccacccaga

SEQ ID NO: 4503291 - DNA, 15 bp, Homo sapiens
tatacccacccagaa

SEQ ID NO: 4503292 - DNA, 22 bp, Homo sapiens
tatacccacccagaatgagaca

SEQ ID NO: 4503293 - DNA, 23 bp, Homo sapiens
tataccccaaattgtgtatatat

SEQ ID NO: 4503294 - DNA, 18 bp, Homo sapiens
tatacgataaataacttt

SEQ ID NO: 4503295 - DNA, 20 bp, Homo sapiens
tatactaaaccaactctaat

SEQ ID NO: 4503296 - DNA, 22 bp, Homo sapiens
tatactcttgaattcctctcaa

SEQ ID NO: 4503297 - DNA, 17 bp, Homo sapiens
tatactctttctgtata

SEQ ID NO: 4503298 - DNA, 22 bp, Homo sapiens
tatactctttctgtatatactt

SEQ ID NO: 4503299 - DNA, 17 bp, Homo sapiens
tatactgaaccaggcca

SEQ ID NO: 4503300 - DNA, 12 bp, Homo sapiens
tatactgaagga

SEQ ID NO: 4503301 - DNA, 12 bp, Homo sapiens
tatactgcatac

SEQ ID NO: 4503302 - DNA, 17 bp, Homo sapiens
tatactgcatacttttt

SEQ ID NO: 4503303 - DNA, 15 bp, Homo sapiens
tatactgtacaataa

SEQ ID NO: 4503304 - DNA, 21 bp, Homo sapiens
tatacttccttacttttaagg

SEQ ID NO: 4503305 - DNA, 15 bp, Homo sapiens
tatacttgaacaaaa

SEQ ID NO: 4503306 - DNA, 16 bp, Homo sapiens
tatacttgaacaaaag

SEQ ID NO: 4503307 - DNA, 20 bp, Homo sapiens
tatgtttctacacattgcta

SEQ ID NO: 4503308 - DNA, 15 bp, Homo sapiens
tatgtttgatttctc

SEQ ID NO: 4503309 - DNA, 14 bp, Homo sapiens
tatgttttaacaaa

SEQ ID NO: 4503310 - DNA, 15 bp, Homo sapiens
tatgtttttactgaa

SEQ ID NO: 4503311 - DNA, 20 bp, Homo sapiens
tatgtttttatttatgaata

SEQ ID NO: 4503312 - DNA, 15 bp, Homo sapiens
tatgttttttcatgg

SEQ ID NO: 4503313 - DNA, 16 bp, Homo sapiens
tattaaaactcatttt

SEQ ID NO: 4503314 - DNA, 19 bp, Homo sapiens
tattaaaattccaaattca

SEQ ID NO: 4503315 - DNA, 19 bp, Homo sapiens
tattaaacaaagtttcaga

SEQ ID NO: 4503316 - DNA, 14 bp, Homo sapiens
tattaaacatacat

SEQ ID NO: 4503317 - DNA, 22 bp, Homo sapiens
tattaaacatacataatacaat

SEQ ID NO: 4503318 - DNA, 18 bp, Homo sapiens
tattaaaggttaaattgc

SEQ ID NO: 4503319 - DNA, 19 bp, Homo sapiens
tattaaaggttaaattgct

SEQ ID NO: 4503320 - DNA, 23 bp, Homo sapiens
tattaaatgcttcatttgtatgt

SEQ ID NO: 4503321 - DNA, 19 bp, Homo sapiens
tattaaatggtttttaaat

SEQ ID NO: 4503322 - DNA, 21 bp, Homo sapiens
tattaaattaaattttgtgtc

SEQ ID NO: 4503323 - DNA, 23 bp, Homo sapiens
tattaagaaaggaagcattgtaa

SEQ ID NO: 4503324 - DNA, 19 bp, Homo sapiens
tattaagaatttaagactt

SEQ ID NO: 4503325 - DNA, 13 bp, Homo sapiens
tattaagagctat

SEQ ID NO: 4503326 - DNA, 17 bp, Homo sapiens
tattaagagctatttta

SEQ ID NO: 4503327 - DNA, 18 bp, Homo sapiens
tattaatagtaatttgta

SEQ ID NO: 4503328 - DNA, 20 bp, Homo sapiens
tattaatagtaatttgtaaa

SEQ ID NO: 4503329 - DNA, 18 bp, Homo sapiens
tattaatataagtttctt

SEQ ID NO: 4503330 - DNA, 18 bp, Homo sapiens
tattaatcaagagaaact

SEQ ID NO: 4503331 - DNA, 14 bp, Homo sapiens
tattaatcatagat

SEQ ID NO: 4503332 - DNA, 12 bp, Homo sapiens
tattaatctact

SEQ ID NO: 4503333 - DNA, 16 bp, Homo sapiens
tattaatctactgtat

SEQ ID NO: 4503334 - DNA, 14 bp, Homo sapiens
tattaatcttagtg

SEQ ID NO: 4503335 - DNA, 17 bp, Homo sapiens
tattaatcttagtgtat

SEQ ID NO: 4503336 - DNA, 18 bp, Homo sapiens
tattaatcttagtgtatg

SEQ ID NO: 4503337 - DNA, 11 bp, Homo sapiens
tattaatcttg

SEQ ID NO: 4503338 - DNA, 16 bp, Homo sapiens
tattaatcttggatag

SEQ ID NO: 4503339 - DNA, 12 bp, Homo sapiens
tattaatgcact

SEQ ID NO: 4503340 - DNA, 13 bp, Homo sapiens
tattaatgcactt

SEQ ID NO: 4503341 - DNA, 16 bp, Homo sapiens
tattaatgtttcttct

SEQ ID NO: 4503342 - DNA, 14 bp, Homo sapiens
tattaatttattgg

SEQ ID NO: 4503343 - DNA, 15 bp, Homo sapiens
tattacaaatgcaaa

SEQ ID NO: 4503344 - DNA, 16 bp, Homo sapiens
tattacaaatgcaaat

SEQ ID NO: 4503345 - DNA, 19 bp, Homo sapiens
tattacaaatgcaaatttc

SEQ ID NO: 4503346 - DNA, 16 bp, Homo sapiens
tattacaagtaatgta

SEQ ID NO: 4503347 - DNA, 12 bp, Homo sapiens
tattacaatgta

SEQ ID NO: 4503348 - DNA, 18 bp, Homo sapiens
tattacaatgtatcttta

SEQ ID NO: 4503349 - DNA, 19 bp, Homo sapiens
tattacaatgtatctttat

SEQ ID NO: 4503350 - DNA, 14 bp, Homo sapiens
tattactaaattga

SEQ ID NO: 4503351 - DNA, 21 bp, Homo sapiens
tattacttgaactttccaaaa

SEQ ID NO: 4503352 - DNA, 18 bp, Homo sapiens
tattactttgtcttttca

SEQ ID NO: 4503353 - DNA, 23 bp, Homo sapiens
tattagaacattcacttttgtta

SEQ ID NO: 4503354 - DNA, 15 bp, Homo sapiens
tattagagtgtcttt

SEQ ID NO: 4503355 - DNA, 18 bp, Homo sapiens
tattagcatggcatattt

SEQ ID NO: 4503356 - DNA, 23 bp, Homo sapiens
tattagcatggcatattttaatc

SEQ ID NO: 4503357 - DNA, 20 bp, Homo sapiens
tattagccctgcattttcat

SEQ ID NO: 4503358 - DNA, 17 bp, Homo sapiens
tattagtattattaaca

SEQ ID NO: 4503359 - DNA, 22 bp, Homo sapiens
tattagttccccaaatacaaag

SEQ ID NO: 4503360 - DNA, 14 bp, Homo sapiens
tattataaactata

SEQ ID NO: 4503361 - DNA, 20 bp, Homo sapiens
tattataaatatatataaag

SEQ ID NO: 4503362 - DNA, 19 bp, Homo sapiens
tattatagaaaattatttg

SEQ ID NO: 4503363 - DNA, 18 bp, Homo sapiens
tattatagacaaaagaat

SEQ ID NO: 4503364 - DNA, 15 bp, Homo sapiens
tattatataaactgt

SEQ ID NO: 4503365 - DNA, 16 bp, Homo sapiens
tattatatatttacag

SEQ ID NO: 4503366 - DNA, 17 bp, Homo sapiens
tattatatgttctagaa

SEQ ID NO: 4503367 - DNA, 14 bp, Homo sapiens
tattatattaaaca

SEQ ID NO: 4503368 - DNA, 16 bp, Homo sapiens
tattatcaatgtttac

SEQ ID NO: 4503369 - DNA, 21 bp, Homo sapiens
tattatcttcttaacagttta

SEQ ID NO: 4503370 - DNA, 22 bp, Homo sapiens
tattatgtcctgtgagatgtgt

SEQ ID NO: 4503371 - DNA, 13 bp, Homo sapiens
tattatgtgaaga

SEQ ID NO: 4503372 - DNA, 15 bp, Homo sapiens
tattatgtgaagaat

SEQ ID NO: 4503373 - DNA, 12 bp, Homo sapiens
tattatgtttaa

SEQ ID NO: 4503374 - DNA, 13 bp, Homo sapiens
tattatgtttatt

SEQ ID NO: 4503375 - DNA, 16 bp, Homo sapiens
tattatgtttatttca

SEQ ID NO: 4503376 - DNA, 14 bp, Homo sapiens
tattattaatttat

SEQ ID NO: 4503377 - DNA, 14 bp, Homo sapiens
tattattacaaata

SEQ ID NO: 4503378 - DNA, 17 bp, Homo sapiens
tattattattatacttc

SEQ ID NO: 4503379 - DNA, 13 bp, Homo sapiens
tattattgcttca

SEQ ID NO: 4503380 - DNA, 16 bp, Homo sapiens
tattattgcttcatgt

SEQ ID NO: 4503381 - DNA, 15 bp, Homo sapiens
tattatttagaaatg

SEQ ID NO: 4503382 - DNA, 21 bp, Homo sapiens
tattatttctaatccttttcc

SEQ ID NO: 4503383 - DNA, 23 bp, Homo sapiens
tattatttctccatcccctccct

SEQ ID NO: 4503384 - DNA, 14 bp, Homo sapiens
tattatttgtctta

SEQ ID NO: 4503385 - DNA, 16 bp, Homo sapiens
tattatttgtcttaaa

SEQ ID NO: 4503386 - DNA, 15 bp, Homo sapiens
tattattttaaattt

SEQ ID NO: 4503387 - DNA, 14 bp, Homo sapiens
tattattttagtgt

SEQ ID NO: 4503388 - DNA, 13 bp, Homo sapiens
tattatttttcaa

SEQ ID NO: 4503389 - DNA, 23 bp, Homo sapiens
tattcaaaaattatctatagcta

SEQ ID NO: 4503390 - DNA, 23 bp, Homo sapiens
tattcaaacagtctcaggaaatc

SEQ ID NO: 4503391 - DNA, 12 bp, Homo sapiens
tattcactgggc

SEQ ID NO: 4503392 - DNA, 19 bp, Homo sapiens
tattcactggttttacaca

SEQ ID NO: 4503393 - DNA, 18 bp, Homo sapiens
tattcagccagcttaaac

SEQ ID NO: 4503394 - DNA, 14 bp, Homo sapiens
tattcagtggtgaa

SEQ ID NO: 4503395 - DNA, 15 bp, Homo sapiens
tattcagtgtcactg

SEQ ID NO: 4503396 - DNA, 23 bp, Homo sapiens
tattcatatacaaacatgtatgt

SEQ ID NO: 4503397 - DNA, 15 bp, Homo sapiens
tattcatgaaatgtg

SEQ ID NO: 4503398 - DNA, 18 bp, Homo sapiens
tattcattatttgtcaaa

SEQ ID NO: 4503399 - DNA, 15 bp, Homo sapiens
tattcattcctcaca

SEQ ID NO: 4503400 - DNA, 21 bp, Homo sapiens
tattccaaaccaaattttaat

SEQ ID NO: 4503401 - DNA, 17 bp, Homo sapiens
tattccaagacatgtct

SEQ ID NO: 4503402 - DNA, 17 bp, Homo sapiens
tattccacaaacacatt

SEQ ID NO: 4503403 - DNA, 14 bp, Homo sapiens
tattccaccttaaa

SEQ ID NO: 4503404 - DNA, 22 bp, Homo sapiens
tattccaccttaaattaaacaa

SEQ ID NO: 4503405 - DNA, 16 bp, Homo sapiens
tattccagaatgctgt

SEQ ID NO: 4503406 - DNA, 22 bp, Homo sapiens
tattccagacttgggaggatgt

SEQ ID NO: 4503407 - DNA, 24 bp, Homo sapiens
tattcccaagctgaatgttcttga

SEQ ID NO: 4503408 - DNA, 21 bp, Homo sapiens
tattccctagaaacttccaaa

SEQ ID NO: 4503409 - DNA, 21 bp, Homo sapiens
tattccctgcacacacatgca

SEQ ID NO: 4503410 - DNA, 14 bp, Homo sapiens
tattccctgcccaa

SEQ ID NO: 4503411 - DNA, 22 bp, Homo sapiens
tattccctgcccaaacccttaa

SEQ ID NO: 4503412 - DNA, 15 bp, Homo sapiens
tattcctttaaaata

SEQ ID NO: 4503413 - DNA, 12 bp, Homo sapiens
tattcctttcct

SEQ ID NO: 4503414 - DNA, 14 bp, Homo sapiens
tattcctttccttt

SEQ ID NO: 4503415 - DNA, 14 bp, Homo sapiens
tattctaattaaaa

SEQ ID NO: 4503416 - DNA, 16 bp, Homo sapiens
tattctaattaaaatt

SEQ ID NO: 4503417 - DNA, 18 bp, Homo sapiens
tattctaattaaaattgt

SEQ ID NO: 4503418 - DNA, 20 bp, Homo sapiens
tattctattacattttcagt

SEQ ID NO: 4503419 - DNA, 15 bp, Homo sapiens
tattctcactccacc

SEQ ID NO: 4503420 - DNA, 19 bp, Homo sapiens
tattctcactccaccaccc

SEQ ID NO: 4503421 - DNA, 22 bp, Homo sapiens
tattctcactccaccacccaaa

SEQ ID NO: 4503422 - DNA, 14 bp, Homo sapiens
tattctcctcggac

SEQ ID NO: 4503423 - DNA, 12 bp, Homo sapiens
tattctctctta

SEQ ID NO: 4503424 - DNA, 16 bp, Homo sapiens
tattctctcttattgt

SEQ ID NO: 4503425 - DNA, 14 bp, Homo sapiens
tattctgacatgta

SEQ ID NO: 4503426 - DNA, 15 bp, Homo sapiens
tattctgacatgtaa

SEQ ID NO: 4503427 - DNA, 12 bp, Homo sapiens
tattctggagtt

SEQ ID NO: 4503428 - DNA, 20 bp, Homo sapiens
tatgcagaaatagacaaaaa

SEQ ID NO: 4503429 - DNA, 18 bp, Homo sapiens
tatgcagtgtagatttta

SEQ ID NO: 4503430 - DNA, 11 bp, Homo sapiens
tatgcatgtag

SEQ ID NO: 4503431 - DNA, 13 bp, Homo sapiens
tatgcatgtagca

SEQ ID NO: 4503432 - DNA, 14 bp, Homo sapiens
tatgcatgtagcat

SEQ ID NO: 4503433 - DNA, 21 bp, Homo sapiens
tatgcatgtagcatataaatg

SEQ ID NO: 4503434 - DNA, 14 bp, Homo sapiens
tatgcattatatca

SEQ ID NO: 4503435 - DNA, 16 bp, Homo sapiens
tatgcattatatcaaa

SEQ ID NO: 4503436 - DNA, 19 bp, Homo sapiens
tatgcattcacatttagaa

SEQ ID NO: 4503437 - DNA, 12 bp, Homo sapiens
tatgcatttttt

SEQ ID NO: 4503438 - DNA, 22 bp, Homo sapiens
tatgccacgggaagtttagaga

SEQ ID NO: 4503439 - DNA, 12 bp, Homo sapiens
tatgcctgtggt

SEQ ID NO: 4503440 - DNA, 14 bp, Homo sapiens
tatgccttgtataa

SEQ ID NO: 4503441 - DNA, 13 bp, Homo sapiens
tatgcggttaatt

SEQ ID NO: 4503442 - DNA, 19 bp, Homo sapiens
tatgctgcaacaaaatgta

SEQ ID NO: 4503443 - DNA, 12 bp, Homo sapiens
tatgctggccag

SEQ ID NO: 4503444 - DNA, 20 bp, Homo sapiens
tatgctggccagcaccctct

SEQ ID NO: 4503445 - DNA, 15 bp, Homo sapiens
tatgctgtatctgtg

SEQ ID NO: 4503446 - DNA, 18 bp, Homo sapiens
tatgctgtatttctttgt

SEQ ID NO: 4503447 - DNA, 19 bp, Homo sapiens
tatgcttactaaatcttca

SEQ ID NO: 4503448 - DNA, 14 bp, Homo sapiens
tatgctttgaactt

SEQ ID NO: 4503449 - DNA, 19 bp, Homo sapiens
tatgctttgaactttagtt

SEQ ID NO: 4503450 - DNA, 13 bp, Homo sapiens
tatggaaaactgt

SEQ ID NO: 4503451 - DNA, 14 bp, Homo sapiens
tatggaagaaagta

SEQ ID NO: 4503452 - DNA, 19 bp, Homo sapiens
tatggaagttgttgctata

SEQ ID NO: 4503453 - DNA, 19 bp, Homo sapiens
tatggaattgatttgcatt

SEQ ID NO: 4503454 - DNA, 16 bp, Homo sapiens
tatggaatttttaagt

SEQ ID NO: 4503455 - DNA, 16 bp, Homo sapiens
tatggagaattgctga

SEQ ID NO: 4503456 - DNA, 18 bp, Homo sapiens
tatggagaattgctgaag

SEQ ID NO: 4503457 - DNA, 14 bp, Homo sapiens
tatggaggattctt

SEQ ID NO: 4503458 - DNA, 21 bp, Homo sapiens
tatggaggattctttccccag

SEQ ID NO: 4503459 - DNA, 20 bp, Homo sapiens
tatggagtcttgtgaaagtg

SEQ ID NO: 4503460 - DNA, 21 bp, Homo sapiens
tatggagtcttgtgaaagtgt

SEQ ID NO: 4503461 - DNA, 16 bp, Homo sapiens
tatggataaagatgag

SEQ ID NO: 4503462 - DNA, 17 bp, Homo sapiens
tatggataaagatgaga

SEQ ID NO: 4503463 - DNA, 20 bp, Homo sapiens
tatggatgattaaattttag

SEQ ID NO: 4503464 - DNA, 23 bp, Homo sapiens
tatggattgggggggccaaaagg

SEQ ID NO: 4503465 - DNA, 13 bp, Homo sapiens
tatggcacctatt

SEQ ID NO: 4503466 - DNA, 15 bp, Homo sapiens
tatggcatttctatt

SEQ ID NO: 4503467 - DNA, 16 bp, Homo sapiens
tatggccaaggctctc

SEQ ID NO: 4503468 - DNA, 23 bp, Homo sapiens
tatggcctcagctgcctcacttc

SEQ ID NO: 4503469 - DNA, 19 bp, Homo sapiens
tatggggatagatgtgtgg

SEQ ID NO: 4503470 - DNA, 19 bp, Homo sapiens
tatgggggcatctcttccc

SEQ ID NO: 4503471 - DNA, 16 bp, Homo sapiens
tatggtagaaaaattt

SEQ ID NO: 4503472 - DNA, 17 bp, Homo sapiens
tatggtatgctggccag

SEQ ID NO: 4503473 - DNA, 23 bp, Homo sapiens
tatggtatgctggccagcaccct

SEQ ID NO: 4503474 - DNA, 14 bp, Homo sapiens
tatggtatgtagcc

SEQ ID NO: 4503475 - DNA, 21 bp, Homo sapiens
tatggtatttattttttcttt

SEQ ID NO: 4503476 - DNA, 17 bp, Homo sapiens
tatggtggatccaaact

SEQ ID NO: 4503477 - DNA, 13 bp, Homo sapiens
tatggtgtatttt

SEQ ID NO: 4503478 - DNA, 17 bp, Homo sapiens
tatggtttgttgcctac

SEQ ID NO: 4503479 - DNA, 13 bp, Homo sapiens
tatgtaaaacatt

SEQ ID NO: 4503480 - DNA, 15 bp, Homo sapiens
tatgtaaaacattta

SEQ ID NO: 4503481 - DNA, 20 bp, Homo sapiens
tatgtaaattacaaatgtgg

SEQ ID NO: 4503482 - DNA, 22 bp, Homo sapiens
tatgtaacacaggataaagtta

SEQ ID NO: 4503483 - DNA, 11 bp, Homo sapiens
tatgtaacatg

SEQ ID NO: 4503484 - DNA, 16 bp, Homo sapiens
tatgtaagcatttgta

SEQ ID NO: 4503485 - DNA, 18 bp, Homo sapiens
tatgtaagcatttgtaca

SEQ ID NO: 4503486 - DNA, 15 bp, Homo sapiens
tatgtacaaacatgt

SEQ ID NO: 4503487 - DNA, 16 bp, Homo sapiens
tatgtacaaacatgtt

SEQ ID NO: 4503488 - DNA, 13 bp, Homo sapiens
tatgtacaaccct

SEQ ID NO: 4503489 - DNA, 11 bp, Homo sapiens
tatgtacaata

SEQ ID NO: 4503490 - DNA, 20 bp, Homo sapiens
tatgtacaatacaatgtaca

SEQ ID NO: 4503491 - DNA, 21 bp, Homo sapiens
tatgtacagaaaacatgtata

SEQ ID NO: 4503492 - DNA, 19 bp, Homo sapiens
tatgtacttttattttttg

SEQ ID NO: 4503493 - DNA, 15 bp, Homo sapiens
tatgtagcaaaatac

SEQ ID NO: 4503494 - DNA, 19 bp, Homo sapiens
tatgtagccttcacacaga

SEQ ID NO: 4503495 - DNA, 17 bp, Homo sapiens
tatgtagtaattgacat

SEQ ID NO: 4503496 - DNA, 20 bp, Homo sapiens
tatgtagtaattgacatgtg

SEQ ID NO: 4503497 - DNA, 19 bp, Homo sapiens
tatgtatgctgatttacta

SEQ ID NO: 4503498 - DNA, 19 bp, Homo sapiens
tatgtatggatatatttga

SEQ ID NO: 4503499 - DNA, 19 bp, Homo sapiens
tatgtattatttacattta

SEQ ID NO: 4503500 - DNA, 21 bp, Homo sapiens
tatgtattatttacatttaat

SEQ ID NO: 4503501 - DNA, 13 bp, Homo sapiens
tatgtatttaaga

SEQ ID NO: 4503502 - DNA, 11 bp, Homo sapiens
tatgtatttcc

SEQ ID NO: 4503503 - DNA, 10 bp, Homo sapiens
tatgtatttt

SEQ ID NO: 4503504 - DNA, 15 bp, Homo sapiens
tatgtattttaaaat

SEQ ID NO: 4503505 - DNA, 16 bp, Homo sapiens
tatgtattttaaaata

SEQ ID NO: 4503506 - DNA, 15 bp, Homo sapiens
tatgtattttcctaa

SEQ ID NO: 4503507 - DNA, 16 bp, Homo sapiens
tatgtattttcctaat

SEQ ID NO: 4503508 - DNA, 23 bp, Homo sapiens
tatgtcaccataatgaacaattg

SEQ ID NO: 4503509 - DNA, 14 bp, Homo sapiens
tatgtcatagaaat

SEQ ID NO: 4503510 - DNA, 16 bp, Homo sapiens
tatgtcatagaaatat

SEQ ID NO: 4503511 - DNA, 18 bp, Homo sapiens
tatgtcatcagtaaagta

SEQ ID NO: 4503512 - DNA, 15 bp, Homo sapiens
tatgtccactgttct

SEQ ID NO: 4503513 - DNA, 16 bp, Homo sapiens
tatgtccttcagctga

SEQ ID NO: 4503514 - DNA, 21 bp, Homo sapiens
tatgtctcgtggtaggactgt

SEQ ID NO: 4503515 - DNA, 14 bp, Homo sapiens
tatgtctcttctga

SEQ ID NO: 4503516 - DNA, 19 bp, Homo sapiens
tatgtctcttgagcatcaa

SEQ ID NO: 4503517 - DNA, 17 bp, Homo sapiens
tatgtctgaacatagaa

SEQ ID NO: 4503518 - DNA, 21 bp, Homo sapiens
tatgtctgaacatagaaactc

SEQ ID NO: 4503519 - DNA, 12 bp, Homo sapiens
tatgtgaagaat

SEQ ID NO: 4503520 - DNA, 17 bp, Homo sapiens
tatgtgaagaatttaga

SEQ ID NO: 4503521 - DNA, 12 bp, Homo sapiens
tatgtgaagttt

SEQ ID NO: 4503522 - DNA, 13 bp, Homo sapiens
tatgtgaagtttt

SEQ ID NO: 4503523 - DNA, 18 bp, Homo sapiens
tatgtgaatatttgtaaa

SEQ ID NO: 4503524 - DNA, 22 bp, Homo sapiens
tatgtgaatatttgtaaaaata

SEQ ID NO: 4503525 - DNA, 15 bp, Homo sapiens
tatgtgaatttgttt

SEQ ID NO: 4503526 - DNA, 20 bp, Homo sapiens
tatgtgacatttctcttccc

SEQ ID NO: 4503527 - DNA, 21 bp, Homo sapiens
tatgtgacattttacattaaa

SEQ ID NO: 4503528 - DNA, 19 bp, Homo sapiens
tatgtgagaaatcagaatt

SEQ ID NO: 4503529 - DNA, 16 bp, Homo sapiens
tatgtgagatttcctt

SEQ ID NO: 4503530 - DNA, 15 bp, Homo sapiens
tatgtgaggtaatta

SEQ ID NO: 4503531 - DNA, 12 bp, Homo sapiens
tatgtggaagtg

SEQ ID NO: 4503532 - DNA, 21 bp, Homo sapiens
tatgtggcaaaacatatacca

SEQ ID NO: 4503533 - DNA, 15 bp, Homo sapiens
tatgtgtaaagattt

SEQ ID NO: 4503534 - DNA, 15 bp, Homo sapiens
tatgtgtgaggagct

SEQ ID NO: 4503535 - DNA, 15 bp, Homo sapiens
tatgtgtgccctgga

SEQ ID NO: 4503536 - DNA, 22 bp, Homo sapiens
tatgtgtgtgtgttgtgtgtgg

SEQ ID NO: 4503537 - DNA, 18 bp, Homo sapiens
tatgtgttatgaacatcc

SEQ ID NO: 4503538 - DNA, 18 bp, Homo sapiens
tatgtgttgaaaaccaaa

SEQ ID NO: 4503539 - DNA, 17 bp, Homo sapiens
tatgtgtttttctcata

SEQ ID NO: 4503540 - DNA, 21 bp, Homo sapiens
tatgttactgtatttttcaga

SEQ ID NO: 4503541 - DNA, 14 bp, Homo sapiens
tatgttatgaggat

SEQ ID NO: 4503542 - DNA, 15 bp, Homo sapiens
tatgttcctcaaatc

SEQ ID NO: 4503543 - DNA, 15 bp, Homo sapiens
tatgttgaatacttt

SEQ ID NO: 4503544 - DNA, 15 bp, Homo sapiens
tatgttgaggatcta

SEQ ID NO: 4503545 - DNA, 23 bp, Homo sapiens
tatgttgataaaccaaaaacatt

SEQ ID NO: 4503546 - DNA, 20 bp, Homo sapiens
tatgttgttgaactaatata

SEQ ID NO: 4503547 - DNA, 13 bp, Homo sapiens
tatgtttaaaata

SEQ ID NO: 4503548 - DNA, 22 bp, Homo sapiens
tatgtttagatagggctgggca

SEQ ID NO: 4503549 - DNA, 19 bp, Homo sapiens
tatatgtgtatacatacat

SEQ ID NO: 4503550 - DNA, 16 bp, Homo sapiens
tatatgtgtgccctgg

SEQ ID NO: 4503551 - DNA, 15 bp, Homo sapiens
tatatgtgttgaaaa

SEQ ID NO: 4503552 - DNA, 13 bp, Homo sapiens
tatattaaaacaa

SEQ ID NO: 4503553 - DNA, 13 bp, Homo sapiens
tatattaaaattc

SEQ ID NO: 4503554 - DNA, 22 bp, Homo sapiens
tatattaaacaaagtttcagag

SEQ ID NO: 4503555 - DNA, 13 bp, Homo sapiens
tatattaaacata

SEQ ID NO: 4503556 - DNA, 13 bp, Homo sapiens
tatattaatagta

SEQ ID NO: 4503557 - DNA, 13 bp, Homo sapiens
tatattacaatga

SEQ ID NO: 4503558 - DNA, 13 bp, Homo sapiens
tatattacaccaa

SEQ ID NO: 4503559 - DNA, 17 bp, Homo sapiens
tatattacagatatttg

SEQ ID NO: 4503560 - DNA, 13 bp, Homo sapiens
tatattataagtt

SEQ ID NO: 4503561 - DNA, 22 bp, Homo sapiens
tatattcaaattatgtataaat

SEQ ID NO: 4503562 - DNA, 22 bp, Homo sapiens
tatattcaggacttgaaagaaa

SEQ ID NO: 4503563 - DNA, 17 bp, Homo sapiens
tatattcatatacaaac

SEQ ID NO: 4503564 - DNA, 22 bp, Homo sapiens
tatattcatatacaaacatgta

SEQ ID NO: 4503565 - DNA, 18 bp, Homo sapiens
tatattcatctaataaat

SEQ ID NO: 4503566 - DNA, 20 bp, Homo sapiens
tatattctgaccgttaaaaa

SEQ ID NO: 4503567 - DNA, 12 bp, Homo sapiens
tatattgaactt

SEQ ID NO: 4503568 - DNA, 23 bp, Homo sapiens
tatattgggtgtagatttctgac

SEQ ID NO: 4503569 - DNA, 18 bp, Homo sapiens
tatattggtttgcacaag

SEQ ID NO: 4503570 - DNA, 15 bp, Homo sapiens
tatattgtaaagaag

SEQ ID NO: 4503571 - DNA, 21 bp, Homo sapiens
tatattgtcctcccctatttt

SEQ ID NO: 4503572 - DNA, 19 bp, Homo sapiens
tatattgtgtttgtgtatt

SEQ ID NO: 4503573 - DNA, 20 bp, Homo sapiens
tatattgtttttatatatta

SEQ ID NO: 4503574 - DNA, 16 bp, Homo sapiens
tatatttaaaaaatta

SEQ ID NO: 4503575 - DNA, 18 bp, Homo sapiens
tatatttaaaaaattatg

SEQ ID NO: 4503576 - DNA, 22 bp, Homo sapiens
tatatttaaaaaattatggaat

SEQ ID NO: 4503577 - DNA, 14 bp, Homo sapiens
tatatttaaaaata

SEQ ID NO: 4503578 - DNA, 15 bp, Homo sapiens
tatatttaaaaataa

SEQ ID NO: 4503579 - DNA, 19 bp, Homo sapiens
tatatttaactctctttat

SEQ ID NO: 4503580 - DNA, 16 bp, Homo sapiens
tatatttcagatgtaa

SEQ ID NO: 4503581 - DNA, 17 bp, Homo sapiens
tatatttcctttatgtg

SEQ ID NO: 4503582 - DNA, 19 bp, Homo sapiens
tatatttcctttatgtgaa

SEQ ID NO: 4503583 - DNA, 22 bp, Homo sapiens
tatatttcctttatgtgaattt

SEQ ID NO: 4503584 - DNA, 13 bp, Homo sapiens
tatatttctatta

SEQ ID NO: 4503585 - DNA, 19 bp, Homo sapiens
tatatttcttcttctaaga

SEQ ID NO: 4503586 - DNA, 19 bp, Homo sapiens
tatatttgaaataaagttg

SEQ ID NO: 4503587 - DNA, 21 bp, Homo sapiens
tatatttgattatgtatggat

SEQ ID NO: 4503588 - DNA, 21 bp, Homo sapiens
tatatttgcatattgaaaagc

SEQ ID NO: 4503589 - DNA, 18 bp, Homo sapiens
tatatttgtccagataat

SEQ ID NO: 4503590 - DNA, 17 bp, Homo sapiens
tatatttgtgctatagt

SEQ ID NO: 4503591 - DNA, 22 bp, Homo sapiens
tatatttgtgctatagtatttg

SEQ ID NO: 4503592 - DNA, 22 bp, Homo sapiens
tatattttaatgtttttaaaaa

SEQ ID NO: 4503593 - DNA, 16 bp, Homo sapiens
tatattttacaatttt

SEQ ID NO: 4503594 - DNA, 13 bp, Homo sapiens
tatattttatctt

SEQ ID NO: 4503595 - DNA, 14 bp, Homo sapiens
tatattttatcttg

SEQ ID NO: 4503596 - DNA, 16 bp, Homo sapiens
tatattttatgaacat

SEQ ID NO: 4503597 - DNA, 21 bp, Homo sapiens
tatattttatgaacattgtac

SEQ ID NO: 4503598 - DNA, 22 bp, Homo sapiens
tatattttatgaacattgtact

SEQ ID NO: 4503599 - DNA, 15 bp, Homo sapiens
tatattttctgtatt

SEQ ID NO: 4503600 - DNA, 22 bp, Homo sapiens
tatatttttatctatataaaat

SEQ ID NO: 4503601 - DNA, 19 bp, Homo sapiens
tatattttttgttaaatga

SEQ ID NO: 4503602 - DNA, 16 bp, Homo sapiens
tatatttttttaactt

SEQ ID NO: 4503603 - DNA, 14 bp, Homo sapiens
tatcaaactgctgt

SEQ ID NO: 4503604 - DNA, 17 bp, Homo sapiens
tatcaaattatcttcac

SEQ ID NO: 4503605 - DNA, 18 bp, Homo sapiens
tatcaacttcgctagaaa

SEQ ID NO: 4503606 - DNA, 15 bp, Homo sapiens
tatcaatgtgtcttt

SEQ ID NO: 4503607 - DNA, 22 bp, Homo sapiens
tatcaatgtgtctttctaagaa

SEQ ID NO: 4503608 - DNA, 13 bp, Homo sapiens
tatcacacaatat

SEQ ID NO: 4503609 - DNA, 14 bp, Homo sapiens
tatcacacaatata

SEQ ID NO: 4503610 - DNA, 13 bp, Homo sapiens
tatcacacacatt

SEQ ID NO: 4503611 - DNA, 20 bp, Homo sapiens
tatcacacacattgctgtga

SEQ ID NO: 4503612 - DNA, 11 bp, Homo sapiens
tatcacagtgt

SEQ ID NO: 4503613 - DNA, 13 bp, Homo sapiens
tatcacagtgttt

SEQ ID NO: 4503614 - DNA, 23 bp, Homo sapiens
tatcacataagagagatgagaaa

SEQ ID NO: 4503615 - DNA, 19 bp, Homo sapiens
tatcaccgtgggctccctg

SEQ ID NO: 4503616 - DNA, 13 bp, Homo sapiens
tatcactcattaa

SEQ ID NO: 4503617 - DNA, 20 bp, Homo sapiens
tatcactgcagtcacctctt

SEQ ID NO: 4503618 - DNA, 11 bp, Homo sapiens
tatcactgtct

SEQ ID NO: 4503619 - DNA, 20 bp, Homo sapiens
tatcactgtgcagttgctgt

SEQ ID NO: 4503620 - DNA, 20 bp, Homo sapiens
tatcacttaatttgaaatct

SEQ ID NO: 4503621 - DNA, 16 bp, Homo sapiens
tatcagatttcattaa

SEQ ID NO: 4503622 - DNA, 18 bp, Homo sapiens
tatcagctttgataattg

SEQ ID NO: 4503623 - DNA, 21 bp, Homo sapiens
tatcagctttgataattgtgt

SEQ ID NO: 4503624 - DNA, 20 bp, Homo sapiens
tatcaggacccagaggaagg

SEQ ID NO: 4503625 - DNA, 14 bp, Homo sapiens
tatcagggcacagt

SEQ ID NO: 4503626 - DNA, 9 bp, Homo sapiens
tatcagtag

SEQ ID NO: 4503627 - DNA, 20 bp, Homo sapiens
tatcagtcaatatttttaga

SEQ ID NO: 4503628 - DNA, 18 bp, Homo sapiens
tatcagtgtcctttccag

SEQ ID NO: 4503629 - DNA, 17 bp, Homo sapiens
tatcagttactcagccc

SEQ ID NO: 4503630 - DNA, 18 bp, Homo sapiens
tatcagttactcagccct

SEQ ID NO: 4503631 - DNA, 20 bp, Homo sapiens
tatcagttatctgtttgtta

SEQ ID NO: 4503632 - DNA, 23 bp, Homo sapiens
tatcataagttatgcctctgaca

SEQ ID NO: 4503633 - DNA, 14 bp, Homo sapiens
tatcatactcttct

SEQ ID NO: 4503634 - DNA, 15 bp, Homo sapiens
tatcatactcttcta

SEQ ID NO: 4503635 - DNA, 23 bp, Homo sapiens
tatcatcagtgtagaacctaatt

SEQ ID NO: 4503636 - DNA, 15 bp, Homo sapiens
tatcatccacacatg

SEQ ID NO: 4503637 - DNA, 19 bp, Homo sapiens
tatcatctggataggagcc

SEQ ID NO: 4503638 - DNA, 20 bp, Homo sapiens
tatcatctgtcattatattc

SEQ ID NO: 4503639 - DNA, 11 bp, Homo sapiens
tatcatgaagc

SEQ ID NO: 4503640 - DNA, 12 bp, Homo sapiens
tatcatgaagcc

SEQ ID NO: 4503641 - DNA, 16 bp, Homo sapiens
tatcatgaagcctgtg

SEQ ID NO: 4503642 - DNA, 15 bp, Homo sapiens
tatcatgcaaaatat

SEQ ID NO: 4503643 - DNA, 17 bp, Homo sapiens
tatcatgcatgtcctgt

SEQ ID NO: 4503644 - DNA, 16 bp, Homo sapiens
tatcatggtgaaaagc

SEQ ID NO: 4503645 - DNA, 17 bp, Homo sapiens
tatcattaaacaaataa

SEQ ID NO: 4503646 - DNA, 13 bp, Homo sapiens
tatcattcaagtg

SEQ ID NO: 4503647 - DNA, 14 bp, Homo sapiens
tatcattcaagtgt

SEQ ID NO: 4503648 - DNA, 15 bp, Homo sapiens
tatccaaaatgcttg

SEQ ID NO: 4503649 - DNA, 22 bp, Homo sapiens
tatccaattcagggtccctgga

SEQ ID NO: 4503650 - DNA, 21 bp, Homo sapiens
tatccacaattattggcaaag

SEQ ID NO: 4503651 - DNA, 15 bp, Homo sapiens
tatccacccagccca

SEQ ID NO: 4503652 - DNA, 15 bp, Homo sapiens
tatccaggcaccagg

SEQ ID NO: 4503653 - DNA, 18 bp, Homo sapiens
tatccaggtaatccaaga

SEQ ID NO: 4503654 - DNA, 21 bp, Homo sapiens
tatccccatctccctgcctgg

SEQ ID NO: 4503655 - DNA, 17 bp, Homo sapiens
tatccctctcttcccct

SEQ ID NO: 4503656 - DNA, 17 bp, Homo sapiens
tatcccttggacatttt

SEQ ID NO: 4503657 - DNA, 13 bp, Homo sapiens
tatcctaaacttt

SEQ ID NO: 4503658 - DNA, 23 bp, Homo sapiens
tatcctaaactttagacttccca

SEQ ID NO: 4503659 - DNA, 20 bp, Homo sapiens
tatcctctccccctcctcca

SEQ ID NO: 4503660 - DNA, 21 bp, Homo sapiens
tatcctgcgggttttaattta

SEQ ID NO: 4503661 - DNA, 19 bp, Homo sapiens
tatcctggccttgtacttg

SEQ ID NO: 4503662 - DNA, 13 bp, Homo sapiens
tatcctgtttgaa

SEQ ID NO: 4503663 - DNA, 21 bp, Homo sapiens
tatcctgtttgaggaaagcaa

SEQ ID NO: 4503664 - DNA, 15 bp, Homo sapiens
tatccttcagcctga

SEQ ID NO: 4503665 - DNA, 19 bp, Homo sapiens
tatcggattactgaattgt

SEQ ID NO: 4503666 - DNA, 14 bp, Homo sapiens
tatcgtgaaatcct

SEQ ID NO: 4503667 - DNA, 13 bp, Homo sapiens
tatctaaagttat

SEQ ID NO: 4503668 - DNA, 19 bp, Homo sapiens
tatctaaagttatatttca

SEQ ID NO: 4503669 - DNA, 16 bp, Homo sapiens
tatctaacattttcta

SEQ ID NO: 4503670 - DNA, 15 bp, Homo sapiens
tatctaagaataata

SEQ ID NO: 4503671 - DNA, 15 bp, Homo sapiens
tatctacaaaaattt

SEQ ID NO: 4503672 - DNA, 21 bp, Homo sapiens
tatctagcatttatttctctg

SEQ ID NO: 4503673 - DNA, 15 bp, Homo sapiens
tatctaggcatttca

SEQ ID NO: 4503674 - DNA, 20 bp, Homo sapiens
tatctattcttctgaccatc

SEQ ID NO: 4503675 - DNA, 15 bp, Homo sapiens
tatctatttgtacaa

SEQ ID NO: 4503676 - DNA, 18 bp, Homo sapiens
tatctatttgtacaattt

SEQ ID NO: 4503677 - DNA, 17 bp, Homo sapiens
tatctcaaaactgcact

SEQ ID NO: 4503678 - DNA, 19 bp, Homo sapiens
tatctcactttgtaaataa

SEQ ID NO: 4503679 - DNA, 20 bp, Homo sapiens
tatctcactttgtaaataaa

SEQ ID NO: 4503680 - DNA, 15 bp, Homo sapiens
tatctcagatgttaa

SEQ ID NO: 4503681 - DNA, 19 bp, Homo sapiens
tatctcagatgttaaaata

SEQ ID NO: 4503682 - DNA, 12 bp, Homo sapiens
tatctcagccat

SEQ ID NO: 4503683 - DNA, 15 bp, Homo sapiens
tatctcagccatagg

SEQ ID NO: 4503684 - DNA, 17 bp, Homo sapiens
tatctccatggccctgt

SEQ ID NO: 4503685 - DNA, 19 bp, Homo sapiens
tatctccatggccctgtcc

SEQ ID NO: 4503686 - DNA, 22 bp, Homo sapiens
tatctccatggccctgtcccag

SEQ ID NO: 4503687 - DNA, 16 bp, Homo sapiens
tatctctatttgagaa

SEQ ID NO: 4503688 - DNA, 12 bp, Homo sapiens
tatctctctgtg

SEQ ID NO: 4503689 - DNA, 19 bp, Homo sapiens
tatctctggcaccacacta

SEQ ID NO: 4503690 - DNA, 18 bp, Homo sapiens
tatctcttggaaaataag

SEQ ID NO: 4503691 - DNA, 19 bp, Homo sapiens
tatctcttggaaaataaga

SEQ ID NO: 4503692 - DNA, 19 bp, Homo sapiens
tatctgaacatttactaca

SEQ ID NO: 4503693 - DNA, 19 bp, Homo sapiens
tatctgaatgatcctgtct

SEQ ID NO: 4503694 - DNA, 22 bp, Homo sapiens
tatctgcaagtgaggtgtgtca

SEQ ID NO: 4503695 - DNA, 19 bp, Homo sapiens
tatctgcatttaccactgt

SEQ ID NO: 4503696 - DNA, 12 bp, Homo sapiens
tatctgcccctc

SEQ ID NO: 4503697 - DNA, 18 bp, Homo sapiens
tatctgcccctcccccac

SEQ ID NO: 4503698 - DNA, 12 bp, Homo sapiens
tatctgctgtcc

SEQ ID NO: 4503699 - DNA, 19 bp, Homo sapiens
tatctggattcaaatttat

SEQ ID NO: 4503700 - DNA, 17 bp, Homo sapiens
tatctgggtaagaagaa

SEQ ID NO: 4503701 - DNA, 22 bp, Homo sapiens
tatctgggtaagaagaaagcaa

SEQ ID NO: 4503702 - DNA, 18 bp, Homo sapiens
tatctggtgcctcctcaa

SEQ ID NO: 4503703 - DNA, 15 bp, Homo sapiens
tatctgtcagctgca

SEQ ID NO: 4503704 - DNA, 16 bp, Homo sapiens
tatctgtgaaatatca

SEQ ID NO: 4503705 - DNA, 20 bp, Homo sapiens
tatctgtgcttctaatatta

SEQ ID NO: 4503706 - DNA, 16 bp, Homo sapiens
tatctgttcccagccc

SEQ ID NO: 4503707 - DNA, 21 bp, Homo sapiens
tatctgttgccttatttctca

SEQ ID NO: 4503708 - DNA, 20 bp, Homo sapiens
tatctgtttcctgacattgt

SEQ ID NO: 4503709 - DNA, 22 bp, Homo sapiens
tatctgtttcctgacattgtct

SEQ ID NO: 4503710 - DNA, 18 bp, Homo sapiens
tatctgtttttaaagcac

SEQ ID NO: 4503711 - DNA, 13 bp, Homo sapiens
tatcttaagcagg

SEQ ID NO: 4503712 - DNA, 14 bp, Homo sapiens
tatcttaagcatgt

SEQ ID NO: 4503713 - DNA, 18 bp, Homo sapiens
tatcttactatttcacaa

SEQ ID NO: 4503714 - DNA, 16 bp, Homo sapiens
tatcttataactgttt

SEQ ID NO: 4503715 - DNA, 22 bp, Homo sapiens
tatcttcaccctcatcctttac

SEQ ID NO: 4503716 - DNA, 20 bp, Homo sapiens
tatcttcatatgtcaccttt

SEQ ID NO: 4503717 - DNA, 15 bp, Homo sapiens
tatcttcatgtaaat

SEQ ID NO: 4503718 - DNA, 16 bp, Homo sapiens
tatcttcatgtaaatt

SEQ ID NO: 4503719 - DNA, 12 bp, Homo sapiens
tatcttctggat

SEQ ID NO: 4503720 - DNA, 14 bp, Homo sapiens
tatcttctggatta

SEQ ID NO: 4503721 - DNA, 21 bp, Homo sapiens
tatcttctggattagaatgcc

SEQ ID NO: 4503722 - DNA, 17 bp, Homo sapiens
tatcttcttaacagttt

SEQ ID NO: 4503723 - DNA, 19 bp, Homo sapiens
tatcttcttataacttgta

SEQ ID NO: 4503724 - DNA, 17 bp, Homo sapiens
tatcttggacaaatcac

SEQ ID NO: 4503725 - DNA, 19 bp, Homo sapiens
tatcttggacaaatcacat

SEQ ID NO: 4503726 - DNA, 11 bp, Homo sapiens
tatcttggcct

SEQ ID NO: 4503727 - DNA, 12 bp, Homo sapiens
tatcttgtgctt

SEQ ID NO: 4503728 - DNA, 15 bp, Homo sapiens
tatctttaagaaaaa

SEQ ID NO: 4503729 - DNA, 21 bp, Homo sapiens
tatctttaccaaaaaccatgt

SEQ ID NO: 4503730 - DNA, 16 bp, Homo sapiens
tatctttattaaaaca

SEQ ID NO: 4503731 - DNA, 16 bp, Homo sapiens
tatctttcagttatta

SEQ ID NO: 4503732 - DNA, 16 bp, Homo sapiens
tatctttctttctcta

SEQ ID NO: 4503733 - DNA, 17 bp, Homo sapiens
tatctttctttctctaa

SEQ ID NO: 4503734 - DNA, 22 bp, Homo sapiens
tatcttttgtttccttttttcc

SEQ ID NO: 4503735 - DNA, 19 bp, Homo sapiens
tatgaaaagctagaattga

SEQ ID NO: 4503736 - DNA, 20 bp, Homo sapiens
tatgaaaagtactaatagaa

SEQ ID NO: 4503737 - DNA, 22 bp, Homo sapiens
tatgaaaatatagacattctca

SEQ ID NO: 4503738 - DNA, 23 bp, Homo sapiens
tatgaaaatgggatgaattcttt

SEQ ID NO: 4503739 - DNA, 16 bp, Homo sapiens
tatgaaagtagattca

SEQ ID NO: 4503740 - DNA, 23 bp, Homo sapiens
tatgaaatgtcccctcaaactca

SEQ ID NO: 4503741 - DNA, 18 bp, Homo sapiens
tatgaaattcaagtgctt

SEQ ID NO: 4503742 - DNA, 16 bp, Homo sapiens
tatgaacattgtactg

SEQ ID NO: 4503743 - DNA, 23 bp, Homo sapiens
tatgaacccttcctgagctttat

SEQ ID NO: 4503744 - DNA, 16 bp, Homo sapiens
tatgaaccctttgttt

SEQ ID NO: 4503745 - DNA, 21 bp, Homo sapiens
tatgaagctacctcaaacttc

SEQ ID NO: 4503746 - DNA, 16 bp, Homo sapiens
tatgaagtataaatct

SEQ ID NO: 4503747 - DNA, 16 bp, Homo sapiens
tatgaagtttttaaaa

SEQ ID NO: 4503748 - DNA, 15 bp, Homo sapiens
tatgaatctgagaga

SEQ ID NO: 4503749 - DNA, 13 bp, Homo sapiens
tatgaattcaaga

SEQ ID NO: 4503750 - DNA, 21 bp, Homo sapiens
tatgacagtgaattttgcaca

SEQ ID NO: 4503751 - DNA, 13 bp, Homo sapiens
tatgacatctaag

SEQ ID NO: 4503752 - DNA, 19 bp, Homo sapiens
tatgaccacagagttatat

SEQ ID NO: 4503753 - DNA, 16 bp, Homo sapiens
tatgaccagaagcctt

SEQ ID NO: 4503754 - DNA, 21 bp, Homo sapiens
tatgacctaggggtttctgtt

SEQ ID NO: 4503755 - DNA, 18 bp, Homo sapiens
tatgactatgtaaactac

SEQ ID NO: 4503756 - DNA, 14 bp, Homo sapiens
tatgagaagaatag

SEQ ID NO: 4503757 - DNA, 16 bp, Homo sapiens
tatgagaatatacctt

SEQ ID NO: 4503758 - DNA, 15 bp, Homo sapiens
tatgagaggcaatga

SEQ ID NO: 4503759 - DNA, 16 bp, Homo sapiens
tatgagatggccatgc

SEQ ID NO: 4503760 - DNA, 19 bp, Homo sapiens
tatgagatggccatgctca

SEQ ID NO: 4503761 - DNA, 13 bp, Homo sapiens
tatgagatttact

SEQ ID NO: 4503762 - DNA, 16 bp, Homo sapiens
tatgagatttactgct

SEQ ID NO: 4503763 - DNA, 16 bp, Homo sapiens
tatgagcagcaagatt

SEQ ID NO: 4503764 - DNA, 20 bp, Homo sapiens
tatgagctatcctttcaaac

SEQ ID NO: 4503765 - DNA, 23 bp, Homo sapiens
tatgagctggggatgtctctcat

SEQ ID NO: 4503766 - DNA, 15 bp, Homo sapiens
tatgagcttcaatat

SEQ ID NO: 4503767 - DNA, 20 bp, Homo sapiens
tatgagcttcaatataagaa

SEQ ID NO: 4503768 - DNA, 18 bp, Homo sapiens
tatgaggaaactgagtca

SEQ ID NO: 4503769 - DNA, 14 bp, Homo sapiens
tatgaggaggggag

SEQ ID NO: 4503770 - DNA, 20 bp, Homo sapiens
tatgaggataatgggaagag

SEQ ID NO: 4503771 - DNA, 12 bp, Homo sapiens
tatgagttcttg

SEQ ID NO: 4503772 - DNA, 14 bp, Homo sapiens
tatgatactgatgc

SEQ ID NO: 4503773 - DNA, 13 bp, Homo sapiens
tatgatatttctt

SEQ ID NO: 4503774 - DNA, 19 bp, Homo sapiens
tatgatcaaaaactgcctt

SEQ ID NO: 4503775 - DNA, 18 bp, Homo sapiens
tatgatctcttctggtgt

SEQ ID NO: 4503776 - DNA, 14 bp, Homo sapiens
tatgatctgtctgt

SEQ ID NO: 4503777 - DNA, 16 bp, Homo sapiens
tatgatctgtctgtgg

SEQ ID NO: 4503778 - DNA, 20 bp, Homo sapiens
tatgatgatacagtgttaaa

SEQ ID NO: 4503779 - DNA, 17 bp, Homo sapiens
tatgattggttcagttt

SEQ ID NO: 4503780 - DNA, 19 bp, Homo sapiens
tatgattggttcagttttt

SEQ ID NO: 4503781 - DNA, 14 bp, Homo sapiens
tatgattttcataa

SEQ ID NO: 4503782 - DNA, 19 bp, Homo sapiens
tatgatttttttttcatac

SEQ ID NO: 4503783 - DNA, 14 bp, Homo sapiens
tatgcaaagcactg

SEQ ID NO: 4503784 - DNA, 14 bp, Homo sapiens
tatgcaagcagctt

SEQ ID NO: 4503785 - DNA, 17 bp, Homo sapiens
tatgcacgaccttggga

SEQ ID NO: 4503786 - DNA, 16 bp, Homo sapiens
tatgcactaaatatga

SEQ ID NO: 4503787 - DNA, 17 bp, Homo sapiens
tatgcactgaagagctc

SEQ ID NO: 4503788 - DNA, 18 bp, Homo sapiens
tatgcactgaagagctct

SEQ ID NO: 4503789 - DNA, 22 bp, Homo sapiens
tatgcactgaagagctcttggc

SEQ ID NO: 4503790 - DNA, 18 bp, Homo sapiens
tatgcagaaatagacaaa

SEQ ID NO: 4503791 - DNA, 19 bp, Homo sapiens
tatttacaaaattttaaca

SEQ ID NO: 4503792 - DNA, 15 bp, Homo sapiens
tatttacaagaagaa

SEQ ID NO: 4503793 - DNA, 14 bp, Homo sapiens
tatttacagaagaa

SEQ ID NO: 4503794 - DNA, 15 bp, Homo sapiens
tatttacagaagaaa

SEQ ID NO: 4503795 - DNA, 14 bp, Homo sapiens
tatttacatttaat

SEQ ID NO: 4503796 - DNA, 15 bp, Homo sapiens
tatttacgctttgat

SEQ ID NO: 4503797 - DNA, 21 bp, Homo sapiens
tatttactttttaaaaataac

SEQ ID NO: 4503798 - DNA, 16 bp, Homo sapiens
tatttagccatagtat

SEQ ID NO: 4503799 - DNA, 12 bp, Homo sapiens
tatttagctgtt

SEQ ID NO: 4503800 - DNA, 14 bp, Homo sapiens
tatttagggtacta

SEQ ID NO: 4503801 - DNA, 22 bp, Homo sapiens
tatttagttacgtataatgctt

SEQ ID NO: 4503802 - DNA, 23 bp, Homo sapiens
tatttagttacgtataatgcttt

SEQ ID NO: 4503803 - DNA, 18 bp, Homo sapiens
tatttataatacagaatc

SEQ ID NO: 4503804 - DNA, 20 bp, Homo sapiens
tatttataatacagaatctt

SEQ ID NO: 4503805 - DNA, 13 bp, Homo sapiens
tatttatataaat

SEQ ID NO: 4503806 - DNA, 20 bp, Homo sapiens
tatttatatactttttcatg

SEQ ID NO: 4503807 - DNA, 20 bp, Homo sapiens
tatttatatcacacaatata

SEQ ID NO: 4503808 - DNA, 15 bp, Homo sapiens
tatttatatgtacat

SEQ ID NO: 4503809 - DNA, 18 bp, Homo sapiens
tatttatgtaatgaagta

SEQ ID NO: 4503810 - DNA, 15 bp, Homo sapiens
tatttattaaatttt

SEQ ID NO: 4503811 - DNA, 14 bp, Homo sapiens
tatttattacataa

SEQ ID NO: 4503812 - DNA, 13 bp, Homo sapiens
tatttattattaa

SEQ ID NO: 4503813 - DNA, 17 bp, Homo sapiens
tatttattattaattta

SEQ ID NO: 4503814 - DNA, 14 bp, Homo sapiens
tatttattgcattg

SEQ ID NO: 4503815 - DNA, 20 bp, Homo sapiens
tatttattgcattgctggta

SEQ ID NO: 4503816 - DNA, 22 bp, Homo sapiens
tatttattgcattgctggtaga

SEQ ID NO: 4503817 - DNA, 10 bp, Homo sapiens
tatttattgt

SEQ ID NO: 4503818 - DNA, 11 bp, Homo sapiens
tatttattgtt

SEQ ID NO: 4503819 - DNA, 16 bp, Homo sapiens
tatttattgttagaaa

SEQ ID NO: 4503820 - DNA, 20 bp, Homo sapiens
tatttattgttagaaaatga

SEQ ID NO: 4503821 - DNA, 23 bp, Homo sapiens
tatttatttaaaactctggtgat

SEQ ID NO: 4503822 - DNA, 11 bp, Homo sapiens
tatttatttct

SEQ ID NO: 4503823 - DNA, 18 bp, Homo sapiens
tatttattttagcaaatc

SEQ ID NO: 4503824 - DNA, 16 bp, Homo sapiens
tatttatttttacctg

SEQ ID NO: 4503825 - DNA, 12 bp, Homo sapiens
tatttcaaatat

SEQ ID NO: 4503826 - DNA, 15 bp, Homo sapiens
tatttcaagtgccta

SEQ ID NO: 4503827 - DNA, 21 bp, Homo sapiens
tatttcaataaatctttcaaa

SEQ ID NO: 4503828 - DNA, 14 bp, Homo sapiens
tatttcaataacag

SEQ ID NO: 4503829 - DNA, 12 bp, Homo sapiens
tatttcaatgag

SEQ ID NO: 4503830 - DNA, 22 bp, Homo sapiens
tatttcacttaaactttgtcac

SEQ ID NO: 4503831 - DNA, 13 bp, Homo sapiens
tatttcagatgta

SEQ ID NO: 4503832 - DNA, 16 bp, Homo sapiens
tatttcagatgtaatg

SEQ ID NO: 4503833 - DNA, 18 bp, Homo sapiens
tatttcagattttgataa

SEQ ID NO: 4503834 - DNA, 13 bp, Homo sapiens
tatttcatctttt

SEQ ID NO: 4503835 - DNA, 14 bp, Homo sapiens
tatttccactaaaa

SEQ ID NO: 4503836 - DNA, 17 bp, Homo sapiens
tatttccactaaaaata

SEQ ID NO: 4503837 - DNA, 19 bp, Homo sapiens
tatttccactaaaaatatt

SEQ ID NO: 4503838 - DNA, 18 bp, Homo sapiens
tatttcctcccccagtta

SEQ ID NO: 4503839 - DNA, 11 bp, Homo sapiens
tatttccttta

SEQ ID NO: 4503840 - DNA, 18 bp, Homo sapiens
tatttcctttatgtgaat

SEQ ID NO: 4503841 - DNA, 19 bp, Homo sapiens
tatttctagttctttcctc

SEQ ID NO: 4503842 - DNA, 12 bp, Homo sapiens
tatttctatgtc

SEQ ID NO: 4503843 - DNA, 14 bp, Homo sapiens
tatttctatgtcat

SEQ ID NO: 4503844 - DNA, 21 bp, Homo sapiens
tatttctattattaattgcaa

SEQ ID NO: 4503845 - DNA, 20 bp, Homo sapiens
tatttctcattgcctcttct

SEQ ID NO: 4503846 - DNA, 17 bp, Homo sapiens
tatttctccatcccctc

SEQ ID NO: 4503847 - DNA, 18 bp, Homo sapiens
tatttctccatcccctcc

SEQ ID NO: 4503848 - DNA, 11 bp, Homo sapiens
tatttctcctt

SEQ ID NO: 4503849 - DNA, 15 bp, Homo sapiens
tatttctctggcaaa

SEQ ID NO: 4503850 - DNA, 13 bp, Homo sapiens
tatttctgatcta

SEQ ID NO: 4503851 - DNA, 12 bp, Homo sapiens
tatttctgattt

SEQ ID NO: 4503852 - DNA, 13 bp, Homo sapiens
tatttctgctctg

SEQ ID NO: 4503853 - DNA, 20 bp, Homo sapiens
tatttctgtttcctatttaa

SEQ ID NO: 4503854 - DNA, 23 bp, Homo sapiens
tatttcttaacctttgctatgta

SEQ ID NO: 4503855 - DNA, 12 bp, Homo sapiens
tatttcttccct

SEQ ID NO: 4503856 - DNA, 14 bp, Homo sapiens
tatttcttccctgc

SEQ ID NO: 4503857 - DNA, 22 bp, Homo sapiens
tatttcttcctaccaagtcaaa

SEQ ID NO: 4503858 - DNA, 21 bp, Homo sapiens
tatttctttcctttaaaaata

SEQ ID NO: 4503859 - DNA, 16 bp, Homo sapiens
tatttcttttgttgta

SEQ ID NO: 4503860 - DNA, 12 bp, Homo sapiens
tatttcttttta

SEQ ID NO: 4503861 - DNA, 14 bp, Homo sapiens
tatttgaaaattac

SEQ ID NO: 4503862 - DNA, 14 bp, Homo sapiens
tatttgaaatagta

SEQ ID NO: 4503863 - DNA, 15 bp, Homo sapiens
tatttgaataaatta

SEQ ID NO: 4503864 - DNA, 17 bp, Homo sapiens
tatttgaggagtgttaa

SEQ ID NO: 4503865 - DNA, 17 bp, Homo sapiens
tatttgattatgtatgg

SEQ ID NO: 4503866 - DNA, 19 bp, Homo sapiens
tatttgcagtatgaactat

SEQ ID NO: 4503867 - DNA, 21 bp, Homo sapiens
tatttgcataacaattcctct

SEQ ID NO: 4503868 - DNA, 14 bp, Homo sapiens
tatttgctaatttt

SEQ ID NO: 4503869 - DNA, 16 bp, Homo sapiens
tatttggaaataaagt

SEQ ID NO: 4503870 - DNA, 19 bp, Homo sapiens
tatttggaaataaagtcag

SEQ ID NO: 4503871 - DNA, 23 bp, Homo sapiens
tatttgtaaggcttgttccaatg

SEQ ID NO: 4503872 - DNA, 20 bp, Homo sapiens
tatttgtaatagatgtttga

SEQ ID NO: 4503873 - DNA, 13 bp, Homo sapiens
tatttgtaattaa

SEQ ID NO: 4503874 - DNA, 15 bp, Homo sapiens
tatttgtaattaaaa

SEQ ID NO: 4503875 - DNA, 14 bp, Homo sapiens
tatttgtacaattt

SEQ ID NO: 4503876 - DNA, 20 bp, Homo sapiens
tatttgtacaattttaaagt

SEQ ID NO: 4503877 - DNA, 22 bp, Homo sapiens
tatttgtataaaagtgtgaaat

SEQ ID NO: 4503878 - DNA, 18 bp, Homo sapiens
tatttgtatgtttttctg

SEQ ID NO: 4503879 - DNA, 16 bp, Homo sapiens
tatttgtattctctgc

SEQ ID NO: 4503880 - DNA, 18 bp, Homo sapiens
tatttgtattctctgcaa

SEQ ID NO: 4503881 - DNA, 13 bp, Homo sapiens
tatttgtcttaaa

SEQ ID NO: 4503882 - DNA, 18 bp, Homo sapiens
tatttgtgctatagtatt

SEQ ID NO: 4503883 - DNA, 21 bp, Homo sapiens
tatttgtgctatagtatttga

SEQ ID NO: 4503884 - DNA, 22 bp, Homo sapiens
tatttgttatatataataaata

SEQ ID NO: 4503885 - DNA, 18 bp, Homo sapiens
tatttgttctttttctga

SEQ ID NO: 4503886 - DNA, 14 bp, Homo sapiens
tattttaaaatata

SEQ ID NO: 4503887 - DNA, 15 bp, Homo sapiens
tattttaaaatatat

SEQ ID NO: 4503888 - DNA, 19 bp, Homo sapiens
tattttaaaatctcctaaa

SEQ ID NO: 4503889 - DNA, 13 bp, Homo sapiens
tattttaaaattt

SEQ ID NO: 4503890 - DNA, 15 bp, Homo sapiens
tattttaaaatttca

SEQ ID NO: 4503891 - DNA, 14 bp, Homo sapiens
tattttaaactact

SEQ ID NO: 4503892 - DNA, 21 bp, Homo sapiens
tattttaaactactgattgaa

SEQ ID NO: 4503893 - DNA, 15 bp, Homo sapiens
tattttaaatatact

SEQ ID NO: 4503894 - DNA, 21 bp, Homo sapiens
tattttaaattataaggactg

SEQ ID NO: 4503895 - DNA, 17 bp, Homo sapiens
tattttaagacgtgaat

SEQ ID NO: 4503896 - DNA, 23 bp, Homo sapiens
tattttacaattttttatcatgc

SEQ ID NO: 4503897 - DNA, 20 bp, Homo sapiens
tattttacttttctgccaaa

SEQ ID NO: 4503898 - DNA, 17 bp, Homo sapiens
tattttagaaagctaaa

SEQ ID NO: 4503899 - DNA, 13 bp, Homo sapiens
tattttagcagtt

SEQ ID NO: 4503900 - DNA, 19 bp, Homo sapiens
tattttagggttctaaatg

SEQ ID NO: 4503901 - DNA, 15 bp, Homo sapiens
tattttagtgtgtaa

SEQ ID NO: 4503902 - DNA, 22 bp, Homo sapiens
tattttataggggatacttgaa

SEQ ID NO: 4503903 - DNA, 13 bp, Homo sapiens
tattttatataaa

SEQ ID NO: 4503904 - DNA, 18 bp, Homo sapiens
tattttatatcatacagt

SEQ ID NO: 4503905 - DNA, 23 bp, Homo sapiens
tattttatctttgattctccttc

SEQ ID NO: 4503906 - DNA, 14 bp, Homo sapiens
tattttatgaacat

SEQ ID NO: 4503907 - DNA, 13 bp, Homo sapiens
tattttatgttta

SEQ ID NO: 4503908 - DNA, 15 bp, Homo sapiens
tattttattgaatac

SEQ ID NO: 4503909 - DNA, 19 bp, Homo sapiens
tattttattgaatactgtc

SEQ ID NO: 4503910 - DNA, 17 bp, Homo sapiens
tattttatttagacaag

SEQ ID NO: 4503911 - DNA, 20 bp, Homo sapiens
tattttatttagacaagaga

SEQ ID NO: 4503912 - DNA, 15 bp, Homo sapiens
tattttatttcaatg

SEQ ID NO: 4503913 - DNA, 22 bp, Homo sapiens
tattctgggcaccacaaaatat

SEQ ID NO: 4503914 - DNA, 12 bp, Homo sapiens
tattctgttgct

SEQ ID NO: 4503915 - DNA, 13 bp, Homo sapiens
tattcttaaaatg

SEQ ID NO: 4503916 - DNA, 22 bp, Homo sapiens
tattcttaacttattacctcag

SEQ ID NO: 4503917 - DNA, 13 bp, Homo sapiens
tattcttctcttc

SEQ ID NO: 4503918 - DNA, 13 bp, Homo sapiens
tattcttcttgaa

SEQ ID NO: 4503919 - DNA, 13 bp, Homo sapiens
tattcttctttct

SEQ ID NO: 4503920 - DNA, 20 bp, Homo sapiens
tattcttttcaaatatttgt

SEQ ID NO: 4503921 - DNA, 14 bp, Homo sapiens
tattgaaaattgaa

SEQ ID NO: 4503922 - DNA, 16 bp, Homo sapiens
tattgaaatgatttca

SEQ ID NO: 4503923 - DNA, 13 bp, Homo sapiens
tattgaaattcta

SEQ ID NO: 4503924 - DNA, 19 bp, Homo sapiens
tattgaagttgtttatcaa

SEQ ID NO: 4503925 - DNA, 14 bp, Homo sapiens
tattgaatactgtc

SEQ ID NO: 4503926 - DNA, 21 bp, Homo sapiens
tattgaatcagaatgccttca

SEQ ID NO: 4503927 - DNA, 21 bp, Homo sapiens
tattgaatgtgaaacatccgt

SEQ ID NO: 4503928 - DNA, 20 bp, Homo sapiens
tattgacaataaaatattat

SEQ ID NO: 4503929 - DNA, 18 bp, Homo sapiens
tattgacacagaaaatgt

SEQ ID NO: 4503930 - DNA, 12 bp, Homo sapiens
tattgacactga

SEQ ID NO: 4503931 - DNA, 16 bp, Homo sapiens
tattgacactgaactt

SEQ ID NO: 4503932 - DNA, 19 bp, Homo sapiens
tattgacactgaacttaat

SEQ ID NO: 4503933 - DNA, 17 bp, Homo sapiens
tattgactcaaaccata

SEQ ID NO: 4503934 - DNA, 15 bp, Homo sapiens
tattgacttttcaat

SEQ ID NO: 4503935 - DNA, 16 bp, Homo sapiens
tattgagattttccat

SEQ ID NO: 4503936 - DNA, 21 bp, Homo sapiens
tattgagcagaattcattcat

SEQ ID NO: 4503937 - DNA, 19 bp, Homo sapiens
tattgagtttgtaggtaaa

SEQ ID NO: 4503938 - DNA, 22 bp, Homo sapiens
tattgagtttgtaggtaaaatg

SEQ ID NO: 4503939 - DNA, 14 bp, Homo sapiens
tattgatatatatt

SEQ ID NO: 4503940 - DNA, 18 bp, Homo sapiens
tattgatatatattataa

SEQ ID NO: 4503941 - DNA, 20 bp, Homo sapiens
tattgatctttttatcatga

SEQ ID NO: 4503942 - DNA, 24 bp, Homo sapiens
tattgatgaggtttattctatctg

SEQ ID NO: 4503943 - DNA, 20 bp, Homo sapiens
tattgatgtacagtctgtca

SEQ ID NO: 4503944 - DNA, 22 bp, Homo sapiens
tattgatttgtcccagaatttt

SEQ ID NO: 4503945 - DNA, 14 bp, Homo sapiens
tattgcaaatgagg

SEQ ID NO: 4503946 - DNA, 22 bp, Homo sapiens
tattgcagaatgtgggtattga

SEQ ID NO: 4503947 - DNA, 20 bp, Homo sapiens
tattgcagtttatcattcaa

SEQ ID NO: 4503948 - DNA, 19 bp, Homo sapiens
tattgcatgcaatttgaag

SEQ ID NO: 4503949 - DNA, 22 bp, Homo sapiens
tattgccaggaaaggagagtac

SEQ ID NO: 4503950 - DNA, 20 bp, Homo sapiens
tattgcccatgatataactt

SEQ ID NO: 4503951 - DNA, 11 bp, Homo sapiens
tattgccttat

SEQ ID NO: 4503952 - DNA, 19 bp, Homo sapiens
tattgccttatttgtctgt

SEQ ID NO: 4503953 - DNA, 20 bp, Homo sapiens
tattgccttatttgtctgta

SEQ ID NO: 4503954 - DNA, 11 bp, Homo sapiens
tattgccttct

SEQ ID NO: 4503955 - DNA, 19 bp, Homo sapiens
tattgctaaaagcatgtat

SEQ ID NO: 4503956 - DNA, 19 bp, Homo sapiens
tattgctcgcccagacacc

SEQ ID NO: 4503957 - DNA, 20 bp, Homo sapiens
tattgctgaagaatctactt

SEQ ID NO: 4503958 - DNA, 18 bp, Homo sapiens
tattgcttagtaaaattt

SEQ ID NO: 4503959 - DNA, 19 bp, Homo sapiens
tattgcttagtaaaattta

SEQ ID NO: 4503960 - DNA, 16 bp, Homo sapiens
tattgcttcaatttca

SEQ ID NO: 4503961 - DNA, 18 bp, Homo sapiens
tattgcttcaatttcaaa

SEQ ID NO: 4503962 - DNA, 20 bp, Homo sapiens
tattgcttcaatttcaaact

SEQ ID NO: 4503963 - DNA, 13 bp, Homo sapiens
tattgcttcatgt

SEQ ID NO: 4503964 - DNA, 14 bp, Homo sapiens
tattgcttcatgtt

SEQ ID NO: 4503965 - DNA, 15 bp, Homo sapiens
tattggaaaaatcac

SEQ ID NO: 4503966 - DNA, 15 bp, Homo sapiens
tattggaacttgcga

SEQ ID NO: 4503967 - DNA, 14 bp, Homo sapiens
tattggaagctgct

SEQ ID NO: 4503968 - DNA, 14 bp, Homo sapiens
tattggagatttgc

SEQ ID NO: 4503969 - DNA, 21 bp, Homo sapiens
tattggatctattgatttgaa

SEQ ID NO: 4503970 - DNA, 20 bp, Homo sapiens
tattggattttcacagagga

SEQ ID NO: 4503971 - DNA, 20 bp, Homo sapiens
tattggcaaagtttaaatgt

SEQ ID NO: 4503972 - DNA, 13 bp, Homo sapiens
tattggtccagct

SEQ ID NO: 4503973 - DNA, 15 bp, Homo sapiens
tattggtttgcacaa

SEQ ID NO: 4503974 - DNA, 17 bp, Homo sapiens
tattggttttaaaaaag

SEQ ID NO: 4503975 - DNA, 12 bp, Homo sapiens
tattgtaaagaa

SEQ ID NO: 4503976 - DNA, 14 bp, Homo sapiens
tattgtaaatgtgg

SEQ ID NO: 4503977 - DNA, 13 bp, Homo sapiens
tattgtaaattat

SEQ ID NO: 4503978 - DNA, 11 bp, Homo sapiens
tattgtacagt

SEQ ID NO: 4503979 - DNA, 14 bp, Homo sapiens
tattgtacagtttt

SEQ ID NO: 4503980 - DNA, 22 bp, Homo sapiens
tattgtagtaaactattcttaa

SEQ ID NO: 4503981 - DNA, 12 bp, Homo sapiens
tattgtagtttg

SEQ ID NO: 4503982 - DNA, 14 bp, Homo sapiens
tattgtagtttgaa

SEQ ID NO: 4503983 - DNA, 16 bp, Homo sapiens
tattgtattgttagat

SEQ ID NO: 4503984 - DNA, 23 bp, Homo sapiens
tattgtcagccatcgtcctggga

SEQ ID NO: 4503985 - DNA, 18 bp, Homo sapiens
tattgtcatctttttcta

SEQ ID NO: 4503986 - DNA, 13 bp, Homo sapiens
tattgtctgtaaa

SEQ ID NO: 4503987 - DNA, 14 bp, Homo sapiens
tattgtctgtctac

SEQ ID NO: 4503988 - DNA, 20 bp, Homo sapiens
tattgtctgtctacatttct

SEQ ID NO: 4503989 - DNA, 20 bp, Homo sapiens
tattgtgaatatttggaatt

SEQ ID NO: 4503990 - DNA, 22 bp, Homo sapiens
tattgtgaatatttggaattga

SEQ ID NO: 4503991 - DNA, 15 bp, Homo sapiens
tattgtgacttcact

SEQ ID NO: 4503992 - DNA, 16 bp, Homo sapiens
tattgtgacttcactg

SEQ ID NO: 4503993 - DNA, 17 bp, Homo sapiens
tattgtgacttcactgt

SEQ ID NO: 4503994 - DNA, 17 bp, Homo sapiens
tattgtgcaatgtaaat

SEQ ID NO: 4503995 - DNA, 22 bp, Homo sapiens
tattgttagaaaatgacttatt

SEQ ID NO: 4503996 - DNA, 15 bp, Homo sapiens
tattgttctcacact

SEQ ID NO: 4503997 - DNA, 15 bp, Homo sapiens
tattgtttaaaatca

SEQ ID NO: 4503998 - DNA, 13 bp, Homo sapiens
tattgtttctgca

SEQ ID NO: 4503999 - DNA, 15 bp, Homo sapiens
tattgtttctgcatt

SEQ ID NO: 4504000 - DNA, 14 bp, Homo sapiens
tattgttttacaat

SEQ ID NO: 4504001 - DNA, 22 bp, Homo sapiens
tattgttttacaatagttctgt

SEQ ID NO: 4504002 - DNA, 13 bp, Homo sapiens
tatttaaaaaact

SEQ ID NO: 4504003 - DNA, 16 bp, Homo sapiens
tatttaaaaaactaaa

SEQ ID NO: 4504004 - DNA, 21 bp, Homo sapiens
tatttaaaaaactaaaaacta

SEQ ID NO: 4504005 - DNA, 14 bp, Homo sapiens
tatttaaaaaactg

SEQ ID NO: 4504006 - DNA, 19 bp, Homo sapiens
tatttaaaaaactgtataa

SEQ ID NO: 4504007 - DNA, 16 bp, Homo sapiens
tatttaaaaaattatg

SEQ ID NO: 4504008 - DNA, 18 bp, Homo sapiens
tatttaaaaaattatgga

SEQ ID NO: 4504009 - DNA, 22 bp, Homo sapiens
tatttaaaaaattatggaatat

SEQ ID NO: 4504010 - DNA, 14 bp, Homo sapiens
tatttaaaactctg

SEQ ID NO: 4504011 - DNA, 15 bp, Homo sapiens
tatttaaaactctgg

SEQ ID NO: 4504012 - DNA, 14 bp, Homo sapiens
tatttaaaatagca

SEQ ID NO: 4504013 - DNA, 23 bp, Homo sapiens
tatttaaaatagcaaaagaagaa

SEQ ID NO: 4504014 - DNA, 21 bp, Homo sapiens
tatttaaaatgctcaatttca

SEQ ID NO: 4504015 - DNA, 18 bp, Homo sapiens
tatttaaattacaatttt

SEQ ID NO: 4504016 - DNA, 14 bp, Homo sapiens
tatttaaattcttt

SEQ ID NO: 4504017 - DNA, 16 bp, Homo sapiens
tatttaaattcttttt

SEQ ID NO: 4504018 - DNA, 11 bp, Homo sapiens
tatttaacaag

SEQ ID NO: 4504019 - DNA, 12 bp, Homo sapiens
tatttaacagaa

SEQ ID NO: 4504020 - DNA, 23 bp, Homo sapiens
tatttaactctctttatgtctgt

SEQ ID NO: 4504021 - DNA, 22 bp, Homo sapiens
tatttaactggtgcactttgta

SEQ ID NO: 4504022 - DNA, 12 bp, Homo sapiens
tatttaagatgt

SEQ ID NO: 4504023 - DNA, 17 bp, Homo sapiens
tatttaagatgtacatt

SEQ ID NO: 4504024 - DNA, 14 bp, Homo sapiens
tatttaagcaaata

SEQ ID NO: 4504025 - DNA, 14 bp, Homo sapiens
tatttaatatcaaa

SEQ ID NO: 4504026 - DNA, 16 bp, Homo sapiens
tatttaatgttttaaa

SEQ ID NO: 4504027 - DNA, 18 bp, Homo sapiens
tatttaatgttttaaatg

SEQ ID NO: 4504028 - DNA, 21 bp, Homo sapiens
tatttaatgttttaaatgtac

SEQ ID NO: 4504029 - DNA, 22 bp, Homo sapiens
tatttaatgttttaaatgtaca

SEQ ID NO: 4504030 - DNA, 15 bp, Homo sapiens
tatttaattataaaa

SEQ ID NO: 4504031 - DNA, 16 bp, Homo sapiens
tatttaattataaaaa

SEQ ID NO: 4504032 - DNA, 16 bp, Homo sapiens
tatttaattatgaaaa

SEQ ID NO: 4504033 - DNA, 17 bp, Homo sapiens
tatttaattgtaaactg

SEQ ID NO: 4504034 - DNA, 22 bp, Homo sapiens
tattttcaaatgtaaactctct

SEQ ID NO: 4504035 - DNA, 12 bp, Homo sapiens
tattttcaagtt

SEQ ID NO: 4504036 - DNA, 23 bp, Homo sapiens
tattttcagaatctgaatgtaat

SEQ ID NO: 4504037 - DNA, 18 bp, Homo sapiens
tattttcattctgccaaa

SEQ ID NO: 4504038 - DNA, 11 bp, Homo sapiens
tattttccagg

SEQ ID NO: 4504039 - DNA, 22 bp, Homo sapiens
tattttccataaatttggactg

SEQ ID NO: 4504040 - DNA, 16 bp, Homo sapiens
tattttcctaatgtga

SEQ ID NO: 4504041 - DNA, 19 bp, Homo sapiens
tattttctattttaagact

SEQ ID NO: 4504042 - DNA, 14 bp, Homo sapiens
tattttctgcaatc

SEQ ID NO: 4504043 - DNA, 15 bp, Homo sapiens
tattttgaatcaata

SEQ ID NO: 4504044 - DNA, 16 bp, Homo sapiens
tattttgaatcaataa

SEQ ID NO: 4504045 - DNA, 22 bp, Homo sapiens
tattttgaatcaataatatatt

SEQ ID NO: 4504046 - DNA, 17 bp, Homo sapiens
tattttgacataaagtt

SEQ ID NO: 4504047 - DNA, 21 bp, Homo sapiens
tattttgagaaactgctgcag

SEQ ID NO: 4504048 - DNA, 19 bp, Homo sapiens
tattttgataataatattg

SEQ ID NO: 4504049 - DNA, 15 bp, Homo sapiens
tattttgatgcagca

SEQ ID NO: 4504050 - DNA, 16 bp, Homo sapiens
tattttgccatttagc

SEQ ID NO: 4504051 - DNA, 21 bp, Homo sapiens
tattttgctgcttgatgatga

SEQ ID NO: 4504052 - DNA, 23 bp, Homo sapiens
tattttggattgtatattgtgtt

SEQ ID NO: 4504053 - DNA, 20 bp, Homo sapiens
tattttgtaatattctgttt

SEQ ID NO: 4504054 - DNA, 17 bp, Homo sapiens
tattttgtacatttttc

SEQ ID NO: 4504055 - DNA, 15 bp, Homo sapiens
tattttgtactttgt

SEQ ID NO: 4504056 - DNA, 22 bp, Homo sapiens
tattttgtctaggagatgcttt

SEQ ID NO: 4504057 - DNA, 16 bp, Homo sapiens
tatttttacatttaaa

SEQ ID NO: 4504058 - DNA, 18 bp, Homo sapiens
tatttttacctgcttttt

SEQ ID NO: 4504059 - DNA, 23 bp, Homo sapiens
tatttttagatggttacactgtt

SEQ ID NO: 4504060 - DNA, 20 bp, Homo sapiens
tatttttatacaagtaattt

SEQ ID NO: 4504061 - DNA, 23 bp, Homo sapiens
tatttttatacaagtaatttcct

SEQ ID NO: 4504062 - DNA, 19 bp, Homo sapiens
tatttttatataatatcta

SEQ ID NO: 4504063 - DNA, 12 bp, Homo sapiens
tatttttatcta

SEQ ID NO: 4504064 - DNA, 18 bp, Homo sapiens
tatttttatctatataaa

SEQ ID NO: 4504065 - DNA, 12 bp, Homo sapiens
tatttttattat

SEQ ID NO: 4504066 - DNA, 13 bp, Homo sapiens
tatttttcctgtc

SEQ ID NO: 4504067 - DNA, 15 bp, Homo sapiens
tatttttcctgtcct

SEQ ID NO: 4504068 - DNA, 15 bp, Homo sapiens
tatttttctctcctg

SEQ ID NO: 4504069 - DNA, 14 bp, Homo sapiens
tatttttctgttac

SEQ ID NO: 4504070 - DNA, 15 bp, Homo sapiens
tatttttctgttacc

SEQ ID NO: 4504071 - DNA, 20 bp, Homo sapiens
tatttttcttttaaagattt

SEQ ID NO: 4504072 - DNA, 13 bp, Homo sapiens
tatttttgacaga

SEQ ID NO: 4504073 - DNA, 11 bp, Homo sapiens
tatttttgtac

SEQ ID NO: 4504074 - DNA, 14 bp, Homo sapiens
tatttttgtacgtt

SEQ ID NO: 4504075 - DNA, 16 bp, Homo sapiens
tatttttgtacgttat

SEQ ID NO: 4504076 - DNA, 13 bp, Homo sapiens
tatttttgttgtt

SEQ ID NO: 4504077 - DNA, 18 bp, Homo sapiens
tattttttaaaaagtgtt

SEQ ID NO: 4504078 - DNA, 12 bp, Homo sapiens
tattttttatga

SEQ ID NO: 4504079 - DNA, 23 bp, Homo sapiens
tattttttatgatggagcaactg

SEQ ID NO: 4504080 - DNA, 17 bp, Homo sapiens
tattttttgtataattg

SEQ ID NO: 4504081 - DNA, 18 bp, Homo sapiens
tatttttttaaaatcact

SEQ ID NO: 4504082 - DNA, 19 bp, Homo sapiens
tatttttttaaaatcacta

SEQ ID NO: 4504083 - DNA, 23 bp, Homo sapiens
tatttttttaaaatcactaacat

SEQ ID NO: 4504084 - DNA, 16 bp, Homo sapiens
tatttttttaaatcaa

SEQ ID NO: 4504085 - DNA, 15 bp, Homo sapiens
tatttttttaacttt

SEQ ID NO: 4504086 - DNA, 17 bp, Homo sapiens
tatttttttaactttac

SEQ ID NO: 4504087 - DNA, 20 bp, Homo sapiens
tatttttttaactttaccat

SEQ ID NO: 4504088 - DNA, 22 bp, Homo sapiens
tatttttttcctaagacatttt

SEQ ID NO: 4504089 - DNA, 16 bp, Homo sapiens
tcaaaaaaaaaaaaga

SEQ ID NO: 4504090 - DNA, 15 bp, Homo sapiens
tcaaaaaaaaaaaga

SEQ ID NO: 4504091 - DNA, 21 bp, Homo sapiens
tcaaaaaaaagaaaatgtctt

SEQ ID NO: 4504092 - DNA, 13 bp, Homo sapiens
tcaaaaaatgagc

SEQ ID NO: 4504093 - DNA, 16 bp, Homo sapiens
tcaaaaacaaagctga

SEQ ID NO: 4504094 - DNA, 17 bp, Homo sapiens
tcaaaaacaaagctgat

SEQ ID NO: 4504095 - DNA, 16 bp, Homo sapiens
tcaaaaacaggcaggt

SEQ ID NO: 4504096 - DNA, 17 bp, Homo sapiens
tcaaaaagaaatcaata

SEQ ID NO: 4504097 - DNA, 19 bp, Homo sapiens
tcaaaaataaaaaatctga

SEQ ID NO: 4504098 - DNA, 20 bp, Homo sapiens
tcaaaaatgccacttaacag

SEQ ID NO: 4504099 - DNA, 20 bp, Homo sapiens
tcaaaacacttccagtctgg

SEQ ID NO: 4504100 - DNA, 19 bp, Homo sapiens
tcaaaacctgattggccac

SEQ ID NO: 4504101 - DNA, 15 bp, Homo sapiens
tcaaaaccttttgaa

SEQ ID NO: 4504102 - DNA, 16 bp, Homo sapiens
tcaaaactacaaatca

SEQ ID NO: 4504103 - DNA, 23 bp, Homo sapiens
tcaaaacttggacccttggaaaa

SEQ ID NO: 4504104 - DNA, 18 bp, Homo sapiens
tcaaaactttaaacctgt

SEQ ID NO: 4504105 - DNA, 21 bp, Homo sapiens
tcaaaagaaaattgatatttt

SEQ ID NO: 4504106 - DNA, 20 bp, Homo sapiens
tcaaaagagaaaaacaaaac

SEQ ID NO: 4504107 - DNA, 12 bp, Homo sapiens
tcaaaagcaaac

SEQ ID NO: 4504108 - DNA, 17 bp, Homo sapiens
tcaaaagctatttaaag

SEQ ID NO: 4504109 - DNA, 13 bp, Homo sapiens
tcaaaataaaaag

SEQ ID NO: 4504110 - DNA, 18 bp, Homo sapiens
tcaaaataaaaattaaat

SEQ ID NO: 4504111 - DNA, 14 bp, Homo sapiens
tcaaaatacttctt

SEQ ID NO: 4504112 - DNA, 19 bp, Homo sapiens
tcaaaatacttctttttca

SEQ ID NO: 4504113 - DNA, 15 bp, Homo sapiens
tcaaaatagaaaagt

SEQ ID NO: 4504114 - DNA, 13 bp, Homo sapiens
tcaaaatattgag

SEQ ID NO: 4504115 - DNA, 22 bp, Homo sapiens
tcaaaatatttaaaaatgtctt

SEQ ID NO: 4504116 - DNA, 21 bp, Homo sapiens
tcaaaatctgtgacctgtcag

SEQ ID NO: 4504117 - DNA, 12 bp, Homo sapiens
tcaaaatctttc

SEQ ID NO: 4504118 - DNA, 18 bp, Homo sapiens
tcaaaatgatagacatat

SEQ ID NO: 4504119 - DNA, 12 bp, Homo sapiens
tcaaaatttaaa

SEQ ID NO: 4504120 - DNA, 13 bp, Homo sapiens
tcaaaatttgctg

SEQ ID NO: 4504121 - DNA, 23 bp, Homo sapiens
tcaaaatttgctgccaaatgcgt

SEQ ID NO: 4504122 - DNA, 17 bp, Homo sapiens
tcaaacaacactggtgt

SEQ ID NO: 4504123 - DNA, 13 bp, Homo sapiens
tcaaacattttct

SEQ ID NO: 4504124 - DNA, 13 bp, Homo sapiens
tcaaacccaggct

SEQ ID NO: 4504125 - DNA, 16 bp, Homo sapiens
tcaaactaaattcaaa

SEQ ID NO: 4504126 - DNA, 23 bp, Homo sapiens
tcaaactaaattcaaagaagtac

SEQ ID NO: 4504127 - DNA, 13 bp, Homo sapiens
tcaaactcattgc

SEQ ID NO: 4504128 - DNA, 14 bp, Homo sapiens
tcaaactgtagaaa

SEQ ID NO: 4504129 - DNA, 12 bp, Homo sapiens
tcaaacttggat

SEQ ID NO: 4504130 - DNA, 16 bp, Homo sapiens
tcaaacttttgaaaga

SEQ ID NO: 4504131 - DNA, 17 bp, Homo sapiens
tcaaacttttgaaagat

SEQ ID NO: 4504132 - DNA, 18 bp, Homo sapiens
tcaaacttttgaaagatg

SEQ ID NO: 4504133 - DNA, 22 bp, Homo sapiens
tcaaacttttgaaagatgtatg

SEQ ID NO: 4504134 - DNA, 15 bp, Homo sapiens
tcaaagactcaaatt

SEQ ID NO: 4504135 - DNA, 16 bp, Homo sapiens
tcaaagactcaaattt

SEQ ID NO: 4504136 - DNA, 15 bp, Homo sapiens
tcaaagatgccccat

SEQ ID NO: 4504137 - DNA, 21 bp, Homo sapiens
tcaaagatgccccattccttg

SEQ ID NO: 4504138 - DNA, 14 bp, Homo sapiens
tcaaagatttttat

SEQ ID NO: 4504139 - DNA, 12 bp, Homo sapiens
tcaaagccagcg

SEQ ID NO: 4504140 - DNA, 22 bp, Homo sapiens
tcaaagctaaaatatataatat

SEQ ID NO: 4504141 - DNA, 12 bp, Homo sapiens
tcaaaggaagac

SEQ ID NO: 4504142 - DNA, 20 bp, Homo sapiens
tcaaaggagcgagcatgtcg

SEQ ID NO: 4504143 - DNA, 17 bp, Homo sapiens
tcaaagtctcatagctt

SEQ ID NO: 4504144 - DNA, 21 bp, Homo sapiens
tcaaagtctcatagctttgga

SEQ ID NO: 4504145 - DNA, 15 bp, Homo sapiens
tcaaataaaaattct

SEQ ID NO: 4504146 - DNA, 13 bp, Homo sapiens
tcaaataaacact

SEQ ID NO: 4504147 - DNA, 14 bp, Homo sapiens
tcaaataaacactg

SEQ ID NO: 4504148 - DNA, 17 bp, Homo sapiens
tcaaataatgcttttct

SEQ ID NO: 4504149 - DNA, 19 bp, Homo sapiens
tcaaataatgcttttctaa

SEQ ID NO: 4504150 - DNA, 21 bp, Homo sapiens
tcaaataatgcttttctaatt

SEQ ID NO: 4504151 - DNA, 19 bp, Homo sapiens
tcaaatacatgcacagtca

SEQ ID NO: 4504152 - DNA, 23 bp, Homo sapiens
tcaaatacatgcacagtcataca

SEQ ID NO: 4504153 - DNA, 18 bp, Homo sapiens
tcaaatatagagatattt

SEQ ID NO: 4504154 - DNA, 16 bp, Homo sapiens
tcaaatatctaagcaa

SEQ ID NO: 4504155 - DNA, 18 bp, Homo sapiens
tcaaatatctctatttaa

SEQ ID NO: 4504156 - DNA, 17 bp, Homo sapiens
tcaaatcaaaaacaggc

SEQ ID NO: 4504157 - DNA, 13 bp, Homo sapiens
tcaaatcaacttt

SEQ ID NO: 4504158 - DNA, 16 bp, Homo sapiens
tcaaatcagtgataat

SEQ ID NO: 4504159 - DNA, 15 bp, Homo sapiens
tcaaatccaaaatgg

SEQ ID NO: 4504160 - DNA, 17 bp, Homo sapiens
tcaaatccaaaatggtt

SEQ ID NO: 4504161 - DNA, 15 bp, Homo sapiens
tcaaatcgatttagt

SEQ ID NO: 4504162 - DNA, 13 bp, Homo sapiens
tcaaatgaaatgt

SEQ ID NO: 4504163 - DNA, 19 bp, Homo sapiens
tcaaatgaataatgccttt

SEQ ID NO: 4504164 - DNA, 15 bp, Homo sapiens
tcaaatgaatgatta

SEQ ID NO: 4504165 - DNA, 22 bp, Homo sapiens
tcaaatgaatgattaaattatg

SEQ ID NO: 4504166 - DNA, 20 bp, Homo sapiens
tcaaatggactgttacagac

SEQ ID NO: 4504167 - DNA, 20 bp, Homo sapiens
tcaaatggtaggcatttcct

SEQ ID NO: 4504168 - DNA, 21 bp, Homo sapiens
tcaaatggtaggcatttccta

SEQ ID NO: 4504169 - DNA, 21 bp, Homo sapiens
tcaaatgtgcaatttgtaaat

SEQ ID NO: 4504170 - DNA, 19 bp, Homo sapiens
tcaaatgttagatattgct

SEQ ID NO: 4504171 - DNA, 16 bp, Homo sapiens
tcaaattcagctctga

SEQ ID NO: 4504172 - DNA, 14 bp, Homo sapiens
tcaaattgctgctt

SEQ ID NO: 4504173 - DNA, 22 bp, Homo sapiens
tcaaatttagaaactaattgac

SEQ ID NO: 4504174 - DNA, 19 bp, Homo sapiens
tcaacaaagtgctttttca

SEQ ID NO: 4504175 - DNA, 15 bp, Homo sapiens
tcaacaagaagaaac

SEQ ID NO: 4504176 - DNA, 15 bp, Homo sapiens
tcaacaagaagaatt

SEQ ID NO: 4504177 - DNA, 20 bp, Homo sapiens
tcaacaagatttccttgtgc

SEQ ID NO: 4504178 - DNA, 14 bp, Homo sapiens
tcaacaattctaaa

SEQ ID NO: 4504179 - DNA, 17 bp, Homo sapiens
tcaacaattctaaaatg

SEQ ID NO: 4504180 - DNA, 16 bp, Homo sapiens
tcaacaattggtgtca

SEQ ID NO: 4504181 - DNA, 19 bp, Homo sapiens
tcaacacaggtagcacaga

SEQ ID NO: 4504182 - DNA, 14 bp, Homo sapiens
tcaacacattttta

SEQ ID NO: 4504183 - DNA, 12 bp, Homo sapiens
tcaacagagaag

SEQ ID NO: 4504184 - DNA, 22 bp, Homo sapiens
tcaacagagaaggcaggaatgt

SEQ ID NO: 4504185 - DNA, 22 bp, Homo sapiens
tcaacagcgttcctagagaaga

SEQ ID NO: 4504186 - DNA, 13 bp, Homo sapiens
tcaacaggagggc

SEQ ID NO: 4504187 - DNA, 14 bp, Homo sapiens
tcaacagtaaacca

SEQ ID NO: 4504188 - DNA, 20 bp, Homo sapiens
tcaacagtaaaccactgaaa

SEQ ID NO: 4504189 - DNA, 14 bp, Homo sapiens
tcaacatttccaaa

SEQ ID NO: 4504190 - DNA, 15 bp, Homo sapiens
tcaacatttccaaaa

SEQ ID NO: 4504191 - DNA, 17 bp, Homo sapiens
tcaacatttctcatgtt

SEQ ID NO: 4504192 - DNA, 22 bp, Homo sapiens
tcaaccaggtccagatgtgcta

SEQ ID NO: 4504193 - DNA, 16 bp, Homo sapiens
tcaaccatcgctttat

SEQ ID NO: 4504194 - DNA, 15 bp, Homo sapiens
tcaacccccctccca

SEQ ID NO: 4504195 - DNA, 17 bp, Homo sapiens
tcaacccccctcccaga

SEQ ID NO: 4504196 - DNA, 21 bp, Homo sapiens
tcaacccccctcccagacagg

SEQ ID NO: 4504197 - DNA, 22 bp, Homo sapiens
tcaaccgcacatgtgccactgt

SEQ ID NO: 4504198 - DNA, 16 bp, Homo sapiens
tcaacctgtaaattat

SEQ ID NO: 4504199 - DNA, 19 bp, Homo sapiens
tcaaccttccaacttcctg

SEQ ID NO: 4504200 - DNA, 21 bp, Homo sapiens
tcaacggggggctcctgccca

SEQ ID NO: 4504201 - DNA, 11 bp, Homo sapiens
tcaactcccaa

SEQ ID NO: 4504202 - DNA, 14 bp, Homo sapiens
tcaactctacccct

SEQ ID NO: 4504203 - DNA, 16 bp, Homo sapiens
tcaactctacccctgc

SEQ ID NO: 4504204 - DNA, 23 bp, Homo sapiens
tcaactctacccctgctcccatt

SEQ ID NO: 4504205 - DNA, 22 bp, Homo sapiens
tcaactctttgttatttgaaaa

SEQ ID NO: 4504206 - DNA, 18 bp, Homo sapiens
tcaactgcctactccaaa

SEQ ID NO: 4504207 - DNA, 20 bp, Homo sapiens
tcaactgcctactccaaaat

SEQ ID NO: 4504208 - DNA, 20 bp, Homo sapiens
tcaactttcctcaaatcaaa

SEQ ID NO: 4504209 - DNA, 15 bp, Homo sapiens
tcaactttgaataaa

SEQ ID NO: 4504210 - DNA, 13 bp, Homo sapiens
tcaacttttatgc

SEQ ID NO: 4504211 - DNA, 16 bp, Homo sapiens
tcaactttttattgcc

SEQ ID NO: 4504212 - DNA, 18 bp, Homo sapiens
tcaactttttattgcctt

SEQ ID NO: 4504213 - DNA, 20 bp, Homo sapiens
tcaactttttattgccttct

SEQ ID NO: 4504214 - DNA, 13 bp, Homo sapiens
tcaagaaaggaaa

SEQ ID NO: 4504215 - DNA, 13 bp, Homo sapiens
tcaagaagacact

SEQ ID NO: 4504216 - DNA, 21 bp, Homo sapiens
tcaagaagtatttttttaatt

SEQ ID NO: 4504217 - DNA, 12 bp, Homo sapiens
tcaagaatcaga

SEQ ID NO: 4504218 - DNA, 16 bp, Homo sapiens
tcaagaatcagaagaa

SEQ ID NO: 4504219 - DNA, 18 bp, Homo sapiens
tcaagacagatgagcagg

SEQ ID NO: 4504220 - DNA, 21 bp, Homo sapiens
tcaagacagatgagcaggagc

SEQ ID NO: 4504221 - DNA, 22 bp, Homo sapiens
tcaagacagatgagcaggagct

SEQ ID NO: 4504222 - DNA, 20 bp, Homo sapiens
tcaagaccagcctgggcaac

SEQ ID NO: 4504223 - DNA, 18 bp, Homo sapiens
tcaagaccagcctgtcca

SEQ ID NO: 4504224 - DNA, 22 bp, Homo sapiens
tcaagacccccatttgtcccag

SEQ ID NO: 4504225 - DNA, 15 bp, Homo sapiens
tcaagagaaacttca

SEQ ID NO: 4504226 - DNA, 17 bp, Homo sapiens
tcaagagctgccctcct

SEQ ID NO: 4504227 - DNA, 19 bp, Homo sapiens
tcaagaggtgggagggccc

SEQ ID NO: 4504228 - DNA, 23 bp, Homo sapiens
tcaagagtgagatgtagaaagtt

SEQ ID NO: 4504229 - DNA, 16 bp, Homo sapiens
tcaagagttaaactta

SEQ ID NO: 4504230 - DNA, 20 bp, Homo sapiens
tcaagatatatgtgtataca

SEQ ID NO: 4504231 - DNA, 13 bp, Homo sapiens
tcaagatatggaa

SEQ ID NO: 4504232 - DNA, 19 bp, Homo sapiens
tcaagatctaaatcatata

SEQ ID NO: 4504233 - DNA, 18 bp, Homo sapiens
tcaagatttttttcctga

SEQ ID NO: 4504234 - DNA, 21 bp, Homo sapiens
tcaagattttttttgtaactt

SEQ ID NO: 4504235 - DNA, 15 bp, Homo sapiens
tcaagcaatcctcct

SEQ ID NO: 4504236 - DNA, 17 bp, Homo sapiens
tcaagcaatcctcctgc

SEQ ID NO: 4504237 - DNA, 17 bp, Homo sapiens
tcaagcacactggaata

SEQ ID NO: 4504238 - DNA, 14 bp, Homo sapiens
tcaagcacttccca

SEQ ID NO: 4504239 - DNA, 14 bp, Homo sapiens
tcaagcatgaagat

SEQ ID NO: 4504240 - DNA, 16 bp, Homo sapiens
tcaagcatgaagataa

SEQ ID NO: 4504241 - DNA, 18 bp, Homo sapiens
tcaagccccatttcctca

SEQ ID NO: 4504242 - DNA, 21 bp, Homo sapiens
tcaagccctcctccccagagc

SEQ ID NO: 4504243 - DNA, 18 bp, Homo sapiens
tcaagcctgtgcaaaaaa

SEQ ID NO: 4504244 - DNA, 16 bp, Homo sapiens
tcaagctagccagagg

SEQ ID NO: 4504245 - DNA, 20 bp, Homo sapiens
tcaagctgttatttcttccc

SEQ ID NO: 4504246 - DNA, 22 bp, Homo sapiens
tcaagcttttgcttgatccaga

SEQ ID NO: 4504247 - DNA, 17 bp, Homo sapiens
tcaaggacaggagcctg

SEQ ID NO: 4504248 - DNA, 19 bp, Homo sapiens
tcaaggataccttcttatt

SEQ ID NO: 4504249 - DNA, 12 bp, Homo sapiens
tcaaggctcaga

SEQ ID NO: 4504250 - DNA, 17 bp, Homo sapiens
tcaaggctcagaaggaa

SEQ ID NO: 4504251 - DNA, 16 bp, Homo sapiens
tcaaggctttaaaagt

SEQ ID NO: 4504252 - DNA, 15 bp, Homo sapiens
tcaagggttttccag

SEQ ID NO: 4504253 - DNA, 16 bp, Homo sapiens
tcaagggttttccagg

SEQ ID NO: 4504254 - DNA, 21 bp, Homo sapiens
tcaaggtcacttaaagggtct

SEQ ID NO: 4504255 - DNA, 15 bp, Homo sapiens
tcaaggtcagaacag

SEQ ID NO: 4504256 - DNA, 22 bp, Homo sapiens
tcaaggtttaaccttaaaatta

SEQ ID NO: 4504257 - DNA, 14 bp, Homo sapiens
tcaagtccatctga

SEQ ID NO: 4504258 - DNA, 18 bp, Homo sapiens
tcaagtgcctagactgtt

SEQ ID NO: 4504259 - DNA, 21 bp, Homo sapiens
tcaagtgcctagactgttact

SEQ ID NO: 4504260 - DNA, 18 bp, Homo sapiens
tcaagtggtattttccag

SEQ ID NO: 4504261 - DNA, 20 bp, Homo sapiens
tcaagtgttaggtcaataac

SEQ ID NO: 4504262 - DNA, 21 bp, Homo sapiens
tcaagttgattagaaagacca

SEQ ID NO: 4504263 - DNA, 14 bp, Homo sapiens
tcaagttgtacatt

SEQ ID NO: 4504264 - DNA, 19 bp, Homo sapiens
tcaagttgttgactgtgat

SEQ ID NO: 4504265 - DNA, 23 bp, Homo sapiens
tcaagttgttgactgtgattaga

SEQ ID NO: 4504266 - DNA, 21 bp, Homo sapiens
tcaagtttttatagttattaa

SEQ ID NO: 4504267 - DNA, 12 bp, Homo sapiens
tcaagtttttca

SEQ ID NO: 4504268 - DNA, 20 bp, Homo sapiens
tcaagtttttcatactgtac

SEQ ID NO: 4504269 - DNA, 21 bp, Homo sapiens
tcaagtttttcatactgtaca

SEQ ID NO: 4504270 - DNA, 21 bp, Homo sapiens
tcaagttttttatactgcact

SEQ ID NO: 4504271 - DNA, 13 bp, Homo sapiens
tcaataaaattct

SEQ ID NO: 4504272 - DNA, 14 bp, Homo sapiens
tcaataaaattctg

SEQ ID NO: 4504273 - DNA, 18 bp, Homo sapiens
tcaataaaattctgtaat

SEQ ID NO: 4504274 - DNA, 20 bp, Homo sapiens
tcaataaaattctgtaattt

SEQ ID NO: 4504275 - DNA, 13 bp, Homo sapiens
tcaataaacagtc

SEQ ID NO: 4504276 - DNA, 15 bp, Homo sapiens
tcaataaacagtcac

SEQ ID NO: 4504277 - DNA, 21 bp, Homo sapiens
tcaataaaccacaagcatctc

SEQ ID NO: 4504278 - DNA, 18 bp, Homo sapiens
tcaataacactgtatttt

SEQ ID NO: 4504279 - DNA, 21 bp, Homo sapiens
tcaataacagatggtgctgct

SEQ ID NO: 4504280 - DNA, 15 bp, Homo sapiens
tcaataatatatttt

SEQ ID NO: 4504281 - DNA, 14 bp, Homo sapiens
tcaatacactagtt

SEQ ID NO: 4504282 - DNA, 18 bp, Homo sapiens
tcaatacactagttgttt

SEQ ID NO: 4504283 - DNA, 17 bp, Homo sapiens
tcaatagcgtgtgtaga

SEQ ID NO: 4504284 - DNA, 13 bp, Homo sapiens
tcaatagtgtcct

SEQ ID NO: 4504285 - DNA, 13 bp, Homo sapiens
tcaatagttgaat

SEQ ID NO: 4504286 - DNA, 15 bp, Homo sapiens
tcaatagttgaatta

SEQ ID NO: 4504287 - DNA, 17 bp, Homo sapiens
tcaatatattgaacttt

SEQ ID NO: 4504288 - DNA, 22 bp, Homo sapiens
tcaatatcttttttttaataaa

SEQ ID NO: 4504289 - DNA, 12 bp, Homo sapiens
tcaatatgcaag

SEQ ID NO: 4504290 - DNA, 17 bp, Homo sapiens
tcaatatgcaagcagct

SEQ ID NO: 4504291 - DNA, 19 bp, Homo sapiens
tcaatatgcaagcagcttt

SEQ ID NO: 4504292 - DNA, 19 bp, Homo sapiens
tcaatattgaatttttcct

SEQ ID NO: 4504293 - DNA, 22 bp, Homo sapiens
tcaatattgaatttttcctatg

SEQ ID NO: 4504294 - DNA, 14 bp, Homo sapiens
tcaatatttaagag

SEQ ID NO: 4504295 - DNA, 19 bp, Homo sapiens
tcaatatttaagagattaa

SEQ ID NO: 4504296 - DNA, 13 bp, Homo sapiens
tcaatatttaagt

SEQ ID NO: 4504297 - DNA, 17 bp, Homo sapiens
tcaatatttaagtttgt

SEQ ID NO: 4504298 - DNA, 13 bp, Homo sapiens
tcaatcatttcta

SEQ ID NO: 4504299 - DNA, 16 bp, Homo sapiens
tcaatccaccttcagg

SEQ ID NO: 4504300 - DNA, 15 bp, Homo sapiens
tcaatccagctatgt

SEQ ID NO: 4504301 - DNA, 13 bp, Homo sapiens
tcaatcccagcct

SEQ ID NO: 4504302 - DNA, 19 bp, Homo sapiens
tcaatctggattcatattt

SEQ ID NO: 4504303 - DNA, 22 bp, Homo sapiens
tcaatctggcttctgcattact

SEQ ID NO: 4504304 - DNA, 15 bp, Homo sapiens
tcaatcttgttactg

SEQ ID NO: 4504305 - DNA, 16 bp, Homo sapiens
tcaatgaggtgtccaa

SEQ ID NO: 4504306 - DNA, 20 bp, Homo sapiens
tcaatgccacgtgctgctga

SEQ ID NO: 4504307 - DNA, 15 bp, Homo sapiens
tcaatggctttgtac

SEQ ID NO: 4504308 - DNA, 23 bp, Homo sapiens
tcaatggctttgtacttgtgatg

SEQ ID NO: 4504309 - DNA, 15 bp, Homo sapiens
tcaatgggctttccc

SEQ ID NO: 4504310 - DNA, 15 bp, Homo sapiens
tcaatgtattgagaa

SEQ ID NO: 4504311 - DNA, 17 bp, Homo sapiens
tcaatgtctaaaaacat

SEQ ID NO: 4504312 - DNA, 18 bp, Homo sapiens
tcaatgtctaaaaacatt

SEQ ID NO: 4504313 - DNA, 20 bp, Homo sapiens
tcaattactggtccaaaaga

SEQ ID NO: 4504314 - DNA, 15 bp, Homo sapiens
tcaattcaaagctgt

SEQ ID NO: 4504315 - DNA, 17 bp, Homo sapiens
tcaattgcatctcccag

SEQ ID NO: 4504316 - DNA, 14 bp, Homo sapiens
tcaattgtcacttt

SEQ ID NO: 4504317 - DNA, 13 bp, Homo sapiens
tcaatttaaaaaa

SEQ ID NO: 4504318 - DNA, 14 bp, Homo sapiens
tcaatttaagtgtt

SEQ ID NO: 4504319 - DNA, 22 bp, Homo sapiens
tcaatttcaaacttttgaaaga

SEQ ID NO: 4504320 - DNA, 13 bp, Homo sapiens
tcaatttcatgtt

SEQ ID NO: 4504321 - DNA, 17 bp, Homo sapiens
tcaatttctaatgttta

SEQ ID NO: 4504322 - DNA, 18 bp, Homo sapiens
tcaatttctaatgtttac

SEQ ID NO: 4504323 - DNA, 19 bp, Homo sapiens
tcaatttctaatgtttact

SEQ ID NO: 4504324 - DNA, 12 bp, Homo sapiens
tcaatttctccc

SEQ ID NO: 4504325 - DNA, 20 bp, Homo sapiens
tcaatttttcttatttcatt

SEQ ID NO: 4504326 - DNA, 23 bp, Homo sapiens
tcaatttttcttatttcatttct

SEQ ID NO: 4504327 - DNA, 19 bp, Homo sapiens
tcacaaaaaaatgttcatt

SEQ ID NO: 4504328 - DNA, 16 bp, Homo sapiens
tcacaaaaaggcaaat

SEQ ID NO: 4504329 - DNA, 15 bp, Homo sapiens
tcacaaactgaatga

SEQ ID NO: 4504330 - DNA, 21 bp, Homo sapiens
tcacaaactgatctaaaatgt

SEQ ID NO: 4504331 - DNA, 13 bp, Homo sapiens
tcacaaactgtga

SEQ ID NO: 4504332 - DNA, 14 bp, Homo sapiens
tcacaaactgtgaa

SEQ ID NO: 4504333 - DNA, 15 bp, Homo sapiens
tcacaaactgtgaaa

SEQ ID NO: 4504334 - DNA, 22 bp, Homo sapiens
tcacaaataagtaatatctttc

SEQ ID NO: 4504335 - DNA, 20 bp, Homo sapiens
tcacaaattccgattagacc

SEQ ID NO: 4504336 - DNA, 15 bp, Homo sapiens
tcacaagcaacagac

SEQ ID NO: 4504337 - DNA, 13 bp, Homo sapiens
tcacaagcctcct

SEQ ID NO: 4504338 - DNA, 14 bp, Homo sapiens
tcacaagcctcctg

SEQ ID NO: 4504339 - DNA, 15 bp, Homo sapiens
tcacaagcctcctgt

SEQ ID NO: 4504340 - DNA, 14 bp, Homo sapiens
tcacaataaagttt

SEQ ID NO: 4504341 - DNA, 19 bp, Homo sapiens
tcacaatattcagtggtga

SEQ ID NO: 4504342 - DNA, 23 bp, Homo sapiens
tcacaatattcagtggtgaaatc

SEQ ID NO: 4504343 - DNA, 15 bp, Homo sapiens
tcacaatgagattga

SEQ ID NO: 4504344 - DNA, 21 bp, Homo sapiens
tcacaattttcctgtggaata

SEQ ID NO: 4504345 - DNA, 18 bp, Homo sapiens
tcacacagccaggtgcct

SEQ ID NO: 4504346 - DNA, 13 bp, Homo sapiens
tcacacagcccag

SEQ ID NO: 4504347 - DNA, 13 bp, Homo sapiens
tcacacagtgtta

SEQ ID NO: 4504348 - DNA, 19 bp, Homo sapiens
tcacacagtgttagtgctg

SEQ ID NO: 4504349 - DNA, 16 bp, Homo sapiens
tcacacatcctgtcag

SEQ ID NO: 4504350 - DNA, 13 bp, Homo sapiens
tcacaccagccat

SEQ ID NO: 4504351 - DNA, 17 bp, Homo sapiens
tcacacctgccctaaac

SEQ ID NO: 4504352 - DNA, 20 bp, Homo sapiens
tcacacgtttaatcccagca

SEQ ID NO: 4504353 - DNA, 23 bp, Homo sapiens
tcacacgtttaatcccagcactt

SEQ ID NO: 4504354 - DNA, 18 bp, Homo sapiens
tcacactaagagggcaga

SEQ ID NO: 4504355 - DNA, 21 bp, Homo sapiens
tcacactaagagggcagactg

SEQ ID NO: 4504356 - DNA, 18 bp, Homo sapiens
tcacactctaactgtata

SEQ ID NO: 4504357 - DNA, 21 bp, Homo sapiens
tcacactctaactgtatattt

SEQ ID NO: 4504358 - DNA, 21 bp, Homo sapiens
tcacactgagaatgtaagaac

SEQ ID NO: 4504359 - DNA, 17 bp, Homo sapiens
tcacactggtctgctgt

SEQ ID NO: 4504360 - DNA, 18 bp, Homo sapiens
tcacactggtctgctgtc

SEQ ID NO: 4504361 - DNA, 20 bp, Homo sapiens
tcacacttatattttatgaa

SEQ ID NO: 4504362 - DNA, 16 bp, Homo sapiens
tcacacttctgtgaga

SEQ ID NO: 4504363 - DNA, 14 bp, Homo sapiens
tcacagaccacagg

SEQ ID NO: 4504364 - DNA, 16 bp, Homo sapiens
tcacagacctcagcag

SEQ ID NO: 4504365 - DNA, 21 bp, Homo sapiens
tcacagagtgagactccatct

SEQ ID NO: 4504366 - DNA, 16 bp, Homo sapiens
tcacagccgtttgaat

SEQ ID NO: 4504367 - DNA, 15 bp, Homo sapiens
tcacagcctcctctg

SEQ ID NO: 4504368 - DNA, 19 bp, Homo sapiens
tcacagcctcctctgtctg

SEQ ID NO: 4504369 - DNA, 19 bp, Homo sapiens
tcacaggaagtagaggagg

SEQ ID NO: 4504370 - DNA, 16 bp, Homo sapiens
tcacaggctgagaact

SEQ ID NO: 4504371 - DNA, 17 bp, Homo sapiens
tcacagggttgggccca

SEQ ID NO: 4504372 - DNA, 20 bp, Homo sapiens
tcacaggtggacaaatgttg

SEQ ID NO: 4504373 - DNA, 16 bp, Homo sapiens
tcacagtaaaaataaa

SEQ ID NO: 4504374 - DNA, 15 bp, Homo sapiens
tcacagtcccactgt

SEQ ID NO: 4504375 - DNA, 20 bp, Homo sapiens
tcacagtgctcttttctcct

SEQ ID NO: 4504376 - DNA, 13 bp, Homo sapiens
tcacagtgctgag

SEQ ID NO: 4504377 - DNA, 18 bp, Homo sapiens
tcacagtgcttttaagtg

SEQ ID NO: 4504378 - DNA, 20 bp, Homo sapiens
tcacagttattattcttcta

SEQ ID NO: 4504379 - DNA, 17 bp, Homo sapiens
tcacagttcctcgccct

SEQ ID NO: 4504380 - DNA, 20 bp, Homo sapiens
tcacagttcctcgccctggg

SEQ ID NO: 4504381 - DNA, 18 bp, Homo sapiens
tcacataaagaaattcaa

SEQ ID NO: 4504382 - DNA, 20 bp, Homo sapiens
tcacataaagaaattcaaga

SEQ ID NO: 4504383 - DNA, 19 bp, Homo sapiens
tcacataagagagatgaga

SEQ ID NO: 4504384 - DNA, 20 bp, Homo sapiens
tcacatagccaactctccca

SEQ ID NO: 4504385 - DNA, 14 bp, Homo sapiens
tcacatagtattat

SEQ ID NO: 4504386 - DNA, 16 bp, Homo sapiens
tcacatagtattatgt

SEQ ID NO: 4504387 - DNA, 13 bp, Homo sapiens
tcacatcacaata

SEQ ID NO: 4504388 - DNA, 22 bp, Homo sapiens
tcacatccctgtaaattgcaga

SEQ ID NO: 4504389 - DNA, 13 bp, Homo sapiens
tcacatcttattt

SEQ ID NO: 4504390 - DNA, 16 bp, Homo sapiens
tcacatcttatttatt

SEQ ID NO: 4504391 - DNA, 21 bp, Homo sapiens
tcacatgatgcacttcaaatt

SEQ ID NO: 4504392 - DNA, 21 bp, Homo sapiens
tcacatgtcagtaccttcaaa

SEQ ID NO: 4504393 - DNA, 15 bp, Homo sapiens
tcacatgtttaactt

SEQ ID NO: 4504394 - DNA, 13 bp, Homo sapiens
tcacattagatct

SEQ ID NO: 4504395 - DNA, 15 bp, Homo sapiens
tcacattaggctgtt

SEQ ID NO: 4504396 - DNA, 18 bp, Homo sapiens
tcacattttccttttcaa

SEQ ID NO: 4504397 - DNA, 16 bp, Homo sapiens
tcacattttgtatgga

SEQ ID NO: 4504398 - DNA, 15 bp, Homo sapiens
tcacatttttgtaat

SEQ ID NO: 4504399 - DNA, 20 bp, Homo sapiens
tcacatttttgtaatgctgt

SEQ ID NO: 4504400 - DNA, 14 bp, Homo sapiens
tcacatttttttct

SEQ ID NO: 4504401 - DNA, 20 bp, Homo sapiens
tcaccaagctcacagttcct

SEQ ID NO: 4504402 - DNA, 21 bp, Homo sapiens
tcaccaagctcacagttcctc

SEQ ID NO: 4504403 - DNA, 22 bp, Homo sapiens
tcaccaagctcacagttcctcg

SEQ ID NO: 4504404 - DNA, 14 bp, Homo sapiens
tcaccaaggctgat

SEQ ID NO: 4504405 - DNA, 16 bp, Homo sapiens
tcaccaagtgcaatag

SEQ ID NO: 4504406 - DNA, 14 bp, Homo sapiens
tcaccaccccctgt

SEQ ID NO: 4504407 - DNA, 17 bp, Homo sapiens
tcaccaccccctgtccc

SEQ ID NO: 4504408 - DNA, 14 bp, Homo sapiens
tcaccaccttccca

SEQ ID NO: 4504409 - DNA, 15 bp, Homo sapiens
tcaccaccttcccag

SEQ ID NO: 4504410 - DNA, 16 bp, Homo sapiens
tcaccaccttcccagc

SEQ ID NO: 4504411 - DNA, 20 bp, Homo sapiens
tcaccacgactggccagggc

SEQ ID NO: 4504412 - DNA, 17 bp, Homo sapiens
tcaccactaccagccag

SEQ ID NO: 4504413 - DNA, 18 bp, Homo sapiens
tcaccactaccagccagc

SEQ ID NO: 4504414 - DNA, 19 bp, Homo sapiens
tcaccactaccagccagcc

SEQ ID NO: 4504415 - DNA, 13 bp, Homo sapiens
tcaccagcaccaa

SEQ ID NO: 4504416 - DNA, 15 bp, Homo sapiens
tcaccagccctgcag

SEQ ID NO: 4504417 - DNA, 18 bp, Homo sapiens
tcaccagctatctgtcat

SEQ ID NO: 4504418 - DNA, 12 bp, Homo sapiens
tcaccagctgca

SEQ ID NO: 4504419 - DNA, 14 bp, Homo sapiens
tcaccagctgcaaa

SEQ ID NO: 4504420 - DNA, 21 bp, Homo sapiens
tcaccagctgcaaagtgtttt

SEQ ID NO: 4504421 - DNA, 19 bp, Homo sapiens
tcaccagtcccatgctggc

SEQ ID NO: 4504422 - DNA, 17 bp, Homo sapiens
tcaccatctacctgctt

SEQ ID NO: 4504423 - DNA, 15 bp, Homo sapiens
tcaccatgatgtgaa

SEQ ID NO: 4504424 - DNA, 15 bp, Homo sapiens
tcaccatgtaagcac

SEQ ID NO: 4504425 - DNA, 18 bp, Homo sapiens
tcaccatgttagccagga

SEQ ID NO: 4504426 - DNA, 15 bp, Homo sapiens
tcaccatttcctcct

SEQ ID NO: 4504427 - DNA, 11 bp, Homo sapiens
tcacccacagg

SEQ ID NO: 4504428 - DNA, 22 bp, Homo sapiens
tcacccacagggctaagagcta

SEQ ID NO: 4504429 - DNA, 22 bp, Homo sapiens
tcacccaccaggccagctcagg

SEQ ID NO: 4504430 - DNA, 14 bp, Homo sapiens
tcacccaccatgga

SEQ ID NO: 4504431 - DNA, 13 bp, Homo sapiens
tcacccacctctt

SEQ ID NO: 4504432 - DNA, 19 bp, Homo sapiens
tcacccagtcctgcccgcc

SEQ ID NO: 4504433 - DNA, 14 bp, Homo sapiens
tcacccccatggcc

SEQ ID NO: 4504434 - DNA, 18 bp, Homo sapiens
tcaccccccacactcact

SEQ ID NO: 4504435 - DNA, 19 bp, Homo sapiens
tcaccccctcccaccccca

SEQ ID NO: 4504436 - DNA, 14 bp, Homo sapiens
tcaccccctcgggt

SEQ ID NO: 4504437 - DNA, 18 bp, Homo sapiens
tcacccccttctccatcc

SEQ ID NO: 4504438 - DNA, 14 bp, Homo sapiens
tcaccccgtctggg

SEQ ID NO: 4504439 - DNA, 20 bp, Homo sapiens
tcacccctccctttctcccc

SEQ ID NO: 4504440 - DNA, 13 bp, Homo sapiens
tcacccctcgcca

SEQ ID NO: 4504441 - DNA, 20 bp, Homo sapiens
tcacccctcgccacctttca

SEQ ID NO: 4504442 - DNA, 16 bp, Homo sapiens
tcacccctctgcccct

SEQ ID NO: 4504443 - DNA, 18 bp, Homo sapiens
tcacccctctgcccctgc

SEQ ID NO: 4504444 - DNA, 10 bp, Homo sapiens
tcaccctcct

SEQ ID NO: 4504445 - DNA, 22 bp, Homo sapiens
tcacccttcccggcccccggcc

SEQ ID NO: 4504446 - DNA, 17 bp, Homo sapiens
tcaccgagactcagcct

SEQ ID NO: 4504447 - DNA, 20 bp, Homo sapiens
tcaccgagactcagcctctg

SEQ ID NO: 4504448 - DNA, 18 bp, Homo sapiens
tcaccggggtggtttagt

SEQ ID NO: 4504449 - DNA, 15 bp, Homo sapiens
tcaccggtcagtgcc

SEQ ID NO: 4504450 - DNA, 16 bp, Homo sapiens
tcaccggtcagtgcct

SEQ ID NO: 4504451 - DNA, 16 bp, Homo sapiens
tcaccgtgggctccct

SEQ ID NO: 4504452 - DNA, 16 bp, Homo sapiens
tcacctaagcacttct

SEQ ID NO: 4504453 - DNA, 18 bp, Homo sapiens
tcacctaagcacttctag

SEQ ID NO: 4504454 - DNA, 19 bp, Homo sapiens
tcacctaagcacttctaga

SEQ ID NO: 4504455 - DNA, 17 bp, Homo sapiens
tcacctagaacgtgcat

SEQ ID NO: 4504456 - DNA, 14 bp, Homo sapiens
tcacctatttaatg

SEQ ID NO: 4504457 - DNA, 16 bp, Homo sapiens
tcacctatttaatgtt

SEQ ID NO: 4504458 - DNA, 20 bp, Homo sapiens
tcacctatttccattcaaca

SEQ ID NO: 4504459 - DNA, 19 bp, Homo sapiens
tcacctccaagcatttcat

SEQ ID NO: 4504460 - DNA, 20 bp, Homo sapiens
tcacctccaagcatttcatg

SEQ ID NO: 4504461 - DNA, 16 bp, Homo sapiens
tcacctccctgctcag

SEQ ID NO: 4504462 - DNA, 23 bp, Homo sapiens
tcacctccctgctcagtgcttgg

SEQ ID NO: 4504463 - DNA, 13 bp, Homo sapiens
tcacctctcagct

SEQ ID NO: 4504464 - DNA, 12 bp, Homo sapiens
tcacctctgcct

SEQ ID NO: 4504465 - DNA, 19 bp, Homo sapiens
tcacctctggactggctag

SEQ ID NO: 4504466 - DNA, 14 bp, Homo sapiens
tcacctcttccgac

SEQ ID NO: 4504467 - DNA, 21 bp, Homo sapiens
tcacctgctcccagtcctgcc

SEQ ID NO: 4504468 - DNA, 22 bp, Homo sapiens
tcacctggacttaagcatctgg

SEQ ID NO: 4504469 - DNA, 15 bp, Homo sapiens
tcacctggttgaccc

SEQ ID NO: 4504470 - DNA, 13 bp, Homo sapiens
tcacctgtaaaac

SEQ ID NO: 4504471 - DNA, 14 bp, Homo sapiens
tcacctgtaaaact

SEQ ID NO: 4504472 - DNA, 16 bp, Homo sapiens
tcacctgtaaaacttt

SEQ ID NO: 4504473 - DNA, 15 bp, Homo sapiens
tcaccttcctgtggg

SEQ ID NO: 4504474 - DNA, 17 bp, Homo sapiens
tcaccttttcaggaaaa

SEQ ID NO: 4504475 - DNA, 22 bp, Homo sapiens
tcaccttttctgtggctggctc

SEQ ID NO: 4504476 - DNA, 19 bp, Homo sapiens
tcacgagcccattctcatg

SEQ ID NO: 4504477 - DNA, 14 bp, Homo sapiens
tcacgattcatttt

SEQ ID NO: 4504478 - DNA, 18 bp, Homo sapiens
tcacgccagacttcccac

SEQ ID NO: 4504479 - DNA, 17 bp, Homo sapiens
tcacgccattctcctgc

SEQ ID NO: 4504480 - DNA, 18 bp, Homo sapiens
tcacgccattctcctgcc

SEQ ID NO: 4504481 - DNA, 19 bp, Homo sapiens
tcacgccattctcctgcct

SEQ ID NO: 4504482 - DNA, 22 bp, Homo sapiens
tcacgccattgtactccagcct

SEQ ID NO: 4504483 - DNA, 22 bp, Homo sapiens
tcacgcctgtaatcccagcact

SEQ ID NO: 4504484 - DNA, 17 bp, Homo sapiens
tcacgctttcctgaatc

SEQ ID NO: 4504485 - DNA, 22 bp, Homo sapiens
tcacgctttcctgaatccaaac

SEQ ID NO: 4504486 - DNA, 13 bp, Homo sapiens
tcacgctttgttt

SEQ ID NO: 4504487 - DNA, 17 bp, Homo sapiens
tcacgctttgtttactc

SEQ ID NO: 4504488 - DNA, 17 bp, Homo sapiens
tcacgggactatttcca

SEQ ID NO: 4504489 - DNA, 23 bp, Homo sapiens
tcacggggttggctgttccagac

SEQ ID NO: 4504490 - DNA, 19 bp, Homo sapiens
tcacgtaaagctagaaatg

SEQ ID NO: 4504491 - DNA, 20 bp, Homo sapiens
tcacgtaaagctagaaatga

SEQ ID NO: 4504492 - DNA, 13 bp, Homo sapiens
tcacgttggtctt

SEQ ID NO: 4504493 - DNA, 17 bp, Homo sapiens
tcactaaatcttttata

SEQ ID NO: 4504494 - DNA, 19 bp, Homo sapiens
tcactaacagggagaagta

SEQ ID NO: 4504495 - DNA, 14 bp, Homo sapiens
tcactaacattata

SEQ ID NO: 4504496 - DNA, 19 bp, Homo sapiens
tcactaacattatattgca

SEQ ID NO: 4504497 - DNA, 19 bp, Homo sapiens
tcactaccctattctctct

SEQ ID NO: 4504498 - DNA, 22 bp, Homo sapiens
tcactagccatgctttatgtgg

SEQ ID NO: 4504499 - DNA, 13 bp, Homo sapiens
tcactatcaattt

SEQ ID NO: 4504500 - DNA, 17 bp, Homo sapiens
tcactatggtatgctgg

SEQ ID NO: 4504501 - DNA, 20 bp, Homo sapiens
tcactatggtatgctggcca

SEQ ID NO: 4504502 - DNA, 13 bp, Homo sapiens
tcactcacatagc

SEQ ID NO: 4504503 - DNA, 22 bp, Homo sapiens
tcactcaccactaccagccagc

SEQ ID NO: 4504504 - DNA, 16 bp, Homo sapiens
tcactcactgtttata

SEQ ID NO: 4504505 - DNA, 20 bp, Homo sapiens
tcactcactgtttataaatg

SEQ ID NO: 4504506 - DNA, 19 bp, Homo sapiens
tcactcatgcaaactgctt

SEQ ID NO: 4504507 - DNA, 21 bp, Homo sapiens
tcactcatgcaaactgcttta

SEQ ID NO: 4504508 - DNA, 15 bp, Homo sapiens
tcactccaccaccca

SEQ ID NO: 4504509 - DNA, 15 bp, Homo sapiens
tcactcccttctacc

SEQ ID NO: 4504510 - DNA, 17 bp, Homo sapiens
tcactcctgactgcccg

SEQ ID NO: 4504511 - DNA, 20 bp, Homo sapiens
tcactcctgagacccctggc

SEQ ID NO: 4504512 - DNA, 21 bp, Homo sapiens
tcactcctgagacccctggcc

SEQ ID NO: 4504513 - DNA, 23 bp, Homo sapiens
tcactcctgagacccctggcctc

SEQ ID NO: 4504514 - DNA, 12 bp, Homo sapiens
tcactctgacag

SEQ ID NO: 4504515 - DNA, 13 bp, Homo sapiens
tcactctgtcagc

SEQ ID NO: 4504516 - DNA, 15 bp, Homo sapiens
tcactctgtcagcca

SEQ ID NO: 4504517 - DNA, 20 bp, Homo sapiens
tcactctgtcagccagccgc

SEQ ID NO: 4504518 - DNA, 16 bp, Homo sapiens
tcactctgtcatcttt

SEQ ID NO: 4504519 - DNA, 14 bp, Homo sapiens
tcactctgtccctg

SEQ ID NO: 4504520 - DNA, 23 bp, Homo sapiens
tcactctgtccctgtccttccct

SEQ ID NO: 4504521 - DNA, 24 bp, Homo sapiens
tcactctgtccctgtccttccctg

SEQ ID NO: 4504522 - DNA, 19 bp, Homo sapiens
tcactctttatagtgcaca

SEQ ID NO: 4504523 - DNA, 22 bp, Homo sapiens
tcactgaatatcaactctgaaa

SEQ ID NO: 4504524 - DNA, 22 bp, Homo sapiens
tcactgagttttgtttcacttt

SEQ ID NO: 4504525 - DNA, 18 bp, Homo sapiens
tcactgatgggaaaactg

SEQ ID NO: 4504526 - DNA, 18 bp, Homo sapiens
tcactgcaattttgtgta

SEQ ID NO: 4504527 - DNA, 16 bp, Homo sapiens
tcactgcagcctcagc

SEQ ID NO: 4504528 - DNA, 16 bp, Homo sapiens
tcactgcatttgcctg

SEQ ID NO: 4504529 - DNA, 17 bp, Homo sapiens
tcactgcatttgcctgc

SEQ ID NO: 4504530 - DNA, 18 bp, Homo sapiens
tcactgcatttgcctgct

SEQ ID NO: 4504531 - DNA, 11 bp, Homo sapiens
tcactgccagg

SEQ ID NO: 4504532 - DNA, 14 bp, Homo sapiens
tcactgccaggcca

SEQ ID NO: 4504533 - DNA, 19 bp, Homo sapiens
tcactgccaggccagcctc

SEQ ID NO: 4504534 - DNA, 15 bp, Homo sapiens
tcactgctccaggcc

SEQ ID NO: 4504535 - DNA, 15 bp, Homo sapiens
tcactggaaagggga

SEQ ID NO: 4504536 - DNA, 17 bp, Homo sapiens
tcactggaaaggggaga

SEQ ID NO: 4504537 - DNA, 18 bp, Homo sapiens
tcactggagcaccaggca

SEQ ID NO: 4504538 - DNA, 20 bp, Homo sapiens
tcactggcgacacgtagcag

SEQ ID NO: 4504539 - DNA, 18 bp, Homo sapiens
tcactggtgagacaatga

SEQ ID NO: 4504540 - DNA, 22 bp, Homo sapiens
tcactggtgagacaatgaaaca

SEQ ID NO: 4504541 - DNA, 14 bp, Homo sapiens
tcactgtaaagaca

SEQ ID NO: 4504542 - DNA, 23 bp, Homo sapiens
tcactgtaaagacaaataaatga

SEQ ID NO: 4504543 - DNA, 14 bp, Homo sapiens
tcactgtatataaa

SEQ ID NO: 4504544 - DNA, 16 bp, Homo sapiens
tcactgtatataaaca

SEQ ID NO: 4504545 - DNA, 18 bp, Homo sapiens
tcactgtatataaacata

SEQ ID NO: 4504546 - DNA, 20 bp, Homo sapiens
tcactgtatataaacatatt

SEQ ID NO: 4504547 - DNA, 20 bp, Homo sapiens
tcactgtccaatatgaaaac

SEQ ID NO: 4504548 - DNA, 20 bp, Homo sapiens
tcactgtctttaattctgta

SEQ ID NO: 4504549 - DNA, 20 bp, Homo sapiens
tcactgtgaaccaaccccca

SEQ ID NO: 4504550 - DNA, 12 bp, Homo sapiens
tcactgtgatca

SEQ ID NO: 4504551 - DNA, 20 bp, Homo sapiens
tcactgtgatgtatattgtg

SEQ ID NO: 4504552 - DNA, 11 bp, Homo sapiens
tcactgtgctg

SEQ ID NO: 4504553 - DNA, 16 bp, Homo sapiens
tcactgtgctggggca

SEQ ID NO: 4504554 - DNA, 21 bp, Homo sapiens
tcactgtgtataggaatttgt

SEQ ID NO: 4504555 - DNA, 17 bp, Homo sapiens
tcactgttgctttgaaa

SEQ ID NO: 4504556 - DNA, 23 bp, Homo sapiens
tcactgtttcatctaagtgcctc

SEQ ID NO: 4504557 - DNA, 23 bp, Homo sapiens
tcacttaaactttgtcacttctg

SEQ ID NO: 4504558 - DNA, 20 bp, Homo sapiens
tcacttaaaggcacaaatag

SEQ ID NO: 4504559 - DNA, 15 bp, Homo sapiens
tcacttaaagggtct

SEQ ID NO: 4504560 - DNA, 13 bp, Homo sapiens
tcacttaatgttt

SEQ ID NO: 4504561 - DNA, 20 bp, Homo sapiens
tcacttacccattagccagg

SEQ ID NO: 4504562 - DNA, 21 bp, Homo sapiens
tcacttaggaaatggctttgt

SEQ ID NO: 4504563 - DNA, 17 bp, Homo sapiens
tcacttagtcctttatc

SEQ ID NO: 4504564 - DNA, 14 bp, Homo sapiens
tcacttcaatgtgt

SEQ ID NO: 4504565 - DNA, 16 bp, Homo sapiens
tcacttcataatccag

SEQ ID NO: 4504566 - DNA, 18 bp, Homo sapiens
tcacttctagatctcagc

SEQ ID NO: 4504567 - DNA, 17 bp, Homo sapiens
tcacttctatttattta

SEQ ID NO: 4504568 - DNA, 13 bp, Homo sapiens
tcacttctccccg

SEQ ID NO: 4504569 - DNA, 22 bp, Homo sapiens
tcacttctcttaaacttgtgaa

SEQ ID NO: 4504570 - DNA, 23 bp, Homo sapiens
tcacttgaacccgggaggcagag

SEQ ID NO: 4504571 - DNA, 15 bp, Homo sapiens
tcacttgaggaggag

SEQ ID NO: 4504572 - DNA, 14 bp, Homo sapiens
tcacttgccacatg

SEQ ID NO: 4504573 - DNA, 13 bp, Homo sapiens
tcactttcatttt

SEQ ID NO: 4504574 - DNA, 18 bp, Homo sapiens
tcactttgacacccaggc

SEQ ID NO: 4504575 - DNA, 15 bp, Homo sapiens
tcactttgccattat

SEQ ID NO: 4504576 - DNA, 21 bp, Homo sapiens
tcactttttatgctatttctg

SEQ ID NO: 4504577 - DNA, 17 bp, Homo sapiens
tcacttttttctgcctt

SEQ ID NO: 4504578 - DNA, 18 bp, Homo sapiens
tcacttttttctgccttg

SEQ ID NO: 4504579 - DNA, 22 bp, Homo sapiens
tcactttttttttttgtttgat

SEQ ID NO: 4504580 - DNA, 13 bp, Homo sapiens
tcagaaaattaaa

SEQ ID NO: 4504581 - DNA, 19 bp, Homo sapiens
tcagaaaattaaactacag

SEQ ID NO: 4504582 - DNA, 15 bp, Homo sapiens
tcagaaacttgtgaa

SEQ ID NO: 4504583 - DNA, 17 bp, Homo sapiens
tcagaaacttgtgaagt

SEQ ID NO: 4504584 - DNA, 18 bp, Homo sapiens
tcagaaacttgtgaagtg

SEQ ID NO: 4504585 - DNA, 23 bp, Homo sapiens
tcagaaagagcaagtctggatct

SEQ ID NO: 4504586 - DNA, 17 bp, Homo sapiens
tcagaaaggaaaaacaa

SEQ ID NO: 4504587 - DNA, 16 bp, Homo sapiens
tcagaaatcaaactgc

SEQ ID NO: 4504588 - DNA, 14 bp, Homo sapiens
tcagaacaaaatca

SEQ ID NO: 4504589 - DNA, 15 bp, Homo sapiens
tcagaacagaggcat

SEQ ID NO: 4504590 - DNA, 21 bp, Homo sapiens
tcagaacagaggcatttaaaa

SEQ ID NO: 4504591 - DNA, 13 bp, Homo sapiens
tcagaaccctgcc

SEQ ID NO: 4504592 - DNA, 17 bp, Homo sapiens
tcagaaccctgccatgg

SEQ ID NO: 4504593 - DNA, 14 bp, Homo sapiens
tcagaacctgagct

SEQ ID NO: 4504594 - DNA, 16 bp, Homo sapiens
tcagaactaactttgg

SEQ ID NO: 4504595 - DNA, 17 bp, Homo sapiens
tcagaactaactttggt

SEQ ID NO: 4504596 - DNA, 19 bp, Homo sapiens
tcagaactgcccttgctgc

SEQ ID NO: 4504597 - DNA, 13 bp, Homo sapiens
tcagaagaaaggc

SEQ ID NO: 4504598 - DNA, 16 bp, Homo sapiens
tcagaagcaagccaga

SEQ ID NO: 4504599 - DNA, 22 bp, Homo sapiens
tcagaagcctccaagcctgcct

SEQ ID NO: 4504600 - DNA, 14 bp, Homo sapiens
tcagaaggagaagg

SEQ ID NO: 4504601 - DNA, 15 bp, Homo sapiens
tcagaaggagaagga

SEQ ID NO: 4504602 - DNA, 16 bp, Homo sapiens
tcagaaggagaaggaa

SEQ ID NO: 4504603 - DNA, 14 bp, Homo sapiens
tcagaaggccccag

SEQ ID NO: 4504604 - DNA, 20 bp, Homo sapiens
tcagaaggccccagagagac

SEQ ID NO: 4504605 - DNA, 16 bp, Homo sapiens
tcagaagtccctgttt

SEQ ID NO: 4504606 - DNA, 17 bp, Homo sapiens
tcagaagttgtgctaaa

SEQ ID NO: 4504607 - DNA, 14 bp, Homo sapiens
tcagaataaaaatg

SEQ ID NO: 4504608 - DNA, 20 bp, Homo sapiens
tcagaataaagttgtatttc

SEQ ID NO: 4504609 - DNA, 15 bp, Homo sapiens
tcagaatggaaattt

SEQ ID NO: 4504610 - DNA, 22 bp, Homo sapiens
tcagaatggaagagagaaagca

SEQ ID NO: 4504611 - DNA, 18 bp, Homo sapiens
tcagaatgtgaaaaagga

SEQ ID NO: 4504612 - DNA, 21 bp, Homo sapiens
tcagaattaagcagaacactg

SEQ ID NO: 4504613 - DNA, 22 bp, Homo sapiens
tcagaattagagcatgggaggt

SEQ ID NO: 4504614 - DNA, 23 bp, Homo sapiens
tcagaattcggtgtgctgccaac

SEQ ID NO: 4504615 - DNA, 21 bp, Homo sapiens
tcagaattgatcattttcccc

SEQ ID NO: 4504616 - DNA, 14 bp, Homo sapiens
tcagaatttagtgt

SEQ ID NO: 4504617 - DNA, 22 bp, Homo sapiens
tcagaatttgtgttgaaggaac

SEQ ID NO: 4504618 - DNA, 13 bp, Homo sapiens
tcagacaaaatgg

SEQ ID NO: 4504619 - DNA, 22 bp, Homo sapiens
tcagacaaaatggatacataaa

SEQ ID NO: 4504620 - DNA, 14 bp, Homo sapiens
tcagacacattttt

SEQ ID NO: 4504621 - DNA, 16 bp, Homo sapiens
tcagacccaggagtcc

SEQ ID NO: 4504622 - DNA, 19 bp, Homo sapiens
tcagacccaggagtccaga

SEQ ID NO: 4504623 - DNA, 22 bp, Homo sapiens
tcagacccaggagtccagaccc

SEQ ID NO: 4504624 - DNA, 18 bp, Homo sapiens
tcagacccaggggtccag

SEQ ID NO: 4504625 - DNA, 12 bp, Homo sapiens
tcagacccccac

SEQ ID NO: 4504626 - DNA, 19 bp, Homo sapiens
tcagacccctcagccccag

SEQ ID NO: 4504627 - DNA, 14 bp, Homo sapiens
tcagacccctgcct

SEQ ID NO: 4504628 - DNA, 15 bp, Homo sapiens
tcagacccctgcctg

SEQ ID NO: 4504629 - DNA, 13 bp, Homo sapiens
tcagaccctaccc

SEQ ID NO: 4504630 - DNA, 23 bp, Homo sapiens
tcagacgtgtgacctccatactg

SEQ ID NO: 4504631 - DNA, 16 bp, Homo sapiens
tcagactcagaggtcc

SEQ ID NO: 4504632 - DNA, 17 bp, Homo sapiens
tcagactcagaggtcca

SEQ ID NO: 4504633 - DNA, 17 bp, Homo sapiens
tcagactctcagcccag

SEQ ID NO: 4504634 - DNA, 18 bp, Homo sapiens
tcagactctcagcccaga

SEQ ID NO: 4504635 - DNA, 19 bp, Homo sapiens
tcagactctcagcccagaa

SEQ ID NO: 4504636 - DNA, 21 bp, Homo sapiens
tcagactctcagcccagaaga

SEQ ID NO: 4504637 - DNA, 15 bp, Homo sapiens
tcagtgttaaatgtg

SEQ ID NO: 4504638 - DNA, 21 bp, Homo sapiens
tcagtgttaaatgtgatgaat

SEQ ID NO: 4504639 - DNA, 20 bp, Homo sapiens
tcagtgttcccaaagtgaac

SEQ ID NO: 4504640 - DNA, 18 bp, Homo sapiens
tcagtgtttatgtgctat

SEQ ID NO: 4504641 - DNA, 16 bp, Homo sapiens
tcagttactcagccct

SEQ ID NO: 4504642 - DNA, 17 bp, Homo sapiens
tcagttactcagccctg

SEQ ID NO: 4504643 - DNA, 15 bp, Homo sapiens
tcagttcccttggcc

SEQ ID NO: 4504644 - DNA, 17 bp, Homo sapiens
tcagttcccttggcctc

SEQ ID NO: 4504645 - DNA, 18 bp, Homo sapiens
tcagttcccttggcctca

SEQ ID NO: 4504646 - DNA, 19 bp, Homo sapiens
tcagttcccttggcctcag

SEQ ID NO: 4504647 - DNA, 20 bp, Homo sapiens
tcagttcccttggcctcaga

SEQ ID NO: 4504648 - DNA, 12 bp, Homo sapiens
tcagttccttca

SEQ ID NO: 4504649 - DNA, 19 bp, Homo sapiens
tcagttctacggatcatca

SEQ ID NO: 4504650 - DNA, 18 bp, Homo sapiens
tcagttctctcccttcct

SEQ ID NO: 4504651 - DNA, 19 bp, Homo sapiens
tcagttctctcccttcctc

SEQ ID NO: 4504652 - DNA, 15 bp, Homo sapiens
tcagttctctgggaa

SEQ ID NO: 4504653 - DNA, 22 bp, Homo sapiens
tcagttgtaataaatctaggat

SEQ ID NO: 4504654 - DNA, 12 bp, Homo sapiens
tcagttgtgttt

SEQ ID NO: 4504655 - DNA, 16 bp, Homo sapiens
tcagttgtgtttttta

SEQ ID NO: 4504656 - DNA, 20 bp, Homo sapiens
tcagttgttatttattgaaa

SEQ ID NO: 4504657 - DNA, 23 bp, Homo sapiens
tcagtttaaggtacactgtttcc

SEQ ID NO: 4504658 - DNA, 14 bp, Homo sapiens
tcagtttcataaaa

SEQ ID NO: 4504659 - DNA, 18 bp, Homo sapiens
tcagtttccgaatctctt

SEQ ID NO: 4504660 - DNA, 16 bp, Homo sapiens
tcagttttcaggagtg

SEQ ID NO: 4504661 - DNA, 13 bp, Homo sapiens
tcagtttttcact

SEQ ID NO: 4504662 - DNA, 15 bp, Homo sapiens
tcagtttttcacttc

SEQ ID NO: 4504663 - DNA, 20 bp, Homo sapiens
tcataaaaacaagtcatttt

SEQ ID NO: 4504664 - DNA, 11 bp, Homo sapiens
tcataaagtca

SEQ ID NO: 4504665 - DNA, 16 bp, Homo sapiens
tcataaatactgtcaa

SEQ ID NO: 4504666 - DNA, 16 bp, Homo sapiens
tcataaatttatggtt

SEQ ID NO: 4504667 - DNA, 19 bp, Homo sapiens
tcataaatttgaataagca

SEQ ID NO: 4504668 - DNA, 12 bp, Homo sapiens
tcataacagcaa

SEQ ID NO: 4504669 - DNA, 16 bp, Homo sapiens
tcataacagtgccatt

SEQ ID NO: 4504670 - DNA, 17 bp, Homo sapiens
tcataacagtgccattg

SEQ ID NO: 4504671 - DNA, 23 bp, Homo sapiens
tcataacggttaagaaagcactt

SEQ ID NO: 4504672 - DNA, 11 bp, Homo sapiens
tcataacttat

SEQ ID NO: 4504673 - DNA, 18 bp, Homo sapiens
tcataacttattgctgat

SEQ ID NO: 4504674 - DNA, 21 bp, Homo sapiens
tcataacttattgctgatttt

SEQ ID NO: 4504675 - DNA, 22 bp, Homo sapiens
tcataagtttgtttaaacactt

SEQ ID NO: 4504676 - DNA, 22 bp, Homo sapiens
tcataattcagaactaaatttt

SEQ ID NO: 4504677 - DNA, 20 bp, Homo sapiens
tcataattcctacagcacta

SEQ ID NO: 4504678 - DNA, 23 bp, Homo sapiens
tcataattcctacagcactactg

SEQ ID NO: 4504679 - DNA, 22 bp, Homo sapiens
tcataatttaaaaatctccatt

SEQ ID NO: 4504680 - DNA, 13 bp, Homo sapiens
tcataattttgca

SEQ ID NO: 4504681 - DNA, 14 bp, Homo sapiens
tcataattttgcaa

SEQ ID NO: 4504682 - DNA, 11 bp, Homo sapiens
tcatacagttt

SEQ ID NO: 4504683 - DNA, 22 bp, Homo sapiens
tcataccacttgaatttattga

SEQ ID NO: 4504684 - DNA, 15 bp, Homo sapiens
tcatactcctgggct

SEQ ID NO: 4504685 - DNA, 21 bp, Homo sapiens
tcatactcttctaaaacttga

SEQ ID NO: 4504686 - DNA, 22 bp, Homo sapiens
tcatactgtacacatttcttaa

SEQ ID NO: 4504687 - DNA, 20 bp, Homo sapiens
tcatactgttttgaataaat

SEQ ID NO: 4504688 - DNA, 13 bp, Homo sapiens
tcatacttaaaaa

SEQ ID NO: 4504689 - DNA, 15 bp, Homo sapiens
tcatacttaaaaatt

SEQ ID NO: 4504690 - DNA, 20 bp, Homo sapiens
tcatagaaacttcatggttt

SEQ ID NO: 4504691 - DNA, 13 bp, Homo sapiens
tcatagaaatatt

SEQ ID NO: 4504692 - DNA, 18 bp, Homo sapiens
tcatagaggaaattcaaa

SEQ ID NO: 4504693 - DNA, 21 bp, Homo sapiens
tcatagattattataaactat

SEQ ID NO: 4504694 - DNA, 19 bp, Homo sapiens
tcatagatttgaaaaactt

SEQ ID NO: 4504695 - DNA, 18 bp, Homo sapiens
tcatagcaagcttttgct

SEQ ID NO: 4504696 - DNA, 20 bp, Homo sapiens
tcatagcaagcttttgctca

SEQ ID NO: 4504697 - DNA, 18 bp, Homo sapiens
tcatagccctcagacatt

SEQ ID NO: 4504698 - DNA, 21 bp, Homo sapiens
tcataggtaaggttttcaagg

SEQ ID NO: 4504699 - DNA, 17 bp, Homo sapiens
tcataggttgagcaatt

SEQ ID NO: 4504700 - DNA, 14 bp, Homo sapiens
tcatagtaacttct

SEQ ID NO: 4504701 - DNA, 16 bp, Homo sapiens
tcatataaagtatcat

SEQ ID NO: 4504702 - DNA, 14 bp, Homo sapiens
tcatatacaaacat

SEQ ID NO: 4504703 - DNA, 15 bp, Homo sapiens
tcatatacaaacatg

SEQ ID NO: 4504704 - DNA, 15 bp, Homo sapiens
tcatatattaaaaca

SEQ ID NO: 4504705 - DNA, 18 bp, Homo sapiens
tcatatattaaaacaata

SEQ ID NO: 4504706 - DNA, 15 bp, Homo sapiens
tcatatccttttgaa

SEQ ID NO: 4504707 - DNA, 14 bp, Homo sapiens
tcatatctaacttt

SEQ ID NO: 4504708 - DNA, 16 bp, Homo sapiens
tcatatctaactttgt

SEQ ID NO: 4504709 - DNA, 18 bp, Homo sapiens
tcatatctaactttgtaa

SEQ ID NO: 4504710 - DNA, 17 bp, Homo sapiens
tcatatggcccagtgtc

SEQ ID NO: 4504711 - DNA, 18 bp, Homo sapiens
tcatatggcccagtgtca

SEQ ID NO: 4504712 - DNA, 20 bp, Homo sapiens
tcatatgtagccttcacaca

SEQ ID NO: 4504713 - DNA, 21 bp, Homo sapiens
tcatattaatataagtttctt

SEQ ID NO: 4504714 - DNA, 18 bp, Homo sapiens
tcatattggaaaaatcac

SEQ ID NO: 4504715 - DNA, 14 bp, Homo sapiens
tcatatttatactt

SEQ ID NO: 4504716 - DNA, 19 bp, Homo sapiens
tcatcaacaagatttcctt

SEQ ID NO: 4504717 - DNA, 13 bp, Homo sapiens
tcatcaagagttt

SEQ ID NO: 4504718 - DNA, 13 bp, Homo sapiens
tcatcaatgcaat

SEQ ID NO: 4504719 - DNA, 11 bp, Homo sapiens
tcatcactgta

SEQ ID NO: 4504720 - DNA, 19 bp, Homo sapiens
tcatcactgtaaagacaaa

SEQ ID NO: 4504721 - DNA, 22 bp, Homo sapiens
tcatcataggtaaggttttcaa

SEQ ID NO: 4504722 - DNA, 16 bp, Homo sapiens
tcatcatcataggtaa

SEQ ID NO: 4504723 - DNA, 12 bp, Homo sapiens
tcatcatgcagc

SEQ ID NO: 4504724 - DNA, 18 bp, Homo sapiens
tcatcattctctgtctca

SEQ ID NO: 4504725 - DNA, 13 bp, Homo sapiens
tcatcatttcagc

SEQ ID NO: 4504726 - DNA, 15 bp, Homo sapiens
tcatccagcctcaga

SEQ ID NO: 4504727 - DNA, 22 bp, Homo sapiens
tcatccagtttgttctccgggt

SEQ ID NO: 4504728 - DNA, 19 bp, Homo sapiens
tcatccatagacacagtat

SEQ ID NO: 4504729 - DNA, 14 bp, Homo sapiens
tcatccatcatcat

SEQ ID NO: 4504730 - DNA, 12 bp, Homo sapiens
tcatcccaacct

SEQ ID NO: 4504731 - DNA, 23 bp, Homo sapiens
tcatcccaacctctttttcctcc

SEQ ID NO: 4504732 - DNA, 17 bp, Homo sapiens
tcatccccacaatctgg

SEQ ID NO: 4504733 - DNA, 21 bp, Homo sapiens
tcatccccacaatctggctta

SEQ ID NO: 4504734 - DNA, 12 bp, Homo sapiens
tcatccccaggg

SEQ ID NO: 4504735 - DNA, 14 bp, Homo sapiens
tcatcccgtatcac

SEQ ID NO: 4504736 - DNA, 11 bp, Homo sapiens
tcatccctgga

SEQ ID NO: 4504737 - DNA, 15 bp, Homo sapiens
tcatccgttgtgact

SEQ ID NO: 4504738 - DNA, 22 bp, Homo sapiens
tcatcctcaaagaaagtgtatt

SEQ ID NO: 4504739 - DNA, 13 bp, Homo sapiens
tcatcctccctga

SEQ ID NO: 4504740 - DNA, 18 bp, Homo sapiens
tcatcctccctgaccctg

SEQ ID NO: 4504741 - DNA, 17 bp, Homo sapiens
tcatcctgactctgccc

SEQ ID NO: 4504742 - DNA, 21 bp, Homo sapiens
tcatcctgctcttttgtgatg

SEQ ID NO: 4504743 - DNA, 23 bp, Homo sapiens
tcatcgaagggattgtgtatctg

SEQ ID NO: 4504744 - DNA, 22 bp, Homo sapiens
tcatcgacttagcctgagtcat

SEQ ID NO: 4504745 - DNA, 17 bp, Homo sapiens
tcatcgctcgtgtgttc

SEQ ID NO: 4504746 - DNA, 14 bp, Homo sapiens
tcatcggaggctgg

SEQ ID NO: 4504747 - DNA, 23 bp, Homo sapiens
tcatcggaggctgggcccctggg

SEQ ID NO: 4504748 - DNA, 13 bp, Homo sapiens
tcatctaaatgaa

SEQ ID NO: 4504749 - DNA, 22 bp, Homo sapiens
tcatctaactgatgagtaaact

SEQ ID NO: 4504750 - DNA, 21 bp, Homo sapiens
tcatctaattctggcaggacc

SEQ ID NO: 4504751 - DNA, 15 bp, Homo sapiens
tcatctaccttttct

SEQ ID NO: 4504752 - DNA, 18 bp, Homo sapiens
tcatctaccttttctggc

SEQ ID NO: 4504753 - DNA, 18 bp, Homo sapiens
tcatctagaattcactga

SEQ ID NO: 4504754 - DNA, 20 bp, Homo sapiens
tcatctatgagggtgtttcc

SEQ ID NO: 4504755 - DNA, 20 bp, Homo sapiens
tcatctattttattttattg

SEQ ID NO: 4504756 - DNA, 14 bp, Homo sapiens
tcatctcatttaag

SEQ ID NO: 4504757 - DNA, 21 bp, Homo sapiens
tcatctcatttaagggaaaaa

SEQ ID NO: 4504758 - DNA, 22 bp, Homo sapiens
tcatctcatttaagggaaaaat

SEQ ID NO: 4504759 - DNA, 19 bp, Homo sapiens
tcatctcccaggccccagg

SEQ ID NO: 4504760 - DNA, 12 bp, Homo sapiens
tcatctccccac

SEQ ID NO: 4504761 - DNA, 18 bp, Homo sapiens
tcatctcctgccttcctc

SEQ ID NO: 4504762 - DNA, 14 bp, Homo sapiens
tcatctctctgggg

SEQ ID NO: 4504763 - DNA, 16 bp, Homo sapiens
tcatctctctggggcc

SEQ ID NO: 4504764 - DNA, 20 bp, Homo sapiens
tcatctcttagctcccctcc

SEQ ID NO: 4504765 - DNA, 13 bp, Homo sapiens
tcatctgaagggg

SEQ ID NO: 4504766 - DNA, 12 bp, Homo sapiens
tcatctgcaaaa

SEQ ID NO: 4504767 - DNA, 13 bp, Homo sapiens
tcatctgcaaaag

SEQ ID NO: 4504768 - DNA, 20 bp, Homo sapiens
tcatctgctaagtaatttag

SEQ ID NO: 4504769 - DNA, 12 bp, Homo sapiens
tcatctgctctc

SEQ ID NO: 4504770 - DNA, 22 bp, Homo sapiens
tcatctggataggagcctgctg

SEQ ID NO: 4504771 - DNA, 23 bp, Homo sapiens
tcatctggttgaactctggtggc

SEQ ID NO: 4504772 - DNA, 14 bp, Homo sapiens
tcatctgtcattat

SEQ ID NO: 4504773 - DNA, 12 bp, Homo sapiens
tcatctgtccct

SEQ ID NO: 4504774 - DNA, 17 bp, Homo sapiens
tcatctgtccctccggg

SEQ ID NO: 4504775 - DNA, 20 bp, Homo sapiens
tcatctgtgggatgctgaag

SEQ ID NO: 4504776 - DNA, 15 bp, Homo sapiens
tcatctgtttgtaat

SEQ ID NO: 4504777 - DNA, 18 bp, Homo sapiens
tcatcttagttctgtata

SEQ ID NO: 4504778 - DNA, 21 bp, Homo sapiens
tcatcttcactgcaattttgt

SEQ ID NO: 4504779 - DNA, 18 bp, Homo sapiens
tcatcttgctaccagtat

SEQ ID NO: 4504780 - DNA, 22 bp, Homo sapiens
tcatcttgtacaaactttgttt

SEQ ID NO: 4504781 - DNA, 15 bp, Homo sapiens
tcatcttgtgaaatg

SEQ ID NO: 4504782 - DNA, 22 bp, Homo sapiens
tcatcttgtgaaatggccagga

SEQ ID NO: 4504783 - DNA, 14 bp, Homo sapiens
tcatctttcttcca

SEQ ID NO: 4504784 - DNA, 20 bp, Homo sapiens
tcatgaaaatgtattccttt

SEQ ID NO: 4504785 - DNA, 15 bp, Homo sapiens
tcatgaaatgtggaa

SEQ ID NO: 4504786 - DNA, 13 bp, Homo sapiens
tcatgaaatgtgt

SEQ ID NO: 4504787 - DNA, 15 bp, Homo sapiens
tcatgaaatgtgttt

SEQ ID NO: 4504788 - DNA, 12 bp, Homo sapiens
tcatgaagcctg

SEQ ID NO: 4504789 - DNA, 14 bp, Homo sapiens
tcatgaatatgatg

SEQ ID NO: 4504790 - DNA, 21 bp, Homo sapiens
tcatgaatattttcaagtttt

SEQ ID NO: 4504791 - DNA, 14 bp, Homo sapiens
tcatgacattatgt

SEQ ID NO: 4504792 - DNA, 14 bp, Homo sapiens
tcatgactttatag

SEQ ID NO: 4504793 - DNA, 15 bp, Homo sapiens
tcatgagttctgctg

SEQ ID NO: 4504794 - DNA, 17 bp, Homo sapiens
tcatgataatgaacaga

SEQ ID NO: 4504795 - DNA, 21 bp, Homo sapiens
tcatgataatgaacagaacat

SEQ ID NO: 4504796 - DNA, 23 bp, Homo sapiens
tcatgatagaaagaataaaatgt

SEQ ID NO: 4504797 - DNA, 22 bp, Homo sapiens
tcatgatagaaggctatgggga

SEQ ID NO: 4504798 - DNA, 19 bp, Homo sapiens
tcatgatctccctgccgcc

SEQ ID NO: 4504799 - DNA, 22 bp, Homo sapiens
tcatgatctccctgccgcctca

SEQ ID NO: 4504800 - DNA, 19 bp, Homo sapiens
tcatgatttcccttgtaga

SEQ ID NO: 4504801 - DNA, 17 bp, Homo sapiens
tcatgcaaactgcttta

SEQ ID NO: 4504802 - DNA, 21 bp, Homo sapiens
tcatgcacacaattagatttc

SEQ ID NO: 4504803 - DNA, 20 bp, Homo sapiens
tcatgcacagtatttgtaat

SEQ ID NO: 4504804 - DNA, 16 bp, Homo sapiens
tcatgcacccctgagc

SEQ ID NO: 4504805 - DNA, 12 bp, Homo sapiens
tcatgcagctgt

SEQ ID NO: 4504806 - DNA, 24 bp, Homo sapiens
tcatgccaaccctgggctattgct

SEQ ID NO: 4504807 - DNA, 17 bp, Homo sapiens
tcatgccagtgccttat

SEQ ID NO: 4504808 - DNA, 19 bp, Homo sapiens
tcatgccatcatgcccagc

SEQ ID NO: 4504809 - DNA, 19 bp, Homo sapiens
tcatgcccaccccctgccc

SEQ ID NO: 4504810 - DNA, 20 bp, Homo sapiens
tcatgcccaccccctgccct

SEQ ID NO: 4504811 - DNA, 21 bp, Homo sapiens
tcatgcccaccccctgccctg

SEQ ID NO: 4504812 - DNA, 15 bp, Homo sapiens
tcatgcccttctgat

SEQ ID NO: 4504813 - DNA, 16 bp, Homo sapiens
tcatgcccttctgatt

SEQ ID NO: 4504814 - DNA, 14 bp, Homo sapiens
tcatgctccttaat

SEQ ID NO: 4504815 - DNA, 18 bp, Homo sapiens
tcatgctctgcaaaagga

SEQ ID NO: 4504816 - DNA, 22 bp, Homo sapiens
tcatgctggaacctgcaaaaaa

SEQ ID NO: 4504817 - DNA, 20 bp, Homo sapiens
tcatgctgggatttccaact

SEQ ID NO: 4504818 - DNA, 19 bp, Homo sapiens
tcatgctgttgctgctact

SEQ ID NO: 4504819 - DNA, 22 bp, Homo sapiens
tcatgcttaataaacatgtcac

SEQ ID NO: 4504820 - DNA, 14 bp, Homo sapiens
tcatgcttgacata

SEQ ID NO: 4504821 - DNA, 15 bp, Homo sapiens
tcatgcttgacatac

SEQ ID NO: 4504822 - DNA, 23 bp, Homo sapiens
tcatgctttcctaaagtctctgc

SEQ ID NO: 4504823 - DNA, 18 bp, Homo sapiens
tcatggacctggtgcccc

SEQ ID NO: 4504824 - DNA, 22 bp, Homo sapiens
tcatggattacttctctataaa

SEQ ID NO: 4504825 - DNA, 17 bp, Homo sapiens
tcatggcaatgaaaatt

SEQ ID NO: 4504826 - DNA, 14 bp, Homo sapiens
tcatgggcctgtgg

SEQ ID NO: 4504827 - DNA, 21 bp, Homo sapiens
tcatgggtcctagcccttccc

SEQ ID NO: 4504828 - DNA, 23 bp, Homo sapiens
tcatgggtcctagcccttccctg

SEQ ID NO: 4504829 - DNA, 19 bp, Homo sapiens
tcatggtagatttttttca

SEQ ID NO: 4504830 - DNA, 15 bp, Homo sapiens
tcatggtcctttctg

SEQ ID NO: 4504831 - DNA, 16 bp, Homo sapiens
tcatggtgtgttacac

SEQ ID NO: 4504832 - DNA, 16 bp, Homo sapiens
tcatgtaaactgtgca

SEQ ID NO: 4504833 - DNA, 22 bp, Homo sapiens
tcatgtaaattgactgtactag

SEQ ID NO: 4504834 - DNA, 16 bp, Homo sapiens
tcatgtacaagatgaa

SEQ ID NO: 4504835 - DNA, 15 bp, Homo sapiens
tcatgtactttttag

SEQ ID NO: 4504836 - DNA, 16 bp, Homo sapiens
tcatgtatatttagtt

SEQ ID NO: 4504837 - DNA, 19 bp, Homo sapiens
tcatgtatcatctggatag

SEQ ID NO: 4504838 - DNA, 16 bp, Homo sapiens
tcatgtatgtatataa

SEQ ID NO: 4504839 - DNA, 23 bp, Homo sapiens
tcatgtctccccagttccacagc

SEQ ID NO: 4504840 - DNA, 22 bp, Homo sapiens
tcatgtcttcattttttaatgt

SEQ ID NO: 4504841 - DNA, 15 bp, Homo sapiens
tcatgtcttgtcata

SEQ ID NO: 4504842 - DNA, 14 bp, Homo sapiens
tcatgtgactcttt

SEQ ID NO: 4504843 - DNA, 17 bp, Homo sapiens
tcatgtgactctttcca

SEQ ID NO: 4504844 - DNA, 18 bp, Homo sapiens
tcatgtggtgaatatgca

SEQ ID NO: 4504845 - DNA, 21 bp, Homo sapiens
tcatgtgtgtccacgactgtc

SEQ ID NO: 4504846 - DNA, 17 bp, Homo sapiens
tcatgtgttccctttgt

SEQ ID NO: 4504847 - DNA, 13 bp, Homo sapiens
tcatgttaaatta

SEQ ID NO: 4504848 - DNA, 22 bp, Homo sapiens
tcatgttaaattagaatgaatt

SEQ ID NO: 4504849 - DNA, 19 bp, Homo sapiens
tcatgttagttaccttata

SEQ ID NO: 4504850 - DNA, 19 bp, Homo sapiens
tcatgttgatcatgtactt

SEQ ID NO: 4504851 - DNA, 14 bp, Homo sapiens
tcatgttttaatgt

SEQ ID NO: 4504852 - DNA, 18 bp, Homo sapiens
tcatgttttaatgtagaa

SEQ ID NO: 4504853 - DNA, 14 bp, Homo sapiens
tcattaaataaatt

SEQ ID NO: 4504854 - DNA, 15 bp, Homo sapiens
tcattaaattactat

SEQ ID NO: 4504855 - DNA, 20 bp, Homo sapiens
tcattaatgatgatcttcag

SEQ ID NO: 4504856 - DNA, 15 bp, Homo sapiens
tcattaattaacccc

SEQ ID NO: 4504857 - DNA, 23 bp, Homo sapiens
tcattaccttttaccagctttta

SEQ ID NO: 4504858 - DNA, 16 bp, Homo sapiens
tcattaggttttgctt

SEQ ID NO: 4504859 - DNA, 13 bp, Homo sapiens
tcattatattcta

SEQ ID NO: 4504860 - DNA, 15 bp, Homo sapiens
tcattatctttgctg

SEQ ID NO: 4504861 - DNA, 15 bp, Homo sapiens
tcattatgctttgaa

SEQ ID NO: 4504862 - DNA, 22 bp, Homo sapiens
tcattatgctttgaactttagt

SEQ ID NO: 4504863 - DNA, 18 bp, Homo sapiens
tcattatgtcaaccaggt

SEQ ID NO: 4504864 - DNA, 16 bp, Homo sapiens
tcattatgttaatatt

SEQ ID NO: 4504865 - DNA, 17 bp, Homo sapiens
tcattattctctgctat

SEQ ID NO: 4504866 - DNA, 13 bp, Homo sapiens
tcattattgtagt

SEQ ID NO: 4504867 - DNA, 13 bp, Homo sapiens
tcattatttcaaa

SEQ ID NO: 4504868 - DNA, 15 bp, Homo sapiens
tcattatttcaaaat

SEQ ID NO: 4504869 - DNA, 14 bp, Homo sapiens
tcattatttgtcaa

SEQ ID NO: 4504870 - DNA, 15 bp, Homo sapiens
tcattcactcttcct

SEQ ID NO: 4504871 - DNA, 16 bp, Homo sapiens
tcattcacttctctta

SEQ ID NO: 4504872 - DNA, 19 bp, Homo sapiens
tcattcagcagcaaatttt

SEQ ID NO: 4504873 - DNA, 12 bp, Homo sapiens
tcattcaggaaa

SEQ ID NO: 4504874 - DNA, 20 bp, Homo sapiens
tcattcaggtgacctcctgc

SEQ ID NO: 4504875 - DNA, 21 bp, Homo sapiens
tcattcaggtgacctcctgca

SEQ ID NO: 4504876 - DNA, 20 bp, Homo sapiens
tcattcatgaatattttcaa

SEQ ID NO: 4504877 - DNA, 21 bp, Homo sapiens
tcattccacactccttgtcaa

SEQ ID NO: 4504878 - DNA, 14 bp, Homo sapiens
tcattccagaggaa

SEQ ID NO: 4504879 - DNA, 15 bp, Homo sapiens
tcattccattgccta

SEQ ID NO: 4504880 - DNA, 20 bp, Homo sapiens
tcattccattgcctagctct

SEQ ID NO: 4504881 - DNA, 23 bp, Homo sapiens
tcattccccaggtggctgaccca

SEQ ID NO: 4504882 - DNA, 24 bp, Homo sapiens
tcattccccattctgtgtcccatg

SEQ ID NO: 4504883 - DNA, 17 bp, Homo sapiens
tcattccttcagatttg

SEQ ID NO: 4504884 - DNA, 18 bp, Homo sapiens
tcattctcataattccta

SEQ ID NO: 4504885 - DNA, 21 bp, Homo sapiens
tcattctcataattcctacag

SEQ ID NO: 4504886 - DNA, 14 bp, Homo sapiens
tcattctgccaaag

SEQ ID NO: 4504887 - DNA, 18 bp, Homo sapiens
tcattctgttatctcagg

SEQ ID NO: 4504888 - DNA, 14 bp, Homo sapiens
tcattgaaatgtaa

SEQ ID NO: 4504889 - DNA, 21 bp, Homo sapiens
tcattgaaatttactgtgaga

SEQ ID NO: 4504890 - DNA, 19 bp, Homo sapiens
tcattgaactttaagaagc

SEQ ID NO: 4504891 - DNA, 18 bp, Homo sapiens
tcattgacttcattttat

SEQ ID NO: 4504892 - DNA, 16 bp, Homo sapiens
tcattgatgttaagaa

SEQ ID NO: 4504893 - DNA, 19 bp, Homo sapiens
tcattgcacctatctcagc

SEQ ID NO: 4504894 - DNA, 24 bp, Homo sapiens
tcattgcacctatctcagccatag

SEQ ID NO: 4504895 - DNA, 20 bp, Homo sapiens
tcattgcagcagataacttt

SEQ ID NO: 4504896 - DNA, 13 bp, Homo sapiens
tcattgccagtgt

SEQ ID NO: 4504897 - DNA, 20 bp, Homo sapiens
tcattgccagtgtctttctt

SEQ ID NO: 4504898 - DNA, 21 bp, Homo sapiens
tcattgccagtgtctttcttt

SEQ ID NO: 4504899 - DNA, 22 bp, Homo sapiens
tcattgccagtgtctttctttg

SEQ ID NO: 4504900 - DNA, 20 bp, Homo sapiens
tcattgcctcttctacttgt

SEQ ID NO: 4504901 - DNA, 15 bp, Homo sapiens
tcattgctgttgtat

SEQ ID NO: 4504902 - DNA, 12 bp, Homo sapiens
tcattgtaatct

SEQ ID NO: 4504903 - DNA, 14 bp, Homo sapiens
tcattgtatgtggt

SEQ ID NO: 4504904 - DNA, 23 bp, Homo sapiens
tcattgtctactcctagaagaac

SEQ ID NO: 4504905 - DNA, 18 bp, Homo sapiens
tcattgtctgtgtagagt

SEQ ID NO: 4504906 - DNA, 20 bp, Homo sapiens
tcattgtgttacctgtagat

SEQ ID NO: 4504907 - DNA, 19 bp, Homo sapiens
tcattgtttggacctgcat

SEQ ID NO: 4504908 - DNA, 15 bp, Homo sapiens
tcatttaaaacaggc

SEQ ID NO: 4504909 - DNA, 22 bp, Homo sapiens
tcatttaactctttgaaactgt

SEQ ID NO: 4504910 - DNA, 19 bp, Homo sapiens
tcatttagtttgattattc

SEQ ID NO: 4504911 - DNA, 19 bp, Homo sapiens
tcatttatatcgctggcca

SEQ ID NO: 4504912 - DNA, 18 bp, Homo sapiens
tcatttcaaaatgcttca

SEQ ID NO: 4504913 - DNA, 18 bp, Homo sapiens
tcatttcaatcgtaaaat

SEQ ID NO: 4504914 - DNA, 15 bp, Homo sapiens
tcatttcacattttt

SEQ ID NO: 4504915 - DNA, 17 bp, Homo sapiens
tcatttcacatttttgt

SEQ ID NO: 4504916 - DNA, 23 bp, Homo sapiens
tcatttcacatttttgtaatgct

SEQ ID NO: 4504917 - DNA, 13 bp, Homo sapiens
tcatttcagccaa

SEQ ID NO: 4504918 - DNA, 14 bp, Homo sapiens
tcatttcagccaaa

SEQ ID NO: 4504919 - DNA, 15 bp, Homo sapiens
tcatttcagccaaag

SEQ ID NO: 4504920 - DNA, 17 bp, Homo sapiens
tcatttcagccaaagtc

SEQ ID NO: 4504921 - DNA, 19 bp, Homo sapiens
tcatttcagggtcttggct

SEQ ID NO: 4504922 - DNA, 11 bp, Homo sapiens
tcatttcatct

SEQ ID NO: 4504923 - DNA, 14 bp, Homo sapiens
tcatttcatctcat

SEQ ID NO: 4504924 - DNA, 16 bp, Homo sapiens
tcatttcattccattg

SEQ ID NO: 4504925 - DNA, 15 bp, Homo sapiens
tcatttccagcattt

SEQ ID NO: 4504926 - DNA, 21 bp, Homo sapiens
tcatttctatttctcctccat

SEQ ID NO: 4504927 - DNA, 16 bp, Homo sapiens
tcatttctctgcatgg

SEQ ID NO: 4504928 - DNA, 16 bp, Homo sapiens
tcatttctgcatcagc

SEQ ID NO: 4504929 - DNA, 14 bp, Homo sapiens
tcatttcttcactt

SEQ ID NO: 4504930 - DNA, 16 bp, Homo sapiens
tcatttggttaaatca

SEQ ID NO: 4504931 - DNA, 18 bp, Homo sapiens
tcatttggttcattaatt

SEQ ID NO: 4504932 - DNA, 16 bp, Homo sapiens
tcatttgtatgtcaaa

SEQ ID NO: 4504933 - DNA, 12 bp, Homo sapiens
tcatttgtttaa

SEQ ID NO: 4504934 - DNA, 14 bp, Homo sapiens
tcatttgtttaaac

SEQ ID NO: 4504935 - DNA, 15 bp, Homo sapiens
tcatttgtttaaaca

SEQ ID NO: 4504936 - DNA, 23 bp, Homo sapiens
tcattttaaattccactgaaaat

SEQ ID NO: 4504937 - DNA, 16 bp, Homo sapiens
tcattttaactggcat

SEQ ID NO: 4504938 - DNA, 12 bp, Homo sapiens
tcattttaagta

SEQ ID NO: 4504939 - DNA, 17 bp, Homo sapiens
tcattttcacttttaaa

SEQ ID NO: 4504940 - DNA, 15 bp, Homo sapiens
tcattttccccccac

SEQ ID NO: 4504941 - DNA, 18 bp, Homo sapiens
tcattttcttgatgtcac

SEQ ID NO: 4504942 - DNA, 19 bp, Homo sapiens
tcattttcttgatgtcact

SEQ ID NO: 4504943 - DNA, 17 bp, Homo sapiens
tcattttgccattaaaa

SEQ ID NO: 4504944 - DNA, 17 bp, Homo sapiens
tcatttttaatgtatct

SEQ ID NO: 4504945 - DNA, 23 bp, Homo sapiens
tcatttttattaaacagtgaact

SEQ ID NO: 4504946 - DNA, 19 bp, Homo sapiens
tcatttttcaatagcacat

SEQ ID NO: 4504947 - DNA, 21 bp, Homo sapiens
tcatttttgaaactgcatttg

SEQ ID NO: 4504948 - DNA, 20 bp, Homo sapiens
tcattttttaatgtgctctg

SEQ ID NO: 4504949 - DNA, 16 bp, Homo sapiens
tcattttttacttgaa

SEQ ID NO: 4504950 - DNA, 17 bp, Homo sapiens
tcattttttacttgaat

SEQ ID NO: 4504951 - DNA, 17 bp, Homo sapiens
tcattttttttaattga

SEQ ID NO: 4504952 - DNA, 16 bp, Homo sapiens
tcattttttttgcttc

SEQ ID NO: 4504953 - DNA, 19 bp, Homo sapiens
tccaaaaaaaaaaaaaata

SEQ ID NO: 4504954 - DNA, 18 bp, Homo sapiens
tccaaaaagctctgaaaa

SEQ ID NO: 4504955 - DNA, 20 bp, Homo sapiens
tccaaaacatttctggacag

SEQ ID NO: 4504956 - DNA, 16 bp, Homo sapiens
tccaaaagattgctga

SEQ ID NO: 4504957 - DNA, 19 bp, Homo sapiens
tccaaacatgtatttatgt

SEQ ID NO: 4504958 - DNA, 13 bp, Homo sapiens
tccaaagaaagtt

SEQ ID NO: 4504959 - DNA, 14 bp, Homo sapiens
tccaaagaaatgta

SEQ ID NO: 4504960 - DNA, 17 bp, Homo sapiens
tccaaagaaatgtaagg

SEQ ID NO: 4504961 - DNA, 15 bp, Homo sapiens
tccaaagaggctgcc

SEQ ID NO: 4504962 - DNA, 19 bp, Homo sapiens
tccaaagaggctgcccctc

SEQ ID NO: 4504963 - DNA, 16 bp, Homo sapiens
tcccaagctgggcccc

SEQ ID NO: 4504964 - DNA, 22 bp, Homo sapiens
tcccaaggcaagcatgaataaa

SEQ ID NO: 4504965 - DNA, 16 bp, Homo sapiens
tcccaaggtcctctca

SEQ ID NO: 4504966 - DNA, 18 bp, Homo sapiens
tcccaaggtcctctcagt

SEQ ID NO: 4504967 - DNA, 20 bp, Homo sapiens
tcccaagtagctgggattac

SEQ ID NO: 4504968 - DNA, 15 bp, Homo sapiens
tcccaagtgccaaag

SEQ ID NO: 4504969 - DNA, 16 bp, Homo sapiens
tcccaagttgtgcttg

SEQ ID NO: 4504970 - DNA, 12 bp, Homo sapiens
tcccaatacaaa

SEQ ID NO: 4504971 - DNA, 22 bp, Homo sapiens
tcccacaaatgcaggtgtcctg

SEQ ID NO: 4504972 - DNA, 19 bp, Homo sapiens
tcccacaccgcgtcccagc

SEQ ID NO: 4504973 - DNA, 23 bp, Homo sapiens
tcccacaccgcgtcccagctccc

SEQ ID NO: 4504974 - DNA, 16 bp, Homo sapiens
tcccacagagtgctgg

SEQ ID NO: 4504975 - DNA, 17 bp, Homo sapiens
tcccacagagtgctgga

SEQ ID NO: 4504976 - DNA, 19 bp, Homo sapiens
tcccacagagtgctggact

SEQ ID NO: 4504977 - DNA, 23 bp, Homo sapiens
tcccacagcagccccaggagaag

SEQ ID NO: 4504978 - DNA, 18 bp, Homo sapiens
tcccacaggacatttctc

SEQ ID NO: 4504979 - DNA, 12 bp, Homo sapiens
tcccacaggagg

SEQ ID NO: 4504980 - DNA, 18 bp, Homo sapiens
tcccacaggttcaggcga

SEQ ID NO: 4504981 - DNA, 16 bp, Homo sapiens
tcccaccagagccggg

SEQ ID NO: 4504982 - DNA, 19 bp, Homo sapiens
tcccaccagagccgggagg

SEQ ID NO: 4504983 - DNA, 15 bp, Homo sapiens
tcccacccacccgcc

SEQ ID NO: 4504984 - DNA, 18 bp, Homo sapiens
tcccaccccacccccttc

SEQ ID NO: 4504985 - DNA, 22 bp, Homo sapiens
tcccaccccacccccttcagtg

SEQ ID NO: 4504986 - DNA, 12 bp, Homo sapiens
tcccacccccag

SEQ ID NO: 4504987 - DNA, 13 bp, Homo sapiens
tcccacccccagc

SEQ ID NO: 4504988 - DNA, 19 bp, Homo sapiens
tcccaccccctcctccccc

SEQ ID NO: 4504989 - DNA, 21 bp, Homo sapiens
tcccaccccctcctcccccag

SEQ ID NO: 4504990 - DNA, 17 bp, Homo sapiens
tcccacccccttctctg

SEQ ID NO: 4504991 - DNA, 20 bp, Homo sapiens
tcccacccccttctctgctc

SEQ ID NO: 4504992 - DNA, 21 bp, Homo sapiens
tcccacccccttctctgctcc

SEQ ID NO: 4504993 - DNA, 20 bp, Homo sapiens
tcccaccctcttcccatgtc

SEQ ID NO: 4504994 - DNA, 15 bp, Homo sapiens
tcccaccgctgcctc

SEQ ID NO: 4504995 - DNA, 12 bp, Homo sapiens
tcccaccgggag

SEQ ID NO: 4504996 - DNA, 18 bp, Homo sapiens
tcccaccgggagcctccc

SEQ ID NO: 4504997 - DNA, 19 bp, Homo sapiens
tcccacctgacacaccagg

SEQ ID NO: 4504998 - DNA, 19 bp, Homo sapiens
tcccacctggctctgtggc

SEQ ID NO: 4504999 - DNA, 12 bp, Homo sapiens
tcccaccttccc

SEQ ID NO: 4505000 - DNA, 15 bp, Homo sapiens
tcccacgttctgtta

SEQ ID NO: 4505001 - DNA, 20 bp, Homo sapiens
tcccactgcactccagcctg

SEQ ID NO: 4505002 - DNA, 21 bp, Homo sapiens
tcccactgcactccagcctga

SEQ ID NO: 4505003 - DNA, 22 bp, Homo sapiens
tcccactttcatctaccttttc

SEQ ID NO: 4505004 - DNA, 23 bp, Homo sapiens
tcccagaactttgggaggccaag

SEQ ID NO: 4505005 - DNA, 23 bp, Homo sapiens
tcccagacaggccctccctgtct

SEQ ID NO: 4505006 - DNA, 15 bp, Homo sapiens
tcccagaccatggga

SEQ ID NO: 4505007 - DNA, 17 bp, Homo sapiens
tcccagagacaggaaaa

SEQ ID NO: 4505008 - DNA, 18 bp, Homo sapiens
tcccagagacaggaaaat

SEQ ID NO: 4505009 - DNA, 16 bp, Homo sapiens
tcccagaggagccacc

SEQ ID NO: 4505010 - DNA, 23 bp, Homo sapiens
tcccagaggtgggatcctccctc

SEQ ID NO: 4505011 - DNA, 14 bp, Homo sapiens
tcccagagtcagag

SEQ ID NO: 4505012 - DNA, 20 bp, Homo sapiens
tcccagagtcagaggagaag

SEQ ID NO: 4505013 - DNA, 22 bp, Homo sapiens
tcccagagtcagaggagaagag

SEQ ID NO: 4505014 - DNA, 19 bp, Homo sapiens
tcccagattggctcacact

SEQ ID NO: 4505015 - DNA, 18 bp, Homo sapiens
tcccagcactttgggagg

SEQ ID NO: 4505016 - DNA, 19 bp, Homo sapiens
tcccagcatccctggagca

SEQ ID NO: 4505017 - DNA, 23 bp, Homo sapiens
tcccagcatccctggagcaggag

SEQ ID NO: 4505018 - DNA, 14 bp, Homo sapiens
tcccagccaccccg

SEQ ID NO: 4505019 - DNA, 14 bp, Homo sapiens
tcccagcccctcct

SEQ ID NO: 4505020 - DNA, 15 bp, Homo sapiens
tcccagcccctcctc

SEQ ID NO: 4505021 - DNA, 18 bp, Homo sapiens
tcccagcccctcctccct

SEQ ID NO: 4505022 - DNA, 20 bp, Homo sapiens
tcccagcccctcctccctca

SEQ ID NO: 4505023 - DNA, 22 bp, Homo sapiens
tcccagcccctcctccctcaga

SEQ ID NO: 4505024 - DNA, 15 bp, Homo sapiens
tcccagcctgcaccc

SEQ ID NO: 4505025 - DNA, 20 bp, Homo sapiens
tcccagctaccaagtcagac

SEQ ID NO: 4505026 - DNA, 17 bp, Homo sapiens
tcccagctactcaggag

SEQ ID NO: 4505027 - DNA, 23 bp, Homo sapiens
tcccagctactggggaggctgag

SEQ ID NO: 4505028 - DNA, 19 bp, Homo sapiens
tcccagctacttgggaggc

SEQ ID NO: 4505029 - DNA, 11 bp, Homo sapiens
tcccagctccc

SEQ ID NO: 4505030 - DNA, 12 bp, Homo sapiens
tcccagctcccc

SEQ ID NO: 4505031 - DNA, 15 bp, Homo sapiens
tcccagctcccctct

SEQ ID NO: 4505032 - DNA, 16 bp, Homo sapiens
tcccagctcccctctt

SEQ ID NO: 4505033 - DNA, 19 bp, Homo sapiens
tcccagctcccctcttttg

SEQ ID NO: 4505034 - DNA, 12 bp, Homo sapiens
tcccagctcctt

SEQ ID NO: 4505035 - DNA, 21 bp, Homo sapiens
tcccagctcctttctcctgtg

SEQ ID NO: 4505036 - DNA, 16 bp, Homo sapiens
tcccagctctccctct

SEQ ID NO: 4505037 - DNA, 21 bp, Homo sapiens
tcccagctctccctctggccc

SEQ ID NO: 4505038 - DNA, 22 bp, Homo sapiens
tcccagctctccctctggccct

SEQ ID NO: 4505039 - DNA, 22 bp, Homo sapiens
tcccaggacctcggatgaccat

SEQ ID NO: 4505040 - DNA, 18 bp, Homo sapiens
tcccaggatctgctccaa

SEQ ID NO: 4505041 - DNA, 21 bp, Homo sapiens
tcccaggcccctggaggctgc

SEQ ID NO: 4505042 - DNA, 17 bp, Homo sapiens
tcccaggccggcccaga

SEQ ID NO: 4505043 - DNA, 14 bp, Homo sapiens
tcccagggaccttg

SEQ ID NO: 4505044 - DNA, 22 bp, Homo sapiens
tcccaggggcccaaggcggccc

SEQ ID NO: 4505045 - DNA, 17 bp, Homo sapiens
tcccaggggtctccctg

SEQ ID NO: 4505046 - DNA, 18 bp, Homo sapiens
tcccaggggtctccctgg

SEQ ID NO: 4505047 - DNA, 21 bp, Homo sapiens
tcccaggggtctccctggctc

SEQ ID NO: 4505048 - DNA, 22 bp, Homo sapiens
tcccaggggtctccctggctcc

SEQ ID NO: 4505049 - DNA, 21 bp, Homo sapiens
tcccagggtagcccgcctgcc

SEQ ID NO: 4505050 - DNA, 23 bp, Homo sapiens
tcccagggtagcccgcctgccag

SEQ ID NO: 4505051 - DNA, 17 bp, Homo sapiens
tcccaggtaccagctgc

SEQ ID NO: 4505052 - DNA, 22 bp, Homo sapiens
tcccagtctacccagagaagcc

SEQ ID NO: 4505053 - DNA, 22 bp, Homo sapiens
tcccagtgaactcctgccaggc

SEQ ID NO: 4505054 - DNA, 16 bp, Homo sapiens
tcccagtgaactcggc

SEQ ID NO: 4505055 - DNA, 15 bp, Homo sapiens
tcccagtgagactgc

SEQ ID NO: 4505056 - DNA, 19 bp, Homo sapiens
tcccagtgagtctctgggg

SEQ ID NO: 4505057 - DNA, 14 bp, Homo sapiens
tcccagttaaagat

SEQ ID NO: 4505058 - DNA, 17 bp, Homo sapiens
tcccagtttctcagaag

SEQ ID NO: 4505059 - DNA, 22 bp, Homo sapiens
tcccataattgctttgccaaaa

SEQ ID NO: 4505060 - DNA, 21 bp, Homo sapiens
tcccatagatactctcttctt

SEQ ID NO: 4505061 - DNA, 14 bp, Homo sapiens
tcccatcactggag

SEQ ID NO: 4505062 - DNA, 22 bp, Homo sapiens
tcccatcactggagcaccaggc

SEQ ID NO: 4505063 - DNA, 13 bp, Homo sapiens
tcccatctgcacc

SEQ ID NO: 4505064 - DNA, 20 bp, Homo sapiens
tcccatctggtcatttggtt

SEQ ID NO: 4505065 - DNA, 11 bp, Homo sapiens
tcccatgaagc

SEQ ID NO: 4505066 - DNA, 17 bp, Homo sapiens
tcccatgaagccttttg

SEQ ID NO: 4505067 - DNA, 13 bp, Homo sapiens
tcccatggagccc

SEQ ID NO: 4505068 - DNA, 15 bp, Homo sapiens
tcccatggagcccca

SEQ ID NO: 4505069 - DNA, 12 bp, Homo sapiens
tcccatgtattt

SEQ ID NO: 4505070 - DNA, 13 bp, Homo sapiens
tcccatgtatttg

SEQ ID NO: 4505071 - DNA, 16 bp, Homo sapiens
tcccatgtatttgtta

SEQ ID NO: 4505072 - DNA, 18 bp, Homo sapiens
tcccattctatgtgtcat

SEQ ID NO: 4505073 - DNA, 15 bp, Homo sapiens
tcccattctgcacca

SEQ ID NO: 4505074 - DNA, 13 bp, Homo sapiens
tcccattgcccag

SEQ ID NO: 4505075 - DNA, 17 bp, Homo sapiens
tcccattgcccagtgag

SEQ ID NO: 4505076 - DNA, 13 bp, Homo sapiens
tcccattgccctg

SEQ ID NO: 4505077 - DNA, 13 bp, Homo sapiens
tcccatttcagct

SEQ ID NO: 4505078 - DNA, 11 bp, Homo sapiens
tcccatttctt

SEQ ID NO: 4505079 - DNA, 18 bp, Homo sapiens
tcccatttcttgctagct

SEQ ID NO: 4505080 - DNA, 21 bp, Homo sapiens
tccccaaaggtccgcaccctg

SEQ ID NO: 4505081 - DNA, 19 bp, Homo sapiens
tccccaacacctgcctctg

SEQ ID NO: 4505082 - DNA, 20 bp, Homo sapiens
tccccaacacctgcctctga

SEQ ID NO: 4505083 - DNA, 17 bp, Homo sapiens
tccagggctcttccaga

SEQ ID NO: 4505084 - DNA, 22 bp, Homo sapiens
tccagggctggactgaggcctg

SEQ ID NO: 4505085 - DNA, 23 bp, Homo sapiens
tccagggctggactgaggcctga

SEQ ID NO: 4505086 - DNA, 23 bp, Homo sapiens
tccaggggccaattttggatgag

SEQ ID NO: 4505087 - DNA, 17 bp, Homo sapiens
tccaggggcccctccag

SEQ ID NO: 4505088 - DNA, 17 bp, Homo sapiens
tccaggggtttacagtg

SEQ ID NO: 4505089 - DNA, 17 bp, Homo sapiens
tccagggtcctctcttc

SEQ ID NO: 4505090 - DNA, 22 bp, Homo sapiens
tccagggtcctctcttccacag

SEQ ID NO: 4505091 - DNA, 14 bp, Homo sapiens
tccagggtttctct

SEQ ID NO: 4505092 - DNA, 13 bp, Homo sapiens
tccaggtcccagc

SEQ ID NO: 4505093 - DNA, 23 bp, Homo sapiens
tccaggtcccagcccctcctccc

SEQ ID NO: 4505094 - DNA, 18 bp, Homo sapiens
tccaggtccgtagctccc

SEQ ID NO: 4505095 - DNA, 19 bp, Homo sapiens
tccaggtccgtagctcccc

SEQ ID NO: 4505096 - DNA, 14 bp, Homo sapiens
tccaggtctgcctg

SEQ ID NO: 4505097 - DNA, 17 bp, Homo sapiens
tccaggtctgcctggtt

SEQ ID NO: 4505098 - DNA, 20 bp, Homo sapiens
tccaggtgattctgtttcct

SEQ ID NO: 4505099 - DNA, 22 bp, Homo sapiens
tccaggtggaacaaacagaaat

SEQ ID NO: 4505100 - DNA, 19 bp, Homo sapiens
tccaggtgtagctaacagt

SEQ ID NO: 4505101 - DNA, 16 bp, Homo sapiens
tccaggtgttactgta

SEQ ID NO: 4505102 - DNA, 15 bp, Homo sapiens
tccagtaacctcgga

SEQ ID NO: 4505103 - DNA, 23 bp, Homo sapiens
tccagtcattatgttaatatttc

SEQ ID NO: 4505104 - DNA, 17 bp, Homo sapiens
tccagtctcatcctccc

SEQ ID NO: 4505105 - DNA, 21 bp, Homo sapiens
tccagtctggaaaacagaaac

SEQ ID NO: 4505106 - DNA, 18 bp, Homo sapiens
tccagtgaaacttgggca

SEQ ID NO: 4505107 - DNA, 23 bp, Homo sapiens
tccagtgaatagatgtgcccttt

SEQ ID NO: 4505108 - DNA, 18 bp, Homo sapiens
tccagtgacttgcaatcc

SEQ ID NO: 4505109 - DNA, 12 bp, Homo sapiens
tccagtgcagtc

SEQ ID NO: 4505110 - DNA, 15 bp, Homo sapiens
tccagtgctctgcct

SEQ ID NO: 4505111 - DNA, 16 bp, Homo sapiens
tccagtgctggatttg

SEQ ID NO: 4505112 - DNA, 13 bp, Homo sapiens
tccagtgggctga

SEQ ID NO: 4505113 - DNA, 20 bp, Homo sapiens
tccagtggggaacaggtccc

SEQ ID NO: 4505114 - DNA, 19 bp, Homo sapiens
tccagttaaaaaaaatttt

SEQ ID NO: 4505115 - DNA, 21 bp, Homo sapiens
tccagttaaaaaaaattttaa

SEQ ID NO: 4505116 - DNA, 21 bp, Homo sapiens
tccagttcatcgattttctat

SEQ ID NO: 4505117 - DNA, 15 bp, Homo sapiens
tccagtttgcccacc

SEQ ID NO: 4505118 - DNA, 18 bp, Homo sapiens
tccagtttgttctccggg

SEQ ID NO: 4505119 - DNA, 12 bp, Homo sapiens
tccagtttttct

SEQ ID NO: 4505120 - DNA, 22 bp, Homo sapiens
tccagtttttgtttttgcatga

SEQ ID NO: 4505121 - DNA, 15 bp, Homo sapiens
tccataaaaaaaaat

SEQ ID NO: 4505122 - DNA, 18 bp, Homo sapiens
tccataatgcattcttct

SEQ ID NO: 4505123 - DNA, 18 bp, Homo sapiens
tccatacacagaggagtg

SEQ ID NO: 4505124 - DNA, 14 bp, Homo sapiens
tccatacagcctct

SEQ ID NO: 4505125 - DNA, 13 bp, Homo sapiens
tccatactgggct

SEQ ID NO: 4505126 - DNA, 24 bp, Homo sapiens
tccatactgtttgcccattttcat

SEQ ID NO: 4505127 - DNA, 13 bp, Homo sapiens
tccatagacacag

SEQ ID NO: 4505128 - DNA, 15 bp, Homo sapiens
tccatagacacagta

SEQ ID NO: 4505129 - DNA, 16 bp, Homo sapiens
tccatagacacagtat

SEQ ID NO: 4505130 - DNA, 23 bp, Homo sapiens
tccatagacacagtattgacttc

SEQ ID NO: 4505131 - DNA, 15 bp, Homo sapiens
tccatagctgctgcc

SEQ ID NO: 4505132 - DNA, 14 bp, Homo sapiens
tccatatttgctaa

SEQ ID NO: 4505133 - DNA, 22 bp, Homo sapiens
tccatcaactcccaacttcttc

SEQ ID NO: 4505134 - DNA, 23 bp, Homo sapiens
tccatcaactcccaacttcttcc

SEQ ID NO: 4505135 - DNA, 21 bp, Homo sapiens
tccatcaccatttcttggcat

SEQ ID NO: 4505136 - DNA, 14 bp, Homo sapiens
tccatcatcactgt

SEQ ID NO: 4505137 - DNA, 18 bp, Homo sapiens
tccatcatcactgtaaag

SEQ ID NO: 4505138 - DNA, 19 bp, Homo sapiens
tccatcatcactgtaaaga

SEQ ID NO: 4505139 - DNA, 15 bp, Homo sapiens
tccatcatgtctgta

SEQ ID NO: 4505140 - DNA, 23 bp, Homo sapiens
tccatcatgtctgtatactcctg

SEQ ID NO: 4505141 - DNA, 21 bp, Homo sapiens
tccatcccctccctgcctgct

SEQ ID NO: 4505142 - DNA, 14 bp, Homo sapiens
tccatccctacccc

SEQ ID NO: 4505143 - DNA, 18 bp, Homo sapiens
tccatccctaccccctaa

SEQ ID NO: 4505144 - DNA, 17 bp, Homo sapiens
tccatccgactgcccct

SEQ ID NO: 4505145 - DNA, 19 bp, Homo sapiens
tccatccgactgcccctgc

SEQ ID NO: 4505146 - DNA, 19 bp, Homo sapiens
tccatcctcctgtgtcact

SEQ ID NO: 4505147 - DNA, 13 bp, Homo sapiens
tccatctccgcct

SEQ ID NO: 4505148 - DNA, 14 bp, Homo sapiens
tccatctcttcctt

SEQ ID NO: 4505149 - DNA, 16 bp, Homo sapiens
tccatctcttccttca

SEQ ID NO: 4505150 - DNA, 18 bp, Homo sapiens
tccatcttgagccacagt

SEQ ID NO: 4505151 - DNA, 18 bp, Homo sapiens
tccatcttgctttttccc

SEQ ID NO: 4505152 - DNA, 22 bp, Homo sapiens
tccatcttggtagttctgtgcc

SEQ ID NO: 4505153 - DNA, 15 bp, Homo sapiens
tccatgaaggcagag

SEQ ID NO: 4505154 - DNA, 22 bp, Homo sapiens
tccatgagttatcatgaatttt

SEQ ID NO: 4505155 - DNA, 22 bp, Homo sapiens
tccatgcctgtagctttcctgg

SEQ ID NO: 4505156 - DNA, 18 bp, Homo sapiens
tccatgcgtgtttctgac

SEQ ID NO: 4505157 - DNA, 21 bp, Homo sapiens
tccatgcgtgtttctgactct

SEQ ID NO: 4505158 - DNA, 14 bp, Homo sapiens
tccatgctccaggg

SEQ ID NO: 4505159 - DNA, 16 bp, Homo sapiens
tccatgctccttgaga

SEQ ID NO: 4505160 - DNA, 20 bp, Homo sapiens
tccatggccctgcaaaagga

SEQ ID NO: 4505161 - DNA, 19 bp, Homo sapiens
tccatggccctgtcccagg

SEQ ID NO: 4505162 - DNA, 18 bp, Homo sapiens
tccatgggcagagcccaa

SEQ ID NO: 4505163 - DNA, 23 bp, Homo sapiens
tccatgggcagagcccaagggaa

SEQ ID NO: 4505164 - DNA, 17 bp, Homo sapiens
tccatggggttcgagac

SEQ ID NO: 4505165 - DNA, 14 bp, Homo sapiens
tccatgtagcagga

SEQ ID NO: 4505166 - DNA, 17 bp, Homo sapiens
tccatgtagcaggactg

SEQ ID NO: 4505167 - DNA, 14 bp, Homo sapiens
tccatgtgtatcca

SEQ ID NO: 4505168 - DNA, 14 bp, Homo sapiens
tccatgttctgggt

SEQ ID NO: 4505169 - DNA, 20 bp, Homo sapiens
tccatgtttattgtttttta

SEQ ID NO: 4505170 - DNA, 13 bp, Homo sapiens
tccattaatttaa

SEQ ID NO: 4505171 - DNA, 17 bp, Homo sapiens
tccattatgaaaatctt

SEQ ID NO: 4505172 - DNA, 18 bp, Homo sapiens
tccattatgaaaatctta

SEQ ID NO: 4505173 - DNA, 20 bp, Homo sapiens
tccattcacaagcctcctgt

SEQ ID NO: 4505174 - DNA, 12 bp, Homo sapiens
tccattcctcag

SEQ ID NO: 4505175 - DNA, 15 bp, Homo sapiens
tccattctcccaggt

SEQ ID NO: 4505176 - DNA, 14 bp, Homo sapiens
tccattctcctcag

SEQ ID NO: 4505177 - DNA, 22 bp, Homo sapiens
tccattctcctcagtggcttct

SEQ ID NO: 4505178 - DNA, 17 bp, Homo sapiens
tccattgaactggaaga

SEQ ID NO: 4505179 - DNA, 20 bp, Homo sapiens
tccattgggcacagtccaga

SEQ ID NO: 4505180 - DNA, 14 bp, Homo sapiens
tccatttaagacac

SEQ ID NO: 4505181 - DNA, 17 bp, Homo sapiens
tccatttggcactatgg

SEQ ID NO: 4505182 - DNA, 18 bp, Homo sapiens
tccattttcctacaggca

SEQ ID NO: 4505183 - DNA, 22 bp, Homo sapiens
tccatttttacaagttatagta

SEQ ID NO: 4505184 - DNA, 13 bp, Homo sapiens
tccatttttttct

SEQ ID NO: 4505185 - DNA, 16 bp, Homo sapiens
tccatttttttcttta

SEQ ID NO: 4505186 - DNA, 23 bp, Homo sapiens
tccatttttttctttacttatct

SEQ ID NO: 4505187 - DNA, 16 bp, Homo sapiens
tcccaaaaacagcccc

SEQ ID NO: 4505188 - DNA, 16 bp, Homo sapiens
tcccaaaacaatctat

SEQ ID NO: 4505189 - DNA, 21 bp, Homo sapiens
tcccaaaacaatctatttaaa

SEQ ID NO: 4505190 - DNA, 19 bp, Homo sapiens
tcccaaacacataatttct

SEQ ID NO: 4505191 - DNA, 11 bp, Homo sapiens
tcccaaagtgc

SEQ ID NO: 4505192 - DNA, 20 bp, Homo sapiens
tcccaaagtgctgggattac

SEQ ID NO: 4505193 - DNA, 21 bp, Homo sapiens
tcccaaagtgctgggattaca

SEQ ID NO: 4505194 - DNA, 23 bp, Homo sapiens
tcccaaagtgctgggattacaga

SEQ ID NO: 4505195 - DNA, 16 bp, Homo sapiens
tcccaaatttcatacc

SEQ ID NO: 4505196 - DNA, 22 bp, Homo sapiens
tcccaaatttgattgatttgaa

SEQ ID NO: 4505197 - DNA, 13 bp, Homo sapiens
tcccaacatggga

SEQ ID NO: 4505198 - DNA, 17 bp, Homo sapiens
tcccaacatttcttaaa

SEQ ID NO: 4505199 - DNA, 20 bp, Homo sapiens
tcccaagaaaggaaaccttt

SEQ ID NO: 4505200 - DNA, 18 bp, Homo sapiens
tcccaagctgaatgttct

SEQ ID NO: 4505201 - DNA, 12 bp, Homo sapiens
tcccaagctggg

SEQ ID NO: 4505202 - DNA, 15 bp, Homo sapiens
tcccaagctgggccc

SEQ ID NO: 4505203 - DNA, 11 bp, Homo sapiens
tccactaaccc

SEQ ID NO: 4505204 - DNA, 15 bp, Homo sapiens
tccactacacctggc

SEQ ID NO: 4505205 - DNA, 17 bp, Homo sapiens
tccactacacctggctg

SEQ ID NO: 4505206 - DNA, 21 bp, Homo sapiens
tccactcatgtgactctttcc

SEQ ID NO: 4505207 - DNA, 15 bp, Homo sapiens
tccactccattgtcg

SEQ ID NO: 4505208 - DNA, 15 bp, Homo sapiens
tccactccttccaga

SEQ ID NO: 4505209 - DNA, 15 bp, Homo sapiens
tccactccttccatc

SEQ ID NO: 4505210 - DNA, 16 bp, Homo sapiens
tccactcgacccagaa

SEQ ID NO: 4505211 - DNA, 14 bp, Homo sapiens
tccactcgtgtgtt

SEQ ID NO: 4505212 - DNA, 14 bp, Homo sapiens
tccactctagttct

SEQ ID NO: 4505213 - DNA, 12 bp, Homo sapiens
tccactctcccc

SEQ ID NO: 4505214 - DNA, 18 bp, Homo sapiens
tccactctcccccacccc

SEQ ID NO: 4505215 - DNA, 19 bp, Homo sapiens
tccactcttgatctctctt

SEQ ID NO: 4505216 - DNA, 15 bp, Homo sapiens
tccactgcaagaggg

SEQ ID NO: 4505217 - DNA, 18 bp, Homo sapiens
tccactgcaagagggggg

SEQ ID NO: 4505218 - DNA, 21 bp, Homo sapiens
tccactggcttttgcctgtaa

SEQ ID NO: 4505219 - DNA, 23 bp, Homo sapiens
tccactggggaatgctcccagct

SEQ ID NO: 4505220 - DNA, 22 bp, Homo sapiens
tccactggggaggaatcctgga

SEQ ID NO: 4505221 - DNA, 22 bp, Homo sapiens
tccactggttcttcttggtctc

SEQ ID NO: 4505222 - DNA, 19 bp, Homo sapiens
tccactgtgcaggttccca

SEQ ID NO: 4505223 - DNA, 19 bp, Homo sapiens
tccactgtgctattacaaa

SEQ ID NO: 4505224 - DNA, 15 bp, Homo sapiens
tccacttcattttgt

SEQ ID NO: 4505225 - DNA, 16 bp, Homo sapiens
tccacttcattttgta

SEQ ID NO: 4505226 - DNA, 18 bp, Homo sapiens
tccacttccaggtctgcc

SEQ ID NO: 4505227 - DNA, 12 bp, Homo sapiens
tccacttgtaag

SEQ ID NO: 4505228 - DNA, 23 bp, Homo sapiens
tccagaaaacctctcctgacccc

SEQ ID NO: 4505229 - DNA, 14 bp, Homo sapiens
tccagaaaccaaac

SEQ ID NO: 4505230 - DNA, 23 bp, Homo sapiens
tccagaacagccctcggcctccg

SEQ ID NO: 4505231 - DNA, 17 bp, Homo sapiens
tccagaagcctctggct

SEQ ID NO: 4505232 - DNA, 18 bp, Homo sapiens
tccagaagttcaaaatca

SEQ ID NO: 4505233 - DNA, 16 bp, Homo sapiens
tccagaatgctgtaca

SEQ ID NO: 4505234 - DNA, 17 bp, Homo sapiens
tccagaatgctgtacat

SEQ ID NO: 4505235 - DNA, 13 bp, Homo sapiens
tccagacagcctg

SEQ ID NO: 4505236 - DNA, 14 bp, Homo sapiens
tccagacagcctgt

SEQ ID NO: 4505237 - DNA, 16 bp, Homo sapiens
tccagaccccccagcc

SEQ ID NO: 4505238 - DNA, 23 bp, Homo sapiens
tccagaccccccagcccctcctc

SEQ ID NO: 4505239 - DNA, 13 bp, Homo sapiens
tccagacctggct

SEQ ID NO: 4505240 - DNA, 14 bp, Homo sapiens
tccagagacaacag

SEQ ID NO: 4505241 - DNA, 16 bp, Homo sapiens
tccagagacaacaggt

SEQ ID NO: 4505242 - DNA, 16 bp, Homo sapiens
tccagagacactgagc

SEQ ID NO: 4505243 - DNA, 18 bp, Homo sapiens
tccagagacactgagcca

SEQ ID NO: 4505244 - DNA, 14 bp, Homo sapiens
tccagagacccctc

SEQ ID NO: 4505245 - DNA, 15 bp, Homo sapiens
tccagagacccctca

SEQ ID NO: 4505246 - DNA, 16 bp, Homo sapiens
tccagagacccctcaa

SEQ ID NO: 4505247 - DNA, 19 bp, Homo sapiens
tccagagattcattttcta

SEQ ID NO: 4505248 - DNA, 17 bp, Homo sapiens
tccagagccccacagcc

SEQ ID NO: 4505249 - DNA, 16 bp, Homo sapiens
tccagaggaataaaaa

SEQ ID NO: 4505250 - DNA, 22 bp, Homo sapiens
tccagaggtgtcgggacatggt

SEQ ID NO: 4505251 - DNA, 15 bp, Homo sapiens
tccagagtccctgcc

SEQ ID NO: 4505252 - DNA, 19 bp, Homo sapiens
tccagagtccctgcctgga

SEQ ID NO: 4505253 - DNA, 21 bp, Homo sapiens
tccagagtccctgcctggacc

SEQ ID NO: 4505254 - DNA, 15 bp, Homo sapiens
tccagatagtgtagc

SEQ ID NO: 4505255 - DNA, 22 bp, Homo sapiens
tccagatagtgtagctgaggag

SEQ ID NO: 4505256 - DNA, 13 bp, Homo sapiens
tccagatcccagg

SEQ ID NO: 4505257 - DNA, 16 bp, Homo sapiens
tccagatcccaggccc

SEQ ID NO: 4505258 - DNA, 23 bp, Homo sapiens
tccagatcccaggcccctggagg

SEQ ID NO: 4505259 - DNA, 14 bp, Homo sapiens
tccagatgcccgag

SEQ ID NO: 4505260 - DNA, 23 bp, Homo sapiens
tccagcaccttctttctggactg

SEQ ID NO: 4505261 - DNA, 13 bp, Homo sapiens
tccagcagcagca

SEQ ID NO: 4505262 - DNA, 16 bp, Homo sapiens
tccagcagcagcactt

SEQ ID NO: 4505263 - DNA, 10 bp, Homo sapiens
tccagccagc

SEQ ID NO: 4505264 - DNA, 14 bp, Homo sapiens
tccagccagcgcct

SEQ ID NO: 4505265 - DNA, 13 bp, Homo sapiens
tccagcccctcct

SEQ ID NO: 4505266 - DNA, 15 bp, Homo sapiens
tccagcccctcctcc

SEQ ID NO: 4505267 - DNA, 16 bp, Homo sapiens
tccagcccctcctccc

SEQ ID NO: 4505268 - DNA, 23 bp, Homo sapiens
tccagccgccattgccaccagga

SEQ ID NO: 4505269 - DNA, 14 bp, Homo sapiens
tccagcctcccctc

SEQ ID NO: 4505270 - DNA, 16 bp, Homo sapiens
tccagcctcccctccc

SEQ ID NO: 4505271 - DNA, 19 bp, Homo sapiens
tccagcctcccctcccctg

SEQ ID NO: 4505272 - DNA, 13 bp, Homo sapiens
tccagcctctgcc

SEQ ID NO: 4505273 - DNA, 12 bp, Homo sapiens
tccagcctctgt

SEQ ID NO: 4505274 - DNA, 20 bp, Homo sapiens
tccagcctgagcgacagtga

SEQ ID NO: 4505275 - DNA, 21 bp, Homo sapiens
tccagcctgagcgacagtgag

SEQ ID NO: 4505276 - DNA, 19 bp, Homo sapiens
tccagcctgggcagccagg

SEQ ID NO: 4505277 - DNA, 19 bp, Homo sapiens
tccagcctggggctgaggc

SEQ ID NO: 4505278 - DNA, 24 bp, Homo sapiens
tccagcctgggtcacagagtgaga

SEQ ID NO: 4505279 - DNA, 18 bp, Homo sapiens
tccagctagtgccaaata

SEQ ID NO: 4505280 - DNA, 23 bp, Homo sapiens
tccagctagtgccaaataattga

SEQ ID NO: 4505281 - DNA, 20 bp, Homo sapiens
tccagctcaccccccacact

SEQ ID NO: 4505282 - DNA, 16 bp, Homo sapiens
tccagctctggcacag

SEQ ID NO: 4505283 - DNA, 21 bp, Homo sapiens
tccagctgactaaactttttt

SEQ ID NO: 4505284 - DNA, 13 bp, Homo sapiens
tccagctgccccg

SEQ ID NO: 4505285 - DNA, 13 bp, Homo sapiens
tccagctggggcc

SEQ ID NO: 4505286 - DNA, 18 bp, Homo sapiens
tccagctggggccagagg

SEQ ID NO: 4505287 - DNA, 15 bp, Homo sapiens
tccagcttgctcttc

SEQ ID NO: 4505288 - DNA, 18 bp, Homo sapiens
tccagcttgtggagcccc

SEQ ID NO: 4505289 - DNA, 21 bp, Homo sapiens
tccaggaaactccacatctgc

SEQ ID NO: 4505290 - DNA, 23 bp, Homo sapiens
tccaggaaactccacatctgcct

SEQ ID NO: 4505291 - DNA, 11 bp, Homo sapiens
tccaggaaaga

SEQ ID NO: 4505292 - DNA, 21 bp, Homo sapiens
tccaggaaagagcagtcagag

SEQ ID NO: 4505293 - DNA, 22 bp, Homo sapiens
tccaggaaagtggccaagaagc

SEQ ID NO: 4505294 - DNA, 21 bp, Homo sapiens
tccaggaagaaagaatgttac

SEQ ID NO: 4505295 - DNA, 15 bp, Homo sapiens
tccaggaatggtgct

SEQ ID NO: 4505296 - DNA, 18 bp, Homo sapiens
tccaggaatggtgcttta

SEQ ID NO: 4505297 - DNA, 16 bp, Homo sapiens
tccaggagaaggccaa

SEQ ID NO: 4505298 - DNA, 23 bp, Homo sapiens
tccaggagaaggccaattcctat

SEQ ID NO: 4505299 - DNA, 17 bp, Homo sapiens
tccaggagctaatctga

SEQ ID NO: 4505300 - DNA, 22 bp, Homo sapiens
tccaggcaatcgttctgctggc

SEQ ID NO: 4505301 - DNA, 19 bp, Homo sapiens
tccaggcaccctcagggag

SEQ ID NO: 4505302 - DNA, 20 bp, Homo sapiens
tccaggcaccctcagggagc

SEQ ID NO: 4505303 - DNA, 19 bp, Homo sapiens
tccaggcccaaggctcccg

SEQ ID NO: 4505304 - DNA, 23 bp, Homo sapiens
tccaggcccccaacccctccttc

SEQ ID NO: 4505305 - DNA, 15 bp, Homo sapiens
tccaggccctccagt

SEQ ID NO: 4505306 - DNA, 17 bp, Homo sapiens
tccaggcctctctctgc

SEQ ID NO: 4505307 - DNA, 21 bp, Homo sapiens
tccaggcctctctctgctcca

SEQ ID NO: 4505308 - DNA, 22 bp, Homo sapiens
tccaggcctctctctgctccat

SEQ ID NO: 4505309 - DNA, 14 bp, Homo sapiens
tccaggcctgcctc

SEQ ID NO: 4505310 - DNA, 15 bp, Homo sapiens
tccaggcctgcctcc

SEQ ID NO: 4505311 - DNA, 16 bp, Homo sapiens
tccaggcctgcctccc

SEQ ID NO: 4505312 - DNA, 18 bp, Homo sapiens
tccaggcctgcctcccac

SEQ ID NO: 4505313 - DNA, 13 bp, Homo sapiens
tccaggctgagag

SEQ ID NO: 4505314 - DNA, 11 bp, Homo sapiens
tccaggctggt

SEQ ID NO: 4505315 - DNA, 15 bp, Homo sapiens
tccaggctgttctca

SEQ ID NO: 4505316 - DNA, 17 bp, Homo sapiens
tccaggctgttctcagc

SEQ ID NO: 4505317 - DNA, 17 bp, Homo sapiens
tccagggaaacagcctc

SEQ ID NO: 4505318 - DNA, 12 bp, Homo sapiens
tccagggaagct

SEQ ID NO: 4505319 - DNA, 17 bp, Homo sapiens
tccagggaagctggccg

SEQ ID NO: 4505320 - DNA, 21 bp, Homo sapiens
tccagggaaggtggccacagc

SEQ ID NO: 4505321 - DNA, 22 bp, Homo sapiens
tccagggaaggtggccacagca

SEQ ID NO: 4505322 - DNA, 16 bp, Homo sapiens
tccagggatgagccaa

SEQ ID NO: 4505323 - DNA, 22 bp, Homo sapiens
tccagggccacgtgccaggccc

SEQ ID NO: 4505324 - DNA, 20 bp, Homo sapiens
tccaaagctttattaccagt

SEQ ID NO: 4505325 - DNA, 15 bp, Homo sapiens
tccaaaggaggctgg

SEQ ID NO: 4505326 - DNA, 15 bp, Homo sapiens
tccaaataaaatgtt

SEQ ID NO: 4505327 - DNA, 16 bp, Homo sapiens
tccaaataaattcaat

SEQ ID NO: 4505328 - DNA, 21 bp, Homo sapiens
tccaaatcctggaaggacaca

SEQ ID NO: 4505329 - DNA, 22 bp, Homo sapiens
tccaaatcctggaaggacacag

SEQ ID NO: 4505330 - DNA, 14 bp, Homo sapiens
tccaaatggaatta

SEQ ID NO: 4505331 - DNA, 18 bp, Homo sapiens
tccaaatggcgtctggaa

SEQ ID NO: 4505332 - DNA, 15 bp, Homo sapiens
tccaaattatttctt

SEQ ID NO: 4505333 - DNA, 19 bp, Homo sapiens
tccaaattcagtttcataa

SEQ ID NO: 4505334 - DNA, 15 bp, Homo sapiens
tccaaattgtgcttc

SEQ ID NO: 4505335 - DNA, 23 bp, Homo sapiens
tccaaattgtgcttctccccaga

SEQ ID NO: 4505336 - DNA, 15 bp, Homo sapiens
tccaacaagttgcct

SEQ ID NO: 4505337 - DNA, 18 bp, Homo sapiens
tccaacactgaagtgctt

SEQ ID NO: 4505338 - DNA, 23 bp, Homo sapiens
tccaacactgaagtgcttgcaga

SEQ ID NO: 4505339 - DNA, 16 bp, Homo sapiens
tccaaccattttcatt

SEQ ID NO: 4505340 - DNA, 17 bp, Homo sapiens
tccaaccattttcatta

SEQ ID NO: 4505341 - DNA, 17 bp, Homo sapiens
tccaaccccccagcact

SEQ ID NO: 4505342 - DNA, 22 bp, Homo sapiens
tccaaccccccagcactgagga

SEQ ID NO: 4505343 - DNA, 23 bp, Homo sapiens
tccaactactaatagaataaagg

SEQ ID NO: 4505344 - DNA, 15 bp, Homo sapiens
tccaactagctggga

SEQ ID NO: 4505345 - DNA, 19 bp, Homo sapiens
tccaactcgaatctgtgtg

SEQ ID NO: 4505346 - DNA, 14 bp, Homo sapiens
tccaacttcctgtg

SEQ ID NO: 4505347 - DNA, 13 bp, Homo sapiens
tccaagacagcag

SEQ ID NO: 4505348 - DNA, 20 bp, Homo sapiens
tccaagacagcagcagcctg

SEQ ID NO: 4505349 - DNA, 21 bp, Homo sapiens
tccaagacagcagcagcctgc

SEQ ID NO: 4505350 - DNA, 20 bp, Homo sapiens
tccaagacatgtctgttcta

SEQ ID NO: 4505351 - DNA, 17 bp, Homo sapiens
tccaagagaactaaagc

SEQ ID NO: 4505352 - DNA, 18 bp, Homo sapiens
tccaagagaactaaagct

SEQ ID NO: 4505353 - DNA, 14 bp, Homo sapiens
tccaagaggctgta

SEQ ID NO: 4505354 - DNA, 16 bp, Homo sapiens
tccaagatgctggcac

SEQ ID NO: 4505355 - DNA, 19 bp, Homo sapiens
tccaagcaaaatctaaaat

SEQ ID NO: 4505356 - DNA, 21 bp, Homo sapiens
tccaagcaaaatctaaaatgt

SEQ ID NO: 4505357 - DNA, 23 bp, Homo sapiens
tccaagcataccaacacgagcag

SEQ ID NO: 4505358 - DNA, 12 bp, Homo sapiens
tccaagcatttc

SEQ ID NO: 4505359 - DNA, 23 bp, Homo sapiens
tccaagcatttcatgaaaaagct

SEQ ID NO: 4505360 - DNA, 23 bp, Homo sapiens
tccaagcctctctggcactttga

SEQ ID NO: 4505361 - DNA, 17 bp, Homo sapiens
tccaagcctgcctccca

SEQ ID NO: 4505362 - DNA, 19 bp, Homo sapiens
tccaagcctgcctcccaag

SEQ ID NO: 4505363 - DNA, 12 bp, Homo sapiens
tccaagcttttg

SEQ ID NO: 4505364 - DNA, 15 bp, Homo sapiens
tccaaggaaacatgc

SEQ ID NO: 4505365 - DNA, 21 bp, Homo sapiens
tccaaggaagggatgtatttg

SEQ ID NO: 4505366 - DNA, 23 bp, Homo sapiens
tccaaggaagggatgtatttgta

SEQ ID NO: 4505367 - DNA, 16 bp, Homo sapiens
tccaaggacaccctcc

SEQ ID NO: 4505368 - DNA, 22 bp, Homo sapiens
tccaagggttgagagccagtgg

SEQ ID NO: 4505369 - DNA, 15 bp, Homo sapiens
tccaaggttcccttg

SEQ ID NO: 4505370 - DNA, 16 bp, Homo sapiens
tccaaggttcccttgt

SEQ ID NO: 4505371 - DNA, 22 bp, Homo sapiens
tccaagtatatcagctactgta

SEQ ID NO: 4505372 - DNA, 18 bp, Homo sapiens
tccaagtcatttttgttt

SEQ ID NO: 4505373 - DNA, 17 bp, Homo sapiens
tccaagtctcagtggct

SEQ ID NO: 4505374 - DNA, 23 bp, Homo sapiens
tccaagtctttcttcttttttaa

SEQ ID NO: 4505375 - DNA, 19 bp, Homo sapiens
tccaataaagtgccttctg

SEQ ID NO: 4505376 - DNA, 13 bp, Homo sapiens
tccaatagaaaga

SEQ ID NO: 4505377 - DNA, 15 bp, Homo sapiens
tccaatatttctgct

SEQ ID NO: 4505378 - DNA, 23 bp, Homo sapiens
tccaatatttctgctttctttga

SEQ ID NO: 4505379 - DNA, 17 bp, Homo sapiens
tccaatattttgccttt

SEQ ID NO: 4505380 - DNA, 14 bp, Homo sapiens
tccaatctgtcaca

SEQ ID NO: 4505381 - DNA, 22 bp, Homo sapiens
tccaatgatacccaacagttta

SEQ ID NO: 4505382 - DNA, 17 bp, Homo sapiens
tccaatgcactgatgtg

SEQ ID NO: 4505383 - DNA, 14 bp, Homo sapiens
tccaatgccacaga

SEQ ID NO: 4505384 - DNA, 20 bp, Homo sapiens
tccaatgccacatacttgca

SEQ ID NO: 4505385 - DNA, 17 bp, Homo sapiens
tccaatgccacctagac

SEQ ID NO: 4505386 - DNA, 22 bp, Homo sapiens
tccaatgccacctagactctcc

SEQ ID NO: 4505387 - DNA, 14 bp, Homo sapiens
tccaatgctgtggg

SEQ ID NO: 4505388 - DNA, 18 bp, Homo sapiens
tccaatgtggcaaggaaa

SEQ ID NO: 4505389 - DNA, 14 bp, Homo sapiens
tccaatgtttcaag

SEQ ID NO: 4505390 - DNA, 15 bp, Homo sapiens
tccaatgtttcaagc

SEQ ID NO: 4505391 - DNA, 23 bp, Homo sapiens
tccaattgcctcttgcaggctga

SEQ ID NO: 4505392 - DNA, 15 bp, Homo sapiens
tccaattttaattta

SEQ ID NO: 4505393 - DNA, 17 bp, Homo sapiens
tccaattttaatttagt

SEQ ID NO: 4505394 - DNA, 13 bp, Homo sapiens
tccacaaacacat

SEQ ID NO: 4505395 - DNA, 21 bp, Homo sapiens
tccacaaacctggatttttta

SEQ ID NO: 4505396 - DNA, 21 bp, Homo sapiens
tccacaaattattaatgaaaa

SEQ ID NO: 4505397 - DNA, 17 bp, Homo sapiens
tccacaaggaataaatg

SEQ ID NO: 4505398 - DNA, 20 bp, Homo sapiens
tccacaaggggattttgctg

SEQ ID NO: 4505399 - DNA, 21 bp, Homo sapiens
tccacaagtgccgcaaattgt

SEQ ID NO: 4505400 - DNA, 20 bp, Homo sapiens
tccacaattattggcaaagt

SEQ ID NO: 4505401 - DNA, 23 bp, Homo sapiens
tccacacaggtgttccgtgggac

SEQ ID NO: 4505402 - DNA, 13 bp, Homo sapiens
tccacacatgaat

SEQ ID NO: 4505403 - DNA, 17 bp, Homo sapiens
tccacaccaagcagcaa

SEQ ID NO: 4505404 - DNA, 15 bp, Homo sapiens
tccacaccttttatt

SEQ ID NO: 4505405 - DNA, 13 bp, Homo sapiens
tccacactgacca

SEQ ID NO: 4505406 - DNA, 17 bp, Homo sapiens
tccacagaacctttgtc

SEQ ID NO: 4505407 - DNA, 12 bp, Homo sapiens
tccacagagagg

SEQ ID NO: 4505408 - DNA, 13 bp, Homo sapiens
tccacagattttt

SEQ ID NO: 4505409 - DNA, 20 bp, Homo sapiens
tccacagatttttttgtaag

SEQ ID NO: 4505410 - DNA, 20 bp, Homo sapiens
tccacagggagcaaacactt

SEQ ID NO: 4505411 - DNA, 17 bp, Homo sapiens
tccacaggtccaaggac

SEQ ID NO: 4505412 - DNA, 12 bp, Homo sapiens
tccacagtggcg

SEQ ID NO: 4505413 - DNA, 18 bp, Homo sapiens
tccacagtggcgggccca

SEQ ID NO: 4505414 - DNA, 16 bp, Homo sapiens
tccacataaattttaa

SEQ ID NO: 4505415 - DNA, 17 bp, Homo sapiens
tccacataaattttaat

SEQ ID NO: 4505416 - DNA, 18 bp, Homo sapiens
tccacatatagagctcca

SEQ ID NO: 4505417 - DNA, 19 bp, Homo sapiens
tccacatcctccacgttct

SEQ ID NO: 4505418 - DNA, 15 bp, Homo sapiens
tccacatctgcctta

SEQ ID NO: 4505419 - DNA, 19 bp, Homo sapiens
tccaccaaaccccacttcc

SEQ ID NO: 4505420 - DNA, 15 bp, Homo sapiens
tccaccagcagcatg

SEQ ID NO: 4505421 - DNA, 16 bp, Homo sapiens
tccaccatccccaccc

SEQ ID NO: 4505422 - DNA, 17 bp, Homo sapiens
tccaccatccccacccc

SEQ ID NO: 4505423 - DNA, 22 bp, Homo sapiens
tccaccatgctctctcacctgc

SEQ ID NO: 4505424 - DNA, 23 bp, Homo sapiens
tccacccacctggcttcatacag

SEQ ID NO: 4505425 - DNA, 13 bp, Homo sapiens
tccaccccaggac

SEQ ID NO: 4505426 - DNA, 19 bp, Homo sapiens
tccacccgggggagcccag

SEQ ID NO: 4505427 - DNA, 16 bp, Homo sapiens
tccaccctctgagctt

SEQ ID NO: 4505428 - DNA, 14 bp, Homo sapiens
tccacccttggcct

SEQ ID NO: 4505429 - DNA, 14 bp, Homo sapiens
tccacctcaactcc

SEQ ID NO: 4505430 - DNA, 21 bp, Homo sapiens
tccacctgcacattgggtggg

SEQ ID NO: 4505431 - DNA, 19 bp, Homo sapiens
tccacctggaaactgctca

SEQ ID NO: 4505432 - DNA, 14 bp, Homo sapiens
tccaccttaaatta

SEQ ID NO: 4505433 - DNA, 18 bp, Homo sapiens
tccaccttaaattaaaca

SEQ ID NO: 4505434 - DNA, 22 bp, Homo sapiens
tccaccttaaattaaacaattt

SEQ ID NO: 4505435 - DNA, 22 bp, Homo sapiens
tccacgagctgtttactaggga

SEQ ID NO: 4505436 - DNA, 21 bp, Homo sapiens
tccacgcccaccagccttgct

SEQ ID NO: 4505437 - DNA, 20 bp, Homo sapiens
tccacgcctcctggccagac

SEQ ID NO: 4505438 - DNA, 13 bp, Homo sapiens
tccacgctgggcc

SEQ ID NO: 4505439 - DNA, 16 bp, Homo sapiens
tccacgctgggcctag

SEQ ID NO: 4505440 - DNA, 14 bp, Homo sapiens
tccacggagccact

SEQ ID NO: 4505441 - DNA, 15 bp, Homo sapiens
tccacggagccactc

SEQ ID NO: 4505442 - DNA, 22 bp, Homo sapiens
tccacgtacttaatttacttaa

SEQ ID NO: 4505443 - DNA, 21 bp, Homo sapiens
tccacgttctgctcatcattc

SEQ ID NO: 4505444 - DNA, 14 bp, Homo sapiens
tcccgtgcctggga

SEQ ID NO: 4505445 - DNA, 23 bp, Homo sapiens
tcccgtggaacgtttttcctgtt

SEQ ID NO: 4505446 - DNA, 18 bp, Homo sapiens
tccctaatgtgtttcttt

SEQ ID NO: 4505447 - DNA, 19 bp, Homo sapiens
tccctaccactgtggcccc

SEQ ID NO: 4505448 - DNA, 16 bp, Homo sapiens
tccctaccccatttgt

SEQ ID NO: 4505449 - DNA, 19 bp, Homo sapiens
tccctaccccctaagagcc

SEQ ID NO: 4505450 - DNA, 20 bp, Homo sapiens
tccctaccccctaagagcca

SEQ ID NO: 4505451 - DNA, 19 bp, Homo sapiens
tccctaccctaaccaagtt

SEQ ID NO: 4505452 - DNA, 15 bp, Homo sapiens
tccctacctcaacct

SEQ ID NO: 4505453 - DNA, 16 bp, Homo sapiens
tccctacctcaacctg

SEQ ID NO: 4505454 - DNA, 17 bp, Homo sapiens
tccctactcccctgggc

SEQ ID NO: 4505455 - DNA, 18 bp, Homo sapiens
tccctactcccctgggca

SEQ ID NO: 4505456 - DNA, 15 bp, Homo sapiens
tccctacttgcagcg

SEQ ID NO: 4505457 - DNA, 14 bp, Homo sapiens
tccctactttctct

SEQ ID NO: 4505458 - DNA, 18 bp, Homo sapiens
tccctagaaacttccaaa

SEQ ID NO: 4505459 - DNA, 20 bp, Homo sapiens
tccctagctttagaccctgg

SEQ ID NO: 4505460 - DNA, 21 bp, Homo sapiens
tccctcaaatgcgcgtgtgca

SEQ ID NO: 4505461 - DNA, 10 bp, Homo sapiens
tccctcaccc

SEQ ID NO: 4505462 - DNA, 14 bp, Homo sapiens
tccctcacccatcc

SEQ ID NO: 4505463 - DNA, 20 bp, Homo sapiens
tccctcaccccctcccaccc

SEQ ID NO: 4505464 - DNA, 14 bp, Homo sapiens
tccctcagacccag

SEQ ID NO: 4505465 - DNA, 16 bp, Homo sapiens
tccctcagacccagga

SEQ ID NO: 4505466 - DNA, 17 bp, Homo sapiens
tccctcagacccaggag

SEQ ID NO: 4505467 - DNA, 19 bp, Homo sapiens
tccctcagactcagaggtc

SEQ ID NO: 4505468 - DNA, 21 bp, Homo sapiens
tccctcagactcagaggtcca

SEQ ID NO: 4505469 - DNA, 13 bp, Homo sapiens
tccctcagcctaa

SEQ ID NO: 4505470 - DNA, 13 bp, Homo sapiens
tccctcaggccca

SEQ ID NO: 4505471 - DNA, 18 bp, Homo sapiens
tccctcaggcccaggagt

SEQ ID NO: 4505472 - DNA, 22 bp, Homo sapiens
tccctcaggcccaggagtccag

SEQ ID NO: 4505473 - DNA, 23 bp, Homo sapiens
tccctcaggcccaggagtccagg

SEQ ID NO: 4505474 - DNA, 21 bp, Homo sapiens
tccctcatctgtccctccggg

SEQ ID NO: 4505475 - DNA, 21 bp, Homo sapiens
tccctccaccccacagaacct

SEQ ID NO: 4505476 - DNA, 18 bp, Homo sapiens
tccctccaccccaggacg

SEQ ID NO: 4505477 - DNA, 15 bp, Homo sapiens
tccctccagggtcct

SEQ ID NO: 4505478 - DNA, 23 bp, Homo sapiens
tccctccagtattgccccctctc

SEQ ID NO: 4505479 - DNA, 22 bp, Homo sapiens
tccctcccagaggagccaccag

SEQ ID NO: 4505480 - DNA, 22 bp, Homo sapiens
tccctccgccttctcccacatg

SEQ ID NO: 4505481 - DNA, 14 bp, Homo sapiens
tccctccgggacct

SEQ ID NO: 4505482 - DNA, 13 bp, Homo sapiens
tccctcctcacct

SEQ ID NO: 4505483 - DNA, 18 bp, Homo sapiens
tccctcctcacctctgga

SEQ ID NO: 4505484 - DNA, 13 bp, Homo sapiens
tccctccttttaa

SEQ ID NO: 4505485 - DNA, 15 bp, Homo sapiens
tccctctaatttctc

SEQ ID NO: 4505486 - DNA, 22 bp, Homo sapiens
tccctctacagagcttccctga

SEQ ID NO: 4505487 - DNA, 15 bp, Homo sapiens
tccctctcagaggcc

SEQ ID NO: 4505488 - DNA, 19 bp, Homo sapiens
tccctctcagaggcctgct

SEQ ID NO: 4505489 - DNA, 14 bp, Homo sapiens
tccctctcctgcct

SEQ ID NO: 4505490 - DNA, 12 bp, Homo sapiens
tccctctctctt

SEQ ID NO: 4505491 - DNA, 16 bp, Homo sapiens
tccctctcttcccctt

SEQ ID NO: 4505492 - DNA, 11 bp, Homo sapiens
tccctctgctg

SEQ ID NO: 4505493 - DNA, 14 bp, Homo sapiens
tccctcttctgccc

SEQ ID NO: 4505494 - DNA, 17 bp, Homo sapiens
tccctgaaaacccagag

SEQ ID NO: 4505495 - DNA, 18 bp, Homo sapiens
tccctgaaaacccagaga

SEQ ID NO: 4505496 - DNA, 22 bp, Homo sapiens
tccctgaccttagcgttctgga

SEQ ID NO: 4505497 - DNA, 14 bp, Homo sapiens
tccctgactcattc

SEQ ID NO: 4505498 - DNA, 16 bp, Homo sapiens
tccctgactcattctg

SEQ ID NO: 4505499 - DNA, 16 bp, Homo sapiens
tccctgactccctgtg

SEQ ID NO: 4505500 - DNA, 19 bp, Homo sapiens
tccctgactccctgtgggg

SEQ ID NO: 4505501 - DNA, 14 bp, Homo sapiens
tccctgactgggag

SEQ ID NO: 4505502 - DNA, 15 bp, Homo sapiens
tccctgactgggagt

SEQ ID NO: 4505503 - DNA, 15 bp, Homo sapiens
tccctgacttgcttt

SEQ ID NO: 4505504 - DNA, 20 bp, Homo sapiens
tccctgaggactgatttcag

SEQ ID NO: 4505505 - DNA, 14 bp, Homo sapiens
tccctgagtcacca

SEQ ID NO: 4505506 - DNA, 16 bp, Homo sapiens
tccctgagtcaccagg

SEQ ID NO: 4505507 - DNA, 15 bp, Homo sapiens
tccctgatcccaccc

SEQ ID NO: 4505508 - DNA, 18 bp, Homo sapiens
tccctgatggcctttgga

SEQ ID NO: 4505509 - DNA, 15 bp, Homo sapiens
tccctgcaaaactcc

SEQ ID NO: 4505510 - DNA, 18 bp, Homo sapiens
tccctgcaagctccgcct

SEQ ID NO: 4505511 - DNA, 12 bp, Homo sapiens
tccctgcacaca

SEQ ID NO: 4505512 - DNA, 20 bp, Homo sapiens
tccctgcacacacatgcata

SEQ ID NO: 4505513 - DNA, 10 bp, Homo sapiens
tccctgcctc

SEQ ID NO: 4505514 - DNA, 16 bp, Homo sapiens
tccctgcctcactcct

SEQ ID NO: 4505515 - DNA, 17 bp, Homo sapiens
tccctgcctcctgccta

SEQ ID NO: 4505516 - DNA, 17 bp, Homo sapiens
tccctgcctctcatcaa

SEQ ID NO: 4505517 - DNA, 19 bp, Homo sapiens
tccctgcctgctccttggc

SEQ ID NO: 4505518 - DNA, 22 bp, Homo sapiens
tccctgcctgtggcccctcccc

SEQ ID NO: 4505519 - DNA, 22 bp, Homo sapiens
tccctgcggcctccacacctga

SEQ ID NO: 4505520 - DNA, 18 bp, Homo sapiens
tccctgctagcacagagg

SEQ ID NO: 4505521 - DNA, 21 bp, Homo sapiens
tccctgctagcacagaggcct

SEQ ID NO: 4505522 - DNA, 22 bp, Homo sapiens
tccctgctagcacagaggcctg

SEQ ID NO: 4505523 - DNA, 15 bp, Homo sapiens
tccctgctcagtgct

SEQ ID NO: 4505524 - DNA, 18 bp, Homo sapiens
tccctgctgctcctagga

SEQ ID NO: 4505525 - DNA, 12 bp, Homo sapiens
tccctgctgggg

SEQ ID NO: 4505526 - DNA, 20 bp, Homo sapiens
tccctgcttgcccgctccca

SEQ ID NO: 4505527 - DNA, 13 bp, Homo sapiens
tccctgctttgca

SEQ ID NO: 4505528 - DNA, 16 bp, Homo sapiens
tccctgctttgcatct

SEQ ID NO: 4505529 - DNA, 19 bp, Homo sapiens
tccctggacttctgggaga

SEQ ID NO: 4505530 - DNA, 20 bp, Homo sapiens
tccctggagaaaaaaattgc

SEQ ID NO: 4505531 - DNA, 22 bp, Homo sapiens
tccctggagtgtggctgaggag

SEQ ID NO: 4505532 - DNA, 22 bp, Homo sapiens
tccctggcatcgtgtattccat

SEQ ID NO: 4505533 - DNA, 11 bp, Homo sapiens
tccctggcgca

SEQ ID NO: 4505534 - DNA, 17 bp, Homo sapiens
tccctggctccctcctc

SEQ ID NO: 4505535 - DNA, 14 bp, Homo sapiens
tccctggcttctgt

SEQ ID NO: 4505536 - DNA, 21 bp, Homo sapiens
tccctggcttgtaactccacc

SEQ ID NO: 4505537 - DNA, 22 bp, Homo sapiens
tccctggcttgtaactccacca

SEQ ID NO: 4505538 - DNA, 15 bp, Homo sapiens
tccctgggcccctcc

SEQ ID NO: 4505539 - DNA, 17 bp, Homo sapiens
tccctgggcccctccac

SEQ ID NO: 4505540 - DNA, 19 bp, Homo sapiens
tccctgggggaagccctgg

SEQ ID NO: 4505541 - DNA, 21 bp, Homo sapiens
tccctgggggaagccctggat

SEQ ID NO: 4505542 - DNA, 22 bp, Homo sapiens
tccctggtcccctcccccatcc

SEQ ID NO: 4505543 - DNA, 19 bp, Homo sapiens
tccctgtaacctcttcaga

SEQ ID NO: 4505544 - DNA, 22 bp, Homo sapiens
tccctgtaacctcttcagaggc

SEQ ID NO: 4505545 - DNA, 16 bp, Homo sapiens
tccctgtagctctgcc

SEQ ID NO: 4505546 - DNA, 17 bp, Homo sapiens
tccctgtagctctgcct

SEQ ID NO: 4505547 - DNA, 15 bp, Homo sapiens
tccctgtcaccaagc

SEQ ID NO: 4505548 - DNA, 14 bp, Homo sapiens
tccctgtcccagtt

SEQ ID NO: 4505549 - DNA, 21 bp, Homo sapiens
tccctgtccctctagtgcctt

SEQ ID NO: 4505550 - DNA, 15 bp, Homo sapiens
tccctgtccttccct

SEQ ID NO: 4505551 - DNA, 16 bp, Homo sapiens
tccctgtctccagggc

SEQ ID NO: 4505552 - DNA, 16 bp, Homo sapiens
tccctgtgggggtggc

SEQ ID NO: 4505553 - DNA, 19 bp, Homo sapiens
tccctgtgggggtggccat

SEQ ID NO: 4505554 - DNA, 21 bp, Homo sapiens
tccctgtgggggtggccatcc

SEQ ID NO: 4505555 - DNA, 23 bp, Homo sapiens
tccctgtgggggtggccatccct

SEQ ID NO: 4505556 - DNA, 19 bp, Homo sapiens
tccctgttttcccacgagg

SEQ ID NO: 4505557 - DNA, 22 bp, Homo sapiens
tcccttaaacaaaaattaaaat

SEQ ID NO: 4505558 - DNA, 16 bp, Homo sapiens
tcccttaacagttgta

SEQ ID NO: 4505559 - DNA, 14 bp, Homo sapiens
tcccttaagcagca

SEQ ID NO: 4505560 - DNA, 18 bp, Homo sapiens
tcccttaaggtctccaaa

SEQ ID NO: 4505561 - DNA, 14 bp, Homo sapiens
tcccttacaaggtg

SEQ ID NO: 4505562 - DNA, 17 bp, Homo sapiens
tcccttagcctctccca

SEQ ID NO: 4505563 - DNA, 20 bp, Homo sapiens
tcccttagcctctcccaccc

SEQ ID NO: 4505564 - DNA, 16 bp, Homo sapiens
tccccaacgtcccctc

SEQ ID NO: 4505565 - DNA, 11 bp, Homo sapiens
tccccaactcc

SEQ ID NO: 4505566 - DNA, 19 bp, Homo sapiens
tccccaactgctccagcct

SEQ ID NO: 4505567 - DNA, 18 bp, Homo sapiens
tccccaaggccacaggga

SEQ ID NO: 4505568 - DNA, 13 bp, Homo sapiens
tccccaataaagc

SEQ ID NO: 4505569 - DNA, 16 bp, Homo sapiens
tccccaataaagcctt

SEQ ID NO: 4505570 - DNA, 20 bp, Homo sapiens
tccccaataaagccttttaa

SEQ ID NO: 4505571 - DNA, 23 bp, Homo sapiens
tccccaattacagggtgactcac

SEQ ID NO: 4505572 - DNA, 16 bp, Homo sapiens
tccccaattctcccct

SEQ ID NO: 4505573 - DNA, 10 bp, Homo sapiens
tccccacact

SEQ ID NO: 4505574 - DNA, 23 bp, Homo sapiens
tccccacccccctctctttctct

SEQ ID NO: 4505575 - DNA, 13 bp, Homo sapiens
tccccacccctgc

SEQ ID NO: 4505576 - DNA, 22 bp, Homo sapiens
tccccacccctgcccccagccc

SEQ ID NO: 4505577 - DNA, 19 bp, Homo sapiens
tccccaccctcctcttgga

SEQ ID NO: 4505578 - DNA, 17 bp, Homo sapiens
tccccacgagggctggc

SEQ ID NO: 4505579 - DNA, 20 bp, Homo sapiens
tccccacggaaggcgggctg

SEQ ID NO: 4505580 - DNA, 18 bp, Homo sapiens
tccccactaataaagtgc

SEQ ID NO: 4505581 - DNA, 12 bp, Homo sapiens
tccccagaccca

SEQ ID NO: 4505582 - DNA, 18 bp, Homo sapiens
tccccagacccagaggtc

SEQ ID NO: 4505583 - DNA, 21 bp, Homo sapiens
tccccagacccagaggtccag

SEQ ID NO: 4505584 - DNA, 12 bp, Homo sapiens
tccccagagctg

SEQ ID NO: 4505585 - DNA, 15 bp, Homo sapiens
tccccagagctggcg

SEQ ID NO: 4505586 - DNA, 20 bp, Homo sapiens
tccccagagctggcgctcag

SEQ ID NO: 4505587 - DNA, 13 bp, Homo sapiens
tccccagccacag

SEQ ID NO: 4505588 - DNA, 17 bp, Homo sapiens
tccccagccagcccttc

SEQ ID NO: 4505589 - DNA, 19 bp, Homo sapiens
tccccagccagcccttccc

SEQ ID NO: 4505590 - DNA, 21 bp, Homo sapiens
tccccagccagcccttccctg

SEQ ID NO: 4505591 - DNA, 22 bp, Homo sapiens
tccccagccagcccttccctgg

SEQ ID NO: 4505592 - DNA, 14 bp, Homo sapiens
tccccagccccctc

SEQ ID NO: 4505593 - DNA, 13 bp, Homo sapiens
tccccagcccctc

SEQ ID NO: 4505594 - DNA, 16 bp, Homo sapiens
tccccagcccctcctc

SEQ ID NO: 4505595 - DNA, 18 bp, Homo sapiens
tccccagcccctcctccc

SEQ ID NO: 4505596 - DNA, 15 bp, Homo sapiens
tccccagctgtttat

SEQ ID NO: 4505597 - DNA, 20 bp, Homo sapiens
tccccaggctggagaccccc

SEQ ID NO: 4505598 - DNA, 23 bp, Homo sapiens
tccccaggggagagggtctggag

SEQ ID NO: 4505599 - DNA, 20 bp, Homo sapiens
tccccaggggtcccagccac

SEQ ID NO: 4505600 - DNA, 19 bp, Homo sapiens
tccccaggtggctgaccca

SEQ ID NO: 4505601 - DNA, 22 bp, Homo sapiens
tccccaggtggctgacccagtc

SEQ ID NO: 4505602 - DNA, 10 bp, Homo sapiens
tccccagtgc

SEQ ID NO: 4505603 - DNA, 14 bp, Homo sapiens
tccccagtgcctgc

SEQ ID NO: 4505604 - DNA, 15 bp, Homo sapiens
tccccagtgcctgcc

SEQ ID NO: 4505605 - DNA, 15 bp, Homo sapiens
tccccagttccacag

SEQ ID NO: 4505606 - DNA, 14 bp, Homo sapiens
tccccatctgtcca

SEQ ID NO: 4505607 - DNA, 17 bp, Homo sapiens
tccccatctgtccagct

SEQ ID NO: 4505608 - DNA, 19 bp, Homo sapiens
tccccatcttctaaaccca

SEQ ID NO: 4505609 - DNA, 11 bp, Homo sapiens
tccccatggga

SEQ ID NO: 4505610 - DNA, 15 bp, Homo sapiens
tccccattctgtgtc

SEQ ID NO: 4505611 - DNA, 15 bp, Homo sapiens
tccccatttcccatc

SEQ ID NO: 4505612 - DNA, 17 bp, Homo sapiens
tccccatttcccatctg

SEQ ID NO: 4505613 - DNA, 23 bp, Homo sapiens
tcccccaaacatctggcatggct

SEQ ID NO: 4505614 - DNA, 16 bp, Homo sapiens
tcccccaacccccacc

SEQ ID NO: 4505615 - DNA, 18 bp, Homo sapiens
tcccccacctactctcag

SEQ ID NO: 4505616 - DNA, 12 bp, Homo sapiens
tcccccagagca

SEQ ID NO: 4505617 - DNA, 21 bp, Homo sapiens
tcccccagagcatctgcccca

SEQ ID NO: 4505618 - DNA, 13 bp, Homo sapiens
tcccccagcaagc

SEQ ID NO: 4505619 - DNA, 16 bp, Homo sapiens
tcccccaggaggcagc

SEQ ID NO: 4505620 - DNA, 15 bp, Homo sapiens
tcccccatccctacc

SEQ ID NO: 4505621 - DNA, 18 bp, Homo sapiens
tcccccatccctaccact

SEQ ID NO: 4505622 - DNA, 21 bp, Homo sapiens
tccccccagaccccgcccctg

SEQ ID NO: 4505623 - DNA, 20 bp, Homo sapiens
tcccccgtggtgcctgcaca

SEQ ID NO: 4505624 - DNA, 14 bp, Homo sapiens
tccccctccccagg

SEQ ID NO: 4505625 - DNA, 21 bp, Homo sapiens
tccccctccccaggctggaga

SEQ ID NO: 4505626 - DNA, 17 bp, Homo sapiens
tccccctcccccattcc

SEQ ID NO: 4505627 - DNA, 20 bp, Homo sapiens
tccccctcctcagccagcct

SEQ ID NO: 4505628 - DNA, 15 bp, Homo sapiens
tccccctctgtccag

SEQ ID NO: 4505629 - DNA, 16 bp, Homo sapiens
tcccccttgccacccc

SEQ ID NO: 4505630 - DNA, 23 bp, Homo sapiens
tccccgaggagctgggcccctgc

SEQ ID NO: 4505631 - DNA, 23 bp, Homo sapiens
tccccgataccatgctgtaagga

SEQ ID NO: 4505632 - DNA, 21 bp, Homo sapiens
tccccgcagcccgcctgccgt

SEQ ID NO: 4505633 - DNA, 15 bp, Homo sapiens
tccccgcctccactc

SEQ ID NO: 4505634 - DNA, 17 bp, Homo sapiens
tccccgcctccactcta

SEQ ID NO: 4505635 - DNA, 14 bp, Homo sapiens
tccccgctctggat

SEQ ID NO: 4505636 - DNA, 20 bp, Homo sapiens
tcccctaagcagaccactga

SEQ ID NO: 4505637 - DNA, 16 bp, Homo sapiens
tcccctagatccagaa

SEQ ID NO: 4505638 - DNA, 17 bp, Homo sapiens
tcccctagtaagtgcct

SEQ ID NO: 4505639 - DNA, 21 bp, Homo sapiens
tcccctatccacccagcccat

SEQ ID NO: 4505640 - DNA, 16 bp, Homo sapiens
tcccctcactctgtca

SEQ ID NO: 4505641 - DNA, 19 bp, Homo sapiens
tcccctcactgatggacaa

SEQ ID NO: 4505642 - DNA, 16 bp, Homo sapiens
tcccctcaggactgca

SEQ ID NO: 4505643 - DNA, 15 bp, Homo sapiens
tcccctcccccatcc

SEQ ID NO: 4505644 - DNA, 15 bp, Homo sapiens
tcccctccctggctc

SEQ ID NO: 4505645 - DNA, 20 bp, Homo sapiens
tcccctcctcttcccttagc

SEQ ID NO: 4505646 - DNA, 18 bp, Homo sapiens
tcccctctcgccccatcc

SEQ ID NO: 4505647 - DNA, 13 bp, Homo sapiens
tcccctctgcttc

SEQ ID NO: 4505648 - DNA, 19 bp, Homo sapiens
tcccctgaggacctttctg

SEQ ID NO: 4505649 - DNA, 20 bp, Homo sapiens
tcccctgccagggcagggcc

SEQ ID NO: 4505650 - DNA, 13 bp, Homo sapiens
tcccctgccccca

SEQ ID NO: 4505651 - DNA, 18 bp, Homo sapiens
tcccctgcccccaggact

SEQ ID NO: 4505652 - DNA, 22 bp, Homo sapiens
tcccctgcccccaggactgggc

SEQ ID NO: 4505653 - DNA, 17 bp, Homo sapiens
tcccctgcccctcacaa

SEQ ID NO: 4505654 - DNA, 19 bp, Homo sapiens
tcccctgctactcctgtgc

SEQ ID NO: 4505655 - DNA, 23 bp, Homo sapiens
tcccctgctactcctgtgctctg

SEQ ID NO: 4505656 - DNA, 19 bp, Homo sapiens
tcccctgctgaccttggag

SEQ ID NO: 4505657 - DNA, 15 bp, Homo sapiens
tcccctggcactggc

SEQ ID NO: 4505658 - DNA, 12 bp, Homo sapiens
tcccctggctgg

SEQ ID NO: 4505659 - DNA, 16 bp, Homo sapiens
tcccctggctggctcc

SEQ ID NO: 4505660 - DNA, 18 bp, Homo sapiens
tcccctggctggctccta

SEQ ID NO: 4505661 - DNA, 21 bp, Homo sapiens
tcccctgggcatcttctggct

SEQ ID NO: 4505662 - DNA, 13 bp, Homo sapiens
tccccttccactg

SEQ ID NO: 4505663 - DNA, 12 bp, Homo sapiens
tccccttcccct

SEQ ID NO: 4505664 - DNA, 11 bp, Homo sapiens
tccccttccct

SEQ ID NO: 4505665 - DNA, 12 bp, Homo sapiens
tccccttccctt

SEQ ID NO: 4505666 - DNA, 10 bp, Homo sapiens
tccccttcct

SEQ ID NO: 4505667 - DNA, 11 bp, Homo sapiens
tccccttcctg

SEQ ID NO: 4505668 - DNA, 15 bp, Homo sapiens
tccccttcctggcac

SEQ ID NO: 4505669 - DNA, 16 bp, Homo sapiens
tccccttctctcatct

SEQ ID NO: 4505670 - DNA, 19 bp, Homo sapiens
tcccgagtagctgggacta

SEQ ID NO: 4505671 - DNA, 15 bp, Homo sapiens
tcccgccactcgcct

SEQ ID NO: 4505672 - DNA, 17 bp, Homo sapiens
tcccgcctccctctcag

SEQ ID NO: 4505673 - DNA, 18 bp, Homo sapiens
tcccgcctccctctcaga

SEQ ID NO: 4505674 - DNA, 9 bp, Homo sapiens
tcccgctcc

SEQ ID NO: 4505675 - DNA, 19 bp, Homo sapiens
tcccggcccccggccaagg

SEQ ID NO: 4505676 - DNA, 21 bp, Homo sapiens
tcccgggagctgggccctgcc

SEQ ID NO: 4505677 - DNA, 22 bp, Homo sapiens
tcccgggagctgggccctgcct

SEQ ID NO: 4505678 - DNA, 16 bp, Homo sapiens
tcccggggccagcact

SEQ ID NO: 4505679 - DNA, 14 bp, Homo sapiens
tcccggggcctgga

SEQ ID NO: 4505680 - DNA, 16 bp, Homo sapiens
tcccggtaccttccat

SEQ ID NO: 4505681 - DNA, 19 bp, Homo sapiens
tcccggttcagacccctgc

SEQ ID NO: 4505682 - DNA, 20 bp, Homo sapiens
tcccggttcagacccctgcc

SEQ ID NO: 4505683 - DNA, 21 bp, Homo sapiens
tcccgtatcacagtgttttta

SEQ ID NO: 4505684 - DNA, 20 bp, Homo sapiens
tcccgtcacccctgtttctg

SEQ ID NO: 4505685 - DNA, 13 bp, Homo sapiens
tcccttcccacat

SEQ ID NO: 4505686 - DNA, 20 bp, Homo sapiens
tcccttcccacatgcctgcg

SEQ ID NO: 4505687 - DNA, 12 bp, Homo sapiens
tcccttcccctc

SEQ ID NO: 4505688 - DNA, 14 bp, Homo sapiens
tcccttcctctctc

SEQ ID NO: 4505689 - DNA, 19 bp, Homo sapiens
tcccttccttcctctcctg

SEQ ID NO: 4505690 - DNA, 16 bp, Homo sapiens
tcccttctcatctccc

SEQ ID NO: 4505691 - DNA, 13 bp, Homo sapiens
tcccttctgtagt

SEQ ID NO: 4505692 - DNA, 19 bp, Homo sapiens
tcccttgaccattggctgc

SEQ ID NO: 4505693 - DNA, 17 bp, Homo sapiens
tcccttgagacctcagc

SEQ ID NO: 4505694 - DNA, 20 bp, Homo sapiens
tcccttgcaggggtcccccc

SEQ ID NO: 4505695 - DNA, 21 bp, Homo sapiens
tcccttgcaggggtcccccct

SEQ ID NO: 4505696 - DNA, 22 bp, Homo sapiens
tcccttgcctctgccctggatt

SEQ ID NO: 4505697 - DNA, 18 bp, Homo sapiens
tcccttgccttcctcagc

SEQ ID NO: 4505698 - DNA, 16 bp, Homo sapiens
tcccttggacatttta

SEQ ID NO: 4505699 - DNA, 19 bp, Homo sapiens
tcccttggacattttatgt

SEQ ID NO: 4505700 - DNA, 13 bp, Homo sapiens
tcccttggcctca

SEQ ID NO: 4505701 - DNA, 19 bp, Homo sapiens
tcccttgtgtcaagacatt

SEQ ID NO: 4505702 - DNA, 21 bp, Homo sapiens
tcccttgtgtcaagacatttc

SEQ ID NO: 4505703 - DNA, 18 bp, Homo sapiens
tccctttccttccatccc

SEQ ID NO: 4505704 - DNA, 23 bp, Homo sapiens
tccctttccttccatccctaccc

SEQ ID NO: 4505705 - DNA, 13 bp, Homo sapiens
tccctttctcagg

SEQ ID NO: 4505706 - DNA, 14 bp, Homo sapiens
tccctttctcccct

SEQ ID NO: 4505707 - DNA, 15 bp, Homo sapiens
tccctttctcccctg

SEQ ID NO: 4505708 - DNA, 23 bp, Homo sapiens
tccctttctcccctgcccccagg

SEQ ID NO: 4505709 - DNA, 17 bp, Homo sapiens
tccctttctctctcctc

SEQ ID NO: 4505710 - DNA, 18 bp, Homo sapiens
tccctttctctctcctct

SEQ ID NO: 4505711 - DNA, 21 bp, Homo sapiens
tccctttctctctcctctctg

SEQ ID NO: 4505712 - DNA, 17 bp, Homo sapiens
tccctttgcccagaaag

SEQ ID NO: 4505713 - DNA, 17 bp, Homo sapiens
tccctttgtctttcaaa

SEQ ID NO: 4505714 - DNA, 13 bp, Homo sapiens
tccctttgtgtat

SEQ ID NO: 4505715 - DNA, 12 bp, Homo sapiens
tccctttttcat

SEQ ID NO: 4505716 - DNA, 16 bp, Homo sapiens
tccctttttcataatt

SEQ ID NO: 4505717 - DNA, 19 bp, Homo sapiens
tccctttttttacatttca

SEQ ID NO: 4505718 - DNA, 18 bp, Homo sapiens
tccgaccacttccagggg

SEQ ID NO: 4505719 - DNA, 15 bp, Homo sapiens
tccgagagggagaga

SEQ ID NO: 4505720 - DNA, 17 bp, Homo sapiens
tccgagcctccagtcca

SEQ ID NO: 4505721 - DNA, 21 bp, Homo sapiens
tccgaggacccaggaaaggca

SEQ ID NO: 4505722 - DNA, 15 bp, Homo sapiens
tccgaggctccccgc

SEQ ID NO: 4505723 - DNA, 14 bp, Homo sapiens
tccgatggtatctg

SEQ ID NO: 4505724 - DNA, 17 bp, Homo sapiens
tccgcaccctgtcctgc

SEQ ID NO: 4505725 - DNA, 18 bp, Homo sapiens
tccgcaccctgtcctgca

SEQ ID NO: 4505726 - DNA, 15 bp, Homo sapiens
tccgcagaagccctg

SEQ ID NO: 4505727 - DNA, 12 bp, Homo sapiens
tccgccagcctc

SEQ ID NO: 4505728 - DNA, 15 bp, Homo sapiens
tccgccagcctcctc

SEQ ID NO: 4505729 - DNA, 18 bp, Homo sapiens
tccgcctacctcagcctc

SEQ ID NO: 4505730 - DNA, 19 bp, Homo sapiens
tccgcctgggtcatgggcc

SEQ ID NO: 4505731 - DNA, 20 bp, Homo sapiens
tccgcctgggtcatgggcct

SEQ ID NO: 4505732 - DNA, 19 bp, Homo sapiens
tccgctgaagatggagggg

SEQ ID NO: 4505733 - DNA, 16 bp, Homo sapiens
tccgctgtcgccccag

SEQ ID NO: 4505734 - DNA, 18 bp, Homo sapiens
tccggacactcctagaga

SEQ ID NO: 4505735 - DNA, 16 bp, Homo sapiens
tccggcccagtgccac

SEQ ID NO: 4505736 - DNA, 19 bp, Homo sapiens
tccggccccgtctctcttg

SEQ ID NO: 4505737 - DNA, 16 bp, Homo sapiens
tccggcctctccctgc

SEQ ID NO: 4505738 - DNA, 20 bp, Homo sapiens
tccggcctctccctgcctgt

SEQ ID NO: 4505739 - DNA, 15 bp, Homo sapiens
tccggcgtcagcctc

SEQ ID NO: 4505740 - DNA, 19 bp, Homo sapiens
tccggcgtcagcctccagc

SEQ ID NO: 4505741 - DNA, 15 bp, Homo sapiens
tccggctgtgctggg

SEQ ID NO: 4505742 - DNA, 13 bp, Homo sapiens
tccgggaaaacag

SEQ ID NO: 4505743 - DNA, 16 bp, Homo sapiens
tccgggaaaacagcta

SEQ ID NO: 4505744 - DNA, 21 bp, Homo sapiens
tccgggacctggtgctgcctc

SEQ ID NO: 4505745 - DNA, 20 bp, Homo sapiens
tccgggggggcccatctctt

SEQ ID NO: 4505746 - DNA, 18 bp, Homo sapiens
tccgggtgtggcctcagc

SEQ ID NO: 4505747 - DNA, 20 bp, Homo sapiens
tccgggtgtggcctcagccc

SEQ ID NO: 4505748 - DNA, 23 bp, Homo sapiens
tccgtagctcccctggctggctc

SEQ ID NO: 4505749 - DNA, 17 bp, Homo sapiens
tccgtaggacaagtttt

SEQ ID NO: 4505750 - DNA, 15 bp, Homo sapiens
tccgtcaagctggtt

SEQ ID NO: 4505751 - DNA, 15 bp, Homo sapiens
tccgtcagcttctcc

SEQ ID NO: 4505752 - DNA, 21 bp, Homo sapiens
tccgtccatccgactgcccct

SEQ ID NO: 4505753 - DNA, 16 bp, Homo sapiens
tccgtgagacacaaga

SEQ ID NO: 4505754 - DNA, 22 bp, Homo sapiens
tccgtgagcaccaccagggctc

SEQ ID NO: 4505755 - DNA, 14 bp, Homo sapiens
tccgtgcttaacca

SEQ ID NO: 4505756 - DNA, 21 bp, Homo sapiens
tccgtgcttaaccaaagaagc

SEQ ID NO: 4505757 - DNA, 13 bp, Homo sapiens
tccgtgtggagca

SEQ ID NO: 4505758 - DNA, 16 bp, Homo sapiens
tccgtgtggagcacgt

SEQ ID NO: 4505759 - DNA, 13 bp, Homo sapiens
tccgtgtgtttat

SEQ ID NO: 4505760 - DNA, 16 bp, Homo sapiens
tccgttcacatgtgtg

SEQ ID NO: 4505761 - DNA, 23 bp, Homo sapiens
tcctaaaactgggattaagaaac

SEQ ID NO: 4505762 - DNA, 14 bp, Homo sapiens
tcctaaaagcaaaa

SEQ ID NO: 4505763 - DNA, 21 bp, Homo sapiens
tcctaaacatcattcattttt

SEQ ID NO: 4505764 - DNA, 10 bp, Homo sapiens
tcctaaactc

SEQ ID NO: 4505765 - DNA, 17 bp, Homo sapiens
tcctaaactctctagct

SEQ ID NO: 4505766 - DNA, 20 bp, Homo sapiens
tcctaaagctgaatcccggc

SEQ ID NO: 4505767 - DNA, 12 bp, Homo sapiens
tcctaagacatt

SEQ ID NO: 4505768 - DNA, 14 bp, Homo sapiens
tcctaagacatttt

SEQ ID NO: 4505769 - DNA, 17 bp, Homo sapiens
tcctaagacatttttca

SEQ ID NO: 4505770 - DNA, 14 bp, Homo sapiens
tcctaagcctaaaa

SEQ ID NO: 4505771 - DNA, 14 bp, Homo sapiens
tcctaatactgtca

SEQ ID NO: 4505772 - DNA, 17 bp, Homo sapiens
tcctaatggctattttt

SEQ ID NO: 4505773 - DNA, 23 bp, Homo sapiens
tcctacaaagacgcaaggtgtgc

SEQ ID NO: 4505774 - DNA, 18 bp, Homo sapiens
tcctacaagagcagcctg

SEQ ID NO: 4505775 - DNA, 19 bp, Homo sapiens
tcctacaagagcagcctgt

SEQ ID NO: 4505776 - DNA, 22 bp, Homo sapiens
tcctacaagagcagcctgtggc

SEQ ID NO: 4505777 - DNA, 17 bp, Homo sapiens
tcctacaggcagtctct

SEQ ID NO: 4505778 - DNA, 19 bp, Homo sapiens
tcctacaggcagtctctct

SEQ ID NO: 4505779 - DNA, 19 bp, Homo sapiens
tcctacaggcctatttaac

SEQ ID NO: 4505780 - DNA, 16 bp, Homo sapiens
tcctaccatcagctct

SEQ ID NO: 4505781 - DNA, 20 bp, Homo sapiens
tcctaccatcagctctgcct

SEQ ID NO: 4505782 - DNA, 14 bp, Homo sapiens
tcctaccctcccac

SEQ ID NO: 4505783 - DNA, 15 bp, Homo sapiens
tcctaccctcccacc

SEQ ID NO: 4505784 - DNA, 17 bp, Homo sapiens
tcctaccctcccaccag

SEQ ID NO: 4505785 - DNA, 13 bp, Homo sapiens
tcctaccgtcttt

SEQ ID NO: 4505786 - DNA, 20 bp, Homo sapiens
tcctagaagaaccaaatacc

SEQ ID NO: 4505787 - DNA, 18 bp, Homo sapiens
tcctagagaacgcagccc

SEQ ID NO: 4505788 - DNA, 23 bp, Homo sapiens
tcctagagaacgcagccctagag

SEQ ID NO: 4505789 - DNA, 21 bp, Homo sapiens
tcctagattacatctgcctta

SEQ ID NO: 4505790 - DNA, 23 bp, Homo sapiens
tcctagcaagtaagaatggccaa

SEQ ID NO: 4505791 - DNA, 17 bp, Homo sapiens
tcctagcaccctggaga

SEQ ID NO: 4505792 - DNA, 15 bp, Homo sapiens
tcctagctctcccag

SEQ ID NO: 4505793 - DNA, 18 bp, Homo sapiens
tcctagctctcccagtga

SEQ ID NO: 4505794 - DNA, 17 bp, Homo sapiens
tcctagctgcacagggc

SEQ ID NO: 4505795 - DNA, 20 bp, Homo sapiens
tcctagctgcacagggcagc

SEQ ID NO: 4505796 - DNA, 18 bp, Homo sapiens
tcctaggacttaaaatta

SEQ ID NO: 4505797 - DNA, 22 bp, Homo sapiens
tcctaggccacgtccaggtccg

SEQ ID NO: 4505798 - DNA, 19 bp, Homo sapiens
tcctagtgtttctttgtgg

SEQ ID NO: 4505799 - DNA, 20 bp, Homo sapiens
tcctataagcttaaatagga

SEQ ID NO: 4505800 - DNA, 21 bp, Homo sapiens
tcctataagcttaaataggaa

SEQ ID NO: 4505801 - DNA, 19 bp, Homo sapiens
tcctatacgcagcgtgctt

SEQ ID NO: 4505802 - DNA, 14 bp, Homo sapiens
tcctatatatttct

SEQ ID NO: 4505803 - DNA, 16 bp, Homo sapiens
tcctatatatttctat

SEQ ID NO: 4505804 - DNA, 19 bp, Homo sapiens
tcctatcacctatttccat

SEQ ID NO: 4505805 - DNA, 23 bp, Homo sapiens
tcctatctagcatttatttctct

SEQ ID NO: 4505806 - DNA, 13 bp, Homo sapiens
tcctatctgtgtt

SEQ ID NO: 4505807 - DNA, 21 bp, Homo sapiens
tcctatgctattgacaataaa

SEQ ID NO: 4505808 - DNA, 19 bp, Homo sapiens
tcctattagtgacttttca

SEQ ID NO: 4505809 - DNA, 20 bp, Homo sapiens
tcctattctgatgaatctca

SEQ ID NO: 4505810 - DNA, 17 bp, Homo sapiens
tcctatttaaagacctg

SEQ ID NO: 4505811 - DNA, 23 bp, Homo sapiens
tcctattttcgatgaagttctga

SEQ ID NO: 4505812 - DNA, 22 bp, Homo sapiens
tcctatttttttaaaatcacta

SEQ ID NO: 4505813 - DNA, 20 bp, Homo sapiens
tcctcaaaaagcagaaggag

SEQ ID NO: 4505814 - DNA, 20 bp, Homo sapiens
tcctcaaaacttcagacata

SEQ ID NO: 4505815 - DNA, 14 bp, Homo sapiens
tcctcaaacaacac

SEQ ID NO: 4505816 - DNA, 18 bp, Homo sapiens
tcctcaaacgacagagga

SEQ ID NO: 4505817 - DNA, 15 bp, Homo sapiens
tcctcaaagaaagtg

SEQ ID NO: 4505818 - DNA, 14 bp, Homo sapiens
tcctcaaagcctca

SEQ ID NO: 4505819 - DNA, 15 bp, Homo sapiens
tcctcaaagcctcaa

SEQ ID NO: 4505820 - DNA, 15 bp, Homo sapiens
tcctcaacagtgttt

SEQ ID NO: 4505821 - DNA, 13 bp, Homo sapiens
tcctcaatccagc

SEQ ID NO: 4505822 - DNA, 15 bp, Homo sapiens
tcctcacacttttgg

SEQ ID NO: 4505823 - DNA, 19 bp, Homo sapiens
tcctcacagtcccactgtg

SEQ ID NO: 4505824 - DNA, 22 bp, Homo sapiens
tcctcaccagtcccatgctggc

SEQ ID NO: 4505825 - DNA, 12 bp, Homo sapiens
tcctcacctctg

SEQ ID NO: 4505826 - DNA, 12 bp, Homo sapiens
tcctcactccca

SEQ ID NO: 4505827 - DNA, 13 bp, Homo sapiens
tcctcactcccag

SEQ ID NO: 4505828 - DNA, 14 bp, Homo sapiens
tcctcagagcgcca

SEQ ID NO: 4505829 - DNA, 15 bp, Homo sapiens
tcctcagagcgccag

SEQ ID NO: 4505830 - DNA, 17 bp, Homo sapiens
tcctcagagcgccagga

SEQ ID NO: 4505831 - DNA, 10 bp, Homo sapiens
tcctcagcca

SEQ ID NO: 4505832 - DNA, 17 bp, Homo sapiens
tcctcagccagcctcct

SEQ ID NO: 4505833 - DNA, 12 bp, Homo sapiens
tcctcagctcta

SEQ ID NO: 4505834 - DNA, 14 bp, Homo sapiens
tcctcagctgcctc

SEQ ID NO: 4505835 - DNA, 14 bp, Homo sapiens
tcctcaggcccagc

SEQ ID NO: 4505836 - DNA, 21 bp, Homo sapiens
tcctcagggagcagggaaggc

SEQ ID NO: 4505837 - DNA, 22 bp, Homo sapiens
tcctcagtggcttctccaggga

SEQ ID NO: 4505838 - DNA, 12 bp, Homo sapiens
tcctcatccctg

SEQ ID NO: 4505839 - DNA, 13 bp, Homo sapiens
tcctcatccctga

SEQ ID NO: 4505840 - DNA, 17 bp, Homo sapiens
tcctcatctatggttct

SEQ ID NO: 4505841 - DNA, 20 bp, Homo sapiens
tcctcattaatagctgcctt

SEQ ID NO: 4505842 - DNA, 15 bp, Homo sapiens
tcctccacagagagg

SEQ ID NO: 4505843 - DNA, 22 bp, Homo sapiens
tcctccacgttctgctcatcat

SEQ ID NO: 4505844 - DNA, 13 bp, Homo sapiens
tcctccagagaca

SEQ ID NO: 4505845 - DNA, 21 bp, Homo sapiens
tcctccagagacactgagcca

SEQ ID NO: 4505846 - DNA, 13 bp, Homo sapiens
tcctccagcctcc

SEQ ID NO: 4505847 - DNA, 13 bp, Homo sapiens
tcctccagggcca

SEQ ID NO: 4505848 - DNA, 17 bp, Homo sapiens
tcctcccaagtggtgcc

SEQ ID NO: 4505849 - DNA, 14 bp, Homo sapiens
tcctcccagcattg

SEQ ID NO: 4505850 - DNA, 19 bp, Homo sapiens
tcctcccaggaagcccagg

SEQ ID NO: 4505851 - DNA, 12 bp, Homo sapiens
tcctcccagtga

SEQ ID NO: 4505852 - DNA, 13 bp, Homo sapiens
tcctcccagtgag

SEQ ID NO: 4505853 - DNA, 23 bp, Homo sapiens
tcctcccagtgagactgccccac

SEQ ID NO: 4505854 - DNA, 21 bp, Homo sapiens
tcctccccaaatcaatacact

SEQ ID NO: 4505855 - DNA, 13 bp, Homo sapiens
tcctccccagagc

SEQ ID NO: 4505856 - DNA, 14 bp, Homo sapiens
tcctccccctgcca

SEQ ID NO: 4505857 - DNA, 20 bp, Homo sapiens
tcctccccctgccagtgcct

SEQ ID NO: 4505858 - DNA, 16 bp, Homo sapiens
tcctcccctcctcttc

SEQ ID NO: 4505859 - DNA, 18 bp, Homo sapiens
tcctcccctcctcttccc

SEQ ID NO: 4505860 - DNA, 20 bp, Homo sapiens
tcctcccgaaaaatgtgtgg

SEQ ID NO: 4505861 - DNA, 14 bp, Homo sapiens
tcctccctcagacc

SEQ ID NO: 4505862 - DNA, 18 bp, Homo sapiens
tcctccctcagacccagc

SEQ ID NO: 4505863 - DNA, 16 bp, Homo sapiens
tcctccctcagactca

SEQ ID NO: 4505864 - DNA, 17 bp, Homo sapiens
tcctccctcagactcag

SEQ ID NO: 4505865 - DNA, 23 bp, Homo sapiens
tcctccctcagactcagaggtcc

SEQ ID NO: 4505866 - DNA, 20 bp, Homo sapiens
tcctccctcatggctctggc

SEQ ID NO: 4505867 - DNA, 17 bp, Homo sapiens
tcctccctgacttttct

SEQ ID NO: 4505868 - DNA, 18 bp, Homo sapiens
tcctcccttccttttccc

SEQ ID NO: 4505869 - DNA, 22 bp, Homo sapiens
tcctcccttccttttccctgct

SEQ ID NO: 4505870 - DNA, 14 bp, Homo sapiens
tcctccgaggccag

SEQ ID NO: 4505871 - DNA, 13 bp, Homo sapiens
tcctcctcaccct

SEQ ID NO: 4505872 - DNA, 20 bp, Homo sapiens
tcctcctcacccttcccggc

SEQ ID NO: 4505873 - DNA, 12 bp, Homo sapiens
tcctcctcacct

SEQ ID NO: 4505874 - DNA, 21 bp, Homo sapiens
tcctcctccaaaggcccccta

SEQ ID NO: 4505875 - DNA, 15 bp, Homo sapiens
tcctcctcccctcct

SEQ ID NO: 4505876 - DNA, 16 bp, Homo sapiens
tcctcctcccctcctc

SEQ ID NO: 4505877 - DNA, 14 bp, Homo sapiens
tcctcctctgccta

SEQ ID NO: 4505878 - DNA, 15 bp, Homo sapiens
tcctcctctgcctac

SEQ ID NO: 4505879 - DNA, 22 bp, Homo sapiens
tcctcctctgcctacagccagg

SEQ ID NO: 4505880 - DNA, 13 bp, Homo sapiens
tcctcctctgtga

SEQ ID NO: 4505881 - DNA, 13 bp, Homo sapiens
tcctcctgcagac

SEQ ID NO: 4505882 - DNA, 23 bp, Homo sapiens
tcctcctgcagacacctggactg

SEQ ID NO: 4505883 - DNA, 12 bp, Homo sapiens
tcctcctgctca

SEQ ID NO: 4505884 - DNA, 14 bp, Homo sapiens
tcctcctgggccct

SEQ ID NO: 4505885 - DNA, 15 bp, Homo sapiens
tcctcctgggccctc

SEQ ID NO: 4505886 - DNA, 12 bp, Homo sapiens
tcctcctgggct

SEQ ID NO: 4505887 - DNA, 17 bp, Homo sapiens
tcctcctgggctccaga

SEQ ID NO: 4505888 - DNA, 20 bp, Homo sapiens
tcctcctggtgggtccaggg

SEQ ID NO: 4505889 - DNA, 21 bp, Homo sapiens
tcctcctggtgggtccagggg

SEQ ID NO: 4505890 - DNA, 22 bp, Homo sapiens
tcctcctggtgggtccaggggc

SEQ ID NO: 4505891 - DNA, 24 bp, Homo sapiens
tcctccttgcccagactacagggc

SEQ ID NO: 4505892 - DNA, 14 bp, Homo sapiens
tcctcctttttcca

SEQ ID NO: 4505893 - DNA, 16 bp, Homo sapiens
tcctcgagatcccaac

SEQ ID NO: 4505894 - DNA, 23 bp, Homo sapiens
tcctcgagatcccaacactgcca

SEQ ID NO: 4505895 - DNA, 18 bp, Homo sapiens
tcctcggagagcagcagc

SEQ ID NO: 4505896 - DNA, 16 bp, Homo sapiens
tcctcggatcaccgag

SEQ ID NO: 4505897 - DNA, 23 bp, Homo sapiens
tcctcggtcgccccgtgtttgcg

SEQ ID NO: 4505898 - DNA, 19 bp, Homo sapiens
tcctctagaagccaaggga

SEQ ID NO: 4505899 - DNA, 15 bp, Homo sapiens
tcctctatggaagga

SEQ ID NO: 4505900 - DNA, 20 bp, Homo sapiens
tcctctcaaattcagctctg

SEQ ID NO: 4505901 - DNA, 20 bp, Homo sapiens
tcctctcccacagagtgctg

SEQ ID NO: 4505902 - DNA, 19 bp, Homo sapiens
tcctctccccctcctccag

SEQ ID NO: 4505903 - DNA, 14 bp, Homo sapiens
tcctctcccctttg

SEQ ID NO: 4505904 - DNA, 16 bp, Homo sapiens
tcctctccctgccaag

SEQ ID NO: 4505905 - DNA, 17 bp, Homo sapiens
tcctctccctgccaagt

SEQ ID NO: 4505906 - DNA, 12 bp, Homo sapiens
tcctctcctgga

SEQ ID NO: 4505907 - DNA, 13 bp, Homo sapiens
tcctctcctggag

SEQ ID NO: 4505908 - DNA, 23 bp, Homo sapiens
tcctctcctttgaaacctgctct

SEQ ID NO: 4505909 - DNA, 15 bp, Homo sapiens
tcctctcgagcccag

SEQ ID NO: 4505910 - DNA, 11 bp, Homo sapiens
tcctctcttcc

SEQ ID NO: 4505911 - DNA, 16 bp, Homo sapiens
tcctctcttccacagt

SEQ ID NO: 4505912 - DNA, 17 bp, Homo sapiens
tcctctcttccacagtg

SEQ ID NO: 4505913 - DNA, 19 bp, Homo sapiens
tcctctcttccacagtggc

SEQ ID NO: 4505914 - DNA, 13 bp, Homo sapiens
tcctctgaaacag

SEQ ID NO: 4505915 - DNA, 15 bp, Homo sapiens
tcctctgaaacagct

SEQ ID NO: 4505916 - DNA, 16 bp, Homo sapiens
tcctctgaaacagctg

SEQ ID NO: 4505917 - DNA, 20 bp, Homo sapiens
tcctctgaaacagctgcctt

SEQ ID NO: 4505918 - DNA, 21 bp, Homo sapiens
tcctctgaatttaattctttc

SEQ ID NO: 4505919 - DNA, 22 bp, Homo sapiens
tcctctgaatttaattctttca

SEQ ID NO: 4505920 - DNA, 23 bp, Homo sapiens
tcctctgaatttaattctttcaa

SEQ ID NO: 4505921 - DNA, 20 bp, Homo sapiens
tcctctgatagctgtttcaa

SEQ ID NO: 4505922 - DNA, 22 bp, Homo sapiens
tcctctgatagctgtttcaaat

SEQ ID NO: 4505923 - DNA, 18 bp, Homo sapiens
tcctctgatttacattca

SEQ ID NO: 4505924 - DNA, 15 bp, Homo sapiens
tcctctgcagtgcct

SEQ ID NO: 4505925 - DNA, 20 bp, Homo sapiens
tcctctgcctacagccaggt

SEQ ID NO: 4505926 - DNA, 20 bp, Homo sapiens
tctcaaaaaaaagaaaatgt

SEQ ID NO: 4505927 - DNA, 23 bp, Homo sapiens
tctcaaaaaaaagaaaatgtctt

SEQ ID NO: 4505928 - DNA, 24 bp, Homo sapiens
tctcaaaacaatattactttgtct

SEQ ID NO: 4505929 - DNA, 22 bp, Homo sapiens
tctcaaaatggtgtgctataaa

SEQ ID NO: 4505930 - DNA, 15 bp, Homo sapiens
tctcaaacttgtggc

SEQ ID NO: 4505931 - DNA, 19 bp, Homo sapiens
tctcaaacttgtggcctca

SEQ ID NO: 4505932 - DNA, 22 bp, Homo sapiens
tctcaaagcataaaatggaata

SEQ ID NO: 4505933 - DNA, 16 bp, Homo sapiens
tctcaaagtaaggctg

SEQ ID NO: 4505934 - DNA, 17 bp, Homo sapiens
tctcaaattcagctctg

SEQ ID NO: 4505935 - DNA, 20 bp, Homo sapiens
tctcaagcgctatccacaga

SEQ ID NO: 4505936 - DNA, 22 bp, Homo sapiens
tctcaagcgctatccacagaac

SEQ ID NO: 4505937 - DNA, 15 bp, Homo sapiens
tctcaaggagaggca

SEQ ID NO: 4505938 - DNA, 14 bp, Homo sapiens
tctcaagtaatata

SEQ ID NO: 4505939 - DNA, 21 bp, Homo sapiens
tctcaagtcaaggaagctggg

SEQ ID NO: 4505940 - DNA, 23 bp, Homo sapiens
tctcaatcctaatttctcctccc

SEQ ID NO: 4505941 - DNA, 18 bp, Homo sapiens
tctcaattgaaagctttt

SEQ ID NO: 4505942 - DNA, 20 bp, Homo sapiens
tctcaattgaaagcttttaa

SEQ ID NO: 4505943 - DNA, 18 bp, Homo sapiens
tctcacactctaactgta

SEQ ID NO: 4505944 - DNA, 19 bp, Homo sapiens
tctcacactggtctgctgt

SEQ ID NO: 4505945 - DNA, 18 bp, Homo sapiens
tctcacaggctgagaact

SEQ ID NO: 4505946 - DNA, 20 bp, Homo sapiens
tctcaccagcagtcgtgggg

SEQ ID NO: 4505947 - DNA, 15 bp, Homo sapiens
tctcaccagctgcaa

SEQ ID NO: 4505948 - DNA, 18 bp, Homo sapiens
tctcaccagctgcaaagt

SEQ ID NO: 4505949 - DNA, 19 bp, Homo sapiens
tctcacccccatccctggg

SEQ ID NO: 4505950 - DNA, 21 bp, Homo sapiens
tctcacctaatggttgtacat

SEQ ID NO: 4505951 - DNA, 13 bp, Homo sapiens
tctcacctggact

SEQ ID NO: 4505952 - DNA, 20 bp, Homo sapiens
tctcacgaaagtatttactt

SEQ ID NO: 4505953 - DNA, 20 bp, Homo sapiens
tctcacgctttgtttactct

SEQ ID NO: 4505954 - DNA, 14 bp, Homo sapiens
tctcactaaatctt

SEQ ID NO: 4505955 - DNA, 15 bp, Homo sapiens
tctcactcaaagaca

SEQ ID NO: 4505956 - DNA, 17 bp, Homo sapiens
tctcactccaccaccca

SEQ ID NO: 4505957 - DNA, 18 bp, Homo sapiens
tctcactcccctctcctc

SEQ ID NO: 4505958 - DNA, 19 bp, Homo sapiens
tctcactcccctctcctcc

SEQ ID NO: 4505959 - DNA, 22 bp, Homo sapiens
tctcactcccctctcctcccct

SEQ ID NO: 4505960 - DNA, 19 bp, Homo sapiens
tctcactgtttgtttttat

SEQ ID NO: 4505961 - DNA, 20 bp, Homo sapiens
tctcactttgacacccaggc

SEQ ID NO: 4505962 - DNA, 14 bp, Homo sapiens
tctcactttgtaaa

SEQ ID NO: 4505963 - DNA, 16 bp, Homo sapiens
tctcactttgtaaata

SEQ ID NO: 4505964 - DNA, 12 bp, Homo sapiens
tctcagaagcac

SEQ ID NO: 4505965 - DNA, 16 bp, Homo sapiens
tctcagaagcacagaa

SEQ ID NO: 4505966 - DNA, 15 bp, Homo sapiens
tctcagaccctgctt

SEQ ID NO: 4505967 - DNA, 21 bp, Homo sapiens
tctcagaccctgcttaggatg

SEQ ID NO: 4505968 - DNA, 14 bp, Homo sapiens
tctcagaggggcca

SEQ ID NO: 4505969 - DNA, 18 bp, Homo sapiens
tctcagagtccactgtgg

SEQ ID NO: 4505970 - DNA, 18 bp, Homo sapiens
tctcagagtgacagtcat

SEQ ID NO: 4505971 - DNA, 14 bp, Homo sapiens
tctcagatgttaaa

SEQ ID NO: 4505972 - DNA, 21 bp, Homo sapiens
tctcagatgttgaaactttga

SEQ ID NO: 4505973 - DNA, 14 bp, Homo sapiens
tctcagatttctga

SEQ ID NO: 4505974 - DNA, 16 bp, Homo sapiens
tctcagcccagaagaa

SEQ ID NO: 4505975 - DNA, 17 bp, Homo sapiens
tctcagctcactgcaac

SEQ ID NO: 4505976 - DNA, 19 bp, Homo sapiens
tctcaggaagtccagccac

SEQ ID NO: 4505977 - DNA, 16 bp, Homo sapiens
tctcaggacagcatcc

SEQ ID NO: 4505978 - DNA, 23 bp, Homo sapiens
tctcaggaccaaagctttcatgt

SEQ ID NO: 4505979 - DNA, 16 bp, Homo sapiens
tctcaggagcttgggc

SEQ ID NO: 4505980 - DNA, 16 bp, Homo sapiens
tctcaggagtctctgg

SEQ ID NO: 4505981 - DNA, 23 bp, Homo sapiens
tctcaggtggaggcaacagggcc

SEQ ID NO: 4505982 - DNA, 15 bp, Homo sapiens
tctcagtctctgagc

SEQ ID NO: 4505983 - DNA, 18 bp, Homo sapiens
tctcagtctctgagcagt

SEQ ID NO: 4505984 - DNA, 13 bp, Homo sapiens
tctcagtcttttc

SEQ ID NO: 4505985 - DNA, 21 bp, Homo sapiens
tctcagtgtcaatgcagcccc

SEQ ID NO: 4505986 - DNA, 16 bp, Homo sapiens
tctcagttctctccct

SEQ ID NO: 4505987 - DNA, 20 bp, Homo sapiens
tctcataattcctacagcac

SEQ ID NO: 4505988 - DNA, 16 bp, Homo sapiens
tctcataccctccctc

SEQ ID NO: 4505989 - DNA, 17 bp, Homo sapiens
tctcatagaacattgat

SEQ ID NO: 4505990 - DNA, 20 bp, Homo sapiens
tctcataggttgagcaattt

SEQ ID NO: 4505991 - DNA, 15 bp, Homo sapiens
tctcatccccagggg

SEQ ID NO: 4505992 - DNA, 13 bp, Homo sapiens
tctcatcctccca

SEQ ID NO: 4505993 - DNA, 18 bp, Homo sapiens
tctcatctccccacgccc

SEQ ID NO: 4505994 - DNA, 17 bp, Homo sapiens
tctcatctcttagctcc

SEQ ID NO: 4505995 - DNA, 15 bp, Homo sapiens
tctcatcttgtgaaa

SEQ ID NO: 4505996 - DNA, 13 bp, Homo sapiens
tctcatctttctt

SEQ ID NO: 4505997 - DNA, 22 bp, Homo sapiens
tctcatctttcttgatcaacat

SEQ ID NO: 4505998 - DNA, 12 bp, Homo sapiens
tctcatgcctcc

SEQ ID NO: 4505999 - DNA, 16 bp, Homo sapiens
tctcatgctccttaat

SEQ ID NO: 4506000 - DNA, 20 bp, Homo sapiens
tctcatggtacttcctctgt

SEQ ID NO: 4506001 - DNA, 14 bp, Homo sapiens
tctcatgtctcccc

SEQ ID NO: 4506002 - DNA, 16 bp, Homo sapiens
tctcattccagaggaa

SEQ ID NO: 4506003 - DNA, 16 bp, Homo sapiens
tctcattccccaggtg

SEQ ID NO: 4506004 - DNA, 16 bp, Homo sapiens
tctcatttcacccctc

SEQ ID NO: 4506005 - DNA, 16 bp, Homo sapiens
tctcatttgggcacct

SEQ ID NO: 4506006 - DNA, 16 bp, Homo sapiens
tctcatttgggctaga

SEQ ID NO: 4506007 - DNA, 18 bp, Homo sapiens
tctcattttaatgtaaag

SEQ ID NO: 4506008 - DNA, 20 bp, Homo sapiens
tctcattttaatgtaaagat

SEQ ID NO: 4506009 - DNA, 22 bp, Homo sapiens
tctcattttaatgtaaagattt

SEQ ID NO: 4506010 - DNA, 20 bp, Homo sapiens
tctccaaaaatctgcctggg

SEQ ID NO: 4506011 - DNA, 23 bp, Homo sapiens
tctccaaaccagacggtgacgcc

SEQ ID NO: 4506012 - DNA, 18 bp, Homo sapiens
tctccaaccccccagcac

SEQ ID NO: 4506013 - DNA, 19 bp, Homo sapiens
tctccaaccccccagcact

SEQ ID NO: 4506014 - DNA, 23 bp, Homo sapiens
tctccaaccccccagcactgagg

SEQ ID NO: 4506015 - DNA, 14 bp, Homo sapiens
tctccaagacagca

SEQ ID NO: 4506016 - DNA, 21 bp, Homo sapiens
tctccaagacagcagcagcct

SEQ ID NO: 4506017 - DNA, 24 bp, Homo sapiens
tctccaagacagcagcagcctgca

SEQ ID NO: 4506018 - DNA, 16 bp, Homo sapiens
tctccaagaccttggc

SEQ ID NO: 4506019 - DNA, 18 bp, Homo sapiens
tctccaagtagtccacct

SEQ ID NO: 4506020 - DNA, 16 bp, Homo sapiens
tctccaattctgaaat

SEQ ID NO: 4506021 - DNA, 15 bp, Homo sapiens
tctccacacaggtgt

SEQ ID NO: 4506022 - DNA, 22 bp, Homo sapiens
tctccacacaggtgttccgtgg

SEQ ID NO: 4506023 - DNA, 15 bp, Homo sapiens
tctccaccccagggt

SEQ ID NO: 4506024 - DNA, 13 bp, Homo sapiens
tctccacctcagc

SEQ ID NO: 4506025 - DNA, 17 bp, Homo sapiens
tctccacctcagccttg

SEQ ID NO: 4506026 - DNA, 19 bp, Homo sapiens
tctccacctcagccttgga

SEQ ID NO: 4506027 - DNA, 13 bp, Homo sapiens
tctccacctgcac

SEQ ID NO: 4506028 - DNA, 13 bp, Homo sapiens
tctccacttgtat

SEQ ID NO: 4506029 - DNA, 15 bp, Homo sapiens
tctccagctgctgag

SEQ ID NO: 4506030 - DNA, 11 bp, Homo sapiens
tctccagggaa

SEQ ID NO: 4506031 - DNA, 19 bp, Homo sapiens
tctccagggccccccaact

SEQ ID NO: 4506032 - DNA, 19 bp, Homo sapiens
tctccaggggtttacagtg

SEQ ID NO: 4506033 - DNA, 16 bp, Homo sapiens
tctccatcccctccct

SEQ ID NO: 4506034 - DNA, 12 bp, Homo sapiens
tctccatggccc

SEQ ID NO: 4506035 - DNA, 18 bp, Homo sapiens
tctccatggccctgcaaa

SEQ ID NO: 4506036 - DNA, 17 bp, Homo sapiens
tctccatgtagaataaa

SEQ ID NO: 4506037 - DNA, 19 bp, Homo sapiens
tctccatgtgtgtgccaag

SEQ ID NO: 4506038 - DNA, 17 bp, Homo sapiens
tctccatttaagacaca

SEQ ID NO: 4506039 - DNA, 14 bp, Homo sapiens
tctcccaacatggg

SEQ ID NO: 4506040 - DNA, 19 bp, Homo sapiens
tctcccaagaaacctgact

SEQ ID NO: 4506041 - DNA, 19 bp, Homo sapiens
tctcccacagagtgctgga

SEQ ID NO: 4506042 - DNA, 14 bp, Homo sapiens
tctcccacatgagg

SEQ ID NO: 4506043 - DNA, 21 bp, Homo sapiens
tctcccacatgaggccatctc

SEQ ID NO: 4506044 - DNA, 22 bp, Homo sapiens
tctcccacatgaggccatctca

SEQ ID NO: 4506045 - DNA, 23 bp, Homo sapiens
tctcccacccggccacagctgct

SEQ ID NO: 4506046 - DNA, 23 bp, Homo sapiens
tctacctgtgtttttttctaaaa

SEQ ID NO: 4506047 - DNA, 16 bp, Homo sapiens
tctaccttcctgtccc

SEQ ID NO: 4506048 - DNA, 18 bp, Homo sapiens
tctaccttcctgtccctg

SEQ ID NO: 4506049 - DNA, 15 bp, Homo sapiens
tctacgcaattgaca

SEQ ID NO: 4506050 - DNA, 21 bp, Homo sapiens
tctacggatcatcaacaagat

SEQ ID NO: 4506051 - DNA, 22 bp, Homo sapiens
tctacgtttccccaataaagcc

SEQ ID NO: 4506052 - DNA, 13 bp, Homo sapiens
tctactaaaaata

SEQ ID NO: 4506053 - DNA, 19 bp, Homo sapiens
tctactaaaaatacaaaaa

SEQ ID NO: 4506054 - DNA, 15 bp, Homo sapiens
tctactaaaaatgca

SEQ ID NO: 4506055 - DNA, 16 bp, Homo sapiens
tctactaaaattcaaa

SEQ ID NO: 4506056 - DNA, 15 bp, Homo sapiens
tctactaattccaca

SEQ ID NO: 4506057 - DNA, 12 bp, Homo sapiens
tctactcccctt

SEQ ID NO: 4506058 - DNA, 20 bp, Homo sapiens
tctactgtatcaataaaatt

SEQ ID NO: 4506059 - DNA, 15 bp, Homo sapiens
tctacttgtaaaatg

SEQ ID NO: 4506060 - DNA, 15 bp, Homo sapiens
tctacttgtcatatc

SEQ ID NO: 4506061 - DNA, 16 bp, Homo sapiens
tctactttcatcttaa

SEQ ID NO: 4506062 - DNA, 18 bp, Homo sapiens
tctagaagatgtgtaaac

SEQ ID NO: 4506063 - DNA, 22 bp, Homo sapiens
tctagaagatgtgtaaacaggt

SEQ ID NO: 4506064 - DNA, 21 bp, Homo sapiens
tctagaatgtctgaagtacaa

SEQ ID NO: 4506065 - DNA, 18 bp, Homo sapiens
tctagaatgttattgtgt

SEQ ID NO: 4506066 - DNA, 20 bp, Homo sapiens
tctagacagagttgcttaat

SEQ ID NO: 4506067 - DNA, 16 bp, Homo sapiens
tctagactataaatgt

SEQ ID NO: 4506068 - DNA, 16 bp, Homo sapiens
tctagactcaaaacct

SEQ ID NO: 4506069 - DNA, 12 bp, Homo sapiens
tctagagacaca

SEQ ID NO: 4506070 - DNA, 12 bp, Homo sapiens
tctagagccttc

SEQ ID NO: 4506071 - DNA, 18 bp, Homo sapiens
tctagagccttcagcctt

SEQ ID NO: 4506072 - DNA, 14 bp, Homo sapiens
tctagataaccttg

SEQ ID NO: 4506073 - DNA, 21 bp, Homo sapiens
tctagatgaagttttacattg

SEQ ID NO: 4506074 - DNA, 14 bp, Homo sapiens
tctagatgattttt

SEQ ID NO: 4506075 - DNA, 21 bp, Homo sapiens
tctagatgattttttgaaagt

SEQ ID NO: 4506076 - DNA, 18 bp, Homo sapiens
tctagatggcaacattgg

SEQ ID NO: 4506077 - DNA, 16 bp, Homo sapiens
tctagcactggcctgc

SEQ ID NO: 4506078 - DNA, 15 bp, Homo sapiens
tctagcatttatttc

SEQ ID NO: 4506079 - DNA, 14 bp, Homo sapiens
tctagcctgcactt

SEQ ID NO: 4506080 - DNA, 20 bp, Homo sapiens
tctagcctgcactttgatgt

SEQ ID NO: 4506081 - DNA, 22 bp, Homo sapiens
tctagcctgcactttgatgtca

SEQ ID NO: 4506082 - DNA, 19 bp, Homo sapiens
tctagctatgctgtatctg

SEQ ID NO: 4506083 - DNA, 13 bp, Homo sapiens
tctagctccgggg

SEQ ID NO: 4506084 - DNA, 23 bp, Homo sapiens
tctagctccgggggtacagccct

SEQ ID NO: 4506085 - DNA, 22 bp, Homo sapiens
tctagctttttaattaagcaaa

SEQ ID NO: 4506086 - DNA, 14 bp, Homo sapiens
tctaggaaatctag

SEQ ID NO: 4506087 - DNA, 13 bp, Homo sapiens
tctaggacacagt

SEQ ID NO: 4506088 - DNA, 23 bp, Homo sapiens
tctaggacacagttcctgggaac

SEQ ID NO: 4506089 - DNA, 15 bp, Homo sapiens
tctaggagatgcttt

SEQ ID NO: 4506090 - DNA, 17 bp, Homo sapiens
tctaggagctgggagga

SEQ ID NO: 4506091 - DNA, 18 bp, Homo sapiens
tctaggagtcaactggct

SEQ ID NO: 4506092 - DNA, 22 bp, Homo sapiens
tctaggatgggaacaaggaagg

SEQ ID NO: 4506093 - DNA, 23 bp, Homo sapiens
tctagggacccctcgccccagcc

SEQ ID NO: 4506094 - DNA, 23 bp, Homo sapiens
tctagggactgccaggctgtttc

SEQ ID NO: 4506095 - DNA, 21 bp, Homo sapiens
tctaggtacgatgacagtgtt

SEQ ID NO: 4506096 - DNA, 18 bp, Homo sapiens
tctagtagctgaaatgca

SEQ ID NO: 4506097 - DNA, 15 bp, Homo sapiens
tctagtagttagaaa

SEQ ID NO: 4506098 - DNA, 19 bp, Homo sapiens
tctagtagttagaaattaa

SEQ ID NO: 4506099 - DNA, 18 bp, Homo sapiens
tctagtgcttttcagtga

SEQ ID NO: 4506100 - DNA, 12 bp, Homo sapiens
tctagttctaga

SEQ ID NO: 4506101 - DNA, 14 bp, Homo sapiens
tctagttgaggagt

SEQ ID NO: 4506102 - DNA, 14 bp, Homo sapiens
tctagtttattcta

SEQ ID NO: 4506103 - DNA, 22 bp, Homo sapiens
tctagttttataggcagctgtc

SEQ ID NO: 4506104 - DNA, 18 bp, Homo sapiens
tctataaaaatactacaa

SEQ ID NO: 4506105 - DNA, 18 bp, Homo sapiens
tctataaaactttctgta

SEQ ID NO: 4506106 - DNA, 14 bp, Homo sapiens
tctataaactataa

SEQ ID NO: 4506107 - DNA, 19 bp, Homo sapiens
tctataacataaagaataa

SEQ ID NO: 4506108 - DNA, 12 bp, Homo sapiens
tctataatttac

SEQ ID NO: 4506109 - DNA, 17 bp, Homo sapiens
tctatacccacccagaa

SEQ ID NO: 4506110 - DNA, 14 bp, Homo sapiens
tctatacctgcctt

SEQ ID NO: 4506111 - DNA, 17 bp, Homo sapiens
tctatagaactgaatga

SEQ ID NO: 4506112 - DNA, 20 bp, Homo sapiens
tctatagccaaaaatagcta

SEQ ID NO: 4506113 - DNA, 20 bp, Homo sapiens
tctataggaacatatgaaaa

SEQ ID NO: 4506114 - DNA, 21 bp, Homo sapiens
tctataggaacatatgaaaat

SEQ ID NO: 4506115 - DNA, 13 bp, Homo sapiens
tctatatcaaaaa

SEQ ID NO: 4506116 - DNA, 18 bp, Homo sapiens
tctatattagatcaaata

SEQ ID NO: 4506117 - DNA, 17 bp, Homo sapiens
tctatatttaaatcatt

SEQ ID NO: 4506118 - DNA, 22 bp, Homo sapiens
tctatcagcatctgacaggtga

SEQ ID NO: 4506119 - DNA, 17 bp, Homo sapiens
tctatcctgtttaataa

SEQ ID NO: 4506120 - DNA, 15 bp, Homo sapiens
tctatctatttgagg

SEQ ID NO: 4506121 - DNA, 20 bp, Homo sapiens
tctatgaaaagcacaagggg

SEQ ID NO: 4506122 - DNA, 18 bp, Homo sapiens
tctatgagggtgtttcct

SEQ ID NO: 4506123 - DNA, 19 bp, Homo sapiens
tctatgagggtgtttcctc

SEQ ID NO: 4506124 - DNA, 20 bp, Homo sapiens
tctatgagttggacttcagt

SEQ ID NO: 4506125 - DNA, 21 bp, Homo sapiens
tctatgctgtttgtagtgaaa

SEQ ID NO: 4506126 - DNA, 20 bp, Homo sapiens
tctatggaaggaggcctcca

SEQ ID NO: 4506127 - DNA, 14 bp, Homo sapiens
tctatggagacttt

SEQ ID NO: 4506128 - DNA, 19 bp, Homo sapiens
tctatggattcacttctat

SEQ ID NO: 4506129 - DNA, 22 bp, Homo sapiens
tctatggattcacttctattta

SEQ ID NO: 4506130 - DNA, 11 bp, Homo sapiens
tctatggcttt

SEQ ID NO: 4506131 - DNA, 23 bp, Homo sapiens
tctatgggaagatacttattttt

SEQ ID NO: 4506132 - DNA, 23 bp, Homo sapiens
tctatgggagattaaaaccagag

SEQ ID NO: 4506133 - DNA, 21 bp, Homo sapiens
tctatgggtttagttacttta

SEQ ID NO: 4506134 - DNA, 12 bp, Homo sapiens
tctatgtatgtt

SEQ ID NO: 4506135 - DNA, 13 bp, Homo sapiens
tctatgtatgtta

SEQ ID NO: 4506136 - DNA, 16 bp, Homo sapiens
tctatgtatgttaatt

SEQ ID NO: 4506137 - DNA, 23 bp, Homo sapiens
tctatgtcatttttaatgtatct

SEQ ID NO: 4506138 - DNA, 18 bp, Homo sapiens
tctatgtgaatatttgta

SEQ ID NO: 4506139 - DNA, 20 bp, Homo sapiens
tctatgtgaatatttgtaaa

SEQ ID NO: 4506140 - DNA, 23 bp, Homo sapiens
tctattaatcaagagaaacttca

SEQ ID NO: 4506141 - DNA, 19 bp, Homo sapiens
tctattaatcacctctctg

SEQ ID NO: 4506142 - DNA, 15 bp, Homo sapiens
tctattatggaaaac

SEQ ID NO: 4506143 - DNA, 19 bp, Homo sapiens
tctattattcaaaaaatca

SEQ ID NO: 4506144 - DNA, 16 bp, Homo sapiens
tctattctccagctga

SEQ ID NO: 4506145 - DNA, 21 bp, Homo sapiens
tctattgacttttcaataaat

SEQ ID NO: 4506146 - DNA, 15 bp, Homo sapiens
tctattgcttggact

SEQ ID NO: 4506147 - DNA, 21 bp, Homo sapiens
tctattgtcgctatgtgactt

SEQ ID NO: 4506148 - DNA, 18 bp, Homo sapiens
tctatttaaaaaactgta

SEQ ID NO: 4506149 - DNA, 14 bp, Homo sapiens
tctatttaaattct

SEQ ID NO: 4506150 - DNA, 15 bp, Homo sapiens
tctatttaaattctt

SEQ ID NO: 4506151 - DNA, 17 bp, Homo sapiens
tctatttaaattctttt

SEQ ID NO: 4506152 - DNA, 20 bp, Homo sapiens
tctatttctcctccatggga

SEQ ID NO: 4506153 - DNA, 14 bp, Homo sapiens
tctatttcttgaag

SEQ ID NO: 4506154 - DNA, 17 bp, Homo sapiens
tctatttgaataaatta

SEQ ID NO: 4506155 - DNA, 13 bp, Homo sapiens
tctatttgtacaa

SEQ ID NO: 4506156 - DNA, 16 bp, Homo sapiens
tctatttgtacaattt

SEQ ID NO: 4506157 - DNA, 17 bp, Homo sapiens
tctatttgtacaatttt

SEQ ID NO: 4506158 - DNA, 22 bp, Homo sapiens
tctatttgtacaattttaaagt

SEQ ID NO: 4506159 - DNA, 12 bp, Homo sapiens
tctattttaaga

SEQ ID NO: 4506160 - DNA, 21 bp, Homo sapiens
tctattttacttttctgccaa

SEQ ID NO: 4506161 - DNA, 14 bp, Homo sapiens
tctattttagaata

SEQ ID NO: 4506162 - DNA, 15 bp, Homo sapiens
tctattttgatgcag

SEQ ID NO: 4506163 - DNA, 21 bp, Homo sapiens
tctattttgatgcagcatttg

SEQ ID NO: 4506164 - DNA, 15 bp, Homo sapiens
tctattttggattgt

SEQ ID NO: 4506165 - DNA, 14 bp, Homo sapiens
tctatttttaatgc

SEQ ID NO: 4506166 - DNA, 17 bp, Homo sapiens
tcgtcaactttcctcaa

SEQ ID NO: 4506167 - DNA, 17 bp, Homo sapiens
tcgtcctccccctgcca

SEQ ID NO: 4506168 - DNA, 21 bp, Homo sapiens
tcgtcctgggactcggagact

SEQ ID NO: 4506169 - DNA, 14 bp, Homo sapiens
tcgtgagctgggga

SEQ ID NO: 4506170 - DNA, 16 bp, Homo sapiens
tcgtgatcttattgct

SEQ ID NO: 4506171 - DNA, 23 bp, Homo sapiens
tcgtgatgggcccgcctcggcct

SEQ ID NO: 4506172 - DNA, 12 bp, Homo sapiens
tcgtgatgtgga

SEQ ID NO: 4506173 - DNA, 17 bp, Homo sapiens
tcgtgccatgatctgta

SEQ ID NO: 4506174 - DNA, 20 bp, Homo sapiens
tcgtgccgttactctccaac

SEQ ID NO: 4506175 - DNA, 23 bp, Homo sapiens
tcgtgccgttactctccaacctg

SEQ ID NO: 4506176 - DNA, 16 bp, Homo sapiens
tcgtgctactgcactc

SEQ ID NO: 4506177 - DNA, 17 bp, Homo sapiens
tcgtggactgtgctggt

SEQ ID NO: 4506178 - DNA, 22 bp, Homo sapiens
tcgtggcacgtattgctgtgtc

SEQ ID NO: 4506179 - DNA, 15 bp, Homo sapiens
tcgtggtaggactgt

SEQ ID NO: 4506180 - DNA, 14 bp, Homo sapiens
tcgtgtgccgctgc

SEQ ID NO: 4506181 - DNA, 22 bp, Homo sapiens
tcgtgtgtgttatttccccagc

SEQ ID NO: 4506182 - DNA, 14 bp, Homo sapiens
tcgtttccatcatg

SEQ ID NO: 4506183 - DNA, 15 bp, Homo sapiens
tcgtttccatcatgt

SEQ ID NO: 4506184 - DNA, 20 bp, Homo sapiens
tcgttttccaaactgactca

SEQ ID NO: 4506185 - DNA, 15 bp, Homo sapiens
tctaaaaacatttgt

SEQ ID NO: 4506186 - DNA, 15 bp, Homo sapiens
tctaaaaagaagcca

SEQ ID NO: 4506187 - DNA, 14 bp, Homo sapiens
tctaaaacaattcc

SEQ ID NO: 4506188 - DNA, 19 bp, Homo sapiens
tctaaaacattcccctccc

SEQ ID NO: 4506189 - DNA, 14 bp, Homo sapiens
tctaaaagtagaca

SEQ ID NO: 4506190 - DNA, 15 bp, Homo sapiens
tctaaaatagcaata

SEQ ID NO: 4506191 - DNA, 13 bp, Homo sapiens
tctaaaatgcaaa

SEQ ID NO: 4506192 - DNA, 12 bp, Homo sapiens
tctaaaatgtca

SEQ ID NO: 4506193 - DNA, 12 bp, Homo sapiens
tctaaaatgttt

SEQ ID NO: 4506194 - DNA, 14 bp, Homo sapiens
tctaaaatgtttta

SEQ ID NO: 4506195 - DNA, 18 bp, Homo sapiens
tctaaaattataaatgac

SEQ ID NO: 4506196 - DNA, 22 bp, Homo sapiens
tctaaaattgagttcttcctgt

SEQ ID NO: 4506197 - DNA, 17 bp, Homo sapiens
tctaaacagaaattatt

SEQ ID NO: 4506198 - DNA, 21 bp, Homo sapiens
tctaaagcactggtttcaaga

SEQ ID NO: 4506199 - DNA, 15 bp, Homo sapiens
tctaaagctttatct

SEQ ID NO: 4506200 - DNA, 19 bp, Homo sapiens
tctaaagctttatctttgt

SEQ ID NO: 4506201 - DNA, 14 bp, Homo sapiens
tctaaagtaaaatt

SEQ ID NO: 4506202 - DNA, 19 bp, Homo sapiens
tctaaagtaaaattgaagc

SEQ ID NO: 4506203 - DNA, 20 bp, Homo sapiens
tctaaagtaaaattgaagca

SEQ ID NO: 4506204 - DNA, 18 bp, Homo sapiens
tctaaatagtattttgtc

SEQ ID NO: 4506205 - DNA, 14 bp, Homo sapiens
tctaaatattgctt

SEQ ID NO: 4506206 - DNA, 20 bp, Homo sapiens
tctaaatattgcttcaattt

SEQ ID NO: 4506207 - DNA, 12 bp, Homo sapiens
tctaaatgaaag

SEQ ID NO: 4506208 - DNA, 13 bp, Homo sapiens
tctaaatgcaata

SEQ ID NO: 4506209 - DNA, 15 bp, Homo sapiens
tctaaatgcccagtt

SEQ ID NO: 4506210 - DNA, 16 bp, Homo sapiens
tctaaatgcccagttc

SEQ ID NO: 4506211 - DNA, 17 bp, Homo sapiens
tctaacaagctatggga

SEQ ID NO: 4506212 - DNA, 18 bp, Homo sapiens
tctaacaataatatttca

SEQ ID NO: 4506213 - DNA, 23 bp, Homo sapiens
tctaacaataatatttcaagtgc

SEQ ID NO: 4506214 - DNA, 13 bp, Homo sapiens
tctaacaatgaca

SEQ ID NO: 4506215 - DNA, 13 bp, Homo sapiens
tctaacagccctc

SEQ ID NO: 4506216 - DNA, 23 bp, Homo sapiens
tctaacagccctcctctgcactc

SEQ ID NO: 4506217 - DNA, 17 bp, Homo sapiens
tctaaccacggttattt

SEQ ID NO: 4506218 - DNA, 15 bp, Homo sapiens
tctaacccaagacat

SEQ ID NO: 4506219 - DNA, 15 bp, Homo sapiens
tctaaccctcccatg

SEQ ID NO: 4506220 - DNA, 13 bp, Homo sapiens
tctaacctcatct

SEQ ID NO: 4506221 - DNA, 18 bp, Homo sapiens
tctaacctcatcttcttc

SEQ ID NO: 4506222 - DNA, 20 bp, Homo sapiens
tctaacctcatcttcttcac

SEQ ID NO: 4506223 - DNA, 21 bp, Homo sapiens
tctaaccttcacgattaactg

SEQ ID NO: 4506224 - DNA, 13 bp, Homo sapiens
tctaactcagcaa

SEQ ID NO: 4506225 - DNA, 23 bp, Homo sapiens
tctaactcccccattttacagat

SEQ ID NO: 4506226 - DNA, 21 bp, Homo sapiens
tctaactgatgagtaaactga

SEQ ID NO: 4506227 - DNA, 18 bp, Homo sapiens
tctaactgtatatttgta

SEQ ID NO: 4506228 - DNA, 13 bp, Homo sapiens
tctaactttgtaa

SEQ ID NO: 4506229 - DNA, 22 bp, Homo sapiens
tctaagaaatatctgtgaaata

SEQ ID NO: 4506230 - DNA, 13 bp, Homo sapiens
tctaagaaatcaa

SEQ ID NO: 4506231 - DNA, 13 bp, Homo sapiens
tctaagaagacat

SEQ ID NO: 4506232 - DNA, 14 bp, Homo sapiens
tctaagaagacatt

SEQ ID NO: 4506233 - DNA, 18 bp, Homo sapiens
tctaagaagacattttgt

SEQ ID NO: 4506234 - DNA, 22 bp, Homo sapiens
tctaagaagacattttgttaca

SEQ ID NO: 4506235 - DNA, 14 bp, Homo sapiens
tctaagaataataa

SEQ ID NO: 4506236 - DNA, 20 bp, Homo sapiens
tctaagagaacaatgtgcta

SEQ ID NO: 4506237 - DNA, 16 bp, Homo sapiens
tctaagcacattccaa

SEQ ID NO: 4506238 - DNA, 15 bp, Homo sapiens
tctaaggcaggatgt

SEQ ID NO: 4506239 - DNA, 14 bp, Homo sapiens
tctaagtaaaacca

SEQ ID NO: 4506240 - DNA, 15 bp, Homo sapiens
tctaagtaaaaccac

SEQ ID NO: 4506241 - DNA, 21 bp, Homo sapiens
tctaagtaaaaccacagcagt

SEQ ID NO: 4506242 - DNA, 22 bp, Homo sapiens
tctaagtaaaaccacagcagtt

SEQ ID NO: 4506243 - DNA, 23 bp, Homo sapiens
tctaagtaaaaccacagcagttg

SEQ ID NO: 4506244 - DNA, 13 bp, Homo sapiens
tctaagtctttcc

SEQ ID NO: 4506245 - DNA, 12 bp, Homo sapiens
tctaatagtctt

SEQ ID NO: 4506246 - DNA, 19 bp, Homo sapiens
tctaatatccccaaattag

SEQ ID NO: 4506247 - DNA, 14 bp, Homo sapiens
tctaatatgattat

SEQ ID NO: 4506248 - DNA, 16 bp, Homo sapiens
tctaatatgattatac

SEQ ID NO: 4506249 - DNA, 17 bp, Homo sapiens
tctaatatgattataca

SEQ ID NO: 4506250 - DNA, 18 bp, Homo sapiens
tctaatatgattatacaa

SEQ ID NO: 4506251 - DNA, 13 bp, Homo sapiens
tctaatccttgct

SEQ ID NO: 4506252 - DNA, 16 bp, Homo sapiens
tctaatgagcatttcc

SEQ ID NO: 4506253 - DNA, 17 bp, Homo sapiens
tctaatgattcaaatgt

SEQ ID NO: 4506254 - DNA, 20 bp, Homo sapiens
tctaatgattcaaatgtttt

SEQ ID NO: 4506255 - DNA, 20 bp, Homo sapiens
tctaatgggggcagtctccc

SEQ ID NO: 4506256 - DNA, 18 bp, Homo sapiens
tctaattaagaaaactat

SEQ ID NO: 4506257 - DNA, 15 bp, Homo sapiens
tctaattctgtgatt

SEQ ID NO: 4506258 - DNA, 22 bp, Homo sapiens
tctacaaaaaatgcagaactta

SEQ ID NO: 4506259 - DNA, 18 bp, Homo sapiens
tctacacactcagccaca

SEQ ID NO: 4506260 - DNA, 14 bp, Homo sapiens
tctacacagagcag

SEQ ID NO: 4506261 - DNA, 12 bp, Homo sapiens
tctacacatgtt

SEQ ID NO: 4506262 - DNA, 15 bp, Homo sapiens
tctacaccaatgaaa

SEQ ID NO: 4506263 - DNA, 16 bp, Homo sapiens
tctacaccaatgaaaa

SEQ ID NO: 4506264 - DNA, 17 bp, Homo sapiens
tctacactccagtgaga

SEQ ID NO: 4506265 - DNA, 11 bp, Homo sapiens
tctacactctc

SEQ ID NO: 4506266 - DNA, 13 bp, Homo sapiens
tctacagaaaaac

SEQ ID NO: 4506267 - DNA, 20 bp, Homo sapiens
tctacaggtccgtttcctta

SEQ ID NO: 4506268 - DNA, 12 bp, Homo sapiens
tctacagtggtt

SEQ ID NO: 4506269 - DNA, 22 bp, Homo sapiens
tctacagtggttttatactgaa

SEQ ID NO: 4506270 - DNA, 23 bp, Homo sapiens
tctacagtggttttatactgaag

SEQ ID NO: 4506271 - DNA, 23 bp, Homo sapiens
tctacatactttcatcctgactc

SEQ ID NO: 4506272 - DNA, 14 bp, Homo sapiens
tctacatgtctaga

SEQ ID NO: 4506273 - DNA, 14 bp, Homo sapiens
tctacattaaacaa

SEQ ID NO: 4506274 - DNA, 19 bp, Homo sapiens
tctacattataataaaatt

SEQ ID NO: 4506275 - DNA, 20 bp, Homo sapiens
tctacattcttggttgttaa

SEQ ID NO: 4506276 - DNA, 20 bp, Homo sapiens
tctacatttctgcagatctt

SEQ ID NO: 4506277 - DNA, 18 bp, Homo sapiens
tctaccaaaaaaaggaag

SEQ ID NO: 4506278 - DNA, 13 bp, Homo sapiens
tctaccctgaaag

SEQ ID NO: 4506279 - DNA, 18 bp, Homo sapiens
tctaccggagagagaatg

SEQ ID NO: 4506280 - DNA, 22 bp, Homo sapiens
tctacctcaaggtaacaagagt

SEQ ID NO: 4506281 - DNA, 16 bp, Homo sapiens
tctacctgaggccagg

SEQ ID NO: 4506282 - DNA, 14 bp, Homo sapiens
tctacctgccactc

SEQ ID NO: 4506283 - DNA, 16 bp, Homo sapiens
tctacctgccactcac

SEQ ID NO: 4506284 - DNA, 21 bp, Homo sapiens
tctacctgccactcacacagc

SEQ ID NO: 4506285 - DNA, 18 bp, Homo sapiens
tctacctgcttggtcttt

SEQ ID NO: 4506286 - DNA, 13 bp, Homo sapiens
tctacctggcaga

SEQ ID NO: 4506287 - DNA, 13 bp, Homo sapiens
tcctttatgtgaa

SEQ ID NO: 4506288 - DNA, 16 bp, Homo sapiens
tcctttatgtgaattt

SEQ ID NO: 4506289 - DNA, 17 bp, Homo sapiens
tcctttatgtgaatttt

SEQ ID NO: 4506290 - DNA, 14 bp, Homo sapiens
tcctttcagccaca

SEQ ID NO: 4506291 - DNA, 17 bp, Homo sapiens
tcctttcagtttttatt

SEQ ID NO: 4506292 - DNA, 13 bp, Homo sapiens
tcctttcccttta

SEQ ID NO: 4506293 - DNA, 22 bp, Homo sapiens
tcctttctgcagacgtctgcct

SEQ ID NO: 4506294 - DNA, 14 bp, Homo sapiens
tcctttctttttct

SEQ ID NO: 4506295 - DNA, 16 bp, Homo sapiens
tcctttctttttcttc

SEQ ID NO: 4506296 - DNA, 17 bp, Homo sapiens
tcctttctttttcttct

SEQ ID NO: 4506297 - DNA, 22 bp, Homo sapiens
tcctttgaagctttaggcagag

SEQ ID NO: 4506298 - DNA, 12 bp, Homo sapiens
tcctttgcaata

SEQ ID NO: 4506299 - DNA, 16 bp, Homo sapiens
tcctttggtcctggtg

SEQ ID NO: 4506300 - DNA, 17 bp, Homo sapiens
tccttttaaagaaacaa

SEQ ID NO: 4506301 - DNA, 21 bp, Homo sapiens
tccttttatctggtgcctcct

SEQ ID NO: 4506302 - DNA, 13 bp, Homo sapiens
tccttttccctgc

SEQ ID NO: 4506303 - DNA, 14 bp, Homo sapiens
tccttttccctgct

SEQ ID NO: 4506304 - DNA, 23 bp, Homo sapiens
tccttttctcccatttcttgcta

SEQ ID NO: 4506305 - DNA, 14 bp, Homo sapiens
tccttttgacactg

SEQ ID NO: 4506306 - DNA, 20 bp, Homo sapiens
tccttttgtccacttgtaag

SEQ ID NO: 4506307 - DNA, 12 bp, Homo sapiens
tcctttttaagg

SEQ ID NO: 4506308 - DNA, 21 bp, Homo sapiens
tcctttttattccttttaaaa

SEQ ID NO: 4506309 - DNA, 17 bp, Homo sapiens
tcctttttccaatgttt

SEQ ID NO: 4506310 - DNA, 12 bp, Homo sapiens
tcctttttctat

SEQ ID NO: 4506311 - DNA, 21 bp, Homo sapiens
tcctttttcttcgctggacta

SEQ ID NO: 4506312 - DNA, 17 bp, Homo sapiens
tcctttttgacactgaa

SEQ ID NO: 4506313 - DNA, 16 bp, Homo sapiens
tcctttttggttttta

SEQ ID NO: 4506314 - DNA, 11 bp, Homo sapiens
tccttttttcc

SEQ ID NO: 4506315 - DNA, 22 bp, Homo sapiens
tccttttttcccataagacaat

SEQ ID NO: 4506316 - DNA, 13 bp, Homo sapiens
tcgaaaaaataat

SEQ ID NO: 4506317 - DNA, 18 bp, Homo sapiens
tcgaaaaaataattattt

SEQ ID NO: 4506318 - DNA, 18 bp, Homo sapiens
tcgaaacacagaaacctt

SEQ ID NO: 4506319 - DNA, 14 bp, Homo sapiens
tcgaatctctgccc

SEQ ID NO: 4506320 - DNA, 17 bp, Homo sapiens
tcgacaaaggccacagg

SEQ ID NO: 4506321 - DNA, 23 bp, Homo sapiens
tcgacccctcctgcccctctctc

SEQ ID NO: 4506322 - DNA, 12 bp, Homo sapiens
tcgaccctgggg

SEQ ID NO: 4506323 - DNA, 20 bp, Homo sapiens
tcgaccctgtgcaggagcta

SEQ ID NO: 4506324 - DNA, 16 bp, Homo sapiens
tcgaccgactttcccc

SEQ ID NO: 4506325 - DNA, 12 bp, Homo sapiens
tcgacctcccca

SEQ ID NO: 4506326 - DNA, 18 bp, Homo sapiens
tcgagaccaacctgacca

SEQ ID NO: 4506327 - DNA, 15 bp, Homo sapiens
tcgagaccatcctgg

SEQ ID NO: 4506328 - DNA, 16 bp, Homo sapiens
tcgagaccatcctggc

SEQ ID NO: 4506329 - DNA, 18 bp, Homo sapiens
tcgagaccatcctggcta

SEQ ID NO: 4506330 - DNA, 17 bp, Homo sapiens
tcgagatcccaacactg

SEQ ID NO: 4506331 - DNA, 21 bp, Homo sapiens
tcgagatcccaacactgccag

SEQ ID NO: 4506332 - DNA, 14 bp, Homo sapiens
tcgagcagggtgct

SEQ ID NO: 4506333 - DNA, 13 bp, Homo sapiens
tcgagcccagatg

SEQ ID NO: 4506334 - DNA, 22 bp, Homo sapiens
tcgaggcctgcaaaccttcctg

SEQ ID NO: 4506335 - DNA, 20 bp, Homo sapiens
tcgaggctgcagtcagccct

SEQ ID NO: 4506336 - DNA, 14 bp, Homo sapiens
tcgaggggcccagg

SEQ ID NO: 4506337 - DNA, 23 bp, Homo sapiens
tcgaggtaggtggatcacctgag

SEQ ID NO: 4506338 - DNA, 15 bp, Homo sapiens
tcgatccaaattgtg

SEQ ID NO: 4506339 - DNA, 13 bp, Homo sapiens
tcgatcctggatt

SEQ ID NO: 4506340 - DNA, 21 bp, Homo sapiens
tcgcacacacccatgtaacca

SEQ ID NO: 4506341 - DNA, 17 bp, Homo sapiens
tcgcagagcttttcaga

SEQ ID NO: 4506342 - DNA, 19 bp, Homo sapiens
tcgcatggtcacacactga

SEQ ID NO: 4506343 - DNA, 13 bp, Homo sapiens
tcgcatttgtcaa

SEQ ID NO: 4506344 - DNA, 22 bp, Homo sapiens
tcgccaggactggtgaatataa

SEQ ID NO: 4506345 - DNA, 17 bp, Homo sapiens
tcgcccacaagccttac

SEQ ID NO: 4506346 - DNA, 20 bp, Homo sapiens
tcgcccacaagccttactca

SEQ ID NO: 4506347 - DNA, 14 bp, Homo sapiens
tcgcccagcaggag

SEQ ID NO: 4506348 - DNA, 13 bp, Homo sapiens
tcgccccaggccc

SEQ ID NO: 4506349 - DNA, 12 bp, Homo sapiens
tcgccccatccc

SEQ ID NO: 4506350 - DNA, 15 bp, Homo sapiens
tcgccccgtgtttgc

SEQ ID NO: 4506351 - DNA, 20 bp, Homo sapiens
tcgcccctccttttggcctg

SEQ ID NO: 4506352 - DNA, 23 bp, Homo sapiens
tcgccccttccctctctccctgc

SEQ ID NO: 4506353 - DNA, 16 bp, Homo sapiens
tcgcctgtaatctcac

SEQ ID NO: 4506354 - DNA, 13 bp, Homo sapiens
tcgccttaaactc

SEQ ID NO: 4506355 - DNA, 14 bp, Homo sapiens
tcgccttaaactct

SEQ ID NO: 4506356 - DNA, 21 bp, Homo sapiens
tcgctcaccgctggcccttag

SEQ ID NO: 4506357 - DNA, 14 bp, Homo sapiens
tcgctctcagttct

SEQ ID NO: 4506358 - DNA, 17 bp, Homo sapiens
tcgctgcacatggcctg

SEQ ID NO: 4506359 - DNA, 21 bp, Homo sapiens
tcgctgcacatggcctgagca

SEQ ID NO: 4506360 - DNA, 19 bp, Homo sapiens
tcgctgccagctctgtatc

SEQ ID NO: 4506361 - DNA, 17 bp, Homo sapiens
tcgctggactattgtgc

SEQ ID NO: 4506362 - DNA, 22 bp, Homo sapiens
tcgctggactctcagtctctga

SEQ ID NO: 4506363 - DNA, 19 bp, Homo sapiens
tcgctttattggctgagat

SEQ ID NO: 4506364 - DNA, 13 bp, Homo sapiens
tcggaatgtcata

SEQ ID NO: 4506365 - DNA, 19 bp, Homo sapiens
tcggaattcataataaatt

SEQ ID NO: 4506366 - DNA, 20 bp, Homo sapiens
tcggaattcataataaattt

SEQ ID NO: 4506367 - DNA, 19 bp, Homo sapiens
tcggacaagacccccagca

SEQ ID NO: 4506368 - DNA, 18 bp, Homo sapiens
tcggaccactaggcctga

SEQ ID NO: 4506369 - DNA, 13 bp, Homo sapiens
tcggacccacccc

SEQ ID NO: 4506370 - DNA, 22 bp, Homo sapiens
tcggacccaccccaactctccc

SEQ ID NO: 4506371 - DNA, 23 bp, Homo sapiens
tcggacccaccccaactctcccc

SEQ ID NO: 4506372 - DNA, 22 bp, Homo sapiens
tcggactaagcctacctgctct

SEQ ID NO: 4506373 - DNA, 16 bp, Homo sapiens
tcggagaagagctgtt

SEQ ID NO: 4506374 - DNA, 17 bp, Homo sapiens
tcggagacgggaccctg

SEQ ID NO: 4506375 - DNA, 18 bp, Homo sapiens
tcggagactatggcctcg

SEQ ID NO: 4506376 - DNA, 16 bp, Homo sapiens
tcggagagcagcagca

SEQ ID NO: 4506377 - DNA, 20 bp, Homo sapiens
tcggaggctacccgctgtgg

SEQ ID NO: 4506378 - DNA, 23 bp, Homo sapiens
tcggaggctgcccccggccccct

SEQ ID NO: 4506379 - DNA, 16 bp, Homo sapiens
tcggatgacaccctgg

SEQ ID NO: 4506380 - DNA, 21 bp, Homo sapiens
tcggatgacaccctggcctga

SEQ ID NO: 4506381 - DNA, 16 bp, Homo sapiens
tcggatttggggtgga

SEQ ID NO: 4506382 - DNA, 14 bp, Homo sapiens
tcggattttttcca

SEQ ID NO: 4506383 - DNA, 15 bp, Homo sapiens
tcggcatagtcccca

SEQ ID NO: 4506384 - DNA, 22 bp, Homo sapiens
tcggccaagaatacttgaagaa

SEQ ID NO: 4506385 - DNA, 12 bp, Homo sapiens
tcggcccacagc

SEQ ID NO: 4506386 - DNA, 13 bp, Homo sapiens
tcggcccctcctc

SEQ ID NO: 4506387 - DNA, 12 bp, Homo sapiens
tcggcctcccaa

SEQ ID NO: 4506388 - DNA, 20 bp, Homo sapiens
tcggcctccgaggctccccg

SEQ ID NO: 4506389 - DNA, 19 bp, Homo sapiens
tcggcctctaaccccaggc

SEQ ID NO: 4506390 - DNA, 18 bp, Homo sapiens
tcggctggggactgctac

SEQ ID NO: 4506391 - DNA, 14 bp, Homo sapiens
tcgggaaagaagaa

SEQ ID NO: 4506392 - DNA, 14 bp, Homo sapiens
tcgggacagctgtg

SEQ ID NO: 4506393 - DNA, 22 bp, Homo sapiens
tcgggacatggttgggggaatg

SEQ ID NO: 4506394 - DNA, 14 bp, Homo sapiens
tcgggagcacccag

SEQ ID NO: 4506395 - DNA, 20 bp, Homo sapiens
tcgggagcacccagagcacc

SEQ ID NO: 4506396 - DNA, 15 bp, Homo sapiens
tcgggcaggtcagcg

SEQ ID NO: 4506397 - DNA, 23 bp, Homo sapiens
tcgggccccatcctcatccctga

SEQ ID NO: 4506398 - DNA, 15 bp, Homo sapiens
tcggggacaggtgac

SEQ ID NO: 4506399 - DNA, 23 bp, Homo sapiens
tcggggacaggtgacagtggctg

SEQ ID NO: 4506400 - DNA, 23 bp, Homo sapiens
tcgggtccatagagatgagccca

SEQ ID NO: 4506401 - DNA, 22 bp, Homo sapiens
tcgggttttattgtttaaaatc

SEQ ID NO: 4506402 - DNA, 12 bp, Homo sapiens
tcggtgaagaaa

SEQ ID NO: 4506403 - DNA, 22 bp, Homo sapiens
tcggtttgccaaaattcatttc

SEQ ID NO: 4506404 - DNA, 15 bp, Homo sapiens
tcgtaaagatttggg

SEQ ID NO: 4506405 - DNA, 20 bp, Homo sapiens
tcgtaaccagccagatcctc

SEQ ID NO: 4506406 - DNA, 15 bp, Homo sapiens
tcgtaatagctcaga

SEQ ID NO: 4506407 - DNA, 15 bp, Homo sapiens
tcgtacagaaagctg

SEQ ID NO: 4506408 - DNA, 11 bp, Homo sapiens
tcctctgcctg

SEQ ID NO: 4506409 - DNA, 12 bp, Homo sapiens
tcctctgcctgc

SEQ ID NO: 4506410 - DNA, 22 bp, Homo sapiens
tcctctgcctgccccgccccca

SEQ ID NO: 4506411 - DNA, 17 bp, Homo sapiens
tcctctggacggcaggc

SEQ ID NO: 4506412 - DNA, 18 bp, Homo sapiens
tcctctggacggcaggct

SEQ ID NO: 4506413 - DNA, 9 bp, Homo sapiens
tcctctggc

SEQ ID NO: 4506414 - DNA, 17 bp, Homo sapiens
tcctctggccgcagagg

SEQ ID NO: 4506415 - DNA, 23 bp, Homo sapiens
tcctctggctggctaactggaag

SEQ ID NO: 4506416 - DNA, 17 bp, Homo sapiens
tcctctggctttcccag

SEQ ID NO: 4506417 - DNA, 19 bp, Homo sapiens
tcctctggctttcccagga

SEQ ID NO: 4506418 - DNA, 14 bp, Homo sapiens
tcctctgggccctg

SEQ ID NO: 4506419 - DNA, 13 bp, Homo sapiens
tcctctggggcct

SEQ ID NO: 4506420 - DNA, 15 bp, Homo sapiens
tcctctggtaaacat

SEQ ID NO: 4506421 - DNA, 12 bp, Homo sapiens
tcctctgtctgc

SEQ ID NO: 4506422 - DNA, 14 bp, Homo sapiens
tcctctgtctgccc

SEQ ID NO: 4506423 - DNA, 15 bp, Homo sapiens
tcctctgtgaactgt

SEQ ID NO: 4506424 - DNA, 15 bp, Homo sapiens
tcctctgttaatgtg

SEQ ID NO: 4506425 - DNA, 21 bp, Homo sapiens
tcctctgttaatgtggactgg

SEQ ID NO: 4506426 - DNA, 20 bp, Homo sapiens
tcctcttcccttagcctctc

SEQ ID NO: 4506427 - DNA, 22 bp, Homo sapiens
tcctcttcccttagcctctccc

SEQ ID NO: 4506428 - DNA, 15 bp, Homo sapiens
tcctcttctgctctt

SEQ ID NO: 4506429 - DNA, 18 bp, Homo sapiens
tcctcttctgctcttttc

SEQ ID NO: 4506430 - DNA, 19 bp, Homo sapiens
tcctcttctgctcttttcc

SEQ ID NO: 4506431 - DNA, 17 bp, Homo sapiens
tcctcttctgggcctga

SEQ ID NO: 4506432 - DNA, 17 bp, Homo sapiens
tcctctttaaaacaaaa

SEQ ID NO: 4506433 - DNA, 15 bp, Homo sapiens
tcctcttttcctggc

SEQ ID NO: 4506434 - DNA, 22 bp, Homo sapiens
tcctcttttcctggcagctgct

SEQ ID NO: 4506435 - DNA, 13 bp, Homo sapiens
tcctcttttgtat

SEQ ID NO: 4506436 - DNA, 23 bp, Homo sapiens
tcctcttttgtattgtttctaca

SEQ ID NO: 4506437 - DNA, 21 bp, Homo sapiens
tcctctttttccatcataatt

SEQ ID NO: 4506438 - DNA, 17 bp, Homo sapiens
tcctgaaacctcttcct

SEQ ID NO: 4506439 - DNA, 18 bp, Homo sapiens
tcctgaactttctccctc

SEQ ID NO: 4506440 - DNA, 17 bp, Homo sapiens
tcctgaagctgctgtgt

SEQ ID NO: 4506441 - DNA, 13 bp, Homo sapiens
tcctgaatatttt

SEQ ID NO: 4506442 - DNA, 14 bp, Homo sapiens
tcctgacagatgcc

SEQ ID NO: 4506443 - DNA, 15 bp, Homo sapiens
tcctgacagatgcct

SEQ ID NO: 4506444 - DNA, 23 bp, Homo sapiens
tcctgacatttgtttattttttg

SEQ ID NO: 4506445 - DNA, 16 bp, Homo sapiens
tcctgaccttgtgatc

SEQ ID NO: 4506446 - DNA, 19 bp, Homo sapiens
tcctgactccgtcaagctg

SEQ ID NO: 4506447 - DNA, 14 bp, Homo sapiens
tcctgactctgccc

SEQ ID NO: 4506448 - DNA, 15 bp, Homo sapiens
tcctgactctgcccc

SEQ ID NO: 4506449 - DNA, 22 bp, Homo sapiens
tcctgactctgccccctgctgg

SEQ ID NO: 4506450 - DNA, 18 bp, Homo sapiens
tcctgacttaacgttcta

SEQ ID NO: 4506451 - DNA, 14 bp, Homo sapiens
tcctgagacccctg

SEQ ID NO: 4506452 - DNA, 17 bp, Homo sapiens
tcctgagctaaatgctt

SEQ ID NO: 4506453 - DNA, 16 bp, Homo sapiens
tcctgaggctttggat

SEQ ID NO: 4506454 - DNA, 24 bp, Homo sapiens
tcctgagggctaattctgggaagg

SEQ ID NO: 4506455 - DNA, 16 bp, Homo sapiens
tcctgaggggcatctg

SEQ ID NO: 4506456 - DNA, 19 bp, Homo sapiens
tcctgaggggcatctgccc

SEQ ID NO: 4506457 - DNA, 21 bp, Homo sapiens
tcctgaggggcatctgcccct

SEQ ID NO: 4506458 - DNA, 19 bp, Homo sapiens
tcctgagtttctctctcct

SEQ ID NO: 4506459 - DNA, 15 bp, Homo sapiens
tcctgatcagagccg

SEQ ID NO: 4506460 - DNA, 13 bp, Homo sapiens
tcctgcaccccag

SEQ ID NO: 4506461 - DNA, 14 bp, Homo sapiens
tcctgcaccccagc

SEQ ID NO: 4506462 - DNA, 16 bp, Homo sapiens
tcctgcaccccagcat

SEQ ID NO: 4506463 - DNA, 18 bp, Homo sapiens
tcctgcaccggggcctgg

SEQ ID NO: 4506464 - DNA, 21 bp, Homo sapiens
tcctgcaccggggcctgggca

SEQ ID NO: 4506465 - DNA, 18 bp, Homo sapiens
tcctgcagacacctggac

SEQ ID NO: 4506466 - DNA, 19 bp, Homo sapiens
tcctgcagacacctggact

SEQ ID NO: 4506467 - DNA, 21 bp, Homo sapiens
tcctgcagacacctggactga

SEQ ID NO: 4506468 - DNA, 18 bp, Homo sapiens
tcctgccacatggagccc

SEQ ID NO: 4506469 - DNA, 12 bp, Homo sapiens
tcctgccatcct

SEQ ID NO: 4506470 - DNA, 17 bp, Homo sapiens
tcctgcccaaaatgtga

SEQ ID NO: 4506471 - DNA, 14 bp, Homo sapiens
tcctgcccaggaga

SEQ ID NO: 4506472 - DNA, 12 bp, Homo sapiens
tcctgcccaggc

SEQ ID NO: 4506473 - DNA, 12 bp, Homo sapiens
tcctgccccctg

SEQ ID NO: 4506474 - DNA, 13 bp, Homo sapiens
tcctgccccctgc

SEQ ID NO: 4506475 - DNA, 14 bp, Homo sapiens
tcctgccccctgcc

SEQ ID NO: 4506476 - DNA, 14 bp, Homo sapiens
tcctgccctgtcca

SEQ ID NO: 4506477 - DNA, 15 bp, Homo sapiens
tcctgccctgtccaa

SEQ ID NO: 4506478 - DNA, 22 bp, Homo sapiens
tcctgccctgtgatatgtctgc

SEQ ID NO: 4506479 - DNA, 16 bp, Homo sapiens
tcctgcccttccctct

SEQ ID NO: 4506480 - DNA, 16 bp, Homo sapiens
tcctgccgcagagctg

SEQ ID NO: 4506481 - DNA, 16 bp, Homo sapiens
tcctgccggtgggacc

SEQ ID NO: 4506482 - DNA, 23 bp, Homo sapiens
tcctgccggtgggaccctgtccg

SEQ ID NO: 4506483 - DNA, 20 bp, Homo sapiens
tcctgcctaagtgcagcccc

SEQ ID NO: 4506484 - DNA, 11 bp, Homo sapiens
tcctgcctact

SEQ ID NO: 4506485 - DNA, 13 bp, Homo sapiens
tcctgcctcagcc

SEQ ID NO: 4506486 - DNA, 14 bp, Homo sapiens
tcctgcctcagcct

SEQ ID NO: 4506487 - DNA, 19 bp, Homo sapiens
tcctgcctcagcctcccat

SEQ ID NO: 4506488 - DNA, 18 bp, Homo sapiens
tcctgcctgccctgcctc

SEQ ID NO: 4506489 - DNA, 19 bp, Homo sapiens
tcctgcctgccctgcctca

SEQ ID NO: 4506490 - DNA, 12 bp, Homo sapiens
tcctgcctggcc

SEQ ID NO: 4506491 - DNA, 13 bp, Homo sapiens
tcctgcctggcca

SEQ ID NO: 4506492 - DNA, 16 bp, Homo sapiens
tcctgcctggccaggc

SEQ ID NO: 4506493 - DNA, 11 bp, Homo sapiens
tcctgcctggt

SEQ ID NO: 4506494 - DNA, 14 bp, Homo sapiens
tcctgcgggtttta

SEQ ID NO: 4506495 - DNA, 16 bp, Homo sapiens
tcctgcgggttttaat

SEQ ID NO: 4506496 - DNA, 13 bp, Homo sapiens
tcctgcgtcccag

SEQ ID NO: 4506497 - DNA, 16 bp, Homo sapiens
tcctgcgtcccagcct

SEQ ID NO: 4506498 - DNA, 22 bp, Homo sapiens
tcctgctcaactctacccctgc

SEQ ID NO: 4506499 - DNA, 20 bp, Homo sapiens
tcctgctccctgtggcactc

SEQ ID NO: 4506500 - DNA, 23 bp, Homo sapiens
tcctgctgactatttgaccccca

SEQ ID NO: 4506501 - DNA, 18 bp, Homo sapiens
tcctgctgcctctctttc

SEQ ID NO: 4506502 - DNA, 18 bp, Homo sapiens
tcctggaacttgctctca

SEQ ID NO: 4506503 - DNA, 17 bp, Homo sapiens
tcctggaaggacacagt

SEQ ID NO: 4506504 - DNA, 19 bp, Homo sapiens
tcctggaaggacacagtga

SEQ ID NO: 4506505 - DNA, 23 bp, Homo sapiens
tcctggaaggacacagtgatgaa

SEQ ID NO: 4506506 - DNA, 14 bp, Homo sapiens
tcctggacatcacc

SEQ ID NO: 4506507 - DNA, 21 bp, Homo sapiens
tcctggacatgaagattcttt

SEQ ID NO: 4506508 - DNA, 17 bp, Homo sapiens
tcctggaccaggcccat

SEQ ID NO: 4506509 - DNA, 17 bp, Homo sapiens
tcctggactccggagga

SEQ ID NO: 4506510 - DNA, 19 bp, Homo sapiens
tcctggactccggaggact

SEQ ID NO: 4506511 - DNA, 23 bp, Homo sapiens
tcctggactccggaggactgagc

SEQ ID NO: 4506512 - DNA, 14 bp, Homo sapiens
tcctggactgaggg

SEQ ID NO: 4506513 - DNA, 22 bp, Homo sapiens
tcctggactgagggggcctgga

SEQ ID NO: 4506514 - DNA, 15 bp, Homo sapiens
tcctggagcccagag

SEQ ID NO: 4506515 - DNA, 18 bp, Homo sapiens
tcctggagcccagaggag

SEQ ID NO: 4506516 - DNA, 14 bp, Homo sapiens
tcctggcagctgct

SEQ ID NO: 4506517 - DNA, 19 bp, Homo sapiens
tcctggccaagcaggctgg

SEQ ID NO: 4506518 - DNA, 13 bp, Homo sapiens
tcctggcccaggg

SEQ ID NO: 4506519 - DNA, 15 bp, Homo sapiens
tcctggcccagggca

SEQ ID NO: 4506520 - DNA, 19 bp, Homo sapiens
tcctggcccagggcatctg

SEQ ID NO: 4506521 - DNA, 22 bp, Homo sapiens
tcctggcctatccgctgccagc

SEQ ID NO: 4506522 - DNA, 23 bp, Homo sapiens
tcctggcctatccgctgccagcc

SEQ ID NO: 4506523 - DNA, 18 bp, Homo sapiens
tcctggccttctgaactc

SEQ ID NO: 4506524 - DNA, 14 bp, Homo sapiens
tcctgggaaatatt

SEQ ID NO: 4506525 - DNA, 16 bp, Homo sapiens
tcctgggaggacaggc

SEQ ID NO: 4506526 - DNA, 16 bp, Homo sapiens
tcctgggcccctccct

SEQ ID NO: 4506527 - DNA, 18 bp, Homo sapiens
tcctgggcccctccctac

SEQ ID NO: 4506528 - DNA, 19 bp, Homo sapiens
tcctgggcccctccctacc

SEQ ID NO: 4506529 - DNA, 20 bp, Homo sapiens
tcctgggcccctccctacct

SEQ ID NO: 4506530 - DNA, 21 bp, Homo sapiens
tcctgggcccctccctacctc

SEQ ID NO: 4506531 - DNA, 22 bp, Homo sapiens
tcctgggcccctccctacctca

SEQ ID NO: 4506532 - DNA, 17 bp, Homo sapiens
tcctgggccctctctgc

SEQ ID NO: 4506533 - DNA, 14 bp, Homo sapiens
tcctgggccctggg

SEQ ID NO: 4506534 - DNA, 14 bp, Homo sapiens
tcctgggcctgccc

SEQ ID NO: 4506535 - DNA, 18 bp, Homo sapiens
tcctgggcctttgcaaga

SEQ ID NO: 4506536 - DNA, 23 bp, Homo sapiens
tcctgggctcaaatgatcctccc

SEQ ID NO: 4506537 - DNA, 14 bp, Homo sapiens
tcctgggctccaga

SEQ ID NO: 4506538 - DNA, 19 bp, Homo sapiens
tcctggggagctcctggga

SEQ ID NO: 4506539 - DNA, 17 bp, Homo sapiens
tcctgggttttgtattc

SEQ ID NO: 4506540 - DNA, 20 bp, Homo sapiens
tcctggtgccaatttcaagt

SEQ ID NO: 4506541 - DNA, 12 bp, Homo sapiens
tcctggtgctgc

SEQ ID NO: 4506542 - DNA, 17 bp, Homo sapiens
tcctggtgctgccgagg

SEQ ID NO: 4506543 - DNA, 19 bp, Homo sapiens
tcctggtgctgccgagggc

SEQ ID NO: 4506544 - DNA, 20 bp, Homo sapiens
tcctggtgctgccgagggct

SEQ ID NO: 4506545 - DNA, 16 bp, Homo sapiens
tcctggtttttgccta

SEQ ID NO: 4506546 - DNA, 13 bp, Homo sapiens
tcctgtaactgtt

SEQ ID NO: 4506547 - DNA, 16 bp, Homo sapiens
tcctgtaagaagcggc

SEQ ID NO: 4506548 - DNA, 21 bp, Homo sapiens
tcctgtaagccaaagaaatga

SEQ ID NO: 4506549 - DNA, 14 bp, Homo sapiens
tcctgtaatatatt

SEQ ID NO: 4506550 - DNA, 14 bp, Homo sapiens
tcctgtacctcagt

SEQ ID NO: 4506551 - DNA, 18 bp, Homo sapiens
tcctgtaggctaaaaggc

SEQ ID NO: 4506552 - DNA, 14 bp, Homo sapiens
tcctgtattcttgt

SEQ ID NO: 4506553 - DNA, 22 bp, Homo sapiens
tcctgtcagataggattttctc

SEQ ID NO: 4506554 - DNA, 19 bp, Homo sapiens
tcctgtccctcatccatag

SEQ ID NO: 4506555 - DNA, 13 bp, Homo sapiens
tcctgtcctccct

SEQ ID NO: 4506556 - DNA, 15 bp, Homo sapiens
tcctgtcctccctca

SEQ ID NO: 4506557 - DNA, 17 bp, Homo sapiens
tcctgtcctgcccgtga

SEQ ID NO: 4506558 - DNA, 15 bp, Homo sapiens
tcctgtctccctcct

SEQ ID NO: 4506559 - DNA, 16 bp, Homo sapiens
tcctgtctggctcgga

SEQ ID NO: 4506560 - DNA, 12 bp, Homo sapiens
tcctgtctgttt

SEQ ID NO: 4506561 - DNA, 16 bp, Homo sapiens
tcctgtcttcccaggg

SEQ ID NO: 4506562 - DNA, 15 bp, Homo sapiens
tcctgtgagatgtgt

SEQ ID NO: 4506563 - DNA, 19 bp, Homo sapiens
tcctgtgatgtcagcggtg

SEQ ID NO: 4506564 - DNA, 23 bp, Homo sapiens
tcctgtgcattggtggcatcaca

SEQ ID NO: 4506565 - DNA, 13 bp, Homo sapiens
tcctgtgcctggc

SEQ ID NO: 4506566 - DNA, 16 bp, Homo sapiens
tcctgtgcctttccta

SEQ ID NO: 4506567 - DNA, 21 bp, Homo sapiens
tcctgtgcctttcctatcacc

SEQ ID NO: 4506568 - DNA, 19 bp, Homo sapiens
tcctgtgctcaccctctct

SEQ ID NO: 4506569 - DNA, 23 bp, Homo sapiens
tcctgtggaaggcagagaaatct

SEQ ID NO: 4506570 - DNA, 15 bp, Homo sapiens
tcctgtggaataaag

SEQ ID NO: 4506571 - DNA, 18 bp, Homo sapiens
tcctgtggaataaagatg

SEQ ID NO: 4506572 - DNA, 20 bp, Homo sapiens
tcctgtgggtgttctttcct

SEQ ID NO: 4506573 - DNA, 18 bp, Homo sapiens
tcctgtggttttattaca

SEQ ID NO: 4506574 - DNA, 19 bp, Homo sapiens
tcctgtgtaacgactacaa

SEQ ID NO: 4506575 - DNA, 15 bp, Homo sapiens
tcctgtgtactgtgt

SEQ ID NO: 4506576 - DNA, 19 bp, Homo sapiens
tcctgtgtattaaaccttt

SEQ ID NO: 4506577 - DNA, 16 bp, Homo sapiens
tcctgttcagcattct

SEQ ID NO: 4506578 - DNA, 18 bp, Homo sapiens
tcctgttcagtaataaaa

SEQ ID NO: 4506579 - DNA, 19 bp, Homo sapiens
tcctgttcttaagacgtga

SEQ ID NO: 4506580 - DNA, 20 bp, Homo sapiens
tcctgttgcacccagccctg

SEQ ID NO: 4506581 - DNA, 22 bp, Homo sapiens
tcctgttgcacccagccctggt

SEQ ID NO: 4506582 - DNA, 18 bp, Homo sapiens
tcctgtttcctagctgtg

SEQ ID NO: 4506583 - DNA, 18 bp, Homo sapiens
tcctgtttgaaatatcat

SEQ ID NO: 4506584 - DNA, 17 bp, Homo sapiens
tcctgtttgtctacata

SEQ ID NO: 4506585 - DNA, 17 bp, Homo sapiens
tcctgttttatatatta

SEQ ID NO: 4506586 - DNA, 19 bp, Homo sapiens
tccttaacccacctctcct

SEQ ID NO: 4506587 - DNA, 22 bp, Homo sapiens
tccttaacccacctctcctgcc

SEQ ID NO: 4506588 - DNA, 19 bp, Homo sapiens
tccttaaggctcttttgta

SEQ ID NO: 4506589 - DNA, 21 bp, Homo sapiens
tccttacaagttagaaaacat

SEQ ID NO: 4506590 - DNA, 22 bp, Homo sapiens
tccttacaagttagaaaacata

SEQ ID NO: 4506591 - DNA, 21 bp, Homo sapiens
tccttatccctctcttcccct

SEQ ID NO: 4506592 - DNA, 22 bp, Homo sapiens
tccttatccctctcttcccctt

SEQ ID NO: 4506593 - DNA, 16 bp, Homo sapiens
tccttatttagcctag

SEQ ID NO: 4506594 - DNA, 11 bp, Homo sapiens
tccttatttat

SEQ ID NO: 4506595 - DNA, 13 bp, Homo sapiens
tccttatttgcct

SEQ ID NO: 4506596 - DNA, 14 bp, Homo sapiens
tccttatttgcctt

SEQ ID NO: 4506597 - DNA, 21 bp, Homo sapiens
tccttatttgccttctactcc

SEQ ID NO: 4506598 - DNA, 13 bp, Homo sapiens
tccttcaaagtct

SEQ ID NO: 4506599 - DNA, 18 bp, Homo sapiens
tccttcaaagtctcaatg

SEQ ID NO: 4506600 - DNA, 20 bp, Homo sapiens
tccttcaacaattctaaaat

SEQ ID NO: 4506601 - DNA, 16 bp, Homo sapiens
tccttcactcatccag

SEQ ID NO: 4506602 - DNA, 14 bp, Homo sapiens
tccttcagatttgg

SEQ ID NO: 4506603 - DNA, 14 bp, Homo sapiens
tccttcagccctca

SEQ ID NO: 4506604 - DNA, 19 bp, Homo sapiens
tccttcagccctcacccct

SEQ ID NO: 4506605 - DNA, 21 bp, Homo sapiens
tccttcagccctcacccctgg

SEQ ID NO: 4506606 - DNA, 13 bp, Homo sapiens
tccttcaggactc

SEQ ID NO: 4506607 - DNA, 19 bp, Homo sapiens
tccttcagtgagcccctcc

SEQ ID NO: 4506608 - DNA, 19 bp, Homo sapiens
tccttcatgacagcctcca

SEQ ID NO: 4506609 - DNA, 24 bp, Homo sapiens
tccttcatttccaccaggccgtgc

SEQ ID NO: 4506610 - DNA, 15 bp, Homo sapiens
tccttccactgtgca

SEQ ID NO: 4506611 - DNA, 19 bp, Homo sapiens
tccttccagatgcccgagc

SEQ ID NO: 4506612 - DNA, 16 bp, Homo sapiens
tccttccccagaccca

SEQ ID NO: 4506613 - DNA, 17 bp, Homo sapiens
tccttccccagacccag

SEQ ID NO: 4506614 - DNA, 16 bp, Homo sapiens
tccttccctcctttta

SEQ ID NO: 4506615 - DNA, 18 bp, Homo sapiens
tccttccctccttttaaa

SEQ ID NO: 4506616 - DNA, 14 bp, Homo sapiens
tccttccctctctg

SEQ ID NO: 4506617 - DNA, 14 bp, Homo sapiens
tccttccctggctt

SEQ ID NO: 4506618 - DNA, 20 bp, Homo sapiens
tccttcctggagcccagagg

SEQ ID NO: 4506619 - DNA, 14 bp, Homo sapiens
tccttccttcagga

SEQ ID NO: 4506620 - DNA, 15 bp, Homo sapiens
tccttccttccctgg

SEQ ID NO: 4506621 - DNA, 16 bp, Homo sapiens
tccttccttccctggc

SEQ ID NO: 4506622 - DNA, 16 bp, Homo sapiens
tccttctaccccaagg

SEQ ID NO: 4506623 - DNA, 14 bp, Homo sapiens
tccttctcccatct

SEQ ID NO: 4506624 - DNA, 23 bp, Homo sapiens
tccttctttttcatatttctacc

SEQ ID NO: 4506625 - DNA, 16 bp, Homo sapiens
tccttgagaatctttg

SEQ ID NO: 4506626 - DNA, 13 bp, Homo sapiens
tccttgaggacag

SEQ ID NO: 4506627 - DNA, 14 bp, Homo sapiens
tccttgaggacaga

SEQ ID NO: 4506628 - DNA, 17 bp, Homo sapiens
tccttgataatatattg

SEQ ID NO: 4506629 - DNA, 17 bp, Homo sapiens
tccttgcacctgcatcc

SEQ ID NO: 4506630 - DNA, 20 bp, Homo sapiens
tccttgccccccgccctcat

SEQ ID NO: 4506631 - DNA, 18 bp, Homo sapiens
tccttgcctgaactccag

SEQ ID NO: 4506632 - DNA, 13 bp, Homo sapiens
tccttgcgcctca

SEQ ID NO: 4506633 - DNA, 18 bp, Homo sapiens
tccttgcgcctcagccct

SEQ ID NO: 4506634 - DNA, 23 bp, Homo sapiens
tccttgcgcctcagccctcagtt

SEQ ID NO: 4506635 - DNA, 15 bp, Homo sapiens
tccttgctatttcaa

SEQ ID NO: 4506636 - DNA, 18 bp, Homo sapiens
tccttgctggtagaagct

SEQ ID NO: 4506637 - DNA, 17 bp, Homo sapiens
tccttggagtcccaggg

SEQ ID NO: 4506638 - DNA, 19 bp, Homo sapiens
tccttggcacccccatgct

SEQ ID NO: 4506639 - DNA, 20 bp, Homo sapiens
tccttggcacccccatgctg

SEQ ID NO: 4506640 - DNA, 17 bp, Homo sapiens
tccttggccatgcagaa

SEQ ID NO: 4506641 - DNA, 21 bp, Homo sapiens
tccttggttatatttttttaa

SEQ ID NO: 4506642 - DNA, 20 bp, Homo sapiens
tccttgtcaacaaagtgctt

SEQ ID NO: 4506643 - DNA, 23 bp, Homo sapiens
tccttgtgcaaaatatttgacta

SEQ ID NO: 4506644 - DNA, 13 bp, Homo sapiens
tcctttaaaaata

SEQ ID NO: 4506645 - DNA, 21 bp, Homo sapiens
tcctttacaactaaataacac

SEQ ID NO: 4506646 - DNA, 23 bp, Homo sapiens
tcctttacaactaaataacacag

SEQ ID NO: 4506647 - DNA, 20 bp, Homo sapiens
tcctttagggttctgcctct

SEQ ID NO: 4506648 - DNA, 23 bp, Homo sapiens
tcctttagtaaaactccgagtga

SEQ ID NO: 4506649 - DNA, 24 bp, Homo sapiens
tctcccacccggccacagctgctg

SEQ ID NO: 4506650 - DNA, 16 bp, Homo sapiens
tctcccagataatgtg

SEQ ID NO: 4506651 - DNA, 18 bp, Homo sapiens
tctcccaggccccagggg

SEQ ID NO: 4506652 - DNA, 21 bp, Homo sapiens
tctcccaggccccaggggaga

SEQ ID NO: 4506653 - DNA, 16 bp, Homo sapiens
tctcccaggcctgcct

SEQ ID NO: 4506654 - DNA, 18 bp, Homo sapiens
tctcccaggcctgcctgc

SEQ ID NO: 4506655 - DNA, 14 bp, Homo sapiens
tctcccagtatgtt

SEQ ID NO: 4506656 - DNA, 18 bp, Homo sapiens
tctcccatggagccccag

SEQ ID NO: 4506657 - DNA, 19 bp, Homo sapiens
tctccccaaagctttatct

SEQ ID NO: 4506658 - DNA, 11 bp, Homo sapiens
tctccccacac

SEQ ID NO: 4506659 - DNA, 19 bp, Homo sapiens
tctccccacgagggctggc

SEQ ID NO: 4506660 - DNA, 20 bp, Homo sapiens
tctccccacgagggctggct

SEQ ID NO: 4506661 - DNA, 13 bp, Homo sapiens
tctccccagcccc

SEQ ID NO: 4506662 - DNA, 12 bp, Homo sapiens
tctccccagtgc

SEQ ID NO: 4506663 - DNA, 16 bp, Homo sapiens
tctccccagtgcctgc

SEQ ID NO: 4506664 - DNA, 21 bp, Homo sapiens
tctccccagtgcctgccactc

SEQ ID NO: 4506665 - DNA, 23 bp, Homo sapiens
tctccccagtgcctgccactctc

SEQ ID NO: 4506666 - DNA, 22 bp, Homo sapiens
tctcccccttgccctcattctt

SEQ ID NO: 4506667 - DNA, 19 bp, Homo sapiens
tctccccgtgtcctctccc

SEQ ID NO: 4506668 - DNA, 17 bp, Homo sapiens
tctcccctcctctgaat

SEQ ID NO: 4506669 - DNA, 14 bp, Homo sapiens
tctccctctcctgc

SEQ ID NO: 4506670 - DNA, 16 bp, Homo sapiens
tctccctctcctgcct

SEQ ID NO: 4506671 - DNA, 15 bp, Homo sapiens
tctccctctggccct

SEQ ID NO: 4506672 - DNA, 17 bp, Homo sapiens
tctccctctggccctgc

SEQ ID NO: 4506673 - DNA, 19 bp, Homo sapiens
tctccctctggccctgcct

SEQ ID NO: 4506674 - DNA, 13 bp, Homo sapiens
tctccctgccgcc

SEQ ID NO: 4506675 - DNA, 15 bp, Homo sapiens
tctccctgcctggcc

SEQ ID NO: 4506676 - DNA, 15 bp, Homo sapiens
tctccctggctccct

SEQ ID NO: 4506677 - DNA, 13 bp, Homo sapiens
tctccctgtgttc

SEQ ID NO: 4506678 - DNA, 20 bp, Homo sapiens
tctccctgtgttctgggctg

SEQ ID NO: 4506679 - DNA, 17 bp, Homo sapiens
tctcccttcctctctcc

SEQ ID NO: 4506680 - DNA, 12 bp, Homo sapiens
tctcccttctca

SEQ ID NO: 4506681 - DNA, 13 bp, Homo sapiens
tctccctttctct

SEQ ID NO: 4506682 - DNA, 20 bp, Homo sapiens
tctccgccagcctcctctgg

SEQ ID NO: 4506683 - DNA, 16 bp, Homo sapiens
tctccgcctccacact

SEQ ID NO: 4506684 - DNA, 16 bp, Homo sapiens
tctccgggtgtggcct

SEQ ID NO: 4506685 - DNA, 18 bp, Homo sapiens
tctccgggtgtggcctca

SEQ ID NO: 4506686 - DNA, 15 bp, Homo sapiens
tctccgttccatctg

SEQ ID NO: 4506687 - DNA, 20 bp, Homo sapiens
tctccgttccatctgggctt

SEQ ID NO: 4506688 - DNA, 15 bp, Homo sapiens
tctcctatatatttc

SEQ ID NO: 4506689 - DNA, 23 bp, Homo sapiens
tctcctatatatttctattatta

SEQ ID NO: 4506690 - DNA, 21 bp, Homo sapiens
tctcctattccttcacacagt

SEQ ID NO: 4506691 - DNA, 15 bp, Homo sapiens
tctcctcactctgtc

SEQ ID NO: 4506692 - DNA, 20 bp, Homo sapiens
tctcctcactctgtccctgt

SEQ ID NO: 4506693 - DNA, 21 bp, Homo sapiens
tctcctcagtggcttctccag

SEQ ID NO: 4506694 - DNA, 17 bp, Homo sapiens
tctcctccccttcctgt

SEQ ID NO: 4506695 - DNA, 23 bp, Homo sapiens
tctcctcccgcccttccatgtgc

SEQ ID NO: 4506696 - DNA, 11 bp, Homo sapiens
tctcctccctc

SEQ ID NO: 4506697 - DNA, 14 bp, Homo sapiens
tctcctccctcagc

SEQ ID NO: 4506698 - DNA, 13 bp, Homo sapiens
tctcctcccttcc

SEQ ID NO: 4506699 - DNA, 14 bp, Homo sapiens
tctcctcccttcct

SEQ ID NO: 4506700 - DNA, 23 bp, Homo sapiens
tctcctcccttccttttccctgc

SEQ ID NO: 4506701 - DNA, 13 bp, Homo sapiens
tctcctcctcccc

SEQ ID NO: 4506702 - DNA, 15 bp, Homo sapiens
tctcctcctcccctc

SEQ ID NO: 4506703 - DNA, 17 bp, Homo sapiens
tctcctctatggaagga

SEQ ID NO: 4506704 - DNA, 11 bp, Homo sapiens
tctcctctctg

SEQ ID NO: 4506705 - DNA, 15 bp, Homo sapiens
tctcctctctgcttc

SEQ ID NO: 4506706 - DNA, 19 bp, Homo sapiens
tctcctctgctcattaaac

SEQ ID NO: 4506707 - DNA, 14 bp, Homo sapiens
tctcctctttaaaa

SEQ ID NO: 4506708 - DNA, 21 bp, Homo sapiens
tctcctgacctcgtgatgggc

SEQ ID NO: 4506709 - DNA, 14 bp, Homo sapiens
tctcctgcaaattt

SEQ ID NO: 4506710 - DNA, 18 bp, Homo sapiens
tctcctgcaaatttagtt

SEQ ID NO: 4506711 - DNA, 12 bp, Homo sapiens
tctcctgccctg

SEQ ID NO: 4506712 - DNA, 14 bp, Homo sapiens
tctcctgccctgtg

SEQ ID NO: 4506713 - DNA, 14 bp, Homo sapiens
tctcctgcctactc

SEQ ID NO: 4506714 - DNA, 15 bp, Homo sapiens
tctcctgcctactca

SEQ ID NO: 4506715 - DNA, 12 bp, Homo sapiens
tctcctgcctca

SEQ ID NO: 4506716 - DNA, 22 bp, Homo sapiens
tctcctgggcccctccctacct

SEQ ID NO: 4506717 - DNA, 17 bp, Homo sapiens
tctcctgtcctccctca

SEQ ID NO: 4506718 - DNA, 17 bp, Homo sapiens
tctccttagacactttg

SEQ ID NO: 4506719 - DNA, 20 bp, Homo sapiens
tctccttatagacacttgct

SEQ ID NO: 4506720 - DNA, 18 bp, Homo sapiens
tctccttcccctacacct

SEQ ID NO: 4506721 - DNA, 22 bp, Homo sapiens
tctccttgccccccgccctcat

SEQ ID NO: 4506722 - DNA, 18 bp, Homo sapiens
tctccttggaaggtcttt

SEQ ID NO: 4506723 - DNA, 14 bp, Homo sapiens
tctccttggccaca

SEQ ID NO: 4506724 - DNA, 17 bp, Homo sapiens
tctcctttaattgtaaa

SEQ ID NO: 4506725 - DNA, 12 bp, Homo sapiens
tctcctttgaaa

SEQ ID NO: 4506726 - DNA, 12 bp, Homo sapiens
tctcctttgcaa

SEQ ID NO: 4506727 - DNA, 11 bp, Homo sapiens
tctcctttgta

SEQ ID NO: 4506728 - DNA, 21 bp, Homo sapiens
tctccttttatctggtgcctc

SEQ ID NO: 4506729 - DNA, 22 bp, Homo sapiens
tctccttttatctggtgcctcc

SEQ ID NO: 4506730 - DNA, 14 bp, Homo sapiens
tctcgatctcctga

SEQ ID NO: 4506731 - DNA, 17 bp, Homo sapiens
tctcgatgcaatgaaca

SEQ ID NO: 4506732 - DNA, 13 bp, Homo sapiens
tctcgccccttcc

SEQ ID NO: 4506733 - DNA, 22 bp, Homo sapiens
tctcgctgcgcagcctccaggg

SEQ ID NO: 4506734 - DNA, 19 bp, Homo sapiens
tctcggactaagcctacct

SEQ ID NO: 4506735 - DNA, 21 bp, Homo sapiens
tctcggcatagtccccagagc

SEQ ID NO: 4506736 - DNA, 17 bp, Homo sapiens
tctcggcccctgtctgt

SEQ ID NO: 4506737 - DNA, 16 bp, Homo sapiens
tctcggtgctccatct

SEQ ID NO: 4506738 - DNA, 19 bp, Homo sapiens
tctcgtggtaggactgtag

SEQ ID NO: 4506739 - DNA, 23 bp, Homo sapiens
tctcgttttgttgccaaagctgg

SEQ ID NO: 4506740 - DNA, 22 bp, Homo sapiens
tctctacaggtccgtttcctta

SEQ ID NO: 4506741 - DNA, 22 bp, Homo sapiens
tctctaccttttaaaattgaat

SEQ ID NO: 4506742 - DNA, 14 bp, Homo sapiens
tctctactaaaaat

SEQ ID NO: 4506743 - DNA, 18 bp, Homo sapiens
tctctactaaaaatacaa

SEQ ID NO: 4506744 - DNA, 15 bp, Homo sapiens
tctctactaaaaatg

SEQ ID NO: 4506745 - DNA, 17 bp, Homo sapiens
tctctactaaaaatgca

SEQ ID NO: 4506746 - DNA, 22 bp, Homo sapiens
tctctactgaatgtcattgaaa

SEQ ID NO: 4506747 - DNA, 16 bp, Homo sapiens
tctctactgttattat

SEQ ID NO: 4506748 - DNA, 13 bp, Homo sapiens
tctctagacaaaa

SEQ ID NO: 4506749 - DNA, 17 bp, Homo sapiens
tctctagtagttagaaa

SEQ ID NO: 4506750 - DNA, 16 bp, Homo sapiens
tctctataaaaaatat

SEQ ID NO: 4506751 - DNA, 22 bp, Homo sapiens
tctctatccaaaataaagatca

SEQ ID NO: 4506752 - DNA, 14 bp, Homo sapiens
tctctatttaaatt

SEQ ID NO: 4506753 - DNA, 15 bp, Homo sapiens
tctctatttaaattc

SEQ ID NO: 4506754 - DNA, 16 bp, Homo sapiens
tctctatttaaattct

SEQ ID NO: 4506755 - DNA, 17 bp, Homo sapiens
tctctatttaaattctt

SEQ ID NO: 4506756 - DNA, 14 bp, Homo sapiens
tctctattttactt

SEQ ID NO: 4506757 - DNA, 15 bp, Homo sapiens
tctctcactcccctc

SEQ ID NO: 4506758 - DNA, 15 bp, Homo sapiens
tctctcatagaacat

SEQ ID NO: 4506759 - DNA, 19 bp, Homo sapiens
tctctcatagaacattgat

SEQ ID NO: 4506760 - DNA, 18 bp, Homo sapiens
tctctcatgcctcctgag

SEQ ID NO: 4506761 - DNA, 16 bp, Homo sapiens
tctctcattgtctgtg

SEQ ID NO: 4506762 - DNA, 22 bp, Homo sapiens
tctctcccagtctacccagaga

SEQ ID NO: 4506763 - DNA, 13 bp, Homo sapiens
tctctccccagcc

SEQ ID NO: 4506764 - DNA, 16 bp, Homo sapiens
tctctccccagccccc

SEQ ID NO: 4506765 - DNA, 16 bp, Homo sapiens
tctctccccatatata

SEQ ID NO: 4506766 - DNA, 21 bp, Homo sapiens
tctctccccatatataaatta

SEQ ID NO: 4506767 - DNA, 19 bp, Homo sapiens
tctctcccctcctctgaat

SEQ ID NO: 4506768 - DNA, 14 bp, Homo sapiens
tctctcccttcctc

SEQ ID NO: 4506769 - DNA, 11 bp, Homo sapiens
tctctcctctc

SEQ ID NO: 4506770 - DNA, 15 bp, Homo sapiens
tctctcctctctgct

SEQ ID NO: 4506771 - DNA, 16 bp, Homo sapiens
tctctcctctctgctt

SEQ ID NO: 4506772 - DNA, 16 bp, Homo sapiens
tctctcctggcctatc

SEQ ID NO: 4506773 - DNA, 20 bp, Homo sapiens
tctctcctgtaagccaaaga

SEQ ID NO: 4506774 - DNA, 13 bp, Homo sapiens
tctctcctgtcct

SEQ ID NO: 4506775 - DNA, 15 bp, Homo sapiens
tctctccttgccccc

SEQ ID NO: 4506776 - DNA, 13 bp, Homo sapiens
tctctccttggcc

SEQ ID NO: 4506777 - DNA, 17 bp, Homo sapiens
tctctccttggccacag

SEQ ID NO: 4506778 - DNA, 14 bp, Homo sapiens
tctctcggcccctg

SEQ ID NO: 4506779 - DNA, 21 bp, Homo sapiens
tctctcggcccctgtctgttc

SEQ ID NO: 4506780 - DNA, 11 bp, Homo sapiens
tctctctcact

SEQ ID NO: 4506781 - DNA, 14 bp, Homo sapiens
tctctctcatgcct

SEQ ID NO: 4506782 - DNA, 18 bp, Homo sapiens
tctctctcccatggagcc

SEQ ID NO: 4506783 - DNA, 11 bp, Homo sapiens
tctctctcctc

SEQ ID NO: 4506784 - DNA, 13 bp, Homo sapiens
tctctctcctctc

SEQ ID NO: 4506785 - DNA, 11 bp, Homo sapiens
tctctctgccc

SEQ ID NO: 4506786 - DNA, 15 bp, Homo sapiens
tctctctggggccct

SEQ ID NO: 4506787 - DNA, 17 bp, Homo sapiens
tctctctgtgctgtgga

SEQ ID NO: 4506788 - DNA, 21 bp, Homo sapiens
tctctctgtgctgtggaagca

SEQ ID NO: 4506789 - DNA, 21 bp, Homo sapiens
tctctcttattgttctttcat

SEQ ID NO: 4506790 - DNA, 11 bp, Homo sapiens
tctctcttctg

SEQ ID NO: 4506791 - DNA, 20 bp, Homo sapiens
tctctcttctgctccaccct

SEQ ID NO: 4506792 - DNA, 13 bp, Homo sapiens
tctctcttggacc

SEQ ID NO: 4506793 - DNA, 19 bp, Homo sapiens
tctctcttggacccacctg

SEQ ID NO: 4506794 - DNA, 13 bp, Homo sapiens
tctctcttgtcct

SEQ ID NO: 4506795 - DNA, 21 bp, Homo sapiens
tctctcttgtcctcttctgct

SEQ ID NO: 4506796 - DNA, 18 bp, Homo sapiens
tctctgaagggacccccc

SEQ ID NO: 4506797 - DNA, 17 bp, Homo sapiens
tctctgaatacacagta

SEQ ID NO: 4506798 - DNA, 15 bp, Homo sapiens
tctctgagctgtgca

SEQ ID NO: 4506799 - DNA, 14 bp, Homo sapiens
tctctgatacacag

SEQ ID NO: 4506800 - DNA, 15 bp, Homo sapiens
tctctgatacacagt

SEQ ID NO: 4506801 - DNA, 15 bp, Homo sapiens
tctctgatgtcccag

SEQ ID NO: 4506802 - DNA, 22 bp, Homo sapiens
tctctgcaattttactgtgaaa

SEQ ID NO: 4506803 - DNA, 16 bp, Homo sapiens
tctctgcagccagccc

SEQ ID NO: 4506804 - DNA, 20 bp, Homo sapiens
tctctgcagtaaaacacatt

SEQ ID NO: 4506805 - DNA, 23 bp, Homo sapiens
tctctgccattctgtgcaggctg

SEQ ID NO: 4506806 - DNA, 16 bp, Homo sapiens
tctctgcccagccggg

SEQ ID NO: 4506807 - DNA, 16 bp, Homo sapiens
tctctgccctctccct

SEQ ID NO: 4506808 - DNA, 15 bp, Homo sapiens
tctctgctccaccac

SEQ ID NO: 4506809 - DNA, 19 bp, Homo sapiens
tctctgctccaccacatcc

SEQ ID NO: 4506810 - DNA, 11 bp, Homo sapiens
tctctgctgta

SEQ ID NO: 4506811 - DNA, 20 bp, Homo sapiens
tctctggaagcccctgggcc

SEQ ID NO: 4506812 - DNA, 18 bp, Homo sapiens
tctctggcaaacttttct

SEQ ID NO: 4506813 - DNA, 17 bp, Homo sapiens
tctctgggacctcctta

SEQ ID NO: 4506814 - DNA, 21 bp, Homo sapiens
tctctgggactctcctcctcc

SEQ ID NO: 4506815 - DNA, 23 bp, Homo sapiens
tctctgggactctcctcctcccc

SEQ ID NO: 4506816 - DNA, 20 bp, Homo sapiens
tctctggtccggacactcct

SEQ ID NO: 4506817 - DNA, 22 bp, Homo sapiens
tctctgtataatctatttacat

SEQ ID NO: 4506818 - DNA, 12 bp, Homo sapiens
tctctgtctcat

SEQ ID NO: 4506819 - DNA, 14 bp, Homo sapiens
tctctgtctcatcc

SEQ ID NO: 4506820 - DNA, 23 bp, Homo sapiens
tctctgtctcatccatcatcatg

SEQ ID NO: 4506821 - DNA, 20 bp, Homo sapiens
tctctgtgtgtgtatgagag

SEQ ID NO: 4506822 - DNA, 20 bp, Homo sapiens
tctctgttacacactaacat

SEQ ID NO: 4506823 - DNA, 14 bp, Homo sapiens
tctctgttcttttc

SEQ ID NO: 4506824 - DNA, 14 bp, Homo sapiens
tctcttacatctcc

SEQ ID NO: 4506825 - DNA, 21 bp, Homo sapiens
tctcttaggtgagacagttgc

SEQ ID NO: 4506826 - DNA, 13 bp, Homo sapiens
tctcttcaataaa

SEQ ID NO: 4506827 - DNA, 23 bp, Homo sapiens
tctcttcaataaaccacaagcat

SEQ ID NO: 4506828 - DNA, 19 bp, Homo sapiens
tctcttcattattctctgc

SEQ ID NO: 4506829 - DNA, 14 bp, Homo sapiens
tctcttccacagtg

SEQ ID NO: 4506830 - DNA, 16 bp, Homo sapiens
tctcttccacatgtta

SEQ ID NO: 4506831 - DNA, 18 bp, Homo sapiens
tctcttccccttccctta

SEQ ID NO: 4506832 - DNA, 18 bp, Homo sapiens
tctcttccctttgtgtat

SEQ ID NO: 4506833 - DNA, 12 bp, Homo sapiens
tctcttccttga

SEQ ID NO: 4506834 - DNA, 18 bp, Homo sapiens
tctcttgagcatcaatct

SEQ ID NO: 4506835 - DNA, 21 bp, Homo sapiens
tctcttggaaaataagacaat

SEQ ID NO: 4506836 - DNA, 16 bp, Homo sapiens
tctcttggtggggagg

SEQ ID NO: 4506837 - DNA, 18 bp, Homo sapiens
tctcttgtcctcttctgc

SEQ ID NO: 4506838 - DNA, 21 bp, Homo sapiens
tctctttaattttaactgatt

SEQ ID NO: 4506839 - DNA, 22 bp, Homo sapiens
tctctttacctttgccctacct

SEQ ID NO: 4506840 - DNA, 13 bp, Homo sapiens
tctctttattata

SEQ ID NO: 4506841 - DNA, 17 bp, Homo sapiens
tctctttattataagtg

SEQ ID NO: 4506842 - DNA, 14 bp, Homo sapiens
tctctttcacacaa

SEQ ID NO: 4506843 - DNA, 14 bp, Homo sapiens
tctctttctctcct

SEQ ID NO: 4506844 - DNA, 15 bp, Homo sapiens
tctcttttaaagtat

SEQ ID NO: 4506845 - DNA, 11 bp, Homo sapiens
tctcttttcta

SEQ ID NO: 4506846 - DNA, 17 bp, Homo sapiens
tctcttttctgtacttc

SEQ ID NO: 4506847 - DNA, 20 bp, Homo sapiens
tctgaaaacctaccagccag

SEQ ID NO: 4506848 - DNA, 9 bp, Homo sapiens
tctgaaaca

SEQ ID NO: 4506849 - DNA, 11 bp, Homo sapiens
tctgaaacagc

SEQ ID NO: 4506850 - DNA, 13 bp, Homo sapiens
tctgaaacagctg

SEQ ID NO: 4506851 - DNA, 17 bp, Homo sapiens
tctgaaacagctgcctt

SEQ ID NO: 4506852 - DNA, 22 bp, Homo sapiens
tctgaaacagctgccttagctt

SEQ ID NO: 4506853 - DNA, 20 bp, Homo sapiens
tctgaaacatttcataattt

SEQ ID NO: 4506854 - DNA, 13 bp, Homo sapiens
tctgaaactggct

SEQ ID NO: 4506855 - DNA, 15 bp, Homo sapiens
tctgaaagaatcatt

SEQ ID NO: 4506856 - DNA, 12 bp, Homo sapiens
tctgaaagccac

SEQ ID NO: 4506857 - DNA, 19 bp, Homo sapiens
tctgaaattcaaaatgctc

SEQ ID NO: 4506858 - DNA, 14 bp, Homo sapiens
tctgaactcaaact

SEQ ID NO: 4506859 - DNA, 17 bp, Homo sapiens
tctgaactcaaactgag

SEQ ID NO: 4506860 - DNA, 20 bp, Homo sapiens
tctgaactccatacagcctc

SEQ ID NO: 4506861 - DNA, 23 bp, Homo sapiens
tctgaacttgagtataagataaa

SEQ ID NO: 4506862 - DNA, 17 bp, Homo sapiens
tctgaagaaggaaggcc

SEQ ID NO: 4506863 - DNA, 20 bp, Homo sapiens
tctgaagaaggaaggcctga

SEQ ID NO: 4506864 - DNA, 13 bp, Homo sapiens
tctgaagaagttt

SEQ ID NO: 4506865 - DNA, 19 bp, Homo sapiens
tctgaagatcaatttctcc

SEQ ID NO: 4506866 - DNA, 13 bp, Homo sapiens
tctgaaggaagag

SEQ ID NO: 4506867 - DNA, 20 bp, Homo sapiens
tctgaaggagccccattcct

SEQ ID NO: 4506868 - DNA, 13 bp, Homo sapiens
tctgaagggaccc

SEQ ID NO: 4506869 - DNA, 13 bp, Homo sapiens
tctgaagtgcttg

SEQ ID NO: 4506870 - DNA, 22 bp, Homo sapiens
tctgaagttttattttaaatta

SEQ ID NO: 4506871 - DNA, 23 bp, Homo sapiens
tctgaatagttaaaaattaaata

SEQ ID NO: 4506872 - DNA, 10 bp, Homo sapiens
tctgaatatt

SEQ ID NO: 4506873 - DNA, 12 bp, Homo sapiens
tctgaatatttt

SEQ ID NO: 4506874 - DNA, 18 bp, Homo sapiens
tctgaatcaccaattaaa

SEQ ID NO: 4506875 - DNA, 17 bp, Homo sapiens
tctgaatgatcttgtgt

SEQ ID NO: 4506876 - DNA, 16 bp, Homo sapiens
tctgaatgtacacttt

SEQ ID NO: 4506877 - DNA, 21 bp, Homo sapiens
tctgaattaattaatttggag

SEQ ID NO: 4506878 - DNA, 12 bp, Homo sapiens
tctgaattattt

SEQ ID NO: 4506879 - DNA, 17 bp, Homo sapiens
tctgaatttgcaaagta

SEQ ID NO: 4506880 - DNA, 14 bp, Homo sapiens
tctgaattttcaga

SEQ ID NO: 4506881 - DNA, 19 bp, Homo sapiens
tctgaatttttaaacaagt

SEQ ID NO: 4506882 - DNA, 22 bp, Homo sapiens
tctgacaaaatggggcagaaga

SEQ ID NO: 4506883 - DNA, 21 bp, Homo sapiens
tctgacagccctgcggagacc

SEQ ID NO: 4506884 - DNA, 16 bp, Homo sapiens
tctgacatgtaagaaa

SEQ ID NO: 4506885 - DNA, 12 bp, Homo sapiens
tctgacctcctc

SEQ ID NO: 4506886 - DNA, 15 bp, Homo sapiens
tctgacctcctctgg

SEQ ID NO: 4506887 - DNA, 20 bp, Homo sapiens
tctgacctcctctgggccct

SEQ ID NO: 4506888 - DNA, 21 bp, Homo sapiens
tctgacctcctctgggccctg

SEQ ID NO: 4506889 - DNA, 22 bp, Homo sapiens
tctgaccttccagagcccaagg

SEQ ID NO: 4506890 - DNA, 14 bp, Homo sapiens
tctgactcagggct

SEQ ID NO: 4506891 - DNA, 14 bp, Homo sapiens
tctgactctgagct

SEQ ID NO: 4506892 - DNA, 17 bp, Homo sapiens
tctgcctcttctgggag

SEQ ID NO: 4506893 - DNA, 12 bp, Homo sapiens
tctgcctgcccc

SEQ ID NO: 4506894 - DNA, 21 bp, Homo sapiens
tctgcctggttccctccccaa

SEQ ID NO: 4506895 - DNA, 23 bp, Homo sapiens
tctgcctgtccccaaacaggaca

SEQ ID NO: 4506896 - DNA, 21 bp, Homo sapiens
tctgcctgttataactctgca

SEQ ID NO: 4506897 - DNA, 22 bp, Homo sapiens
tctgcctgttataactctgcac

SEQ ID NO: 4506898 - DNA, 16 bp, Homo sapiens
tctgccttaaaaccaa

SEQ ID NO: 4506899 - DNA, 17 bp, Homo sapiens
tctgccttaaaaccaaa

SEQ ID NO: 4506900 - DNA, 19 bp, Homo sapiens
tctgccttcacaaatgtca

SEQ ID NO: 4506901 - DNA, 21 bp, Homo sapiens
tctgccttcacaaatgtcatt

SEQ ID NO: 4506902 - DNA, 15 bp, Homo sapiens
tctgccttgccctcc

SEQ ID NO: 4506903 - DNA, 22 bp, Homo sapiens
tctgccttgccctcctgggccc

SEQ ID NO: 4506904 - DNA, 23 bp, Homo sapiens
tctgcgcttggtctttctgtgct

SEQ ID NO: 4506905 - DNA, 21 bp, Homo sapiens
tctgcggagcacactggctca

SEQ ID NO: 4506906 - DNA, 14 bp, Homo sapiens
tctgcggggctgag

SEQ ID NO: 4506907 - DNA, 18 bp, Homo sapiens
tctgcgggggcagtgctc

SEQ ID NO: 4506908 - DNA, 20 bp, Homo sapiens
tctgcgggggcagtgctcac

SEQ ID NO: 4506909 - DNA, 16 bp, Homo sapiens
tctgcgtgggtcagaa

SEQ ID NO: 4506910 - DNA, 15 bp, Homo sapiens
tctgctaaatatcac

SEQ ID NO: 4506911 - DNA, 16 bp, Homo sapiens
tctgctacttcactgt

SEQ ID NO: 4506912 - DNA, 18 bp, Homo sapiens
tctgctagagcagacagg

SEQ ID NO: 4506913 - DNA, 14 bp, Homo sapiens
tctgctaggcgctg

SEQ ID NO: 4506914 - DNA, 15 bp, Homo sapiens
tctgctatatataaa

SEQ ID NO: 4506915 - DNA, 14 bp, Homo sapiens
tctgctatatttgt

SEQ ID NO: 4506916 - DNA, 18 bp, Homo sapiens
tctgctcatcattctctg

SEQ ID NO: 4506917 - DNA, 23 bp, Homo sapiens
tctgctcatcattctctgtctca

SEQ ID NO: 4506918 - DNA, 14 bp, Homo sapiens
tctgctccaccaca

SEQ ID NO: 4506919 - DNA, 15 bp, Homo sapiens
tctgctccacccttg

SEQ ID NO: 4506920 - DNA, 16 bp, Homo sapiens
tctgctccacccttgg

SEQ ID NO: 4506921 - DNA, 21 bp, Homo sapiens
tctgctccacccttggcctgt

SEQ ID NO: 4506922 - DNA, 20 bp, Homo sapiens
tctgctccataccttttctc

SEQ ID NO: 4506923 - DNA, 12 bp, Homo sapiens
tctgctctgctg

SEQ ID NO: 4506924 - DNA, 12 bp, Homo sapiens
tctgctctggaa

SEQ ID NO: 4506925 - DNA, 16 bp, Homo sapiens
tctgctcttttcctgg

SEQ ID NO: 4506926 - DNA, 16 bp, Homo sapiens
tctgctgagttggcct

SEQ ID NO: 4506927 - DNA, 16 bp, Homo sapiens
tctgctgctctgacct

SEQ ID NO: 4506928 - DNA, 20 bp, Homo sapiens
tctgctgctctgaccttcca

SEQ ID NO: 4506929 - DNA, 15 bp, Homo sapiens
tctgctgctggcccc

SEQ ID NO: 4506930 - DNA, 17 bp, Homo sapiens
tctgctggagaaagcca

SEQ ID NO: 4506931 - DNA, 20 bp, Homo sapiens
tctgctggagaaagccacgc

SEQ ID NO: 4506932 - DNA, 19 bp, Homo sapiens
tctgctggagtttcatgta

SEQ ID NO: 4506933 - DNA, 23 bp, Homo sapiens
tctgctggcatcaagaggtggga

SEQ ID NO: 4506934 - DNA, 15 bp, Homo sapiens
tctgctggctcagga

SEQ ID NO: 4506935 - DNA, 19 bp, Homo sapiens
tctgctgtccagacagcct

SEQ ID NO: 4506936 - DNA, 21 bp, Homo sapiens
tctgctgtccagacagcctgt

SEQ ID NO: 4506937 - DNA, 17 bp, Homo sapiens
tctgctgtcctgtttct

SEQ ID NO: 4506938 - DNA, 16 bp, Homo sapiens
tctgcttctcatccca

SEQ ID NO: 4506939 - DNA, 13 bp, Homo sapiens
tctgcttttaagt

SEQ ID NO: 4506940 - DNA, 18 bp, Homo sapiens
tctgcttttcctctgcct

SEQ ID NO: 4506941 - DNA, 16 bp, Homo sapiens
tctgcttttctgccct

SEQ ID NO: 4506942 - DNA, 17 bp, Homo sapiens
tctgcttttctgccctg

SEQ ID NO: 4506943 - DNA, 18 bp, Homo sapiens
tctgcttttctgccctgg

SEQ ID NO: 4506944 - DNA, 14 bp, Homo sapiens
tctgctttttctgt

SEQ ID NO: 4506945 - DNA, 22 bp, Homo sapiens
tctggaacaacttgtagcagct

SEQ ID NO: 4506946 - DNA, 20 bp, Homo sapiens
tctggaagactgctcccggc

SEQ ID NO: 4506947 - DNA, 17 bp, Homo sapiens
tctggaagcaaatggca

SEQ ID NO: 4506948 - DNA, 18 bp, Homo sapiens
tctggaagcccctgggcc

SEQ ID NO: 4506949 - DNA, 13 bp, Homo sapiens
tctggaagtccaa

SEQ ID NO: 4506950 - DNA, 19 bp, Homo sapiens
tctggaataaagttgcaga

SEQ ID NO: 4506951 - DNA, 14 bp, Homo sapiens
tctggaatgagcct

SEQ ID NO: 4506952 - DNA, 13 bp, Homo sapiens
tctggacagcaga

SEQ ID NO: 4506953 - DNA, 18 bp, Homo sapiens
tctggacagcagaagcct

SEQ ID NO: 4506954 - DNA, 17 bp, Homo sapiens
tctggacggcaggctca

SEQ ID NO: 4506955 - DNA, 22 bp, Homo sapiens
tctggacggcaggctcactgcc

SEQ ID NO: 4506956 - DNA, 15 bp, Homo sapiens
tctggactctgcccc

SEQ ID NO: 4506957 - DNA, 19 bp, Homo sapiens
tctggactctgccccaatc

SEQ ID NO: 4506958 - DNA, 20 bp, Homo sapiens
tctggactctgccccaatcg

SEQ ID NO: 4506959 - DNA, 22 bp, Homo sapiens
tctggactggcgttcacctccc

SEQ ID NO: 4506960 - DNA, 14 bp, Homo sapiens
tctggactggctag

SEQ ID NO: 4506961 - DNA, 15 bp, Homo sapiens
tctggagaagcagtg

SEQ ID NO: 4506962 - DNA, 22 bp, Homo sapiens
tctggagaagcagtgagccgca

SEQ ID NO: 4506963 - DNA, 20 bp, Homo sapiens
tctggagagctagaacctgg

SEQ ID NO: 4506964 - DNA, 21 bp, Homo sapiens
tctggagagctagaacctgga

SEQ ID NO: 4506965 - DNA, 22 bp, Homo sapiens
tctggagagctagaacctggag

SEQ ID NO: 4506966 - DNA, 18 bp, Homo sapiens
tctggagctgggagacaa

SEQ ID NO: 4506967 - DNA, 14 bp, Homo sapiens
tctggagctgtccg

SEQ ID NO: 4506968 - DNA, 21 bp, Homo sapiens
tctggataggagcctgctggt

SEQ ID NO: 4506969 - DNA, 16 bp, Homo sapiens
tctggatgcatttcca

SEQ ID NO: 4506970 - DNA, 16 bp, Homo sapiens
tctggattagcttttc

SEQ ID NO: 4506971 - DNA, 15 bp, Homo sapiens
tctggattcatattt

SEQ ID NO: 4506972 - DNA, 19 bp, Homo sapiens
tctggcaaacttttctttc

SEQ ID NO: 4506973 - DNA, 20 bp, Homo sapiens
tctggcaaacttttctttct

SEQ ID NO: 4506974 - DNA, 16 bp, Homo sapiens
tctggcaacatcttta

SEQ ID NO: 4506975 - DNA, 18 bp, Homo sapiens
tctggcaaggactttgta

SEQ ID NO: 4506976 - DNA, 23 bp, Homo sapiens
tctggcaaggactttgtacattt

SEQ ID NO: 4506977 - DNA, 18 bp, Homo sapiens
tctggcaccatgttggcc

SEQ ID NO: 4506978 - DNA, 15 bp, Homo sapiens
tctggccctgccttc

SEQ ID NO: 4506979 - DNA, 15 bp, Homo sapiens
tctggcctctgcttt

SEQ ID NO: 4506980 - DNA, 16 bp, Homo sapiens
tctggctacctgtttg

SEQ ID NO: 4506981 - DNA, 16 bp, Homo sapiens
tctggctagaggccag

SEQ ID NO: 4506982 - DNA, 21 bp, Homo sapiens
tctggctcggacccaccccaa

SEQ ID NO: 4506983 - DNA, 16 bp, Homo sapiens
tctggctctaattcac

SEQ ID NO: 4506984 - DNA, 15 bp, Homo sapiens
tctggctctgcctca

SEQ ID NO: 4506985 - DNA, 15 bp, Homo sapiens
tctggcttagtgcca

SEQ ID NO: 4506986 - DNA, 16 bp, Homo sapiens
tctggcttctgcatta

SEQ ID NO: 4506987 - DNA, 13 bp, Homo sapiens
tctggctttccca

SEQ ID NO: 4506988 - DNA, 16 bp, Homo sapiens
tctgggaccctttcct

SEQ ID NO: 4506989 - DNA, 20 bp, Homo sapiens
tctgggactctcctcctccc

SEQ ID NO: 4506990 - DNA, 22 bp, Homo sapiens
tctgggactctcctcctcccct

SEQ ID NO: 4506991 - DNA, 24 bp, Homo sapiens
tctgggactgtgcctggctccctg

SEQ ID NO: 4506992 - DNA, 23 bp, Homo sapiens
tctgggatatatggaggattctt

SEQ ID NO: 4506993 - DNA, 16 bp, Homo sapiens
tctgggcatggcaggg

SEQ ID NO: 4506994 - DNA, 21 bp, Homo sapiens
tctgggcatggcagggccagg

SEQ ID NO: 4506995 - DNA, 18 bp, Homo sapiens
tctgggccccctcctccc

SEQ ID NO: 4506996 - DNA, 23 bp, Homo sapiens
tctgggccctgtcgcccctcctt

SEQ ID NO: 4506997 - DNA, 12 bp, Homo sapiens
tctgggcctgac

SEQ ID NO: 4506998 - DNA, 19 bp, Homo sapiens
tctgggctaggtagaaaaa

SEQ ID NO: 4506999 - DNA, 14 bp, Homo sapiens
tctggggcagagga

SEQ ID NO: 4507000 - DNA, 13 bp, Homo sapiens
tctggggccctgg

SEQ ID NO: 4507001 - DNA, 14 bp, Homo sapiens
tctggggccctggg

SEQ ID NO: 4507002 - DNA, 13 bp, Homo sapiens
tctggggctgtgt

SEQ ID NO: 4507003 - DNA, 17 bp, Homo sapiens
tctggggtgggcagttt

SEQ ID NO: 4507004 - DNA, 18 bp, Homo sapiens
tctggggttcagcccctc

SEQ ID NO: 4507005 - DNA, 23 bp, Homo sapiens
tctggggttcagcccctcctctg

SEQ ID NO: 4507006 - DNA, 16 bp, Homo sapiens
tctgggtaagaagaaa

SEQ ID NO: 4507007 - DNA, 18 bp, Homo sapiens
tctgggtaagaagaaagc

SEQ ID NO: 4507008 - DNA, 16 bp, Homo sapiens
tctgggtatctttcca

SEQ ID NO: 4507009 - DNA, 21 bp, Homo sapiens
tctgggtgatggaaactgcca

SEQ ID NO: 4507010 - DNA, 18 bp, Homo sapiens
tctgggtgttgaccactc

SEQ ID NO: 4507011 - DNA, 13 bp, Homo sapiens
tctgggtttctaa

SEQ ID NO: 4507012 - DNA, 14 bp, Homo sapiens
tctgacttcctctg

SEQ ID NO: 4507013 - DNA, 12 bp, Homo sapiens
tctgacttttgt

SEQ ID NO: 4507014 - DNA, 14 bp, Homo sapiens
tctgagaaagacta

SEQ ID NO: 4507015 - DNA, 23 bp, Homo sapiens
tctgagaaagactattcaaacag

SEQ ID NO: 4507016 - DNA, 22 bp, Homo sapiens
tctgagactctcttaggagcag

SEQ ID NO: 4507017 - DNA, 14 bp, Homo sapiens
tctgagagaggcca

SEQ ID NO: 4507018 - DNA, 19 bp, Homo sapiens
tctgagagtcattcaggtg

SEQ ID NO: 4507019 - DNA, 16 bp, Homo sapiens
tctgagcaaaggccct

SEQ ID NO: 4507020 - DNA, 19 bp, Homo sapiens
tctgagcaccgaatattga

SEQ ID NO: 4507021 - DNA, 15 bp, Homo sapiens
tctgagccagattac

SEQ ID NO: 4507022 - DNA, 20 bp, Homo sapiens
tctgagccctggtgtgtttc

SEQ ID NO: 4507023 - DNA, 18 bp, Homo sapiens
tctgagctctgcatttgt

SEQ ID NO: 4507024 - DNA, 15 bp, Homo sapiens
tctgagctgtaattt

SEQ ID NO: 4507025 - DNA, 14 bp, Homo sapiens
tctgaggcccctgc

SEQ ID NO: 4507026 - DNA, 15 bp, Homo sapiens
tctgaggcccctgcc

SEQ ID NO: 4507027 - DNA, 16 bp, Homo sapiens
tctgagtccagctccc

SEQ ID NO: 4507028 - DNA, 17 bp, Homo sapiens
tctgagtccagctcccc

SEQ ID NO: 4507029 - DNA, 13 bp, Homo sapiens
tctgagtctgagt

SEQ ID NO: 4507030 - DNA, 18 bp, Homo sapiens
tctgagtgagttttactc

SEQ ID NO: 4507031 - DNA, 19 bp, Homo sapiens
tctgagttctgtgtatttt

SEQ ID NO: 4507032 - DNA, 14 bp, Homo sapiens
tctgagttttgtgt

SEQ ID NO: 4507033 - DNA, 13 bp, Homo sapiens
tctgataaactga

SEQ ID NO: 4507034 - DNA, 19 bp, Homo sapiens
tctgataagagaatcaaca

SEQ ID NO: 4507035 - DNA, 20 bp, Homo sapiens
tctgatatctatagtagaca

SEQ ID NO: 4507036 - DNA, 21 bp, Homo sapiens
tctgatatgtatccatcagga

SEQ ID NO: 4507037 - DNA, 13 bp, Homo sapiens
tctgatatgtgaa

SEQ ID NO: 4507038 - DNA, 12 bp, Homo sapiens
tctgatcaaatt

SEQ ID NO: 4507039 - DNA, 13 bp, Homo sapiens
tctgatctataca

SEQ ID NO: 4507040 - DNA, 19 bp, Homo sapiens
tctgatctgtactttgtgt

SEQ ID NO: 4507041 - DNA, 22 bp, Homo sapiens
tctgatctgtgctttccagctc

SEQ ID NO: 4507042 - DNA, 17 bp, Homo sapiens
tctgatgagaacaagct

SEQ ID NO: 4507043 - DNA, 16 bp, Homo sapiens
tctgatggaactgtgt

SEQ ID NO: 4507044 - DNA, 21 bp, Homo sapiens
tctgatggaactgtgtattta

SEQ ID NO: 4507045 - DNA, 15 bp, Homo sapiens
tctgatggccttaat

SEQ ID NO: 4507046 - DNA, 21 bp, Homo sapiens
tctgatggccttaatttcctt

SEQ ID NO: 4507047 - DNA, 23 bp, Homo sapiens
tctgatggtataaacaggagaca

SEQ ID NO: 4507048 - DNA, 14 bp, Homo sapiens
tctgatgtcccagt

SEQ ID NO: 4507049 - DNA, 14 bp, Homo sapiens
tctgattaagcatt

SEQ ID NO: 4507050 - DNA, 17 bp, Homo sapiens
tctgattaatccatttt

SEQ ID NO: 4507051 - DNA, 18 bp, Homo sapiens
tctgattatgtaagcatt

SEQ ID NO: 4507052 - DNA, 19 bp, Homo sapiens
tctgattatgtaagcattt

SEQ ID NO: 4507053 - DNA, 20 bp, Homo sapiens
tctgatttattttgtatgaa

SEQ ID NO: 4507054 - DNA, 12 bp, Homo sapiens
tctgatttcata

SEQ ID NO: 4507055 - DNA, 13 bp, Homo sapiens
tctgatttcataa

SEQ ID NO: 4507056 - DNA, 15 bp, Homo sapiens
tctgcaaaaggagag

SEQ ID NO: 4507057 - DNA, 16 bp, Homo sapiens
tctgcaaaaggagaga

SEQ ID NO: 4507058 - DNA, 18 bp, Homo sapiens
tctgcaaaatgtagaaat

SEQ ID NO: 4507059 - DNA, 18 bp, Homo sapiens
tctgcaacatttgacaaa

SEQ ID NO: 4507060 - DNA, 20 bp, Homo sapiens
tctgcaattttactgtgaaa

SEQ ID NO: 4507061 - DNA, 17 bp, Homo sapiens
tctgcacacaaatatta

SEQ ID NO: 4507062 - DNA, 18 bp, Homo sapiens
tctgcacagtcagaagga

SEQ ID NO: 4507063 - DNA, 22 bp, Homo sapiens
tctgcacccagtgaacacattt

SEQ ID NO: 4507064 - DNA, 15 bp, Homo sapiens
tctgcaccccttctc

SEQ ID NO: 4507065 - DNA, 19 bp, Homo sapiens
tctgcaccccttctctcct

SEQ ID NO: 4507066 - DNA, 21 bp, Homo sapiens
tctgcaccccttctctcctcc

SEQ ID NO: 4507067 - DNA, 21 bp, Homo sapiens
tctgcactactcctctgcagt

SEQ ID NO: 4507068 - DNA, 21 bp, Homo sapiens
tctgcactcccacctgacaca

SEQ ID NO: 4507069 - DNA, 20 bp, Homo sapiens
tctgcactcctttatctgta

SEQ ID NO: 4507070 - DNA, 21 bp, Homo sapiens
tctgcactcctttatctgtaa

SEQ ID NO: 4507071 - DNA, 18 bp, Homo sapiens
tctgcagacttcccagct

SEQ ID NO: 4507072 - DNA, 19 bp, Homo sapiens
tctgcagatcttccgtggt

SEQ ID NO: 4507073 - DNA, 14 bp, Homo sapiens
tctgcagccagccc

SEQ ID NO: 4507074 - DNA, 18 bp, Homo sapiens
tctgcagccagcccagcc

SEQ ID NO: 4507075 - DNA, 13 bp, Homo sapiens
tctgcaggacaga

SEQ ID NO: 4507076 - DNA, 14 bp, Homo sapiens
tctgcaggacagag

SEQ ID NO: 4507077 - DNA, 14 bp, Homo sapiens
tctgcaggctgggg

SEQ ID NO: 4507078 - DNA, 17 bp, Homo sapiens
tctgcaggctggggagg

SEQ ID NO: 4507079 - DNA, 14 bp, Homo sapiens
tctgcagtgccttg

SEQ ID NO: 4507080 - DNA, 15 bp, Homo sapiens
tctgcagtgccttgg

SEQ ID NO: 4507081 - DNA, 12 bp, Homo sapiens
tctgcatagaca

SEQ ID NO: 4507082 - DNA, 14 bp, Homo sapiens
tctgcatcagctgc

SEQ ID NO: 4507083 - DNA, 19 bp, Homo sapiens
tctgcatcagctgctgaaa

SEQ ID NO: 4507084 - DNA, 21 bp, Homo sapiens
tctgcatccagagattcattt

SEQ ID NO: 4507085 - DNA, 22 bp, Homo sapiens
tctgcatccagagattcatttt

SEQ ID NO: 4507086 - DNA, 23 bp, Homo sapiens
tctgcatccagagattcattttc

SEQ ID NO: 4507087 - DNA, 15 bp, Homo sapiens
tctgcatgcggccca

SEQ ID NO: 4507088 - DNA, 18 bp, Homo sapiens
tctgcatgcggcccagcc

SEQ ID NO: 4507089 - DNA, 20 bp, Homo sapiens
tctgcatgcggcccagcccg

SEQ ID NO: 4507090 - DNA, 21 bp, Homo sapiens
tctgcatgcggcccagcccgg

SEQ ID NO: 4507091 - DNA, 16 bp, Homo sapiens
tctgcatttcatatta

SEQ ID NO: 4507092 - DNA, 15 bp, Homo sapiens
tctgcatttgtctat

SEQ ID NO: 4507093 - DNA, 14 bp, Homo sapiens
tctgccaacctaaa

SEQ ID NO: 4507094 - DNA, 17 bp, Homo sapiens
tctgccaacctaaaact

SEQ ID NO: 4507095 - DNA, 16 bp, Homo sapiens
tctgccaccagcccct

SEQ ID NO: 4507096 - DNA, 23 bp, Homo sapiens
tctgccaccagcccctccccaga

SEQ ID NO: 4507097 - DNA, 13 bp, Homo sapiens
tctgccaccccta

SEQ ID NO: 4507098 - DNA, 22 bp, Homo sapiens
tctgccacccctaaactccagg

SEQ ID NO: 4507099 - DNA, 20 bp, Homo sapiens
tctgccagaagatcccctca

SEQ ID NO: 4507100 - DNA, 22 bp, Homo sapiens
tctgccagaagatcccctcagg

SEQ ID NO: 4507101 - DNA, 15 bp, Homo sapiens
tctgccaggagacag

SEQ ID NO: 4507102 - DNA, 12 bp, Homo sapiens
tctgccagggag

SEQ ID NO: 4507103 - DNA, 13 bp, Homo sapiens
tctgccagggagc

SEQ ID NO: 4507104 - DNA, 22 bp, Homo sapiens
tctgccatcacatagtattatg

SEQ ID NO: 4507105 - DNA, 22 bp, Homo sapiens
tctgccattctgtgcaggctgc

SEQ ID NO: 4507106 - DNA, 15 bp, Homo sapiens
tctgccattgggacc

SEQ ID NO: 4507107 - DNA, 18 bp, Homo sapiens
tctgcccaattggaggaa

SEQ ID NO: 4507108 - DNA, 22 bp, Homo sapiens
tctgcccagccgggcacagtgg

SEQ ID NO: 4507109 - DNA, 13 bp, Homo sapiens
tctgccccctccc

SEQ ID NO: 4507110 - DNA, 16 bp, Homo sapiens
tctgccccctgctggc

SEQ ID NO: 4507111 - DNA, 13 bp, Homo sapiens
tctgcccctcact

SEQ ID NO: 4507112 - DNA, 14 bp, Homo sapiens
tctgcccctccccc

SEQ ID NO: 4507113 - DNA, 16 bp, Homo sapiens
tctgcccctcccccaa

SEQ ID NO: 4507114 - DNA, 18 bp, Homo sapiens
tctgcccctcccccaacc

SEQ ID NO: 4507115 - DNA, 18 bp, Homo sapiens
tctgcccctcccccactt

SEQ ID NO: 4507116 - DNA, 17 bp, Homo sapiens
tctgcccctgcagctgg

SEQ ID NO: 4507117 - DNA, 19 bp, Homo sapiens
tctgcccggctacatcagc

SEQ ID NO: 4507118 - DNA, 23 bp, Homo sapiens
tctgcccgggaaggtcaccagca

SEQ ID NO: 4507119 - DNA, 15 bp, Homo sapiens
tctgccctctccctg

SEQ ID NO: 4507120 - DNA, 13 bp, Homo sapiens
tctgccctggatt

SEQ ID NO: 4507121 - DNA, 17 bp, Homo sapiens
tctgccctggctgctgc

SEQ ID NO: 4507122 - DNA, 19 bp, Homo sapiens
tctgccgattttgtaaatg

SEQ ID NO: 4507123 - DNA, 15 bp, Homo sapiens
tctgccgctgccatg

SEQ ID NO: 4507124 - DNA, 20 bp, Homo sapiens
tctgccggtcgggcagccag

SEQ ID NO: 4507125 - DNA, 22 bp, Homo sapiens
tctgccggtcgggcagccagca

SEQ ID NO: 4507126 - DNA, 15 bp, Homo sapiens
tctgcctacagccag

SEQ ID NO: 4507127 - DNA, 16 bp, Homo sapiens
tctgcctacagccagg

SEQ ID NO: 4507128 - DNA, 13 bp, Homo sapiens
tctgcctatgcac

SEQ ID NO: 4507129 - DNA, 23 bp, Homo sapiens
tctgcctatgcactgaagagctc

SEQ ID NO: 4507130 - DNA, 13 bp, Homo sapiens
tctgcctcaggag

SEQ ID NO: 4507131 - DNA, 13 bp, Homo sapiens
tctgcctctctgg

SEQ ID NO: 4507132 - DNA, 15 bp, Homo sapiens
tctgcctcttctggg

SEQ ID NO: 4507133 - DNA, 12 bp, Homo sapiens
tctttctctcag

SEQ ID NO: 4507134 - DNA, 12 bp, Homo sapiens
tctttctctcct

SEQ ID NO: 4507135 - DNA, 15 bp, Homo sapiens
tctttctctcctttc

SEQ ID NO: 4507136 - DNA, 11 bp, Homo sapiens
tctttctctct

SEQ ID NO: 4507137 - DNA, 11 bp, Homo sapiens
tctttctctgg

SEQ ID NO: 4507138 - DNA, 18 bp, Homo sapiens
tctttctgagtgccttct

SEQ ID NO: 4507139 - DNA, 22 bp, Homo sapiens
tctttctgctatgtgtggtact

SEQ ID NO: 4507140 - DNA, 19 bp, Homo sapiens
tctttctgtgcttggattt

SEQ ID NO: 4507141 - DNA, 20 bp, Homo sapiens
tctttctgtgcttggatttg

SEQ ID NO: 4507142 - DNA, 13 bp, Homo sapiens
tctttcttccaaa

SEQ ID NO: 4507143 - DNA, 13 bp, Homo sapiens
tctttcttcctct

SEQ ID NO: 4507144 - DNA, 22 bp, Homo sapiens
tctttcttggagtgccaagttt

SEQ ID NO: 4507145 - DNA, 18 bp, Homo sapiens
tctttctttccaaaacat

SEQ ID NO: 4507146 - DNA, 22 bp, Homo sapiens
tctttctttccaaaacatttct

SEQ ID NO: 4507147 - DNA, 19 bp, Homo sapiens
tctttctttgcaccaaaga

SEQ ID NO: 4507148 - DNA, 18 bp, Homo sapiens
tctttctttggtgccttt

SEQ ID NO: 4507149 - DNA, 13 bp, Homo sapiens
tctttgaaagctt

SEQ ID NO: 4507150 - DNA, 11 bp, Homo sapiens
tctttgaaata

SEQ ID NO: 4507151 - DNA, 19 bp, Homo sapiens
tctttgactgtcagcaaga

SEQ ID NO: 4507152 - DNA, 23 bp, Homo sapiens
tctttgagaccatccattctcct

SEQ ID NO: 4507153 - DNA, 22 bp, Homo sapiens
tctttgagcccattcttctggg

SEQ ID NO: 4507154 - DNA, 22 bp, Homo sapiens
tctttgattctccttttatgtg

SEQ ID NO: 4507155 - DNA, 15 bp, Homo sapiens
tctttgcaaagtatt

SEQ ID NO: 4507156 - DNA, 15 bp, Homo sapiens
tctttgcaccaaaga

SEQ ID NO: 4507157 - DNA, 15 bp, Homo sapiens
tctttgcagagcctt

SEQ ID NO: 4507158 - DNA, 12 bp, Homo sapiens
tctttgcctctg

SEQ ID NO: 4507159 - DNA, 13 bp, Homo sapiens
tctttgcctctgc

SEQ ID NO: 4507160 - DNA, 14 bp, Homo sapiens
tctttgccttctct

SEQ ID NO: 4507161 - DNA, 12 bp, Homo sapiens
tctttgctgccc

SEQ ID NO: 4507162 - DNA, 15 bp, Homo sapiens
tctttgctgcccctg

SEQ ID NO: 4507163 - DNA, 20 bp, Homo sapiens
tctttgctgcccctgtctgg

SEQ ID NO: 4507164 - DNA, 21 bp, Homo sapiens
tctttgctgcccctgtctgga

SEQ ID NO: 4507165 - DNA, 19 bp, Homo sapiens
tctttgcttcacttctccc

SEQ ID NO: 4507166 - DNA, 15 bp, Homo sapiens
tctttgcttgaacac

SEQ ID NO: 4507167 - DNA, 16 bp, Homo sapiens
tctttggaaagtacac

SEQ ID NO: 4507168 - DNA, 17 bp, Homo sapiens
tctttggaaataaaaga

SEQ ID NO: 4507169 - DNA, 13 bp, Homo sapiens
tctttggtgcctt

SEQ ID NO: 4507170 - DNA, 15 bp, Homo sapiens
tctttggtgcctttc

SEQ ID NO: 4507171 - DNA, 20 bp, Homo sapiens
tctttggtgcctttcctgtt

SEQ ID NO: 4507172 - DNA, 22 bp, Homo sapiens
tctttggtgcctttcctgttca

SEQ ID NO: 4507173 - DNA, 18 bp, Homo sapiens
tctttgtaaatgcatatt

SEQ ID NO: 4507174 - DNA, 17 bp, Homo sapiens
tctttgtaccaaaattt

SEQ ID NO: 4507175 - DNA, 23 bp, Homo sapiens
tctttgtaccaaaattttaaaaa

SEQ ID NO: 4507176 - DNA, 15 bp, Homo sapiens
tctttgtattcttca

SEQ ID NO: 4507177 - DNA, 18 bp, Homo sapiens
tctttgtattcttcatga

SEQ ID NO: 4507178 - DNA, 19 bp, Homo sapiens
tctttgtattcttcatgaa

SEQ ID NO: 4507179 - DNA, 20 bp, Homo sapiens
tctttgtgacaggaaagccc

SEQ ID NO: 4507180 - DNA, 15 bp, Homo sapiens
tctttgtgcctttgg

SEQ ID NO: 4507181 - DNA, 16 bp, Homo sapiens
tctttgtgcctttggc

SEQ ID NO: 4507182 - DNA, 19 bp, Homo sapiens
tctttgtggtttcttgttt

SEQ ID NO: 4507183 - DNA, 15 bp, Homo sapiens
tctttgtgtaatcta

SEQ ID NO: 4507184 - DNA, 18 bp, Homo sapiens
tctttgttattataacat

SEQ ID NO: 4507185 - DNA, 13 bp, Homo sapiens
tctttgtttaaaa

SEQ ID NO: 4507186 - DNA, 16 bp, Homo sapiens
tctttgtttaaatgcc

SEQ ID NO: 4507187 - DNA, 12 bp, Homo sapiens
tcttttaaacat

SEQ ID NO: 4507188 - DNA, 14 bp, Homo sapiens
tcttttaaagattt

SEQ ID NO: 4507189 - DNA, 21 bp, Homo sapiens
tcttttaatgaggaccaatgt

SEQ ID NO: 4507190 - DNA, 14 bp, Homo sapiens
tcttttacattttt

SEQ ID NO: 4507191 - DNA, 13 bp, Homo sapiens
tcttttacctgct

SEQ ID NO: 4507192 - DNA, 14 bp, Homo sapiens
tcttttacctgctg

SEQ ID NO: 4507193 - DNA, 21 bp, Homo sapiens
tcttttacctgctgcttctcc

SEQ ID NO: 4507194 - DNA, 14 bp, Homo sapiens
tcttttagaaaagg

SEQ ID NO: 4507195 - DNA, 22 bp, Homo sapiens
tcttttataattctcattaaaa

SEQ ID NO: 4507196 - DNA, 20 bp, Homo sapiens
tcttttatagtggaaaaaca

SEQ ID NO: 4507197 - DNA, 21 bp, Homo sapiens
tcttttatagtggaaaaacac

SEQ ID NO: 4507198 - DNA, 18 bp, Homo sapiens
tcttttatttaacaaaaa

SEQ ID NO: 4507199 - DNA, 19 bp, Homo sapiens
tcttttcccccattaatca

SEQ ID NO: 4507200 - DNA, 11 bp, Homo sapiens
tcttttctaga

SEQ ID NO: 4507201 - DNA, 14 bp, Homo sapiens
tcttttctctttaa

SEQ ID NO: 4507202 - DNA, 16 bp, Homo sapiens
tcttttctgtacttcc

SEQ ID NO: 4507203 - DNA, 13 bp, Homo sapiens
tcttttctttctg

SEQ ID NO: 4507204 - DNA, 13 bp, Homo sapiens
tcttttctttgta

SEQ ID NO: 4507205 - DNA, 16 bp, Homo sapiens
tcttttgaatcaatct

SEQ ID NO: 4507206 - DNA, 16 bp, Homo sapiens
tcttttgaattcttga

SEQ ID NO: 4507207 - DNA, 14 bp, Homo sapiens
tcttttgtaagtat

SEQ ID NO: 4507208 - DNA, 20 bp, Homo sapiens
tcttttgtgatgaacatatt

SEQ ID NO: 4507209 - DNA, 13 bp, Homo sapiens
tctttttcctcct

SEQ ID NO: 4507210 - DNA, 17 bp, Homo sapiens
tctttttctacatgtga

SEQ ID NO: 4507211 - DNA, 14 bp, Homo sapiens
tctttttctttctt

SEQ ID NO: 4507212 - DNA, 14 bp, Homo sapiens
tctttttgaaatgt

SEQ ID NO: 4507213 - DNA, 15 bp, Homo sapiens
tctttttgttgtaaa

SEQ ID NO: 4507214 - DNA, 17 bp, Homo sapiens
tcttttttaaattttct

SEQ ID NO: 4507215 - DNA, 16 bp, Homo sapiens
tcttttttaagttgtc

SEQ ID NO: 4507216 - DNA, 17 bp, Homo sapiens
tcttttttaataaacta

SEQ ID NO: 4507217 - DNA, 12 bp, Homo sapiens
tcttttttctct

SEQ ID NO: 4507218 - DNA, 13 bp, Homo sapiens
tctttttttctgt

SEQ ID NO: 4507219 - DNA, 15 bp, Homo sapiens
tcttttttttaatgt

SEQ ID NO: 4507220 - DNA, 20 bp, Homo sapiens
tctttttttttaagttctta

SEQ ID NO: 4507221 - DNA, 17 bp, Homo sapiens
tctttttttttcttcat

SEQ ID NO: 4507222 - DNA, 21 bp, Homo sapiens
tctttttttttctttttccag

SEQ ID NO: 4507223 - DNA, 15 bp, Homo sapiens
tcttttttttttccc

SEQ ID NO: 4507224 - DNA, 20 bp, Homo sapiens
tgaaaaaaaaaaagaagaag

SEQ ID NO: 4507225 - DNA, 23 bp, Homo sapiens
tgaaaaaaaatttgttttcaaca

SEQ ID NO: 4507226 - DNA, 15 bp, Homo sapiens
tgaaaaaaacttcat

SEQ ID NO: 4507227 - DNA, 16 bp, Homo sapiens
tgaaaaaaacttcatt

SEQ ID NO: 4507228 - DNA, 23 bp, Homo sapiens
tgaaaaaaagggaaaacaaatat

SEQ ID NO: 4507229 - DNA, 15 bp, Homo sapiens
tgaaaaaaattgaaa

SEQ ID NO: 4507230 - DNA, 22 bp, Homo sapiens
tgaaaaaatagagcctgaggga

SEQ ID NO: 4507231 - DNA, 20 bp, Homo sapiens
tgaaaaacaattttctgtaa

SEQ ID NO: 4507232 - DNA, 15 bp, Homo sapiens
tgaaaaactaatgtg

SEQ ID NO: 4507233 - DNA, 17 bp, Homo sapiens
tgaaaaactaatgtgtc

SEQ ID NO: 4507234 - DNA, 19 bp, Homo sapiens
tgaaaaatagcatatgcct

SEQ ID NO: 4507235 - DNA, 21 bp, Homo sapiens
tgaaaaatctcattatttctg

SEQ ID NO: 4507236 - DNA, 21 bp, Homo sapiens
tgaaaaattccactcaaaata

SEQ ID NO: 4507237 - DNA, 20 bp, Homo sapiens
tgaaaacatgtactacagct

SEQ ID NO: 4507238 - DNA, 21 bp, Homo sapiens
tgaaaacatgtactacagcta

SEQ ID NO: 4507239 - DNA, 24 bp, Homo sapiens
tgaaaacatgtactacagctatat

SEQ ID NO: 4507240 - DNA, 15 bp, Homo sapiens
tgaaaaccaaaatga

SEQ ID NO: 4507241 - DNA, 16 bp, Homo sapiens
tgaaaacccaaggcca

SEQ ID NO: 4507242 - DNA, 16 bp, Homo sapiens
tgaaaaccgtaaagtg

SEQ ID NO: 4507243 - DNA, 20 bp, Homo sapiens
tgaaaacgtcttccttcttt

SEQ ID NO: 4507244 - DNA, 17 bp, Homo sapiens
tgaaaactaaggatttt

SEQ ID NO: 4507245 - DNA, 14 bp, Homo sapiens
tgaaaactagcatt

SEQ ID NO: 4507246 - DNA, 20 bp, Homo sapiens
tgaaaactagggctcatttt

SEQ ID NO: 4507247 - DNA, 22 bp, Homo sapiens
tgaaaactcatgatcaagatat

SEQ ID NO: 4507248 - DNA, 13 bp, Homo sapiens
tgaaaactctttg

SEQ ID NO: 4507249 - DNA, 18 bp, Homo sapiens
tgaaaactctttgctgct

SEQ ID NO: 4507250 - DNA, 19 bp, Homo sapiens
tgaaaactgtgcaactttt

SEQ ID NO: 4507251 - DNA, 23 bp, Homo sapiens
tgaaaactgtgcaactttttaaa

SEQ ID NO: 4507252 - DNA, 15 bp, Homo sapiens
tgaaaagaaggaaag

SEQ ID NO: 4507253 - DNA, 15 bp, Homo sapiens
tgaaaagaagtagtg

SEQ ID NO: 4507254 - DNA, 15 bp, Homo sapiens
tcttaaaacacatga

SEQ ID NO: 4507255 - DNA, 12 bp, Homo sapiens
tcttaaaagata

SEQ ID NO: 4507256 - DNA, 12 bp, Homo sapiens
tcttaaaagtac

SEQ ID NO: 4507257 - DNA, 16 bp, Homo sapiens
tcttaaaatgcaatat

SEQ ID NO: 4507258 - DNA, 20 bp, Homo sapiens
tcttaaacaatttgtgtaga

SEQ ID NO: 4507259 - DNA, 16 bp, Homo sapiens
tcttaaactaatacgt

SEQ ID NO: 4507260 - DNA, 15 bp, Homo sapiens
tcttaaacttgtgaa

SEQ ID NO: 4507261 - DNA, 17 bp, Homo sapiens
tcttaaagacaaatttt

SEQ ID NO: 4507262 - DNA, 22 bp, Homo sapiens
tcttaaagtattcttctcttcc

SEQ ID NO: 4507263 - DNA, 15 bp, Homo sapiens
tcttaaataagaaac

SEQ ID NO: 4507264 - DNA, 19 bp, Homo sapiens
tcttaaataagaaactttt

SEQ ID NO: 4507265 - DNA, 22 bp, Homo sapiens
tcttaaattcatttctagactc

SEQ ID NO: 4507266 - DNA, 13 bp, Homo sapiens
tcttaactgtatt

SEQ ID NO: 4507267 - DNA, 16 bp, Homo sapiens
tcttaactgtatttca

SEQ ID NO: 4507268 - DNA, 21 bp, Homo sapiens
tcttaagacagcatgtgttaa

SEQ ID NO: 4507269 - DNA, 21 bp, Homo sapiens
tcttaatataaattcactttc

SEQ ID NO: 4507270 - DNA, 18 bp, Homo sapiens
tcttaattaaaagaatat

SEQ ID NO: 4507271 - DNA, 14 bp, Homo sapiens
tcttaattattata

SEQ ID NO: 4507272 - DNA, 16 bp, Homo sapiens
tcttaattgtgtttat

SEQ ID NO: 4507273 - DNA, 21 bp, Homo sapiens
tcttacaataaaccctccttg

SEQ ID NO: 4507274 - DNA, 14 bp, Homo sapiens
tcttacagccaagt

SEQ ID NO: 4507275 - DNA, 21 bp, Homo sapiens
tcttacatctccttgatcatg

SEQ ID NO: 4507276 - DNA, 18 bp, Homo sapiens
tcttacctactattggcc

SEQ ID NO: 4507277 - DNA, 15 bp, Homo sapiens
tcttactatttcaca

SEQ ID NO: 4507278 - DNA, 13 bp, Homo sapiens
tcttactctgccg

SEQ ID NO: 4507279 - DNA, 12 bp, Homo sapiens
tcttacttttat

SEQ ID NO: 4507280 - DNA, 13 bp, Homo sapiens
tcttagaagaata

SEQ ID NO: 4507281 - DNA, 15 bp, Homo sapiens
tcttagaagaatatt

SEQ ID NO: 4507282 - DNA, 14 bp, Homo sapiens
tcttagagatgatt

SEQ ID NO: 4507283 - DNA, 16 bp, Homo sapiens
tcttagagatgattca

SEQ ID NO: 4507284 - DNA, 18 bp, Homo sapiens
tcttagagccaagtgtct

SEQ ID NO: 4507285 - DNA, 23 bp, Homo sapiens
tcttagagccaagtgtcttttaa

SEQ ID NO: 4507286 - DNA, 21 bp, Homo sapiens
tcttagagttttattcctttc

SEQ ID NO: 4507287 - DNA, 21 bp, Homo sapiens
tcttagataacttcttgaaaa

SEQ ID NO: 4507288 - DNA, 16 bp, Homo sapiens
tcttagcatcctgcct

SEQ ID NO: 4507289 - DNA, 14 bp, Homo sapiens
tcttaggagcagag

SEQ ID NO: 4507290 - DNA, 14 bp, Homo sapiens
tcttagtgtatgat

SEQ ID NO: 4507291 - DNA, 19 bp, Homo sapiens
tcttagttctgtatataaa

SEQ ID NO: 4507292 - DNA, 20 bp, Homo sapiens
tcttatacagataaaacatg

SEQ ID NO: 4507293 - DNA, 15 bp, Homo sapiens
tcttatactgtacaa

SEQ ID NO: 4507294 - DNA, 21 bp, Homo sapiens
tcttatactgtacaataaaaa

SEQ ID NO: 4507295 - DNA, 14 bp, Homo sapiens
tcttatattggttt

SEQ ID NO: 4507296 - DNA, 17 bp, Homo sapiens
tcttatgcaaaactttt

SEQ ID NO: 4507297 - DNA, 13 bp, Homo sapiens
tcttatgtgacat

SEQ ID NO: 4507298 - DNA, 19 bp, Homo sapiens
tcttatgtgacattaacaa

SEQ ID NO: 4507299 - DNA, 14 bp, Homo sapiens
tcttattccttttt

SEQ ID NO: 4507300 - DNA, 15 bp, Homo sapiens
tcttattctcactcc

SEQ ID NO: 4507301 - DNA, 15 bp, Homo sapiens
tcttatttcatttct

SEQ ID NO: 4507302 - DNA, 15 bp, Homo sapiens
tcttatttctttcct

SEQ ID NO: 4507303 - DNA, 16 bp, Homo sapiens
tcttattttagtatac

SEQ ID NO: 4507304 - DNA, 23 bp, Homo sapiens
tcttcaataaaccacaagcatct

SEQ ID NO: 4507305 - DNA, 15 bp, Homo sapiens
tcttcacaacagatt

SEQ ID NO: 4507306 - DNA, 15 bp, Homo sapiens
tcttcacaggcactc

SEQ ID NO: 4507307 - DNA, 19 bp, Homo sapiens
tcttcacatgtttaacttt

SEQ ID NO: 4507308 - DNA, 18 bp, Homo sapiens
tcttcaccaagtgcaata

SEQ ID NO: 4507309 - DNA, 22 bp, Homo sapiens
tcttcaccccccaatctcttgg

SEQ ID NO: 4507310 - DNA, 14 bp, Homo sapiens
tcttcactggtgag

SEQ ID NO: 4507311 - DNA, 13 bp, Homo sapiens
tcttcactgtata

SEQ ID NO: 4507312 - DNA, 17 bp, Homo sapiens
tcttcacttacaagaaa

SEQ ID NO: 4507313 - DNA, 17 bp, Homo sapiens
tcttcacttcaagctgt

SEQ ID NO: 4507314 - DNA, 18 bp, Homo sapiens
tcttcagactctcagccc

SEQ ID NO: 4507315 - DNA, 22 bp, Homo sapiens
tcttcagaggtgctaaattgtc

SEQ ID NO: 4507316 - DNA, 18 bp, Homo sapiens
tcttcaggcctccctctc

SEQ ID NO: 4507317 - DNA, 14 bp, Homo sapiens
tcttcaggcctgct

SEQ ID NO: 4507318 - DNA, 18 bp, Homo sapiens
tcttcagtttttcacttc

SEQ ID NO: 4507319 - DNA, 17 bp, Homo sapiens
tcttcataataaacctt

SEQ ID NO: 4507320 - DNA, 20 bp, Homo sapiens
tcttcatccatagacacagt

SEQ ID NO: 4507321 - DNA, 18 bp, Homo sapiens
tcttcatctaatatgata

SEQ ID NO: 4507322 - DNA, 13 bp, Homo sapiens
tcttcatgaaatg

SEQ ID NO: 4507323 - DNA, 17 bp, Homo sapiens
tcttcatgaaatgtgtt

SEQ ID NO: 4507324 - DNA, 17 bp, Homo sapiens
tcttcattattctctgc

SEQ ID NO: 4507325 - DNA, 14 bp, Homo sapiens
tcttcatttctctg

SEQ ID NO: 4507326 - DNA, 18 bp, Homo sapiens
tcttcattttttaatgtg

SEQ ID NO: 4507327 - DNA, 19 bp, Homo sapiens
tcttcattttttttaattg

SEQ ID NO: 4507328 - DNA, 20 bp, Homo sapiens
tcttccacaaaaaatacttt

SEQ ID NO: 4507329 - DNA, 23 bp, Homo sapiens
tcttccacaaagaaaattcctat

SEQ ID NO: 4507330 - DNA, 23 bp, Homo sapiens
tcttccacagtggcgggcccact

SEQ ID NO: 4507331 - DNA, 21 bp, Homo sapiens
tcttccagtcttcctgacact

SEQ ID NO: 4507332 - DNA, 12 bp, Homo sapiens
tcttcccacagg

SEQ ID NO: 4507333 - DNA, 15 bp, Homo sapiens
tcttcccacaggagg

SEQ ID NO: 4507334 - DNA, 20 bp, Homo sapiens
tcttccccagaaaggagact

SEQ ID NO: 4507335 - DNA, 13 bp, Homo sapiens
tcttccctacctc

SEQ ID NO: 4507336 - DNA, 21 bp, Homo sapiens
tcttccctgcttcacgattct

SEQ ID NO: 4507337 - DNA, 11 bp, Homo sapiens
tcttccctggg

SEQ ID NO: 4507338 - DNA, 13 bp, Homo sapiens
tcttccctgggct

SEQ ID NO: 4507339 - DNA, 17 bp, Homo sapiens
tcttccctgtcagcctg

SEQ ID NO: 4507340 - DNA, 21 bp, Homo sapiens
tcttccgactctttctgagtg

SEQ ID NO: 4507341 - DNA, 16 bp, Homo sapiens
tcttcctaatcgctaa

SEQ ID NO: 4507342 - DNA, 18 bp, Homo sapiens
tcttcctaccctgcctcc

SEQ ID NO: 4507343 - DNA, 21 bp, Homo sapiens
tcttcctaccctgcctccctt

SEQ ID NO: 4507344 - DNA, 23 bp, Homo sapiens
tcttcctcaaaataaagaagtat

SEQ ID NO: 4507345 - DNA, 21 bp, Homo sapiens
tcttcctcacagtcccactgt

SEQ ID NO: 4507346 - DNA, 14 bp, Homo sapiens
tcttcctcccaagt

SEQ ID NO: 4507347 - DNA, 22 bp, Homo sapiens
tcttcctgtgaagtttaattgt

SEQ ID NO: 4507348 - DNA, 21 bp, Homo sapiens
tcttccttcagaagtttcgtc

SEQ ID NO: 4507349 - DNA, 23 bp, Homo sapiens
tcttccttctaccccaaggccag

SEQ ID NO: 4507350 - DNA, 16 bp, Homo sapiens
tcttctaaaatagcaa

SEQ ID NO: 4507351 - DNA, 18 bp, Homo sapiens
tcttctaaaatagcaata

SEQ ID NO: 4507352 - DNA, 13 bp, Homo sapiens
tcttctaaacttc

SEQ ID NO: 4507353 - DNA, 20 bp, Homo sapiens
tcttctaagaagacattttg

SEQ ID NO: 4507354 - DNA, 18 bp, Homo sapiens
tcttctaccctcatcatc

SEQ ID NO: 4507355 - DNA, 21 bp, Homo sapiens
tcttctagatggaccccagca

SEQ ID NO: 4507356 - DNA, 12 bp, Homo sapiens
tcttctatttat

SEQ ID NO: 4507357 - DNA, 10 bp, Homo sapiens
tcttctcatt

SEQ ID NO: 4507358 - DNA, 15 bp, Homo sapiens
tcttctcatttcacc

SEQ ID NO: 4507359 - DNA, 16 bp, Homo sapiens
tcttctccaattctga

SEQ ID NO: 4507360 - DNA, 23 bp, Homo sapiens
tcttctccaattctgaaatactt

SEQ ID NO: 4507361 - DNA, 22 bp, Homo sapiens
tcttctctaacaagctatggga

SEQ ID NO: 4507362 - DNA, 14 bp, Homo sapiens
tcttctctttctct

SEQ ID NO: 4507363 - DNA, 19 bp, Homo sapiens
tcttctgagctatttcatc

SEQ ID NO: 4507364 - DNA, 21 bp, Homo sapiens
tcttctgagctatttcatcta

SEQ ID NO: 4507365 - DNA, 20 bp, Homo sapiens
tcttctgcaagcctcatgcc

SEQ ID NO: 4507366 - DNA, 12 bp, Homo sapiens
tcttctgctcca

SEQ ID NO: 4507367 - DNA, 13 bp, Homo sapiens
tcttctgctccac

SEQ ID NO: 4507368 - DNA, 14 bp, Homo sapiens
tcttctgctccacc

SEQ ID NO: 4507369 - DNA, 16 bp, Homo sapiens
tcttctgctccaccct

SEQ ID NO: 4507370 - DNA, 23 bp, Homo sapiens
tcttctgctccacccttggcctg

SEQ ID NO: 4507371 - DNA, 23 bp, Homo sapiens
tcttctgggagggcagcagggct

SEQ ID NO: 4507372 - DNA, 20 bp, Homo sapiens
tcttctggggcaggctgggc

SEQ ID NO: 4507373 - DNA, 22 bp, Homo sapiens
tcttctggggcaggctgggcca

SEQ ID NO: 4507374 - DNA, 14 bp, Homo sapiens
tcttctgtattttt

SEQ ID NO: 4507375 - DNA, 18 bp, Homo sapiens
tcttcttataacttgtaa

SEQ ID NO: 4507376 - DNA, 15 bp, Homo sapiens
tcttcttcaccattt

SEQ ID NO: 4507377 - DNA, 13 bp, Homo sapiens
tcttcttccctcc

SEQ ID NO: 4507378 - DNA, 22 bp, Homo sapiens
tcttcttccctccctatctaac

SEQ ID NO: 4507379 - DNA, 21 bp, Homo sapiens
tcttcttctaagaagacattt

SEQ ID NO: 4507380 - DNA, 14 bp, Homo sapiens
tcttcttgaaaata

SEQ ID NO: 4507381 - DNA, 20 bp, Homo sapiens
tcttctttattattcctagt

SEQ ID NO: 4507382 - DNA, 16 bp, Homo sapiens
tcttctttgtgccttt

SEQ ID NO: 4507383 - DNA, 15 bp, Homo sapiens
tcttcttttttaagt

SEQ ID NO: 4507384 - DNA, 12 bp, Homo sapiens
tcttgaaaaaga

SEQ ID NO: 4507385 - DNA, 23 bp, Homo sapiens
tcttgaaaactgtgcaacttttt

SEQ ID NO: 4507386 - DNA, 20 bp, Homo sapiens
tcttgaaatgaaagggaaac

SEQ ID NO: 4507387 - DNA, 21 bp, Homo sapiens
tcttgaaatgaaagggaaact

SEQ ID NO: 4507388 - DNA, 14 bp, Homo sapiens
tcttgaaattaaga

SEQ ID NO: 4507389 - DNA, 19 bp, Homo sapiens
tcttgaacgttatgttcag

SEQ ID NO: 4507390 - DNA, 15 bp, Homo sapiens
tcttgaattcctctc

SEQ ID NO: 4507391 - DNA, 16 bp, Homo sapiens
tcttgaattcctctca

SEQ ID NO: 4507392 - DNA, 18 bp, Homo sapiens
tcttgacaatcatctcca

SEQ ID NO: 4507393 - DNA, 16 bp, Homo sapiens
tcttgactacagtcag

SEQ ID NO: 4507394 - DNA, 18 bp, Homo sapiens
tcttgactttttaaaaaa

SEQ ID NO: 4507395 - DNA, 22 bp, Homo sapiens
tcttgagcagttagcagaccta

SEQ ID NO: 4507396 - DNA, 18 bp, Homo sapiens
tcttgagcatcaatcttg

SEQ ID NO: 4507397 - DNA, 20 bp, Homo sapiens
tcttgagcatcaatcttgtt

SEQ ID NO: 4507398 - DNA, 17 bp, Homo sapiens
tcttgagccacagtcac

SEQ ID NO: 4507399 - DNA, 19 bp, Homo sapiens
tcttgatcaacatcttttc

SEQ ID NO: 4507400 - DNA, 23 bp, Homo sapiens
tcttgatcaacatcttttcttgc

SEQ ID NO: 4507401 - DNA, 14 bp, Homo sapiens
tcttgattatccat

SEQ ID NO: 4507402 - DNA, 13 bp, Homo sapiens
tcttgatttgagt

SEQ ID NO: 4507403 - DNA, 23 bp, Homo sapiens
tcttgcaagggaagagcctttat

SEQ ID NO: 4507404 - DNA, 17 bp, Homo sapiens
tcttgcattcaaaatct

SEQ ID NO: 4507405 - DNA, 19 bp, Homo sapiens
tcttgcattcaaaatcttc

SEQ ID NO: 4507406 - DNA, 15 bp, Homo sapiens
tcttgcccatcctga

SEQ ID NO: 4507407 - DNA, 17 bp, Homo sapiens
tcttgccttttgttaat

SEQ ID NO: 4507408 - DNA, 13 bp, Homo sapiens
tcttgctaccagt

SEQ ID NO: 4507409 - DNA, 14 bp, Homo sapiens
tcttgctagctatt

SEQ ID NO: 4507410 - DNA, 18 bp, Homo sapiens
tcttgctgcactctgtag

SEQ ID NO: 4507411 - DNA, 19 bp, Homo sapiens
tcttgctgttaaaaataat

SEQ ID NO: 4507412 - DNA, 18 bp, Homo sapiens
tcttgctgttgacatatt

SEQ ID NO: 4507413 - DNA, 11 bp, Homo sapiens
tcttgcttctt

SEQ ID NO: 4507414 - DNA, 16 bp, Homo sapiens
tcttgcttctttctag

SEQ ID NO: 4507415 - DNA, 17 bp, Homo sapiens
tcttgcttctttctaga

SEQ ID NO: 4507416 - DNA, 18 bp, Homo sapiens
tcttgcttctttctagaa

SEQ ID NO: 4507417 - DNA, 20 bp, Homo sapiens
tcttggaagctgtttggaaa

SEQ ID NO: 4507418 - DNA, 14 bp, Homo sapiens
tcttggaattacaa

SEQ ID NO: 4507419 - DNA, 18 bp, Homo sapiens
tcttggagtgccaagttt

SEQ ID NO: 4507420 - DNA, 19 bp, Homo sapiens
tcttggcttaatcattttc

SEQ ID NO: 4507421 - DNA, 20 bp, Homo sapiens
tcttggcttaatcattttca

SEQ ID NO: 4507422 - DNA, 16 bp, Homo sapiens
tcttggggcgcccacc

SEQ ID NO: 4507423 - DNA, 13 bp, Homo sapiens
tcttgggggaggc

SEQ ID NO: 4507424 - DNA, 14 bp, Homo sapiens
tcttggtaaaacat

SEQ ID NO: 4507425 - DNA, 16 bp, Homo sapiens
tcttggtagttctgtg

SEQ ID NO: 4507426 - DNA, 19 bp, Homo sapiens
tcttggtagttctgtgcct

SEQ ID NO: 4507427 - DNA, 13 bp, Homo sapiens
tcttggtcagctt

SEQ ID NO: 4507428 - DNA, 19 bp, Homo sapiens
tcttggtgtttgactgtaa

SEQ ID NO: 4507429 - DNA, 19 bp, Homo sapiens
tcttggttcgatacctgga

SEQ ID NO: 4507430 - DNA, 15 bp, Homo sapiens
tcttggttgaggaaa

SEQ ID NO: 4507431 - DNA, 22 bp, Homo sapiens
tcttggtttgtcagtttatctt

SEQ ID NO: 4507432 - DNA, 13 bp, Homo sapiens
tcttgtaaagact

SEQ ID NO: 4507433 - DNA, 15 bp, Homo sapiens
tcttgtaaatctttt

SEQ ID NO: 4507434 - DNA, 15 bp, Homo sapiens
tcttgtacaaacttt

SEQ ID NO: 4507435 - DNA, 18 bp, Homo sapiens
tcttgtacaaactttgtt

SEQ ID NO: 4507436 - DNA, 16 bp, Homo sapiens
tcttgtaccatagaaa

SEQ ID NO: 4507437 - DNA, 20 bp, Homo sapiens
tcttgtaccatagaaaaatg

SEQ ID NO: 4507438 - DNA, 22 bp, Homo sapiens
tcttgtaccatagaaaaatgta

SEQ ID NO: 4507439 - DNA, 15 bp, Homo sapiens
tcttgtatttaaaaa

SEQ ID NO: 4507440 - DNA, 16 bp, Homo sapiens
tcttgtcatacaaatt

SEQ ID NO: 4507441 - DNA, 19 bp, Homo sapiens
tcttgtccccacccatgcg

SEQ ID NO: 4507442 - DNA, 15 bp, Homo sapiens
tcttgtcttttcaga

SEQ ID NO: 4507443 - DNA, 14 bp, Homo sapiens
tcttgtgaaatggc

SEQ ID NO: 4507444 - DNA, 20 bp, Homo sapiens
tcttgtgtagatttgaaaat

SEQ ID NO: 4507445 - DNA, 12 bp, Homo sapiens
tcttgtgtttct

SEQ ID NO: 4507446 - DNA, 20 bp, Homo sapiens
tcttgttactgctgattctt

SEQ ID NO: 4507447 - DNA, 20 bp, Homo sapiens
tcttgttattaatgtttctt

SEQ ID NO: 4507448 - DNA, 15 bp, Homo sapiens
tcttgttcaggaaaa

SEQ ID NO: 4507449 - DNA, 15 bp, Homo sapiens
tcttgttcctgtgca

SEQ ID NO: 4507450 - DNA, 20 bp, Homo sapiens
tcttgttctgagattcaata

SEQ ID NO: 4507451 - DNA, 14 bp, Homo sapiens
tcttgttgataaaa

SEQ ID NO: 4507452 - DNA, 13 bp, Homo sapiens
tcttgtttattga

SEQ ID NO: 4507453 - DNA, 13 bp, Homo sapiens
tctttaaaacaaa

SEQ ID NO: 4507454 - DNA, 15 bp, Homo sapiens
tctttaaaagaatga

SEQ ID NO: 4507455 - DNA, 16 bp, Homo sapiens
tctttaaaagaatgac

SEQ ID NO: 4507456 - DNA, 17 bp, Homo sapiens
tctttaaaatacacact

SEQ ID NO: 4507457 - DNA, 23 bp, Homo sapiens
tctttaaatcattttaggaaagg

SEQ ID NO: 4507458 - DNA, 19 bp, Homo sapiens
tctttaaccacttttcaat

SEQ ID NO: 4507459 - DNA, 21 bp, Homo sapiens
tctttaactgccgtaatttaa

SEQ ID NO: 4507460 - DNA, 14 bp, Homo sapiens
tctttaactgtcat

SEQ ID NO: 4507461 - DNA, 14 bp, Homo sapiens
tctttaagccatag

SEQ ID NO: 4507462 - DNA, 18 bp, Homo sapiens
tctttaatcacttaacat

SEQ ID NO: 4507463 - DNA, 23 bp, Homo sapiens
tctttaatcacttaacattccta

SEQ ID NO: 4507464 - DNA, 22 bp, Homo sapiens
tctttagagaatccgtattgaa

SEQ ID NO: 4507465 - DNA, 15 bp, Homo sapiens
tctttagatgcaagt

SEQ ID NO: 4507466 - DNA, 22 bp, Homo sapiens
tctttaggggaagtaaaacagt

SEQ ID NO: 4507467 - DNA, 17 bp, Homo sapiens
tctttatagtgaagtgt

SEQ ID NO: 4507468 - DNA, 21 bp, Homo sapiens
tctttatagtgcacaaaatga

SEQ ID NO: 4507469 - DNA, 23 bp, Homo sapiens
tctttattgtccaccatgctctc

SEQ ID NO: 4507470 - DNA, 13 bp, Homo sapiens
tctttattgtctg

SEQ ID NO: 4507471 - DNA, 14 bp, Homo sapiens
tctttattgtctgt

SEQ ID NO: 4507472 - DNA, 20 bp, Homo sapiens
tctttcaaaaccttttgaaa

SEQ ID NO: 4507473 - DNA, 21 bp, Homo sapiens
tctttcaaaaccttttgaaat

SEQ ID NO: 4507474 - DNA, 15 bp, Homo sapiens
tctttcaaaagcctt

SEQ ID NO: 4507475 - DNA, 18 bp, Homo sapiens
tctttcaaaccagcttca

SEQ ID NO: 4507476 - DNA, 16 bp, Homo sapiens
tctttcagtacttttt

SEQ ID NO: 4507477 - DNA, 23 bp, Homo sapiens
tctttcagtacttttttaaatat

SEQ ID NO: 4507478 - DNA, 14 bp, Homo sapiens
tctttcatgtcttg

SEQ ID NO: 4507479 - DNA, 16 bp, Homo sapiens
tctttcattgctaaga

SEQ ID NO: 4507480 - DNA, 18 bp, Homo sapiens
tctttccaaaacatttct

SEQ ID NO: 4507481 - DNA, 17 bp, Homo sapiens
tctttccaaataaaatg

SEQ ID NO: 4507482 - DNA, 14 bp, Homo sapiens
tctttccaaattat

SEQ ID NO: 4507483 - DNA, 19 bp, Homo sapiens
tctttccaaattatttctt

SEQ ID NO: 4507484 - DNA, 12 bp, Homo sapiens
tctttccaggct

SEQ ID NO: 4507485 - DNA, 14 bp, Homo sapiens
tctttccctgcgag

SEQ ID NO: 4507486 - DNA, 14 bp, Homo sapiens
tctttccgactgcc

SEQ ID NO: 4507487 - DNA, 18 bp, Homo sapiens
tctttccgactgcccaga

SEQ ID NO: 4507488 - DNA, 15 bp, Homo sapiens
tctttcctccccctg

SEQ ID NO: 4507489 - DNA, 12 bp, Homo sapiens
tctttcctgccc

SEQ ID NO: 4507490 - DNA, 17 bp, Homo sapiens
tctttcctgccctgtcc

SEQ ID NO: 4507491 - DNA, 16 bp, Homo sapiens
tctttcctttaaaaat

SEQ ID NO: 4507492 - DNA, 11 bp, Homo sapiens
tctttctagcc

SEQ ID NO: 4507493 - DNA, 20 bp, Homo sapiens
tctttctccttcattaatga

SEQ ID NO: 4507494 - DNA, 21 bp, Homo sapiens
tctttctccttgaatatcttt

SEQ ID NO: 4507495 - DNA, 20 bp, Homo sapiens
tctttctctaatgttgtatc

SEQ ID NO: 4507496 - DNA, 19 bp, Homo sapiens
tgaaaagcaatattgtata

SEQ ID NO: 4507497 - DNA, 22 bp, Homo sapiens
tgaaaaggtttatgaaaaagaa

SEQ ID NO: 4507498 - DNA, 24 bp, Homo sapiens
tgaaaagtaattgaaaaaggtgat

SEQ ID NO: 4507499 - DNA, 22 bp, Homo sapiens
tgaaaagtactaatagaacttg

SEQ ID NO: 4507500 - DNA, 21 bp, Homo sapiens
tgaaaagtatattgataacct

SEQ ID NO: 4507501 - DNA, 17 bp, Homo sapiens
tgaaaagtcgttttcca

SEQ ID NO: 4507502 - DNA, 23 bp, Homo sapiens
tgaaaataaaaaatattgaaatg

SEQ ID NO: 4507503 - DNA, 21 bp, Homo sapiens
tgaaaataaaaagatcacttt

SEQ ID NO: 4507504 - DNA, 16 bp, Homo sapiens
tgaaaataaaacacac

SEQ ID NO: 4507505 - DNA, 23 bp, Homo sapiens
tgaaaatacaacttaaataataa

SEQ ID NO: 4507506 - DNA, 21 bp, Homo sapiens
tgaaaatatacttgactctaa

SEQ ID NO: 4507507 - DNA, 14 bp, Homo sapiens
tgaaaatatatatt

SEQ ID NO: 4507508 - DNA, 23 bp, Homo sapiens
tgaaaatatatattatatacata

SEQ ID NO: 4507509 - DNA, 18 bp, Homo sapiens
tgaaaatatgtactgtat

SEQ ID NO: 4507510 - DNA, 22 bp, Homo sapiens
tgaaaatgaatgccgaatttgg

SEQ ID NO: 4507511 - DNA, 13 bp, Homo sapiens
tgaaaatgagccc

SEQ ID NO: 4507512 - DNA, 19 bp, Homo sapiens
tgaaaatgattcctggaca

SEQ ID NO: 4507513 - DNA, 23 bp, Homo sapiens
tgaaaatgtattcctttaaaata

SEQ ID NO: 4507514 - DNA, 20 bp, Homo sapiens
tgaaaatgtccaggaaagtg

SEQ ID NO: 4507515 - DNA, 14 bp, Homo sapiens
tgaaaatgtcttgt

SEQ ID NO: 4507516 - DNA, 21 bp, Homo sapiens
tgaaaatgtgctatactgcat

SEQ ID NO: 4507517 - DNA, 14 bp, Homo sapiens
tgaaaattacatgt

SEQ ID NO: 4507518 - DNA, 23 bp, Homo sapiens
tgaaaattacatgttttttcatt

SEQ ID NO: 4507519 - DNA, 17 bp, Homo sapiens
tgaaaattatttaaacc

SEQ ID NO: 4507520 - DNA, 22 bp, Homo sapiens
tgaaaattcgcccgagctgttt

SEQ ID NO: 4507521 - DNA, 22 bp, Homo sapiens
tgaaaattctaacccaagacat

SEQ ID NO: 4507522 - DNA, 16 bp, Homo sapiens
tgaaaattgaaaagta

SEQ ID NO: 4507523 - DNA, 17 bp, Homo sapiens
tgaaaattgaaaagtac

SEQ ID NO: 4507524 - DNA, 15 bp, Homo sapiens
tgaaaattgtataaa

SEQ ID NO: 4507525 - DNA, 17 bp, Homo sapiens
tgaaaattgtataaatt

SEQ ID NO: 4507526 - DNA, 14 bp, Homo sapiens
tgaaacaaagagtt

SEQ ID NO: 4507527 - DNA, 23 bp, Homo sapiens
tgaaacactttgcctcctgtgta

SEQ ID NO: 4507528 - DNA, 11 bp, Homo sapiens
tgaaacagctg

SEQ ID NO: 4507529 - DNA, 13 bp, Homo sapiens
tgaaacagctgcc

SEQ ID NO: 4507530 - DNA, 18 bp, Homo sapiens
tgaaacattttttcttct

SEQ ID NO: 4507531 - DNA, 20 bp, Homo sapiens
tgaaaccaccgtgaaccaga

SEQ ID NO: 4507532 - DNA, 15 bp, Homo sapiens
tgaaaccagtattta

SEQ ID NO: 4507533 - DNA, 22 bp, Homo sapiens
tgaaacctcagggctgtcccag

SEQ ID NO: 4507534 - DNA, 17 bp, Homo sapiens
tgaaactaagagctctc

SEQ ID NO: 4507535 - DNA, 19 bp, Homo sapiens
tgaaactcatagacactga

SEQ ID NO: 4507536 - DNA, 21 bp, Homo sapiens
tgaaactcgcgagtgtaactt

SEQ ID NO: 4507537 - DNA, 22 bp, Homo sapiens
tgaaactgagatgtgaacacat

SEQ ID NO: 4507538 - DNA, 16 bp, Homo sapiens
tgaaactggcttcccc

SEQ ID NO: 4507539 - DNA, 15 bp, Homo sapiens
tgaaactggttccta

SEQ ID NO: 4507540 - DNA, 22 bp, Homo sapiens
tgaaactgtatcatctttgcca

SEQ ID NO: 4507541 - DNA, 14 bp, Homo sapiens
tgaaactttcattc

SEQ ID NO: 4507542 - DNA, 17 bp, Homo sapiens
tgaaagaggaatgaagt

SEQ ID NO: 4507543 - DNA, 23 bp, Homo sapiens
tgaaagcagggacttgaacccat

SEQ ID NO: 4507544 - DNA, 16 bp, Homo sapiens
tgaaagctgatttttt

SEQ ID NO: 4507545 - DNA, 21 bp, Homo sapiens
tgaaagctttggaaaaatctt

SEQ ID NO: 4507546 - DNA, 14 bp, Homo sapiens
tgaaaggagacatt

SEQ ID NO: 4507547 - DNA, 17 bp, Homo sapiens
tgaaaggctatcctgct

SEQ ID NO: 4507548 - DNA, 22 bp, Homo sapiens
tgaaagggagctatcaggaaca

SEQ ID NO: 4507549 - DNA, 16 bp, Homo sapiens
tgaaagggatcatcat

SEQ ID NO: 4507550 - DNA, 21 bp, Homo sapiens
tgaaagggtttgatatggaga

SEQ ID NO: 4507551 - DNA, 22 bp, Homo sapiens
tgaaagggtttgtaatacttta

SEQ ID NO: 4507552 - DNA, 16 bp, Homo sapiens
tgaaaggtaatttgag

SEQ ID NO: 4507553 - DNA, 15 bp, Homo sapiens
tgaaaggtagacttt

SEQ ID NO: 4507554 - DNA, 21 bp, Homo sapiens
tgaaaggtgccatggaagagg

SEQ ID NO: 4507555 - DNA, 17 bp, Homo sapiens
tgaaaggtgtgaacagc

SEQ ID NO: 4507556 - DNA, 12 bp, Homo sapiens
tgaaagttgctt

SEQ ID NO: 4507557 - DNA, 13 bp, Homo sapiens
tgaaagttgcttt

SEQ ID NO: 4507558 - DNA, 19 bp, Homo sapiens
tgaaagttgcttttattgc

SEQ ID NO: 4507559 - DNA, 20 bp, Homo sapiens
tgaaagttgcttttattgca

SEQ ID NO: 4507560 - DNA, 14 bp, Homo sapiens
tgaaagttgtacat

SEQ ID NO: 4507561 - DNA, 17 bp, Homo sapiens
tgaaagttgtacatgat

SEQ ID NO: 4507562 - DNA, 18 bp, Homo sapiens
tgaaagttgtacatgata

SEQ ID NO: 4507563 - DNA, 20 bp, Homo sapiens
tgaaagtttaacaaatgact

SEQ ID NO: 4507564 - DNA, 17 bp, Homo sapiens
tgaaagttttgtaaaag

SEQ ID NO: 4507565 - DNA, 17 bp, Homo sapiens
tgaaataaaaaaagatt

SEQ ID NO: 4507566 - DNA, 18 bp, Homo sapiens
tgaaataaaaaaagattt

SEQ ID NO: 4507567 - DNA, 15 bp, Homo sapiens
tgaaataaagttgaa

SEQ ID NO: 4507568 - DNA, 17 bp, Homo sapiens
tgaaataagccagacat

SEQ ID NO: 4507569 - DNA, 18 bp, Homo sapiens
tgaaataatatatttctt

SEQ ID NO: 4507570 - DNA, 19 bp, Homo sapiens
tgaaataatatatttcttc

SEQ ID NO: 4507571 - DNA, 21 bp, Homo sapiens
tgaaataatatatttcttctt

SEQ ID NO: 4507572 - DNA, 23 bp, Homo sapiens
tgaaataccacaagcctgagaac

SEQ ID NO: 4507573 - DNA, 17 bp, Homo sapiens
tgaaataccttttctca

SEQ ID NO: 4507574 - DNA, 17 bp, Homo sapiens
tgaaatagattttttca

SEQ ID NO: 4507575 - DNA, 21 bp, Homo sapiens
tgaaataggagggaaaccttt

SEQ ID NO: 4507576 - DNA, 15 bp, Homo sapiens
tgaaatagtatacat

SEQ ID NO: 4507577 - DNA, 17 bp, Homo sapiens
tgaaatagtatacattg

SEQ ID NO: 4507578 - DNA, 21 bp, Homo sapiens
tgaaatagtatacattgtctt

SEQ ID NO: 4507579 - DNA, 21 bp, Homo sapiens
tgaaatagtcctgaagttctt

SEQ ID NO: 4507580 - DNA, 16 bp, Homo sapiens
tgaaatagtctgtgtg

SEQ ID NO: 4507581 - DNA, 17 bp, Homo sapiens
tgaaatatatattgtaa

SEQ ID NO: 4507582 - DNA, 18 bp, Homo sapiens
tgaaatatatattgtaaa

SEQ ID NO: 4507583 - DNA, 17 bp, Homo sapiens
tgaaatatatgtgaaag

SEQ ID NO: 4507584 - DNA, 20 bp, Homo sapiens
tgaaatcccatctctacaaa

SEQ ID NO: 4507585 - DNA, 15 bp, Homo sapiens
tgaaatccctgcctc

SEQ ID NO: 4507586 - DNA, 20 bp, Homo sapiens
tgaaatccctgcctcaggcc

SEQ ID NO: 4507587 - DNA, 16 bp, Homo sapiens
tgaaatcttgtttgtt

SEQ ID NO: 4507588 - DNA, 23 bp, Homo sapiens
tgaaatcttgtttgttactgtca

SEQ ID NO: 4507589 - DNA, 18 bp, Homo sapiens
tgaaatgaaagggaaact

SEQ ID NO: 4507590 - DNA, 21 bp, Homo sapiens
tgaaatgaatgattctacagc

SEQ ID NO: 4507591 - DNA, 19 bp, Homo sapiens
tgaaatgataaagactttt

SEQ ID NO: 4507592 - DNA, 22 bp, Homo sapiens
tgaaatgccaaaggaagtttta

SEQ ID NO: 4507593 - DNA, 12 bp, Homo sapiens
tgaaatgctgta

SEQ ID NO: 4507594 - DNA, 20 bp, Homo sapiens
tgaaatgctgtatttttaca

SEQ ID NO: 4507595 - DNA, 13 bp, Homo sapiens
tgaaatgctttta

SEQ ID NO: 4507596 - DNA, 22 bp, Homo sapiens
tgaaatgcttttatattctaat

SEQ ID NO: 4507597 - DNA, 12 bp, Homo sapiens
tgaaatggaaca

SEQ ID NO: 4507598 - DNA, 16 bp, Homo sapiens
tgaaatgtacgtcatt

SEQ ID NO: 4507599 - DNA, 22 bp, Homo sapiens
tgaaatgtttactaagtggact

SEQ ID NO: 4507600 - DNA, 19 bp, Homo sapiens
tgaaattaacacaaaggaa

SEQ ID NO: 4507601 - DNA, 19 bp, Homo sapiens
tgaaattaagaaggcaaaa

SEQ ID NO: 4507602 - DNA, 21 bp, Homo sapiens
tgaaattaagaaggcaaaaat

SEQ ID NO: 4507603 - DNA, 23 bp, Homo sapiens
tgaaattaagaaggcaaaaatgt

SEQ ID NO: 4507604 - DNA, 16 bp, Homo sapiens
tgaaattcaaaatgct

SEQ ID NO: 4507605 - DNA, 19 bp, Homo sapiens
tgaaattcaaaatgctcta

SEQ ID NO: 4507606 - DNA, 11 bp, Homo sapiens
tgaaattctga

SEQ ID NO: 4507607 - DNA, 19 bp, Homo sapiens
tgaaattctgaatttgcaa

SEQ ID NO: 4507608 - DNA, 13 bp, Homo sapiens
tgaaatttacaaa

SEQ ID NO: 4507609 - DNA, 15 bp, Homo sapiens
tgaaatttacacagt

SEQ ID NO: 4507610 - DNA, 19 bp, Homo sapiens
tgaaatttcctaatttatt

SEQ ID NO: 4507611 - DNA, 14 bp, Homo sapiens
tgaaattttaacct

SEQ ID NO: 4507612 - DNA, 14 bp, Homo sapiens
tgaaattttagaaa

SEQ ID NO: 4507613 - DNA, 18 bp, Homo sapiens
tgaaattttatatgctta

SEQ ID NO: 4507614 - DNA, 20 bp, Homo sapiens
tgaacaaaaatgtttccact

SEQ ID NO: 4507615 - DNA, 13 bp, Homo sapiens
tctgggtttggat

SEQ ID NO: 4507616 - DNA, 18 bp, Homo sapiens
tctggtaagactgctggt

SEQ ID NO: 4507617 - DNA, 13 bp, Homo sapiens
tctggtagcctgc

SEQ ID NO: 4507618 - DNA, 17 bp, Homo sapiens
tctggtattaaatgcca

SEQ ID NO: 4507619 - DNA, 22 bp, Homo sapiens
tctggtctaaattgtgttacta

SEQ ID NO: 4507620 - DNA, 12 bp, Homo sapiens
tctggtgcctcc

SEQ ID NO: 4507621 - DNA, 14 bp, Homo sapiens
tctggtgcctcctc

SEQ ID NO: 4507622 - DNA, 15 bp, Homo sapiens
tctggtgctcctgca

SEQ ID NO: 4507623 - DNA, 18 bp, Homo sapiens
tctggtggtcttccttct

SEQ ID NO: 4507624 - DNA, 19 bp, Homo sapiens
tctggtgtatattttaatg

SEQ ID NO: 4507625 - DNA, 15 bp, Homo sapiens
tctggttgaactctg

SEQ ID NO: 4507626 - DNA, 15 bp, Homo sapiens
tctggttgcctcccc

SEQ ID NO: 4507627 - DNA, 18 bp, Homo sapiens
tctggttgtttctgttcc

SEQ ID NO: 4507628 - DNA, 13 bp, Homo sapiens
tctgtaaactgtg

SEQ ID NO: 4507629 - DNA, 16 bp, Homo sapiens
tctgtaaatctacaca

SEQ ID NO: 4507630 - DNA, 13 bp, Homo sapiens
tctgtaatattta

SEQ ID NO: 4507631 - DNA, 20 bp, Homo sapiens
tctgtaatatttacaatgta

SEQ ID NO: 4507632 - DNA, 22 bp, Homo sapiens
tctgtaatatttacaatgtatt

SEQ ID NO: 4507633 - DNA, 19 bp, Homo sapiens
tctgtaatgatactgatta

SEQ ID NO: 4507634 - DNA, 14 bp, Homo sapiens
tctgtaatgtaaat

SEQ ID NO: 4507635 - DNA, 16 bp, Homo sapiens
tctgtaatgtaaataa

SEQ ID NO: 4507636 - DNA, 22 bp, Homo sapiens
tctgtaatgtaaataaactatt

SEQ ID NO: 4507637 - DNA, 20 bp, Homo sapiens
tctgtaattcaggtttttcc

SEQ ID NO: 4507638 - DNA, 16 bp, Homo sapiens
tctgtacaaataatag

SEQ ID NO: 4507639 - DNA, 23 bp, Homo sapiens
tctgtacagcaagatgtttcttg

SEQ ID NO: 4507640 - DNA, 16 bp, Homo sapiens
tctgtacatttgcaat

SEQ ID NO: 4507641 - DNA, 14 bp, Homo sapiens
tctgtacttcctga

SEQ ID NO: 4507642 - DNA, 14 bp, Homo sapiens
tctgtactttgtgt

SEQ ID NO: 4507643 - DNA, 19 bp, Homo sapiens
tctgtagagggccctggtg

SEQ ID NO: 4507644 - DNA, 20 bp, Homo sapiens
tctgtagagggccctggtgt

SEQ ID NO: 4507645 - DNA, 17 bp, Homo sapiens
tctgtagcttatctgcc

SEQ ID NO: 4507646 - DNA, 20 bp, Homo sapiens
tctgtagtaaaatgttttca

SEQ ID NO: 4507647 - DNA, 22 bp, Homo sapiens
tctgtagtaaaatgttttcatt

SEQ ID NO: 4507648 - DNA, 24 bp, Homo sapiens
tctgtagtaatttattgtctgtct

SEQ ID NO: 4507649 - DNA, 15 bp, Homo sapiens
tctgtagtgtattaa

SEQ ID NO: 4507650 - DNA, 19 bp, Homo sapiens
tctgtagttcaatttcatg

SEQ ID NO: 4507651 - DNA, 17 bp, Homo sapiens
tctgtataacagccttt

SEQ ID NO: 4507652 - DNA, 14 bp, Homo sapiens
tctgtataatctat

SEQ ID NO: 4507653 - DNA, 14 bp, Homo sapiens
tctgtatataaata

SEQ ID NO: 4507654 - DNA, 19 bp, Homo sapiens
tctgtattgaaaatggctt

SEQ ID NO: 4507655 - DNA, 23 bp, Homo sapiens
tctgtattttatttagacaagag

SEQ ID NO: 4507656 - DNA, 17 bp, Homo sapiens
tctgtcaagagtagtta

SEQ ID NO: 4507657 - DNA, 20 bp, Homo sapiens
tctgtcaagagtagttatat

SEQ ID NO: 4507658 - DNA, 22 bp, Homo sapiens
tctgtcaagagtagttatataa

SEQ ID NO: 4507659 - DNA, 20 bp, Homo sapiens
tctgtcacagtaaaaataaa

SEQ ID NO: 4507660 - DNA, 22 bp, Homo sapiens
tctgtcacagtaaaaataaaat

SEQ ID NO: 4507661 - DNA, 19 bp, Homo sapiens
tctgtcaccagctatctgt

SEQ ID NO: 4507662 - DNA, 20 bp, Homo sapiens
tctgtcaccagctatctgtc

SEQ ID NO: 4507663 - DNA, 13 bp, Homo sapiens
tctgtcaggggct

SEQ ID NO: 4507664 - DNA, 14 bp, Homo sapiens
tctgtcagtaaaac

SEQ ID NO: 4507665 - DNA, 19 bp, Homo sapiens
tctgtcagtgtttgtattt

SEQ ID NO: 4507666 - DNA, 19 bp, Homo sapiens
tctgtcatccatatttgct

SEQ ID NO: 4507667 - DNA, 23 bp, Homo sapiens
tctgtcatctctctggggccctg

SEQ ID NO: 4507668 - DNA, 22 bp, Homo sapiens
tctgtcatgaacatgttcctga

SEQ ID NO: 4507669 - DNA, 18 bp, Homo sapiens
tctgtcattatattctaa

SEQ ID NO: 4507670 - DNA, 22 bp, Homo sapiens
tctgtcattatattctaattaa

SEQ ID NO: 4507671 - DNA, 20 bp, Homo sapiens
tctgtccagctggggccaga

SEQ ID NO: 4507672 - DNA, 21 bp, Homo sapiens
tctgtccagctggggccagag

SEQ ID NO: 4507673 - DNA, 13 bp, Homo sapiens
tctgtcccccagg

SEQ ID NO: 4507674 - DNA, 15 bp, Homo sapiens
tctgtccctgtaaaa

SEQ ID NO: 4507675 - DNA, 20 bp, Homo sapiens
tctgtccctgtccttccctg

SEQ ID NO: 4507676 - DNA, 20 bp, Homo sapiens
tctgtccgttcacatgtgtg

SEQ ID NO: 4507677 - DNA, 20 bp, Homo sapiens
tctgtccgtttactccaagg

SEQ ID NO: 4507678 - DNA, 14 bp, Homo sapiens
tctgtctcagtcca

SEQ ID NO: 4507679 - DNA, 12 bp, Homo sapiens
tctgtctccaag

SEQ ID NO: 4507680 - DNA, 14 bp, Homo sapiens
tctgtctctatatt

SEQ ID NO: 4507681 - DNA, 22 bp, Homo sapiens
tctgtctgcccttcaccccagt

SEQ ID NO: 4507682 - DNA, 15 bp, Homo sapiens
tctgtcttcacaaca

SEQ ID NO: 4507683 - DNA, 19 bp, Homo sapiens
tctgtcttgttaatgcttt

SEQ ID NO: 4507684 - DNA, 21 bp, Homo sapiens
tctgtctttcctgaaccatgt

SEQ ID NO: 4507685 - DNA, 13 bp, Homo sapiens
tctgtgaactgtg

SEQ ID NO: 4507686 - DNA, 18 bp, Homo sapiens
tctgtgaagcctctctcc

SEQ ID NO: 4507687 - DNA, 19 bp, Homo sapiens
tctgtgaagcctttatcta

SEQ ID NO: 4507688 - DNA, 19 bp, Homo sapiens
tctgtgaatttcagaggtc

SEQ ID NO: 4507689 - DNA, 18 bp, Homo sapiens
tctgtgaccaatgtcttg

SEQ ID NO: 4507690 - DNA, 15 bp, Homo sapiens
tctgtgacccatctg

SEQ ID NO: 4507691 - DNA, 21 bp, Homo sapiens
tctgtgacctgtcagaataaa

SEQ ID NO: 4507692 - DNA, 17 bp, Homo sapiens
tctgtgagactcgagaa

SEQ ID NO: 4507693 - DNA, 18 bp, Homo sapiens
tctgtgcaaacagtaacg

SEQ ID NO: 4507694 - DNA, 14 bp, Homo sapiens
tctgtgccccatgc

SEQ ID NO: 4507695 - DNA, 12 bp, Homo sapiens
tctgtgcctccc

SEQ ID NO: 4507696 - DNA, 18 bp, Homo sapiens
tctgtgcctccccccaga

SEQ ID NO: 4507697 - DNA, 20 bp, Homo sapiens
tctgtgcctccccccagacc

SEQ ID NO: 4507698 - DNA, 13 bp, Homo sapiens
tctgtggctggct

SEQ ID NO: 4507699 - DNA, 14 bp, Homo sapiens
tctgtggctggctc

SEQ ID NO: 4507700 - DNA, 23 bp, Homo sapiens
tctgtggctggctctaccttcct

SEQ ID NO: 4507701 - DNA, 13 bp, Homo sapiens
tctgtggtccctt

SEQ ID NO: 4507702 - DNA, 19 bp, Homo sapiens
tctgtgtatatctcttgga

SEQ ID NO: 4507703 - DNA, 21 bp, Homo sapiens
tctgtgtatatctcttggaaa

SEQ ID NO: 4507704 - DNA, 18 bp, Homo sapiens
tctgtgtattttcagtca

SEQ ID NO: 4507705 - DNA, 16 bp, Homo sapiens
tctgtgtgaaactttc

SEQ ID NO: 4507706 - DNA, 21 bp, Homo sapiens
tctgtgtggctgtgcaatttc

SEQ ID NO: 4507707 - DNA, 19 bp, Homo sapiens
tctgtgtgggactgtacac

SEQ ID NO: 4507708 - DNA, 20 bp, Homo sapiens
tctgtgtgggactgtacaca

SEQ ID NO: 4507709 - DNA, 11 bp, Homo sapiens
tctgtgtgtgt

SEQ ID NO: 4507710 - DNA, 19 bp, Homo sapiens
tctgtgtgtttatgtgtgt

SEQ ID NO: 4507711 - DNA, 13 bp, Homo sapiens
tctgtgttgcttc

SEQ ID NO: 4507712 - DNA, 15 bp, Homo sapiens
tctgttaatttagta

SEQ ID NO: 4507713 - DNA, 15 bp, Homo sapiens
tctgttacacactaa

SEQ ID NO: 4507714 - DNA, 19 bp, Homo sapiens
tctgttaggggccaataaa

SEQ ID NO: 4507715 - DNA, 23 bp, Homo sapiens
tctgttaggggccaataaaatgt

SEQ ID NO: 4507716 - DNA, 12 bp, Homo sapiens
tctgttatatga

SEQ ID NO: 4507717 - DNA, 12 bp, Homo sapiens
tctgttccaaat

SEQ ID NO: 4507718 - DNA, 13 bp, Homo sapiens
tctgttccaaatt

SEQ ID NO: 4507719 - DNA, 14 bp, Homo sapiens
tctgttccaaattc

SEQ ID NO: 4507720 - DNA, 22 bp, Homo sapiens
tctgttccaaattcagtttcat

SEQ ID NO: 4507721 - DNA, 23 bp, Homo sapiens
tctgttcccagcccctcctccct

SEQ ID NO: 4507722 - DNA, 17 bp, Homo sapiens
tctgttcccagcccctg

SEQ ID NO: 4507723 - DNA, 18 bp, Homo sapiens
tctgttgcaagcccctct

SEQ ID NO: 4507724 - DNA, 12 bp, Homo sapiens
tctgttggataa

SEQ ID NO: 4507725 - DNA, 13 bp, Homo sapiens
tctgtttctagtt

SEQ ID NO: 4507726 - DNA, 15 bp, Homo sapiens
tctgtttctctgctg

SEQ ID NO: 4507727 - DNA, 17 bp, Homo sapiens
tctgtttctctgctgtc

SEQ ID NO: 4507728 - DNA, 18 bp, Homo sapiens
tctgtttggacccatggt

SEQ ID NO: 4507729 - DNA, 14 bp, Homo sapiens
tctgtttgttactg

SEQ ID NO: 4507730 - DNA, 15 bp, Homo sapiens
tctgttttacaggaa

SEQ ID NO: 4507731 - DNA, 18 bp, Homo sapiens
tctgttttcttctcagtc

SEQ ID NO: 4507732 - DNA, 19 bp, Homo sapiens
tctgttttgtggtttggaa

SEQ ID NO: 4507733 - DNA, 22 bp, Homo sapiens
tctgttttgttaatatacccca

SEQ ID NO: 4507734 - DNA, 14 bp, Homo sapiens
tcttaaaacacatg

SEQ ID NO: 4507735 - DNA, 13 bp, Homo sapiens
tgaacaaaagggt

SEQ ID NO: 4507736 - DNA, 14 bp, Homo sapiens
tgaacaaaagggtc

SEQ ID NO: 4507737 - DNA, 13 bp, Homo sapiens
tgaacaaaattat

SEQ ID NO: 4507738 - DNA, 15 bp, Homo sapiens
tgaacaaaattattt

SEQ ID NO: 4507739 - DNA, 14 bp, Homo sapiens
tgaacaatgtatac

SEQ ID NO: 4507740 - DNA, 19 bp, Homo sapiens
tgaacaatgtatacaatgc

SEQ ID NO: 4507741 - DNA, 18 bp, Homo sapiens
tgaacacaaactgtaaat

SEQ ID NO: 4507742 - DNA, 19 bp, Homo sapiens
tgaacacaaactgtaaata

SEQ ID NO: 4507743 - DNA, 22 bp, Homo sapiens
tgaacacaaccagaggtggcag

SEQ ID NO: 4507744 - DNA, 13 bp, Homo sapiens
tgaacagaacata

SEQ ID NO: 4507745 - DNA, 16 bp, Homo sapiens
tgaacagccctctctc

SEQ ID NO: 4507746 - DNA, 14 bp, Homo sapiens
tgaacagctttgta

SEQ ID NO: 4507747 - DNA, 15 bp, Homo sapiens
tgaacagctttgtat

SEQ ID NO: 4507748 - DNA, 21 bp, Homo sapiens
tgaacatattcatgaaatgtg

SEQ ID NO: 4507749 - DNA, 20 bp, Homo sapiens
tgaacatccctttttcaatg

SEQ ID NO: 4507750 - DNA, 16 bp, Homo sapiens
tgaacatctcatgtgt

SEQ ID NO: 4507751 - DNA, 23 bp, Homo sapiens
tgaacattaaaatatagagacag

SEQ ID NO: 4507752 - DNA, 14 bp, Homo sapiens
tgaacattccagag

SEQ ID NO: 4507753 - DNA, 20 bp, Homo sapiens
tgaacattgtactgttgctt

SEQ ID NO: 4507754 - DNA, 15 bp, Homo sapiens
tgaacatttactaca

SEQ ID NO: 4507755 - DNA, 17 bp, Homo sapiens
tgaaccaaaaatagaaa

SEQ ID NO: 4507756 - DNA, 18 bp, Homo sapiens
tgaaccaaaaatagaaat

SEQ ID NO: 4507757 - DNA, 14 bp, Homo sapiens
tgaaccaaaacata

SEQ ID NO: 4507758 - DNA, 16 bp, Homo sapiens
tgaaccaacccccatc

SEQ ID NO: 4507759 - DNA, 13 bp, Homo sapiens
tgaaccacagaaa

SEQ ID NO: 4507760 - DNA, 14 bp, Homo sapiens
tgaaccacagaaat

SEQ ID NO: 4507761 - DNA, 16 bp, Homo sapiens
tgaaccacagaaatca

SEQ ID NO: 4507762 - DNA, 23 bp, Homo sapiens
tgaaccactgtgtactggagcct

SEQ ID NO: 4507763 - DNA, 19 bp, Homo sapiens
tgaaccattatactttata

SEQ ID NO: 4507764 - DNA, 13 bp, Homo sapiens
tgaacccaggagg

SEQ ID NO: 4507765 - DNA, 22 bp, Homo sapiens
tgaacccatatttgtacaccaa

SEQ ID NO: 4507766 - DNA, 14 bp, Homo sapiens
tgaacccatatttt

SEQ ID NO: 4507767 - DNA, 17 bp, Homo sapiens
tgaaccccagaggcaga

SEQ ID NO: 4507768 - DNA, 16 bp, Homo sapiens
tgaacccgggggacag

SEQ ID NO: 4507769 - DNA, 17 bp, Homo sapiens
tgaacctacctgccttg

SEQ ID NO: 4507770 - DNA, 14 bp, Homo sapiens
tgaacctatccttc

SEQ ID NO: 4507771 - DNA, 12 bp, Homo sapiens
tgaacctgcaag

SEQ ID NO: 4507772 - DNA, 15 bp, Homo sapiens
tgaacctgctactta

SEQ ID NO: 4507773 - DNA, 12 bp, Homo sapiens
tgaacctggagg

SEQ ID NO: 4507774 - DNA, 20 bp, Homo sapiens
tgaacgatccttcaaagtct

SEQ ID NO: 4507775 - DNA, 16 bp, Homo sapiens
tgaacggggagaaaag

SEQ ID NO: 4507776 - DNA, 13 bp, Homo sapiens
tgaacgttttaat

SEQ ID NO: 4507777 - DNA, 16 bp, Homo sapiens
tgaacgttttaataat

SEQ ID NO: 4507778 - DNA, 15 bp, Homo sapiens
tgaactaaagtgctg

SEQ ID NO: 4507779 - DNA, 21 bp, Homo sapiens
tgaactaaagtgctgcactca

SEQ ID NO: 4507780 - DNA, 17 bp, Homo sapiens
tgaactacatgcataaa

SEQ ID NO: 4507781 - DNA, 19 bp, Homo sapiens
tgaactacatgcataaact

SEQ ID NO: 4507782 - DNA, 19 bp, Homo sapiens
tgaactcaccctgggagcc

SEQ ID NO: 4507783 - DNA, 20 bp, Homo sapiens
tgaactcactttcctcctga

SEQ ID NO: 4507784 - DNA, 20 bp, Homo sapiens
tgaactcagcacattcggga

SEQ ID NO: 4507785 - DNA, 18 bp, Homo sapiens
tgaactccatacagcctc

SEQ ID NO: 4507786 - DNA, 20 bp, Homo sapiens
tgaactccatacagcctcta

SEQ ID NO: 4507787 - DNA, 14 bp, Homo sapiens
tgaactcgcaggga

SEQ ID NO: 4507788 - DNA, 16 bp, Homo sapiens
tgaactctgttccccc

SEQ ID NO: 4507789 - DNA, 13 bp, Homo sapiens
tgaactgaacacc

SEQ ID NO: 4507790 - DNA, 23 bp, Homo sapiens
tgaactgaggagatgaccaggga

SEQ ID NO: 4507791 - DNA, 12 bp, Homo sapiens
tgaactgctttt

SEQ ID NO: 4507792 - DNA, 21 bp, Homo sapiens
tgaactgcttttaaaagtgca

SEQ ID NO: 4507793 - DNA, 17 bp, Homo sapiens
tgaactggaagaaagca

SEQ ID NO: 4507794 - DNA, 17 bp, Homo sapiens
tgaactggtcttccttt

SEQ ID NO: 4507795 - DNA, 22 bp, Homo sapiens
tgaactgtagagtcctatttca

SEQ ID NO: 4507796 - DNA, 19 bp, Homo sapiens
tgaactgtgtgtgaatctg

SEQ ID NO: 4507797 - DNA, 11 bp, Homo sapiens
tgaactgttac

SEQ ID NO: 4507798 - DNA, 16 bp, Homo sapiens
tgaacttccaagctcc

SEQ ID NO: 4507799 - DNA, 21 bp, Homo sapiens
tgaacttccaagctccaaatc

SEQ ID NO: 4507800 - DNA, 16 bp, Homo sapiens
tgaacttgaagctaac

SEQ ID NO: 4507801 - DNA, 13 bp, Homo sapiens
tgaactttctccc

SEQ ID NO: 4507802 - DNA, 14 bp, Homo sapiens
tgaactttctccct

SEQ ID NO: 4507803 - DNA, 12 bp, Homo sapiens
tgaactttgaat

SEQ ID NO: 4507804 - DNA, 16 bp, Homo sapiens
tgaacttttgtactga

SEQ ID NO: 4507805 - DNA, 18 bp, Homo sapiens
tgaacttttgtactgaat

SEQ ID NO: 4507806 - DNA, 15 bp, Homo sapiens
tgaagaaaatcactt

SEQ ID NO: 4507807 - DNA, 21 bp, Homo sapiens
tgaagaaacagagtggcctcc

SEQ ID NO: 4507808 - DNA, 14 bp, Homo sapiens
tgaagaacatgtga

SEQ ID NO: 4507809 - DNA, 18 bp, Homo sapiens
tgaagaactgttgcctaa

SEQ ID NO: 4507810 - DNA, 20 bp, Homo sapiens
tgaagaactgttgcctaatt

SEQ ID NO: 4507811 - DNA, 21 bp, Homo sapiens
tgaagaagcacttctgctgca

SEQ ID NO: 4507812 - DNA, 22 bp, Homo sapiens
tgaagaagttaattcttaaaac

SEQ ID NO: 4507813 - DNA, 20 bp, Homo sapiens
tgaagaatacttctcatttt

SEQ ID NO: 4507814 - DNA, 21 bp, Homo sapiens
tgaagaatacttctcattttt

SEQ ID NO: 4507815 - DNA, 23 bp, Homo sapiens
tgaagaatcacgatttcatcctt

SEQ ID NO: 4507816 - DNA, 22 bp, Homo sapiens
tgaagaatttagatcttatatt

SEQ ID NO: 4507817 - DNA, 14 bp, Homo sapiens
tgaagacagcttcc

SEQ ID NO: 4507818 - DNA, 16 bp, Homo sapiens
tgaagacagcttccca

SEQ ID NO: 4507819 - DNA, 18 bp, Homo sapiens
tgaagactggaagctaat

SEQ ID NO: 4507820 - DNA, 20 bp, Homo sapiens
tgaagagaagggcagggctg

SEQ ID NO: 4507821 - DNA, 19 bp, Homo sapiens
tgaagagacagagacaagt

SEQ ID NO: 4507822 - DNA, 23 bp, Homo sapiens
tgaagagagcatttggcagagtc

SEQ ID NO: 4507823 - DNA, 19 bp, Homo sapiens
tgaagagatccttccattc

SEQ ID NO: 4507824 - DNA, 13 bp, Homo sapiens
tgaagagctcttg

SEQ ID NO: 4507825 - DNA, 15 bp, Homo sapiens
tgaagaggaccagag

SEQ ID NO: 4507826 - DNA, 16 bp, Homo sapiens
tgaagaggaccagagg

SEQ ID NO: 4507827 - DNA, 13 bp, Homo sapiens
tgaagaggcttct

SEQ ID NO: 4507828 - DNA, 12 bp, Homo sapiens
tgaagagtcaga

SEQ ID NO: 4507829 - DNA, 13 bp, Homo sapiens
tgaagatcaattt

SEQ ID NO: 4507830 - DNA, 18 bp, Homo sapiens
tgaagatccccaactgct

SEQ ID NO: 4507831 - DNA, 21 bp, Homo sapiens
tgaagatccccaactgctcca

SEQ ID NO: 4507832 - DNA, 22 bp, Homo sapiens
tgaagatggagggggctggggt

SEQ ID NO: 4507833 - DNA, 23 bp, Homo sapiens
tgaagatggagggggctggggtc

SEQ ID NO: 4507834 - DNA, 18 bp, Homo sapiens
tgaagatgtagaggagaa

SEQ ID NO: 4507835 - DNA, 11 bp, Homo sapiens
tgaagattctt

SEQ ID NO: 4507836 - DNA, 16 bp, Homo sapiens
tgaagattctttccca

SEQ ID NO: 4507837 - DNA, 21 bp, Homo sapiens
tgaagattctttcccaattca

SEQ ID NO: 4507838 - DNA, 18 bp, Homo sapiens
tgaagcaattagtctgaa

SEQ ID NO: 4507839 - DNA, 15 bp, Homo sapiens
tgaagcagcactgtg

SEQ ID NO: 4507840 - DNA, 13 bp, Homo sapiens
tgaagcagtcttg

SEQ ID NO: 4507841 - DNA, 16 bp, Homo sapiens
tgaagcagtcttgctc

SEQ ID NO: 4507842 - DNA, 19 bp, Homo sapiens
tgaagcatagctacaattt

SEQ ID NO: 4507843 - DNA, 20 bp, Homo sapiens
tgaagcatagctacaatttg

SEQ ID NO: 4507844 - DNA, 12 bp, Homo sapiens
tgaagccaaaga

SEQ ID NO: 4507845 - DNA, 21 bp, Homo sapiens
tgaagccaagtggggtgctgg

SEQ ID NO: 4507846 - DNA, 21 bp, Homo sapiens
tgaagccatgagttccagaaa

SEQ ID NO: 4507847 - DNA, 15 bp, Homo sapiens
tgaagcctaaatttg

SEQ ID NO: 4507848 - DNA, 15 bp, Homo sapiens
tgaagcctctctcct

SEQ ID NO: 4507849 - DNA, 13 bp, Homo sapiens
tgaagccttttga

SEQ ID NO: 4507850 - DNA, 16 bp, Homo sapiens
tgaagccttttgaaag

SEQ ID NO: 4507851 - DNA, 13 bp, Homo sapiens
tgaagctgctgtg

SEQ ID NO: 4507852 - DNA, 16 bp, Homo sapiens
tgaagctgttgtgtga

SEQ ID NO: 4507853 - DNA, 21 bp, Homo sapiens
tgaagcttcggccgcgccacc

SEQ ID NO: 4507854 - DNA, 18 bp, Homo sapiens
tgaagcttggttgactga

SEQ ID NO: 4507855 - DNA, 19 bp, Homo sapiens
tgaagctttggttctctga

SEQ ID NO: 4507856 - DNA, 20 bp, Homo sapiens
tgaagctttggttctctgat

SEQ ID NO: 4507857 - DNA, 21 bp, Homo sapiens
tgaaggaaaaacacaagcaaa

SEQ ID NO: 4507858 - DNA, 16 bp, Homo sapiens
tgaaggaagagaagac

SEQ ID NO: 4507859 - DNA, 16 bp, Homo sapiens
tgaaggaatacaatat

SEQ ID NO: 4507860 - DNA, 22 bp, Homo sapiens
tgaaggagaggcaacatccaaa

SEQ ID NO: 4507861 - DNA, 11 bp, Homo sapiens
tgaaggagccc

SEQ ID NO: 4507862 - DNA, 22 bp, Homo sapiens
tgaaggagccccattcctggga

SEQ ID NO: 4507863 - DNA, 22 bp, Homo sapiens
tgaaggattatggaaaaataaa

SEQ ID NO: 4507864 - DNA, 18 bp, Homo sapiens
tgaaggcaaaattgcaaa

SEQ ID NO: 4507865 - DNA, 17 bp, Homo sapiens
tgaaggctaaaaagcaa

SEQ ID NO: 4507866 - DNA, 23 bp, Homo sapiens
tgaaggctctcacccccatccct

SEQ ID NO: 4507867 - DNA, 19 bp, Homo sapiens
tgaaggcttctctctgtgg

SEQ ID NO: 4507868 - DNA, 15 bp, Homo sapiens
tgaagggaagagaca

SEQ ID NO: 4507869 - DNA, 14 bp, Homo sapiens
tgaaggtaaataaa

SEQ ID NO: 4507870 - DNA, 19 bp, Homo sapiens
tgaaggtagaatgttttca

SEQ ID NO: 4507871 - DNA, 21 bp, Homo sapiens
tgaaggtctcctaaaactggg

SEQ ID NO: 4507872 - DNA, 19 bp, Homo sapiens
tgaaggtgataagggaaaa

SEQ ID NO: 4507873 - DNA, 18 bp, Homo sapiens
tgaaggtgttgggtcagt

SEQ ID NO: 4507874 - DNA, 18 bp, Homo sapiens
tgaagtacaaacatgaaa

SEQ ID NO: 4507875 - DNA, 14 bp, Homo sapiens
tgaagtataaatct

SEQ ID NO: 4507876 - DNA, 13 bp, Homo sapiens
tgaagtatctttg

SEQ ID NO: 4507877 - DNA, 23 bp, Homo sapiens
tgaagtccttcagtgagcccctc

SEQ ID NO: 4507878 - DNA, 17 bp, Homo sapiens
tgaagtcgttgtgaggg

SEQ ID NO: 4507879 - DNA, 16 bp, Homo sapiens
tgaagtctagaatcat

SEQ ID NO: 4507880 - DNA, 19 bp, Homo sapiens
tgaagtctagaatcatact

SEQ ID NO: 4507881 - DNA, 15 bp, Homo sapiens
tgaagtgagaactcc

SEQ ID NO: 4507882 - DNA, 20 bp, Homo sapiens
tgaagtgcttgtatagcttt

SEQ ID NO: 4507883 - DNA, 14 bp, Homo sapiens
tgaagtgtggctgg

SEQ ID NO: 4507884 - DNA, 15 bp, Homo sapiens
tgaagtgtggctggt

SEQ ID NO: 4507885 - DNA, 15 bp, Homo sapiens
tgaagtgttaataca

SEQ ID NO: 4507886 - DNA, 19 bp, Homo sapiens
tgaagtgttccctttttca

SEQ ID NO: 4507887 - DNA, 16 bp, Homo sapiens
tgaagttagtggaaat

SEQ ID NO: 4507888 - DNA, 16 bp, Homo sapiens
tgaagttatgctgtca

SEQ ID NO: 4507889 - DNA, 14 bp, Homo sapiens
tgaagttctgagat

SEQ ID NO: 4507890 - DNA, 16 bp, Homo sapiens
tgaagttgtttatcaa

SEQ ID NO: 4507891 - DNA, 19 bp, Homo sapiens
tgaagtttaattgtctcaa

SEQ ID NO: 4507892 - DNA, 17 bp, Homo sapiens
tgaagtttacaatcaaa

SEQ ID NO: 4507893 - DNA, 22 bp, Homo sapiens
tgaagtttcaagttttaaagtt

SEQ ID NO: 4507894 - DNA, 23 bp, Homo sapiens
tgaagtttcctatgactaattca

SEQ ID NO: 4507895 - DNA, 15 bp, Homo sapiens
tgaagttttacattg

SEQ ID NO: 4507896 - DNA, 23 bp, Homo sapiens
tgaagttttattttaaattatta

SEQ ID NO: 4507897 - DNA, 14 bp, Homo sapiens
tgaagttttccttg

SEQ ID NO: 4507898 - DNA, 16 bp, Homo sapiens
tgaagtttttaaaaat

SEQ ID NO: 4507899 - DNA, 15 bp, Homo sapiens
tgaataaaattaggt

SEQ ID NO: 4507900 - DNA, 11 bp, Homo sapiens
tgaataaagaa

SEQ ID NO: 4507901 - DNA, 20 bp, Homo sapiens
tgaataaagaatacttgaac

SEQ ID NO: 4507902 - DNA, 22 bp, Homo sapiens
tgaataaagaatacttgaactt

SEQ ID NO: 4507903 - DNA, 14 bp, Homo sapiens
tgaataaagaatgc

SEQ ID NO: 4507904 - DNA, 18 bp, Homo sapiens
tgaataaagaatgccatt

SEQ ID NO: 4507905 - DNA, 22 bp, Homo sapiens
tgaataaagcctttgtatcttt

SEQ ID NO: 4507906 - DNA, 19 bp, Homo sapiens
tgaataaattctataggaa

SEQ ID NO: 4507907 - DNA, 21 bp, Homo sapiens
tgaataaattctataggaaca

SEQ ID NO: 4507908 - DNA, 16 bp, Homo sapiens
tgaataaattttcaaa

SEQ ID NO: 4507909 - DNA, 22 bp, Homo sapiens
tgaataagcagaacatactgtt

SEQ ID NO: 4507910 - DNA, 14 bp, Homo sapiens
tgaataatgaaaat

SEQ ID NO: 4507911 - DNA, 21 bp, Homo sapiens
tgaataatgcctttgtaacca

SEQ ID NO: 4507912 - DNA, 16 bp, Homo sapiens
tgaataatggaaaatg

SEQ ID NO: 4507913 - DNA, 20 bp, Homo sapiens
tgaatacagttacttaatga

SEQ ID NO: 4507914 - DNA, 21 bp, Homo sapiens
tgaatacagttacttaatgac

SEQ ID NO: 4507915 - DNA, 13 bp, Homo sapiens
tgaatacattaac

SEQ ID NO: 4507916 - DNA, 23 bp, Homo sapiens
tgaatacattaacggtgctaaaa

SEQ ID NO: 4507917 - DNA, 16 bp, Homo sapiens
tgaatactgtctgtat

SEQ ID NO: 4507918 - DNA, 19 bp, Homo sapiens
tgaatagtgctgcaataaa

SEQ ID NO: 4507919 - DNA, 20 bp, Homo sapiens
tgaatagttaaaaattaaat

SEQ ID NO: 4507920 - DNA, 17 bp, Homo sapiens
tgaatagtttatttctg

SEQ ID NO: 4507921 - DNA, 22 bp, Homo sapiens
tgaatagtttatttctgtgaaa

SEQ ID NO: 4507922 - DNA, 22 bp, Homo sapiens
tgaatataaatgtgtgtatgtg

SEQ ID NO: 4507923 - DNA, 14 bp, Homo sapiens
tgaatataatccct

SEQ ID NO: 4507924 - DNA, 15 bp, Homo sapiens
tgaatatatggcatt

SEQ ID NO: 4507925 - DNA, 14 bp, Homo sapiens
tgaatatctttcga

SEQ ID NO: 4507926 - DNA, 11 bp, Homo sapiens
tgaatattaaa

SEQ ID NO: 4507927 - DNA, 15 bp, Homo sapiens
tgaatattactccta

SEQ ID NO: 4507928 - DNA, 19 bp, Homo sapiens
tgaatattactcctatttt

SEQ ID NO: 4507929 - DNA, 16 bp, Homo sapiens
tgaatattcctttatt

SEQ ID NO: 4507930 - DNA, 18 bp, Homo sapiens
tgaatatttggaattgaa

SEQ ID NO: 4507931 - DNA, 13 bp, Homo sapiens
tgaatatttgtaa

SEQ ID NO: 4507932 - DNA, 19 bp, Homo sapiens
tgaatattttcaagttttt

SEQ ID NO: 4507933 - DNA, 15 bp, Homo sapiens
tgaatattttttgaa

SEQ ID NO: 4507934 - DNA, 22 bp, Homo sapiens
tgaatattttttgaaggtttca

SEQ ID NO: 4507935 - DNA, 13 bp, Homo sapiens
tgaatcaataata

SEQ ID NO: 4507936 - DNA, 22 bp, Homo sapiens
tgaatcaataatatattttctg

SEQ ID NO: 4507937 - DNA, 18 bp, Homo sapiens
tgaatcacagtatcagta

SEQ ID NO: 4507938 - DNA, 23 bp, Homo sapiens
tgaatcacgtaaagctagaaatg

SEQ ID NO: 4507939 - DNA, 21 bp, Homo sapiens
tgaatcactgttgctttgaaa

SEQ ID NO: 4507940 - DNA, 16 bp, Homo sapiens
tgaatccaaactaatc

SEQ ID NO: 4507941 - DNA, 16 bp, Homo sapiens
tgaatccatcttgctt

SEQ ID NO: 4507942 - DNA, 21 bp, Homo sapiens
tgaatcccccttgccacccca

SEQ ID NO: 4507943 - DNA, 18 bp, Homo sapiens
tgaatctgcttttcctct

SEQ ID NO: 4507944 - DNA, 20 bp, Homo sapiens
tgaatctgtgcaaacagtaa

SEQ ID NO: 4507945 - DNA, 20 bp, Homo sapiens
tgaatctgtgtgcatatttg

SEQ ID NO: 4507946 - DNA, 15 bp, Homo sapiens
tgaatgaatggctaa

SEQ ID NO: 4507947 - DNA, 20 bp, Homo sapiens
tgaatgaatggctaagcaaa

SEQ ID NO: 4507948 - DNA, 14 bp, Homo sapiens
tgaatgatctattc

SEQ ID NO: 4507949 - DNA, 16 bp, Homo sapiens
tgaatgatcttgtgta

SEQ ID NO: 4507950 - DNA, 15 bp, Homo sapiens
tgaatgattaaatta

SEQ ID NO: 4507951 - DNA, 19 bp, Homo sapiens
tgaatgattaaattatgaa

SEQ ID NO: 4507952 - DNA, 16 bp, Homo sapiens
tgaatgattcagtgtt

SEQ ID NO: 4507953 - DNA, 15 bp, Homo sapiens
tgaatgattctacag

SEQ ID NO: 4507954 - DNA, 19 bp, Homo sapiens
tgaatgatttccaaagaga

SEQ ID NO: 4507955 - DNA, 18 bp, Homo sapiens
tgaatgcataatgtttaa

SEQ ID NO: 4507956 - DNA, 23 bp, Homo sapiens
tgaatgccgaatttggtacacat

SEQ ID NO: 4507957 - DNA, 14 bp, Homo sapiens
tgaatgcttttagt

SEQ ID NO: 4507958 - DNA, 23 bp, Homo sapiens
tgaatgcttttagtgtgtgcata

SEQ ID NO: 4507959 - DNA, 19 bp, Homo sapiens
tgaatggaggacttttctg

SEQ ID NO: 4507960 - DNA, 23 bp, Homo sapiens
tgaatggccttcatatcatccac

SEQ ID NO: 4507961 - DNA, 16 bp, Homo sapiens
tgaatggtctctgtca

SEQ ID NO: 4507962 - DNA, 15 bp, Homo sapiens
tgaatggtgttgtat

SEQ ID NO: 4507963 - DNA, 18 bp, Homo sapiens
tgaatggtgttgtatgcc

SEQ ID NO: 4507964 - DNA, 18 bp, Homo sapiens
tgaatgtaatttgtgtaa

SEQ ID NO: 4507965 - DNA, 19 bp, Homo sapiens
tgaatgtactatgtctgaa

SEQ ID NO: 4507966 - DNA, 13 bp, Homo sapiens
tgaatgtggcagt

SEQ ID NO: 4507967 - DNA, 20 bp, Homo sapiens
tgaatgttcttgaattatat

SEQ ID NO: 4507968 - DNA, 19 bp, Homo sapiens
tgaattaattaatttggag

SEQ ID NO: 4507969 - DNA, 18 bp, Homo sapiens
tgaattaccatagagtaa

SEQ ID NO: 4507970 - DNA, 17 bp, Homo sapiens
tgaattacctggatgtt

SEQ ID NO: 4507971 - DNA, 11 bp, Homo sapiens
tgaattagaaa

SEQ ID NO: 4507972 - DNA, 20 bp, Homo sapiens
tgaattaggctgtaactact

SEQ ID NO: 4507973 - DNA, 21 bp, Homo sapiens
tgaattaggctgtaactactt

SEQ ID NO: 4507974 - DNA, 18 bp, Homo sapiens
tgaattatcagcaaagaa

SEQ ID NO: 4507975 - DNA, 20 bp, Homo sapiens
tgaattatcagcaaagaaaa

SEQ ID NO: 4507976 - DNA, 18 bp, Homo sapiens
tgaattattatatacata

SEQ ID NO: 4507977 - DNA, 21 bp, Homo sapiens
tgaattatttttaaagatctt

SEQ ID NO: 4507978 - DNA, 20 bp, Homo sapiens
tgaattccactccttccaga

SEQ ID NO: 4507979 - DNA, 20 bp, Homo sapiens
tgaattcttggttgaggaaa

SEQ ID NO: 4507980 - DNA, 17 bp, Homo sapiens
tgaattggctatgcagt

SEQ ID NO: 4507981 - DNA, 17 bp, Homo sapiens
tgaatttctcctttcct

SEQ ID NO: 4507982 - DNA, 19 bp, Homo sapiens
tgaattttataaataaaat

SEQ ID NO: 4507983 - DNA, 17 bp, Homo sapiens
tgaattttctaaaagct

SEQ ID NO: 4507984 - DNA, 15 bp, Homo sapiens
tgaattttgggactt

SEQ ID NO: 4507985 - DNA, 13 bp, Homo sapiens
tgaattttgggga

SEQ ID NO: 4507986 - DNA, 22 bp, Homo sapiens
tgaatttttgcaataatgcagt

SEQ ID NO: 4507987 - DNA, 18 bp, Homo sapiens
tgacaaaaaatgttttaa

SEQ ID NO: 4507988 - DNA, 17 bp, Homo sapiens
tgacaaaactaaccttg

SEQ ID NO: 4507989 - DNA, 19 bp, Homo sapiens
tgacaaaactaaccttgaa

SEQ ID NO: 4507990 - DNA, 13 bp, Homo sapiens
tgacaaaatgact

SEQ ID NO: 4507991 - DNA, 19 bp, Homo sapiens
tgacaaaatgactggctcc

SEQ ID NO: 4507992 - DNA, 20 bp, Homo sapiens
tgacaaaatgactggctcct

SEQ ID NO: 4507993 - DNA, 18 bp, Homo sapiens
tgacaaacacaattctag

SEQ ID NO: 4507994 - DNA, 17 bp, Homo sapiens
tgacaaagaaacccaag

SEQ ID NO: 4507995 - DNA, 19 bp, Homo sapiens
tgacaaataagattaataa

SEQ ID NO: 4507996 - DNA, 15 bp, Homo sapiens
tgacaacacttaata

SEQ ID NO: 4507997 - DNA, 20 bp, Homo sapiens
tgacaacacttaatagcaac

SEQ ID NO: 4507998 - DNA, 17 bp, Homo sapiens
tgacaaccattaaagtc

SEQ ID NO: 4507999 - DNA, 21 bp, Homo sapiens
tgacaagagttggggacagaa

SEQ ID NO: 4508000 - DNA, 17 bp, Homo sapiens
tgacaatactgctgcct

SEQ ID NO: 4508001 - DNA, 17 bp, Homo sapiens
tgacaatagttatgcct

SEQ ID NO: 4508002 - DNA, 23 bp, Homo sapiens
tgacaatagttatgcctgtacta

SEQ ID NO: 4508003 - DNA, 16 bp, Homo sapiens
tgacacaactgtgtga

SEQ ID NO: 4508004 - DNA, 23 bp, Homo sapiens
tgacacaccaggcgctaattcaa

SEQ ID NO: 4508005 - DNA, 18 bp, Homo sapiens
tgacacagaaaatgttga

SEQ ID NO: 4508006 - DNA, 19 bp, Homo sapiens
tgacacagaaaatgttgag

SEQ ID NO: 4508007 - DNA, 17 bp, Homo sapiens
tgacacatagtttttca

SEQ ID NO: 4508008 - DNA, 22 bp, Homo sapiens
tgacacatggcccctccccctg

SEQ ID NO: 4508009 - DNA, 14 bp, Homo sapiens
tgacacccaggccc

SEQ ID NO: 4508010 - DNA, 13 bp, Homo sapiens
tgacacctccccc

SEQ ID NO: 4508011 - DNA, 15 bp, Homo sapiens
tgacacctccccctt

SEQ ID NO: 4508012 - DNA, 19 bp, Homo sapiens
tgacacgcagttgctcgct

SEQ ID NO: 4508013 - DNA, 16 bp, Homo sapiens
tgacacgcttctgagc

SEQ ID NO: 4508014 - DNA, 23 bp, Homo sapiens
tgacactagcccaatgaaatgaa

SEQ ID NO: 4508015 - DNA, 19 bp, Homo sapiens
tgacactgctctaacagcc

SEQ ID NO: 4508016 - DNA, 15 bp, Homo sapiens
tgacacttaaaaatg

SEQ ID NO: 4508017 - DNA, 16 bp, Homo sapiens
tgacacttaaaaatgg

SEQ ID NO: 4508018 - DNA, 17 bp, Homo sapiens
tgacacttaaaaatggt

SEQ ID NO: 4508019 - DNA, 19 bp, Homo sapiens
tgacacttccaaagactcc

SEQ ID NO: 4508020 - DNA, 16 bp, Homo sapiens
tgacagaagctatttc

SEQ ID NO: 4508021 - DNA, 14 bp, Homo sapiens
tgacagaggctgca

SEQ ID NO: 4508022 - DNA, 22 bp, Homo sapiens
tgacagatcttttttttttccc

SEQ ID NO: 4508023 - DNA, 15 bp, Homo sapiens
tgacagatgcctggt

SEQ ID NO: 4508024 - DNA, 22 bp, Homo sapiens
tgacagctctgtttagaggagg

SEQ ID NO: 4508025 - DNA, 21 bp, Homo sapiens
tgacagctgtccctgtcacca

SEQ ID NO: 4508026 - DNA, 13 bp, Homo sapiens
tgacagcttggaa

SEQ ID NO: 4508027 - DNA, 20 bp, Homo sapiens
tgacagcttggaaagggaag

SEQ ID NO: 4508028 - DNA, 21 bp, Homo sapiens
tgacagcttgggaggaaacct

SEQ ID NO: 4508029 - DNA, 16 bp, Homo sapiens
tgacaggaaagccctc

SEQ ID NO: 4508030 - DNA, 21 bp, Homo sapiens
tgacaggaaagccctccccct

SEQ ID NO: 4508031 - DNA, 13 bp, Homo sapiens
tgacaggctctcc

SEQ ID NO: 4508032 - DNA, 15 bp, Homo sapiens
tgacaggctctcctg

SEQ ID NO: 4508033 - DNA, 17 bp, Homo sapiens
tgacaggctctcctggc

SEQ ID NO: 4508034 - DNA, 22 bp, Homo sapiens
tgacagggacatgccctgtgtg

SEQ ID NO: 4508035 - DNA, 16 bp, Homo sapiens
tgacaggtcagcagta

SEQ ID NO: 4508036 - DNA, 21 bp, Homo sapiens
tgacagtattatacgctggca

SEQ ID NO: 4508037 - DNA, 21 bp, Homo sapiens
tgacagtcataaatactgtca

SEQ ID NO: 4508038 - DNA, 22 bp, Homo sapiens
tgacagtcataaatactgtcaa

SEQ ID NO: 4508039 - DNA, 24 bp, Homo sapiens
tgacagtcataaatactgtcaaac

SEQ ID NO: 4508040 - DNA, 14 bp, Homo sapiens
tgacagtccacagg

SEQ ID NO: 4508041 - DNA, 15 bp, Homo sapiens
tgacagtccacaggg

SEQ ID NO: 4508042 - DNA, 18 bp, Homo sapiens
tgacagtccacaggggcc

SEQ ID NO: 4508043 - DNA, 11 bp, Homo sapiens
tgacagtggct

SEQ ID NO: 4508044 - DNA, 15 bp, Homo sapiens
tgacagtggctgctc

SEQ ID NO: 4508045 - DNA, 17 bp, Homo sapiens
tgacagtggctgctctg

SEQ ID NO: 4508046 - DNA, 23 bp, Homo sapiens
tgacagtggctgctctgggaagg

SEQ ID NO: 4508047 - DNA, 20 bp, Homo sapiens
tgacataaccaatttgtaat

SEQ ID NO: 4508048 - DNA, 17 bp, Homo sapiens
tgacatacatccaacat

SEQ ID NO: 4508049 - DNA, 18 bp, Homo sapiens
tgacatacctaccagtat

SEQ ID NO: 4508050 - DNA, 20 bp, Homo sapiens
tgacatacctaccagtatta

SEQ ID NO: 4508051 - DNA, 21 bp, Homo sapiens
tgacatacgcttttaatgaaa

SEQ ID NO: 4508052 - DNA, 12 bp, Homo sapiens
tgacatatttaa

SEQ ID NO: 4508053 - DNA, 18 bp, Homo sapiens
tgacatatttaatgtttt

SEQ ID NO: 4508054 - DNA, 22 bp, Homo sapiens
tgacatatttaatgttttaaat

SEQ ID NO: 4508055 - DNA, 23 bp, Homo sapiens
tgacatatttaatgttttaaatg

SEQ ID NO: 4508056 - DNA, 18 bp, Homo sapiens
tgacatccagagatgact

SEQ ID NO: 4508057 - DNA, 17 bp, Homo sapiens
tgacatgcctatatgag

SEQ ID NO: 4508058 - DNA, 18 bp, Homo sapiens
tgacatggtgcctgagag

SEQ ID NO: 4508059 - DNA, 14 bp, Homo sapiens
tgacattcactgag

SEQ ID NO: 4508060 - DNA, 19 bp, Homo sapiens
tgacattgccaaaaaggat

SEQ ID NO: 4508061 - DNA, 15 bp, Homo sapiens
tgacattgcgtttga

SEQ ID NO: 4508062 - DNA, 14 bp, Homo sapiens
tgacattgtctcct

SEQ ID NO: 4508063 - DNA, 18 bp, Homo sapiens
tgacatttatttttcatt

SEQ ID NO: 4508064 - DNA, 21 bp, Homo sapiens
tgacatttatttttcatttag

SEQ ID NO: 4508065 - DNA, 12 bp, Homo sapiens
tgacatttcact

SEQ ID NO: 4508066 - DNA, 16 bp, Homo sapiens
tgacattttacattaa

SEQ ID NO: 4508067 - DNA, 12 bp, Homo sapiens
tgacattttact

SEQ ID NO: 4508068 - DNA, 14 bp, Homo sapiens
tgaccaaagtcctt

SEQ ID NO: 4508069 - DNA, 20 bp, Homo sapiens
tgaccaacatggagaaaccc

SEQ ID NO: 4508070 - DNA, 15 bp, Homo sapiens
tgaccaagatactta

SEQ ID NO: 4508071 - DNA, 19 bp, Homo sapiens
tgaccaatattgtacagtt

SEQ ID NO: 4508072 - DNA, 17 bp, Homo sapiens
tgaccactccagagaag

SEQ ID NO: 4508073 - DNA, 17 bp, Homo sapiens
tgaccactgcagaagac

SEQ ID NO: 4508074 - DNA, 14 bp, Homo sapiens
tgaccagaaagctt

SEQ ID NO: 4508075 - DNA, 17 bp, Homo sapiens
tgaccagggatgctggg

SEQ ID NO: 4508076 - DNA, 15 bp, Homo sapiens
tgaccagtttctttt

SEQ ID NO: 4508077 - DNA, 22 bp, Homo sapiens
tgaccagtttcttttcttttgt

SEQ ID NO: 4508078 - DNA, 19 bp, Homo sapiens
tgaccatccactctaccct

SEQ ID NO: 4508079 - DNA, 22 bp, Homo sapiens
tgaccatccactctaccctccc

SEQ ID NO: 4508080 - DNA, 19 bp, Homo sapiens
tgaccatgcgtcaggggcc

SEQ ID NO: 4508081 - DNA, 18 bp, Homo sapiens
tgaccattattcacaggt

SEQ ID NO: 4508082 - DNA, 18 bp, Homo sapiens
tgacccagagtggagtct

SEQ ID NO: 4508083 - DNA, 22 bp, Homo sapiens
tgacccagagtggagtctgagt

SEQ ID NO: 4508084 - DNA, 12 bp, Homo sapiens
tgacccagtccc

SEQ ID NO: 4508085 - DNA, 14 bp, Homo sapiens
tgacccagtccctg

SEQ ID NO: 4508086 - DNA, 16 bp, Homo sapiens
tgacccagtccctggg

SEQ ID NO: 4508087 - DNA, 13 bp, Homo sapiens
tgaccccagagga

SEQ ID NO: 4508088 - DNA, 14 bp, Homo sapiens
tgacccccatgtaa

SEQ ID NO: 4508089 - DNA, 20 bp, Homo sapiens
tgacccctgcctgttggcag

SEQ ID NO: 4508090 - DNA, 21 bp, Homo sapiens
tgaccctcctgttgcacccag

SEQ ID NO: 4508091 - DNA, 23 bp, Homo sapiens
tgaccgtgggcggggccttgcgg

SEQ ID NO: 4508092 - DNA, 14 bp, Homo sapiens
tgaccgttaaaaaa

SEQ ID NO: 4508093 - DNA, 13 bp, Homo sapiens
tgacctactctca

SEQ ID NO: 4508094 - DNA, 17 bp, Homo sapiens
tgacctagttttccatg

SEQ ID NO: 4508095 - DNA, 17 bp, Homo sapiens
tgacctcaactaaccct

SEQ ID NO: 4508096 - DNA, 15 bp, Homo sapiens
tgagaatgtaagaac

SEQ ID NO: 4508097 - DNA, 12 bp, Homo sapiens
tgagacagctct

SEQ ID NO: 4508098 - DNA, 14 bp, Homo sapiens
tgagacaggctggg

SEQ ID NO: 4508099 - DNA, 20 bp, Homo sapiens
tgagacagggtcttgctctg

SEQ ID NO: 4508100 - DNA, 10 bp, Homo sapiens
tgagacatcc

SEQ ID NO: 4508101 - DNA, 18 bp, Homo sapiens
tgagacatgaagacacca

SEQ ID NO: 4508102 - DNA, 18 bp, Homo sapiens
tgagaccaacttttcaat

SEQ ID NO: 4508103 - DNA, 15 bp, Homo sapiens
tgagaccaggctggg

SEQ ID NO: 4508104 - DNA, 18 bp, Homo sapiens
tgagaccaggctgggcat

SEQ ID NO: 4508105 - DNA, 17 bp, Homo sapiens
tgagaccagggtggcca

SEQ ID NO: 4508106 - DNA, 17 bp, Homo sapiens
tgagacccccacacctc

SEQ ID NO: 4508107 - DNA, 22 bp, Homo sapiens
tgagacccccacacctcagttc

SEQ ID NO: 4508108 - DNA, 13 bp, Homo sapiens
tgagacccctggc

SEQ ID NO: 4508109 - DNA, 18 bp, Homo sapiens
tgagacccctggcctccg

SEQ ID NO: 4508110 - DNA, 22 bp, Homo sapiens
tgagacccctggcctccggcgt

SEQ ID NO: 4508111 - DNA, 19 bp, Homo sapiens
tgagaccctgggagagaag

SEQ ID NO: 4508112 - DNA, 13 bp, Homo sapiens
tgagaccctgtct

SEQ ID NO: 4508113 - DNA, 13 bp, Homo sapiens
tgagacctgacca

SEQ ID NO: 4508114 - DNA, 14 bp, Homo sapiens
tgagacctgaccag

SEQ ID NO: 4508115 - DNA, 14 bp, Homo sapiens
tgagactccatctc

SEQ ID NO: 4508116 - DNA, 17 bp, Homo sapiens
tgagactcgagaacttt

SEQ ID NO: 4508117 - DNA, 14 bp, Homo sapiens
tgagactgtacata

SEQ ID NO: 4508118 - DNA, 18 bp, Homo sapiens
tgagactttcttctagtg

SEQ ID NO: 4508119 - DNA, 15 bp, Homo sapiens
tgagactttttggtg

SEQ ID NO: 4508120 - DNA, 20 bp, Homo sapiens
tgagagacccaaggaggaaa

SEQ ID NO: 4508121 - DNA, 21 bp, Homo sapiens
tgagagacccaaggaggaaaa

SEQ ID NO: 4508122 - DNA, 18 bp, Homo sapiens
tgagagacgccactccct

SEQ ID NO: 4508123 - DNA, 20 bp, Homo sapiens
tgagagacgccactccctgg

SEQ ID NO: 4508124 - DNA, 16 bp, Homo sapiens
tgagagagatgggagc

SEQ ID NO: 4508125 - DNA, 21 bp, Homo sapiens
tgagagagatgggagctcctc

SEQ ID NO: 4508126 - DNA, 23 bp, Homo sapiens
tgagagatgctgtagacatctgt

SEQ ID NO: 4508127 - DNA, 23 bp, Homo sapiens
tgagagcccattcccaccattct

SEQ ID NO: 4508128 - DNA, 12 bp, Homo sapiens
tgagagcctgtg

SEQ ID NO: 4508129 - DNA, 18 bp, Homo sapiens
tgagaggatgaacatctt

SEQ ID NO: 4508130 - DNA, 16 bp, Homo sapiens
tgagaggcaggcatag

SEQ ID NO: 4508131 - DNA, 11 bp, Homo sapiens
tgagaggctga

SEQ ID NO: 4508132 - DNA, 14 bp, Homo sapiens
tgagaggctgaggt

SEQ ID NO: 4508133 - DNA, 14 bp, Homo sapiens
tgagagtcaaagct

SEQ ID NO: 4508134 - DNA, 15 bp, Homo sapiens
tgagagtgcactgct

SEQ ID NO: 4508135 - DNA, 23 bp, Homo sapiens
tgagagtttctggattagctttt

SEQ ID NO: 4508136 - DNA, 20 bp, Homo sapiens
tgagatacaaggcccagaag

SEQ ID NO: 4508137 - DNA, 21 bp, Homo sapiens
tgagatactttgcattgtctg

SEQ ID NO: 4508138 - DNA, 23 bp, Homo sapiens
tgagatcgtgctactgcactcca

SEQ ID NO: 4508139 - DNA, 19 bp, Homo sapiens
tgagatctgcacagtcaga

SEQ ID NO: 4508140 - DNA, 20 bp, Homo sapiens
tgagatctgctgtcctgttt

SEQ ID NO: 4508141 - DNA, 22 bp, Homo sapiens
tgagatctgctgtcctgtttct

SEQ ID NO: 4508142 - DNA, 14 bp, Homo sapiens
tgagatcttcctgc

SEQ ID NO: 4508143 - DNA, 15 bp, Homo sapiens
tgagatggccatgct

SEQ ID NO: 4508144 - DNA, 21 bp, Homo sapiens
tgagatggggtctcgctctgt

SEQ ID NO: 4508145 - DNA, 16 bp, Homo sapiens
tgagatgtagaaagtt

SEQ ID NO: 4508146 - DNA, 13 bp, Homo sapiens
tgagatgtgaaca

SEQ ID NO: 4508147 - DNA, 19 bp, Homo sapiens
tgagatgtgaacacatcag

SEQ ID NO: 4508148 - DNA, 17 bp, Homo sapiens
tgagatgtgtatcagtg

SEQ ID NO: 4508149 - DNA, 18 bp, Homo sapiens
tgagattcaatattgaat

SEQ ID NO: 4508150 - DNA, 15 bp, Homo sapiens
tgagattctcaaagg

SEQ ID NO: 4508151 - DNA, 22 bp, Homo sapiens
tgagattctcaaaggagcgagc

SEQ ID NO: 4508152 - DNA, 18 bp, Homo sapiens
tgagattgcaccactgca

SEQ ID NO: 4508153 - DNA, 18 bp, Homo sapiens
tgagattgccccaggtct

SEQ ID NO: 4508154 - DNA, 20 bp, Homo sapiens
tgagatttttgttttccact

SEQ ID NO: 4508155 - DNA, 19 bp, Homo sapiens
tgagattttttttccgtgt

SEQ ID NO: 4508156 - DNA, 14 bp, Homo sapiens
tgagcaaaggccct

SEQ ID NO: 4508157 - DNA, 16 bp, Homo sapiens
tgagcacatctctctg

SEQ ID NO: 4508158 - DNA, 18 bp, Homo sapiens
tgagcacatctctctgcc

SEQ ID NO: 4508159 - DNA, 14 bp, Homo sapiens
tgagcaccaccagg

SEQ ID NO: 4508160 - DNA, 17 bp, Homo sapiens
tgagcaccaccagggct

SEQ ID NO: 4508161 - DNA, 19 bp, Homo sapiens
tgagcaccaccagggctcc

SEQ ID NO: 4508162 - DNA, 23 bp, Homo sapiens
tgagcaccaccagggctccagga

SEQ ID NO: 4508163 - DNA, 13 bp, Homo sapiens
tgagcactcctgg

SEQ ID NO: 4508164 - DNA, 23 bp, Homo sapiens
tgagcactcctggtgcaggtctc

SEQ ID NO: 4508165 - DNA, 13 bp, Homo sapiens
tgagcactgtagg

SEQ ID NO: 4508166 - DNA, 18 bp, Homo sapiens
tgagcagagagcaaagga

SEQ ID NO: 4508167 - DNA, 15 bp, Homo sapiens
tgagcagccgccagc

SEQ ID NO: 4508168 - DNA, 19 bp, Homo sapiens
tgagcagccgccagctggg

SEQ ID NO: 4508169 - DNA, 14 bp, Homo sapiens
tgagcagcctctgg

SEQ ID NO: 4508170 - DNA, 21 bp, Homo sapiens
tgagcagcctctggacagcca

SEQ ID NO: 4508171 - DNA, 22 bp, Homo sapiens
tgagcagcctctggacagccag

SEQ ID NO: 4508172 - DNA, 18 bp, Homo sapiens
tgagcaggagcttgggtc

SEQ ID NO: 4508173 - DNA, 15 bp, Homo sapiens
tgagcagtcgcctgc

SEQ ID NO: 4508174 - DNA, 13 bp, Homo sapiens
tgagcatattttc

SEQ ID NO: 4508175 - DNA, 23 bp, Homo sapiens
tgagcatattttcttacttttat

SEQ ID NO: 4508176 - DNA, 17 bp, Homo sapiens
tgagcatcaatcttgtt

SEQ ID NO: 4508177 - DNA, 21 bp, Homo sapiens
tgagcatcaatcttgttactg

SEQ ID NO: 4508178 - DNA, 14 bp, Homo sapiens
tgagcatgcacact

SEQ ID NO: 4508179 - DNA, 19 bp, Homo sapiens
tgagcatgcacactgagaa

SEQ ID NO: 4508180 - DNA, 20 bp, Homo sapiens
tgagcatgcacactgagaat

SEQ ID NO: 4508181 - DNA, 14 bp, Homo sapiens
tgagcatggggcca

SEQ ID NO: 4508182 - DNA, 20 bp, Homo sapiens
tgagcattagaatggaggaa

SEQ ID NO: 4508183 - DNA, 11 bp, Homo sapiens
tgagcattcag

SEQ ID NO: 4508184 - DNA, 20 bp, Homo sapiens
tgagcattcaggcagcactg

SEQ ID NO: 4508185 - DNA, 19 bp, Homo sapiens
tgagccaaggaggcctggg

SEQ ID NO: 4508186 - DNA, 18 bp, Homo sapiens
tgagccacagatgggcaa

SEQ ID NO: 4508187 - DNA, 15 bp, Homo sapiens
tgagccaccgtgcct

SEQ ID NO: 4508188 - DNA, 19 bp, Homo sapiens
tgagccaccgtgcctggcc

SEQ ID NO: 4508189 - DNA, 14 bp, Homo sapiens
tgagccactgcgcc

SEQ ID NO: 4508190 - DNA, 16 bp, Homo sapiens
tgagccagattacagg

SEQ ID NO: 4508191 - DNA, 12 bp, Homo sapiens
tgagccagcagg

SEQ ID NO: 4508192 - DNA, 13 bp, Homo sapiens
tgagccagcaggg

SEQ ID NO: 4508193 - DNA, 20 bp, Homo sapiens
tgagccaggcttttctcagg

SEQ ID NO: 4508194 - DNA, 17 bp, Homo sapiens
tgagcccattcttctgg

SEQ ID NO: 4508195 - DNA, 20 bp, Homo sapiens
tgagcccccaccggaactgg

SEQ ID NO: 4508196 - DNA, 17 bp, Homo sapiens
tgagcccctccccagcc

SEQ ID NO: 4508197 - DNA, 22 bp, Homo sapiens
tgagcccctccccagccagccc

SEQ ID NO: 4508198 - DNA, 22 bp, Homo sapiens
tgagcccctttgcctgtcaagt

SEQ ID NO: 4508199 - DNA, 19 bp, Homo sapiens
tgagccctcctgagggccg

SEQ ID NO: 4508200 - DNA, 13 bp, Homo sapiens
tgagccctgctct

SEQ ID NO: 4508201 - DNA, 15 bp, Homo sapiens
tgagccctgctcttc

SEQ ID NO: 4508202 - DNA, 21 bp, Homo sapiens
tgagccctgctcttctctccc

SEQ ID NO: 4508203 - DNA, 12 bp, Homo sapiens
tgagccctggct

SEQ ID NO: 4508204 - DNA, 17 bp, Homo sapiens
tgagccgcccaaggcct

SEQ ID NO: 4508205 - DNA, 19 bp, Homo sapiens
tgagccgcccaaggccttc

SEQ ID NO: 4508206 - DNA, 16 bp, Homo sapiens
tgagccgggcccctgg

SEQ ID NO: 4508207 - DNA, 15 bp, Homo sapiens
tgagcctcctgtgcc

SEQ ID NO: 4508208 - DNA, 19 bp, Homo sapiens
tgagcctcctgtgcctggc

SEQ ID NO: 4508209 - DNA, 24 bp, Homo sapiens
tgagcctcctgtgcctggccccag

SEQ ID NO: 4508210 - DNA, 14 bp, Homo sapiens
tgagcctgagcaga

SEQ ID NO: 4508211 - DNA, 15 bp, Homo sapiens
tgagcgagctgggcc

SEQ ID NO: 4508212 - DNA, 17 bp, Homo sapiens
tgagcgtccagaaatgg

SEQ ID NO: 4508213 - DNA, 22 bp, Homo sapiens
tgagcgtgcgcactgcatggga

SEQ ID NO: 4508214 - DNA, 19 bp, Homo sapiens
tgagctactggattcttat

SEQ ID NO: 4508215 - DNA, 17 bp, Homo sapiens
tgagctatcctttcaaa

SEQ ID NO: 4508216 - DNA, 20 bp, Homo sapiens
tgacctcaggtgatccgcct

SEQ ID NO: 4508217 - DNA, 22 bp, Homo sapiens
tgacctccatactgggctaagg

SEQ ID NO: 4508218 - DNA, 14 bp, Homo sapiens
tgacctcctctggg

SEQ ID NO: 4508219 - DNA, 20 bp, Homo sapiens
tgacctcctctgggccctgt

SEQ ID NO: 4508220 - DNA, 17 bp, Homo sapiens
tgacctcggacagagcc

SEQ ID NO: 4508221 - DNA, 13 bp, Homo sapiens
tgacctcttgcct

SEQ ID NO: 4508222 - DNA, 14 bp, Homo sapiens
tgacctcttgcctc

SEQ ID NO: 4508223 - DNA, 16 bp, Homo sapiens
tgacctcttgcctcga

SEQ ID NO: 4508224 - DNA, 12 bp, Homo sapiens
tgacctgagggc

SEQ ID NO: 4508225 - DNA, 18 bp, Homo sapiens
tgacctgcattgtaaata

SEQ ID NO: 4508226 - DNA, 14 bp, Homo sapiens
tgacctgtcagaat

SEQ ID NO: 4508227 - DNA, 22 bp, Homo sapiens
tgacctgtgtttcacttaatgt

SEQ ID NO: 4508228 - DNA, 21 bp, Homo sapiens
tgaccttagcgttctggactc

SEQ ID NO: 4508229 - DNA, 17 bp, Homo sapiens
tgaccttccaaagacta

SEQ ID NO: 4508230 - DNA, 21 bp, Homo sapiens
tgaccttggaggaatgacaat

SEQ ID NO: 4508231 - DNA, 23 bp, Homo sapiens
tgacctttatttattaaacttca

SEQ ID NO: 4508232 - DNA, 20 bp, Homo sapiens
tgacgctcagccccaggcca

SEQ ID NO: 4508233 - DNA, 14 bp, Homo sapiens
tgacgggatgctct

SEQ ID NO: 4508234 - DNA, 21 bp, Homo sapiens
tgacgtattatctgttgcctt

SEQ ID NO: 4508235 - DNA, 18 bp, Homo sapiens
tgacgtggtaaaatgtga

SEQ ID NO: 4508236 - DNA, 20 bp, Homo sapiens
tgactaaactacattataaa

SEQ ID NO: 4508237 - DNA, 21 bp, Homo sapiens
tgactaaactttttttctgta

SEQ ID NO: 4508238 - DNA, 18 bp, Homo sapiens
tgactaaattcgtgattt

SEQ ID NO: 4508239 - DNA, 19 bp, Homo sapiens
tgactaaattcgtgatttt

SEQ ID NO: 4508240 - DNA, 21 bp, Homo sapiens
tgactaacaggccaaagagtc

SEQ ID NO: 4508241 - DNA, 15 bp, Homo sapiens
tgactaattttacat

SEQ ID NO: 4508242 - DNA, 18 bp, Homo sapiens
tgactaattttacatgtt

SEQ ID NO: 4508243 - DNA, 22 bp, Homo sapiens
tgactaattttacatgtttata

SEQ ID NO: 4508244 - DNA, 18 bp, Homo sapiens
tgactacagtcaggaaag

SEQ ID NO: 4508245 - DNA, 21 bp, Homo sapiens
tgactagaagggccagtcctg

SEQ ID NO: 4508246 - DNA, 17 bp, Homo sapiens
tgactatggagtcttgt

SEQ ID NO: 4508247 - DNA, 21 bp, Homo sapiens
tgactatggagtcttgtgaaa

SEQ ID NO: 4508248 - DNA, 18 bp, Homo sapiens
tgactatttgacccccac

SEQ ID NO: 4508249 - DNA, 18 bp, Homo sapiens
tgactcaattatttgcat

SEQ ID NO: 4508250 - DNA, 14 bp, Homo sapiens
tgactcacacctga

SEQ ID NO: 4508251 - DNA, 12 bp, Homo sapiens
tgactcacccaa

SEQ ID NO: 4508252 - DNA, 14 bp, Homo sapiens
tgactcacccaagc

SEQ ID NO: 4508253 - DNA, 19 bp, Homo sapiens
tgactcacttcaatgtgtc

SEQ ID NO: 4508254 - DNA, 13 bp, Homo sapiens
tgactcagggctc

SEQ ID NO: 4508255 - DNA, 17 bp, Homo sapiens
tgactcagggctcctgg

SEQ ID NO: 4508256 - DNA, 19 bp, Homo sapiens
tgactcagggctcctgggt

SEQ ID NO: 4508257 - DNA, 18 bp, Homo sapiens
tgactccagtataatctc

SEQ ID NO: 4508258 - DNA, 11 bp, Homo sapiens
tgactcctgga

SEQ ID NO: 4508259 - DNA, 12 bp, Homo sapiens
tgactcctggac

SEQ ID NO: 4508260 - DNA, 14 bp, Homo sapiens
tgactcctttccaa

SEQ ID NO: 4508261 - DNA, 20 bp, Homo sapiens
tgactcgacaaaggccacag

SEQ ID NO: 4508262 - DNA, 17 bp, Homo sapiens
tgactctagcaaggctc

SEQ ID NO: 4508263 - DNA, 11 bp, Homo sapiens
tgactctccag

SEQ ID NO: 4508264 - DNA, 13 bp, Homo sapiens
tgactctccaggg

SEQ ID NO: 4508265 - DNA, 15 bp, Homo sapiens
tgactctgccccctg

SEQ ID NO: 4508266 - DNA, 20 bp, Homo sapiens
tgactctggggtgcagcttc

SEQ ID NO: 4508267 - DNA, 15 bp, Homo sapiens
tgactcttactcctt

SEQ ID NO: 4508268 - DNA, 16 bp, Homo sapiens
tgactctttattgtct

SEQ ID NO: 4508269 - DNA, 14 bp, Homo sapiens
tgactctttccaac

SEQ ID NO: 4508270 - DNA, 16 bp, Homo sapiens
tgactctttccaaccg

SEQ ID NO: 4508271 - DNA, 21 bp, Homo sapiens
tgactgaaaaaaaaaaagaag

SEQ ID NO: 4508272 - DNA, 22 bp, Homo sapiens
tgactgaacgatccttcaaagt

SEQ ID NO: 4508273 - DNA, 16 bp, Homo sapiens
tgactgacaaagacat

SEQ ID NO: 4508274 - DNA, 15 bp, Homo sapiens
tgactgatgattttc

SEQ ID NO: 4508275 - DNA, 16 bp, Homo sapiens
tgactgccccaactcc

SEQ ID NO: 4508276 - DNA, 17 bp, Homo sapiens
tgactgccccaactcct

SEQ ID NO: 4508277 - DNA, 14 bp, Homo sapiens
tgactgccccctcc

SEQ ID NO: 4508278 - DNA, 19 bp, Homo sapiens
tgactggatggtccagtgt

SEQ ID NO: 4508279 - DNA, 19 bp, Homo sapiens
tgactggccacacaggatc

SEQ ID NO: 4508280 - DNA, 13 bp, Homo sapiens
tgactggctcctg

SEQ ID NO: 4508281 - DNA, 22 bp, Homo sapiens
tgactggctcctgacttaacgt

SEQ ID NO: 4508282 - DNA, 16 bp, Homo sapiens
tgactggttcagaaat

SEQ ID NO: 4508283 - DNA, 16 bp, Homo sapiens
tgactggtttctcctg

SEQ ID NO: 4508284 - DNA, 20 bp, Homo sapiens
tgactggtttctcctggtag

SEQ ID NO: 4508285 - DNA, 17 bp, Homo sapiens
tgactgtgattagatca

SEQ ID NO: 4508286 - DNA, 15 bp, Homo sapiens
tgactgttcttggta

SEQ ID NO: 4508287 - DNA, 12 bp, Homo sapiens
tgacttacaatt

SEQ ID NO: 4508288 - DNA, 23 bp, Homo sapiens
tgacttactttaattactggaat

SEQ ID NO: 4508289 - DNA, 14 bp, Homo sapiens
tgacttagcctcct

SEQ ID NO: 4508290 - DNA, 20 bp, Homo sapiens
tgacttagcgtcaagacatt

SEQ ID NO: 4508291 - DNA, 19 bp, Homo sapiens
tgacttaggtaaaataaaa

SEQ ID NO: 4508292 - DNA, 23 bp, Homo sapiens
tgacttaggtaaaataaaagact

SEQ ID NO: 4508293 - DNA, 13 bp, Homo sapiens
tgacttatagtac

SEQ ID NO: 4508294 - DNA, 14 bp, Homo sapiens
tgacttatagtaca

SEQ ID NO: 4508295 - DNA, 12 bp, Homo sapiens
tgacttcaggtg

SEQ ID NO: 4508296 - DNA, 19 bp, Homo sapiens
tgacttccttatttctgaa

SEQ ID NO: 4508297 - DNA, 15 bp, Homo sapiens
tgacttctaagtaaa

SEQ ID NO: 4508298 - DNA, 17 bp, Homo sapiens
tgacttctgctgctggc

SEQ ID NO: 4508299 - DNA, 18 bp, Homo sapiens
tgacttgagccactcctt

SEQ ID NO: 4508300 - DNA, 24 bp, Homo sapiens
tgacttgcaatccaggctgttctc

SEQ ID NO: 4508301 - DNA, 23 bp, Homo sapiens
tgacttggatcccaaagcaagga

SEQ ID NO: 4508302 - DNA, 12 bp, Homo sapiens
tgacttgggttt

SEQ ID NO: 4508303 - DNA, 23 bp, Homo sapiens
tgacttgtacaaacagtatttct

SEQ ID NO: 4508304 - DNA, 21 bp, Homo sapiens
tgactttagaaagctgacatt

SEQ ID NO: 4508305 - DNA, 16 bp, Homo sapiens
tgacttttaaaatttg

SEQ ID NO: 4508306 - DNA, 13 bp, Homo sapiens
tgacttttctgta

SEQ ID NO: 4508307 - DNA, 19 bp, Homo sapiens
tgacttttctgtaattcag

SEQ ID NO: 4508308 - DNA, 22 bp, Homo sapiens
tgacttttctgtaattcaggtt

SEQ ID NO: 4508309 - DNA, 13 bp, Homo sapiens
tgactttttataa

SEQ ID NO: 4508310 - DNA, 19 bp, Homo sapiens
tgactttttataaaatggc

SEQ ID NO: 4508311 - DNA, 17 bp, Homo sapiens
tgactttttgcatttaa

SEQ ID NO: 4508312 - DNA, 23 bp, Homo sapiens
tgactttttggaattcagcagtt

SEQ ID NO: 4508313 - DNA, 14 bp, Homo sapiens
tgactttttttgta

SEQ ID NO: 4508314 - DNA, 21 bp, Homo sapiens
tgagaaaaatttacatggcaa

SEQ ID NO: 4508315 - DNA, 11 bp, Homo sapiens
tgagaaactgc

SEQ ID NO: 4508316 - DNA, 19 bp, Homo sapiens
tgagaaaggacagagccag

SEQ ID NO: 4508317 - DNA, 14 bp, Homo sapiens
tgagaaatttaaac

SEQ ID NO: 4508318 - DNA, 14 bp, Homo sapiens
tgagaacaagctat

SEQ ID NO: 4508319 - DNA, 19 bp, Homo sapiens
tgagaacctaatgcactct

SEQ ID NO: 4508320 - DNA, 23 bp, Homo sapiens
tgagaactccatcagaaaaccaa

SEQ ID NO: 4508321 - DNA, 15 bp, Homo sapiens
tgagaactgaatttt

SEQ ID NO: 4508322 - DNA, 17 bp, Homo sapiens
tgagaagaagtggctgc

SEQ ID NO: 4508323 - DNA, 18 bp, Homo sapiens
tgagaagaagtggctgcc

SEQ ID NO: 4508324 - DNA, 17 bp, Homo sapiens
tgagaagagcttgcaca

SEQ ID NO: 4508325 - DNA, 22 bp, Homo sapiens
tgagaagagcttgcacagccaa

SEQ ID NO: 4508326 - DNA, 13 bp, Homo sapiens
tgagaaggcagcc

SEQ ID NO: 4508327 - DNA, 16 bp, Homo sapiens
tgagaatagaaacgta

SEQ ID NO: 4508328 - DNA, 13 bp, Homo sapiens
tgagaatatacct

SEQ ID NO: 4508329 - DNA, 16 bp, Homo sapiens
tgagaatataccttat

SEQ ID NO: 4508330 - DNA, 22 bp, Homo sapiens
tgagaatataccttatttattt

SEQ ID NO: 4508331 - DNA, 19 bp, Homo sapiens
tgagaatatagacagtgcc

SEQ ID NO: 4508332 - DNA, 20 bp, Homo sapiens
tgagaatatagacagtgccc

SEQ ID NO: 4508333 - DNA, 20 bp, Homo sapiens
tgagaatcactgctccaggc

SEQ ID NO: 4508334 - DNA, 13 bp, Homo sapiens
tgagaatcccaaa

SEQ ID NO: 4508335 - DNA, 12 bp, Homo sapiens
tgagaatctacc

SEQ ID NO: 4508336 - DNA, 21 bp, Homo sapiens
tgagaatctacccccagatcc

SEQ ID NO: 4508337 - DNA, 20 bp, Homo sapiens
tgagttgcatgtttttgaaa

SEQ ID NO: 4508338 - DNA, 16 bp, Homo sapiens
tgagttgggcagccag

SEQ ID NO: 4508339 - DNA, 12 bp, Homo sapiens
tgagtttaaaaa

SEQ ID NO: 4508340 - DNA, 16 bp, Homo sapiens
tgagtttgagctgcct

SEQ ID NO: 4508341 - DNA, 18 bp, Homo sapiens
tgagtttgagctgccttc

SEQ ID NO: 4508342 - DNA, 16 bp, Homo sapiens
tgagtttgtaggtaaa

SEQ ID NO: 4508343 - DNA, 21 bp, Homo sapiens
tgagtttgtaggtaaaatgta

SEQ ID NO: 4508344 - DNA, 17 bp, Homo sapiens
tgagttttgtgtttgtt

SEQ ID NO: 4508345 - DNA, 21 bp, Homo sapiens
tgagttttgtgtttgttgtag

SEQ ID NO: 4508346 - DNA, 17 bp, Homo sapiens
tgagttttgtttcactt

SEQ ID NO: 4508347 - DNA, 18 bp, Homo sapiens
tgagttttgtttcacttt

SEQ ID NO: 4508348 - DNA, 18 bp, Homo sapiens
tgagtttttatggggctg

SEQ ID NO: 4508349 - DNA, 20 bp, Homo sapiens
tgagtttttcctcccagtga

SEQ ID NO: 4508350 - DNA, 14 bp, Homo sapiens
tgagttttttcctt

SEQ ID NO: 4508351 - DNA, 15 bp, Homo sapiens
tgataaaaataaagc

SEQ ID NO: 4508352 - DNA, 15 bp, Homo sapiens
tgataaaaatgatat

SEQ ID NO: 4508353 - DNA, 16 bp, Homo sapiens
tgataaaaatgatatt

SEQ ID NO: 4508354 - DNA, 18 bp, Homo sapiens
tgataaaacaacagctcg

SEQ ID NO: 4508355 - DNA, 16 bp, Homo sapiens
tgataaaatgctttaa

SEQ ID NO: 4508356 - DNA, 18 bp, Homo sapiens
tgataaaccaaaaacatt

SEQ ID NO: 4508357 - DNA, 13 bp, Homo sapiens
tgataaagacttt

SEQ ID NO: 4508358 - DNA, 15 bp, Homo sapiens
tgataaatcagtcaa

SEQ ID NO: 4508359 - DNA, 22 bp, Homo sapiens
tgataactgtttatatgtgttg

SEQ ID NO: 4508360 - DNA, 17 bp, Homo sapiens
tgataagacattttgtt

SEQ ID NO: 4508361 - DNA, 17 bp, Homo sapiens
tgataagagaatcaaca

SEQ ID NO: 4508362 - DNA, 24 bp, Homo sapiens
tgataagcagtcatcctcagatca

SEQ ID NO: 4508363 - DNA, 19 bp, Homo sapiens
tgataagggaaaagataaa

SEQ ID NO: 4508364 - DNA, 20 bp, Homo sapiens
tgataagggaaaagataaag

SEQ ID NO: 4508365 - DNA, 21 bp, Homo sapiens
tgataagttgaggaaagaaat

SEQ ID NO: 4508366 - DNA, 18 bp, Homo sapiens
tgataataatattgtttt

SEQ ID NO: 4508367 - DNA, 21 bp, Homo sapiens
tgataatatattgtgttgact

SEQ ID NO: 4508368 - DNA, 15 bp, Homo sapiens
tgataatgaacagaa

SEQ ID NO: 4508369 - DNA, 14 bp, Homo sapiens
tgataatgttcatt

SEQ ID NO: 4508370 - DNA, 19 bp, Homo sapiens
tgataatgttcattttgaa

SEQ ID NO: 4508371 - DNA, 19 bp, Homo sapiens
tgataattatttacaaaat

SEQ ID NO: 4508372 - DNA, 14 bp, Homo sapiens
tgataattttaaat

SEQ ID NO: 4508373 - DNA, 17 bp, Homo sapiens
tgatacacagtaattgt

SEQ ID NO: 4508374 - DNA, 19 bp, Homo sapiens
tgatacacagtaattgtga

SEQ ID NO: 4508375 - DNA, 14 bp, Homo sapiens
tgatacagttttga

SEQ ID NO: 4508376 - DNA, 16 bp, Homo sapiens
tgatacccaacagttt

SEQ ID NO: 4508377 - DNA, 14 bp, Homo sapiens
tgatactgcttttc

SEQ ID NO: 4508378 - DNA, 11 bp, Homo sapiens
tgatactttag

SEQ ID NO: 4508379 - DNA, 12 bp, Homo sapiens
tgatactttagc

SEQ ID NO: 4508380 - DNA, 18 bp, Homo sapiens
tgatactttagccatcat

SEQ ID NO: 4508381 - DNA, 23 bp, Homo sapiens
tgatactttagtacaatttcaac

SEQ ID NO: 4508382 - DNA, 15 bp, Homo sapiens
tgatagcactggttt

SEQ ID NO: 4508383 - DNA, 14 bp, Homo sapiens
tgataggaaggaaa

SEQ ID NO: 4508384 - DNA, 23 bp, Homo sapiens
tgataggtaaatttttaggcaaa

SEQ ID NO: 4508385 - DNA, 16 bp, Homo sapiens
tgatagtcctttttcc

SEQ ID NO: 4508386 - DNA, 21 bp, Homo sapiens
tgatagtcctttttccaatgt

SEQ ID NO: 4508387 - DNA, 14 bp, Homo sapiens
tgatagttgaatgt

SEQ ID NO: 4508388 - DNA, 17 bp, Homo sapiens
tgatagttgaatgttgc

SEQ ID NO: 4508389 - DNA, 14 bp, Homo sapiens
tgatagttgtgtgt

SEQ ID NO: 4508390 - DNA, 13 bp, Homo sapiens
tgatatacacagt

SEQ ID NO: 4508391 - DNA, 15 bp, Homo sapiens
tgatataccaaatta

SEQ ID NO: 4508392 - DNA, 22 bp, Homo sapiens
tgatatatttgttgatattaag

SEQ ID NO: 4508393 - DNA, 14 bp, Homo sapiens
tgatatattttaca

SEQ ID NO: 4508394 - DNA, 10 bp, Homo sapiens
tgatatgcat

SEQ ID NO: 4508395 - DNA, 18 bp, Homo sapiens
tgatatgcatatttgttt

SEQ ID NO: 4508396 - DNA, 19 bp, Homo sapiens
tgatatgcatatttgttta

SEQ ID NO: 4508397 - DNA, 11 bp, Homo sapiens
tgatatgcatg

SEQ ID NO: 4508398 - DNA, 13 bp, Homo sapiens
tgatatgcatgta

SEQ ID NO: 4508399 - DNA, 16 bp, Homo sapiens
tgatattatattaaac

SEQ ID NO: 4508400 - DNA, 17 bp, Homo sapiens
tgatattgtttgctgtt

SEQ ID NO: 4508401 - DNA, 15 bp, Homo sapiens
tgatatttttataca

SEQ ID NO: 4508402 - DNA, 17 bp, Homo sapiens
tgatatttttatacaag

SEQ ID NO: 4508403 - DNA, 21 bp, Homo sapiens
tgatatttttatacaagtaat

SEQ ID NO: 4508404 - DNA, 19 bp, Homo sapiens
tgatattttttatcataaa

SEQ ID NO: 4508405 - DNA, 17 bp, Homo sapiens
tgatcaaaaataatgca

SEQ ID NO: 4508406 - DNA, 14 bp, Homo sapiens
tgatcaacatcttt

SEQ ID NO: 4508407 - DNA, 23 bp, Homo sapiens
tgatcaacatcttttcttgcctc

SEQ ID NO: 4508408 - DNA, 16 bp, Homo sapiens
tgatcaagatatatgt

SEQ ID NO: 4508409 - DNA, 13 bp, Homo sapiens
tgatcacacagtg

SEQ ID NO: 4508410 - DNA, 17 bp, Homo sapiens
tgatcacatctaaagct

SEQ ID NO: 4508411 - DNA, 21 bp, Homo sapiens
tgatcacatctaaagctttat

SEQ ID NO: 4508412 - DNA, 16 bp, Homo sapiens
tgatcacttatcagtt

SEQ ID NO: 4508413 - DNA, 16 bp, Homo sapiens
tgatcattttcccccc

SEQ ID NO: 4508414 - DNA, 17 bp, Homo sapiens
tgatcattttcccccca

SEQ ID NO: 4508415 - DNA, 18 bp, Homo sapiens
tgatcattttccccccac

SEQ ID NO: 4508416 - DNA, 21 bp, Homo sapiens
tgatcattttccccccactct

SEQ ID NO: 4508417 - DNA, 20 bp, Homo sapiens
tgatccaaagctggtcgagc

SEQ ID NO: 4508418 - DNA, 14 bp, Homo sapiens
tgatccaactaatg

SEQ ID NO: 4508419 - DNA, 17 bp, Homo sapiens
tgatccagaagagccca

SEQ ID NO: 4508420 - DNA, 17 bp, Homo sapiens
tgatccaggcaatcgtt

SEQ ID NO: 4508421 - DNA, 21 bp, Homo sapiens
tgatccaggcaatcgttctgc

SEQ ID NO: 4508422 - DNA, 23 bp, Homo sapiens
tgatcccaccccctcctccccca

SEQ ID NO: 4508423 - DNA, 16 bp, Homo sapiens
tgatcggaaagctctt

SEQ ID NO: 4508424 - DNA, 20 bp, Homo sapiens
tgatctacttctgtaattgt

SEQ ID NO: 4508425 - DNA, 15 bp, Homo sapiens
tgatctgtactttgt

SEQ ID NO: 4508426 - DNA, 15 bp, Homo sapiens
tgatctgtatttaat

SEQ ID NO: 4508427 - DNA, 17 bp, Homo sapiens
tgatctgtctgtggcaa

SEQ ID NO: 4508428 - DNA, 12 bp, Homo sapiens
tgatctgtgctt

SEQ ID NO: 4508429 - DNA, 20 bp, Homo sapiens
tgatctgtgctttccagctc

SEQ ID NO: 4508430 - DNA, 21 bp, Homo sapiens
tgatctgtgctttccagctca

SEQ ID NO: 4508431 - DNA, 22 bp, Homo sapiens
tgatctgtgctttccagctcac

SEQ ID NO: 4508432 - DNA, 13 bp, Homo sapiens
tgatctgttgcaa

SEQ ID NO: 4508433 - DNA, 21 bp, Homo sapiens
tgatcttaaaataattcatat

SEQ ID NO: 4508434 - DNA, 16 bp, Homo sapiens
tgatcttcactgtata

SEQ ID NO: 4508435 - DNA, 22 bp, Homo sapiens
tgatcttgagaaccttttcaaa

SEQ ID NO: 4508436 - DNA, 14 bp, Homo sapiens
tgatctttgagccc

SEQ ID NO: 4508437 - DNA, 21 bp, Homo sapiens
tgatctttgggcatcagaaaa

SEQ ID NO: 4508438 - DNA, 23 bp, Homo sapiens
tgatctttgggcatcagaaaaca

SEQ ID NO: 4508439 - DNA, 18 bp, Homo sapiens
tgatctttgtttaaatgc

SEQ ID NO: 4508440 - DNA, 21 bp, Homo sapiens
tgatctttgtttaaatgccaa

SEQ ID NO: 4508441 - DNA, 22 bp, Homo sapiens
tgatctttgtttaaatgccaaa

SEQ ID NO: 4508442 - DNA, 22 bp, Homo sapiens
tgatgaacatattcatgaaatg

SEQ ID NO: 4508443 - DNA, 22 bp, Homo sapiens
tgatgaatcagtcctagaatgt

SEQ ID NO: 4508444 - DNA, 17 bp, Homo sapiens
tgatgacgggatgctct

SEQ ID NO: 4508445 - DNA, 15 bp, Homo sapiens
tgatgagaggccagc

SEQ ID NO: 4508446 - DNA, 19 bp, Homo sapiens
tgatgaggtattttttcct

SEQ ID NO: 4508447 - DNA, 20 bp, Homo sapiens
tgatgagtaaactgaggccc

SEQ ID NO: 4508448 - DNA, 13 bp, Homo sapiens
tgatgatgatgaa

SEQ ID NO: 4508449 - DNA, 16 bp, Homo sapiens
tgatgatgatgatgaa

SEQ ID NO: 4508450 - DNA, 16 bp, Homo sapiens
tgatgatgatgatgat

SEQ ID NO: 4508451 - DNA, 14 bp, Homo sapiens
tgatgattttcctt

SEQ ID NO: 4508452 - DNA, 16 bp, Homo sapiens
tgatgcagataaaata

SEQ ID NO: 4508453 - DNA, 23 bp, Homo sapiens
tgatgcagcatttgataatgata

SEQ ID NO: 4508454 - DNA, 15 bp, Homo sapiens
tgatgcagtctcctc

SEQ ID NO: 4508455 - DNA, 15 bp, Homo sapiens
tgatgccagctgtct

SEQ ID NO: 4508456 - DNA, 14 bp, Homo sapiens
tgatgctccctccc

SEQ ID NO: 4508457 - DNA, 17 bp, Homo sapiens
tgatgctccctcccctg

SEQ ID NO: 4508458 - DNA, 21 bp, Homo sapiens
tgagctattaaaactcagcct

SEQ ID NO: 4508459 - DNA, 15 bp, Homo sapiens
tgagctattttcctc

SEQ ID NO: 4508460 - DNA, 19 bp, Homo sapiens
tgagctattttcctctggc

SEQ ID NO: 4508461 - DNA, 23 bp, Homo sapiens
tgagctattttcctctggccgca

SEQ ID NO: 4508462 - DNA, 16 bp, Homo sapiens
tgagctcagaccccca

SEQ ID NO: 4508463 - DNA, 18 bp, Homo sapiens
tgagctcagacccccact

SEQ ID NO: 4508464 - DNA, 20 bp, Homo sapiens
tgagctcagacccccactct

SEQ ID NO: 4508465 - DNA, 14 bp, Homo sapiens
tgagctcaggaggt

SEQ ID NO: 4508466 - DNA, 19 bp, Homo sapiens
tgagctccttaaggctctt

SEQ ID NO: 4508467 - DNA, 21 bp, Homo sapiens
tgagctccttaaggctctttt

SEQ ID NO: 4508468 - DNA, 15 bp, Homo sapiens
tgagctcggggacag

SEQ ID NO: 4508469 - DNA, 17 bp, Homo sapiens
tgagctctcaggccgag

SEQ ID NO: 4508470 - DNA, 18 bp, Homo sapiens
tgagctctcaggccgaga

SEQ ID NO: 4508471 - DNA, 21 bp, Homo sapiens
tgagctctcaggccgagagcc

SEQ ID NO: 4508472 - DNA, 22 bp, Homo sapiens
tgagctctcaggccgagagcct

SEQ ID NO: 4508473 - DNA, 22 bp, Homo sapiens
tgagctctgcatttgtctattc

SEQ ID NO: 4508474 - DNA, 23 bp, Homo sapiens
tgagctctgcatttgtctattct

SEQ ID NO: 4508475 - DNA, 21 bp, Homo sapiens
tgagctctggttatttttctc

SEQ ID NO: 4508476 - DNA, 15 bp, Homo sapiens
tgagctcttccctta

SEQ ID NO: 4508477 - DNA, 23 bp, Homo sapiens
tgagctcttcccttattcctaat

SEQ ID NO: 4508478 - DNA, 14 bp, Homo sapiens
tgagctgaggcagc

SEQ ID NO: 4508479 - DNA, 12 bp, Homo sapiens
tgagctgcagcc

SEQ ID NO: 4508480 - DNA, 12 bp, Homo sapiens
tgagctgccttc

SEQ ID NO: 4508481 - DNA, 19 bp, Homo sapiens
tgagctgctgactgccaat

SEQ ID NO: 4508482 - DNA, 20 bp, Homo sapiens
tgagctggggactcagggac

SEQ ID NO: 4508483 - DNA, 21 bp, Homo sapiens
tgagctgtgactgctttgctg

SEQ ID NO: 4508484 - DNA, 19 bp, Homo sapiens
tgagctgtgttcacagacc

SEQ ID NO: 4508485 - DNA, 21 bp, Homo sapiens
tgagcttcaatataagaagca

SEQ ID NO: 4508486 - DNA, 19 bp, Homo sapiens
tgaggaaactgagtcactc

SEQ ID NO: 4508487 - DNA, 19 bp, Homo sapiens
tgaggaagaacggggctct

SEQ ID NO: 4508488 - DNA, 17 bp, Homo sapiens
tgaggaagagggactgt

SEQ ID NO: 4508489 - DNA, 19 bp, Homo sapiens
tgaggaagtggctgtccct

SEQ ID NO: 4508490 - DNA, 23 bp, Homo sapiens
tgaggactctttccgactgccca

SEQ ID NO: 4508491 - DNA, 22 bp, Homo sapiens
tgaggagatgaccagggatgct

SEQ ID NO: 4508492 - DNA, 12 bp, Homo sapiens
tgaggagcctct

SEQ ID NO: 4508493 - DNA, 13 bp, Homo sapiens
tgaggagcctctg

SEQ ID NO: 4508494 - DNA, 13 bp, Homo sapiens
tgaggagctgctg

SEQ ID NO: 4508495 - DNA, 14 bp, Homo sapiens
tgaggagctgctgg

SEQ ID NO: 4508496 - DNA, 17 bp, Homo sapiens
tgaggaggagctggcct

SEQ ID NO: 4508497 - DNA, 17 bp, Homo sapiens
tgaggaggcctccatct

SEQ ID NO: 4508498 - DNA, 13 bp, Homo sapiens
tgaggaggggagg

SEQ ID NO: 4508499 - DNA, 16 bp, Homo sapiens
tgaggaggggagggta

SEQ ID NO: 4508500 - DNA, 21 bp, Homo sapiens
tgaggagtttcctaaaagttc

SEQ ID NO: 4508501 - DNA, 18 bp, Homo sapiens
tgaggatataatgtgtgc

SEQ ID NO: 4508502 - DNA, 12 bp, Homo sapiens
tgaggatctatt

SEQ ID NO: 4508503 - DNA, 22 bp, Homo sapiens
tgaggatctattactgaccgta

SEQ ID NO: 4508504 - DNA, 20 bp, Homo sapiens
tgaggcaataaaaatcatag

SEQ ID NO: 4508505 - DNA, 12 bp, Homo sapiens
tgaggcaataag

SEQ ID NO: 4508506 - DNA, 18 bp, Homo sapiens
tgaggcagaagaattgaa

SEQ ID NO: 4508507 - DNA, 14 bp, Homo sapiens
tgaggcaggagaat

SEQ ID NO: 4508508 - DNA, 19 bp, Homo sapiens
tgaggcatctttacatcta

SEQ ID NO: 4508509 - DNA, 15 bp, Homo sapiens
tgaggccagggcaga

SEQ ID NO: 4508510 - DNA, 16 bp, Homo sapiens
tgaggccagggcagag

SEQ ID NO: 4508511 - DNA, 14 bp, Homo sapiens
tgaggccatctcag

SEQ ID NO: 4508512 - DNA, 19 bp, Homo sapiens
tgaggccatctcaggagat

SEQ ID NO: 4508513 - DNA, 22 bp, Homo sapiens
tgaggcccccgcagagactgtg

SEQ ID NO: 4508514 - DNA, 14 bp, Homo sapiens
tgaggcccctgcct

SEQ ID NO: 4508515 - DNA, 15 bp, Homo sapiens
tgaggccggacagag

SEQ ID NO: 4508516 - DNA, 14 bp, Homo sapiens
tgaggcctccaagg

SEQ ID NO: 4508517 - DNA, 18 bp, Homo sapiens
tgaggcggaggctgtgct

SEQ ID NO: 4508518 - DNA, 19 bp, Homo sapiens
tgaggcggaggctgtgctc

SEQ ID NO: 4508519 - DNA, 17 bp, Homo sapiens
tgaggctgaataaagcc

SEQ ID NO: 4508520 - DNA, 23 bp, Homo sapiens
tgaggctttggatttgacattgc

SEQ ID NO: 4508521 - DNA, 21 bp, Homo sapiens
tgagggaagaacattattcat

SEQ ID NO: 4508522 - DNA, 14 bp, Homo sapiens
tgagggagacagga

SEQ ID NO: 4508523 - DNA, 11 bp, Homo sapiens
tgagggcagtc

SEQ ID NO: 4508524 - DNA, 22 bp, Homo sapiens
tgagggtgactatggagctgag

SEQ ID NO: 4508525 - DNA, 18 bp, Homo sapiens
tgagggtgtttcctctaa

SEQ ID NO: 4508526 - DNA, 17 bp, Homo sapiens
tgaggtactgagagtga

SEQ ID NO: 4508527 - DNA, 16 bp, Homo sapiens
tgaggtatcactgcag

SEQ ID NO: 4508528 - DNA, 16 bp, Homo sapiens
tgaggtcaacacaggt

SEQ ID NO: 4508529 - DNA, 19 bp, Homo sapiens
tgaggtcaacacaggtagc

SEQ ID NO: 4508530 - DNA, 17 bp, Homo sapiens
tgaggtctgtttaaagt

SEQ ID NO: 4508531 - DNA, 17 bp, Homo sapiens
tgaggtgaaagggagct

SEQ ID NO: 4508532 - DNA, 18 bp, Homo sapiens
tgaggtgaaagggagcta

SEQ ID NO: 4508533 - DNA, 18 bp, Homo sapiens
tgaggtgaacaaggtaaa

SEQ ID NO: 4508534 - DNA, 22 bp, Homo sapiens
tgaggtgggaggtggaagaagg

SEQ ID NO: 4508535 - DNA, 21 bp, Homo sapiens
tgaggtgggttttcttcccat

SEQ ID NO: 4508536 - DNA, 14 bp, Homo sapiens
tgaggttcctctgc

SEQ ID NO: 4508537 - DNA, 15 bp, Homo sapiens
tgaggttcctctgcc

SEQ ID NO: 4508538 - DNA, 16 bp, Homo sapiens
tgaggttcctctgcct

SEQ ID NO: 4508539 - DNA, 22 bp, Homo sapiens
tgagtaaaccctatctgtgatt

SEQ ID NO: 4508540 - DNA, 17 bp, Homo sapiens
tgagtaaactgaggccc

SEQ ID NO: 4508541 - DNA, 22 bp, Homo sapiens
tgagtaattcaagcctctaaac

SEQ ID NO: 4508542 - DNA, 17 bp, Homo sapiens
tgagtaattttggattt

SEQ ID NO: 4508543 - DNA, 19 bp, Homo sapiens
tgagtactctttctctccc

SEQ ID NO: 4508544 - DNA, 19 bp, Homo sapiens
tgagtagtggccactgggg

SEQ ID NO: 4508545 - DNA, 19 bp, Homo sapiens
tgagtataagataaaataa

SEQ ID NO: 4508546 - DNA, 13 bp, Homo sapiens
tgagtcaccagga

SEQ ID NO: 4508547 - DNA, 16 bp, Homo sapiens
tgagtcactgagcatc

SEQ ID NO: 4508548 - DNA, 17 bp, Homo sapiens
tgagtcagaatgtgaaa

SEQ ID NO: 4508549 - DNA, 23 bp, Homo sapiens
tgagtcatttgtttaaacaatct

SEQ ID NO: 4508550 - DNA, 15 bp, Homo sapiens
tgagtccagctcccc

SEQ ID NO: 4508551 - DNA, 17 bp, Homo sapiens
tgagtccattctcccag

SEQ ID NO: 4508552 - DNA, 19 bp, Homo sapiens
tgagtccattctcccaggt

SEQ ID NO: 4508553 - DNA, 16 bp, Homo sapiens
tgagtccctccatgca

SEQ ID NO: 4508554 - DNA, 16 bp, Homo sapiens
tgagtcctgtctctgc

SEQ ID NO: 4508555 - DNA, 18 bp, Homo sapiens
tgagtcctgtctctgcct

SEQ ID NO: 4508556 - DNA, 20 bp, Homo sapiens
tgagtctacctgagcattca

SEQ ID NO: 4508557 - DNA, 13 bp, Homo sapiens
tgagtctgtaatt

SEQ ID NO: 4508558 - DNA, 18 bp, Homo sapiens
tgagtcttaactgtattt

SEQ ID NO: 4508559 - DNA, 21 bp, Homo sapiens
tgagtgaaatactgtacaggg

SEQ ID NO: 4508560 - DNA, 12 bp, Homo sapiens
tgagtgccatgc

SEQ ID NO: 4508561 - DNA, 17 bp, Homo sapiens
tgagtgccatgcttttt

SEQ ID NO: 4508562 - DNA, 12 bp, Homo sapiens
tgagtgccttct

SEQ ID NO: 4508563 - DNA, 12 bp, Homo sapiens
tgagtgctctga

SEQ ID NO: 4508564 - DNA, 20 bp, Homo sapiens
tgagtgcttgttagagagaa

SEQ ID NO: 4508565 - DNA, 17 bp, Homo sapiens
tgagtggccagggaatc

SEQ ID NO: 4508566 - DNA, 22 bp, Homo sapiens
tgagtgtgggagtgcagagaaa

SEQ ID NO: 4508567 - DNA, 13 bp, Homo sapiens
tgagttaactgtg

SEQ ID NO: 4508568 - DNA, 16 bp, Homo sapiens
tgagttatcatgaatt

SEQ ID NO: 4508569 - DNA, 17 bp, Homo sapiens
tgagttccagttgaagt

SEQ ID NO: 4508570 - DNA, 19 bp, Homo sapiens
tgagttcccgggagctggg

SEQ ID NO: 4508571 - DNA, 16 bp, Homo sapiens
tgagttctgggtttct

SEQ ID NO: 4508572 - DNA, 15 bp, Homo sapiens
tgagttctgtgtatt

SEQ ID NO: 4508573 - DNA, 15 bp, Homo sapiens
tgagttcttcctgta

SEQ ID NO: 4508574 - DNA, 17 bp, Homo sapiens
tgagttcttcctgtaat

SEQ ID NO: 4508575 - DNA, 16 bp, Homo sapiens
tgagttcttgtttttt

SEQ ID NO: 4508576 - DNA, 16 bp, Homo sapiens
tgagttgattgagaag

SEQ ID NO: 4508577 - DNA, 15 bp, Homo sapiens
tgagttgcatgtttt

SEQ ID NO: 4508578 - DNA, 13 bp, Homo sapiens
tgcaaaattaaat

SEQ ID NO: 4508579 - DNA, 20 bp, Homo sapiens
tgcaaacatggagaaatcta

SEQ ID NO: 4508580 - DNA, 17 bp, Homo sapiens
tgcaaacctcatctttc

SEQ ID NO: 4508581 - DNA, 16 bp, Homo sapiens
tgcaaaccttcctggg

SEQ ID NO: 4508582 - DNA, 14 bp, Homo sapiens
tgcaaagagacatt

SEQ ID NO: 4508583 - DNA, 16 bp, Homo sapiens
tgcaaagagacatttc

SEQ ID NO: 4508584 - DNA, 21 bp, Homo sapiens
tgcaaagcaatcttttataca

SEQ ID NO: 4508585 - DNA, 23 bp, Homo sapiens
tgcaaagtacaatgtgtttttct

SEQ ID NO: 4508586 - DNA, 15 bp, Homo sapiens
tgcaaagtactgtaa

SEQ ID NO: 4508587 - DNA, 21 bp, Homo sapiens
tgcaaagtactgtaagaataa

SEQ ID NO: 4508588 - DNA, 16 bp, Homo sapiens
tgcaaagtattgtaaa

SEQ ID NO: 4508589 - DNA, 20 bp, Homo sapiens
tgcaaagtattgtaaattat

SEQ ID NO: 4508590 - DNA, 10 bp, Homo sapiens
tgcaaagtgt

SEQ ID NO: 4508591 - DNA, 19 bp, Homo sapiens
tgcaaagtgttttgtacca

SEQ ID NO: 4508592 - DNA, 18 bp, Homo sapiens
tgcaaatattagcaaaga

SEQ ID NO: 4508593 - DNA, 14 bp, Homo sapiens
tgcaaatctgatgg

SEQ ID NO: 4508594 - DNA, 13 bp, Homo sapiens
tgcaaattcagaa

SEQ ID NO: 4508595 - DNA, 15 bp, Homo sapiens
tgcaaattcagaact

SEQ ID NO: 4508596 - DNA, 14 bp, Homo sapiens
tgcaaattgtgaaa

SEQ ID NO: 4508597 - DNA, 14 bp, Homo sapiens
tgcaaatttagttt

SEQ ID NO: 4508598 - DNA, 17 bp, Homo sapiens
tgcaaatttagtttgtt

SEQ ID NO: 4508599 - DNA, 16 bp, Homo sapiens
tgcaacatttgacaaa

SEQ ID NO: 4508600 - DNA, 20 bp, Homo sapiens
tgcaacccaaggactgaggg

SEQ ID NO: 4508601 - DNA, 13 bp, Homo sapiens
tgcaacctcacta

SEQ ID NO: 4508602 - DNA, 19 bp, Homo sapiens
tgcaacctcgctggactct

SEQ ID NO: 4508603 - DNA, 14 bp, Homo sapiens
tgcaacctctgcct

SEQ ID NO: 4508604 - DNA, 21 bp, Homo sapiens
tgcaacctctgcctcccaggt

SEQ ID NO: 4508605 - DNA, 19 bp, Homo sapiens
tgcaactaactgactctgt

SEQ ID NO: 4508606 - DNA, 19 bp, Homo sapiens
tgcaactaattcaataaaa

SEQ ID NO: 4508607 - DNA, 21 bp, Homo sapiens
tgcaacttccgctgaggggtc

SEQ ID NO: 4508608 - DNA, 17 bp, Homo sapiens
tgcaactttttaaagta

SEQ ID NO: 4508609 - DNA, 20 bp, Homo sapiens
tgcaagaagaaatcatgata

SEQ ID NO: 4508610 - DNA, 15 bp, Homo sapiens
tgcaagaatgaaatg

SEQ ID NO: 4508611 - DNA, 16 bp, Homo sapiens
tgcaagaccacggagg

SEQ ID NO: 4508612 - DNA, 15 bp, Homo sapiens
tgcaagatgtgaatt

SEQ ID NO: 4508613 - DNA, 16 bp, Homo sapiens
tgcaagatgtgaatta

SEQ ID NO: 4508614 - DNA, 18 bp, Homo sapiens
tgcaagatgtgaattatt

SEQ ID NO: 4508615 - DNA, 23 bp, Homo sapiens
tgcaagattttttttttaagtga

SEQ ID NO: 4508616 - DNA, 12 bp, Homo sapiens
tgcaagcactcg

SEQ ID NO: 4508617 - DNA, 13 bp, Homo sapiens
tgcaaggaccagg

SEQ ID NO: 4508618 - DNA, 14 bp, Homo sapiens
tgcaaggaccagga

SEQ ID NO: 4508619 - DNA, 15 bp, Homo sapiens
tgcaaggaccaggac

SEQ ID NO: 4508620 - DNA, 23 bp, Homo sapiens
tgcaaggtggcctttgtgctgcg

SEQ ID NO: 4508621 - DNA, 14 bp, Homo sapiens
tgcaagtctgccga

SEQ ID NO: 4508622 - DNA, 15 bp, Homo sapiens
tgcaagtctgccgat

SEQ ID NO: 4508623 - DNA, 16 bp, Homo sapiens
tgcaagttgctctgac

SEQ ID NO: 4508624 - DNA, 17 bp, Homo sapiens
tgcaataaagttattca

SEQ ID NO: 4508625 - DNA, 14 bp, Homo sapiens
tgcaataactctgg

SEQ ID NO: 4508626 - DNA, 14 bp, Homo sapiens
tgcaataatgcagt

SEQ ID NO: 4508627 - DNA, 20 bp, Homo sapiens
tgcaataatgcagtatggta

SEQ ID NO: 4508628 - DNA, 13 bp, Homo sapiens
tgcaatagcagtt

SEQ ID NO: 4508629 - DNA, 14 bp, Homo sapiens
tgcaatatttgtaa

SEQ ID NO: 4508630 - DNA, 20 bp, Homo sapiens
tgcaatatttgtaaggcttg

SEQ ID NO: 4508631 - DNA, 21 bp, Homo sapiens
tgcaatccaatgcactgatgt

SEQ ID NO: 4508632 - DNA, 23 bp, Homo sapiens
tgcaatccaggctgttctcagcg

SEQ ID NO: 4508633 - DNA, 15 bp, Homo sapiens
tgcaatccatttatt

SEQ ID NO: 4508634 - DNA, 16 bp, Homo sapiens
tgcaatccatttattt

SEQ ID NO: 4508635 - DNA, 16 bp, Homo sapiens
tgcaatctaatctgaa

SEQ ID NO: 4508636 - DNA, 17 bp, Homo sapiens
tgcaatctactggaaat

SEQ ID NO: 4508637 - DNA, 17 bp, Homo sapiens
tgcaatgacataaccaa

SEQ ID NO: 4508638 - DNA, 15 bp, Homo sapiens
tgcaatgagccatga

SEQ ID NO: 4508639 - DNA, 12 bp, Homo sapiens
tgcaatgggtaa

SEQ ID NO: 4508640 - DNA, 19 bp, Homo sapiens
tgcaatgggtaagggaggg

SEQ ID NO: 4508641 - DNA, 20 bp, Homo sapiens
tgcaatgggtaagggaggga

SEQ ID NO: 4508642 - DNA, 20 bp, Homo sapiens
tgcaatgtccagcagtctga

SEQ ID NO: 4508643 - DNA, 18 bp, Homo sapiens
tgcaatgtgatctatgtt

SEQ ID NO: 4508644 - DNA, 17 bp, Homo sapiens
tgcaatgttcaatgcca

SEQ ID NO: 4508645 - DNA, 19 bp, Homo sapiens
tgcaattaaacttccaaag

SEQ ID NO: 4508646 - DNA, 17 bp, Homo sapiens
tgcaattccaagaaaat

SEQ ID NO: 4508647 - DNA, 18 bp, Homo sapiens
tgcaattccaagaaaata

SEQ ID NO: 4508648 - DNA, 19 bp, Homo sapiens
tgcaattccaagaaaatat

SEQ ID NO: 4508649 - DNA, 16 bp, Homo sapiens
tgcaatttctgtacat

SEQ ID NO: 4508650 - DNA, 13 bp, Homo sapiens
tgcaatttgaagt

SEQ ID NO: 4508651 - DNA, 19 bp, Homo sapiens
tgcaattttactgtgaaaa

SEQ ID NO: 4508652 - DNA, 16 bp, Homo sapiens
tgcacaagttccctgg

SEQ ID NO: 4508653 - DNA, 19 bp, Homo sapiens
tgcacaagttccctggaga

SEQ ID NO: 4508654 - DNA, 20 bp, Homo sapiens
tgcacaataaaaatgtttaa

SEQ ID NO: 4508655 - DNA, 21 bp, Homo sapiens
tgcacaataaaaatgtttaac

SEQ ID NO: 4508656 - DNA, 16 bp, Homo sapiens
tgcacaatatttcttt

SEQ ID NO: 4508657 - DNA, 14 bp, Homo sapiens
tgcacacacatgca

SEQ ID NO: 4508658 - DNA, 15 bp, Homo sapiens
tgcacacacatgcat

SEQ ID NO: 4508659 - DNA, 15 bp, Homo sapiens
tgcacaccagagaca

SEQ ID NO: 4508660 - DNA, 12 bp, Homo sapiens
tgcacaccctgg

SEQ ID NO: 4508661 - DNA, 20 bp, Homo sapiens
tgcacacctactagtcacca

SEQ ID NO: 4508662 - DNA, 13 bp, Homo sapiens
tgcacactgagaa

SEQ ID NO: 4508663 - DNA, 14 bp, Homo sapiens
tgcacactgagaat

SEQ ID NO: 4508664 - DNA, 19 bp, Homo sapiens
tgcacactttggcccaggg

SEQ ID NO: 4508665 - DNA, 16 bp, Homo sapiens
tgcacagatatacttt

SEQ ID NO: 4508666 - DNA, 19 bp, Homo sapiens
tgcacagatatactttgtg

SEQ ID NO: 4508667 - DNA, 18 bp, Homo sapiens
tgcacagcaggctgccag

SEQ ID NO: 4508668 - DNA, 22 bp, Homo sapiens
tgcacagccaacgagacacatt

SEQ ID NO: 4508669 - DNA, 20 bp, Homo sapiens
tgcacaggcacacagggccc

SEQ ID NO: 4508670 - DNA, 20 bp, Homo sapiens
tgcacagggcagctgggccc

SEQ ID NO: 4508671 - DNA, 18 bp, Homo sapiens
tgcacagtttagaacaga

SEQ ID NO: 4508672 - DNA, 20 bp, Homo sapiens
tgcacagtttagaacagagg

SEQ ID NO: 4508673 - DNA, 20 bp, Homo sapiens
tgcacatctacatgccatgc

SEQ ID NO: 4508674 - DNA, 22 bp, Homo sapiens
tgcacatctacatgccatgcct

SEQ ID NO: 4508675 - DNA, 18 bp, Homo sapiens
tgcacatctgtgtcttgt

SEQ ID NO: 4508676 - DNA, 13 bp, Homo sapiens
tgcacatctgttt

SEQ ID NO: 4508677 - DNA, 17 bp, Homo sapiens
tgcacatctgttttgta

SEQ ID NO: 4508678 - DNA, 14 bp, Homo sapiens
tgcacatgcctctg

SEQ ID NO: 4508679 - DNA, 18 bp, Homo sapiens
tgcacatgcctctgtaga

SEQ ID NO: 4508680 - DNA, 22 bp, Homo sapiens
tgcacatgctgtctggccctgg

SEQ ID NO: 4508681 - DNA, 22 bp, Homo sapiens
tgcacattgggtggggctcctg

SEQ ID NO: 4508682 - DNA, 18 bp, Homo sapiens
tgcaccaatcttgtttat

SEQ ID NO: 4508683 - DNA, 20 bp, Homo sapiens
tgcaccaatcttgtttatag

SEQ ID NO: 4508684 - DNA, 16 bp, Homo sapiens
tgcaccacacctggca

SEQ ID NO: 4508685 - DNA, 13 bp, Homo sapiens
tgcacccagaaca

SEQ ID NO: 4508686 - DNA, 15 bp, Homo sapiens
tgcacccagccctgg

SEQ ID NO: 4508687 - DNA, 15 bp, Homo sapiens
tgcacccatcagcac

SEQ ID NO: 4508688 - DNA, 18 bp, Homo sapiens
tgcaccccagcattccag

SEQ ID NO: 4508689 - DNA, 20 bp, Homo sapiens
tgcaccccagcattccagct

SEQ ID NO: 4508690 - DNA, 21 bp, Homo sapiens
tgcacccctgagccagcaggg

SEQ ID NO: 4508691 - DNA, 18 bp, Homo sapiens
tgcacccctgcccccagg

SEQ ID NO: 4508692 - DNA, 14 bp, Homo sapiens
tgcacccctgggcc

SEQ ID NO: 4508693 - DNA, 15 bp, Homo sapiens
tgcaccccttctctc

SEQ ID NO: 4508694 - DNA, 16 bp, Homo sapiens
tgcaccggggcctggg

SEQ ID NO: 4508695 - DNA, 15 bp, Homo sapiens
tgcacctaaagaaaa

SEQ ID NO: 4508696 - DNA, 16 bp, Homo sapiens
tgcacctaaagaaaaa

SEQ ID NO: 4508697 - DNA, 14 bp, Homo sapiens
tgcacctcccccca

SEQ ID NO: 4508698 - DNA, 17 bp, Homo sapiens
tgcacctccccccactg

SEQ ID NO: 4508699 - DNA, 18 bp, Homo sapiens
tgcacctcctaccctccc

SEQ ID NO: 4508700 - DNA, 19 bp, Homo sapiens
tgcacctcctaccctccca

SEQ ID NO: 4508701 - DNA, 21 bp, Homo sapiens
tgcacgcagattagcaggcca

SEQ ID NO: 4508702 - DNA, 21 bp, Homo sapiens
tgcacggtgggccttgctggg

SEQ ID NO: 4508703 - DNA, 23 bp, Homo sapiens
tgcacggtgggccttgctgggga

SEQ ID NO: 4508704 - DNA, 18 bp, Homo sapiens
tgcacgtggagagctggt

SEQ ID NO: 4508705 - DNA, 14 bp, Homo sapiens
tgcacgtgtctggg

SEQ ID NO: 4508706 - DNA, 13 bp, Homo sapiens
tgcactaaatatg

SEQ ID NO: 4508707 - DNA, 15 bp, Homo sapiens
tgcactactcctctg

SEQ ID NO: 4508708 - DNA, 23 bp, Homo sapiens
tgcactactcctctgcagtgcct

SEQ ID NO: 4508709 - DNA, 14 bp, Homo sapiens
tgcactatatacat

SEQ ID NO: 4508710 - DNA, 14 bp, Homo sapiens
tgcactcatcatat

SEQ ID NO: 4508711 - DNA, 15 bp, Homo sapiens
tgcactccagcctga

SEQ ID NO: 4508712 - DNA, 21 bp, Homo sapiens
tgcactcctttatctgtaatt

SEQ ID NO: 4508713 - DNA, 12 bp, Homo sapiens
tgcactctgtaa

SEQ ID NO: 4508714 - DNA, 20 bp, Homo sapiens
tgcactctgtaattgcactt

SEQ ID NO: 4508715 - DNA, 13 bp, Homo sapiens
tgcactgaacagg

SEQ ID NO: 4508716 - DNA, 20 bp, Homo sapiens
tgcactgaacaggttctctt

SEQ ID NO: 4508717 - DNA, 20 bp, Homo sapiens
tgcactgaagagctcttggc

SEQ ID NO: 4508718 - DNA, 21 bp, Homo sapiens
tgcactgaagagctcttggcc

SEQ ID NO: 4508719 - DNA, 13 bp, Homo sapiens
tgcactgatgttg

SEQ ID NO: 4508720 - DNA, 14 bp, Homo sapiens
tgcactgatgttgt

SEQ ID NO: 4508721 - DNA, 17 bp, Homo sapiens
tgcactggccttctgat

SEQ ID NO: 4508722 - DNA, 21 bp, Homo sapiens
tgcactggccttctgatgaaa

SEQ ID NO: 4508723 - DNA, 16 bp, Homo sapiens
tgcactgtaaatatcc

SEQ ID NO: 4508724 - DNA, 17 bp, Homo sapiens
tgcactgtaaatatccc

SEQ ID NO: 4508725 - DNA, 23 bp, Homo sapiens
tgcactgttccccctgtgcagcc

SEQ ID NO: 4508726 - DNA, 15 bp, Homo sapiens
tgcactgtttgcatg

SEQ ID NO: 4508727 - DNA, 19 bp, Homo sapiens
tgcactgtttgcatgcgcc

SEQ ID NO: 4508728 - DNA, 15 bp, Homo sapiens
tgcacttcaaattca

SEQ ID NO: 4508729 - DNA, 17 bp, Homo sapiens
tgcactttgatgtcatg

SEQ ID NO: 4508730 - DNA, 13 bp, Homo sapiens
tgcactttgtaaa

SEQ ID NO: 4508731 - DNA, 16 bp, Homo sapiens
tgcactttgtaaattc

SEQ ID NO: 4508732 - DNA, 12 bp, Homo sapiens
tgcactttgtag

SEQ ID NO: 4508733 - DNA, 15 bp, Homo sapiens
tgcactttgtagtgt

SEQ ID NO: 4508734 - DNA, 15 bp, Homo sapiens
tgcactttttaagtt

SEQ ID NO: 4508735 - DNA, 22 bp, Homo sapiens
tgcactttttccttactgtgca

SEQ ID NO: 4508736 - DNA, 21 bp, Homo sapiens
tgcacttttttgtttgaatgt

SEQ ID NO: 4508737 - DNA, 16 bp, Homo sapiens
tgcagaaaagcacctg

SEQ ID NO: 4508738 - DNA, 13 bp, Homo sapiens
tgcagaaagcatc

SEQ ID NO: 4508739 - DNA, 17 bp, Homo sapiens
tgcagaaatagacaaaa

SEQ ID NO: 4508740 - DNA, 19 bp, Homo sapiens
tgcagaaatagacaaaaag

SEQ ID NO: 4508741 - DNA, 16 bp, Homo sapiens
tgcagaaccagcacta

SEQ ID NO: 4508742 - DNA, 13 bp, Homo sapiens
tgcagaagtaagc

SEQ ID NO: 4508743 - DNA, 18 bp, Homo sapiens
tgcagacaacaccttcct

SEQ ID NO: 4508744 - DNA, 23 bp, Homo sapiens
tgcagacacctaaccccagggca

SEQ ID NO: 4508745 - DNA, 18 bp, Homo sapiens
tgcagacacctggactga

SEQ ID NO: 4508746 - DNA, 13 bp, Homo sapiens
tgcagaccccagg

SEQ ID NO: 4508747 - DNA, 23 bp, Homo sapiens
tgcagacctgtcctcctggtggg

SEQ ID NO: 4508748 - DNA, 20 bp, Homo sapiens
tgcagacggatgcccattcc

SEQ ID NO: 4508749 - DNA, 10 bp, Homo sapiens
tgcagagcct

SEQ ID NO: 4508750 - DNA, 15 bp, Homo sapiens
tgcagagccttctca

SEQ ID NO: 4508751 - DNA, 20 bp, Homo sapiens
tgcagagccttctcagaagc

SEQ ID NO: 4508752 - DNA, 13 bp, Homo sapiens
tgcagaggaagag

SEQ ID NO: 4508753 - DNA, 15 bp, Homo sapiens
tgcagaggggaaaga

SEQ ID NO: 4508754 - DNA, 16 bp, Homo sapiens
tgcagagttcagactt

SEQ ID NO: 4508755 - DNA, 17 bp, Homo sapiens
tgcagagttcagacttc

SEQ ID NO: 4508756 - DNA, 16 bp, Homo sapiens
tgcagataaacagtag

SEQ ID NO: 4508757 - DNA, 19 bp, Homo sapiens
tgcagataaacagtagtga

SEQ ID NO: 4508758 - DNA, 16 bp, Homo sapiens
tgcagatcatctgggg

SEQ ID NO: 4508759 - DNA, 16 bp, Homo sapiens
tgcagattacactgat

SEQ ID NO: 4508760 - DNA, 20 bp, Homo sapiens
tgcagattctgagcaaaggc

SEQ ID NO: 4508761 - DNA, 16 bp, Homo sapiens
tgcagcaactcccacg

SEQ ID NO: 4508762 - DNA, 14 bp, Homo sapiens
tgcagcaattactc

SEQ ID NO: 4508763 - DNA, 13 bp, Homo sapiens
tgcagcagtcgcc

SEQ ID NO: 4508764 - DNA, 23 bp, Homo sapiens
tgcagccagcccagcccagctgg

SEQ ID NO: 4508765 - DNA, 17 bp, Homo sapiens
tgcagccagggctgggg

SEQ ID NO: 4508766 - DNA, 20 bp, Homo sapiens
tgcagcggctgccctctggg

SEQ ID NO: 4508767 - DNA, 17 bp, Homo sapiens
tgcagctcaactttctg

SEQ ID NO: 4508768 - DNA, 16 bp, Homo sapiens
tgcagctcactaccct

SEQ ID NO: 4508769 - DNA, 16 bp, Homo sapiens
tgcagctgagcctgag

SEQ ID NO: 4508770 - DNA, 15 bp, Homo sapiens
tgcagctgctgtctg

SEQ ID NO: 4508771 - DNA, 16 bp, Homo sapiens
tgcagctgctgtctga

SEQ ID NO: 4508772 - DNA, 20 bp, Homo sapiens
tgcagctggaatgtgccaca

SEQ ID NO: 4508773 - DNA, 22 bp, Homo sapiens
tgcagctggaatgtgccacaga

SEQ ID NO: 4508774 - DNA, 23 bp, Homo sapiens
tgcagctggaatgtgccacagag

SEQ ID NO: 4508775 - DNA, 22 bp, Homo sapiens
tgcagctgtggcagagttacag

SEQ ID NO: 4508776 - DNA, 15 bp, Homo sapiens
tgcagcttcacccac

SEQ ID NO: 4508777 - DNA, 17 bp, Homo sapiens
tgcagcttcacccacca

SEQ ID NO: 4508778 - DNA, 24 bp, Homo sapiens
tgcagcttttggttaatatgtctt

SEQ ID NO: 4508779 - DNA, 19 bp, Homo sapiens
tgcaggaatcacccctctg

SEQ ID NO: 4508780 - DNA, 15 bp, Homo sapiens
tgcaggagagagcag

SEQ ID NO: 4508781 - DNA, 17 bp, Homo sapiens
tgcaggagagagcagca

SEQ ID NO: 4508782 - DNA, 19 bp, Homo sapiens
tgcaggagtgtcctgccca

SEQ ID NO: 4508783 - DNA, 21 bp, Homo sapiens
tgcaggcagagctggagcccc

SEQ ID NO: 4508784 - DNA, 14 bp, Homo sapiens
tgcaggcagcacag

SEQ ID NO: 4508785 - DNA, 10 bp, Homo sapiens
tgcaggcccc

SEQ ID NO: 4508786 - DNA, 19 bp, Homo sapiens
tgcaggccccgcttgtcca

SEQ ID NO: 4508787 - DNA, 14 bp, Homo sapiens
tgcaggcctgtccc

SEQ ID NO: 4508788 - DNA, 16 bp, Homo sapiens
tgcaggcctgtccctg

SEQ ID NO: 4508789 - DNA, 20 bp, Homo sapiens
tgcaggcctgtccctgggag

SEQ ID NO: 4508790 - DNA, 20 bp, Homo sapiens
tgcaggctgcagtggctccc

SEQ ID NO: 4508791 - DNA, 12 bp, Homo sapiens
tgcaggctgggg

SEQ ID NO: 4508792 - DNA, 13 bp, Homo sapiens
tgcaggctgggga

SEQ ID NO: 4508793 - DNA, 16 bp, Homo sapiens
tgcaggctggggaggt

SEQ ID NO: 4508794 - DNA, 23 bp, Homo sapiens
tgcaggctggggaggtgctgggg

SEQ ID NO: 4508795 - DNA, 20 bp, Homo sapiens
tgcagggagacatctgcacc

SEQ ID NO: 4508796 - DNA, 20 bp, Homo sapiens
tgcagggagccttctgccac

SEQ ID NO: 4508797 - DNA, 13 bp, Homo sapiens
tgcagggagggga

SEQ ID NO: 4508798 - DNA, 15 bp, Homo sapiens
tgcagggaggggagg

SEQ ID NO: 4508799 - DNA, 15 bp, Homo sapiens
tgcagggccactgga

SEQ ID NO: 4508800 - DNA, 14 bp, Homo sapiens
tgcagggctggtct

SEQ ID NO: 4508801 - DNA, 23 bp, Homo sapiens
tgcaggggtcagtgcagcagagg

SEQ ID NO: 4508802 - DNA, 19 bp, Homo sapiens
tgcagggtcctcttctggg

SEQ ID NO: 4508803 - DNA, 20 bp, Homo sapiens
tgcagggtgggtgagctctc

SEQ ID NO: 4508804 - DNA, 21 bp, Homo sapiens
tgcagggtgggtgagctctca

SEQ ID NO: 4508805 - DNA, 20 bp, Homo sapiens
tgcaggtctccacctgcaca

SEQ ID NO: 4508806 - DNA, 11 bp, Homo sapiens
tgcaggtgctg

SEQ ID NO: 4508807 - DNA, 13 bp, Homo sapiens
tgcaggtggcaga

SEQ ID NO: 4508808 - DNA, 14 bp, Homo sapiens
tgcaggttgcagag

SEQ ID NO: 4508809 - DNA, 17 bp, Homo sapiens
tgcaggtttgacacgca

SEQ ID NO: 4508810 - DNA, 19 bp, Homo sapiens
tgcagtacagaattggata

SEQ ID NO: 4508811 - DNA, 16 bp, Homo sapiens
tgcagtatggtacatt

SEQ ID NO: 4508812 - DNA, 19 bp, Homo sapiens
tgcagtcacatcacaatat

SEQ ID NO: 4508813 - DNA, 23 bp, Homo sapiens
tgcagtcatttggtgctctgcta

SEQ ID NO: 4508814 - DNA, 16 bp, Homo sapiens
tgcagtctcatttctc

SEQ ID NO: 4508815 - DNA, 17 bp, Homo sapiens
tgcagtctcctctttaa

SEQ ID NO: 4508816 - DNA, 18 bp, Homo sapiens
tgcagtggcgcattctag

SEQ ID NO: 4508817 - DNA, 18 bp, Homo sapiens
tgcagtggctcccctgcc

SEQ ID NO: 4508818 - DNA, 15 bp, Homo sapiens
tgcagtgttagtatt

SEQ ID NO: 4508819 - DNA, 21 bp, Homo sapiens
tgcagttctcacgaaagtatt

SEQ ID NO: 4508820 - DNA, 12 bp, Homo sapiens
tgcagtttatca

SEQ ID NO: 4508821 - DNA, 19 bp, Homo sapiens
tgcagtttatcattcaagt

SEQ ID NO: 4508822 - DNA, 17 bp, Homo sapiens
tgcagtttcatgtatgt

SEQ ID NO: 4508823 - DNA, 15 bp, Homo sapiens
tgcagtttcattcaa

SEQ ID NO: 4508824 - DNA, 18 bp, Homo sapiens
tgcagtttgaaattctga

SEQ ID NO: 4508825 - DNA, 22 bp, Homo sapiens
tgcagtttgaaattctgaattt

SEQ ID NO: 4508826 - DNA, 23 bp, Homo sapiens
tgcagtttgaaattctgaatttg

SEQ ID NO: 4508827 - DNA, 18 bp, Homo sapiens
tgcagtttttcattttaa

SEQ ID NO: 4508828 - DNA, 19 bp, Homo sapiens
tgcataacctttacactcc

SEQ ID NO: 4508829 - DNA, 17 bp, Homo sapiens
tgcataatagctacagt

SEQ ID NO: 4508830 - DNA, 21 bp, Homo sapiens
tgcataatgctttggaaaaat

SEQ ID NO: 4508831 - DNA, 18 bp, Homo sapiens
tgcataatgtttctggat

SEQ ID NO: 4508832 - DNA, 23 bp, Homo sapiens
tgcatactttttaaatgtaaaga

SEQ ID NO: 4508833 - DNA, 12 bp, Homo sapiens
tgcatagacaaa

SEQ ID NO: 4508834 - DNA, 20 bp, Homo sapiens
tgcatagattccctgagcag

SEQ ID NO: 4508835 - DNA, 16 bp, Homo sapiens
tgcatagcagtatatg

SEQ ID NO: 4508836 - DNA, 21 bp, Homo sapiens
tgcatagttgtagacaaagta

SEQ ID NO: 4508837 - DNA, 13 bp, Homo sapiens
tgcatatgttgaa

SEQ ID NO: 4508838 - DNA, 15 bp, Homo sapiens
tgcatattaaataat

SEQ ID NO: 4508839 - DNA, 14 bp, Homo sapiens
tgcatattcaatgt

SEQ ID NO: 4508840 - DNA, 18 bp, Homo sapiens
tgcatatttattgcattg

SEQ ID NO: 4508841 - DNA, 22 bp, Homo sapiens
tgcatatttattgcattgctgg

SEQ ID NO: 4508842 - DNA, 18 bp, Homo sapiens
tgcatatttgttacttta

SEQ ID NO: 4508843 - DNA, 19 bp, Homo sapiens
tgcatcacactcaaggaca

SEQ ID NO: 4508844 - DNA, 20 bp, Homo sapiens
tgcatcacactcaaggacag

SEQ ID NO: 4508845 - DNA, 22 bp, Homo sapiens
tgcatcacactcaaggacagga

SEQ ID NO: 4508846 - DNA, 19 bp, Homo sapiens
tgcatcagctgctgaaaca

SEQ ID NO: 4508847 - DNA, 20 bp, Homo sapiens
tgcatccagagattcatttt

SEQ ID NO: 4508848 - DNA, 21 bp, Homo sapiens
tgcatccagcagtacaataaa

SEQ ID NO: 4508849 - DNA, 21 bp, Homo sapiens
tgcatccattcctcagggaca

SEQ ID NO: 4508850 - DNA, 22 bp, Homo sapiens
tgcatcccaaaccacgcctctt

SEQ ID NO: 4508851 - DNA, 23 bp, Homo sapiens
tgcatcccaaaccacgcctcttg

SEQ ID NO: 4508852 - DNA, 19 bp, Homo sapiens
tgcatcccacgttctgtta

SEQ ID NO: 4508853 - DNA, 17 bp, Homo sapiens
tgcatccgcctgaaagt

SEQ ID NO: 4508854 - DNA, 19 bp, Homo sapiens
tgcatccgtagttccctga

SEQ ID NO: 4508855 - DNA, 14 bp, Homo sapiens
tgcatccttgtaat

SEQ ID NO: 4508856 - DNA, 19 bp, Homo sapiens
tgcatccttgtaatacctg

SEQ ID NO: 4508857 - DNA, 14 bp, Homo sapiens
tgcatcgctgttct

SEQ ID NO: 4508858 - DNA, 15 bp, Homo sapiens
tgcatcgggaaagaa

SEQ ID NO: 4508859 - DNA, 18 bp, Homo sapiens
tgcatcgggaaagaagaa

SEQ ID NO: 4508860 - DNA, 14 bp, Homo sapiens
tgcatctcagatgc

SEQ ID NO: 4508861 - DNA, 15 bp, Homo sapiens
tgcatctcagatgcc

SEQ ID NO: 4508862 - DNA, 13 bp, Homo sapiens
tgcatctctgtga

SEQ ID NO: 4508863 - DNA, 13 bp, Homo sapiens
tgcatctgcacat

SEQ ID NO: 4508864 - DNA, 17 bp, Homo sapiens
tgcatctggagagaaca

SEQ ID NO: 4508865 - DNA, 21 bp, Homo sapiens
tgcatctggagagaacaggtt

SEQ ID NO: 4508866 - DNA, 10 bp, Homo sapiens
tgcatgaaat

SEQ ID NO: 4508867 - DNA, 23 bp, Homo sapiens
tgcatgcaactaattcaataaaa

SEQ ID NO: 4508868 - DNA, 20 bp, Homo sapiens
tgcatggaagtaattaaggt

SEQ ID NO: 4508869 - DNA, 18 bp, Homo sapiens
tgcatggctcctgtctgg

SEQ ID NO: 4508870 - DNA, 23 bp, Homo sapiens
tgcatgggaaatagcggccctgg

SEQ ID NO: 4508871 - DNA, 16 bp, Homo sapiens
tgcatggtaatttata

SEQ ID NO: 4508872 - DNA, 17 bp, Homo sapiens
tgcatggtttagaaagc

SEQ ID NO: 4508873 - DNA, 17 bp, Homo sapiens
tgcatggtttggagctg

SEQ ID NO: 4508874 - DNA, 17 bp, Homo sapiens
tgcatgtagcatataaa

SEQ ID NO: 4508875 - DNA, 20 bp, Homo sapiens
tgcatgtagcatataaatgt

SEQ ID NO: 4508876 - DNA, 17 bp, Homo sapiens
tgcatgtagtaacacta

SEQ ID NO: 4508877 - DNA, 16 bp, Homo sapiens
tgcatgtcagagcact

SEQ ID NO: 4508878 - DNA, 16 bp, Homo sapiens
tgcatgtcctgtaaag

SEQ ID NO: 4508879 - DNA, 18 bp, Homo sapiens
tgcatgtgcatgcatacc

SEQ ID NO: 4508880 - DNA, 18 bp, Homo sapiens
tgcatgttccactaaccc

SEQ ID NO: 4508881 - DNA, 18 bp, Homo sapiens
tgcattaaaatttcttat

SEQ ID NO: 4508882 - DNA, 13 bp, Homo sapiens
tgcattaaattca

SEQ ID NO: 4508883 - DNA, 17 bp, Homo sapiens
tgcattaaattcacaaa

SEQ ID NO: 4508884 - DNA, 21 bp, Homo sapiens
tgcattaaattcacaaacttt

SEQ ID NO: 4508885 - DNA, 21 bp, Homo sapiens
tgcattatatttgtaaattta

SEQ ID NO: 4508886 - DNA, 15 bp, Homo sapiens
tgcattattaaattg

SEQ ID NO: 4508887 - DNA, 18 bp, Homo sapiens
tgcattattaaattgtaa

SEQ ID NO: 4508888 - DNA, 18 bp, Homo sapiens
tgcattcatttttatagc

SEQ ID NO: 4508889 - DNA, 18 bp, Homo sapiens
tgcattccagaacaaatt

SEQ ID NO: 4508890 - DNA, 23 bp, Homo sapiens
tgcattcctgtgccctagatgca

SEQ ID NO: 4508891 - DNA, 21 bp, Homo sapiens
tgcattcgttgtgttttttaa

SEQ ID NO: 4508892 - DNA, 15 bp, Homo sapiens
tgcattcttctctgt

SEQ ID NO: 4508893 - DNA, 22 bp, Homo sapiens
tgcattgccgctgtataaagca

SEQ ID NO: 4508894 - DNA, 20 bp, Homo sapiens
tgcattgctctggatctgtt

SEQ ID NO: 4508895 - DNA, 15 bp, Homo sapiens
tgcattgctggtaga

SEQ ID NO: 4508896 - DNA, 16 bp, Homo sapiens
tgcattggttttccat

SEQ ID NO: 4508897 - DNA, 12 bp, Homo sapiens
tgcattgtaaat

SEQ ID NO: 4508898 - DNA, 15 bp, Homo sapiens
tgcattgttgtaaag

SEQ ID NO: 4508899 - DNA, 15 bp, Homo sapiens
tgcatttaaaacaga

SEQ ID NO: 4508900 - DNA, 20 bp, Homo sapiens
tgcatttaaaacagacactg

SEQ ID NO: 4508901 - DNA, 22 bp, Homo sapiens
tgcatttaaatacagtcttcca

SEQ ID NO: 4508902 - DNA, 24 bp, Homo sapiens
tgcatttaaatacagtcttccatt

SEQ ID NO: 4508903 - DNA, 16 bp, Homo sapiens
tgcatttcaaatgtta

SEQ ID NO: 4508904 - DNA, 17 bp, Homo sapiens
tgcatttcatattattt

SEQ ID NO: 4508905 - DNA, 17 bp, Homo sapiens
tgcatttgagagaagcc

SEQ ID NO: 4508906 - DNA, 23 bp, Homo sapiens
tgcatttgagagaagccacgctg

SEQ ID NO: 4508907 - DNA, 16 bp, Homo sapiens
tgcatttgatacattt

SEQ ID NO: 4508908 - DNA, 14 bp, Homo sapiens
tgcatttgcctgct

SEQ ID NO: 4508909 - DNA, 23 bp, Homo sapiens
tgcatttggcaacccaaggaacc

SEQ ID NO: 4508910 - DNA, 16 bp, Homo sapiens
tgcatttgtctattct

SEQ ID NO: 4508911 - DNA, 19 bp, Homo sapiens
tgcatttgtctattctcca

SEQ ID NO: 4508912 - DNA, 14 bp, Homo sapiens
tgcattttaccatc

SEQ ID NO: 4508913 - DNA, 13 bp, Homo sapiens
tgcatttttaaaa

SEQ ID NO: 4508914 - DNA, 16 bp, Homo sapiens
tgcatttttaaaacta

SEQ ID NO: 4508915 - DNA, 14 bp, Homo sapiens
tgcatttttaaact

SEQ ID NO: 4508916 - DNA, 15 bp, Homo sapiens
tgcatttttaaactt

SEQ ID NO: 4508917 - DNA, 21 bp, Homo sapiens
tgcatttttaaacttgaaata

SEQ ID NO: 4508918 - DNA, 20 bp, Homo sapiens
tgcatttttatcatgtaaca

SEQ ID NO: 4508919 - DNA, 20 bp, Homo sapiens
tgcatttttgttttgaaagt

SEQ ID NO: 4508920 - DNA, 16 bp, Homo sapiens
tgccaaaaaaaaatac

SEQ ID NO: 4508921 - DNA, 20 bp, Homo sapiens
tgccaaaaaggatacataat

SEQ ID NO: 4508922 - DNA, 14 bp, Homo sapiens
tgccaaaatgcaac

SEQ ID NO: 4508923 - DNA, 17 bp, Homo sapiens
tgccaaaattcatttct

SEQ ID NO: 4508924 - DNA, 13 bp, Homo sapiens
tgccaaacagagt

SEQ ID NO: 4508925 - DNA, 23 bp, Homo sapiens
tgccaaacctcctgtcagtgagg

SEQ ID NO: 4508926 - DNA, 17 bp, Homo sapiens
tgccaaagaagcagacc

SEQ ID NO: 4508927 - DNA, 20 bp, Homo sapiens
tgccaaagctagggtggccc

SEQ ID NO: 4508928 - DNA, 21 bp, Homo sapiens
tgccaaagctagggtggccct

SEQ ID NO: 4508929 - DNA, 22 bp, Homo sapiens
tgccaaagctagggtggccctt

SEQ ID NO: 4508930 - DNA, 19 bp, Homo sapiens
tgccaaagtaaaacaatac

SEQ ID NO: 4508931 - DNA, 22 bp, Homo sapiens
tgccaaagtacagaatttgaat

SEQ ID NO: 4508932 - DNA, 20 bp, Homo sapiens
tgccaacacttaatcatttt

SEQ ID NO: 4508933 - DNA, 22 bp, Homo sapiens
tgccaacagttgtatgtttgct

SEQ ID NO: 4508934 - DNA, 16 bp, Homo sapiens
tgccaacctaaaactc

SEQ ID NO: 4508935 - DNA, 18 bp, Homo sapiens
tgccaacctaaaactctt

SEQ ID NO: 4508936 - DNA, 14 bp, Homo sapiens
tgccaactccatct

SEQ ID NO: 4508937 - DNA, 21 bp, Homo sapiens
tgccaacttaagtatttacag

SEQ ID NO: 4508938 - DNA, 17 bp, Homo sapiens
tgccaagagtgaaggga

SEQ ID NO: 4508939 - DNA, 21 bp, Homo sapiens
tgatgctttgagaacatactt

SEQ ID NO: 4508940 - DNA, 19 bp, Homo sapiens
tgatggaaaataccagtgt

SEQ ID NO: 4508941 - DNA, 24 bp, Homo sapiens
tgatggaaaataccagtgttgggt

SEQ ID NO: 4508942 - DNA, 16 bp, Homo sapiens
tgatggaaactgccaa

SEQ ID NO: 4508943 - DNA, 17 bp, Homo sapiens
tgatggaaactgccaaa

SEQ ID NO: 4508944 - DNA, 23 bp, Homo sapiens
tgatggagaggacagagcagggg

SEQ ID NO: 4508945 - DNA, 17 bp, Homo sapiens
tgatggagcaactgaaa

SEQ ID NO: 4508946 - DNA, 14 bp, Homo sapiens
tgatggagttcctt

SEQ ID NO: 4508947 - DNA, 22 bp, Homo sapiens
tgatggagtttctctagaagct

SEQ ID NO: 4508948 - DNA, 15 bp, Homo sapiens
tgatggattccaaac

SEQ ID NO: 4508949 - DNA, 18 bp, Homo sapiens
tgatggccggctggttgt

SEQ ID NO: 4508950 - DNA, 18 bp, Homo sapiens
tgatggcctttggaccca

SEQ ID NO: 4508951 - DNA, 13 bp, Homo sapiens
tgatgggaaaact

SEQ ID NO: 4508952 - DNA, 22 bp, Homo sapiens
tgatgggttcttagagccttag

SEQ ID NO: 4508953 - DNA, 18 bp, Homo sapiens
tgatgtaaaaatgcttcc

SEQ ID NO: 4508954 - DNA, 18 bp, Homo sapiens
tgatgtacagtctgtcat

SEQ ID NO: 4508955 - DNA, 24 bp, Homo sapiens
tgatgtacataactcctgtccctt

SEQ ID NO: 4508956 - DNA, 15 bp, Homo sapiens
tgatgtattttcata

SEQ ID NO: 4508957 - DNA, 11 bp, Homo sapiens
tgatgtcccag

SEQ ID NO: 4508958 - DNA, 14 bp, Homo sapiens
tgatgtctccaagt

SEQ ID NO: 4508959 - DNA, 22 bp, Homo sapiens
tgatgtctccaagtagtccacc

SEQ ID NO: 4508960 - DNA, 22 bp, Homo sapiens
tgatgtggaggaagagccacct

SEQ ID NO: 4508961 - DNA, 23 bp, Homo sapiens
tgatgtggaggaagagccacctg

SEQ ID NO: 4508962 - DNA, 13 bp, Homo sapiens
tgatgtggatgaa

SEQ ID NO: 4508963 - DNA, 16 bp, Homo sapiens
tgatgttaaatgtaat

SEQ ID NO: 4508964 - DNA, 17 bp, Homo sapiens
tgatgttccacctgcca

SEQ ID NO: 4508965 - DNA, 16 bp, Homo sapiens
tgatgttctttccatg

SEQ ID NO: 4508966 - DNA, 17 bp, Homo sapiens
tgatgttgagggaacag

SEQ ID NO: 4508967 - DNA, 13 bp, Homo sapiens
tgatgtttgtcct

SEQ ID NO: 4508968 - DNA, 11 bp, Homo sapiens
tgatgtttgtg

SEQ ID NO: 4508969 - DNA, 17 bp, Homo sapiens
tgatgtttgtggcctca

SEQ ID NO: 4508970 - DNA, 20 bp, Homo sapiens
tgatgtttgtggcctcagaa

SEQ ID NO: 4508971 - DNA, 15 bp, Homo sapiens
tgatgtttttaaagg

SEQ ID NO: 4508972 - DNA, 17 bp, Homo sapiens
tgatgttttttctgtaa

SEQ ID NO: 4508973 - DNA, 18 bp, Homo sapiens
tgatgttttttctgtaat

SEQ ID NO: 4508974 - DNA, 22 bp, Homo sapiens
tgatgttttttctgtaatgtaa

SEQ ID NO: 4508975 - DNA, 23 bp, Homo sapiens
tgatgttttttctgtaatgtaaa

SEQ ID NO: 4508976 - DNA, 20 bp, Homo sapiens
tgattaaagtgctcacgtta

SEQ ID NO: 4508977 - DNA, 12 bp, Homo sapiens
tgattaaattat

SEQ ID NO: 4508978 - DNA, 13 bp, Homo sapiens
tgattaataaaat

SEQ ID NO: 4508979 - DNA, 14 bp, Homo sapiens
tgattaccagggac

SEQ ID NO: 4508980 - DNA, 16 bp, Homo sapiens
tgattaccagggactg

SEQ ID NO: 4508981 - DNA, 16 bp, Homo sapiens
tgattaccagtctgat

SEQ ID NO: 4508982 - DNA, 15 bp, Homo sapiens
tgattacctgccaat

SEQ ID NO: 4508983 - DNA, 15 bp, Homo sapiens
tgattactctttgct

SEQ ID NO: 4508984 - DNA, 21 bp, Homo sapiens
tgattactctttgctttgtag

SEQ ID NO: 4508985 - DNA, 20 bp, Homo sapiens
tgattactggcctttttcat

SEQ ID NO: 4508986 - DNA, 15 bp, Homo sapiens
tgattagataaagat

SEQ ID NO: 4508987 - DNA, 19 bp, Homo sapiens
tgattataccatgtgtgct

SEQ ID NO: 4508988 - DNA, 20 bp, Homo sapiens
tgattattaacgatgtccaa

SEQ ID NO: 4508989 - DNA, 14 bp, Homo sapiens
tgattattcagtgt

SEQ ID NO: 4508990 - DNA, 13 bp, Homo sapiens
tgattatttatga

SEQ ID NO: 4508991 - DNA, 16 bp, Homo sapiens
tgattatttatgacct

SEQ ID NO: 4508992 - DNA, 12 bp, Homo sapiens
tgattattttag

SEQ ID NO: 4508993 - DNA, 21 bp, Homo sapiens
tgattatttttcttttaaaga

SEQ ID NO: 4508994 - DNA, 23 bp, Homo sapiens
tgattcaaaatatttaaaaatgt

SEQ ID NO: 4508995 - DNA, 14 bp, Homo sapiens
tgattcaaatgttt

SEQ ID NO: 4508996 - DNA, 16 bp, Homo sapiens
tgattcaaatgtttta

SEQ ID NO: 4508997 - DNA, 12 bp, Homo sapiens
tgattcaagcca

SEQ ID NO: 4508998 - DNA, 20 bp, Homo sapiens
tgattcaaggctcagaagga

SEQ ID NO: 4508999 - DNA, 21 bp, Homo sapiens
tgattcaaggctcagaaggaa

SEQ ID NO: 4509000 - DNA, 21 bp, Homo sapiens
tgattcaatctgtaaactgtg

SEQ ID NO: 4509001 - DNA, 22 bp, Homo sapiens
tgattcagaaaatgttctgttt

SEQ ID NO: 4509002 - DNA, 24 bp, Homo sapiens
tgattcagtgttaaatgtgatgaa

SEQ ID NO: 4509003 - DNA, 16 bp, Homo sapiens
tgattcatagtaactt

SEQ ID NO: 4509004 - DNA, 13 bp, Homo sapiens
tgattcccaactc

SEQ ID NO: 4509005 - DNA, 15 bp, Homo sapiens
tgattcccaactcct

SEQ ID NO: 4509006 - DNA, 24 bp, Homo sapiens
tgattcctggacatcaccagtcct

SEQ ID NO: 4509007 - DNA, 21 bp, Homo sapiens
tgattctatttatatgtacat

SEQ ID NO: 4509008 - DNA, 14 bp, Homo sapiens
tgattctccttcag

SEQ ID NO: 4509009 - DNA, 16 bp, Homo sapiens
tgattctgcagtaaat

SEQ ID NO: 4509010 - DNA, 14 bp, Homo sapiens
tgattctgtttcct

SEQ ID NO: 4509011 - DNA, 18 bp, Homo sapiens
tgattcttgtaaatcttt

SEQ ID NO: 4509012 - DNA, 20 bp, Homo sapiens
tgattcttgtaaatcttttt

SEQ ID NO: 4509013 - DNA, 21 bp, Homo sapiens
tgattcttgtaaatctttttg

SEQ ID NO: 4509014 - DNA, 17 bp, Homo sapiens
tgattgaatttttaagc

SEQ ID NO: 4509015 - DNA, 14 bp, Homo sapiens
tgattgatttgaag

SEQ ID NO: 4509016 - DNA, 17 bp, Homo sapiens
tgattggttcagttttt

SEQ ID NO: 4509017 - DNA, 20 bp, Homo sapiens
tgattgtgaggcttctaata

SEQ ID NO: 4509018 - DNA, 21 bp, Homo sapiens
tgatttaaagactacaataaa

SEQ ID NO: 4509019 - DNA, 22 bp, Homo sapiens
tgatttaaagactacaataaaa

SEQ ID NO: 4509020 - DNA, 13 bp, Homo sapiens
tgatttaacactt

SEQ ID NO: 4509021 - DNA, 20 bp, Homo sapiens
tgatttagattgagtaagat

SEQ ID NO: 4509022 - DNA, 16 bp, Homo sapiens
tgatttatctttcaag

SEQ ID NO: 4509023 - DNA, 11 bp, Homo sapiens
tgatttcagaa

SEQ ID NO: 4509024 - DNA, 19 bp, Homo sapiens
tgatttcagtaagtctcat

SEQ ID NO: 4509025 - DNA, 13 bp, Homo sapiens
tgatttcattcaa

SEQ ID NO: 4509026 - DNA, 18 bp, Homo sapiens
tgatttccaaagagaaaa

SEQ ID NO: 4509027 - DNA, 20 bp, Homo sapiens
tgatttcccactgcactcca

SEQ ID NO: 4509028 - DNA, 16 bp, Homo sapiens
tgatttcccccctccg

SEQ ID NO: 4509029 - DNA, 16 bp, Homo sapiens
tgatttccttgaatgt

SEQ ID NO: 4509030 - DNA, 16 bp, Homo sapiens
tgatttctatggcttt

SEQ ID NO: 4509031 - DNA, 18 bp, Homo sapiens
tgatttctatggctttca

SEQ ID NO: 4509032 - DNA, 22 bp, Homo sapiens
tgatttctatggctttcaaagc

SEQ ID NO: 4509033 - DNA, 18 bp, Homo sapiens
tgatttctttaaaagaat

SEQ ID NO: 4509034 - DNA, 20 bp, Homo sapiens
tgatttctttaaaagaatga

SEQ ID NO: 4509035 - DNA, 21 bp, Homo sapiens
tgatttctttaaaagaatgac

SEQ ID NO: 4509036 - DNA, 14 bp, Homo sapiens
tgatttgagttgat

SEQ ID NO: 4509037 - DNA, 15 bp, Homo sapiens
tgatttgatctttgt

SEQ ID NO: 4509038 - DNA, 18 bp, Homo sapiens
tgatttgatctttgttta

SEQ ID NO: 4509039 - DNA, 14 bp, Homo sapiens
tgatttgcattgaa

SEQ ID NO: 4509040 - DNA, 18 bp, Homo sapiens
tgatttgcattgaacaca

SEQ ID NO: 4509041 - DNA, 20 bp, Homo sapiens
tgatttgggctgaatgtatg

SEQ ID NO: 4509042 - DNA, 21 bp, Homo sapiens
tgatttgggctgaatgtatgt

SEQ ID NO: 4509043 - DNA, 15 bp, Homo sapiens
tgattttaagacaag

SEQ ID NO: 4509044 - DNA, 12 bp, Homo sapiens
tgattttaagag

SEQ ID NO: 4509045 - DNA, 17 bp, Homo sapiens
tgattttcaagcagcat

SEQ ID NO: 4509046 - DNA, 18 bp, Homo sapiens
tgattttgccccctgagg

SEQ ID NO: 4509047 - DNA, 13 bp, Homo sapiens
tgattttggcatg

SEQ ID NO: 4509048 - DNA, 15 bp, Homo sapiens
tgatttttaagattt

SEQ ID NO: 4509049 - DNA, 14 bp, Homo sapiens
tgattttttgaaag

SEQ ID NO: 4509050 - DNA, 18 bp, Homo sapiens
tgattttttgaaagttaa

SEQ ID NO: 4509051 - DNA, 16 bp, Homo sapiens
tgattttttttccttt

SEQ ID NO: 4509052 - DNA, 22 bp, Homo sapiens
tgatttttttttcatacactta

SEQ ID NO: 4509053 - DNA, 21 bp, Homo sapiens
tgatttttttttttttttcct

SEQ ID NO: 4509054 - DNA, 21 bp, Homo sapiens
tgcaaaaactctttgagaggg

SEQ ID NO: 4509055 - DNA, 16 bp, Homo sapiens
tgcaaaaactgtaaaa

SEQ ID NO: 4509056 - DNA, 17 bp, Homo sapiens
tgcaaaaataatcatga

SEQ ID NO: 4509057 - DNA, 21 bp, Homo sapiens
tgcaaaacccatatccccggt

SEQ ID NO: 4509058 - DNA, 19 bp, Homo sapiens
tgcaaaactccaggcagga

SEQ ID NO: 4509059 - DNA, 22 bp, Homo sapiens
tgcccacagaaagccaggagca

SEQ ID NO: 4509060 - DNA, 20 bp, Homo sapiens
tgcccaccacaactaacaat

SEQ ID NO: 4509061 - DNA, 15 bp, Homo sapiens
tgcccaccccctgcc

SEQ ID NO: 4509062 - DNA, 20 bp, Homo sapiens
tgcccaccccctgccctgca

SEQ ID NO: 4509063 - DNA, 17 bp, Homo sapiens
tgcccacctgcccatca

SEQ ID NO: 4509064 - DNA, 20 bp, Homo sapiens
tgcccactggccgctgagcg

SEQ ID NO: 4509065 - DNA, 17 bp, Homo sapiens
tgcccagaataagttat

SEQ ID NO: 4509066 - DNA, 17 bp, Homo sapiens
tgcccagaatttaccat

SEQ ID NO: 4509067 - DNA, 17 bp, Homo sapiens
tgcccagactacagggc

SEQ ID NO: 4509068 - DNA, 19 bp, Homo sapiens
tgcccagcaacatggagga

SEQ ID NO: 4509069 - DNA, 19 bp, Homo sapiens
tgcccagccctaaacatca

SEQ ID NO: 4509070 - DNA, 12 bp, Homo sapiens
tgcccagccctg

SEQ ID NO: 4509071 - DNA, 13 bp, Homo sapiens
tgcccagccctgg

SEQ ID NO: 4509072 - DNA, 17 bp, Homo sapiens
tgcccagccctggccca

SEQ ID NO: 4509073 - DNA, 18 bp, Homo sapiens
tgcccagccctggcccag

SEQ ID NO: 4509074 - DNA, 19 bp, Homo sapiens
tgcccagccctggcccagg

SEQ ID NO: 4509075 - DNA, 21 bp, Homo sapiens
tgcccagccctggcccaggtg

SEQ ID NO: 4509076 - DNA, 13 bp, Homo sapiens
tgcccagcctgct

SEQ ID NO: 4509077 - DNA, 18 bp, Homo sapiens
tgcccagcctggaaacct

SEQ ID NO: 4509078 - DNA, 16 bp, Homo sapiens
tgcccagcctggatgc

SEQ ID NO: 4509079 - DNA, 18 bp, Homo sapiens
tgcccagcctggatgcca

SEQ ID NO: 4509080 - DNA, 19 bp, Homo sapiens
tgcccaggagacagaccac

SEQ ID NO: 4509081 - DNA, 16 bp, Homo sapiens
tgcccaggagagccag

SEQ ID NO: 4509082 - DNA, 17 bp, Homo sapiens
tgcccaggagagccagc

SEQ ID NO: 4509083 - DNA, 20 bp, Homo sapiens
tgcccaggagagccagccct

SEQ ID NO: 4509084 - DNA, 21 bp, Homo sapiens
tgcccaggagagccagccctc

SEQ ID NO: 4509085 - DNA, 22 bp, Homo sapiens
tgcccaggagagccagccctcc

SEQ ID NO: 4509086 - DNA, 23 bp, Homo sapiens
tgcccaggagagccagccctccc

SEQ ID NO: 4509087 - DNA, 14 bp, Homo sapiens
tgcccaggccacag

SEQ ID NO: 4509088 - DNA, 16 bp, Homo sapiens
tgcccaggccacagag

SEQ ID NO: 4509089 - DNA, 18 bp, Homo sapiens
tgcccaggcctatctgga

SEQ ID NO: 4509090 - DNA, 18 bp, Homo sapiens
tgcccaggctggagtgca

SEQ ID NO: 4509091 - DNA, 15 bp, Homo sapiens
tgcccagtacattta

SEQ ID NO: 4509092 - DNA, 16 bp, Homo sapiens
tgcccagtgagccctg

SEQ ID NO: 4509093 - DNA, 21 bp, Homo sapiens
tgcccagtgagccctgctctt

SEQ ID NO: 4509094 - DNA, 20 bp, Homo sapiens
tgcccatcacagggttgggc

SEQ ID NO: 4509095 - DNA, 23 bp, Homo sapiens
tgcccatcacagggttgggccca

SEQ ID NO: 4509096 - DNA, 20 bp, Homo sapiens
tgcccatcctgccatcctca

SEQ ID NO: 4509097 - DNA, 18 bp, Homo sapiens
tgcccatgagcaagccta

SEQ ID NO: 4509098 - DNA, 13 bp, Homo sapiens
tgcccattcctgc

SEQ ID NO: 4509099 - DNA, 17 bp, Homo sapiens
tgcccattcctgcctgg

SEQ ID NO: 4509100 - DNA, 18 bp, Homo sapiens
tgcccattcctgcctggt

SEQ ID NO: 4509101 - DNA, 20 bp, Homo sapiens
tgcccattcctgcctggtcc

SEQ ID NO: 4509102 - DNA, 15 bp, Homo sapiens
tgccccaactcctgg

SEQ ID NO: 4509103 - DNA, 20 bp, Homo sapiens
tgccccacatgcatgtctgc

SEQ ID NO: 4509104 - DNA, 19 bp, Homo sapiens
tgccccacccaactccaca

SEQ ID NO: 4509105 - DNA, 21 bp, Homo sapiens
tgccccacccaactccacagg

SEQ ID NO: 4509106 - DNA, 13 bp, Homo sapiens
tgccccaccccat

SEQ ID NO: 4509107 - DNA, 15 bp, Homo sapiens
tgccccacgcacgca

SEQ ID NO: 4509108 - DNA, 13 bp, Homo sapiens
tgccccagagctg

SEQ ID NO: 4509109 - DNA, 15 bp, Homo sapiens
tgccccagagctgtt

SEQ ID NO: 4509110 - DNA, 17 bp, Homo sapiens
tgccccagagctgttta

SEQ ID NO: 4509111 - DNA, 17 bp, Homo sapiens
tgccccagggagtccag

SEQ ID NO: 4509112 - DNA, 19 bp, Homo sapiens
tgccccaggtacacctccc

SEQ ID NO: 4509113 - DNA, 22 bp, Homo sapiens
tgccccagtcggccccatctct

SEQ ID NO: 4509114 - DNA, 21 bp, Homo sapiens
tgccccatcagtgctccctca

SEQ ID NO: 4509115 - DNA, 20 bp, Homo sapiens
tgccccatccagacctggct

SEQ ID NO: 4509116 - DNA, 12 bp, Homo sapiens
tgccccatgcct

SEQ ID NO: 4509117 - DNA, 15 bp, Homo sapiens
tgccccatgcctgtc

SEQ ID NO: 4509118 - DNA, 23 bp, Homo sapiens
tgccccatgcctgtccagcctgg

SEQ ID NO: 4509119 - DNA, 20 bp, Homo sapiens
tgccccattccttgcgcctc

SEQ ID NO: 4509120 - DNA, 22 bp, Homo sapiens
tgccccattgagatcttcctgc

SEQ ID NO: 4509121 - DNA, 23 bp, Homo sapiens
tgcccccaccccttcctgtctca

SEQ ID NO: 4509122 - DNA, 14 bp, Homo sapiens
tgcccccagccccg

SEQ ID NO: 4509123 - DNA, 12 bp, Homo sapiens
tgcccccaggac

SEQ ID NO: 4509124 - DNA, 14 bp, Homo sapiens
tgcccccaggactg

SEQ ID NO: 4509125 - DNA, 15 bp, Homo sapiens
tgcccccaggactgg

SEQ ID NO: 4509126 - DNA, 23 bp, Homo sapiens
tgccccccatgaggaaggaacag

SEQ ID NO: 4509127 - DNA, 18 bp, Homo sapiens
tgccccccgaggctgcta

SEQ ID NO: 4509128 - DNA, 15 bp, Homo sapiens
tgccccccgccctca

SEQ ID NO: 4509129 - DNA, 13 bp, Homo sapiens
tgcccccctcctc

SEQ ID NO: 4509130 - DNA, 16 bp, Homo sapiens
tgcccccctcctccag

SEQ ID NO: 4509131 - DNA, 18 bp, Homo sapiens
tgcccccggccccctggt

SEQ ID NO: 4509132 - DNA, 20 bp, Homo sapiens
tgccccctcccccatgggct

SEQ ID NO: 4509133 - DNA, 21 bp, Homo sapiens
tgccccctcccccatgggctg

SEQ ID NO: 4509134 - DNA, 14 bp, Homo sapiens
tgccccctctcact

SEQ ID NO: 4509135 - DNA, 18 bp, Homo sapiens
tgccccctgccagtgaag

SEQ ID NO: 4509136 - DNA, 23 bp, Homo sapiens
tgccccgcagacggtctgtgtgc

SEQ ID NO: 4509137 - DNA, 21 bp, Homo sapiens
tgccccgtcggactgccccca

SEQ ID NO: 4509138 - DNA, 19 bp, Homo sapiens
tgccccgtgtgtgtggccg

SEQ ID NO: 4509139 - DNA, 12 bp, Homo sapiens
tgcccctccccc

SEQ ID NO: 4509140 - DNA, 21 bp, Homo sapiens
tgcccctcccccaacccccac

SEQ ID NO: 4509141 - DNA, 23 bp, Homo sapiens
tgcccctcccccaacccccaccc

SEQ ID NO: 4509142 - DNA, 15 bp, Homo sapiens
tgcccctcccccact

SEQ ID NO: 4509143 - DNA, 14 bp, Homo sapiens
tgcccctctgcctt

SEQ ID NO: 4509144 - DNA, 11 bp, Homo sapiens
tgcccctgcag

SEQ ID NO: 4509145 - DNA, 20 bp, Homo sapiens
tgcccctgctcactgggccc

SEQ ID NO: 4509146 - DNA, 12 bp, Homo sapiens
tgcccctggctt

SEQ ID NO: 4509147 - DNA, 13 bp, Homo sapiens
tgcccctggcttt

SEQ ID NO: 4509148 - DNA, 16 bp, Homo sapiens
tgcccctggctttgcc

SEQ ID NO: 4509149 - DNA, 12 bp, Homo sapiens
tgcccctgtctg

SEQ ID NO: 4509150 - DNA, 23 bp, Homo sapiens
tgcccctgtctggaagacgtggc

SEQ ID NO: 4509151 - DNA, 21 bp, Homo sapiens
tgccccttaaacacaggctgt

SEQ ID NO: 4509152 - DNA, 15 bp, Homo sapiens
tgccccttctacact

SEQ ID NO: 4509153 - DNA, 16 bp, Homo sapiens
tgccccttctacactc

SEQ ID NO: 4509154 - DNA, 13 bp, Homo sapiens
tgccccttggtcc

SEQ ID NO: 4509155 - DNA, 18 bp, Homo sapiens
tgccccttggtcctggca

SEQ ID NO: 4509156 - DNA, 19 bp, Homo sapiens
tgcccgaaactaagccagg

SEQ ID NO: 4509157 - DNA, 20 bp, Homo sapiens
tgcccgaaactaagccaggc

SEQ ID NO: 4509158 - DNA, 23 bp, Homo sapiens
tgcccgaaactaagccaggcctg

SEQ ID NO: 4509159 - DNA, 15 bp, Homo sapiens
tgcccgactgactgg

SEQ ID NO: 4509160 - DNA, 21 bp, Homo sapiens
tgcccgcgggagacagcttct

SEQ ID NO: 4509161 - DNA, 22 bp, Homo sapiens
tgcccgcgggagacagcttctc

SEQ ID NO: 4509162 - DNA, 19 bp, Homo sapiens
tgcccgctccatggaaaag

SEQ ID NO: 4509163 - DNA, 14 bp, Homo sapiens
tgcccgctcccaca

SEQ ID NO: 4509164 - DNA, 16 bp, Homo sapiens
tgcccgctcccacagc

SEQ ID NO: 4509165 - DNA, 23 bp, Homo sapiens
tgcccgctcccacagcttcctga

SEQ ID NO: 4509166 - DNA, 23 bp, Homo sapiens
tgcccggagattggacggcctga

SEQ ID NO: 4509167 - DNA, 17 bp, Homo sapiens
tgcccgggagctcagga

SEQ ID NO: 4509168 - DNA, 18 bp, Homo sapiens
tgcccgtctctctcccat

SEQ ID NO: 4509169 - DNA, 13 bp, Homo sapiens
tgccctccaaaga

SEQ ID NO: 4509170 - DNA, 20 bp, Homo sapiens
tgccctcccaagtcccaccc

SEQ ID NO: 4509171 - DNA, 22 bp, Homo sapiens
tgccctcccaagtcccaccctc

SEQ ID NO: 4509172 - DNA, 14 bp, Homo sapiens
tgccctcctgggcc

SEQ ID NO: 4509173 - DNA, 19 bp, Homo sapiens
tgccctcctgggccctggg

SEQ ID NO: 4509174 - DNA, 17 bp, Homo sapiens
tgccctctggggccact

SEQ ID NO: 4509175 - DNA, 19 bp, Homo sapiens
tgccctgaccatgcatttt

SEQ ID NO: 4509176 - DNA, 22 bp, Homo sapiens
tgccctgagcactcctggtgca

SEQ ID NO: 4509177 - DNA, 13 bp, Homo sapiens
tgccctgcctcag

SEQ ID NO: 4509178 - DNA, 21 bp, Homo sapiens
tgccctgcctcagccaggccc

SEQ ID NO: 4509179 - DNA, 14 bp, Homo sapiens
tgccaagatttaaa

SEQ ID NO: 4509180 - DNA, 18 bp, Homo sapiens
tgccaagctaatctgcct

SEQ ID NO: 4509181 - DNA, 19 bp, Homo sapiens
tgccaagctaatctgcctg

SEQ ID NO: 4509182 - DNA, 18 bp, Homo sapiens
tgccaaggctctcccctc

SEQ ID NO: 4509183 - DNA, 21 bp, Homo sapiens
tgccaagggctttgttttgca

SEQ ID NO: 4509184 - DNA, 15 bp, Homo sapiens
tgccaagtaagagtg

SEQ ID NO: 4509185 - DNA, 17 bp, Homo sapiens
tgccaagtcagcatatg

SEQ ID NO: 4509186 - DNA, 17 bp, Homo sapiens
tgccaagtctcagaaga

SEQ ID NO: 4509187 - DNA, 14 bp, Homo sapiens
tgccaatcaatagc

SEQ ID NO: 4509188 - DNA, 18 bp, Homo sapiens
tgccaatcttaaagacaa

SEQ ID NO: 4509189 - DNA, 19 bp, Homo sapiens
tgccaatcttaaagacaaa

SEQ ID NO: 4509190 - DNA, 18 bp, Homo sapiens
tgccaattgctaccgaga

SEQ ID NO: 4509191 - DNA, 13 bp, Homo sapiens
tgccaatttcaag

SEQ ID NO: 4509192 - DNA, 16 bp, Homo sapiens
tgccacagaggcccca

SEQ ID NO: 4509193 - DNA, 18 bp, Homo sapiens
tgccacagaggccccacc

SEQ ID NO: 4509194 - DNA, 15 bp, Homo sapiens
tgccacagccagagg

SEQ ID NO: 4509195 - DNA, 18 bp, Homo sapiens
tgccacatggtgtctccc

SEQ ID NO: 4509196 - DNA, 20 bp, Homo sapiens
tgccacatggtgtctcccaa

SEQ ID NO: 4509197 - DNA, 22 bp, Homo sapiens
tgccacatggtgtctcccaaca

SEQ ID NO: 4509198 - DNA, 16 bp, Homo sapiens
tgccaccaacttacaa

SEQ ID NO: 4509199 - DNA, 13 bp, Homo sapiens
tgccaccagcccc

SEQ ID NO: 4509200 - DNA, 19 bp, Homo sapiens
tgccaccagcccctcccca

SEQ ID NO: 4509201 - DNA, 12 bp, Homo sapiens
tgccaccaggag

SEQ ID NO: 4509202 - DNA, 17 bp, Homo sapiens
tgccaccaggagaacca

SEQ ID NO: 4509203 - DNA, 22 bp, Homo sapiens
tgccaccaggagaaccactaca

SEQ ID NO: 4509204 - DNA, 13 bp, Homo sapiens
tgccacccacctt

SEQ ID NO: 4509205 - DNA, 15 bp, Homo sapiens
tgccaccccaccctc

SEQ ID NO: 4509206 - DNA, 19 bp, Homo sapiens
tgccaccccaccctccctg

SEQ ID NO: 4509207 - DNA, 20 bp, Homo sapiens
tgccaccccaccctccctgg

SEQ ID NO: 4509208 - DNA, 23 bp, Homo sapiens
tgccaccccaccctccctggagt

SEQ ID NO: 4509209 - DNA, 13 bp, Homo sapiens
tgccacccctaaa

SEQ ID NO: 4509210 - DNA, 16 bp, Homo sapiens
tgccacccgcccaccc

SEQ ID NO: 4509211 - DNA, 13 bp, Homo sapiens
tgccacctatgcc

SEQ ID NO: 4509212 - DNA, 17 bp, Homo sapiens
tgccacctatgcctgtg

SEQ ID NO: 4509213 - DNA, 19 bp, Homo sapiens
tgccacctatgcctgtggt

SEQ ID NO: 4509214 - DNA, 17 bp, Homo sapiens
tgccacctcccctatcc

SEQ ID NO: 4509215 - DNA, 22 bp, Homo sapiens
tgccacctcccctatccaccca

SEQ ID NO: 4509216 - DNA, 16 bp, Homo sapiens
tgccaccttgtggccg

SEQ ID NO: 4509217 - DNA, 16 bp, Homo sapiens
tgccactaaattgaca

SEQ ID NO: 4509218 - DNA, 15 bp, Homo sapiens
tgccactcacacagc

SEQ ID NO: 4509219 - DNA, 18 bp, Homo sapiens
tgccactcacacagccag

SEQ ID NO: 4509220 - DNA, 20 bp, Homo sapiens
tgccactcacacagccaggt

SEQ ID NO: 4509221 - DNA, 22 bp, Homo sapiens
tgccactcacacagccaggtgc

SEQ ID NO: 4509222 - DNA, 18 bp, Homo sapiens
tgccactgccccccgagg

SEQ ID NO: 4509223 - DNA, 21 bp, Homo sapiens
tgccactgttcagcggagctg

SEQ ID NO: 4509224 - DNA, 18 bp, Homo sapiens
tgccacttaatgtatgtt

SEQ ID NO: 4509225 - DNA, 20 bp, Homo sapiens
tgccacttaatgtatgttac

SEQ ID NO: 4509226 - DNA, 16 bp, Homo sapiens
tgccacttctcactca

SEQ ID NO: 4509227 - DNA, 23 bp, Homo sapiens
tgccacttgtcaaagaaggtgct

SEQ ID NO: 4509228 - DNA, 20 bp, Homo sapiens
tgccagaccgcagagaggct

SEQ ID NO: 4509229 - DNA, 22 bp, Homo sapiens
tgccagagaggtggggatcctg

SEQ ID NO: 4509230 - DNA, 14 bp, Homo sapiens
tgccagaggccctg

SEQ ID NO: 4509231 - DNA, 20 bp, Homo sapiens
tgccagaggccctggaggga

SEQ ID NO: 4509232 - DNA, 22 bp, Homo sapiens
tgccagaggccctggagggaag

SEQ ID NO: 4509233 - DNA, 16 bp, Homo sapiens
tgccagatataactgt

SEQ ID NO: 4509234 - DNA, 21 bp, Homo sapiens
tgccagatataactgtcttgt

SEQ ID NO: 4509235 - DNA, 13 bp, Homo sapiens
tgccagcagagcc

SEQ ID NO: 4509236 - DNA, 18 bp, Homo sapiens
tgccagcagagccagggc

SEQ ID NO: 4509237 - DNA, 19 bp, Homo sapiens
tgccagcagagccagggca

SEQ ID NO: 4509238 - DNA, 15 bp, Homo sapiens
tgccagcattccaga

SEQ ID NO: 4509239 - DNA, 18 bp, Homo sapiens
tgccagcattccagactt

SEQ ID NO: 4509240 - DNA, 21 bp, Homo sapiens
tgccagcattccagacttcaa

SEQ ID NO: 4509241 - DNA, 14 bp, Homo sapiens
tgccagcccacccc

SEQ ID NO: 4509242 - DNA, 16 bp, Homo sapiens
tgccagcccaccccct

SEQ ID NO: 4509243 - DNA, 21 bp, Homo sapiens
tgccagcgccaaaacaagcca

SEQ ID NO: 4509244 - DNA, 15 bp, Homo sapiens
tgccagctgcccttg

SEQ ID NO: 4509245 - DNA, 15 bp, Homo sapiens
tgccaggaagggcca

SEQ ID NO: 4509246 - DNA, 23 bp, Homo sapiens
tgccaggcggacaaagttcagtg

SEQ ID NO: 4509247 - DNA, 17 bp, Homo sapiens
tgccaggctaatttttt

SEQ ID NO: 4509248 - DNA, 14 bp, Homo sapiens
tgccaggctccctt

SEQ ID NO: 4509249 - DNA, 19 bp, Homo sapiens
tgccaggctccctttctct

SEQ ID NO: 4509250 - DNA, 23 bp, Homo sapiens
tgccaggctccctttctcttctt

SEQ ID NO: 4509251 - DNA, 12 bp, Homo sapiens
tgccaggctgtt

SEQ ID NO: 4509252 - DNA, 15 bp, Homo sapiens
tgccagggatgggca

SEQ ID NO: 4509253 - DNA, 17 bp, Homo sapiens
tgccagggatgggcagc

SEQ ID NO: 4509254 - DNA, 12 bp, Homo sapiens
tgccagggcagg

SEQ ID NO: 4509255 - DNA, 15 bp, Homo sapiens
tgccagggcagggcc

SEQ ID NO: 4509256 - DNA, 13 bp, Homo sapiens
tgccagtattttt

SEQ ID NO: 4509257 - DNA, 15 bp, Homo sapiens
tgccagtgcactccg

SEQ ID NO: 4509258 - DNA, 14 bp, Homo sapiens
tgccagtgcagcca

SEQ ID NO: 4509259 - DNA, 16 bp, Homo sapiens
tgccagtgcctgggtg

SEQ ID NO: 4509260 - DNA, 15 bp, Homo sapiens
tgccagtgtctttct

SEQ ID NO: 4509261 - DNA, 21 bp, Homo sapiens
tgccataaaattgcagtttca

SEQ ID NO: 4509262 - DNA, 21 bp, Homo sapiens
tgccatcactggtccaggtct

SEQ ID NO: 4509263 - DNA, 13 bp, Homo sapiens
tgccatcatctcc

SEQ ID NO: 4509264 - DNA, 16 bp, Homo sapiens
tgccatcatctcctgc

SEQ ID NO: 4509265 - DNA, 16 bp, Homo sapiens
tgccatcatgtttaca

SEQ ID NO: 4509266 - DNA, 13 bp, Homo sapiens
tgccatcctcttt

SEQ ID NO: 4509267 - DNA, 17 bp, Homo sapiens
tgccatcctctttctct

SEQ ID NO: 4509268 - DNA, 13 bp, Homo sapiens
tgccatcctggcc

SEQ ID NO: 4509269 - DNA, 17 bp, Homo sapiens
tgccatgacagaggctg

SEQ ID NO: 4509270 - DNA, 20 bp, Homo sapiens
tgccatgagccgcccaaggc

SEQ ID NO: 4509271 - DNA, 14 bp, Homo sapiens
tgccatgatctgta

SEQ ID NO: 4509272 - DNA, 13 bp, Homo sapiens
tgccatgctgggc

SEQ ID NO: 4509273 - DNA, 14 bp, Homo sapiens
tgccatgctgggcc

SEQ ID NO: 4509274 - DNA, 15 bp, Homo sapiens
tgccatgctgggcca

SEQ ID NO: 4509275 - DNA, 19 bp, Homo sapiens
tgccatgctgggccactgg

SEQ ID NO: 4509276 - DNA, 15 bp, Homo sapiens
tgccatgctttgagt

SEQ ID NO: 4509277 - DNA, 19 bp, Homo sapiens
tgccatgctttttggtgag

SEQ ID NO: 4509278 - DNA, 20 bp, Homo sapiens
tgccatggaactgtttcctt

SEQ ID NO: 4509279 - DNA, 16 bp, Homo sapiens
tgccatggaagaggct

SEQ ID NO: 4509280 - DNA, 21 bp, Homo sapiens
tgccatgttggccaggctggt

SEQ ID NO: 4509281 - DNA, 16 bp, Homo sapiens
tgccattacccagtgc

SEQ ID NO: 4509282 - DNA, 16 bp, Homo sapiens
tgccattagccaagga

SEQ ID NO: 4509283 - DNA, 14 bp, Homo sapiens
tgccattctgtgca

SEQ ID NO: 4509284 - DNA, 16 bp, Homo sapiens
tgccattcttctggtg

SEQ ID NO: 4509285 - DNA, 17 bp, Homo sapiens
tgccattgggaccctcc

SEQ ID NO: 4509286 - DNA, 19 bp, Homo sapiens
tgccattgggaccctccag

SEQ ID NO: 4509287 - DNA, 19 bp, Homo sapiens
tgccattggggtagttgtg

SEQ ID NO: 4509288 - DNA, 15 bp, Homo sapiens
tgccattgtccagga

SEQ ID NO: 4509289 - DNA, 17 bp, Homo sapiens
tgccattgtctttatat

SEQ ID NO: 4509290 - DNA, 16 bp, Homo sapiens
tgccatttatttcctc

SEQ ID NO: 4509291 - DNA, 15 bp, Homo sapiens
tgccatttcatgtcc

SEQ ID NO: 4509292 - DNA, 16 bp, Homo sapiens
tgccatttctcacgcc

SEQ ID NO: 4509293 - DNA, 13 bp, Homo sapiens
tgcccaaaatgtg

SEQ ID NO: 4509294 - DNA, 20 bp, Homo sapiens
tgcccaaacagctgtattta

SEQ ID NO: 4509295 - DNA, 13 bp, Homo sapiens
tgcccaaaccctt

SEQ ID NO: 4509296 - DNA, 19 bp, Homo sapiens
tgcccaaacccttaactga

SEQ ID NO: 4509297 - DNA, 22 bp, Homo sapiens
tgcccaaacccttaactgacat

SEQ ID NO: 4509298 - DNA, 19 bp, Homo sapiens
tgcccaaggcctaccccag

SEQ ID NO: 4509299 - DNA, 20 bp, Homo sapiens
tgcccaaggcctaccccagt

SEQ ID NO: 4509300 - DNA, 17 bp, Homo sapiens
tgccctggactgtttca

SEQ ID NO: 4509301 - DNA, 15 bp, Homo sapiens
tgccctggctgctgc

SEQ ID NO: 4509302 - DNA, 17 bp, Homo sapiens
tgccctggctgctgccc

SEQ ID NO: 4509303 - DNA, 20 bp, Homo sapiens
tgccctggctgctgccccca

SEQ ID NO: 4509304 - DNA, 22 bp, Homo sapiens
tgccctgtcaagcttctctgtt

SEQ ID NO: 4509305 - DNA, 18 bp, Homo sapiens
tgccctgtggacaggatg

SEQ ID NO: 4509306 - DNA, 19 bp, Homo sapiens
tgccctgtggacaggatga

SEQ ID NO: 4509307 - DNA, 16 bp, Homo sapiens
tgccctgtgtggctgg

SEQ ID NO: 4509308 - DNA, 19 bp, Homo sapiens
tgccctgttaaaagatgaa

SEQ ID NO: 4509309 - DNA, 17 bp, Homo sapiens
tgcccttggtgcgaggg

SEQ ID NO: 4509310 - DNA, 19 bp, Homo sapiens
tgcccttttttctgcctcc

SEQ ID NO: 4509311 - DNA, 20 bp, Homo sapiens
tgcccttttttctgcctcct

SEQ ID NO: 4509312 - DNA, 19 bp, Homo sapiens
tgccgaatttggtacacat

SEQ ID NO: 4509313 - DNA, 20 bp, Homo sapiens
tgccgaatttggtacacatg

SEQ ID NO: 4509314 - DNA, 15 bp, Homo sapiens
tgccgacctcgtcct

SEQ ID NO: 4509315 - DNA, 17 bp, Homo sapiens
tgccgacctcgtcctcc

SEQ ID NO: 4509316 - DNA, 21 bp, Homo sapiens
tgccgacctcgtcctccccct

SEQ ID NO: 4509317 - DNA, 22 bp, Homo sapiens
tgccgacctcgtcctccccctg

SEQ ID NO: 4509318 - DNA, 19 bp, Homo sapiens
tgccgacttggagactcct

SEQ ID NO: 4509319 - DNA, 13 bp, Homo sapiens
tgccgagcccagc

SEQ ID NO: 4509320 - DNA, 19 bp, Homo sapiens
tgccgagggctggccggga

SEQ ID NO: 4509321 - DNA, 13 bp, Homo sapiens
tgccgcaccccag

SEQ ID NO: 4509322 - DNA, 16 bp, Homo sapiens
tgccgcgatgggtcag

SEQ ID NO: 4509323 - DNA, 15 bp, Homo sapiens
tgccgctgccatgct

SEQ ID NO: 4509324 - DNA, 16 bp, Homo sapiens
tgccgctgccgctgca

SEQ ID NO: 4509325 - DNA, 20 bp, Homo sapiens
tgccggcggcagccccactt

SEQ ID NO: 4509326 - DNA, 18 bp, Homo sapiens
tgccgggaggcagccaca

SEQ ID NO: 4509327 - DNA, 17 bp, Homo sapiens
tgccggtacacagccag

SEQ ID NO: 4509328 - DNA, 20 bp, Homo sapiens
tgccgtctaggattgggcct

SEQ ID NO: 4509329 - DNA, 16 bp, Homo sapiens
tgccgtgagcatgcac

SEQ ID NO: 4509330 - DNA, 18 bp, Homo sapiens
tgcctaagcattgcctgg

SEQ ID NO: 4509331 - DNA, 19 bp, Homo sapiens
tgcctaagcattgcctggc

SEQ ID NO: 4509332 - DNA, 14 bp, Homo sapiens
tgcctaagtggctg

SEQ ID NO: 4509333 - DNA, 17 bp, Homo sapiens
tgcctaataaagagact

SEQ ID NO: 4509334 - DNA, 15 bp, Homo sapiens
tgcctaatggagaag

SEQ ID NO: 4509335 - DNA, 15 bp, Homo sapiens
tgcctaattggaaag

SEQ ID NO: 4509336 - DNA, 16 bp, Homo sapiens
tgcctaattggaaagt

SEQ ID NO: 4509337 - DNA, 14 bp, Homo sapiens
tgcctacagccagg

SEQ ID NO: 4509338 - DNA, 17 bp, Homo sapiens
tgcctaggcgattttgt

SEQ ID NO: 4509339 - DNA, 21 bp, Homo sapiens
tgcctaggcgattttgtctac

SEQ ID NO: 4509340 - DNA, 15 bp, Homo sapiens
tgcctaggctggaaa

SEQ ID NO: 4509341 - DNA, 22 bp, Homo sapiens
tgcctcaatgtgaatcagaccc

SEQ ID NO: 4509342 - DNA, 18 bp, Homo sapiens
tgcctcactcctccgtga

SEQ ID NO: 4509343 - DNA, 20 bp, Homo sapiens
tgcctcactcctccgtgagc

SEQ ID NO: 4509344 - DNA, 22 bp, Homo sapiens
tgcctcagacgttgcctgagaa

SEQ ID NO: 4509345 - DNA, 22 bp, Homo sapiens
tgcctcaggccaagggaccagg

SEQ ID NO: 4509346 - DNA, 17 bp, Homo sapiens
tgcctccaagttcaaaa

SEQ ID NO: 4509347 - DNA, 14 bp, Homo sapiens
tgcctccaccctct

SEQ ID NO: 4509348 - DNA, 17 bp, Homo sapiens
tgcctccaccgctgcct

SEQ ID NO: 4509349 - DNA, 12 bp, Homo sapiens
tgcctccagggc

SEQ ID NO: 4509350 - DNA, 14 bp, Homo sapiens
tgcctccagggctg

SEQ ID NO: 4509351 - DNA, 18 bp, Homo sapiens
tgcctccagggctggact

SEQ ID NO: 4509352 - DNA, 20 bp, Homo sapiens
tgcctccagggctggactga

SEQ ID NO: 4509353 - DNA, 16 bp, Homo sapiens
tgcctcccattctgca

SEQ ID NO: 4509354 - DNA, 21 bp, Homo sapiens
tgcctccccatttcccatctg

SEQ ID NO: 4509355 - DNA, 16 bp, Homo sapiens
tgcctccccccagacc

SEQ ID NO: 4509356 - DNA, 17 bp, Homo sapiens
tgcctccccccagaccc

SEQ ID NO: 4509357 - DNA, 22 bp, Homo sapiens
tgcctccccccagaccccgccc

SEQ ID NO: 4509358 - DNA, 11 bp, Homo sapiens
tgcctcctcaa

SEQ ID NO: 4509359 - DNA, 22 bp, Homo sapiens
tgcctcctcaaacccagtctca

SEQ ID NO: 4509360 - DNA, 22 bp, Homo sapiens
tgcctcctggccaagcaggctg

SEQ ID NO: 4509361 - DNA, 17 bp, Homo sapiens
tgcctcctgtgcctccc

SEQ ID NO: 4509362 - DNA, 20 bp, Homo sapiens
tgcctcctgtgtactgtgtc

SEQ ID NO: 4509363 - DNA, 16 bp, Homo sapiens
tgcctcgaggggccca

SEQ ID NO: 4509364 - DNA, 22 bp, Homo sapiens
tgcctcgctcaccgctggccct

SEQ ID NO: 4509365 - DNA, 19 bp, Homo sapiens
tgcctcgtagagtgacctc

SEQ ID NO: 4509366 - DNA, 23 bp, Homo sapiens
tgcctctacctgacactcccttg

SEQ ID NO: 4509367 - DNA, 18 bp, Homo sapiens
tgcctctcatcaactgaa

SEQ ID NO: 4509368 - DNA, 17 bp, Homo sapiens
tgcctctccctgctgct

SEQ ID NO: 4509369 - DNA, 13 bp, Homo sapiens
tgcctctctttga

SEQ ID NO: 4509370 - DNA, 22 bp, Homo sapiens
tgcctctgacagtccacagggg

SEQ ID NO: 4509371 - DNA, 17 bp, Homo sapiens
tgcctctgaccccagca

SEQ ID NO: 4509372 - DNA, 15 bp, Homo sapiens
tgcctctgcagtctc

SEQ ID NO: 4509373 - DNA, 21 bp, Homo sapiens
tgcctctgcagtctcatttct

SEQ ID NO: 4509374 - DNA, 24 bp, Homo sapiens
tgcctctgcagtctcatttctcat

SEQ ID NO: 4509375 - DNA, 13 bp, Homo sapiens
tgcctctgctccc

SEQ ID NO: 4509376 - DNA, 14 bp, Homo sapiens
tgcctctgctccct

SEQ ID NO: 4509377 - DNA, 16 bp, Homo sapiens
tgcctctgctccctct

SEQ ID NO: 4509378 - DNA, 15 bp, Homo sapiens
tgcctctgtcccctt

SEQ ID NO: 4509379 - DNA, 16 bp, Homo sapiens
tgcctcttaggactgg

SEQ ID NO: 4509380 - DNA, 21 bp, Homo sapiens
tgcctcttccagtcttcctga

SEQ ID NO: 4509381 - DNA, 20 bp, Homo sapiens
tgcctcttctcttgacagtc

SEQ ID NO: 4509382 - DNA, 13 bp, Homo sapiens
tgcctcttctggg

SEQ ID NO: 4509383 - DNA, 16 bp, Homo sapiens
tgcctcttctgggagg

SEQ ID NO: 4509384 - DNA, 19 bp, Homo sapiens
tgcctcttttacctgctgc

SEQ ID NO: 4509385 - DNA, 21 bp, Homo sapiens
tgcctcttttacctgctgctt

SEQ ID NO: 4509386 - DNA, 23 bp, Homo sapiens
tgcctgaacagccctctctctca

SEQ ID NO: 4509387 - DNA, 22 bp, Homo sapiens
tgcctgactaatttttgtattt

SEQ ID NO: 4509388 - DNA, 14 bp, Homo sapiens
tgcctgagaccagg

SEQ ID NO: 4509389 - DNA, 20 bp, Homo sapiens
tgcctgagaccagggtggcc

SEQ ID NO: 4509390 - DNA, 13 bp, Homo sapiens
tgcctgagaggca

SEQ ID NO: 4509391 - DNA, 15 bp, Homo sapiens
tgcctgagaggcagg

SEQ ID NO: 4509392 - DNA, 18 bp, Homo sapiens
tgcctgagaggcaggcat

SEQ ID NO: 4509393 - DNA, 14 bp, Homo sapiens
tgcctgaggctgta

SEQ ID NO: 4509394 - DNA, 14 bp, Homo sapiens
tgcctgcagcaggc

SEQ ID NO: 4509395 - DNA, 15 bp, Homo sapiens
tgcctgccactctct

SEQ ID NO: 4509396 - DNA, 18 bp, Homo sapiens
tgcctgccactctctggg

SEQ ID NO: 4509397 - DNA, 19 bp, Homo sapiens
tgcctgccactctctggga

SEQ ID NO: 4509398 - DNA, 12 bp, Homo sapiens
tgcctgccccgc

SEQ ID NO: 4509399 - DNA, 21 bp, Homo sapiens
tgcctgcccctaccctggact

SEQ ID NO: 4509400 - DNA, 14 bp, Homo sapiens
tgcctgcgcccacc

SEQ ID NO: 4509401 - DNA, 20 bp, Homo sapiens
tgcctgcgcccaccccgctc

SEQ ID NO: 4509402 - DNA, 16 bp, Homo sapiens
tgcctgcgcctgctgc

SEQ ID NO: 4509403 - DNA, 19 bp, Homo sapiens
tgcctgcgtgggtgtgtgc

SEQ ID NO: 4509404 - DNA, 16 bp, Homo sapiens
tgcctgcttctttcca

SEQ ID NO: 4509405 - DNA, 19 bp, Homo sapiens
tgcctgcttctttccagaa

SEQ ID NO: 4509406 - DNA, 15 bp, Homo sapiens
tgcctgctttttgga

SEQ ID NO: 4509407 - DNA, 16 bp, Homo sapiens
tgcctgctttttggaa

SEQ ID NO: 4509408 - DNA, 22 bp, Homo sapiens
tgcctgctttttggaaagtcag

SEQ ID NO: 4509409 - DNA, 22 bp, Homo sapiens
tgcctggagacaaggtgctaac

SEQ ID NO: 4509410 - DNA, 23 bp, Homo sapiens
tgcctggcaggctgtctggccag

SEQ ID NO: 4509411 - DNA, 13 bp, Homo sapiens
tgcctggccagat

SEQ ID NO: 4509412 - DNA, 12 bp, Homo sapiens
tgcctggccagg

SEQ ID NO: 4509413 - DNA, 16 bp, Homo sapiens
tgcctggccaggcaga

SEQ ID NO: 4509414 - DNA, 20 bp, Homo sapiens
tgcctggccaggcagatctg

SEQ ID NO: 4509415 - DNA, 13 bp, Homo sapiens
tgcctggccccag

SEQ ID NO: 4509416 - DNA, 18 bp, Homo sapiens
tgcctggccttcctgtct

SEQ ID NO: 4509417 - DNA, 14 bp, Homo sapiens
tgcctggctccctg

SEQ ID NO: 4509418 - DNA, 20 bp, Homo sapiens
tgcctggtatatccaaaagc

SEQ ID NO: 4509419 - DNA, 23 bp, Homo sapiens
tgcctggtatatccaaaagcttt

SEQ ID NO: 4509420 - DNA, 15 bp, Homo sapiens
tgctaccagtattta

SEQ ID NO: 4509421 - DNA, 18 bp, Homo sapiens
tgctaccagtatttagaa

SEQ ID NO: 4509422 - DNA, 15 bp, Homo sapiens
tgctaccgagaaggt

SEQ ID NO: 4509423 - DNA, 19 bp, Homo sapiens
tgctacctcagtgctcctg

SEQ ID NO: 4509424 - DNA, 20 bp, Homo sapiens
tgctacctcagtgctcctgg

SEQ ID NO: 4509425 - DNA, 19 bp, Homo sapiens
tgctacgtacatgtgaggc

SEQ ID NO: 4509426 - DNA, 14 bp, Homo sapiens
tgctactataatca

SEQ ID NO: 4509427 - DNA, 20 bp, Homo sapiens
tgctactataatcaaatgat

SEQ ID NO: 4509428 - DNA, 12 bp, Homo sapiens
tgctactcctgt

SEQ ID NO: 4509429 - DNA, 21 bp, Homo sapiens
tgctactgcactccagcctgg

SEQ ID NO: 4509430 - DNA, 15 bp, Homo sapiens
tgctactgctgctgc

SEQ ID NO: 4509431 - DNA, 23 bp, Homo sapiens
tgctacttcactgtcatcttcaa

SEQ ID NO: 4509432 - DNA, 13 bp, Homo sapiens
tgctagcacagag

SEQ ID NO: 4509433 - DNA, 17 bp, Homo sapiens
tgctagcacagaggcct

SEQ ID NO: 4509434 - DNA, 17 bp, Homo sapiens
tgctaggagctgacaat

SEQ ID NO: 4509435 - DNA, 19 bp, Homo sapiens
tgctagtgggccctctctc

SEQ ID NO: 4509436 - DNA, 21 bp, Homo sapiens
tgctataatctgtttttacgt

SEQ ID NO: 4509437 - DNA, 13 bp, Homo sapiens
tgctatactgcat

SEQ ID NO: 4509438 - DNA, 14 bp, Homo sapiens
tgctatagtatttg

SEQ ID NO: 4509439 - DNA, 21 bp, Homo sapiens
tgctatagtatttgattcaaa

SEQ ID NO: 4509440 - DNA, 20 bp, Homo sapiens
tgctatccccatctccctgc

SEQ ID NO: 4509441 - DNA, 22 bp, Homo sapiens
tgctatccccatctccctgcct

SEQ ID NO: 4509442 - DNA, 17 bp, Homo sapiens
tgctatggttttctcca

SEQ ID NO: 4509443 - DNA, 18 bp, Homo sapiens
tgctattgtagagccaga

SEQ ID NO: 4509444 - DNA, 14 bp, Homo sapiens
tgctatttaacatt

SEQ ID NO: 4509445 - DNA, 15 bp, Homo sapiens
tgctatttaacattt

SEQ ID NO: 4509446 - DNA, 15 bp, Homo sapiens
tgctattttcatcac

SEQ ID NO: 4509447 - DNA, 23 bp, Homo sapiens
tgctcaaaacacttccagtctgg

SEQ ID NO: 4509448 - DNA, 18 bp, Homo sapiens
tgctcaaattactaatga

SEQ ID NO: 4509449 - DNA, 13 bp, Homo sapiens
tgctcaatttcag

SEQ ID NO: 4509450 - DNA, 16 bp, Homo sapiens
tgctcaatttcagcac

SEQ ID NO: 4509451 - DNA, 14 bp, Homo sapiens
tgctcaccagccct

SEQ ID NO: 4509452 - DNA, 18 bp, Homo sapiens
tgctcaccagccctgcag

SEQ ID NO: 4509453 - DNA, 13 bp, Homo sapiens
tgctcaccctctc

SEQ ID NO: 4509454 - DNA, 19 bp, Homo sapiens
tgctcaccgcccatcaggg

SEQ ID NO: 4509455 - DNA, 23 bp, Homo sapiens
tgctcaccgcccatcagggttct

SEQ ID NO: 4509456 - DNA, 14 bp, Homo sapiens
tgctcactgggccc

SEQ ID NO: 4509457 - DNA, 17 bp, Homo sapiens
tgctcaggtgcaagtgc

SEQ ID NO: 4509458 - DNA, 13 bp, Homo sapiens
tgctcagtgcttg

SEQ ID NO: 4509459 - DNA, 19 bp, Homo sapiens
tgctcatacacagttaaat

SEQ ID NO: 4509460 - DNA, 22 bp, Homo sapiens
tgctcatattgtgattctgcct

SEQ ID NO: 4509461 - DNA, 19 bp, Homo sapiens
tgctcatcattctctgtct

SEQ ID NO: 4509462 - DNA, 19 bp, Homo sapiens
tgctcatgtatatttagtt

SEQ ID NO: 4509463 - DNA, 15 bp, Homo sapiens
tgctcattaaactga

SEQ ID NO: 4509464 - DNA, 15 bp, Homo sapiens
tgctccagcctctgc

SEQ ID NO: 4509465 - DNA, 20 bp, Homo sapiens
tgctccagcctctgccgctg

SEQ ID NO: 4509466 - DNA, 16 bp, Homo sapiens
tgctccagggagattt

SEQ ID NO: 4509467 - DNA, 16 bp, Homo sapiens
tgctccagggtcaggc

SEQ ID NO: 4509468 - DNA, 17 bp, Homo sapiens
tgctccagggtcaggcg

SEQ ID NO: 4509469 - DNA, 18 bp, Homo sapiens
tgctccataccttttctc

SEQ ID NO: 4509470 - DNA, 19 bp, Homo sapiens
tgctccataccttttctct

SEQ ID NO: 4509471 - DNA, 12 bp, Homo sapiens
tgctccatctcc

SEQ ID NO: 4509472 - DNA, 20 bp, Homo sapiens
tgctccatttttaaccactt

SEQ ID NO: 4509473 - DNA, 15 bp, Homo sapiens
tgctcccacctggct

SEQ ID NO: 4509474 - DNA, 13 bp, Homo sapiens
tgctcccagctgt

SEQ ID NO: 4509475 - DNA, 18 bp, Homo sapiens
tgctcccagtcctgcctg

SEQ ID NO: 4509476 - DNA, 19 bp, Homo sapiens
tgctcccagtcctgcctga

SEQ ID NO: 4509477 - DNA, 16 bp, Homo sapiens
tgctccccaacacctg

SEQ ID NO: 4509478 - DNA, 13 bp, Homo sapiens
tgctccccacagc

SEQ ID NO: 4509479 - DNA, 23 bp, Homo sapiens
tgctccccacagcgtccctggcg

SEQ ID NO: 4509480 - DNA, 13 bp, Homo sapiens
tgctccccacgtc

SEQ ID NO: 4509481 - DNA, 14 bp, Homo sapiens
tgctcccccacccc

SEQ ID NO: 4509482 - DNA, 20 bp, Homo sapiens
tgctcccggcccgcctgccc

SEQ ID NO: 4509483 - DNA, 18 bp, Homo sapiens
tgctccctcccctgccct

SEQ ID NO: 4509484 - DNA, 20 bp, Homo sapiens
tgctccctcccctgccctgg

SEQ ID NO: 4509485 - DNA, 13 bp, Homo sapiens
tgctccctgcaag

SEQ ID NO: 4509486 - DNA, 16 bp, Homo sapiens
tgctccctgcctcctg

SEQ ID NO: 4509487 - DNA, 19 bp, Homo sapiens
tgctccctgcctcctgcct

SEQ ID NO: 4509488 - DNA, 13 bp, Homo sapiens
tgctcctagaagt

SEQ ID NO: 4509489 - DNA, 17 bp, Homo sapiens
tgctcctagcaccctgg

SEQ ID NO: 4509490 - DNA, 12 bp, Homo sapiens
tgctcctccagg

SEQ ID NO: 4509491 - DNA, 14 bp, Homo sapiens
tgctcctgcatgca

SEQ ID NO: 4509492 - DNA, 19 bp, Homo sapiens
tgctcctgcatgcaactaa

SEQ ID NO: 4509493 - DNA, 12 bp, Homo sapiens
tgctcctgtgct

SEQ ID NO: 4509494 - DNA, 18 bp, Homo sapiens
tgctcctgtgctcaccct

SEQ ID NO: 4509495 - DNA, 23 bp, Homo sapiens
tgctccttgagaggagaaatgca

SEQ ID NO: 4509496 - DNA, 16 bp, Homo sapiens
tgctccttggcacccc

SEQ ID NO: 4509497 - DNA, 18 bp, Homo sapiens
tgctccttggcaccccca

SEQ ID NO: 4509498 - DNA, 19 bp, Homo sapiens
tgctccttggcacccccat

SEQ ID NO: 4509499 - DNA, 22 bp, Homo sapiens
tgctccttggcacccccatgct

SEQ ID NO: 4509500 - DNA, 14 bp, Homo sapiens
tgctccttgggccc

SEQ ID NO: 4509501 - DNA, 18 bp, Homo sapiens
tgctccttgggccctttg

SEQ ID NO: 4509502 - DNA, 19 bp, Homo sapiens
tgctcgcccacaaactgat

SEQ ID NO: 4509503 - DNA, 14 bp, Homo sapiens
tgctcgcttttcct

SEQ ID NO: 4509504 - DNA, 16 bp, Homo sapiens
tgctcggacacagttt

SEQ ID NO: 4509505 - DNA, 22 bp, Homo sapiens
tgctcggacacagttttgtctt

SEQ ID NO: 4509506 - DNA, 13 bp, Homo sapiens
tgctctcccaagg

SEQ ID NO: 4509507 - DNA, 13 bp, Homo sapiens
tgctctcctccac

SEQ ID NO: 4509508 - DNA, 15 bp, Homo sapiens
tgctctccttcactc

SEQ ID NO: 4509509 - DNA, 20 bp, Homo sapiens
tgctctccttcactctgaca

SEQ ID NO: 4509510 - DNA, 23 bp, Homo sapiens
tgctctccttcctggagcccaga

SEQ ID NO: 4509511 - DNA, 16 bp, Homo sapiens
tgctctctatccaaaa

SEQ ID NO: 4509512 - DNA, 12 bp, Homo sapiens
tgctctctcacc

SEQ ID NO: 4509513 - DNA, 13 bp, Homo sapiens
tgctctctgcagc

SEQ ID NO: 4509514 - DNA, 15 bp, Homo sapiens
tgctctctgcagcca

SEQ ID NO: 4509515 - DNA, 17 bp, Homo sapiens
tgctctctgcagccagc

SEQ ID NO: 4509516 - DNA, 14 bp, Homo sapiens
tgctctctgtgacc

SEQ ID NO: 4509517 - DNA, 15 bp, Homo sapiens
tgctctgcaaaagga

SEQ ID NO: 4509518 - DNA, 21 bp, Homo sapiens
tgctctgcaggctggggaggt

SEQ ID NO: 4509519 - DNA, 17 bp, Homo sapiens
tgctctgcctcagacgt

SEQ ID NO: 4509520 - DNA, 12 bp, Homo sapiens
tgctctggaata

SEQ ID NO: 4509521 - DNA, 22 bp, Homo sapiens
tgctctggaataaagttgcaga

SEQ ID NO: 4509522 - DNA, 23 bp, Homo sapiens
tgctctggaataaagttgcagat

SEQ ID NO: 4509523 - DNA, 14 bp, Homo sapiens
tgctctgggaaggg

SEQ ID NO: 4509524 - DNA, 12 bp, Homo sapiens
tgctctggggat

SEQ ID NO: 4509525 - DNA, 20 bp, Homo sapiens
tgctctggggatttctggga

SEQ ID NO: 4509526 - DNA, 21 bp, Homo sapiens
tgctctggggatttctgggat

SEQ ID NO: 4509527 - DNA, 17 bp, Homo sapiens
tgctctgtaaaacacac

SEQ ID NO: 4509528 - DNA, 13 bp, Homo sapiens
tgctctgtacctg

SEQ ID NO: 4509529 - DNA, 19 bp, Homo sapiens
tgctctgtcccccaggctg

SEQ ID NO: 4509530 - DNA, 20 bp, Homo sapiens
tgctctgtcccccaggctgg

SEQ ID NO: 4509531 - DNA, 16 bp, Homo sapiens
tgctctgtgtatatct

SEQ ID NO: 4509532 - DNA, 17 bp, Homo sapiens
tgctctgtgtatatctc

SEQ ID NO: 4509533 - DNA, 18 bp, Homo sapiens
tgctctgtgtatatctct

SEQ ID NO: 4509534 - DNA, 23 bp, Homo sapiens
tgctctgtgtatatctcttggaa

SEQ ID NO: 4509535 - DNA, 13 bp, Homo sapiens
tgctcttcagtgg

SEQ ID NO: 4509536 - DNA, 20 bp, Homo sapiens
tgctcttctctccccagccc

SEQ ID NO: 4509537 - DNA, 11 bp, Homo sapiens
tgctctttaaa

SEQ ID NO: 4509538 - DNA, 23 bp, Homo sapiens
tgctctttagatgcaagtggctg

SEQ ID NO: 4509539 - DNA, 13 bp, Homo sapiens
tgctcttttcctg

SEQ ID NO: 4509540 - DNA, 14 bp, Homo sapiens
tgctcttttcctgg

SEQ ID NO: 4509541 - DNA, 21 bp, Homo sapiens
tgcctggttccctccccaagg

SEQ ID NO: 4509542 - DNA, 17 bp, Homo sapiens
tgcctggttttatttat

SEQ ID NO: 4509543 - DNA, 19 bp, Homo sapiens
tgcctgtagctttcctggt

SEQ ID NO: 4509544 - DNA, 22 bp, Homo sapiens
tgcctgtagctttcctggtccc

SEQ ID NO: 4509545 - DNA, 17 bp, Homo sapiens
tgcctgtagtctcagct

SEQ ID NO: 4509546 - DNA, 12 bp, Homo sapiens
tgcctgtcaagt

SEQ ID NO: 4509547 - DNA, 16 bp, Homo sapiens
tgcctgtccagcctgg

SEQ ID NO: 4509548 - DNA, 20 bp, Homo sapiens
tgcctgtccagcctgggcag

SEQ ID NO: 4509549 - DNA, 19 bp, Homo sapiens
tgcctgtgagcatggggcc

SEQ ID NO: 4509550 - DNA, 11 bp, Homo sapiens
tgcctgtggca

SEQ ID NO: 4509551 - DNA, 14 bp, Homo sapiens
tgcctgtggcccct

SEQ ID NO: 4509552 - DNA, 21 bp, Homo sapiens
tgcctgtggcccctcccctgc

SEQ ID NO: 4509553 - DNA, 24 bp, Homo sapiens
tgcctgtggtgaagtgtggctggt

SEQ ID NO: 4509554 - DNA, 20 bp, Homo sapiens
tgcctgttataactctgcac

SEQ ID NO: 4509555 - DNA, 23 bp, Homo sapiens
tgcctgttggcaggcccactccc

SEQ ID NO: 4509556 - DNA, 22 bp, Homo sapiens
tgccttaaaaccaaagagggct

SEQ ID NO: 4509557 - DNA, 17 bp, Homo sapiens
tgccttaaacacacatt

SEQ ID NO: 4509558 - DNA, 20 bp, Homo sapiens
tgccttaataaaaaatgaaa

SEQ ID NO: 4509559 - DNA, 16 bp, Homo sapiens
tgccttacctcctgcc

SEQ ID NO: 4509560 - DNA, 17 bp, Homo sapiens
tgccttacctcctgccc

SEQ ID NO: 4509561 - DNA, 20 bp, Homo sapiens
tgccttacctcctgcccagg

SEQ ID NO: 4509562 - DNA, 19 bp, Homo sapiens
tgccttactcttcttgaaa

SEQ ID NO: 4509563 - DNA, 17 bp, Homo sapiens
tgccttagcttcaggaa

SEQ ID NO: 4509564 - DNA, 17 bp, Homo sapiens
tgccttatgttgaaaaa

SEQ ID NO: 4509565 - DNA, 15 bp, Homo sapiens
tgccttatttctcat

SEQ ID NO: 4509566 - DNA, 18 bp, Homo sapiens
tgccttatttgtctgtaa

SEQ ID NO: 4509567 - DNA, 15 bp, Homo sapiens
tgccttcaaggactg

SEQ ID NO: 4509568 - DNA, 19 bp, Homo sapiens
tgccttcaaggactgtttc

SEQ ID NO: 4509569 - DNA, 14 bp, Homo sapiens
tgccttcactgggc

SEQ ID NO: 4509570 - DNA, 17 bp, Homo sapiens
tgccttcactgggccag

SEQ ID NO: 4509571 - DNA, 20 bp, Homo sapiens
tgccttcactgggccagtca

SEQ ID NO: 4509572 - DNA, 12 bp, Homo sapiens
tgccttccagat

SEQ ID NO: 4509573 - DNA, 15 bp, Homo sapiens
tgccttccagatcct

SEQ ID NO: 4509574 - DNA, 22 bp, Homo sapiens
tgccttccagatcctctctggg

SEQ ID NO: 4509575 - DNA, 20 bp, Homo sapiens
tgccttccatgtcggcctct

SEQ ID NO: 4509576 - DNA, 13 bp, Homo sapiens
tgccttccctagc

SEQ ID NO: 4509577 - DNA, 14 bp, Homo sapiens
tgccttccctagct

SEQ ID NO: 4509578 - DNA, 19 bp, Homo sapiens
tgccttcctcctgggccct

SEQ ID NO: 4509579 - DNA, 19 bp, Homo sapiens
tgccttcctgtttttcaca

SEQ ID NO: 4509580 - DNA, 17 bp, Homo sapiens
tgccttctactcccctt

SEQ ID NO: 4509581 - DNA, 16 bp, Homo sapiens
tgccttctcaccagct

SEQ ID NO: 4509582 - DNA, 20 bp, Homo sapiens
tgccttctcaccagctgcaa

SEQ ID NO: 4509583 - DNA, 15 bp, Homo sapiens
tgccttctgggcttt

SEQ ID NO: 4509584 - DNA, 22 bp, Homo sapiens
tgccttcttcggggaactcctg

SEQ ID NO: 4509585 - DNA, 14 bp, Homo sapiens
tgccttgcacagga

SEQ ID NO: 4509586 - DNA, 18 bp, Homo sapiens
tgccttggaggaaatgtg

SEQ ID NO: 4509587 - DNA, 21 bp, Homo sapiens
tgccttggaggaaatgtgctc

SEQ ID NO: 4509588 - DNA, 20 bp, Homo sapiens
tgccttggagggtcccaagc

SEQ ID NO: 4509589 - DNA, 17 bp, Homo sapiens
tgccttggcctcccaaa

SEQ ID NO: 4509590 - DNA, 17 bp, Homo sapiens
tgccttgtcacgccaga

SEQ ID NO: 4509591 - DNA, 19 bp, Homo sapiens
tgccttgttgtattcctgc

SEQ ID NO: 4509592 - DNA, 16 bp, Homo sapiens
tgccttgttttttgtt

SEQ ID NO: 4509593 - DNA, 18 bp, Homo sapiens
tgcctttaatattttgta

SEQ ID NO: 4509594 - DNA, 23 bp, Homo sapiens
tgcctttagaaaatataagtaaa

SEQ ID NO: 4509595 - DNA, 12 bp, Homo sapiens
tgcctttcctgt

SEQ ID NO: 4509596 - DNA, 19 bp, Homo sapiens
tgcctttcctgttcagcat

SEQ ID NO: 4509597 - DNA, 20 bp, Homo sapiens
tgcctttcctgttcagcatt

SEQ ID NO: 4509598 - DNA, 13 bp, Homo sapiens
tgcctttctttgc

SEQ ID NO: 4509599 - DNA, 17 bp, Homo sapiens
tgcctttctttgcctct

SEQ ID NO: 4509600 - DNA, 21 bp, Homo sapiens
tgcctttgcagttggactctc

SEQ ID NO: 4509601 - DNA, 13 bp, Homo sapiens
tgcctttggcctg

SEQ ID NO: 4509602 - DNA, 15 bp, Homo sapiens
tgcctttgttttgat

SEQ ID NO: 4509603 - DNA, 19 bp, Homo sapiens
tgccttttgcaaccaggaa

SEQ ID NO: 4509604 - DNA, 20 bp, Homo sapiens
tgccttttgttaatgcattg

SEQ ID NO: 4509605 - DNA, 21 bp, Homo sapiens
tgccttttgttaatgcattgt

SEQ ID NO: 4509606 - DNA, 21 bp, Homo sapiens
tgcctttttagatgtattttt

SEQ ID NO: 4509607 - DNA, 20 bp, Homo sapiens
tgcgaagaccctcttgccca

SEQ ID NO: 4509608 - DNA, 15 bp, Homo sapiens
tgcgacgcttgctct

SEQ ID NO: 4509609 - DNA, 18 bp, Homo sapiens
tgcgagtccaaggccagt

SEQ ID NO: 4509610 - DNA, 20 bp, Homo sapiens
tgcgagtccaaggccagtcc

SEQ ID NO: 4509611 - DNA, 12 bp, Homo sapiens
tgcgcactgcat

SEQ ID NO: 4509612 - DNA, 14 bp, Homo sapiens
tgcgcactgcatgg

SEQ ID NO: 4509613 - DNA, 16 bp, Homo sapiens
tgcgcagcctccaggg

SEQ ID NO: 4509614 - DNA, 17 bp, Homo sapiens
tgcgcagcctccagggc

SEQ ID NO: 4509615 - DNA, 20 bp, Homo sapiens
tgcgcattctaacctggagg

SEQ ID NO: 4509616 - DNA, 21 bp, Homo sapiens
tgcgcccttaactgcatccag

SEQ ID NO: 4509617 - DNA, 18 bp, Homo sapiens
tgcgcctcagccctcagt

SEQ ID NO: 4509618 - DNA, 12 bp, Homo sapiens
tgcgcctgctgc

SEQ ID NO: 4509619 - DNA, 19 bp, Homo sapiens
tgcgccttcgtgcctgaga

SEQ ID NO: 4509620 - DNA, 23 bp, Homo sapiens
tgcgcgtgcacgtggagagctgg

SEQ ID NO: 4509621 - DNA, 14 bp, Homo sapiens
tgcgcgtgtgcacg

SEQ ID NO: 4509622 - DNA, 12 bp, Homo sapiens
tgcgctcagggg

SEQ ID NO: 4509623 - DNA, 22 bp, Homo sapiens
tgcgcttgaccatgttgcactg

SEQ ID NO: 4509624 - DNA, 15 bp, Homo sapiens
tgcggagcacactgg

SEQ ID NO: 4509625 - DNA, 16 bp, Homo sapiens
tgcggcccagcccggc

SEQ ID NO: 4509626 - DNA, 18 bp, Homo sapiens
tgcggcccagcccggctc

SEQ ID NO: 4509627 - DNA, 21 bp, Homo sapiens
tgcggcccagcccggctccca

SEQ ID NO: 4509628 - DNA, 17 bp, Homo sapiens
tgcgggagccagactgt

SEQ ID NO: 4509629 - DNA, 20 bp, Homo sapiens
tgcgggagccagactgtcca

SEQ ID NO: 4509630 - DNA, 15 bp, Homo sapiens
tgcgggatacagctg

SEQ ID NO: 4509631 - DNA, 22 bp, Homo sapiens
tgcgggcgcgggcagccaccca

SEQ ID NO: 4509632 - DNA, 16 bp, Homo sapiens
tgcgggctgaggccag

SEQ ID NO: 4509633 - DNA, 17 bp, Homo sapiens
tgcgggcttttccccgg

SEQ ID NO: 4509634 - DNA, 17 bp, Homo sapiens
tgcggtatccgccccca

SEQ ID NO: 4509635 - DNA, 21 bp, Homo sapiens
tgcggttaattttgaagtgct

SEQ ID NO: 4509636 - DNA, 17 bp, Homo sapiens
tgcgtaaggatgtgtga

SEQ ID NO: 4509637 - DNA, 18 bp, Homo sapiens
tgcgtagaagatatggaa

SEQ ID NO: 4509638 - DNA, 16 bp, Homo sapiens
tgcgtatgcagtgtag

SEQ ID NO: 4509639 - DNA, 17 bp, Homo sapiens
tgcgtccaccctgagct

SEQ ID NO: 4509640 - DNA, 19 bp, Homo sapiens
tgcgtccacgagctgttta

SEQ ID NO: 4509641 - DNA, 14 bp, Homo sapiens
tgcgtcccagcctg

SEQ ID NO: 4509642 - DNA, 23 bp, Homo sapiens
tgcgtccccccccaacctttccc

SEQ ID NO: 4509643 - DNA, 14 bp, Homo sapiens
tgcgtcctcctcac

SEQ ID NO: 4509644 - DNA, 19 bp, Homo sapiens
tgcgtcctcctcacctcat

SEQ ID NO: 4509645 - DNA, 22 bp, Homo sapiens
tgcgtgttccagccaaagcatg

SEQ ID NO: 4509646 - DNA, 23 bp, Homo sapiens
tgcgtgttccagccaaagcatgc

SEQ ID NO: 4509647 - DNA, 22 bp, Homo sapiens
tgcgtgtttgggtttttttcct

SEQ ID NO: 4509648 - DNA, 18 bp, Homo sapiens
tgctaaagggagaaatgc

SEQ ID NO: 4509649 - DNA, 13 bp, Homo sapiens
tgctaacaaagac

SEQ ID NO: 4509650 - DNA, 13 bp, Homo sapiens
tgctaagactaac

SEQ ID NO: 4509651 - DNA, 13 bp, Homo sapiens
tgctaagagaagt

SEQ ID NO: 4509652 - DNA, 14 bp, Homo sapiens
tgctaaggcagctg

SEQ ID NO: 4509653 - DNA, 21 bp, Homo sapiens
tgctaatatactttttttgtt

SEQ ID NO: 4509654 - DNA, 18 bp, Homo sapiens
tgctaattcccaacattt

SEQ ID NO: 4509655 - DNA, 14 bp, Homo sapiens
tgctaatttagaga

SEQ ID NO: 4509656 - DNA, 16 bp, Homo sapiens
tgctacaaaaacacag

SEQ ID NO: 4509657 - DNA, 16 bp, Homo sapiens
tgctacatcagactct

SEQ ID NO: 4509658 - DNA, 17 bp, Homo sapiens
tgctacatcagactcta

SEQ ID NO: 4509659 - DNA, 18 bp, Homo sapiens
tgctacatcagactctag

SEQ ID NO: 4509660 - DNA, 24 bp, Homo sapiens
tgctacatgacgacaaagctgcta

SEQ ID NO: 4509661 - DNA, 14 bp, Homo sapiens
tgctcttttgtgat

SEQ ID NO: 4509662 - DNA, 17 bp, Homo sapiens
tgctgaaactgcccact

SEQ ID NO: 4509663 - DNA, 13 bp, Homo sapiens
tgctgaactcagc

SEQ ID NO: 4509664 - DNA, 19 bp, Homo sapiens
tgctgaactcagcacattc

SEQ ID NO: 4509665 - DNA, 17 bp, Homo sapiens
tgctgaaggagatgagt

SEQ ID NO: 4509666 - DNA, 22 bp, Homo sapiens
tgctgaattgagaataagaatt

SEQ ID NO: 4509667 - DNA, 14 bp, Homo sapiens
tgctgaccttggag

SEQ ID NO: 4509668 - DNA, 18 bp, Homo sapiens
tgctgactggcttcagca

SEQ ID NO: 4509669 - DNA, 15 bp, Homo sapiens
tgctgagagacccaa

SEQ ID NO: 4509670 - DNA, 21 bp, Homo sapiens
tgctgagatgaggaggggagc

SEQ ID NO: 4509671 - DNA, 13 bp, Homo sapiens
tgctgagccagct

SEQ ID NO: 4509672 - DNA, 18 bp, Homo sapiens
tgctgagccagctgcaga

SEQ ID NO: 4509673 - DNA, 16 bp, Homo sapiens
tgctgagtaaacataa

SEQ ID NO: 4509674 - DNA, 14 bp, Homo sapiens
tgctgagttggcct

SEQ ID NO: 4509675 - DNA, 16 bp, Homo sapiens
tgctgagttggcctgg

SEQ ID NO: 4509676 - DNA, 17 bp, Homo sapiens
tgctgatggagccttcc

SEQ ID NO: 4509677 - DNA, 19 bp, Homo sapiens
tgctgatgggttcttagag

SEQ ID NO: 4509678 - DNA, 17 bp, Homo sapiens
tgctgattatttatgac

SEQ ID NO: 4509679 - DNA, 15 bp, Homo sapiens
tgctgattcttgtaa

SEQ ID NO: 4509680 - DNA, 16 bp, Homo sapiens
tgctgattcttgtaaa

SEQ ID NO: 4509681 - DNA, 17 bp, Homo sapiens
tgctgattcttgtaaat

SEQ ID NO: 4509682 - DNA, 20 bp, Homo sapiens
tgctgattcttgtaaatctt

SEQ ID NO: 4509683 - DNA, 16 bp, Homo sapiens
tgctgattttaatgga

SEQ ID NO: 4509684 - DNA, 13 bp, Homo sapiens
tgctgcaaacctg

SEQ ID NO: 4509685 - DNA, 22 bp, Homo sapiens
tgctgcaacaagctcatccctg

SEQ ID NO: 4509686 - DNA, 23 bp, Homo sapiens
tgctgcagattagttctttttgc

SEQ ID NO: 4509687 - DNA, 20 bp, Homo sapiens
tgctgcagtcacatcacaat

SEQ ID NO: 4509688 - DNA, 18 bp, Homo sapiens
tgctgcagtcatctactt

SEQ ID NO: 4509689 - DNA, 22 bp, Homo sapiens
tgctgccaccacttttggattt

SEQ ID NO: 4509690 - DNA, 13 bp, Homo sapiens
tgctgcccatgag

SEQ ID NO: 4509691 - DNA, 19 bp, Homo sapiens
tgctgccccatcagtgctc

SEQ ID NO: 4509692 - DNA, 21 bp, Homo sapiens
tgctgccccatcagtgctccc

SEQ ID NO: 4509693 - DNA, 20 bp, Homo sapiens
tgctgcccccaccccgggga

SEQ ID NO: 4509694 - DNA, 22 bp, Homo sapiens
tgctgcccccaccccggggacc

SEQ ID NO: 4509695 - DNA, 19 bp, Homo sapiens
tgctgcccctgtctggaag

SEQ ID NO: 4509696 - DNA, 23 bp, Homo sapiens
tgctgcccgcgggagacagcttc

SEQ ID NO: 4509697 - DNA, 15 bp, Homo sapiens
tgctgccctgttgcc

SEQ ID NO: 4509698 - DNA, 13 bp, Homo sapiens
tgctgccgagggc

SEQ ID NO: 4509699 - DNA, 14 bp, Homo sapiens
tgctgccgccgccg

SEQ ID NO: 4509700 - DNA, 13 bp, Homo sapiens
tgctgcctaataa

SEQ ID NO: 4509701 - DNA, 14 bp, Homo sapiens
tgctgcctaataaa

SEQ ID NO: 4509702 - DNA, 17 bp, Homo sapiens
tgctgcctaataaagag

SEQ ID NO: 4509703 - DNA, 12 bp, Homo sapiens
tgctgccttcag

SEQ ID NO: 4509704 - DNA, 16 bp, Homo sapiens
tgctgccttcagggag

SEQ ID NO: 4509705 - DNA, 22 bp, Homo sapiens
tgctgccttcagggagacaggc

SEQ ID NO: 4509706 - DNA, 16 bp, Homo sapiens
tgctgcgcctgcaggc

SEQ ID NO: 4509707 - DNA, 22 bp, Homo sapiens
tgctgcgcctgcaggcagagct

SEQ ID NO: 4509708 - DNA, 13 bp, Homo sapiens
tgctgctctccca

SEQ ID NO: 4509709 - DNA, 12 bp, Homo sapiens
tgctgctgcccc

SEQ ID NO: 4509710 - DNA, 19 bp, Homo sapiens
tgctgctgcccctgcacag

SEQ ID NO: 4509711 - DNA, 14 bp, Homo sapiens
tgctgctgcccctt

SEQ ID NO: 4509712 - DNA, 21 bp, Homo sapiens
tgctgcttctgaatacaaatt

SEQ ID NO: 4509713 - DNA, 15 bp, Homo sapiens
tgctgctttgggctg

SEQ ID NO: 4509714 - DNA, 19 bp, Homo sapiens
tgctggaacacaggggcct

SEQ ID NO: 4509715 - DNA, 21 bp, Homo sapiens
tgctggactgttccaggccct

SEQ ID NO: 4509716 - DNA, 13 bp, Homo sapiens
tgctggagctctg

SEQ ID NO: 4509717 - DNA, 13 bp, Homo sapiens
tgctggaggggtg

SEQ ID NO: 4509718 - DNA, 23 bp, Homo sapiens
tgctggaggggtggcccagagcc

SEQ ID NO: 4509719 - DNA, 20 bp, Homo sapiens
tgctggagtttcatgtacaa

SEQ ID NO: 4509720 - DNA, 18 bp, Homo sapiens
tgctggagttttgttggt

SEQ ID NO: 4509721 - DNA, 14 bp, Homo sapiens
tgctggccagcacc

SEQ ID NO: 4509722 - DNA, 15 bp, Homo sapiens
tgctggccagcaccc

SEQ ID NO: 4509723 - DNA, 16 bp, Homo sapiens
tgctggccagcaccct

SEQ ID NO: 4509724 - DNA, 17 bp, Homo sapiens
tgctggccagcaccctc

SEQ ID NO: 4509725 - DNA, 18 bp, Homo sapiens
tgctggccagcaccctct

SEQ ID NO: 4509726 - DNA, 22 bp, Homo sapiens
tgctggccccgcccctgccccc

SEQ ID NO: 4509727 - DNA, 17 bp, Homo sapiens
tgctggccgcctcaccc

SEQ ID NO: 4509728 - DNA, 15 bp, Homo sapiens
tgctggcgcctctgc

SEQ ID NO: 4509729 - DNA, 20 bp, Homo sapiens
tgctgggaggagggagaggg

SEQ ID NO: 4509730 - DNA, 23 bp, Homo sapiens
tgctgggattaaggcgtgagcca

SEQ ID NO: 4509731 - DNA, 20 bp, Homo sapiens
tgctgggattacaggtgtga

SEQ ID NO: 4509732 - DNA, 16 bp, Homo sapiens
tgctgggatttccaac

SEQ ID NO: 4509733 - DNA, 15 bp, Homo sapiens
tgctgggcagaggga

SEQ ID NO: 4509734 - DNA, 17 bp, Homo sapiens
tgctgggccactgggga

SEQ ID NO: 4509735 - DNA, 20 bp, Homo sapiens
tgctgggccactggggactt

SEQ ID NO: 4509736 - DNA, 17 bp, Homo sapiens
tgctgggctctccacct

SEQ ID NO: 4509737 - DNA, 20 bp, Homo sapiens
tgctgggctctccacctcag

SEQ ID NO: 4509738 - DNA, 15 bp, Homo sapiens
tgctgggctgggccc

SEQ ID NO: 4509739 - DNA, 20 bp, Homo sapiens
tgctggggaagaacagcccc

SEQ ID NO: 4509740 - DNA, 13 bp, Homo sapiens
tgctgggggagcc

SEQ ID NO: 4509741 - DNA, 21 bp, Homo sapiens
tgctgggggagccctgggttc

SEQ ID NO: 4509742 - DNA, 13 bp, Homo sapiens
tgctgggtctgag

SEQ ID NO: 4509743 - DNA, 19 bp, Homo sapiens
tgctgggtctgaggcccct

SEQ ID NO: 4509744 - DNA, 20 bp, Homo sapiens
tgctgggtctgaggcccctg

SEQ ID NO: 4509745 - DNA, 23 bp, Homo sapiens
tgctgggtctgaggcccctgcct

SEQ ID NO: 4509746 - DNA, 15 bp, Homo sapiens
tgctggtcagagaga

SEQ ID NO: 4509747 - DNA, 15 bp, Homo sapiens
tgctggtttttcagt

SEQ ID NO: 4509748 - DNA, 16 bp, Homo sapiens
tgctgtaaaatttgtg

SEQ ID NO: 4509749 - DNA, 17 bp, Homo sapiens
tgctgtaaaatttgtgt

SEQ ID NO: 4509750 - DNA, 17 bp, Homo sapiens
tgctgtacatctatttt

SEQ ID NO: 4509751 - DNA, 19 bp, Homo sapiens
tgctgtactctttgctagt

SEQ ID NO: 4509752 - DNA, 23 bp, Homo sapiens
tgctgtatccatccatggggctg

SEQ ID NO: 4509753 - DNA, 16 bp, Homo sapiens
tgctgtatttctttgt

SEQ ID NO: 4509754 - DNA, 16 bp, Homo sapiens
tgctgtattttgatat

SEQ ID NO: 4509755 - DNA, 22 bp, Homo sapiens
tgctgtcaacttcccatctggc

SEQ ID NO: 4509756 - DNA, 16 bp, Homo sapiens
tgctgtcatggtcctt

SEQ ID NO: 4509757 - DNA, 21 bp, Homo sapiens
tgctgtccagacagcctgtat

SEQ ID NO: 4509758 - DNA, 17 bp, Homo sapiens
tgctgtccatgcttctc

SEQ ID NO: 4509759 - DNA, 15 bp, Homo sapiens
tgctgtccccactgc

SEQ ID NO: 4509760 - DNA, 21 bp, Homo sapiens
tgctgtcgttgttgtggaagc

SEQ ID NO: 4509761 - DNA, 21 bp, Homo sapiens
tgctgtctgagtagtggccac

SEQ ID NO: 4509762 - DNA, 15 bp, Homo sapiens
tgctgtctgggactc

SEQ ID NO: 4509763 - DNA, 20 bp, Homo sapiens
tgctgtcttttgttctctga

SEQ ID NO: 4509764 - DNA, 17 bp, Homo sapiens
tgctgtgagggagggga

SEQ ID NO: 4509765 - DNA, 23 bp, Homo sapiens
tgctgtgagggaggggaaaagca

SEQ ID NO: 4509766 - DNA, 19 bp, Homo sapiens
tgctgtgccatgctgggcc

SEQ ID NO: 4509767 - DNA, 20 bp, Homo sapiens
tgctgtgccatgctgggcca

SEQ ID NO: 4509768 - DNA, 16 bp, Homo sapiens
tgctgtgctctgggga

SEQ ID NO: 4509769 - DNA, 12 bp, Homo sapiens
tgctgtgctgct

SEQ ID NO: 4509770 - DNA, 14 bp, Homo sapiens
tgctgtgctgctca

SEQ ID NO: 4509771 - DNA, 22 bp, Homo sapiens
tgctgtggaactacattactgt

SEQ ID NO: 4509772 - DNA, 13 bp, Homo sapiens
tgctgtggaagca

SEQ ID NO: 4509773 - DNA, 11 bp, Homo sapiens
tgctgtgggca

SEQ ID NO: 4509774 - DNA, 13 bp, Homo sapiens
tgctgtgggcagc

SEQ ID NO: 4509775 - DNA, 17 bp, Homo sapiens
tgctgtgggcagcaccc

SEQ ID NO: 4509776 - DNA, 18 bp, Homo sapiens
tgctgtgggcagcaccct

SEQ ID NO: 4509777 - DNA, 12 bp, Homo sapiens
tgctgtgtaaaa

SEQ ID NO: 4509778 - DNA, 15 bp, Homo sapiens
tgctgtgtgcttttt

SEQ ID NO: 4509779 - DNA, 22 bp, Homo sapiens
tgctgttaactgcaaccttgtt

SEQ ID NO: 4509780 - DNA, 14 bp, Homo sapiens
tgctgttatgtttt

SEQ ID NO: 4509781 - DNA, 14 bp, Homo sapiens
tgctgttctcagga

SEQ ID NO: 4509782 - DNA, 22 bp, Homo sapiens
tgctgttctcttgggaactgaa

SEQ ID NO: 4509783 - DNA, 21 bp, Homo sapiens
tgctgttgacatatttaatgt

SEQ ID NO: 4509784 - DNA, 22 bp, Homo sapiens
tgctgttgctgctactgtctta

SEQ ID NO: 4509785 - DNA, 21 bp, Homo sapiens
tgctgttgggtttttgctgtt

SEQ ID NO: 4509786 - DNA, 17 bp, Homo sapiens
tgctgtttattaatctt

SEQ ID NO: 4509787 - DNA, 17 bp, Homo sapiens
tgctgtttgacacctct

SEQ ID NO: 4509788 - DNA, 14 bp, Homo sapiens
tgctgtttgcttgt

SEQ ID NO: 4509789 - DNA, 16 bp, Homo sapiens
tgctgtttgtagtgaa

SEQ ID NO: 4509790 - DNA, 13 bp, Homo sapiens
tgctgttttctgt

SEQ ID NO: 4509791 - DNA, 19 bp, Homo sapiens
tgctgttttctgtaaattc

SEQ ID NO: 4509792 - DNA, 20 bp, Homo sapiens
tgctgttttctgtaaattca

SEQ ID NO: 4509793 - DNA, 21 bp, Homo sapiens
tgctgttttctgtaaattcat

SEQ ID NO: 4509794 - DNA, 15 bp, Homo sapiens
tgcttaaaaatactt

SEQ ID NO: 4509795 - DNA, 23 bp, Homo sapiens
tgcttaaaagcatttttattata

SEQ ID NO: 4509796 - DNA, 12 bp, Homo sapiens
tgcttaaaatat

SEQ ID NO: 4509797 - DNA, 15 bp, Homo sapiens
tgcttaaaatatgtg

SEQ ID NO: 4509798 - DNA, 22 bp, Homo sapiens
tgcttaaatttcttatgtgaca

SEQ ID NO: 4509799 - DNA, 13 bp, Homo sapiens
tgcttaaatttta

SEQ ID NO: 4509800 - DNA, 16 bp, Homo sapiens
tgcttaaattttaact

SEQ ID NO: 4509801 - DNA, 14 bp, Homo sapiens
tgcttacctaattt

SEQ ID NO: 4509802 - DNA, 16 bp, Homo sapiens
tgcttagatgttccaa

SEQ ID NO: 4509803 - DNA, 16 bp, Homo sapiens
tgcttagtaaaattta

SEQ ID NO: 4509804 - DNA, 12 bp, Homo sapiens
tgcttagtaagt

SEQ ID NO: 4509805 - DNA, 14 bp, Homo sapiens
tgcttattgcttag

SEQ ID NO: 4509806 - DNA, 21 bp, Homo sapiens
tgcttcacaggttttatgtgt

SEQ ID NO: 4509807 - DNA, 20 bp, Homo sapiens
tgcttcactcatgcaaactg

SEQ ID NO: 4509808 - DNA, 21 bp, Homo sapiens
tgcttcactcatgcaaactgc

SEQ ID NO: 4509809 - DNA, 16 bp, Homo sapiens
tgcttcacttctccca

SEQ ID NO: 4509810 - DNA, 20 bp, Homo sapiens
tgcttcatttgtatgtcaaa

SEQ ID NO: 4509811 - DNA, 23 bp, Homo sapiens
tgcttcccattgtggctcctatc

SEQ ID NO: 4509812 - DNA, 11 bp, Homo sapiens
tgcttcctaca

SEQ ID NO: 4509813 - DNA, 14 bp, Homo sapiens
tgcttctacatgat

SEQ ID NO: 4509814 - DNA, 21 bp, Homo sapiens
tgcttctccaaaaatctgcct

SEQ ID NO: 4509815 - DNA, 13 bp, Homo sapiens
tgcttctccccag

SEQ ID NO: 4509816 - DNA, 16 bp, Homo sapiens
tgcttctccccagaat

SEQ ID NO: 4509817 - DNA, 13 bp, Homo sapiens
tgcttctctttgt

SEQ ID NO: 4509818 - DNA, 16 bp, Homo sapiens
tgcttctgaatacaaa

SEQ ID NO: 4509819 - DNA, 21 bp, Homo sapiens
tgcttcttggagctttggaat

SEQ ID NO: 4509820 - DNA, 13 bp, Homo sapiens
tgcttctttccag

SEQ ID NO: 4509821 - DNA, 16 bp, Homo sapiens
tgcttctttccagaaa

SEQ ID NO: 4509822 - DNA, 14 bp, Homo sapiens
tgcttctttctaga

SEQ ID NO: 4509823 - DNA, 15 bp, Homo sapiens
tgcttctttctagaa

SEQ ID NO: 4509824 - DNA, 16 bp, Homo sapiens
tgcttgaacacagtat

SEQ ID NO: 4509825 - DNA, 20 bp, Homo sapiens
tgcttgaacacagtattttc

SEQ ID NO: 4509826 - DNA, 14 bp, Homo sapiens
tgcttgacatacct

SEQ ID NO: 4509827 - DNA, 21 bp, Homo sapiens
tgcttgagccaggaggcctgc

SEQ ID NO: 4509828 - DNA, 22 bp, Homo sapiens
tgcttgatccagaagagcccat

SEQ ID NO: 4509829 - DNA, 18 bp, Homo sapiens
tgcttgcatctgcacata

SEQ ID NO: 4509830 - DNA, 18 bp, Homo sapiens
tgcttgccaaagtacaga

SEQ ID NO: 4509831 - DNA, 18 bp, Homo sapiens
tgcttgcccgctcccaca

SEQ ID NO: 4509832 - DNA, 18 bp, Homo sapiens
tgcttgcggcaaaaggaa

SEQ ID NO: 4509833 - DNA, 21 bp, Homo sapiens
tgcttgcggcaaaaggaaagc

SEQ ID NO: 4509834 - DNA, 18 bp, Homo sapiens
tgcttggagcaatcagaa

SEQ ID NO: 4509835 - DNA, 23 bp, Homo sapiens
tgcttgggaatgaaattaacaca

SEQ ID NO: 4509836 - DNA, 23 bp, Homo sapiens
tgcttgggagcctgtggccagca

SEQ ID NO: 4509837 - DNA, 14 bp, Homo sapiens
tgcttgggctccac

SEQ ID NO: 4509838 - DNA, 18 bp, Homo sapiens
tgcttggttggctggcag

SEQ ID NO: 4509839 - DNA, 14 bp, Homo sapiens
tgcttgtatagctt

SEQ ID NO: 4509840 - DNA, 19 bp, Homo sapiens
tgcttgtattgtaaatgtg

SEQ ID NO: 4509841 - DNA, 17 bp, Homo sapiens
tgcttgttagagagaaa

SEQ ID NO: 4509842 - DNA, 19 bp, Homo sapiens
tgcttgttagagagaaaga

SEQ ID NO: 4509843 - DNA, 13 bp, Homo sapiens
tgcttgtttatga

SEQ ID NO: 4509844 - DNA, 14 bp, Homo sapiens
tgcttgtttatgat

SEQ ID NO: 4509845 - DNA, 18 bp, Homo sapiens
tgcttgtttatgatattt

SEQ ID NO: 4509846 - DNA, 20 bp, Homo sapiens
tgctttaaatagatttcagc

SEQ ID NO: 4509847 - DNA, 16 bp, Homo sapiens
tgctttaacttttaaa

SEQ ID NO: 4509848 - DNA, 17 bp, Homo sapiens
tgctttattccagaatg

SEQ ID NO: 4509849 - DNA, 19 bp, Homo sapiens
tgctttattgaattagaaa

SEQ ID NO: 4509850 - DNA, 15 bp, Homo sapiens
tgctttattttccct

SEQ ID NO: 4509851 - DNA, 23 bp, Homo sapiens
tgctttcaagatctaaatcatat

SEQ ID NO: 4509852 - DNA, 12 bp, Homo sapiens
tgctttccagct

SEQ ID NO: 4509853 - DNA, 13 bp, Homo sapiens
tgctttccagctc

SEQ ID NO: 4509854 - DNA, 15 bp, Homo sapiens
tgctttcctatctag

SEQ ID NO: 4509855 - DNA, 15 bp, Homo sapiens
tgctttcctgcagca

SEQ ID NO: 4509856 - DNA, 17 bp, Homo sapiens
tgctttcctgcatctct

SEQ ID NO: 4509857 - DNA, 14 bp, Homo sapiens
tgctttcctgggcc

SEQ ID NO: 4509858 - DNA, 16 bp, Homo sapiens
tgctttccttcatctc

SEQ ID NO: 4509859 - DNA, 18 bp, Homo sapiens
tgctttcgaactgctagt

SEQ ID NO: 4509860 - DNA, 19 bp, Homo sapiens
tgctttctatgctgtttgt

SEQ ID NO: 4509861 - DNA, 13 bp, Homo sapiens
tgctttctattgt

SEQ ID NO: 4509862 - DNA, 20 bp, Homo sapiens
tgctttctcctttaattgta

SEQ ID NO: 4509863 - DNA, 18 bp, Homo sapiens
tgctttctctctcatgcc

SEQ ID NO: 4509864 - DNA, 14 bp, Homo sapiens
tgctttctgttcca

SEQ ID NO: 4509865 - DNA, 17 bp, Homo sapiens
tgctttctgttccaaat

SEQ ID NO: 4509866 - DNA, 16 bp, Homo sapiens
tgctttcttacctact

SEQ ID NO: 4509867 - DNA, 17 bp, Homo sapiens
tgctttgaaaaatctca

SEQ ID NO: 4509868 - DNA, 21 bp, Homo sapiens
tgctttgagtccacgcccacc

SEQ ID NO: 4509869 - DNA, 20 bp, Homo sapiens
tgctttgcatctttgttact

SEQ ID NO: 4509870 - DNA, 17 bp, Homo sapiens
tgctttgccaaaatacc

SEQ ID NO: 4509871 - DNA, 22 bp, Homo sapiens
tgctttggaaaaatgggtcttt

SEQ ID NO: 4509872 - DNA, 12 bp, Homo sapiens
tgctttggaaac

SEQ ID NO: 4509873 - DNA, 18 bp, Homo sapiens
tgctttggttaatacatc

SEQ ID NO: 4509874 - DNA, 22 bp, Homo sapiens
tgctttgttaaaaaaaaaaaga

SEQ ID NO: 4509875 - DNA, 13 bp, Homo sapiens
tgcttttaagttt

SEQ ID NO: 4509876 - DNA, 15 bp, Homo sapiens
tgcttttatattcta

SEQ ID NO: 4509877 - DNA, 18 bp, Homo sapiens
tgcttttccctttgtgag

SEQ ID NO: 4509878 - DNA, 14 bp, Homo sapiens
tgcttttctaatta

SEQ ID NO: 4509879 - DNA, 18 bp, Homo sapiens
tgcttttctgccctggct

SEQ ID NO: 4509880 - DNA, 17 bp, Homo sapiens
tgcttttgcagaaatca

SEQ ID NO: 4509881 - DNA, 14 bp, Homo sapiens
tgcttttgcttcta

SEQ ID NO: 4509882 - DNA, 18 bp, Homo sapiens
tgctttttatttctgcat

SEQ ID NO: 4509883 - DNA, 23 bp, Homo sapiens
tgctttttttgtgtgtatttgct

SEQ ID NO: 4509884 - DNA, 16 bp, Homo sapiens
tggaaaaacagcatgt

SEQ ID NO: 4509885 - DNA, 13 bp, Homo sapiens
tggaaaaatgcca

SEQ ID NO: 4509886 - DNA, 13 bp, Homo sapiens
tggaaaaatgccc

SEQ ID NO: 4509887 - DNA, 21 bp, Homo sapiens
tggaaaaatgggtcttttata

SEQ ID NO: 4509888 - DNA, 17 bp, Homo sapiens
tggaaaacaaggaagtc

SEQ ID NO: 4509889 - DNA, 20 bp, Homo sapiens
tggaaaactgtgttgccaca

SEQ ID NO: 4509890 - DNA, 18 bp, Homo sapiens
tggaaaagtgatgtattt

SEQ ID NO: 4509891 - DNA, 21 bp, Homo sapiens
tggaaaagtgatgtattttca

SEQ ID NO: 4509892 - DNA, 22 bp, Homo sapiens
tggaaaataagacaatagtatt

SEQ ID NO: 4509893 - DNA, 18 bp, Homo sapiens
tggaaaatgccatgaatt

SEQ ID NO: 4509894 - DNA, 15 bp, Homo sapiens
tggaaaattcatttt

SEQ ID NO: 4509895 - DNA, 18 bp, Homo sapiens
tggaaacattttttaaaa

SEQ ID NO: 4509896 - DNA, 19 bp, Homo sapiens
tggaaaccttccacccagt

SEQ ID NO: 4509897 - DNA, 17 bp, Homo sapiens
tggaaactcaaggaaaa

SEQ ID NO: 4509898 - DNA, 13 bp, Homo sapiens
tggaaaggggaga

SEQ ID NO: 4509899 - DNA, 14 bp, Homo sapiens
tggaaaggggagag

SEQ ID NO: 4509900 - DNA, 23 bp, Homo sapiens
tggaaaggggagagcctgctggc

SEQ ID NO: 4509901 - DNA, 20 bp, Homo sapiens
tggaaagtacactctgctgt

SEQ ID NO: 4509902 - DNA, 21 bp, Homo sapiens
tggaaagtgccagcattccag

SEQ ID NO: 4509903 - DNA, 22 bp, Homo sapiens
tggaaagtgccagcattccaga

SEQ ID NO: 4509904 - DNA, 16 bp, Homo sapiens
tggaaagttttctcca

SEQ ID NO: 4509905 - DNA, 15 bp, Homo sapiens
tggaaataaaaatgt

SEQ ID NO: 4509906 - DNA, 12 bp, Homo sapiens
tggaaataaagt

SEQ ID NO: 4509907 - DNA, 22 bp, Homo sapiens
tggaaatagaaagaagccatat

SEQ ID NO: 4509908 - DNA, 22 bp, Homo sapiens
tggaaatatcagttactcagcc

SEQ ID NO: 4509909 - DNA, 22 bp, Homo sapiens
tggaaatcagtagaaagctaaa

SEQ ID NO: 4509910 - DNA, 22 bp, Homo sapiens
tggaaatctcagattcttcact

SEQ ID NO: 4509911 - DNA, 19 bp, Homo sapiens
tggaaatggatgcaaagta

SEQ ID NO: 4509912 - DNA, 17 bp, Homo sapiens
tggaaatgtagcactta

SEQ ID NO: 4509913 - DNA, 16 bp, Homo sapiens
tggaaatttataatat

SEQ ID NO: 4509914 - DNA, 23 bp, Homo sapiens
tggaaatttataatataaatata

SEQ ID NO: 4509915 - DNA, 23 bp, Homo sapiens
tggaaattttatatgtaaatgtg

SEQ ID NO: 4509916 - DNA, 16 bp, Homo sapiens
tggaacaaagtgaagg

SEQ ID NO: 4509917 - DNA, 20 bp, Homo sapiens
tggaacaacttgtagcagct

SEQ ID NO: 4509918 - DNA, 15 bp, Homo sapiens
tggaacagatttcaa

SEQ ID NO: 4509919 - DNA, 18 bp, Homo sapiens
tggaacataaaaaggaca

SEQ ID NO: 4509920 - DNA, 20 bp, Homo sapiens
tggaacataaaatacaatgt

SEQ ID NO: 4509921 - DNA, 12 bp, Homo sapiens
tggaaccagccc

SEQ ID NO: 4509922 - DNA, 16 bp, Homo sapiens
tggaacctgcaaaaaa

SEQ ID NO: 4509923 - DNA, 17 bp, Homo sapiens
tggaaccttccctccaa

SEQ ID NO: 4509924 - DNA, 13 bp, Homo sapiens
tggaactctgctt

SEQ ID NO: 4509925 - DNA, 16 bp, Homo sapiens
tggaactgtgtattta

SEQ ID NO: 4509926 - DNA, 23 bp, Homo sapiens
tggaactgtgtttcaaatggact

SEQ ID NO: 4509927 - DNA, 16 bp, Homo sapiens
tggaacttagccattt

SEQ ID NO: 4509928 - DNA, 15 bp, Homo sapiens
tggaagaaccactgt

SEQ ID NO: 4509929 - DNA, 15 bp, Homo sapiens
tggaagaagggagaa

SEQ ID NO: 4509930 - DNA, 15 bp, Homo sapiens
tggaagaagtttttt

SEQ ID NO: 4509931 - DNA, 21 bp, Homo sapiens
tggaagaataaaattgcctct

SEQ ID NO: 4509932 - DNA, 23 bp, Homo sapiens
tggaagaataaaattgcctctct

SEQ ID NO: 4509933 - DNA, 23 bp, Homo sapiens
tggaagaggaacagcactgggga

SEQ ID NO: 4509934 - DNA, 18 bp, Homo sapiens
tggaagatagctgtgact

SEQ ID NO: 4509935 - DNA, 18 bp, Homo sapiens
tggaagcaacaggaatca

SEQ ID NO: 4509936 - DNA, 19 bp, Homo sapiens
tggaagcagaggccctgcc

SEQ ID NO: 4509937 - DNA, 20 bp, Homo sapiens
tggaagcagaggccctgccc

SEQ ID NO: 4509938 - DNA, 21 bp, Homo sapiens
tggaagcagaggccctgcccc

SEQ ID NO: 4509939 - DNA, 23 bp, Homo sapiens
tggaagcatgtagactgtgccag

SEQ ID NO: 4509940 - DNA, 21 bp, Homo sapiens
tggaagcatgtttattctgtt

SEQ ID NO: 4509941 - DNA, 18 bp, Homo sapiens
tggaagccagctttccct

SEQ ID NO: 4509942 - DNA, 17 bp, Homo sapiens
tggaagccctccttcca

SEQ ID NO: 4509943 - DNA, 23 bp, Homo sapiens
tggaagctagacacatgaaggta

SEQ ID NO: 4509944 - DNA, 14 bp, Homo sapiens
tggaaggacacagt

SEQ ID NO: 4509945 - DNA, 16 bp, Homo sapiens
tggaaggacacagtga

SEQ ID NO: 4509946 - DNA, 14 bp, Homo sapiens
tggaaggcagagaa

SEQ ID NO: 4509947 - DNA, 15 bp, Homo sapiens
tggaaggcagagaaa

SEQ ID NO: 4509948 - DNA, 18 bp, Homo sapiens
tggaaggcagagaaatct

SEQ ID NO: 4509949 - DNA, 17 bp, Homo sapiens
tggaagggtttgtggct

SEQ ID NO: 4509950 - DNA, 16 bp, Homo sapiens
tggaagtgtatttatt

SEQ ID NO: 4509951 - DNA, 14 bp, Homo sapiens
tggaagtgtgggtc

SEQ ID NO: 4509952 - DNA, 21 bp, Homo sapiens
tggaagtgtgggtctgtgtgt

SEQ ID NO: 4509953 - DNA, 23 bp, Homo sapiens
tggaagttgttgctatacatgtt

SEQ ID NO: 4509954 - DNA, 19 bp, Homo sapiens
tggaataaagatggtccaa

SEQ ID NO: 4509955 - DNA, 17 bp, Homo sapiens
tggaataaagttgcaga

SEQ ID NO: 4509956 - DNA, 18 bp, Homo sapiens
tggaataaagttgcagat

SEQ ID NO: 4509957 - DNA, 12 bp, Homo sapiens
tggaatactttt

SEQ ID NO: 4509958 - DNA, 15 bp, Homo sapiens
tggaatataaaacag

SEQ ID NO: 4509959 - DNA, 18 bp, Homo sapiens
tggaatataaggaaagca

SEQ ID NO: 4509960 - DNA, 16 bp, Homo sapiens
tggaatatggccaagg

SEQ ID NO: 4509961 - DNA, 12 bp, Homo sapiens
tggaatattaaa

SEQ ID NO: 4509962 - DNA, 14 bp, Homo sapiens
tggaatattttatc

SEQ ID NO: 4509963 - DNA, 17 bp, Homo sapiens
tggaatattttatcctg

SEQ ID NO: 4509964 - DNA, 19 bp, Homo sapiens
tggaatattttatcctgta

SEQ ID NO: 4509965 - DNA, 21 bp, Homo sapiens
tggaatattttatcctgtatt

SEQ ID NO: 4509966 - DNA, 20 bp, Homo sapiens
tggaatcaaggtaagctcag

SEQ ID NO: 4509967 - DNA, 22 bp, Homo sapiens
tggaatcctccttaatttaatt

SEQ ID NO: 4509968 - DNA, 18 bp, Homo sapiens
tggaatctacaagccaaa

SEQ ID NO: 4509969 - DNA, 13 bp, Homo sapiens
tggaatctggaga

SEQ ID NO: 4509970 - DNA, 15 bp, Homo sapiens
tggaatggatttttc

SEQ ID NO: 4509971 - DNA, 13 bp, Homo sapiens
tggaatggtgttt

SEQ ID NO: 4509972 - DNA, 20 bp, Homo sapiens
tggaatggtgttttgtcaga

SEQ ID NO: 4509973 - DNA, 14 bp, Homo sapiens
tggaatgtgccaca

SEQ ID NO: 4509974 - DNA, 15 bp, Homo sapiens
tggaatgtgccacag

SEQ ID NO: 4509975 - DNA, 16 bp, Homo sapiens
tggaatgtgccacaga

SEQ ID NO: 4509976 - DNA, 20 bp, Homo sapiens
tggaatgtgccacagaggcc

SEQ ID NO: 4509977 - DNA, 21 bp, Homo sapiens
tggaatgtgccacagaggccc

SEQ ID NO: 4509978 - DNA, 16 bp, Homo sapiens
tggaatgttggataag

SEQ ID NO: 4509979 - DNA, 21 bp, Homo sapiens
tggaatgttggataaggaatt

SEQ ID NO: 4509980 - DNA, 22 bp, Homo sapiens
tggaatgtttttccctccccag

SEQ ID NO: 4509981 - DNA, 17 bp, Homo sapiens
tggaattaaaaggatag

SEQ ID NO: 4509982 - DNA, 18 bp, Homo sapiens
tggaattacaagccctgg

SEQ ID NO: 4509983 - DNA, 17 bp, Homo sapiens
tggaattattgtagaca

SEQ ID NO: 4509984 - DNA, 18 bp, Homo sapiens
tggaattattgtagacat

SEQ ID NO: 4509985 - DNA, 18 bp, Homo sapiens
tggaattcagcagtttta

SEQ ID NO: 4509986 - DNA, 19 bp, Homo sapiens
tggaattgatttgcattga

SEQ ID NO: 4509987 - DNA, 22 bp, Homo sapiens
tggaatttctcccagtcattta

SEQ ID NO: 4509988 - DNA, 17 bp, Homo sapiens
tggaatttgcctgctgg

SEQ ID NO: 4509989 - DNA, 15 bp, Homo sapiens
tggaattttgcaaag

SEQ ID NO: 4509990 - DNA, 21 bp, Homo sapiens
tggacaaatcacatattttaa

SEQ ID NO: 4509991 - DNA, 14 bp, Homo sapiens
tggacaaggaggtc

SEQ ID NO: 4509992 - DNA, 16 bp, Homo sapiens
tggacaatcttatgtt

SEQ ID NO: 4509993 - DNA, 16 bp, Homo sapiens
tggacacattggaatg

SEQ ID NO: 4509994 - DNA, 22 bp, Homo sapiens
tggacacattggaatgccttgg

SEQ ID NO: 4509995 - DNA, 16 bp, Homo sapiens
tggacacgagccacaa

SEQ ID NO: 4509996 - DNA, 21 bp, Homo sapiens
tggacacgagccacaagctgc

SEQ ID NO: 4509997 - DNA, 23 bp, Homo sapiens
tggacacttaatactaccttgaa

SEQ ID NO: 4509998 - DNA, 12 bp, Homo sapiens
tggacagacaga

SEQ ID NO: 4509999 - DNA, 12 bp, Homo sapiens
tggacagcagaa

SEQ ID NO: 4510000 - DNA, 16 bp, Homo sapiens
tggacagcagaagcct

SEQ ID NO: 4510001 - DNA, 19 bp, Homo sapiens
tggacagcagaagcctcca

SEQ ID NO: 4510002 - DNA, 19 bp, Homo sapiens
tggacagcagacaagaggg

SEQ ID NO: 4510003 - DNA, 13 bp, Homo sapiens
tggacagccagtg

SEQ ID NO: 4510004 - DNA, 19 bp, Homo sapiens
tggacaggatgaggacaga

SEQ ID NO: 4510005 - DNA, 18 bp, Homo sapiens
tggacagtacctgattgt

SEQ ID NO: 4510006 - DNA, 22 bp, Homo sapiens
tggacatgaagattctttccca

SEQ ID NO: 4510007 - DNA, 19 bp, Homo sapiens
tggacatttagaagaaaga

SEQ ID NO: 4510008 - DNA, 16 bp, Homo sapiens
tggacattttatgtct

SEQ ID NO: 4510009 - DNA, 21 bp, Homo sapiens
tggaccaacctgctctgtccc

SEQ ID NO: 4510010 - DNA, 17 bp, Homo sapiens
tggaccaagcacaaaaa

SEQ ID NO: 4510011 - DNA, 20 bp, Homo sapiens
tggaccaatagggctgagct

SEQ ID NO: 4510012 - DNA, 21 bp, Homo sapiens
tggaccaattattgatatata

SEQ ID NO: 4510013 - DNA, 21 bp, Homo sapiens
tggaccaccgttcagtcattt

SEQ ID NO: 4510014 - DNA, 22 bp, Homo sapiens
tggaccagcctctccactcatg

SEQ ID NO: 4510015 - DNA, 18 bp, Homo sapiens
tggaccaggacaggacca

SEQ ID NO: 4510016 - DNA, 15 bp, Homo sapiens
tggaccatgccagat

SEQ ID NO: 4510017 - DNA, 22 bp, Homo sapiens
tggacccatggtcatctctgtt

SEQ ID NO: 4510018 - DNA, 18 bp, Homo sapiens
tggaccgaaatctgtatt

SEQ ID NO: 4510019 - DNA, 22 bp, Homo sapiens
tggacctcagcaagctgcccag

SEQ ID NO: 4510020 - DNA, 13 bp, Homo sapiens
tggacctgtgctg

SEQ ID NO: 4510021 - DNA, 17 bp, Homo sapiens
tggacgctgcagacccc

SEQ ID NO: 4510022 - DNA, 15 bp, Homo sapiens
tggacggcaggctca

SEQ ID NO: 4510023 - DNA, 21 bp, Homo sapiens
tggacggcaggctcactgcca

SEQ ID NO: 4510024 - DNA, 23 bp, Homo sapiens
tggacggcaggctcactgccagg

SEQ ID NO: 4510025 - DNA, 12 bp, Homo sapiens
tggactacacaa

SEQ ID NO: 4510026 - DNA, 14 bp, Homo sapiens
tggactacacaata

SEQ ID NO: 4510027 - DNA, 21 bp, Homo sapiens
tggactccagcctgcctggca

SEQ ID NO: 4510028 - DNA, 18 bp, Homo sapiens
tggactccggaggactga

SEQ ID NO: 4510029 - DNA, 19 bp, Homo sapiens
tggactccggaggactgag

SEQ ID NO: 4510030 - DNA, 13 bp, Homo sapiens
tggactctcaggg

SEQ ID NO: 4510031 - DNA, 14 bp, Homo sapiens
tggactctcaggga

SEQ ID NO: 4510032 - DNA, 22 bp, Homo sapiens
tggactctcagtctctgagcag

SEQ ID NO: 4510033 - DNA, 21 bp, Homo sapiens
tggactctgaaatatcccggg

SEQ ID NO: 4510034 - DNA, 17 bp, Homo sapiens
tggactctgccccaatc

SEQ ID NO: 4510035 - DNA, 19 bp, Homo sapiens
tggactctgccccaatcgg

SEQ ID NO: 4510036 - DNA, 19 bp, Homo sapiens
tggactgagccaaggaggc

SEQ ID NO: 4510037 - DNA, 17 bp, Homo sapiens
tggactgagtgggaagc

SEQ ID NO: 4510038 - DNA, 13 bp, Homo sapiens
tggactggctaga

SEQ ID NO: 4510039 - DNA, 19 bp, Homo sapiens
tggactggctagagtcctc

SEQ ID NO: 4510040 - DNA, 17 bp, Homo sapiens
tggactgttccaggccc

SEQ ID NO: 4510041 - DNA, 18 bp, Homo sapiens
tggactgttccaggccct

SEQ ID NO: 4510042 - DNA, 22 bp, Homo sapiens
tggactgtttcaaggtccatgg

SEQ ID NO: 4510043 - DNA, 19 bp, Homo sapiens
tggacttaagcatctggct

SEQ ID NO: 4510044 - DNA, 17 bp, Homo sapiens
tggacttattcattcct

SEQ ID NO: 4510045 - DNA, 17 bp, Homo sapiens
tggactttgcacacttt

SEQ ID NO: 4510046 - DNA, 17 bp, Homo sapiens
tggagaaaaaaattgct

SEQ ID NO: 4510047 - DNA, 23 bp, Homo sapiens
tggagaaagccacgccctccctg

SEQ ID NO: 4510048 - DNA, 22 bp, Homo sapiens
tggagaaccagggctcttctca

SEQ ID NO: 4510049 - DNA, 22 bp, Homo sapiens
tggagaacccaggggacagctg

SEQ ID NO: 4510050 - DNA, 19 bp, Homo sapiens
tggagaactagaacctgga

SEQ ID NO: 4510051 - DNA, 13 bp, Homo sapiens
tggagaagattta

SEQ ID NO: 4510052 - DNA, 14 bp, Homo sapiens
tggagaagatttat

SEQ ID NO: 4510053 - DNA, 19 bp, Homo sapiens
tggagaagccacaggcctg

SEQ ID NO: 4510054 - DNA, 18 bp, Homo sapiens
tggagaattgctgaaggg

SEQ ID NO: 4510055 - DNA, 19 bp, Homo sapiens
tggagaattgctgaagggc

SEQ ID NO: 4510056 - DNA, 20 bp, Homo sapiens
tggagaccctgccacagcca

SEQ ID NO: 4510057 - DNA, 21 bp, Homo sapiens
tggagaccctgccacagccag

SEQ ID NO: 4510058 - DNA, 14 bp, Homo sapiens
tggagaccttaccc

SEQ ID NO: 4510059 - DNA, 19 bp, Homo sapiens
tggagactcctggtctgtg

SEQ ID NO: 4510060 - DNA, 20 bp, Homo sapiens
tggagactcctggtctgtga

SEQ ID NO: 4510061 - DNA, 16 bp, Homo sapiens
tggagactttgctgtt

SEQ ID NO: 4510062 - DNA, 21 bp, Homo sapiens
tggagagctagaacctggaga

SEQ ID NO: 4510063 - DNA, 15 bp, Homo sapiens
tggagaggcggcctc

SEQ ID NO: 4510064 - DNA, 14 bp, Homo sapiens
tggagataaaagca

SEQ ID NO: 4510065 - DNA, 21 bp, Homo sapiens
tggagataaaagcaattctga

SEQ ID NO: 4510066 - DNA, 17 bp, Homo sapiens
tggagatagtgccaggt

SEQ ID NO: 4510067 - DNA, 21 bp, Homo sapiens
tggagatagtgccaggtggct

SEQ ID NO: 4510068 - DNA, 21 bp, Homo sapiens
tggagatgcatcgggaaagaa

SEQ ID NO: 4510069 - DNA, 14 bp, Homo sapiens
tggagatgtaaaat

SEQ ID NO: 4510070 - DNA, 15 bp, Homo sapiens
tggagatgtaaaatg

SEQ ID NO: 4510071 - DNA, 21 bp, Homo sapiens
tggagattgggatactgtaat

SEQ ID NO: 4510072 - DNA, 15 bp, Homo sapiens
tggagcacaaaattc

SEQ ID NO: 4510073 - DNA, 14 bp, Homo sapiens
tggagcagaatcag

SEQ ID NO: 4510074 - DNA, 12 bp, Homo sapiens
tggagcagaggg

SEQ ID NO: 4510075 - DNA, 13 bp, Homo sapiens
tggagcagagggg

SEQ ID NO: 4510076 - DNA, 15 bp, Homo sapiens
tggagcatcaagcca

SEQ ID NO: 4510077 - DNA, 23 bp, Homo sapiens
tggagcattaactaaatgctcat

SEQ ID NO: 4510078 - DNA, 20 bp, Homo sapiens
tggagccaaaaaattgattc

SEQ ID NO: 4510079 - DNA, 21 bp, Homo sapiens
tggagcccataggccaccccc

SEQ ID NO: 4510080 - DNA, 16 bp, Homo sapiens
tggagccccagccccc

SEQ ID NO: 4510081 - DNA, 17 bp, Homo sapiens
tggagctcctccctcca

SEQ ID NO: 4510082 - DNA, 19 bp, Homo sapiens
tggagctcctccctccagc

SEQ ID NO: 4510083 - DNA, 20 bp, Homo sapiens
tggagctcctccctccagct

SEQ ID NO: 4510084 - DNA, 22 bp, Homo sapiens
tggagctcctccctccagctgc

SEQ ID NO: 4510085 - DNA, 21 bp, Homo sapiens
tggagctcttgggtcagagaa

SEQ ID NO: 4510086 - DNA, 15 bp, Homo sapiens
tggagctgtcacctc

SEQ ID NO: 4510087 - DNA, 13 bp, Homo sapiens
tggagctgtcatc

SEQ ID NO: 4510088 - DNA, 21 bp, Homo sapiens
tggagctgtgccgaggcttgg

SEQ ID NO: 4510089 - DNA, 18 bp, Homo sapiens
tggaggaagagccacctg

SEQ ID NO: 4510090 - DNA, 22 bp, Homo sapiens
tggaggaagagccacctgcaag

SEQ ID NO: 4510091 - DNA, 18 bp, Homo sapiens
tggaggaatacattttat

SEQ ID NO: 4510092 - DNA, 20 bp, Homo sapiens
tggaggacctttaggtcaaa

SEQ ID NO: 4510093 - DNA, 14 bp, Homo sapiens
tggaggaggaaggc

SEQ ID NO: 4510094 - DNA, 15 bp, Homo sapiens
tggaggaggaaggca

SEQ ID NO: 4510095 - DNA, 15 bp, Homo sapiens
tggaggaggcctggg

SEQ ID NO: 4510096 - DNA, 18 bp, Homo sapiens
tggaggaggcctgggggc

SEQ ID NO: 4510097 - DNA, 20 bp, Homo sapiens
tggaggattctttccccaga

SEQ ID NO: 4510098 - DNA, 23 bp, Homo sapiens
tggaggatttcctacccccgtcc

SEQ ID NO: 4510099 - DNA, 14 bp, Homo sapiens
tggaggcaatccta

SEQ ID NO: 4510100 - DNA, 14 bp, Homo sapiens
tggaggcaatgtgg

SEQ ID NO: 4510101 - DNA, 21 bp, Homo sapiens
tggaggccaccaagctgctct

SEQ ID NO: 4510102 - DNA, 23 bp, Homo sapiens
tggaggccaccaagctgctctcc

SEQ ID NO: 4510103 - DNA, 21 bp, Homo sapiens
tggaggccactgtttggaaat

SEQ ID NO: 4510104 - DNA, 18 bp, Homo sapiens
tggaggcccaggctggga

SEQ ID NO: 4510105 - DNA, 12 bp, Homo sapiens
tggaggctgccc

SEQ ID NO: 4510106 - DNA, 21 bp, Homo sapiens
tggagggaatgaacctggagg

SEQ ID NO: 4510107 - DNA, 13 bp, Homo sapiens
tggagggagggaa

SEQ ID NO: 4510108 - DNA, 20 bp, Homo sapiens
tggagggatcagttgccccc

SEQ ID NO: 4510109 - DNA, 19 bp, Homo sapiens
tggagggcaagccctgccc

SEQ ID NO: 4510110 - DNA, 20 bp, Homo sapiens
tggagggctagaacctggag

SEQ ID NO: 4510111 - DNA, 23 bp, Homo sapiens
tggagggctagaacctggagagc

SEQ ID NO: 4510112 - DNA, 21 bp, Homo sapiens
tggagggctagaactggagag

SEQ ID NO: 4510113 - DNA, 21 bp, Homo sapiens
tggagggctagaatctggaga

SEQ ID NO: 4510114 - DNA, 12 bp, Homo sapiens
tggagggctgga

SEQ ID NO: 4510115 - DNA, 22 bp, Homo sapiens
tggagggctggaatctggagag

SEQ ID NO: 4510116 - DNA, 13 bp, Homo sapiens
tggagggcttggc

SEQ ID NO: 4510117 - DNA, 20 bp, Homo sapiens
tggagggcttggcccagcgc

SEQ ID NO: 4510118 - DNA, 21 bp, Homo sapiens
tggaggggcttgggcctgcac

SEQ ID NO: 4510119 - DNA, 16 bp, Homo sapiens
tggaggggtggcccag

SEQ ID NO: 4510120 - DNA, 18 bp, Homo sapiens
tggaggggtggcccagag

SEQ ID NO: 4510121 - DNA, 23 bp, Homo sapiens
tggaggggtggcccagagccata

SEQ ID NO: 4510122 - DNA, 14 bp, Homo sapiens
tggaggggtgtggc

SEQ ID NO: 4510123 - DNA, 21 bp, Homo sapiens
tggagggtcccaagctgggcc

SEQ ID NO: 4510124 - DNA, 18 bp, Homo sapiens
tggaggtgcttgatctat

SEQ ID NO: 4510125 - DNA, 21 bp, Homo sapiens
tggaggtgtcaggctgctggc

SEQ ID NO: 4510126 - DNA, 13 bp, Homo sapiens
tggagtctgagtc

SEQ ID NO: 4510127 - DNA, 16 bp, Homo sapiens
tggagtctgagtctga

SEQ ID NO: 4510128 - DNA, 23 bp, Homo sapiens
tggagtctgtctctttcagtgct

SEQ ID NO: 4510129 - DNA, 19 bp, Homo sapiens
tggagtcttgtgaaagtgt

SEQ ID NO: 4510130 - DNA, 19 bp, Homo sapiens
tggagtgttccccttccac

SEQ ID NO: 4510131 - DNA, 22 bp, Homo sapiens
tggagtgttccccttccactga

SEQ ID NO: 4510132 - DNA, 13 bp, Homo sapiens
tggagttccttat

SEQ ID NO: 4510133 - DNA, 14 bp, Homo sapiens
tggagttccttatc

SEQ ID NO: 4510134 - DNA, 17 bp, Homo sapiens
tggagttccttctggtg

SEQ ID NO: 4510135 - DNA, 20 bp, Homo sapiens
tggagtttctctagaagctc

SEQ ID NO: 4510136 - DNA, 19 bp, Homo sapiens
tggagtttgggctggagct

SEQ ID NO: 4510137 - DNA, 21 bp, Homo sapiens
tggagtttttgtttggagagc

SEQ ID NO: 4510138 - DNA, 23 bp, Homo sapiens
tggagtttttgtttggagagcac

SEQ ID NO: 4510139 - DNA, 17 bp, Homo sapiens
tggataaattgtttagt

SEQ ID NO: 4510140 - DNA, 15 bp, Homo sapiens
tggataagtggctgt

SEQ ID NO: 4510141 - DNA, 19 bp, Homo sapiens
tggataagtttctattctg

SEQ ID NO: 4510142 - DNA, 23 bp, Homo sapiens
tggataataaagatactagagaa

SEQ ID NO: 4510143 - DNA, 13 bp, Homo sapiens
tggatactgtaga

SEQ ID NO: 4510144 - DNA, 22 bp, Homo sapiens
tggatacttggatttagtttca

SEQ ID NO: 4510145 - DNA, 13 bp, Homo sapiens
tggatagctaata

SEQ ID NO: 4510146 - DNA, 17 bp, Homo sapiens
tggatagctaataatga

SEQ ID NO: 4510147 - DNA, 13 bp, Homo sapiens
tggatatagaaaa

SEQ ID NO: 4510148 - DNA, 17 bp, Homo sapiens
tggatatgtaaaacatt

SEQ ID NO: 4510149 - DNA, 14 bp, Homo sapiens
tggatattgttacg

SEQ ID NO: 4510150 - DNA, 14 bp, Homo sapiens
tggatcacaaagtg

SEQ ID NO: 4510151 - DNA, 23 bp, Homo sapiens
tggatcacagaggcttcttcaga

SEQ ID NO: 4510152 - DNA, 23 bp, Homo sapiens
tggatcacctgaggtcaggagtt

SEQ ID NO: 4510153 - DNA, 17 bp, Homo sapiens
tggatcatagaattgca

SEQ ID NO: 4510154 - DNA, 14 bp, Homo sapiens
tggatcccaaagca

SEQ ID NO: 4510155 - DNA, 21 bp, Homo sapiens
tggatcccaaagcaaggagat

SEQ ID NO: 4510156 - DNA, 23 bp, Homo sapiens
tggatcctgctgctttgggctgg

SEQ ID NO: 4510157 - DNA, 23 bp, Homo sapiens
tggatctgggaccctttccttcc

SEQ ID NO: 4510158 - DNA, 19 bp, Homo sapiens
tggatctgtgaggggctct

SEQ ID NO: 4510159 - DNA, 20 bp, Homo sapiens
tggatcttcagaactgccct

SEQ ID NO: 4510160 - DNA, 21 bp, Homo sapiens
tggatcttcagaactgccctt

SEQ ID NO: 4510161 - DNA, 15 bp, Homo sapiens
tggatgatatacaca

SEQ ID NO: 4510162 - DNA, 16 bp, Homo sapiens
tggatgatatacacag

SEQ ID NO: 4510163 - DNA, 12 bp, Homo sapiens
tggatgcatttc

SEQ ID NO: 4510164 - DNA, 22 bp, Homo sapiens
tggatgcatttcaaatgttaga

SEQ ID NO: 4510165 - DNA, 21 bp, Homo sapiens
tggatgccaatattaaatctg

SEQ ID NO: 4510166 - DNA, 20 bp, Homo sapiens
tggatgcctcattatgtcaa

SEQ ID NO: 4510167 - DNA, 12 bp, Homo sapiens
tggatgccttga

SEQ ID NO: 4510168 - DNA, 15 bp, Homo sapiens
tggatggtccagtgt

SEQ ID NO: 4510169 - DNA, 14 bp, Homo sapiens
tggatggtgtgcct

SEQ ID NO: 4510170 - DNA, 12 bp, Homo sapiens
tggatggtttgt

SEQ ID NO: 4510171 - DNA, 22 bp, Homo sapiens
tggatggtttgttgttctgcct

SEQ ID NO: 4510172 - DNA, 13 bp, Homo sapiens
tggatgtcattgt

SEQ ID NO: 4510173 - DNA, 15 bp, Homo sapiens
tggattaaacctttt

SEQ ID NO: 4510174 - DNA, 14 bp, Homo sapiens
tggattaaattagt

SEQ ID NO: 4510175 - DNA, 16 bp, Homo sapiens
tggattacgatgtaaa

SEQ ID NO: 4510176 - DNA, 20 bp, Homo sapiens
tggattactgccattcactt

SEQ ID NO: 4510177 - DNA, 20 bp, Homo sapiens
tggattacttctctataaaa

SEQ ID NO: 4510178 - DNA, 17 bp, Homo sapiens
tggattataatcagaat

SEQ ID NO: 4510179 - DNA, 17 bp, Homo sapiens
tggattcattctcataa

SEQ ID NO: 4510180 - DNA, 13 bp, Homo sapiens
tggattccatgct

SEQ ID NO: 4510181 - DNA, 15 bp, Homo sapiens
tggattccatgctaa

SEQ ID NO: 4510182 - DNA, 15 bp, Homo sapiens
tggattctaaaatgc

SEQ ID NO: 4510183 - DNA, 17 bp, Homo sapiens
tggattgggggggccaa

SEQ ID NO: 4510184 - DNA, 14 bp, Homo sapiens
tggattgtcaaaga

SEQ ID NO: 4510185 - DNA, 20 bp, Homo sapiens
tggattgtgcctaatgtgtt

SEQ ID NO: 4510186 - DNA, 15 bp, Homo sapiens
tggattgtttttccc

SEQ ID NO: 4510187 - DNA, 18 bp, Homo sapiens
tggatttaaaagcctgct

SEQ ID NO: 4510188 - DNA, 20 bp, Homo sapiens
tggatttaaaagcctgctca

SEQ ID NO: 4510189 - DNA, 12 bp, Homo sapiens
tggatttagagc

SEQ ID NO: 4510190 - DNA, 21 bp, Homo sapiens
tggatttcctaatactgtcat

SEQ ID NO: 4510191 - DNA, 21 bp, Homo sapiens
tggatttgatgagttaactgt

SEQ ID NO: 4510192 - DNA, 22 bp, Homo sapiens
tggattttggttttgttcccct

SEQ ID NO: 4510193 - DNA, 18 bp, Homo sapiens
tggatttttctttaactg

SEQ ID NO: 4510194 - DNA, 23 bp, Homo sapiens
tggattttttatgtacaaccctg

SEQ ID NO: 4510195 - DNA, 22 bp, Homo sapiens
tggcaaaaaggagccttttgct

SEQ ID NO: 4510196 - DNA, 15 bp, Homo sapiens
tggcaaaactcaggc

SEQ ID NO: 4510197 - DNA, 16 bp, Homo sapiens
tggcaaacagggcctc

SEQ ID NO: 4510198 - DNA, 24 bp, Homo sapiens
tggcaaacgctaaagagcccttgc

SEQ ID NO: 4510199 - DNA, 17 bp, Homo sapiens
tggcaaagtttaaatgt

SEQ ID NO: 4510200 - DNA, 15 bp, Homo sapiens
tggcaaatgaaagca

SEQ ID NO: 4510201 - DNA, 17 bp, Homo sapiens
tggcaacccaaggaacc

SEQ ID NO: 4510202 - DNA, 17 bp, Homo sapiens
tggcaaggtcatagaca

SEQ ID NO: 4510203 - DNA, 12 bp, Homo sapiens
tggcaatagacc

SEQ ID NO: 4510204 - DNA, 16 bp, Homo sapiens
tggcaatgaaaatttt

SEQ ID NO: 4510205 - DNA, 20 bp, Homo sapiens
tggcaatgaaaattttaaga

SEQ ID NO: 4510206 - DNA, 17 bp, Homo sapiens
tggcaattccaatattt

SEQ ID NO: 4510207 - DNA, 18 bp, Homo sapiens
tggcaattttatgttttt

SEQ ID NO: 4510208 - DNA, 23 bp, Homo sapiens
tggcacagaggtagtctcactgc

SEQ ID NO: 4510209 - DNA, 22 bp, Homo sapiens
tggcacagccgcgggccaggag

SEQ ID NO: 4510210 - DNA, 18 bp, Homo sapiens
tggcacagttttctgaga

SEQ ID NO: 4510211 - DNA, 15 bp, Homo sapiens
tggcacatgccacct

SEQ ID NO: 4510212 - DNA, 16 bp, Homo sapiens
tggcacattgcccctc

SEQ ID NO: 4510213 - DNA, 18 bp, Homo sapiens
tggcacattgcccctctg

SEQ ID NO: 4510214 - DNA, 22 bp, Homo sapiens
tggcacattgcccctctgcctt

SEQ ID NO: 4510215 - DNA, 20 bp, Homo sapiens
tggcaccagatgcaacctca

SEQ ID NO: 4510216 - DNA, 20 bp, Homo sapiens
tggcacccaccgtggaggag

SEQ ID NO: 4510217 - DNA, 21 bp, Homo sapiens
tggcacccaccgtggaggagg

SEQ ID NO: 4510218 - DNA, 22 bp, Homo sapiens
tggcacccaccgtggaggagga

SEQ ID NO: 4510219 - DNA, 16 bp, Homo sapiens
tggcacgtattgctgt

SEQ ID NO: 4510220 - DNA, 15 bp, Homo sapiens
tggcactagaatgca

SEQ ID NO: 4510221 - DNA, 21 bp, Homo sapiens
tggcactatggtttgttgcct

SEQ ID NO: 4510222 - DNA, 23 bp, Homo sapiens
tggcactctctgccattctgtgc

SEQ ID NO: 4510223 - DNA, 21 bp, Homo sapiens
tggcactggcaaacagggcct

SEQ ID NO: 4510224 - DNA, 23 bp, Homo sapiens
tggcacttttgatgaaataaaat

SEQ ID NO: 4510225 - DNA, 16 bp, Homo sapiens
tggcagatgtcttccc

SEQ ID NO: 4510226 - DNA, 17 bp, Homo sapiens
tggcagatgtcttccct

SEQ ID NO: 4510227 - DNA, 20 bp, Homo sapiens
tggcagatgtcttccctggg

SEQ ID NO: 4510228 - DNA, 20 bp, Homo sapiens
tggcagcagaaaacttgtgt

SEQ ID NO: 4510229 - DNA, 14 bp, Homo sapiens
tggcagctagtgcc

SEQ ID NO: 4510230 - DNA, 15 bp, Homo sapiens
tggcagctagtgcct

SEQ ID NO: 4510231 - DNA, 19 bp, Homo sapiens
tggcagctgagagccctgc

SEQ ID NO: 4510232 - DNA, 15 bp, Homo sapiens
tggcagctgctgtgg

SEQ ID NO: 4510233 - DNA, 19 bp, Homo sapiens
tggcaggagaatttctact

SEQ ID NO: 4510234 - DNA, 17 bp, Homo sapiens
tggcaggaggagctgcc

SEQ ID NO: 4510235 - DNA, 20 bp, Homo sapiens
tggcaggcacacagcagccc

SEQ ID NO: 4510236 - DNA, 21 bp, Homo sapiens
tggcaggcacacagcagcccc

SEQ ID NO: 4510237 - DNA, 23 bp, Homo sapiens
tggcaggcacacagcagcccccc

SEQ ID NO: 4510238 - DNA, 13 bp, Homo sapiens
tggcaggcccact

SEQ ID NO: 4510239 - DNA, 22 bp, Homo sapiens
tggcagggcgccaagtctggca

SEQ ID NO: 4510240 - DNA, 23 bp, Homo sapiens
tggcagggcgccaagtctggcac

SEQ ID NO: 4510241 - DNA, 17 bp, Homo sapiens
tggcaggtcctcccctc

SEQ ID NO: 4510242 - DNA, 22 bp, Homo sapiens
tggcaggtggaggtgtcaggct

SEQ ID NO: 4510243 - DNA, 22 bp, Homo sapiens
tggcagtaaagagaaactttgt

SEQ ID NO: 4510244 - DNA, 12 bp, Homo sapiens
tggcagtggttt

SEQ ID NO: 4510245 - DNA, 16 bp, Homo sapiens
tggcagtttatattta

SEQ ID NO: 4510246 - DNA, 20 bp, Homo sapiens
tggcataatagtcaatttct

SEQ ID NO: 4510247 - DNA, 17 bp, Homo sapiens
tggcataatttgtctta

SEQ ID NO: 4510248 - DNA, 19 bp, Homo sapiens
tggcatacaaaatatttaa

SEQ ID NO: 4510249 - DNA, 16 bp, Homo sapiens
tggcatagccccggcc

SEQ ID NO: 4510250 - DNA, 15 bp, Homo sapiens
tggcatagctctggg

SEQ ID NO: 4510251 - DNA, 20 bp, Homo sapiens
tggcatatatgtgatctggg

SEQ ID NO: 4510252 - DNA, 15 bp, Homo sapiens
tggcatatggtccta

SEQ ID NO: 4510253 - DNA, 23 bp, Homo sapiens
tggcatattttaatcattatttg

SEQ ID NO: 4510254 - DNA, 18 bp, Homo sapiens
tggcatcacagaccccag

SEQ ID NO: 4510255 - DNA, 18 bp, Homo sapiens
tggcatcgcagtctctta

SEQ ID NO: 4510256 - DNA, 21 bp, Homo sapiens
tggcatctctccccatatata

SEQ ID NO: 4510257 - DNA, 20 bp, Homo sapiens
tggcatctttgccttgggct

SEQ ID NO: 4510258 - DNA, 23 bp, Homo sapiens
tggcatctttgccttgggctgct

SEQ ID NO: 4510259 - DNA, 16 bp, Homo sapiens
tggcatgcttaaattt

SEQ ID NO: 4510260 - DNA, 16 bp, Homo sapiens
tggctcacactgagaa

SEQ ID NO: 4510261 - DNA, 14 bp, Homo sapiens
tggctcagacccct

SEQ ID NO: 4510262 - DNA, 14 bp, Homo sapiens
tggctcagtgccac

SEQ ID NO: 4510263 - DNA, 20 bp, Homo sapiens
tggctccactcttgatctct

SEQ ID NO: 4510264 - DNA, 14 bp, Homo sapiens
tggctccagtctca

SEQ ID NO: 4510265 - DNA, 20 bp, Homo sapiens
tggctcccatgaccatactg

SEQ ID NO: 4510266 - DNA, 19 bp, Homo sapiens
tggctccctcctccaggcc

SEQ ID NO: 4510267 - DNA, 21 bp, Homo sapiens
tggctccctcctccaggcctg

SEQ ID NO: 4510268 - DNA, 23 bp, Homo sapiens
tggctccctgatgggggacagga

SEQ ID NO: 4510269 - DNA, 20 bp, Homo sapiens
tggctcctgaggggcatctg

SEQ ID NO: 4510270 - DNA, 23 bp, Homo sapiens
tggctcctgaggggcatctgccc

SEQ ID NO: 4510271 - DNA, 23 bp, Homo sapiens
tggctcgctccctgtagctctgc

SEQ ID NO: 4510272 - DNA, 22 bp, Homo sapiens
tggctcggacccaccccaactc

SEQ ID NO: 4510273 - DNA, 19 bp, Homo sapiens
tggctctaattcacagtgc

SEQ ID NO: 4510274 - DNA, 23 bp, Homo sapiens
tggctctaccttcctgtccctga

SEQ ID NO: 4510275 - DNA, 22 bp, Homo sapiens
tggctctctattccctcagcct

SEQ ID NO: 4510276 - DNA, 13 bp, Homo sapiens
tggctctgccccc

SEQ ID NO: 4510277 - DNA, 14 bp, Homo sapiens
tggctctgccctgg

SEQ ID NO: 4510278 - DNA, 20 bp, Homo sapiens
tggctctgggtgaggtaggc

SEQ ID NO: 4510279 - DNA, 20 bp, Homo sapiens
tggctgaagaggaccagagg

SEQ ID NO: 4510280 - DNA, 22 bp, Homo sapiens
tggctgaagaggaccagaggag

SEQ ID NO: 4510281 - DNA, 24 bp, Homo sapiens
tggctgaagaggaccagaggagca

SEQ ID NO: 4510282 - DNA, 15 bp, Homo sapiens
tggctgacccagtcc

SEQ ID NO: 4510283 - DNA, 19 bp, Homo sapiens
tggctgacccagtccctgg

SEQ ID NO: 4510284 - DNA, 23 bp, Homo sapiens
tggctgaggaggcctccatctca

SEQ ID NO: 4510285 - DNA, 17 bp, Homo sapiens
tggctgaggttcctctg

SEQ ID NO: 4510286 - DNA, 24 bp, Homo sapiens
tggctgaggttcctctgcctgccc

SEQ ID NO: 4510287 - DNA, 16 bp, Homo sapiens
tggctgccacacccag

SEQ ID NO: 4510288 - DNA, 14 bp, Homo sapiens
tggctgcccaggag

SEQ ID NO: 4510289 - DNA, 13 bp, Homo sapiens
tggctgccccggc

SEQ ID NO: 4510290 - DNA, 13 bp, Homo sapiens
tggctgccttctt

SEQ ID NO: 4510291 - DNA, 16 bp, Homo sapiens
tggctgccttctttcc

SEQ ID NO: 4510292 - DNA, 17 bp, Homo sapiens
tggctgccttctttcca

SEQ ID NO: 4510293 - DNA, 12 bp, Homo sapiens
tggctgctctgg

SEQ ID NO: 4510294 - DNA, 14 bp, Homo sapiens
tggctgctctggga

SEQ ID NO: 4510295 - DNA, 15 bp, Homo sapiens
tggctgctctgggaa

SEQ ID NO: 4510296 - DNA, 21 bp, Homo sapiens
tggctgctgccatgtctcaga

SEQ ID NO: 4510297 - DNA, 17 bp, Homo sapiens
tggctggaggagcagca

SEQ ID NO: 4510298 - DNA, 11 bp, Homo sapiens
tggctggctct

SEQ ID NO: 4510299 - DNA, 20 bp, Homo sapiens
tggctggctctaccttcctg

SEQ ID NO: 4510300 - DNA, 21 bp, Homo sapiens
tggctggggtgtcaataaagc

SEQ ID NO: 4510301 - DNA, 14 bp, Homo sapiens
tggctggtgtcccc

SEQ ID NO: 4510302 - DNA, 15 bp, Homo sapiens
tggctggtgtcccct

SEQ ID NO: 4510303 - DNA, 11 bp, Homo sapiens
tggctgtccct

SEQ ID NO: 4510304 - DNA, 14 bp, Homo sapiens
tggctgtccctgtg

SEQ ID NO: 4510305 - DNA, 21 bp, Homo sapiens
tggctgtcctaccatcagctc

SEQ ID NO: 4510306 - DNA, 16 bp, Homo sapiens
tggctgtgatcttaaa

SEQ ID NO: 4510307 - DNA, 21 bp, Homo sapiens
tggctgttttccctctgctgc

SEQ ID NO: 4510308 - DNA, 23 bp, Homo sapiens
tggcttaggatcgacaagaagtt

SEQ ID NO: 4510309 - DNA, 15 bp, Homo sapiens
tggcttatgtcatca

SEQ ID NO: 4510310 - DNA, 16 bp, Homo sapiens
tggcttcatctgtcaa

SEQ ID NO: 4510311 - DNA, 18 bp, Homo sapiens
tggcttccccactccccc

SEQ ID NO: 4510312 - DNA, 18 bp, Homo sapiens
tggcttccgtgagacaca

SEQ ID NO: 4510313 - DNA, 19 bp, Homo sapiens
tggcttccgtgagacacaa

SEQ ID NO: 4510314 - DNA, 16 bp, Homo sapiens
tggcttcggacaaaat

SEQ ID NO: 4510315 - DNA, 14 bp, Homo sapiens
tggcttctgtgggg

SEQ ID NO: 4510316 - DNA, 22 bp, Homo sapiens
tggcttcttttctttgtatcat

SEQ ID NO: 4510317 - DNA, 12 bp, Homo sapiens
tggcttgctgtt

SEQ ID NO: 4510318 - DNA, 14 bp, Homo sapiens
tggcttgctgttta

SEQ ID NO: 4510319 - DNA, 14 bp, Homo sapiens
tggctttcagagcc

SEQ ID NO: 4510320 - DNA, 22 bp, Homo sapiens
tggctttcataaatcatgttgt

SEQ ID NO: 4510321 - DNA, 12 bp, Homo sapiens
tggctttccagg

SEQ ID NO: 4510322 - DNA, 14 bp, Homo sapiens
tggctttccaggca

SEQ ID NO: 4510323 - DNA, 15 bp, Homo sapiens
tggctttccaggcac

SEQ ID NO: 4510324 - DNA, 14 bp, Homo sapiens
tggctttcccagga

SEQ ID NO: 4510325 - DNA, 19 bp, Homo sapiens
tggctttcccaggagatgg

SEQ ID NO: 4510326 - DNA, 18 bp, Homo sapiens
tggctttgcagctgctgt

SEQ ID NO: 4510327 - DNA, 12 bp, Homo sapiens
tggctttgcctc

SEQ ID NO: 4510328 - DNA, 17 bp, Homo sapiens
tggctttgcctcttctt

SEQ ID NO: 4510329 - DNA, 13 bp, Homo sapiens
tggctttgctgtt

SEQ ID NO: 4510330 - DNA, 19 bp, Homo sapiens
tggctttggcactctctgc

SEQ ID NO: 4510331 - DNA, 22 bp, Homo sapiens
tggcttttcgcttgcttctgca

SEQ ID NO: 4510332 - DNA, 19 bp, Homo sapiens
tggcttttgcctgtaagaa

SEQ ID NO: 4510333 - DNA, 20 bp, Homo sapiens
tgggaaactgggtttctcat

SEQ ID NO: 4510334 - DNA, 15 bp, Homo sapiens
tgggaaagcataaag

SEQ ID NO: 4510335 - DNA, 19 bp, Homo sapiens
tgggaaagctctgtagagc

SEQ ID NO: 4510336 - DNA, 17 bp, Homo sapiens
tgggaaatagcggccct

SEQ ID NO: 4510337 - DNA, 19 bp, Homo sapiens
tgggaaatgagaaggcagc

SEQ ID NO: 4510338 - DNA, 22 bp, Homo sapiens
tgggaacctagctacactgagc

SEQ ID NO: 4510339 - DNA, 18 bp, Homo sapiens
tgggaacgtgactgcccc

SEQ ID NO: 4510340 - DNA, 23 bp, Homo sapiens
tgggaagaaagaatgcaagagtg

SEQ ID NO: 4510341 - DNA, 18 bp, Homo sapiens
tgggaagacgaggccctc

SEQ ID NO: 4510342 - DNA, 13 bp, Homo sapiens
tgggaagactcag

SEQ ID NO: 4510343 - DNA, 15 bp, Homo sapiens
tgggaagattctcta

SEQ ID NO: 4510344 - DNA, 15 bp, Homo sapiens
tgggaaggccagctg

SEQ ID NO: 4510345 - DNA, 16 bp, Homo sapiens
tgggaaggccagctgc

SEQ ID NO: 4510346 - DNA, 22 bp, Homo sapiens
tgggaaggcctcttggagacct

SEQ ID NO: 4510347 - DNA, 18 bp, Homo sapiens
tgggaaggcgagtctggg

SEQ ID NO: 4510348 - DNA, 13 bp, Homo sapiens
tgggaagggagag

SEQ ID NO: 4510349 - DNA, 19 bp, Homo sapiens
tgggaagggagagttcttt

SEQ ID NO: 4510350 - DNA, 23 bp, Homo sapiens
tgggaagggagagttctttgctg

SEQ ID NO: 4510351 - DNA, 15 bp, Homo sapiens
tgggaagtgaagact

SEQ ID NO: 4510352 - DNA, 16 bp, Homo sapiens
tgggaataaaagtatt

SEQ ID NO: 4510353 - DNA, 23 bp, Homo sapiens
tgggaataagtgccaggatggaa

SEQ ID NO: 4510354 - DNA, 12 bp, Homo sapiens
tgggaatgggag

SEQ ID NO: 4510355 - DNA, 13 bp, Homo sapiens
tgggaatgggaga

SEQ ID NO: 4510356 - DNA, 12 bp, Homo sapiens
tgggaatttata

SEQ ID NO: 4510357 - DNA, 16 bp, Homo sapiens
tgggaatttggcttca

SEQ ID NO: 4510358 - DNA, 21 bp, Homo sapiens
tgggacaccccgacttttgtt

SEQ ID NO: 4510359 - DNA, 18 bp, Homo sapiens
tgggacagaggagcaagg

SEQ ID NO: 4510360 - DNA, 20 bp, Homo sapiens
tgggacatggaaaagaaggc

SEQ ID NO: 4510361 - DNA, 18 bp, Homo sapiens
tgggaccagggatggggg

SEQ ID NO: 4510362 - DNA, 22 bp, Homo sapiens
tgggacccacgaaactgccctg

SEQ ID NO: 4510363 - DNA, 14 bp, Homo sapiens
tgggaccctcagca

SEQ ID NO: 4510364 - DNA, 15 bp, Homo sapiens
tgggaccctcagcag

SEQ ID NO: 4510365 - DNA, 18 bp, Homo sapiens
tgggaccctcagcagctc

SEQ ID NO: 4510366 - DNA, 20 bp, Homo sapiens
tgggaccctccagtgctgga

SEQ ID NO: 4510367 - DNA, 21 bp, Homo sapiens
tgggaccctccagtgctggat

SEQ ID NO: 4510368 - DNA, 22 bp, Homo sapiens
tgggaccctgtccggcccagtg

SEQ ID NO: 4510369 - DNA, 14 bp, Homo sapiens
tgggaccctttcct

SEQ ID NO: 4510370 - DNA, 18 bp, Homo sapiens
tgggaccctttccttcct

SEQ ID NO: 4510371 - DNA, 20 bp, Homo sapiens
tgggactacaggcgcccgcc

SEQ ID NO: 4510372 - DNA, 22 bp, Homo sapiens
tgggactcagttgttctgagca

SEQ ID NO: 4510373 - DNA, 20 bp, Homo sapiens
tgggactctcctcctcccct

SEQ ID NO: 4510374 - DNA, 23 bp, Homo sapiens
tgggactctcctcctcccctcct

SEQ ID NO: 4510375 - DNA, 15 bp, Homo sapiens
tgggactgactttcc

SEQ ID NO: 4510376 - DNA, 17 bp, Homo sapiens
tgggactgctaaataaa

SEQ ID NO: 4510377 - DNA, 15 bp, Homo sapiens
tgggactgtacacac

SEQ ID NO: 4510378 - DNA, 16 bp, Homo sapiens
tgggactgtgcctggc

SEQ ID NO: 4510379 - DNA, 18 bp, Homo sapiens
tgggactgtgcctggctc

SEQ ID NO: 4510380 - DNA, 20 bp, Homo sapiens
tgggactgtgcctggctccc

SEQ ID NO: 4510381 - DNA, 23 bp, Homo sapiens
tgggactgtgcctggctccctga

SEQ ID NO: 4510382 - DNA, 16 bp, Homo sapiens
tgggactgtggtgact

SEQ ID NO: 4510383 - DNA, 23 bp, Homo sapiens
tgggacttctacccagatggaaa

SEQ ID NO: 4510384 - DNA, 18 bp, Homo sapiens
tgggagagctggtggtgc

SEQ ID NO: 4510385 - DNA, 23 bp, Homo sapiens
tgggagaggcaataaataaatgt

SEQ ID NO: 4510386 - DNA, 18 bp, Homo sapiens
tgggagatttttttgagt

SEQ ID NO: 4510387 - DNA, 14 bp, Homo sapiens
tgggagcagtccat

SEQ ID NO: 4510388 - DNA, 19 bp, Homo sapiens
tgggagcagtccatgcatg

SEQ ID NO: 4510389 - DNA, 17 bp, Homo sapiens
tgggagccacttctccc

SEQ ID NO: 4510390 - DNA, 22 bp, Homo sapiens
tgggagccccagggtcttccct

SEQ ID NO: 4510391 - DNA, 14 bp, Homo sapiens
tgggagccgggtct

SEQ ID NO: 4510392 - DNA, 21 bp, Homo sapiens
tgggagcctagctcctgccac

SEQ ID NO: 4510393 - DNA, 19 bp, Homo sapiens
tgggagcctgtggccagca

SEQ ID NO: 4510394 - DNA, 14 bp, Homo sapiens
tgggagctcctctc

SEQ ID NO: 4510395 - DNA, 18 bp, Homo sapiens
tgggagctcctctcctgg

SEQ ID NO: 4510396 - DNA, 19 bp, Homo sapiens
tgggagctcctctcctgga

SEQ ID NO: 4510397 - DNA, 20 bp, Homo sapiens
tgggagctgaaccacagaaa

SEQ ID NO: 4510398 - DNA, 20 bp, Homo sapiens
tgggaggaactccttgcaca

SEQ ID NO: 4510399 - DNA, 19 bp, Homo sapiens
tgggaggacggtgcaaccc

SEQ ID NO: 4510400 - DNA, 18 bp, Homo sapiens
tgggaggatacagaggag

SEQ ID NO: 4510401 - DNA, 11 bp, Homo sapiens
tgggaggcagg

SEQ ID NO: 4510402 - DNA, 14 bp, Homo sapiens
tgggaggcgtgccc

SEQ ID NO: 4510403 - DNA, 17 bp, Homo sapiens
tgggaggcgtgcccccc

SEQ ID NO: 4510404 - DNA, 20 bp, Homo sapiens
tgggaggctcacccccttct

SEQ ID NO: 4510405 - DNA, 14 bp, Homo sapiens
tgggaggctgaggc

SEQ ID NO: 4510406 - DNA, 13 bp, Homo sapiens
tgggagggaggag

SEQ ID NO: 4510407 - DNA, 15 bp, Homo sapiens
tgggagggatcagcc

SEQ ID NO: 4510408 - DNA, 17 bp, Homo sapiens
tgggagggatcagcccc

SEQ ID NO: 4510409 - DNA, 23 bp, Homo sapiens
tgggagggggcttgaagccaaag

SEQ ID NO: 4510410 - DNA, 23 bp, Homo sapiens
tgggaggtggaagcagaggccct

SEQ ID NO: 4510411 - DNA, 18 bp, Homo sapiens
tgggagtaacagggcaga

SEQ ID NO: 4510412 - DNA, 19 bp, Homo sapiens
tgggagtcattaccacgcc

SEQ ID NO: 4510413 - DNA, 15 bp, Homo sapiens
tgggagtccctacct

SEQ ID NO: 4510414 - DNA, 21 bp, Homo sapiens
tgggagtgaggatgtctgggc

SEQ ID NO: 4510415 - DNA, 16 bp, Homo sapiens
tgggagtgcagagaaa

SEQ ID NO: 4510416 - DNA, 22 bp, Homo sapiens
tgggagtgttcccgtgcctggg

SEQ ID NO: 4510417 - DNA, 23 bp, Homo sapiens
tgggataaagatgcaaggaccag

SEQ ID NO: 4510418 - DNA, 15 bp, Homo sapiens
tgggatatggctgcc

SEQ ID NO: 4510419 - DNA, 15 bp, Homo sapiens
tgggatcatccagag

SEQ ID NO: 4510420 - DNA, 18 bp, Homo sapiens
tgggatccacgctgggcc

SEQ ID NO: 4510421 - DNA, 15 bp, Homo sapiens
tgggatcctccctca

SEQ ID NO: 4510422 - DNA, 19 bp, Homo sapiens
tgggatcctccctcatggc

SEQ ID NO: 4510423 - DNA, 15 bp, Homo sapiens
tgggatgggaccagg

SEQ ID NO: 4510424 - DNA, 18 bp, Homo sapiens
tgggatggtggagggcca

SEQ ID NO: 4510425 - DNA, 12 bp, Homo sapiens
tgggattacagg

SEQ ID NO: 4510426 - DNA, 16 bp, Homo sapiens
tgggattgagtctgtg

SEQ ID NO: 4510427 - DNA, 19 bp, Homo sapiens
tgggattgagtctgtgcca

SEQ ID NO: 4510428 - DNA, 13 bp, Homo sapiens
tgggattttgcaa

SEQ ID NO: 4510429 - DNA, 19 bp, Homo sapiens
tgggcaaaccctggtgctt

SEQ ID NO: 4510430 - DNA, 15 bp, Homo sapiens
tgggcaaagcctagt

SEQ ID NO: 4510431 - DNA, 21 bp, Homo sapiens
tgggcaaagcctagtgaaggc

SEQ ID NO: 4510432 - DNA, 16 bp, Homo sapiens
tgggcaaagggaagta

SEQ ID NO: 4510433 - DNA, 13 bp, Homo sapiens
tgggcaaggaaaa

SEQ ID NO: 4510434 - DNA, 19 bp, Homo sapiens
tgggcaaggaaaaagaaaa

SEQ ID NO: 4510435 - DNA, 13 bp, Homo sapiens
tgggcacagtcca

SEQ ID NO: 4510436 - DNA, 15 bp, Homo sapiens
tgggcacagtccaga

SEQ ID NO: 4510437 - DNA, 19 bp, Homo sapiens
tgggcacagtccagaccca

SEQ ID NO: 4510438 - DNA, 15 bp, Homo sapiens
tgggcacatgctcag

SEQ ID NO: 4510439 - DNA, 16 bp, Homo sapiens
tgggcacatgctcagg

SEQ ID NO: 4510440 - DNA, 21 bp, Homo sapiens
tgggcactccgcgccgatgcc

SEQ ID NO: 4510441 - DNA, 14 bp, Homo sapiens
tgggcactggggcc

SEQ ID NO: 4510442 - DNA, 14 bp, Homo sapiens
tgggcagagcccaa

SEQ ID NO: 4510443 - DNA, 16 bp, Homo sapiens
tgggcagatcacttga

SEQ ID NO: 4510444 - DNA, 15 bp, Homo sapiens
tgggcagattttcag

SEQ ID NO: 4510445 - DNA, 17 bp, Homo sapiens
tgggcagcaatttaaat

SEQ ID NO: 4510446 - DNA, 18 bp, Homo sapiens
tgggcagcaatttaaatg

SEQ ID NO: 4510447 - DNA, 21 bp, Homo sapiens
tgggcagcaatttaaatgtta

SEQ ID NO: 4510448 - DNA, 17 bp, Homo sapiens
tgggcagcaccctcccc

SEQ ID NO: 4510449 - DNA, 14 bp, Homo sapiens
tgggcagccaggag

SEQ ID NO: 4510450 - DNA, 14 bp, Homo sapiens
tgggcagccaggct

SEQ ID NO: 4510451 - DNA, 15 bp, Homo sapiens
tgggcagccaggctg

SEQ ID NO: 4510452 - DNA, 16 bp, Homo sapiens
tgggcagccaggctgc

SEQ ID NO: 4510453 - DNA, 12 bp, Homo sapiens
tgggcaggaagg

SEQ ID NO: 4510454 - DNA, 11 bp, Homo sapiens
tgggcaggagg

SEQ ID NO: 4510455 - DNA, 21 bp, Homo sapiens
tgggcaggaggaaaaggcttg

SEQ ID NO: 4510456 - DNA, 22 bp, Homo sapiens
tgggcaggaggaaaaggcttgg

SEQ ID NO: 4510457 - DNA, 13 bp, Homo sapiens
tgggcaggaggga

SEQ ID NO: 4510458 - DNA, 16 bp, Homo sapiens
tgggcaggagggaggt

SEQ ID NO: 4510459 - DNA, 16 bp, Homo sapiens
tgggcagtgccccagg

SEQ ID NO: 4510460 - DNA, 17 bp, Homo sapiens
tgggcagtgccccaggg

SEQ ID NO: 4510461 - DNA, 15 bp, Homo sapiens
tgggcagttttttga

SEQ ID NO: 4510462 - DNA, 16 bp, Homo sapiens
tgggcatcttctggct

SEQ ID NO: 4510463 - DNA, 13 bp, Homo sapiens
tgggcatcttttg

SEQ ID NO: 4510464 - DNA, 19 bp, Homo sapiens
tgggcatcttttgtattaa

SEQ ID NO: 4510465 - DNA, 17 bp, Homo sapiens
tgggcatttggtgagag

SEQ ID NO: 4510466 - DNA, 23 bp, Homo sapiens
tgggcatttggtgagagtcaaag

SEQ ID NO: 4510467 - DNA, 20 bp, Homo sapiens
tgggcattttacaagaagta

SEQ ID NO: 4510468 - DNA, 16 bp, Homo sapiens
tgggcattttcctcct

SEQ ID NO: 4510469 - DNA, 19 bp, Homo sapiens
tgggcattttcctcctctg

SEQ ID NO: 4510470 - DNA, 18 bp, Homo sapiens
tgggccacacccaggaag

SEQ ID NO: 4510471 - DNA, 14 bp, Homo sapiens
tgggccaccaggga

SEQ ID NO: 4510472 - DNA, 16 bp, Homo sapiens
tgggccaccagggatc

SEQ ID NO: 4510473 - DNA, 16 bp, Homo sapiens
tgggccaccgccttgc

SEQ ID NO: 4510474 - DNA, 14 bp, Homo sapiens
tgggccactgggga

SEQ ID NO: 4510475 - DNA, 22 bp, Homo sapiens
tgggccactggggactttattt

SEQ ID NO: 4510476 - DNA, 23 bp, Homo sapiens
tgggccactggggactttattta

SEQ ID NO: 4510477 - DNA, 17 bp, Homo sapiens
tgggccagcggggctgc

SEQ ID NO: 4510478 - DNA, 19 bp, Homo sapiens
tgggccagcggggctgctc

SEQ ID NO: 4510479 - DNA, 17 bp, Homo sapiens
tgggccaggacaggccc

SEQ ID NO: 4510480 - DNA, 17 bp, Homo sapiens
tgggccagtccccgagg

SEQ ID NO: 4510481 - DNA, 18 bp, Homo sapiens
tgggccataattatgaaa

SEQ ID NO: 4510482 - DNA, 18 bp, Homo sapiens
tgggccatgtccaaagag

SEQ ID NO: 4510483 - DNA, 19 bp, Homo sapiens
tgggccatgtccaaagagg

SEQ ID NO: 4510484 - DNA, 24 bp, Homo sapiens
tgggccatgtccaaagaggctgcc

SEQ ID NO: 4510485 - DNA, 22 bp, Homo sapiens
tgggcccaagacagatgcccca

SEQ ID NO: 4510486 - DNA, 10 bp, Homo sapiens
tgggcccagg

SEQ ID NO: 4510487 - DNA, 17 bp, Homo sapiens
tgggccccaccacctag

SEQ ID NO: 4510488 - DNA, 20 bp, Homo sapiens
tgggccccagcccaccctcc

SEQ ID NO: 4510489 - DNA, 13 bp, Homo sapiens
tgggcccctccac

SEQ ID NO: 4510490 - DNA, 17 bp, Homo sapiens
tgggcccctccacgcct

SEQ ID NO: 4510491 - DNA, 23 bp, Homo sapiens
tgggcccctccacgcctcctggc

SEQ ID NO: 4510492 - DNA, 18 bp, Homo sapiens
tgggcccctccctacctc

SEQ ID NO: 4510493 - DNA, 19 bp, Homo sapiens
tgggcccctccctacctca

SEQ ID NO: 4510494 - DNA, 15 bp, Homo sapiens
tgggcccggtccaca

SEQ ID NO: 4510495 - DNA, 17 bp, Homo sapiens
tgggcccggtccacagg

SEQ ID NO: 4510496 - DNA, 16 bp, Homo sapiens
tgggccctctctctgg

SEQ ID NO: 4510497 - DNA, 13 bp, Homo sapiens
tgggccctgcctg

SEQ ID NO: 4510498 - DNA, 15 bp, Homo sapiens
tgggccctgcctgca

SEQ ID NO: 4510499 - DNA, 17 bp, Homo sapiens
tgggccctgcctgcagc

SEQ ID NO: 4510500 - DNA, 21 bp, Homo sapiens
tgggccctgcctgcagccagg

SEQ ID NO: 4510501 - DNA, 16 bp, Homo sapiens
tggtgaagtaaattag

SEQ ID NO: 4510502 - DNA, 14 bp, Homo sapiens
tggtgaagtgtggc

SEQ ID NO: 4510503 - DNA, 17 bp, Homo sapiens
tggtgaagtgtggctgg

SEQ ID NO: 4510504 - DNA, 20 bp, Homo sapiens
tggtgaagtgtggctggtgt

SEQ ID NO: 4510505 - DNA, 16 bp, Homo sapiens
tggtgacaaaattcat

SEQ ID NO: 4510506 - DNA, 19 bp, Homo sapiens
tggtgacaggccaaaggcc

SEQ ID NO: 4510507 - DNA, 15 bp, Homo sapiens
tggtgaccagtttct

SEQ ID NO: 4510508 - DNA, 14 bp, Homo sapiens
tggtgacttctgct

SEQ ID NO: 4510509 - DNA, 16 bp, Homo sapiens
tggtgacttctgctgc

SEQ ID NO: 4510510 - DNA, 17 bp, Homo sapiens
tggtgagagtcaaagct

SEQ ID NO: 4510511 - DNA, 13 bp, Homo sapiens
tggtgataaaaat

SEQ ID NO: 4510512 - DNA, 13 bp, Homo sapiens
tggtgatgactta

SEQ ID NO: 4510513 - DNA, 16 bp, Homo sapiens
tggtgcaaattcagaa

SEQ ID NO: 4510514 - DNA, 17 bp, Homo sapiens
tggtgcactttgtaaat

SEQ ID NO: 4510515 - DNA, 15 bp, Homo sapiens
tggtgcagccttccc

SEQ ID NO: 4510516 - DNA, 22 bp, Homo sapiens
tggtgcagccttcccctccctg

SEQ ID NO: 4510517 - DNA, 19 bp, Homo sapiens
tggtgcagggagacatctg

SEQ ID NO: 4510518 - DNA, 23 bp, Homo sapiens
tggtgcagggagacatctgcacc

SEQ ID NO: 4510519 - DNA, 21 bp, Homo sapiens
tggtgcaggtctccacctgca

SEQ ID NO: 4510520 - DNA, 14 bp, Homo sapiens
tggtgcatgggctc

SEQ ID NO: 4510521 - DNA, 22 bp, Homo sapiens
tggtgccatttctgaactgtta

SEQ ID NO: 4510522 - DNA, 20 bp, Homo sapiens
tggtgcctttcctgttcagc

SEQ ID NO: 4510523 - DNA, 18 bp, Homo sapiens
tggtgctaaaggaggcca

SEQ ID NO: 4510524 - DNA, 20 bp, Homo sapiens
tggtgctgccgagggctggc

SEQ ID NO: 4510525 - DNA, 17 bp, Homo sapiens
tggtgctttttataaaa

SEQ ID NO: 4510526 - DNA, 19 bp, Homo sapiens
tggtggaggaagggctggg

SEQ ID NO: 4510527 - DNA, 19 bp, Homo sapiens
tggtggcaacattcattgc

SEQ ID NO: 4510528 - DNA, 15 bp, Homo sapiens
tggtggcctggtccc

SEQ ID NO: 4510529 - DNA, 14 bp, Homo sapiens
tggtggctcatgcc

SEQ ID NO: 4510530 - DNA, 16 bp, Homo sapiens
tggtggctcatgcctg

SEQ ID NO: 4510531 - DNA, 17 bp, Homo sapiens
tggtggctcatgcctgt

SEQ ID NO: 4510532 - DNA, 11 bp, Homo sapiens
tggtggggagg

SEQ ID NO: 4510533 - DNA, 17 bp, Homo sapiens
tggtgggtccatgggca

SEQ ID NO: 4510534 - DNA, 18 bp, Homo sapiens
tggtgggtccatgggcag

SEQ ID NO: 4510535 - DNA, 19 bp, Homo sapiens
tggtgggttcaggggactc

SEQ ID NO: 4510536 - DNA, 13 bp, Homo sapiens
tggtgggttgatg

SEQ ID NO: 4510537 - DNA, 15 bp, Homo sapiens
tggtggtgaaattga

SEQ ID NO: 4510538 - DNA, 16 bp, Homo sapiens
tggtggtttttgctct

SEQ ID NO: 4510539 - DNA, 13 bp, Homo sapiens
tggtgtaatcatt

SEQ ID NO: 4510540 - DNA, 18 bp, Homo sapiens
tggtgtaatcattttaaa

SEQ ID NO: 4510541 - DNA, 17 bp, Homo sapiens
tggtgtaatttgaagat

SEQ ID NO: 4510542 - DNA, 15 bp, Homo sapiens
tggtgtccacctggc

SEQ ID NO: 4510543 - DNA, 22 bp, Homo sapiens
tggtgtcccggtaccttccata

SEQ ID NO: 4510544 - DNA, 14 bp, Homo sapiens
tggtgtcctgaggc

SEQ ID NO: 4510545 - DNA, 11 bp, Homo sapiens
tggtgtctcca

SEQ ID NO: 4510546 - DNA, 22 bp, Homo sapiens
tggtgtctcccaacatgggagg

SEQ ID NO: 4510547 - DNA, 16 bp, Homo sapiens
tggtgtgaacccggga

SEQ ID NO: 4510548 - DNA, 17 bp, Homo sapiens
tggtgtgaacccgggag

SEQ ID NO: 4510549 - DNA, 19 bp, Homo sapiens
tggtgtgtccccctctgtc

SEQ ID NO: 4510550 - DNA, 23 bp, Homo sapiens
tggtgtgttcaagaccagcctgg

SEQ ID NO: 4510551 - DNA, 18 bp, Homo sapiens
tggtgttctaagactctg

SEQ ID NO: 4510552 - DNA, 14 bp, Homo sapiens
tggtgttgactgga

SEQ ID NO: 4510553 - DNA, 11 bp, Homo sapiens
tggtgttggct

SEQ ID NO: 4510554 - DNA, 18 bp, Homo sapiens
tggtgtttctagcactgg

SEQ ID NO: 4510555 - DNA, 19 bp, Homo sapiens
tggttaatacatctttccc

SEQ ID NO: 4510556 - DNA, 14 bp, Homo sapiens
tggttaatgtagta

SEQ ID NO: 4510557 - DNA, 14 bp, Homo sapiens
tggttacactgtta

SEQ ID NO: 4510558 - DNA, 21 bp, Homo sapiens
tggttacactgttagaacact

SEQ ID NO: 4510559 - DNA, 14 bp, Homo sapiens
tggttaccaggcac

SEQ ID NO: 4510560 - DNA, 18 bp, Homo sapiens
tggttaccccgggctggg

SEQ ID NO: 4510561 - DNA, 14 bp, Homo sapiens
tggttacttcttct

SEQ ID NO: 4510562 - DNA, 15 bp, Homo sapiens
tggttacttcttctc

SEQ ID NO: 4510563 - DNA, 21 bp, Homo sapiens
tggttacttcttctcttagat

SEQ ID NO: 4510564 - DNA, 15 bp, Homo sapiens
tggttcacactgacc

SEQ ID NO: 4510565 - DNA, 16 bp, Homo sapiens
tggttcattaattcta

SEQ ID NO: 4510566 - DNA, 22 bp, Homo sapiens
tggttcctgtgtgaccctgggc

SEQ ID NO: 4510567 - DNA, 18 bp, Homo sapiens
tggttcgatacctggagc

SEQ ID NO: 4510568 - DNA, 13 bp, Homo sapiens
tggttctaaatat

SEQ ID NO: 4510569 - DNA, 19 bp, Homo sapiens
tggttctaaatattgcttc

SEQ ID NO: 4510570 - DNA, 11 bp, Homo sapiens
tggttctaact

SEQ ID NO: 4510571 - DNA, 22 bp, Homo sapiens
tggttctcagaaccatttcacc

SEQ ID NO: 4510572 - DNA, 11 bp, Homo sapiens
tggttctcatc

SEQ ID NO: 4510573 - DNA, 17 bp, Homo sapiens
tggttctcatctttctt

SEQ ID NO: 4510574 - DNA, 14 bp, Homo sapiens
tggttctctgcctt

SEQ ID NO: 4510575 - DNA, 16 bp, Homo sapiens
tggttctgcctcctgg

SEQ ID NO: 4510576 - DNA, 19 bp, Homo sapiens
tggttctgtgacccatctg

SEQ ID NO: 4510577 - DNA, 23 bp, Homo sapiens
tggttgaatacagttacttaatg

SEQ ID NO: 4510578 - DNA, 22 bp, Homo sapiens
tggttgaggtggaagccctcct

SEQ ID NO: 4510579 - DNA, 14 bp, Homo sapiens
tggttgatgccaaa

SEQ ID NO: 4510580 - DNA, 16 bp, Homo sapiens
tggttggagagctaga

SEQ ID NO: 4510581 - DNA, 17 bp, Homo sapiens
tggttgtttctgttcca

SEQ ID NO: 4510582 - DNA, 18 bp, Homo sapiens
tggtttaaaagaaaaaat

SEQ ID NO: 4510583 - DNA, 21 bp, Homo sapiens
tggtttaaagaaagtgtattt

SEQ ID NO: 4510584 - DNA, 17 bp, Homo sapiens
tggtttaattcagcaga

SEQ ID NO: 4510585 - DNA, 18 bp, Homo sapiens
tggtttatcagcaaaaaa

SEQ ID NO: 4510586 - DNA, 19 bp, Homo sapiens
tggtttcctcgagaggcac

SEQ ID NO: 4510587 - DNA, 13 bp, Homo sapiens
tggtttctcctgg

SEQ ID NO: 4510588 - DNA, 11 bp, Homo sapiens
tggtttcttat

SEQ ID NO: 4510589 - DNA, 19 bp, Homo sapiens
tggtttgcctgaggctgta

SEQ ID NO: 4510590 - DNA, 20 bp, Homo sapiens
tggtttgtacatatcaaata

SEQ ID NO: 4510591 - DNA, 18 bp, Homo sapiens
tggttttacacagagaaa

SEQ ID NO: 4510592 - DNA, 16 bp, Homo sapiens
tggttttatactgaag

SEQ ID NO: 4510593 - DNA, 21 bp, Homo sapiens
tggttttctgccaatgaccaa

SEQ ID NO: 4510594 - DNA, 21 bp, Homo sapiens
tggtttttaaattttgtaatg

SEQ ID NO: 4510595 - DNA, 19 bp, Homo sapiens
tgtaaaaaatggagctcag

SEQ ID NO: 4510596 - DNA, 22 bp, Homo sapiens
tgtaaaaacccaagtccctgtc

SEQ ID NO: 4510597 - DNA, 12 bp, Homo sapiens
tgtaaaacaggt

SEQ ID NO: 4510598 - DNA, 18 bp, Homo sapiens
tgtaaaactttattttat

SEQ ID NO: 4510599 - DNA, 16 bp, Homo sapiens
tgtaaaatagaaaaag

SEQ ID NO: 4510600 - DNA, 19 bp, Homo sapiens
tgtaaaatattttgaatca

SEQ ID NO: 4510601 - DNA, 23 bp, Homo sapiens
tgtaaaatgaattgaaaaacaat

SEQ ID NO: 4510602 - DNA, 14 bp, Homo sapiens
tgtaaaatgtatta

SEQ ID NO: 4510603 - DNA, 19 bp, Homo sapiens
tgtaaaatgtattatgtcc

SEQ ID NO: 4510604 - DNA, 12 bp, Homo sapiens
tgtaaaattaat

SEQ ID NO: 4510605 - DNA, 22 bp, Homo sapiens
tgtaaactgtactagtctgtgt

SEQ ID NO: 4510606 - DNA, 22 bp, Homo sapiens
tgtaaactgtgtattccaagac

SEQ ID NO: 4510607 - DNA, 17 bp, Homo sapiens
tgtaaacttggaatcaa

SEQ ID NO: 4510608 - DNA, 18 bp, Homo sapiens
tgtaaagacaaataaatg

SEQ ID NO: 4510609 - DNA, 23 bp, Homo sapiens
tgtaaagactgagcagaactgaa

SEQ ID NO: 4510610 - DNA, 21 bp, Homo sapiens
tgtaaagtatttgatgtacat

SEQ ID NO: 4510611 - DNA, 22 bp, Homo sapiens
tgtaaagttaatcagaaagaaa

SEQ ID NO: 4510612 - DNA, 18 bp, Homo sapiens
tgtaaagttatgtattta

SEQ ID NO: 4510613 - DNA, 20 bp, Homo sapiens
tgtaaagttggttggataag

SEQ ID NO: 4510614 - DNA, 15 bp, Homo sapiens
tgtaaataaactatt

SEQ ID NO: 4510615 - DNA, 18 bp, Homo sapiens
tgtaaataaactatttat

SEQ ID NO: 4510616 - DNA, 22 bp, Homo sapiens
tgtaaataaactatttatatca

SEQ ID NO: 4510617 - DNA, 21 bp, Homo sapiens
tgtaaataaccccattctttg

SEQ ID NO: 4510618 - DNA, 21 bp, Homo sapiens
tgtaaatacacatagcatgta

SEQ ID NO: 4510619 - DNA, 12 bp, Homo sapiens
tgtaaataggtt

SEQ ID NO: 4510620 - DNA, 13 bp, Homo sapiens
tgtaaataggttt

SEQ ID NO: 4510621 - DNA, 11 bp, Homo sapiens
tgtaaatatcc

SEQ ID NO: 4510622 - DNA, 12 bp, Homo sapiens
tggggtgcatct

SEQ ID NO: 4510623 - DNA, 15 bp, Homo sapiens
tggggtgccgcctgc

SEQ ID NO: 4510624 - DNA, 22 bp, Homo sapiens
tggggtgccttcactgggccag

SEQ ID NO: 4510625 - DNA, 23 bp, Homo sapiens
tggggtgccttcactgggccagt

SEQ ID NO: 4510626 - DNA, 22 bp, Homo sapiens
tggggtgggagtaacagggcag

SEQ ID NO: 4510627 - DNA, 22 bp, Homo sapiens
tggggtggggggatggtaagag

SEQ ID NO: 4510628 - DNA, 18 bp, Homo sapiens
tggggtgtggggtggggt

SEQ ID NO: 4510629 - DNA, 15 bp, Homo sapiens
tggggttcagcccct

SEQ ID NO: 4510630 - DNA, 22 bp, Homo sapiens
tggggttcctctgtacagcaag

SEQ ID NO: 4510631 - DNA, 15 bp, Homo sapiens
tggggttctctacag

SEQ ID NO: 4510632 - DNA, 16 bp, Homo sapiens
tggggttgccagaggc

SEQ ID NO: 4510633 - DNA, 20 bp, Homo sapiens
tggggttgccagaggccctg

SEQ ID NO: 4510634 - DNA, 22 bp, Homo sapiens
tggggttgccagaggccctgga

SEQ ID NO: 4510635 - DNA, 17 bp, Homo sapiens
tgggtaacttagaagga

SEQ ID NO: 4510636 - DNA, 22 bp, Homo sapiens
tgggtaagaaagccaccttgtt

SEQ ID NO: 4510637 - DNA, 12 bp, Homo sapiens
tgggtaagaaga

SEQ ID NO: 4510638 - DNA, 14 bp, Homo sapiens
tgggtaagaagaaa

SEQ ID NO: 4510639 - DNA, 16 bp, Homo sapiens
tgggtaagggagggaa

SEQ ID NO: 4510640 - DNA, 17 bp, Homo sapiens
tgggtacttatactaaa

SEQ ID NO: 4510641 - DNA, 21 bp, Homo sapiens
tgggtagaaaaattattagaa

SEQ ID NO: 4510642 - DNA, 20 bp, Homo sapiens
tgggtatattgataaatttt

SEQ ID NO: 4510643 - DNA, 21 bp, Homo sapiens
tgggtcacagagtgagactcc

SEQ ID NO: 4510644 - DNA, 15 bp, Homo sapiens
tgggtcactcattaa

SEQ ID NO: 4510645 - DNA, 17 bp, Homo sapiens
tgggtcagaaccctgcc

SEQ ID NO: 4510646 - DNA, 12 bp, Homo sapiens
tgggtcagtctg

SEQ ID NO: 4510647 - DNA, 13 bp, Homo sapiens
tgggtccagggag

SEQ ID NO: 4510648 - DNA, 21 bp, Homo sapiens
tgggtccaggggcccctccag

SEQ ID NO: 4510649 - DNA, 23 bp, Homo sapiens
tgggtccccccgagtctccggga

SEQ ID NO: 4510650 - DNA, 19 bp, Homo sapiens
tgggtcccggctctgtggg

SEQ ID NO: 4510651 - DNA, 13 bp, Homo sapiens
tgggtcctagccc

SEQ ID NO: 4510652 - DNA, 14 bp, Homo sapiens
tgggtcctgccagc

SEQ ID NO: 4510653 - DNA, 14 bp, Homo sapiens
tgggtctctgaagg

SEQ ID NO: 4510654 - DNA, 13 bp, Homo sapiens
tgggtcttcagct

SEQ ID NO: 4510655 - DNA, 15 bp, Homo sapiens
tgggtcttcagcttt

SEQ ID NO: 4510656 - DNA, 20 bp, Homo sapiens
tgggtcttttataggaaaaa

SEQ ID NO: 4510657 - DNA, 13 bp, Homo sapiens
tgggtgagagaga

SEQ ID NO: 4510658 - DNA, 15 bp, Homo sapiens
tgggtgagagaggaa

SEQ ID NO: 4510659 - DNA, 20 bp, Homo sapiens
tgggtgatggaaactgccaa

SEQ ID NO: 4510660 - DNA, 15 bp, Homo sapiens
tgggtgctgccatga

SEQ ID NO: 4510661 - DNA, 16 bp, Homo sapiens
tgggtgctggtcctgt

SEQ ID NO: 4510662 - DNA, 19 bp, Homo sapiens
tgggtgggcctggccctgc

SEQ ID NO: 4510663 - DNA, 23 bp, Homo sapiens
tgggtgggcctggccctgctttc

SEQ ID NO: 4510664 - DNA, 17 bp, Homo sapiens
tgggtgtagatttctga

SEQ ID NO: 4510665 - DNA, 17 bp, Homo sapiens
tgggtgtcaagtgcctg

SEQ ID NO: 4510666 - DNA, 19 bp, Homo sapiens
tgggtgtcatttcattcca

SEQ ID NO: 4510667 - DNA, 15 bp, Homo sapiens
tgggtgttctttcct

SEQ ID NO: 4510668 - DNA, 19 bp, Homo sapiens
tgggtgttctttcctgccc

SEQ ID NO: 4510669 - DNA, 21 bp, Homo sapiens
tgggttatcatggaagaaaag

SEQ ID NO: 4510670 - DNA, 20 bp, Homo sapiens
tgggttccctttccttccat

SEQ ID NO: 4510671 - DNA, 19 bp, Homo sapiens
tgggttttgtattctctga

SEQ ID NO: 4510672 - DNA, 16 bp, Homo sapiens
tgggtttttgctgttt

SEQ ID NO: 4510673 - DNA, 13 bp, Homo sapiens
tggtaaaatgtga

SEQ ID NO: 4510674 - DNA, 16 bp, Homo sapiens
tggtaaagactggctt

SEQ ID NO: 4510675 - DNA, 10 bp, Homo sapiens
tggtaacatt

SEQ ID NO: 4510676 - DNA, 22 bp, Homo sapiens
tggtaaccagccctgcacgacc

SEQ ID NO: 4510677 - DNA, 22 bp, Homo sapiens
tggtaactgctttctgttccaa

SEQ ID NO: 4510678 - DNA, 24 bp, Homo sapiens
tggtaacttttgtgaattaggctg

SEQ ID NO: 4510679 - DNA, 14 bp, Homo sapiens
tggtaagagaagtg

SEQ ID NO: 4510680 - DNA, 12 bp, Homo sapiens
tggtaagattgt

SEQ ID NO: 4510681 - DNA, 16 bp, Homo sapiens
tggtacacaatgtgat

SEQ ID NO: 4510682 - DNA, 20 bp, Homo sapiens
tggtacacatgtgttatcta

SEQ ID NO: 4510683 - DNA, 19 bp, Homo sapiens
tggtacataggcttctatt

SEQ ID NO: 4510684 - DNA, 20 bp, Homo sapiens
tggtacccgcccttccgagc

SEQ ID NO: 4510685 - DNA, 18 bp, Homo sapiens
tggtactgtagcagggga

SEQ ID NO: 4510686 - DNA, 22 bp, Homo sapiens
tggtacttcctctgtgaactgt

SEQ ID NO: 4510687 - DNA, 16 bp, Homo sapiens
tggtactttgcagctg

SEQ ID NO: 4510688 - DNA, 16 bp, Homo sapiens
tggtagatgacaaata

SEQ ID NO: 4510689 - DNA, 17 bp, Homo sapiens
tggtagatttttttcat

SEQ ID NO: 4510690 - DNA, 15 bp, Homo sapiens
tggtagcagcaggct

SEQ ID NO: 4510691 - DNA, 20 bp, Homo sapiens
tggtagccatcaagcacttc

SEQ ID NO: 4510692 - DNA, 13 bp, Homo sapiens
tggtaggaactgc

SEQ ID NO: 4510693 - DNA, 20 bp, Homo sapiens
tggtaggaactgctgggctt

SEQ ID NO: 4510694 - DNA, 16 bp, Homo sapiens
tggtaggcatttccta

SEQ ID NO: 4510695 - DNA, 19 bp, Homo sapiens
tggtagggtataatgtgtc

SEQ ID NO: 4510696 - DNA, 21 bp, Homo sapiens
tggtagttctgtgcctccccc

SEQ ID NO: 4510697 - DNA, 15 bp, Homo sapiens
tggtagttttacagt

SEQ ID NO: 4510698 - DNA, 17 bp, Homo sapiens
tggtatagccatgattt

SEQ ID NO: 4510699 - DNA, 16 bp, Homo sapiens
tggtatcaaaattaca

SEQ ID NO: 4510700 - DNA, 16 bp, Homo sapiens
tggtatcatatattaa

SEQ ID NO: 4510701 - DNA, 16 bp, Homo sapiens
tggtatcttaaagtgt

SEQ ID NO: 4510702 - DNA, 16 bp, Homo sapiens
tggtatgcattcttta

SEQ ID NO: 4510703 - DNA, 17 bp, Homo sapiens
tggtatgcattctttat

SEQ ID NO: 4510704 - DNA, 22 bp, Homo sapiens
tggtatgcattctttatagtga

SEQ ID NO: 4510705 - DNA, 18 bp, Homo sapiens
tggtatgctggccagcac

SEQ ID NO: 4510706 - DNA, 16 bp, Homo sapiens
tggtattaataaaaag

SEQ ID NO: 4510707 - DNA, 20 bp, Homo sapiens
tggtattcaactaatacatg

SEQ ID NO: 4510708 - DNA, 15 bp, Homo sapiens
tggtcacacactgat

SEQ ID NO: 4510709 - DNA, 20 bp, Homo sapiens
tggtcacagacttctggcct

SEQ ID NO: 4510710 - DNA, 16 bp, Homo sapiens
tggtcacagcctcctc

SEQ ID NO: 4510711 - DNA, 20 bp, Homo sapiens
tggtcacagtaaagagtaca

SEQ ID NO: 4510712 - DNA, 12 bp, Homo sapiens
tggtcagagtgc

SEQ ID NO: 4510713 - DNA, 17 bp, Homo sapiens
tggtcagagtgccactg

SEQ ID NO: 4510714 - DNA, 16 bp, Homo sapiens
tggtcagcaggtgtct

SEQ ID NO: 4510715 - DNA, 15 bp, Homo sapiens
tggtcagccctaggg

SEQ ID NO: 4510716 - DNA, 18 bp, Homo sapiens
tggtcattttatgttaag

SEQ ID NO: 4510717 - DNA, 15 bp, Homo sapiens
tggtccagcttgctc

SEQ ID NO: 4510718 - DNA, 12 bp, Homo sapiens
tggtccaggaga

SEQ ID NO: 4510719 - DNA, 16 bp, Homo sapiens
tggtccaggagaaggc

SEQ ID NO: 4510720 - DNA, 19 bp, Homo sapiens
tggtccagggaagctggcc

SEQ ID NO: 4510721 - DNA, 12 bp, Homo sapiens
tggtccagtgtc

SEQ ID NO: 4510722 - DNA, 13 bp, Homo sapiens
tggtccagtgtca

SEQ ID NO: 4510723 - DNA, 11 bp, Homo sapiens
tggtcccctcc

SEQ ID NO: 4510724 - DNA, 13 bp, Homo sapiens
tggtccctcaccc

SEQ ID NO: 4510725 - DNA, 22 bp, Homo sapiens
tggtcccttccaatgctgtggg

SEQ ID NO: 4510726 - DNA, 16 bp, Homo sapiens
tggtccggacactcct

SEQ ID NO: 4510727 - DNA, 16 bp, Homo sapiens
tggtcctaaaagcaaa

SEQ ID NO: 4510728 - DNA, 21 bp, Homo sapiens
tggtcctaaaagcaaaataaa

SEQ ID NO: 4510729 - DNA, 23 bp, Homo sapiens
tggtcctaaaagcaaaataaaaa

SEQ ID NO: 4510730 - DNA, 12 bp, Homo sapiens
tggtcctgactt

SEQ ID NO: 4510731 - DNA, 16 bp, Homo sapiens
tggtcctggtgctgcc

SEQ ID NO: 4510732 - DNA, 19 bp, Homo sapiens
tggtccttccctgatggcc

SEQ ID NO: 4510733 - DNA, 21 bp, Homo sapiens
tggtccttccctgatggcctt

SEQ ID NO: 4510734 - DNA, 15 bp, Homo sapiens
tggtcctttctggaa

SEQ ID NO: 4510735 - DNA, 18 bp, Homo sapiens
tggtctaaggttcagcct

SEQ ID NO: 4510736 - DNA, 23 bp, Homo sapiens
tggtctcccatatgcagaaatag

SEQ ID NO: 4510737 - DNA, 22 bp, Homo sapiens
tggtctgaggggcaactgagtc

SEQ ID NO: 4510738 - DNA, 23 bp, Homo sapiens
tggtcttatagtgtttggacagc

SEQ ID NO: 4510739 - DNA, 16 bp, Homo sapiens
tggtcttttataattc

SEQ ID NO: 4510740 - DNA, 23 bp, Homo sapiens
tggtgaaaacgtcttccttcttt

SEQ ID NO: 4510741 - DNA, 18 bp, Homo sapiens
tggtgaaagggtttgata

SEQ ID NO: 4510742 - DNA, 24 bp, Homo sapiens
tgggccctgcctgcagccagggct

SEQ ID NO: 4510743 - DNA, 14 bp, Homo sapiens
tgggccctgggctg

SEQ ID NO: 4510744 - DNA, 16 bp, Homo sapiens
tgggccctgggctggc

SEQ ID NO: 4510745 - DNA, 21 bp, Homo sapiens
tgggccctgtcgcccctcctt

SEQ ID NO: 4510746 - DNA, 13 bp, Homo sapiens
tgggccctttgag

SEQ ID NO: 4510747 - DNA, 22 bp, Homo sapiens
tgggcctgtggggactgaacct

SEQ ID NO: 4510748 - DNA, 15 bp, Homo sapiens
tgggcggggccttgc

SEQ ID NO: 4510749 - DNA, 16 bp, Homo sapiens
tgggcggggccttgcg

SEQ ID NO: 4510750 - DNA, 18 bp, Homo sapiens
tgggctattgctgctgcc

SEQ ID NO: 4510751 - DNA, 20 bp, Homo sapiens
tgggctcaaatgatcctccc

SEQ ID NO: 4510752 - DNA, 18 bp, Homo sapiens
tgggctccacgggcaggg

SEQ ID NO: 4510753 - DNA, 19 bp, Homo sapiens
tgggctccctgactgggag

SEQ ID NO: 4510754 - DNA, 17 bp, Homo sapiens
tgggctcggaggctgcc

SEQ ID NO: 4510755 - DNA, 18 bp, Homo sapiens
tgggctctccacctcagc

SEQ ID NO: 4510756 - DNA, 20 bp, Homo sapiens
tgggctctccacctcagcct

SEQ ID NO: 4510757 - DNA, 21 bp, Homo sapiens
tgggctctccacctcagcctt

SEQ ID NO: 4510758 - DNA, 19 bp, Homo sapiens
tgggctctgacagaaagca

SEQ ID NO: 4510759 - DNA, 21 bp, Homo sapiens
tgggctgaatgtatgtaaata

SEQ ID NO: 4510760 - DNA, 17 bp, Homo sapiens
tgggctgccaccagccc

SEQ ID NO: 4510761 - DNA, 19 bp, Homo sapiens
tgggctgccaccagccccc

SEQ ID NO: 4510762 - DNA, 23 bp, Homo sapiens
tgggctggacttctacctgccct

SEQ ID NO: 4510763 - DNA, 18 bp, Homo sapiens
tgggctggcacagcccct

SEQ ID NO: 4510764 - DNA, 19 bp, Homo sapiens
tgggctggcacagcccctg

SEQ ID NO: 4510765 - DNA, 20 bp, Homo sapiens
tgggctggcacagcccctgg

SEQ ID NO: 4510766 - DNA, 21 bp, Homo sapiens
tgggctggcgcttggatctgg

SEQ ID NO: 4510767 - DNA, 17 bp, Homo sapiens
tgggctgggtgctggga

SEQ ID NO: 4510768 - DNA, 15 bp, Homo sapiens
tgggctgtctgtcac

SEQ ID NO: 4510769 - DNA, 18 bp, Homo sapiens
tgggctgtctgtcaccag

SEQ ID NO: 4510770 - DNA, 21 bp, Homo sapiens
tgggctgtgtcctaaggccca

SEQ ID NO: 4510771 - DNA, 20 bp, Homo sapiens
tgggcttaaagcagaagccc

SEQ ID NO: 4510772 - DNA, 13 bp, Homo sapiens
tgggcttatatct

SEQ ID NO: 4510773 - DNA, 21 bp, Homo sapiens
tgggcttcctgcccttccctc

SEQ ID NO: 4510774 - DNA, 23 bp, Homo sapiens
tgggcttcctgcccttccctctg

SEQ ID NO: 4510775 - DNA, 15 bp, Homo sapiens
tgggcttggcctgct

SEQ ID NO: 4510776 - DNA, 17 bp, Homo sapiens
tgggcttggcctgctgt

SEQ ID NO: 4510777 - DNA, 19 bp, Homo sapiens
tgggcttggcctgctgtga

SEQ ID NO: 4510778 - DNA, 15 bp, Homo sapiens
tggggaacaggtccc

SEQ ID NO: 4510779 - DNA, 16 bp, Homo sapiens
tggggaacggaggagg

SEQ ID NO: 4510780 - DNA, 17 bp, Homo sapiens
tggggaagaacagcccc

SEQ ID NO: 4510781 - DNA, 17 bp, Homo sapiens
tggggaattaaatagtg

SEQ ID NO: 4510782 - DNA, 20 bp, Homo sapiens
tggggacacagcatcagctc

SEQ ID NO: 4510783 - DNA, 16 bp, Homo sapiens
tggggacagagggtgt

SEQ ID NO: 4510784 - DNA, 18 bp, Homo sapiens
tggggacctggcactggg

SEQ ID NO: 4510785 - DNA, 19 bp, Homo sapiens
tggggacgtgaacgtttta

SEQ ID NO: 4510786 - DNA, 21 bp, Homo sapiens
tggggacgtgaacgttttaat

SEQ ID NO: 4510787 - DNA, 19 bp, Homo sapiens
tggggactccggctgtgct

SEQ ID NO: 4510788 - DNA, 20 bp, Homo sapiens
tggggacttcaactgcccag

SEQ ID NO: 4510789 - DNA, 15 bp, Homo sapiens
tggggagagagccct

SEQ ID NO: 4510790 - DNA, 23 bp, Homo sapiens
tggggagagagcccttcccaggg

SEQ ID NO: 4510791 - DNA, 12 bp, Homo sapiens
tggggagatcca

SEQ ID NO: 4510792 - DNA, 15 bp, Homo sapiens
tggggagatgcttct

SEQ ID NO: 4510793 - DNA, 18 bp, Homo sapiens
tggggagctcctgggacc

SEQ ID NO: 4510794 - DNA, 19 bp, Homo sapiens
tggggagctcctgggaccc

SEQ ID NO: 4510795 - DNA, 12 bp, Homo sapiens
tggggaggctga

SEQ ID NO: 4510796 - DNA, 19 bp, Homo sapiens
tggggaggctgaggcagga

SEQ ID NO: 4510797 - DNA, 17 bp, Homo sapiens
tggggaggtgctggggg

SEQ ID NO: 4510798 - DNA, 19 bp, Homo sapiens
tggggaggtgctgggggag

SEQ ID NO: 4510799 - DNA, 24 bp, Homo sapiens
tggggaggtgctgggggagccctg

SEQ ID NO: 4510800 - DNA, 18 bp, Homo sapiens
tggggagtttagggtggg

SEQ ID NO: 4510801 - DNA, 20 bp, Homo sapiens
tggggagtttagggtggggg

SEQ ID NO: 4510802 - DNA, 18 bp, Homo sapiens
tggggatagatgtgtgga

SEQ ID NO: 4510803 - DNA, 20 bp, Homo sapiens
tggggatagatgtgtggaca

SEQ ID NO: 4510804 - DNA, 22 bp, Homo sapiens
tggggatcttcccacaggaggg

SEQ ID NO: 4510805 - DNA, 15 bp, Homo sapiens
tggggattgcccctg

SEQ ID NO: 4510806 - DNA, 15 bp, Homo sapiens
tggggatttctggga

SEQ ID NO: 4510807 - DNA, 13 bp, Homo sapiens
tggggcagaagag

SEQ ID NO: 4510808 - DNA, 15 bp, Homo sapiens
tggggcagagcctcc

SEQ ID NO: 4510809 - DNA, 16 bp, Homo sapiens
tggggcaggctgggcc

SEQ ID NO: 4510810 - DNA, 18 bp, Homo sapiens
tggggcaggctgggccat

SEQ ID NO: 4510811 - DNA, 17 bp, Homo sapiens
tggggccagaggctggg

SEQ ID NO: 4510812 - DNA, 12 bp, Homo sapiens
tggggccccatc

SEQ ID NO: 4510813 - DNA, 21 bp, Homo sapiens
tggggccccatcttgatcttt

SEQ ID NO: 4510814 - DNA, 15 bp, Homo sapiens
tggggccctgggcct

SEQ ID NO: 4510815 - DNA, 22 bp, Homo sapiens
tggggccggttttcctcagctc

SEQ ID NO: 4510816 - DNA, 16 bp, Homo sapiens
tggggcctcagcctgc

SEQ ID NO: 4510817 - DNA, 21 bp, Homo sapiens
tggggcctcaggctccgggca

SEQ ID NO: 4510818 - DNA, 23 bp, Homo sapiens
tggggccttcgggaccctggggc

SEQ ID NO: 4510819 - DNA, 14 bp, Homo sapiens
tggggcctttgcca

SEQ ID NO: 4510820 - DNA, 20 bp, Homo sapiens
tggggcctttgccagcagag

SEQ ID NO: 4510821 - DNA, 22 bp, Homo sapiens
tggggcgcccacccggcccggc

SEQ ID NO: 4510822 - DNA, 20 bp, Homo sapiens
tggggcggagccccggctct

SEQ ID NO: 4510823 - DNA, 12 bp, Homo sapiens
tggggctcccag

SEQ ID NO: 4510824 - DNA, 15 bp, Homo sapiens
tggggctcccagcca

SEQ ID NO: 4510825 - DNA, 18 bp, Homo sapiens
tggggctcccagccaggc

SEQ ID NO: 4510826 - DNA, 19 bp, Homo sapiens
tggggctcccagccaggcc

SEQ ID NO: 4510827 - DNA, 20 bp, Homo sapiens
tggggctcccagccaggccc

SEQ ID NO: 4510828 - DNA, 21 bp, Homo sapiens
tggggctgacacccaggcccg

SEQ ID NO: 4510829 - DNA, 14 bp, Homo sapiens
tggggctgattgta

SEQ ID NO: 4510830 - DNA, 12 bp, Homo sapiens
tggggctggttt

SEQ ID NO: 4510831 - DNA, 12 bp, Homo sapiens
tggggctgtgtt

SEQ ID NO: 4510832 - DNA, 18 bp, Homo sapiens
tggggcttcacagccaca

SEQ ID NO: 4510833 - DNA, 20 bp, Homo sapiens
tgggggacagaaagagactc

SEQ ID NO: 4510834 - DNA, 19 bp, Homo sapiens
tgggggacgatcaggagga

SEQ ID NO: 4510835 - DNA, 11 bp, Homo sapiens
tgggggatgta

SEQ ID NO: 4510836 - DNA, 16 bp, Homo sapiens
tgggggcagagggcag

SEQ ID NO: 4510837 - DNA, 17 bp, Homo sapiens
tgggggcagagggcaga

SEQ ID NO: 4510838 - DNA, 21 bp, Homo sapiens
tgggggcagtctccccttcct

SEQ ID NO: 4510839 - DNA, 22 bp, Homo sapiens
tgggggcagtctccccttcctg

SEQ ID NO: 4510840 - DNA, 23 bp, Homo sapiens
tggggggacagagactcagatga

SEQ ID NO: 4510841 - DNA, 13 bp, Homo sapiens
tggggggcagggc

SEQ ID NO: 4510842 - DNA, 20 bp, Homo sapiens
tgggggggaccgggcccctc

SEQ ID NO: 4510843 - DNA, 20 bp, Homo sapiens
tgggggggccaaaaggaaaa

SEQ ID NO: 4510844 - DNA, 23 bp, Homo sapiens
tgggggtaagaaaagctggtctg

SEQ ID NO: 4510845 - DNA, 14 bp, Homo sapiens
tgggggtctgtgtg

SEQ ID NO: 4510846 - DNA, 14 bp, Homo sapiens
tgggggtggaggac

SEQ ID NO: 4510847 - DNA, 17 bp, Homo sapiens
tgggggtggaggaccga

SEQ ID NO: 4510848 - DNA, 14 bp, Homo sapiens
tgggggtggcaggc

SEQ ID NO: 4510849 - DNA, 23 bp, Homo sapiens
tgggggtggccatccctgggccc

SEQ ID NO: 4510850 - DNA, 13 bp, Homo sapiens
tgggggtgggaag

SEQ ID NO: 4510851 - DNA, 16 bp, Homo sapiens
tgggggtgggaagtgg

SEQ ID NO: 4510852 - DNA, 15 bp, Homo sapiens
tgggggtgggtcaga

SEQ ID NO: 4510853 - DNA, 16 bp, Homo sapiens
tggggtaagccagagc

SEQ ID NO: 4510854 - DNA, 18 bp, Homo sapiens
tggggtaagccagagcct

SEQ ID NO: 4510855 - DNA, 19 bp, Homo sapiens
tggggtaagccagagcctg

SEQ ID NO: 4510856 - DNA, 21 bp, Homo sapiens
tggggtaggttgggagaatgt

SEQ ID NO: 4510857 - DNA, 16 bp, Homo sapiens
tggggtcacagaggca

SEQ ID NO: 4510858 - DNA, 17 bp, Homo sapiens
tggggtccctccacccc

SEQ ID NO: 4510859 - DNA, 13 bp, Homo sapiens
tggggtctccctc

SEQ ID NO: 4510860 - DNA, 21 bp, Homo sapiens
tggggtctccctctcctgcct

SEQ ID NO: 4510861 - DNA, 22 bp, Homo sapiens
tggcattattaggtcttaaagt

SEQ ID NO: 4510862 - DNA, 22 bp, Homo sapiens
tggccaaaggaccgttttgtat

SEQ ID NO: 4510863 - DNA, 15 bp, Homo sapiens
tggccaacatggtga

SEQ ID NO: 4510864 - DNA, 15 bp, Homo sapiens
tggccaagcaggctg

SEQ ID NO: 4510865 - DNA, 16 bp, Homo sapiens
tggccaagttcttagt

SEQ ID NO: 4510866 - DNA, 23 bp, Homo sapiens
tggccacacaggcagggcctggc

SEQ ID NO: 4510867 - DNA, 15 bp, Homo sapiens
tggccacactggggc

SEQ ID NO: 4510868 - DNA, 18 bp, Homo sapiens
tggccacactggggctga

SEQ ID NO: 4510869 - DNA, 19 bp, Homo sapiens
tggccacactggggctgac

SEQ ID NO: 4510870 - DNA, 13 bp, Homo sapiens
tggccactcagct

SEQ ID NO: 4510871 - DNA, 17 bp, Homo sapiens
tggccactggatcctgc

SEQ ID NO: 4510872 - DNA, 20 bp, Homo sapiens
tggccactggatcctgctgc

SEQ ID NO: 4510873 - DNA, 21 bp, Homo sapiens
tggccactggatcctgctgct

SEQ ID NO: 4510874 - DNA, 21 bp, Homo sapiens
tggccagaaataaagggacca

SEQ ID NO: 4510875 - DNA, 13 bp, Homo sapiens
tggccagagcctc

SEQ ID NO: 4510876 - DNA, 13 bp, Homo sapiens
tggccagcaccct

SEQ ID NO: 4510877 - DNA, 16 bp, Homo sapiens
tggccagcagccccca

SEQ ID NO: 4510878 - DNA, 21 bp, Homo sapiens
tggccagcccctggggcccag

SEQ ID NO: 4510879 - DNA, 15 bp, Homo sapiens
tggccaggagctctt

SEQ ID NO: 4510880 - DNA, 22 bp, Homo sapiens
tggccaggagctcttcaggcct

SEQ ID NO: 4510881 - DNA, 23 bp, Homo sapiens
tggccaggagctcttcaggcctc

SEQ ID NO: 4510882 - DNA, 12 bp, Homo sapiens
tggccaggcaga

SEQ ID NO: 4510883 - DNA, 17 bp, Homo sapiens
tggccaggcagatctgt

SEQ ID NO: 4510884 - DNA, 20 bp, Homo sapiens
tggccaggctggtcttgaac

SEQ ID NO: 4510885 - DNA, 22 bp, Homo sapiens
tggccaggggtgctcctgtgct

SEQ ID NO: 4510886 - DNA, 13 bp, Homo sapiens
tggccaggtgccg

SEQ ID NO: 4510887 - DNA, 15 bp, Homo sapiens
tggccagtgctgccc

SEQ ID NO: 4510888 - DNA, 18 bp, Homo sapiens
tggccatatatgctgtat

SEQ ID NO: 4510889 - DNA, 13 bp, Homo sapiens
tggccatccctgg

SEQ ID NO: 4510890 - DNA, 14 bp, Homo sapiens
tggccatccctggg

SEQ ID NO: 4510891 - DNA, 23 bp, Homo sapiens
tggccatccctgggcccctccac

SEQ ID NO: 4510892 - DNA, 22 bp, Homo sapiens
tggccatttccaagaggctgta

SEQ ID NO: 4510893 - DNA, 13 bp, Homo sapiens
tggcccaatgcct

SEQ ID NO: 4510894 - DNA, 19 bp, Homo sapiens
tggcccaatgcctataaaa

SEQ ID NO: 4510895 - DNA, 11 bp, Homo sapiens
tggcccagaga

SEQ ID NO: 4510896 - DNA, 19 bp, Homo sapiens
tggcccagcacgagcctgg

SEQ ID NO: 4510897 - DNA, 17 bp, Homo sapiens
tggcccagccctgctgg

SEQ ID NO: 4510898 - DNA, 20 bp, Homo sapiens
tggcccagccctgctggccg

SEQ ID NO: 4510899 - DNA, 17 bp, Homo sapiens
tggcccagggtggccac

SEQ ID NO: 4510900 - DNA, 18 bp, Homo sapiens
tggcccagggtggccaca

SEQ ID NO: 4510901 - DNA, 14 bp, Homo sapiens
tggcccaggtgccc

SEQ ID NO: 4510902 - DNA, 12 bp, Homo sapiens
tggcccagtgtc

SEQ ID NO: 4510903 - DNA, 19 bp, Homo sapiens
tggccccatgtctctcaga

SEQ ID NO: 4510904 - DNA, 21 bp, Homo sapiens
tggccccatgtctctcagaat

SEQ ID NO: 4510905 - DNA, 22 bp, Homo sapiens
tggcccccaataaaggcagctg

SEQ ID NO: 4510906 - DNA, 13 bp, Homo sapiens
tggcccccacagc

SEQ ID NO: 4510907 - DNA, 19 bp, Homo sapiens
tggcccccatcagccctgc

SEQ ID NO: 4510908 - DNA, 20 bp, Homo sapiens
tggcccccatcagccctgct

SEQ ID NO: 4510909 - DNA, 17 bp, Homo sapiens
tggcccctcacccacca

SEQ ID NO: 4510910 - DNA, 19 bp, Homo sapiens
tggcccctcacccaccatg

SEQ ID NO: 4510911 - DNA, 19 bp, Homo sapiens
tggcccctccccctgccag

SEQ ID NO: 4510912 - DNA, 14 bp, Homo sapiens
tggcccctcccctg

SEQ ID NO: 4510913 - DNA, 14 bp, Homo sapiens
tggcccggcagggc

SEQ ID NO: 4510914 - DNA, 19 bp, Homo sapiens
tggccctaaatagcagaaa

SEQ ID NO: 4510915 - DNA, 15 bp, Homo sapiens
tggccctgcaaaagg

SEQ ID NO: 4510916 - DNA, 12 bp, Homo sapiens
tggccctgcctt

SEQ ID NO: 4510917 - DNA, 20 bp, Homo sapiens
tggccctgctttctacgcca

SEQ ID NO: 4510918 - DNA, 13 bp, Homo sapiens
tggccctggcctg

SEQ ID NO: 4510919 - DNA, 23 bp, Homo sapiens
tggccctggggatcttcccacag

SEQ ID NO: 4510920 - DNA, 16 bp, Homo sapiens
tggccctgtcccaggc

SEQ ID NO: 4510921 - DNA, 17 bp, Homo sapiens
tggccgagctcctgggg

SEQ ID NO: 4510922 - DNA, 18 bp, Homo sapiens
tggccgagggtcctggct

SEQ ID NO: 4510923 - DNA, 19 bp, Homo sapiens
tggccgagggtcctggctc

SEQ ID NO: 4510924 - DNA, 20 bp, Homo sapiens
tggccgagggtcctggctcc

SEQ ID NO: 4510925 - DNA, 18 bp, Homo sapiens
tggccgcctcaccccctc

SEQ ID NO: 4510926 - DNA, 23 bp, Homo sapiens
tggccgcgccaaataatgtctct

SEQ ID NO: 4510927 - DNA, 18 bp, Homo sapiens
tggccgggactgctgctc

SEQ ID NO: 4510928 - DNA, 20 bp, Homo sapiens
tggccgggactgctgctctc

SEQ ID NO: 4510929 - DNA, 21 bp, Homo sapiens
tggccgggactgctgctctcc

SEQ ID NO: 4510930 - DNA, 22 bp, Homo sapiens
tggccgggactgctgctctccc

SEQ ID NO: 4510931 - DNA, 24 bp, Homo sapiens
tggccgggcacagtggctcacgcc

SEQ ID NO: 4510932 - DNA, 20 bp, Homo sapiens
tggccggtgccagctgccct

SEQ ID NO: 4510933 - DNA, 17 bp, Homo sapiens
tggccgtctcctccctc

SEQ ID NO: 4510934 - DNA, 21 bp, Homo sapiens
tggcctaaacctcagttatta

SEQ ID NO: 4510935 - DNA, 16 bp, Homo sapiens
tggcctaacctgccga

SEQ ID NO: 4510936 - DNA, 19 bp, Homo sapiens
tggcctatccgctgccagc

SEQ ID NO: 4510937 - DNA, 16 bp, Homo sapiens
tggcctatttcagctg

SEQ ID NO: 4510938 - DNA, 13 bp, Homo sapiens
tggcctcagccct

SEQ ID NO: 4510939 - DNA, 15 bp, Homo sapiens
tggcctcagccctca

SEQ ID NO: 4510940 - DNA, 17 bp, Homo sapiens
tggcctcagctgcctca

SEQ ID NO: 4510941 - DNA, 20 bp, Homo sapiens
tggcctccggcgtcagcctc

SEQ ID NO: 4510942 - DNA, 14 bp, Homo sapiens
tggcctctccccag

SEQ ID NO: 4510943 - DNA, 16 bp, Homo sapiens
tggcctctccccagga

SEQ ID NO: 4510944 - DNA, 14 bp, Homo sapiens
tggcctctgctttc

SEQ ID NO: 4510945 - DNA, 15 bp, Homo sapiens
tggcctctgtgccat

SEQ ID NO: 4510946 - DNA, 19 bp, Homo sapiens
tggcctcttcaggcctgct

SEQ ID NO: 4510947 - DNA, 16 bp, Homo sapiens
tggcctgacagctctg

SEQ ID NO: 4510948 - DNA, 15 bp, Homo sapiens
tggcctgagagggga

SEQ ID NO: 4510949 - DNA, 18 bp, Homo sapiens
tggcctgatctctgctcc

SEQ ID NO: 4510950 - DNA, 22 bp, Homo sapiens
tggcctgctaaggctcctcctt

SEQ ID NO: 4510951 - DNA, 19 bp, Homo sapiens
tggcctgggggaggtcaga

SEQ ID NO: 4510952 - DNA, 19 bp, Homo sapiens
tggcctggtttcctcgaga

SEQ ID NO: 4510953 - DNA, 20 bp, Homo sapiens
tggcctggtttcctcgagag

SEQ ID NO: 4510954 - DNA, 14 bp, Homo sapiens
tggcctgtctcatc

SEQ ID NO: 4510955 - DNA, 20 bp, Homo sapiens
tggcctgtctcatccccagg

SEQ ID NO: 4510956 - DNA, 21 bp, Homo sapiens
tggcctgttcttctatgggtt

SEQ ID NO: 4510957 - DNA, 23 bp, Homo sapiens
tggccttggaatatggccaaggc

SEQ ID NO: 4510958 - DNA, 16 bp, Homo sapiens
tggcctttccttccct

SEQ ID NO: 4510959 - DNA, 21 bp, Homo sapiens
tggcctttccttccctctctg

SEQ ID NO: 4510960 - DNA, 15 bp, Homo sapiens
tggcctttggaccca

SEQ ID NO: 4510961 - DNA, 16 bp, Homo sapiens
tggcctttggacccag

SEQ ID NO: 4510962 - DNA, 18 bp, Homo sapiens
tggcctttggacccaggg

SEQ ID NO: 4510963 - DNA, 19 bp, Homo sapiens
tggcctttttcatttatct

SEQ ID NO: 4510964 - DNA, 15 bp, Homo sapiens
tggcgcaatctcagc

SEQ ID NO: 4510965 - DNA, 16 bp, Homo sapiens
tggcgcaggtgggctg

SEQ ID NO: 4510966 - DNA, 15 bp, Homo sapiens
tggcgctcagcagcc

SEQ ID NO: 4510967 - DNA, 23 bp, Homo sapiens
tggcggctactcagcagccctcc

SEQ ID NO: 4510968 - DNA, 15 bp, Homo sapiens
tggcgtgctcagacc

SEQ ID NO: 4510969 - DNA, 14 bp, Homo sapiens
tggctaacagtcta

SEQ ID NO: 4510970 - DNA, 16 bp, Homo sapiens
tggctaacagtctagt

SEQ ID NO: 4510971 - DNA, 19 bp, Homo sapiens
tggctaacttttcattttt

SEQ ID NO: 4510972 - DNA, 18 bp, Homo sapiens
tggctaagcaaaatgtga

SEQ ID NO: 4510973 - DNA, 16 bp, Homo sapiens
tggctaattttctgta

SEQ ID NO: 4510974 - DNA, 22 bp, Homo sapiens
tggctagaggccagccccaccc

SEQ ID NO: 4510975 - DNA, 23 bp, Homo sapiens
tggctagaggccagccccaccca

SEQ ID NO: 4510976 - DNA, 23 bp, Homo sapiens
tggctataacagtgtctttctag

SEQ ID NO: 4510977 - DNA, 19 bp, Homo sapiens
tggctataggtgctacaaa

SEQ ID NO: 4510978 - DNA, 14 bp, Homo sapiens
tggctatgaacaga

SEQ ID NO: 4510979 - DNA, 18 bp, Homo sapiens
tggctatgtttttaatgt

SEQ ID NO: 4510980 - DNA, 14 bp, Homo sapiens
tggctcacactgag

SEQ ID NO: 4510981 - DNA, 22 bp, Homo sapiens
tgtaccagttaatttttccaac

SEQ ID NO: 4510982 - DNA, 23 bp, Homo sapiens
tgtaccagttaatttttccaact

SEQ ID NO: 4510983 - DNA, 14 bp, Homo sapiens
tgtaccatagaaaa

SEQ ID NO: 4510984 - DNA, 22 bp, Homo sapiens
tgtaccatagaaaaatgtataa

SEQ ID NO: 4510985 - DNA, 15 bp, Homo sapiens
tgtacctcagtggat

SEQ ID NO: 4510986 - DNA, 22 bp, Homo sapiens
tgtacctcagtggatcttcaga

SEQ ID NO: 4510987 - DNA, 16 bp, Homo sapiens
tgtaccttaagatatt

SEQ ID NO: 4510988 - DNA, 18 bp, Homo sapiens
tgtaccttctttcactct

SEQ ID NO: 4510989 - DNA, 15 bp, Homo sapiens
tgtaccttgaccatc

SEQ ID NO: 4510990 - DNA, 15 bp, Homo sapiens
tgtactaaggagcat

SEQ ID NO: 4510991 - DNA, 14 bp, Homo sapiens
tgtactacagctat

SEQ ID NO: 4510992 - DNA, 16 bp, Homo sapiens
tgtactacagctatat

SEQ ID NO: 4510993 - DNA, 18 bp, Homo sapiens
tgtactacagctatattt

SEQ ID NO: 4510994 - DNA, 12 bp, Homo sapiens
tgtactcagggc

SEQ ID NO: 4510995 - DNA, 12 bp, Homo sapiens
tgtactccagcc

SEQ ID NO: 4510996 - DNA, 15 bp, Homo sapiens
tgtactccagcctgg

SEQ ID NO: 4510997 - DNA, 14 bp, Homo sapiens
tgtactcccagcac

SEQ ID NO: 4510998 - DNA, 16 bp, Homo sapiens
tgtactcccagcactt

SEQ ID NO: 4510999 - DNA, 16 bp, Homo sapiens
tgtactgaattcttta

SEQ ID NO: 4511000 - DNA, 15 bp, Homo sapiens
tgtactttatatctt

SEQ ID NO: 4511001 - DNA, 13 bp, Homo sapiens
tgtacttttcatt

SEQ ID NO: 4511002 - DNA, 22 bp, Homo sapiens
tgtacttttcattctcttttaa

SEQ ID NO: 4511003 - DNA, 20 bp, Homo sapiens
tgtagaaaagggaactgaac

SEQ ID NO: 4511004 - DNA, 23 bp, Homo sapiens
tgtagaaaatttgttattttgca

SEQ ID NO: 4511005 - DNA, 21 bp, Homo sapiens
tgtagaaaggggagaatgtca

SEQ ID NO: 4511006 - DNA, 14 bp, Homo sapiens
tgtagaataaatgg

SEQ ID NO: 4511007 - DNA, 22 bp, Homo sapiens
tgtagaatctcttcatgcttga

SEQ ID NO: 4511008 - DNA, 20 bp, Homo sapiens
tgtagactctaagatacact

SEQ ID NO: 4511009 - DNA, 15 bp, Homo sapiens
tgtagactgtgccag

SEQ ID NO: 4511010 - DNA, 23 bp, Homo sapiens
tgtagagaacacgcgtatttaca

SEQ ID NO: 4511011 - DNA, 16 bp, Homo sapiens
tgtagattcaggtaat

SEQ ID NO: 4511012 - DNA, 14 bp, Homo sapiens
tgtagattgattgt

SEQ ID NO: 4511013 - DNA, 14 bp, Homo sapiens
tgtagatttgaaaa

SEQ ID NO: 4511014 - DNA, 16 bp, Homo sapiens
tgtagatttgaaaatt

SEQ ID NO: 4511015 - DNA, 18 bp, Homo sapiens
tgtagattttatagtgtg

SEQ ID NO: 4511016 - DNA, 21 bp, Homo sapiens
tgtagattttgttatgttcaa

SEQ ID NO: 4511017 - DNA, 13 bp, Homo sapiens
tgtagcaaatttg

SEQ ID NO: 4511018 - DNA, 21 bp, Homo sapiens
tgtagcaatggccagagcctc

SEQ ID NO: 4511019 - DNA, 16 bp, Homo sapiens
tgtagccacagctgct

SEQ ID NO: 4511020 - DNA, 22 bp, Homo sapiens
tgtagccacagctgctgttctc

SEQ ID NO: 4511021 - DNA, 24 bp, Homo sapiens
tgtagccacagctgctgttctcag

SEQ ID NO: 4511022 - DNA, 16 bp, Homo sapiens
tgtagcttatctgccc

SEQ ID NO: 4511023 - DNA, 18 bp, Homo sapiens
tgtagcttcagtcattaa

SEQ ID NO: 4511024 - DNA, 17 bp, Homo sapiens
tgtagctttcctggtcc

SEQ ID NO: 4511025 - DNA, 20 bp, Homo sapiens
tgtaggagctacccttttcc

SEQ ID NO: 4511026 - DNA, 20 bp, Homo sapiens
tgtaggatgacaggctctcc

SEQ ID NO: 4511027 - DNA, 21 bp, Homo sapiens
tgtaggcacttttattttcat

SEQ ID NO: 4511028 - DNA, 22 bp, Homo sapiens
tgtaggggttaacttggtcaga

SEQ ID NO: 4511029 - DNA, 20 bp, Homo sapiens
tgtagggtttggacagaccc

SEQ ID NO: 4511030 - DNA, 13 bp, Homo sapiens
tgtaggtaaaatg

SEQ ID NO: 4511031 - DNA, 19 bp, Homo sapiens
tgtaggtaaaatgtatttt

SEQ ID NO: 4511032 - DNA, 18 bp, Homo sapiens
tgtagtaaaatgttttca

SEQ ID NO: 4511033 - DNA, 20 bp, Homo sapiens
tgtagtaaaatgttttcatt

SEQ ID NO: 4511034 - DNA, 18 bp, Homo sapiens
tgtagtaaactattctta

SEQ ID NO: 4511035 - DNA, 15 bp, Homo sapiens
tgtagtaacactaat

SEQ ID NO: 4511036 - DNA, 17 bp, Homo sapiens
tgtagtaacactaatat

SEQ ID NO: 4511037 - DNA, 15 bp, Homo sapiens
tgtagtaattgacat

SEQ ID NO: 4511038 - DNA, 18 bp, Homo sapiens
tgtagtaattgacatgtg

SEQ ID NO: 4511039 - DNA, 19 bp, Homo sapiens
tgtagtaattgacatgtgc

SEQ ID NO: 4511040 - DNA, 21 bp, Homo sapiens
tgtagtatggcctgacagctc

SEQ ID NO: 4511041 - DNA, 23 bp, Homo sapiens
tgtagtatggcctgacagctctg

SEQ ID NO: 4511042 - DNA, 15 bp, Homo sapiens
tgtagtatggtatat

SEQ ID NO: 4511043 - DNA, 13 bp, Homo sapiens
tgtagtctcagct

SEQ ID NO: 4511044 - DNA, 21 bp, Homo sapiens
tgtagtgcatttttaaacttg

SEQ ID NO: 4511045 - DNA, 13 bp, Homo sapiens
tgtagttaatata

SEQ ID NO: 4511046 - DNA, 18 bp, Homo sapiens
tgtagttaatataaatgt

SEQ ID NO: 4511047 - DNA, 21 bp, Homo sapiens
tgtagtttgaaagttgtacat

SEQ ID NO: 4511048 - DNA, 23 bp, Homo sapiens
tgtagttttattttatgtttaga

SEQ ID NO: 4511049 - DNA, 22 bp, Homo sapiens
tgtagtttttaattaaaaactt

SEQ ID NO: 4511050 - DNA, 20 bp, Homo sapiens
tgtataaaaattatcaaaaa

SEQ ID NO: 4511051 - DNA, 18 bp, Homo sapiens
tgtataaaagtgtgaaat

SEQ ID NO: 4511052 - DNA, 16 bp, Homo sapiens
tgtataaacagaactc

SEQ ID NO: 4511053 - DNA, 15 bp, Homo sapiens
tgtataatactttgt

SEQ ID NO: 4511054 - DNA, 20 bp, Homo sapiens
tgtataatactttgtataca

SEQ ID NO: 4511055 - DNA, 22 bp, Homo sapiens
tgtataatattgaaaattgaaa

SEQ ID NO: 4511056 - DNA, 22 bp, Homo sapiens
tgtataatgtgcagaaaatatt

SEQ ID NO: 4511057 - DNA, 18 bp, Homo sapiens
tgtataattggatttcct

SEQ ID NO: 4511058 - DNA, 19 bp, Homo sapiens
tgtataattggatttccta

SEQ ID NO: 4511059 - DNA, 19 bp, Homo sapiens
tgtatacaagtactggtaa

SEQ ID NO: 4511060 - DNA, 15 bp, Homo sapiens
tgtatacatacatgt

SEQ ID NO: 4511061 - DNA, 17 bp, Homo sapiens
tgtatactatagtacca

SEQ ID NO: 4511062 - DNA, 19 bp, Homo sapiens
tgtatactcctgtcaccta

SEQ ID NO: 4511063 - DNA, 21 bp, Homo sapiens
tgtatactttaaataatttaa

SEQ ID NO: 4511064 - DNA, 18 bp, Homo sapiens
tgtatagatatttcctct

SEQ ID NO: 4511065 - DNA, 16 bp, Homo sapiens
tgtatagcttttatct

SEQ ID NO: 4511066 - DNA, 16 bp, Homo sapiens
tgtataggaatttgta

SEQ ID NO: 4511067 - DNA, 15 bp, Homo sapiens
tgtatagtaaatcac

SEQ ID NO: 4511068 - DNA, 11 bp, Homo sapiens
tgtatagtgtt

SEQ ID NO: 4511069 - DNA, 15 bp, Homo sapiens
tgtatagtgttcaca

SEQ ID NO: 4511070 - DNA, 19 bp, Homo sapiens
tgtatataaacatattttt

SEQ ID NO: 4511071 - DNA, 15 bp, Homo sapiens
tgtatataaatatat

SEQ ID NO: 4511072 - DNA, 13 bp, Homo sapiens
tgtatatactttt

SEQ ID NO: 4511073 - DNA, 20 bp, Homo sapiens
tgtatatatcttataactgt

SEQ ID NO: 4511074 - DNA, 20 bp, Homo sapiens
tgtatatatggatcagagga

SEQ ID NO: 4511075 - DNA, 18 bp, Homo sapiens
tgtatatatgtgtgccct

SEQ ID NO: 4511076 - DNA, 20 bp, Homo sapiens
tgtatatattattataatct

SEQ ID NO: 4511077 - DNA, 13 bp, Homo sapiens
tgtatatcgttat

SEQ ID NO: 4511078 - DNA, 18 bp, Homo sapiens
tgtatatctcttggaaaa

SEQ ID NO: 4511079 - DNA, 21 bp, Homo sapiens
tgtatattaagaagcaataac

SEQ ID NO: 4511080 - DNA, 15 bp, Homo sapiens
tgtatattacaatga

SEQ ID NO: 4511081 - DNA, 13 bp, Homo sapiens
tgtatattacacc

SEQ ID NO: 4511082 - DNA, 15 bp, Homo sapiens
tgtatattacaccaa

SEQ ID NO: 4511083 - DNA, 20 bp, Homo sapiens
tgtatattgggtgtagattt

SEQ ID NO: 4511084 - DNA, 13 bp, Homo sapiens
tgtatattgtaat

SEQ ID NO: 4511085 - DNA, 22 bp, Homo sapiens
tgtatatttttatctatataaa

SEQ ID NO: 4511086 - DNA, 14 bp, Homo sapiens
tgtatcaatttcta

SEQ ID NO: 4511087 - DNA, 17 bp, Homo sapiens
tgtatcaatttctaatg

SEQ ID NO: 4511088 - DNA, 15 bp, Homo sapiens
tgtatcagtgtcctt

SEQ ID NO: 4511089 - DNA, 19 bp, Homo sapiens
tgtatcagtgtcctttcca

SEQ ID NO: 4511090 - DNA, 13 bp, Homo sapiens
tgtatcagtgttt

SEQ ID NO: 4511091 - DNA, 23 bp, Homo sapiens
tgtatcagtgtttatgtgctatt

SEQ ID NO: 4511092 - DNA, 16 bp, Homo sapiens
tgtatcatctttgcca

SEQ ID NO: 4511093 - DNA, 19 bp, Homo sapiens
tgtatcctccctggcagac

SEQ ID NO: 4511094 - DNA, 12 bp, Homo sapiens
tgtatctaagaa

SEQ ID NO: 4511095 - DNA, 21 bp, Homo sapiens
tgtatctacagtaatgaaatg

SEQ ID NO: 4511096 - DNA, 17 bp, Homo sapiens
tgtatctatttgtacaa

SEQ ID NO: 4511097 - DNA, 18 bp, Homo sapiens
tgtatgaaaaattgggga

SEQ ID NO: 4511098 - DNA, 14 bp, Homo sapiens
tgtatgaaatatat

SEQ ID NO: 4511099 - DNA, 16 bp, Homo sapiens
tgtatgaaatatatgt

SEQ ID NO: 4511100 - DNA, 18 bp, Homo sapiens
tgtatgaaatatatgtga

SEQ ID NO: 4511101 - DNA, 20 bp, Homo sapiens
tgtaaatattagtgcagtta

SEQ ID NO: 4511102 - DNA, 17 bp, Homo sapiens
tgtaaatattttaaaga

SEQ ID NO: 4511103 - DNA, 18 bp, Homo sapiens
tgtaaatattttaaagaa

SEQ ID NO: 4511104 - DNA, 14 bp, Homo sapiens
tgtaaatcctgtgt

SEQ ID NO: 4511105 - DNA, 15 bp, Homo sapiens
tgtaaatcctgtgtt

SEQ ID NO: 4511106 - DNA, 16 bp, Homo sapiens
tgtaaatctttttgct

SEQ ID NO: 4511107 - DNA, 19 bp, Homo sapiens
tgtaaatgcttaaatttca

SEQ ID NO: 4511108 - DNA, 21 bp, Homo sapiens
tgtaaatgcttaaatttcaga

SEQ ID NO: 4511109 - DNA, 10 bp, Homo sapiens
tgtaaattat

SEQ ID NO: 4511110 - DNA, 22 bp, Homo sapiens
tgtaaattatatttgtgctata

SEQ ID NO: 4511111 - DNA, 18 bp, Homo sapiens
tgtaaattgcagaattca

SEQ ID NO: 4511112 - DNA, 19 bp, Homo sapiens
tgtaaattgcagaattcaa

SEQ ID NO: 4511113 - DNA, 21 bp, Homo sapiens
tgtaaattgcagaattcaaaa

SEQ ID NO: 4511114 - DNA, 17 bp, Homo sapiens
tgtaaattgttgtttca

SEQ ID NO: 4511115 - DNA, 15 bp, Homo sapiens
tgtaaatttatgtga

SEQ ID NO: 4511116 - DNA, 17 bp, Homo sapiens
tgtaaccacaactttca

SEQ ID NO: 4511117 - DNA, 17 bp, Homo sapiens
tgtaactactttataac

SEQ ID NO: 4511118 - DNA, 21 bp, Homo sapiens
tgtaactaggctcagagatgt

SEQ ID NO: 4511119 - DNA, 12 bp, Homo sapiens
tgtaactccacc

SEQ ID NO: 4511120 - DNA, 16 bp, Homo sapiens
tgtaactgttacagta

SEQ ID NO: 4511121 - DNA, 21 bp, Homo sapiens
tgtaactgtttagatgaatgt

SEQ ID NO: 4511122 - DNA, 14 bp, Homo sapiens
tgtaacttcaaata

SEQ ID NO: 4511123 - DNA, 21 bp, Homo sapiens
tgtaagaacaactacctgagc

SEQ ID NO: 4511124 - DNA, 16 bp, Homo sapiens
tgtaagaacacatttt

SEQ ID NO: 4511125 - DNA, 19 bp, Homo sapiens
tgtaagaactacaaacaaa

SEQ ID NO: 4511126 - DNA, 16 bp, Homo sapiens
tgtaagaactgtacat

SEQ ID NO: 4511127 - DNA, 17 bp, Homo sapiens
tgtaagaaggcaatatt

SEQ ID NO: 4511128 - DNA, 16 bp, Homo sapiens
tgtaagaataatttat

SEQ ID NO: 4511129 - DNA, 20 bp, Homo sapiens
tgtaagacagtgccctgaga

SEQ ID NO: 4511130 - DNA, 19 bp, Homo sapiens
tgtaagcaacttgcttcta

SEQ ID NO: 4511131 - DNA, 21 bp, Homo sapiens
tgtaagcaacttgcttctaaa

SEQ ID NO: 4511132 - DNA, 13 bp, Homo sapiens
tgtaagccaaaga

SEQ ID NO: 4511133 - DNA, 18 bp, Homo sapiens
tgtaagccaaagaaatga

SEQ ID NO: 4511134 - DNA, 22 bp, Homo sapiens
tgtaagccaaagaaatgaacat

SEQ ID NO: 4511135 - DNA, 21 bp, Homo sapiens
tgtaaggcttgttccaatgcc

SEQ ID NO: 4511136 - DNA, 18 bp, Homo sapiens
tgtaagtaaatgctttga

SEQ ID NO: 4511137 - DNA, 20 bp, Homo sapiens
tgtaagtctgatttttaaga

SEQ ID NO: 4511138 - DNA, 22 bp, Homo sapiens
tgtaataaaactatttgtataa

SEQ ID NO: 4511139 - DNA, 13 bp, Homo sapiens
tgtaataaaactg

SEQ ID NO: 4511140 - DNA, 15 bp, Homo sapiens
tgtaataaaactgtt

SEQ ID NO: 4511141 - DNA, 13 bp, Homo sapiens
tgtaataaacagg

SEQ ID NO: 4511142 - DNA, 13 bp, Homo sapiens
tgtaataaagtgt

SEQ ID NO: 4511143 - DNA, 14 bp, Homo sapiens
tgtaataaagtgtt

SEQ ID NO: 4511144 - DNA, 19 bp, Homo sapiens
tgtaataaagtgttttcag

SEQ ID NO: 4511145 - DNA, 23 bp, Homo sapiens
tgtaataaatctaggatgtgatg

SEQ ID NO: 4511146 - DNA, 19 bp, Homo sapiens
tgtaataactttcttacca

SEQ ID NO: 4511147 - DNA, 13 bp, Homo sapiens
tgtaataagcaat

SEQ ID NO: 4511148 - DNA, 13 bp, Homo sapiens
tgtaataatgtac

SEQ ID NO: 4511149 - DNA, 21 bp, Homo sapiens
tgtaatacctgattgatcaca

SEQ ID NO: 4511150 - DNA, 20 bp, Homo sapiens
tgtaatagggaaaattctaa

SEQ ID NO: 4511151 - DNA, 16 bp, Homo sapiens
tgtaatatatttatat

SEQ ID NO: 4511152 - DNA, 21 bp, Homo sapiens
tgtaatatatttatatacttt

SEQ ID NO: 4511153 - DNA, 17 bp, Homo sapiens
tgtaatatggaaatctt

SEQ ID NO: 4511154 - DNA, 17 bp, Homo sapiens
tgtaatattgagggata

SEQ ID NO: 4511155 - DNA, 15 bp, Homo sapiens
tgtaatatttacaat

SEQ ID NO: 4511156 - DNA, 17 bp, Homo sapiens
tgtaatatttacaatgt

SEQ ID NO: 4511157 - DNA, 21 bp, Homo sapiens
tgtaatcattttaaattccac

SEQ ID NO: 4511158 - DNA, 16 bp, Homo sapiens
tgtaatcccagcactt

SEQ ID NO: 4511159 - DNA, 20 bp, Homo sapiens
tgtaatctaagtatatgtga

SEQ ID NO: 4511160 - DNA, 15 bp, Homo sapiens
tgtaatcttgaattg

SEQ ID NO: 4511161 - DNA, 13 bp, Homo sapiens
tgtaatgagcacc

SEQ ID NO: 4511162 - DNA, 23 bp, Homo sapiens
tgtaatgattttggaactgtgtt

SEQ ID NO: 4511163 - DNA, 22 bp, Homo sapiens
tgtaatggagcatcaagccact

SEQ ID NO: 4511164 - DNA, 14 bp, Homo sapiens
tgtaatgtaaataa

SEQ ID NO: 4511165 - DNA, 18 bp, Homo sapiens
tgtaatgtaaataaacta

SEQ ID NO: 4511166 - DNA, 21 bp, Homo sapiens
tgtaatgtaggcacttttatt

SEQ ID NO: 4511167 - DNA, 19 bp, Homo sapiens
tgtaatgttttctttgcaa

SEQ ID NO: 4511168 - DNA, 14 bp, Homo sapiens
tgtaattaaaagca

SEQ ID NO: 4511169 - DNA, 19 bp, Homo sapiens
tgtaattaaactagtttaa

SEQ ID NO: 4511170 - DNA, 17 bp, Homo sapiens
tgtaattaactgtaaac

SEQ ID NO: 4511171 - DNA, 19 bp, Homo sapiens
tgtaattaactgtaaactt

SEQ ID NO: 4511172 - DNA, 21 bp, Homo sapiens
tgtaattagtgccacttaatg

SEQ ID NO: 4511173 - DNA, 20 bp, Homo sapiens
tgtaattgtaattccaaaat

SEQ ID NO: 4511174 - DNA, 20 bp, Homo sapiens
tgtaatttaaaattgtgatg

SEQ ID NO: 4511175 - DNA, 22 bp, Homo sapiens
tgtaatttaaaattgtgatgtg

SEQ ID NO: 4511176 - DNA, 19 bp, Homo sapiens
tgtaatttcgccttaaact

SEQ ID NO: 4511177 - DNA, 21 bp, Homo sapiens
tgtaatttctttaaatgtgta

SEQ ID NO: 4511178 - DNA, 18 bp, Homo sapiens
tgtaatttgaatgagttt

SEQ ID NO: 4511179 - DNA, 17 bp, Homo sapiens
tgtaatttgtgtaataa

SEQ ID NO: 4511180 - DNA, 23 bp, Homo sapiens
tgtaattttatttgttctttttc

SEQ ID NO: 4511181 - DNA, 17 bp, Homo sapiens
tgtaattttattttaaa

SEQ ID NO: 4511182 - DNA, 13 bp, Homo sapiens
tgtaatttttgct

SEQ ID NO: 4511183 - DNA, 19 bp, Homo sapiens
tgtacaaacagtatttctg

SEQ ID NO: 4511184 - DNA, 16 bp, Homo sapiens
tgtacaaatcctctgt

SEQ ID NO: 4511185 - DNA, 12 bp, Homo sapiens
tgtacaaccctg

SEQ ID NO: 4511186 - DNA, 14 bp, Homo sapiens
tgtacaaccctgac

SEQ ID NO: 4511187 - DNA, 16 bp, Homo sapiens
tgtacaataaaaacat

SEQ ID NO: 4511188 - DNA, 20 bp, Homo sapiens
tgtacaataaaaacattgcc

SEQ ID NO: 4511189 - DNA, 15 bp, Homo sapiens
tgtacaatacaatgt

SEQ ID NO: 4511190 - DNA, 18 bp, Homo sapiens
tgtacaatgtacacactg

SEQ ID NO: 4511191 - DNA, 19 bp, Homo sapiens
tgtacacactttatttact

SEQ ID NO: 4511192 - DNA, 15 bp, Homo sapiens
tgtacacatttctta

SEQ ID NO: 4511193 - DNA, 20 bp, Homo sapiens
tgtacactttctgtctcaaa

SEQ ID NO: 4511194 - DNA, 15 bp, Homo sapiens
tgtacactttttaca

SEQ ID NO: 4511195 - DNA, 18 bp, Homo sapiens
tgtacactttttacagca

SEQ ID NO: 4511196 - DNA, 22 bp, Homo sapiens
tgtacactttttacagcagcaa

SEQ ID NO: 4511197 - DNA, 15 bp, Homo sapiens
tgtacagaaaacatg

SEQ ID NO: 4511198 - DNA, 13 bp, Homo sapiens
tgtacagactctt

SEQ ID NO: 4511199 - DNA, 14 bp, Homo sapiens
tgtacagaggaagc

SEQ ID NO: 4511200 - DNA, 14 bp, Homo sapiens
tgtacagtattgtg

SEQ ID NO: 4511201 - DNA, 14 bp, Homo sapiens
tgtacagtctgtca

SEQ ID NO: 4511202 - DNA, 18 bp, Homo sapiens
tgtacagttgagctcagg

SEQ ID NO: 4511203 - DNA, 12 bp, Homo sapiens
tgtacagttttt

SEQ ID NO: 4511204 - DNA, 19 bp, Homo sapiens
tgtacataactcctgtccc

SEQ ID NO: 4511205 - DNA, 20 bp, Homo sapiens
tgtacataactcctgtccct

SEQ ID NO: 4511206 - DNA, 17 bp, Homo sapiens
tgtacataattgcatga

SEQ ID NO: 4511207 - DNA, 16 bp, Homo sapiens
tgtacatatcaaatag

SEQ ID NO: 4511208 - DNA, 18 bp, Homo sapiens
tgtacatatcaaatagat

SEQ ID NO: 4511209 - DNA, 20 bp, Homo sapiens
tgtacatatttgagactagt

SEQ ID NO: 4511210 - DNA, 20 bp, Homo sapiens
tgtacatctattttggattg

SEQ ID NO: 4511211 - DNA, 21 bp, Homo sapiens
tgtacatctattttggattgt

SEQ ID NO: 4511212 - DNA, 18 bp, Homo sapiens
tgtacatgataagacatt

SEQ ID NO: 4511213 - DNA, 20 bp, Homo sapiens
tgtacattacagattaaaga

SEQ ID NO: 4511214 - DNA, 19 bp, Homo sapiens
tgtacattgtgagctctgg

SEQ ID NO: 4511215 - DNA, 24 bp, Homo sapiens
tgtacattgtgagctctggttatt

SEQ ID NO: 4511216 - DNA, 17 bp, Homo sapiens
tgtacatttaataatat

SEQ ID NO: 4511217 - DNA, 15 bp, Homo sapiens
tgtaccaaaatttta

SEQ ID NO: 4511218 - DNA, 19 bp, Homo sapiens
tgtaccagtgaatttttgc

SEQ ID NO: 4511219 - DNA, 21 bp, Homo sapiens
tgtaccagtgaatttttgcaa

SEQ ID NO: 4511220 - DNA, 14 bp, Homo sapiens
tgtaccagttaatt

SEQ ID NO: 4511221 - DNA, 20 bp, Homo sapiens
tgtcatctttttctagagtt

SEQ ID NO: 4511222 - DNA, 20 bp, Homo sapiens
tgtcatgctgggatttccaa

SEQ ID NO: 4511223 - DNA, 19 bp, Homo sapiens
tgtcatggtcctttctgga

SEQ ID NO: 4511224 - DNA, 21 bp, Homo sapiens
tgtcatggtcctttctggaag

SEQ ID NO: 4511225 - DNA, 22 bp, Homo sapiens
tgtcatgtgttccctttgtctt

SEQ ID NO: 4511226 - DNA, 14 bp, Homo sapiens
tgtcattatattct

SEQ ID NO: 4511227 - DNA, 23 bp, Homo sapiens
tgtcattcccctcttttgtcttc

SEQ ID NO: 4511228 - DNA, 13 bp, Homo sapiens
tgtcattggaagc

SEQ ID NO: 4511229 - DNA, 21 bp, Homo sapiens
tgtcattgtctactcctagaa

SEQ ID NO: 4511230 - DNA, 19 bp, Homo sapiens
tgtcatttccaccagcagt

SEQ ID NO: 4511231 - DNA, 12 bp, Homo sapiens
tgtcatttgcac

SEQ ID NO: 4511232 - DNA, 13 bp, Homo sapiens
tgtcatttgcaca

SEQ ID NO: 4511233 - DNA, 15 bp, Homo sapiens
tgtcatttgcacaca

SEQ ID NO: 4511234 - DNA, 14 bp, Homo sapiens
tgtcattttcttga

SEQ ID NO: 4511235 - DNA, 21 bp, Homo sapiens
tgtcattttcttgatgtcact

SEQ ID NO: 4511236 - DNA, 13 bp, Homo sapiens
tgtcattttggta

SEQ ID NO: 4511237 - DNA, 14 bp, Homo sapiens
tgtcatttttaaaa

SEQ ID NO: 4511238 - DNA, 16 bp, Homo sapiens
tgtcatttttaatgta

SEQ ID NO: 4511239 - DNA, 18 bp, Homo sapiens
tgtcatttttaatgtatc

SEQ ID NO: 4511240 - DNA, 20 bp, Homo sapiens
tgtccaaagaggctgcccct

SEQ ID NO: 4511241 - DNA, 14 bp, Homo sapiens
tgtccaccatgctc

SEQ ID NO: 4511242 - DNA, 20 bp, Homo sapiens
tgtccaccatgctctctcac

SEQ ID NO: 4511243 - DNA, 18 bp, Homo sapiens
tgtccacgactgtctcca

SEQ ID NO: 4511244 - DNA, 19 bp, Homo sapiens
tgtccacgtacttaattta

SEQ ID NO: 4511245 - DNA, 14 bp, Homo sapiens
tgtccactgttctg

SEQ ID NO: 4511246 - DNA, 15 bp, Homo sapiens
tgtccagacagcctg

SEQ ID NO: 4511247 - DNA, 17 bp, Homo sapiens
tgtccagacagcctgta

SEQ ID NO: 4511248 - DNA, 15 bp, Homo sapiens
tgtccagcagtctga

SEQ ID NO: 4511249 - DNA, 17 bp, Homo sapiens
tgtccagcattgctgga

SEQ ID NO: 4511250 - DNA, 19 bp, Homo sapiens
tgtccagcattgctggact

SEQ ID NO: 4511251 - DNA, 12 bp, Homo sapiens
tgtccagcctgg

SEQ ID NO: 4511252 - DNA, 14 bp, Homo sapiens
tgtccagcctgggc

SEQ ID NO: 4511253 - DNA, 19 bp, Homo sapiens
tgtccagcctgggcagcca

SEQ ID NO: 4511254 - DNA, 14 bp, Homo sapiens
tgtccagctggggc

SEQ ID NO: 4511255 - DNA, 21 bp, Homo sapiens
tgtccagggaaacagcctctc

SEQ ID NO: 4511256 - DNA, 13 bp, Homo sapiens
tgtccagttataa

SEQ ID NO: 4511257 - DNA, 14 bp, Homo sapiens
tgtccagttttctt

SEQ ID NO: 4511258 - DNA, 20 bp, Homo sapiens
tgtccatacactttgttgca

SEQ ID NO: 4511259 - DNA, 14 bp, Homo sapiens
tgtccattgtccaa

SEQ ID NO: 4511260 - DNA, 12 bp, Homo sapiens
tgtcccaagtgc

SEQ ID NO: 4511261 - DNA, 16 bp, Homo sapiens
tgtcccaccgggagcc

SEQ ID NO: 4511262 - DNA, 18 bp, Homo sapiens
tgtcccaccgggagcctc

SEQ ID NO: 4511263 - DNA, 22 bp, Homo sapiens
tgtcccaccgggagcctccccc

SEQ ID NO: 4511264 - DNA, 22 bp, Homo sapiens
tgtcccactacatctgggactg

SEQ ID NO: 4511265 - DNA, 22 bp, Homo sapiens
tgtcccagccccggcaagccac

SEQ ID NO: 4511266 - DNA, 18 bp, Homo sapiens
tgtcccagctaccaagtc

SEQ ID NO: 4511267 - DNA, 23 bp, Homo sapiens
tgtcccagtgctcaccagccctg

SEQ ID NO: 4511268 - DNA, 20 bp, Homo sapiens
tgtcccatctggtcatttgg

SEQ ID NO: 4511269 - DNA, 14 bp, Homo sapiens
tgtcccattctaga

SEQ ID NO: 4511270 - DNA, 15 bp, Homo sapiens
tgtcccattctagat

SEQ ID NO: 4511271 - DNA, 16 bp, Homo sapiens
tgtcccattctagatc

SEQ ID NO: 4511272 - DNA, 17 bp, Homo sapiens
tgtcccattctagatcc

SEQ ID NO: 4511273 - DNA, 21 bp, Homo sapiens
tgtcccattctagatcctgca

SEQ ID NO: 4511274 - DNA, 21 bp, Homo sapiens
tgtccccagcctacctctcca

SEQ ID NO: 4511275 - DNA, 19 bp, Homo sapiens
tgtcccccccaggccttgt

SEQ ID NO: 4511276 - DNA, 23 bp, Homo sapiens
tgtcccctcactctgtcagccag

SEQ ID NO: 4511277 - DNA, 16 bp, Homo sapiens
tgtccccttcccctgc

SEQ ID NO: 4511278 - DNA, 18 bp, Homo sapiens
tgtccccttcccctgctg

SEQ ID NO: 4511279 - DNA, 14 bp, Homo sapiens
tgtccccttctctc

SEQ ID NO: 4511280 - DNA, 22 bp, Homo sapiens
tgtccctgggggagtaattctg

SEQ ID NO: 4511281 - DNA, 13 bp, Homo sapiens
tgtccctgtcacc

SEQ ID NO: 4511282 - DNA, 17 bp, Homo sapiens
tgtccctgtccttccct

SEQ ID NO: 4511283 - DNA, 16 bp, Homo sapiens
tgtcccttgcctctgc

SEQ ID NO: 4511284 - DNA, 15 bp, Homo sapiens
tgtccctttccccta

SEQ ID NO: 4511285 - DNA, 22 bp, Homo sapiens
tgtccctttcccctagatccag

SEQ ID NO: 4511286 - DNA, 12 bp, Homo sapiens
tgtcccttttcc

SEQ ID NO: 4511287 - DNA, 13 bp, Homo sapiens
tgtcccttttccc

SEQ ID NO: 4511288 - DNA, 16 bp, Homo sapiens
tgtcctaatcatacac

SEQ ID NO: 4511289 - DNA, 22 bp, Homo sapiens
tgtcctaatcatataccagagg

SEQ ID NO: 4511290 - DNA, 16 bp, Homo sapiens
tgtcctaccactctaa

SEQ ID NO: 4511291 - DNA, 24 bp, Homo sapiens
tgtcctaccatcagctctgccttg

SEQ ID NO: 4511292 - DNA, 16 bp, Homo sapiens
tgtcctacgtccaagg

SEQ ID NO: 4511293 - DNA, 19 bp, Homo sapiens
tgtcctagaagttctttga

SEQ ID NO: 4511294 - DNA, 15 bp, Homo sapiens
tgtcctattatattc

SEQ ID NO: 4511295 - DNA, 12 bp, Homo sapiens
tgtcctcaggga

SEQ ID NO: 4511296 - DNA, 19 bp, Homo sapiens
tgtcctcagggagcaggga

SEQ ID NO: 4511297 - DNA, 17 bp, Homo sapiens
tgtcctccagaagcctc

SEQ ID NO: 4511298 - DNA, 19 bp, Homo sapiens
tgtcctccagaagcctctg

SEQ ID NO: 4511299 - DNA, 13 bp, Homo sapiens
tgtcctcttctgc

SEQ ID NO: 4511300 - DNA, 17 bp, Homo sapiens
tgtcctcttctgctctt

SEQ ID NO: 4511301 - DNA, 21 bp, Homo sapiens
tgtcctcttctgctcttttcc

SEQ ID NO: 4511302 - DNA, 20 bp, Homo sapiens
tgtcctgcacaccctgggcc

SEQ ID NO: 4511303 - DNA, 13 bp, Homo sapiens
tgtcctgcccgtg

SEQ ID NO: 4511304 - DNA, 17 bp, Homo sapiens
tgtcctgcctattatct

SEQ ID NO: 4511305 - DNA, 21 bp, Homo sapiens
tgtcctgggcctgcccctgtg

SEQ ID NO: 4511306 - DNA, 22 bp, Homo sapiens
tgtcctgtaaaggttacaagcc

SEQ ID NO: 4511307 - DNA, 16 bp, Homo sapiens
tgtcctgtaactgtta

SEQ ID NO: 4511308 - DNA, 23 bp, Homo sapiens
tgtcctgtgagatgtgtatcagt

SEQ ID NO: 4511309 - DNA, 13 bp, Homo sapiens
tgtcctgtgatgt

SEQ ID NO: 4511310 - DNA, 14 bp, Homo sapiens
tgtcctgtgatgtc

SEQ ID NO: 4511311 - DNA, 19 bp, Homo sapiens
tgtccttaacccacctctc

SEQ ID NO: 4511312 - DNA, 16 bp, Homo sapiens
tgtccttccattttca

SEQ ID NO: 4511313 - DNA, 12 bp, Homo sapiens
tgtccttccctg

SEQ ID NO: 4511314 - DNA, 16 bp, Homo sapiens
tgtccttccctgttct

SEQ ID NO: 4511315 - DNA, 19 bp, Homo sapiens
tgtccttccctgttctccc

SEQ ID NO: 4511316 - DNA, 20 bp, Homo sapiens
tgtcgaaaagagtcttccaa

SEQ ID NO: 4511317 - DNA, 22 bp, Homo sapiens
tgtcgaaaagagtcttccaatt

SEQ ID NO: 4511318 - DNA, 13 bp, Homo sapiens
tgtcgcccaggct

SEQ ID NO: 4511319 - DNA, 15 bp, Homo sapiens
tgtcgccccaggccc

SEQ ID NO: 4511320 - DNA, 21 bp, Homo sapiens
tgtcgccccaggccctccctg

SEQ ID NO: 4511321 - DNA, 23 bp, Homo sapiens
tgtcgccccaggccctccctgac

SEQ ID NO: 4511322 - DNA, 23 bp, Homo sapiens
tgtcgcccctccttttggcctgg

SEQ ID NO: 4511323 - DNA, 20 bp, Homo sapiens
tgtcggccccaccagtgcct

SEQ ID NO: 4511324 - DNA, 23 bp, Homo sapiens
tgtcggccccaccagtgcctctc

SEQ ID NO: 4511325 - DNA, 12 bp, Homo sapiens
tgtcggcctcta

SEQ ID NO: 4511326 - DNA, 14 bp, Homo sapiens
tgtcggcctctaac

SEQ ID NO: 4511327 - DNA, 16 bp, Homo sapiens
tgtcgtaaagatttgg

SEQ ID NO: 4511328 - DNA, 14 bp, Homo sapiens
tgtctaaaaacatt

SEQ ID NO: 4511329 - DNA, 13 bp, Homo sapiens
tgtctacatttct

SEQ ID NO: 4511330 - DNA, 19 bp, Homo sapiens
tgtctactcctagaagaac

SEQ ID NO: 4511331 - DNA, 23 bp, Homo sapiens
tgtctactcctagaagaaccaaa

SEQ ID NO: 4511332 - DNA, 22 bp, Homo sapiens
tgtctagagaacactgtgctct

SEQ ID NO: 4511333 - DNA, 13 bp, Homo sapiens
tgtctagagcaac

SEQ ID NO: 4511334 - DNA, 19 bp, Homo sapiens
tgtctaggcaggacctgtg

SEQ ID NO: 4511335 - DNA, 19 bp, Homo sapiens
tgtctaggtctcctcaggg

SEQ ID NO: 4511336 - DNA, 18 bp, Homo sapiens
tgtctaggttaaagctaa

SEQ ID NO: 4511337 - DNA, 22 bp, Homo sapiens
tgtctaggttaaagctaaactg

SEQ ID NO: 4511338 - DNA, 20 bp, Homo sapiens
tgtctattatagtgaaacat

SEQ ID NO: 4511339 - DNA, 20 bp, Homo sapiens
tgtctattatttagaaatga

SEQ ID NO: 4511340 - DNA, 14 bp, Homo sapiens
tgtctattcagctt

SEQ ID NO: 4511341 - DNA, 18 bp, Homo sapiens
tgtatgaataatgaaaat

SEQ ID NO: 4511342 - DNA, 13 bp, Homo sapiens
tgtatgacagtga

SEQ ID NO: 4511343 - DNA, 12 bp, Homo sapiens
tgtatgattact

SEQ ID NO: 4511344 - DNA, 18 bp, Homo sapiens
tgtatgccaagtgagaag

SEQ ID NO: 4511345 - DNA, 12 bp, Homo sapiens
tgtatgccttta

SEQ ID NO: 4511346 - DNA, 19 bp, Homo sapiens
tgtatggatatatttgaaa

SEQ ID NO: 4511347 - DNA, 18 bp, Homo sapiens
tgtatggatttccagttt

SEQ ID NO: 4511348 - DNA, 20 bp, Homo sapiens
tgtatgtacaatacaatgta

SEQ ID NO: 4511349 - DNA, 21 bp, Homo sapiens
tgtatgtacaatacaatgtac

SEQ ID NO: 4511350 - DNA, 14 bp, Homo sapiens
tgtatgtatgtcca

SEQ ID NO: 4511351 - DNA, 12 bp, Homo sapiens
tgtatgtggggg

SEQ ID NO: 4511352 - DNA, 20 bp, Homo sapiens
tgtatgtgggggtctgtgtg

SEQ ID NO: 4511353 - DNA, 22 bp, Homo sapiens
tgtatgtgggggtctgtgtgtt

SEQ ID NO: 4511354 - DNA, 19 bp, Homo sapiens
tgtatgtttgctgattatt

SEQ ID NO: 4511355 - DNA, 15 bp, Homo sapiens
tgtatgtttttctgt

SEQ ID NO: 4511356 - DNA, 16 bp, Homo sapiens
tgtatgtttttctgta

SEQ ID NO: 4511357 - DNA, 15 bp, Homo sapiens
tgtattaaatggttt

SEQ ID NO: 4511358 - DNA, 18 bp, Homo sapiens
tgtattaacatgcaataa

SEQ ID NO: 4511359 - DNA, 20 bp, Homo sapiens
tgtattaagaaaggaagcat

SEQ ID NO: 4511360 - DNA, 14 bp, Homo sapiens
tgtattaagccact

SEQ ID NO: 4511361 - DNA, 15 bp, Homo sapiens
tgtattatgtcctgt

SEQ ID NO: 4511362 - DNA, 20 bp, Homo sapiens
tgtattatgtcctgtgagat

SEQ ID NO: 4511363 - DNA, 15 bp, Homo sapiens
tgtattccaagacat

SEQ ID NO: 4511364 - DNA, 21 bp, Homo sapiens
tgtattccaagacatgtctgt

SEQ ID NO: 4511365 - DNA, 18 bp, Homo sapiens
tgtattcctttaaaatat

SEQ ID NO: 4511366 - DNA, 17 bp, Homo sapiens
tgtattcgtgcattttt

SEQ ID NO: 4511367 - DNA, 14 bp, Homo sapiens
tgtattctctgagc

SEQ ID NO: 4511368 - DNA, 21 bp, Homo sapiens
tgtattctctgagctgtgcag

SEQ ID NO: 4511369 - DNA, 19 bp, Homo sapiens
tgtattctctgcaatttta

SEQ ID NO: 4511370 - DNA, 14 bp, Homo sapiens
tgtattctgaggat

SEQ ID NO: 4511371 - DNA, 16 bp, Homo sapiens
tgtattcttcatgaaa

SEQ ID NO: 4511372 - DNA, 17 bp, Homo sapiens
tgtattcttcatgaaat

SEQ ID NO: 4511373 - DNA, 15 bp, Homo sapiens
tgtattgagtcttaa

SEQ ID NO: 4511374 - DNA, 19 bp, Homo sapiens
tgtattgagtcttaactgt

SEQ ID NO: 4511375 - DNA, 20 bp, Homo sapiens
tgtattgagtcttaactgta

SEQ ID NO: 4511376 - DNA, 22 bp, Homo sapiens
tgtattgagtcttaactgtatt

SEQ ID NO: 4511377 - DNA, 14 bp, Homo sapiens
tgtattgcttcctg

SEQ ID NO: 4511378 - DNA, 18 bp, Homo sapiens
tgtattgtaaatgtggat

SEQ ID NO: 4511379 - DNA, 19 bp, Homo sapiens
tgtattgttagatgtttgt

SEQ ID NO: 4511380 - DNA, 13 bp, Homo sapiens
tgtattgtttcta

SEQ ID NO: 4511381 - DNA, 14 bp, Homo sapiens
tgtatttaaaaaca

SEQ ID NO: 4511382 - DNA, 15 bp, Homo sapiens
tgtatttaaaaacat

SEQ ID NO: 4511383 - DNA, 19 bp, Homo sapiens
tgtatttaattgtaaactg

SEQ ID NO: 4511384 - DNA, 13 bp, Homo sapiens
tgtatttaccaaa

SEQ ID NO: 4511385 - DNA, 20 bp, Homo sapiens
tgtatttacgctttgattca

SEQ ID NO: 4511386 - DNA, 18 bp, Homo sapiens
tgtatttatataagtctg

SEQ ID NO: 4511387 - DNA, 22 bp, Homo sapiens
tgtatttatgtaatgaagtaaa

SEQ ID NO: 4511388 - DNA, 22 bp, Homo sapiens
tgtatttattggttttgcagaa

SEQ ID NO: 4511389 - DNA, 20 bp, Homo sapiens
tgtatttcagtattttccag

SEQ ID NO: 4511390 - DNA, 22 bp, Homo sapiens
tgtatttgaaaattacatgttt

SEQ ID NO: 4511391 - DNA, 17 bp, Homo sapiens
tgtatttgctaattttt

SEQ ID NO: 4511392 - DNA, 12 bp, Homo sapiens
tgtatttggaaa

SEQ ID NO: 4511393 - DNA, 21 bp, Homo sapiens
tgtatttggaaataaagtcag

SEQ ID NO: 4511394 - DNA, 15 bp, Homo sapiens
tgtattttcaaatgt

SEQ ID NO: 4511395 - DNA, 15 bp, Homo sapiens
tgtattttcctaatg

SEQ ID NO: 4511396 - DNA, 23 bp, Homo sapiens
tgtattttgatataattgtactg

SEQ ID NO: 4511397 - DNA, 22 bp, Homo sapiens
tgtattttggaggtgcttgatc

SEQ ID NO: 4511398 - DNA, 18 bp, Homo sapiens
tgtatttttcatctttaa

SEQ ID NO: 4511399 - DNA, 21 bp, Homo sapiens
tgtatttttttttctaagaga

SEQ ID NO: 4511400 - DNA, 18 bp, Homo sapiens
tgtcaaactgtagaaatg

SEQ ID NO: 4511401 - DNA, 13 bp, Homo sapiens
tgtcaaagaagct

SEQ ID NO: 4511402 - DNA, 17 bp, Homo sapiens
tgtcaaataaacactgt

SEQ ID NO: 4511403 - DNA, 16 bp, Homo sapiens
tgtcaacaaagtgctt

SEQ ID NO: 4511404 - DNA, 20 bp, Homo sapiens
tgtcaaccccaagttagttc

SEQ ID NO: 4511405 - DNA, 17 bp, Homo sapiens
tgtcaacttttaacttt

SEQ ID NO: 4511406 - DNA, 20 bp, Homo sapiens
tgtcaagagtagttatataa

SEQ ID NO: 4511407 - DNA, 22 bp, Homo sapiens
tgtcaagagtagttatataatt

SEQ ID NO: 4511408 - DNA, 13 bp, Homo sapiens
tgtcaagattttt

SEQ ID NO: 4511409 - DNA, 17 bp, Homo sapiens
tgtcaagctggtgctac

SEQ ID NO: 4511410 - DNA, 14 bp, Homo sapiens
tgtcaagttgtgct

SEQ ID NO: 4511411 - DNA, 15 bp, Homo sapiens
tgtcaagttgtgctt

SEQ ID NO: 4511412 - DNA, 19 bp, Homo sapiens
tgtcaattcataaaaacaa

SEQ ID NO: 4511413 - DNA, 11 bp, Homo sapiens
tgtcacaataa

SEQ ID NO: 4511414 - DNA, 13 bp, Homo sapiens
tgtcacaataaag

SEQ ID NO: 4511415 - DNA, 16 bp, Homo sapiens
tgtcacacaaactgat

SEQ ID NO: 4511416 - DNA, 20 bp, Homo sapiens
tgtcacacaaactgatgatg

SEQ ID NO: 4511417 - DNA, 15 bp, Homo sapiens
tgtcacacagggcag

SEQ ID NO: 4511418 - DNA, 14 bp, Homo sapiens
tgtcacaccagcca

SEQ ID NO: 4511419 - DNA, 15 bp, Homo sapiens
tgtcacaccagccat

SEQ ID NO: 4511420 - DNA, 12 bp, Homo sapiens
tgtcacaggcat

SEQ ID NO: 4511421 - DNA, 16 bp, Homo sapiens
tgtcacagtaaaaata

SEQ ID NO: 4511422 - DNA, 17 bp, Homo sapiens
tgtcacagtcttgtgaa

SEQ ID NO: 4511423 - DNA, 18 bp, Homo sapiens
tgtcacagtcttgtgaac

SEQ ID NO: 4511424 - DNA, 23 bp, Homo sapiens
tgtcacagtcttgtgaactttga

SEQ ID NO: 4511425 - DNA, 18 bp, Homo sapiens
tgtcacataaaagtctgt

SEQ ID NO: 4511426 - DNA, 21 bp, Homo sapiens
tgtcaccaccttcccagctct

SEQ ID NO: 4511427 - DNA, 23 bp, Homo sapiens
tgtcaccaccttcccagctctcc

SEQ ID NO: 4511428 - DNA, 23 bp, Homo sapiens
tgtcacgagcccattctcatgtt

SEQ ID NO: 4511429 - DNA, 12 bp, Homo sapiens
tgtcacttttta

SEQ ID NO: 4511430 - DNA, 20 bp, Homo sapiens
tgtcagaataaaaatgtggt

SEQ ID NO: 4511431 - DNA, 21 bp, Homo sapiens
tgtcagacttccaaatcctgg

SEQ ID NO: 4511432 - DNA, 23 bp, Homo sapiens
tgtcagagcactttaaaaacagg

SEQ ID NO: 4511433 - DNA, 20 bp, Homo sapiens
tgtcagagcccagcccagga

SEQ ID NO: 4511434 - DNA, 15 bp, Homo sapiens
tgtcagatgcccgag

SEQ ID NO: 4511435 - DNA, 21 bp, Homo sapiens
tgtcagatgcccgagggaggg

SEQ ID NO: 4511436 - DNA, 21 bp, Homo sapiens
tgtcagatgcgtgcccagctc

SEQ ID NO: 4511437 - DNA, 18 bp, Homo sapiens
tgtcagattaaattacag

SEQ ID NO: 4511438 - DNA, 17 bp, Homo sapiens
tgtcagattcctttccc

SEQ ID NO: 4511439 - DNA, 23 bp, Homo sapiens
tgtcagccatcgtcctgggactc

SEQ ID NO: 4511440 - DNA, 21 bp, Homo sapiens
tgtcagctcccctcggagaag

SEQ ID NO: 4511441 - DNA, 23 bp, Homo sapiens
tgtcagctgcaaggtactctggt

SEQ ID NO: 4511442 - DNA, 15 bp, Homo sapiens
tgtcaggctgctggc

SEQ ID NO: 4511443 - DNA, 17 bp, Homo sapiens
tgtcaggctgctggcgc

SEQ ID NO: 4511444 - DNA, 20 bp, Homo sapiens
tgtcaggtggttaccaggca

SEQ ID NO: 4511445 - DNA, 22 bp, Homo sapiens
tgtcaggtggttaccaggcact

SEQ ID NO: 4511446 - DNA, 23 bp, Homo sapiens
tgtcaggtggttaccaggcactg

SEQ ID NO: 4511447 - DNA, 20 bp, Homo sapiens
tgtcagtaccttcaaactag

SEQ ID NO: 4511448 - DNA, 20 bp, Homo sapiens
tgtcagtatgtggaagtgtg

SEQ ID NO: 4511449 - DNA, 22 bp, Homo sapiens
tgtcagtatgtggaagtgtggg

SEQ ID NO: 4511450 - DNA, 16 bp, Homo sapiens
tgtcagtggggcagcc

SEQ ID NO: 4511451 - DNA, 11 bp, Homo sapiens
tgtcagtgtca

SEQ ID NO: 4511452 - DNA, 14 bp, Homo sapiens
tgtcagtgtttgta

SEQ ID NO: 4511453 - DNA, 17 bp, Homo sapiens
tgtcagtgtttgtattt

SEQ ID NO: 4511454 - DNA, 17 bp, Homo sapiens
tgtcagttgttatttat

SEQ ID NO: 4511455 - DNA, 18 bp, Homo sapiens
tgtcataaactttctcca

SEQ ID NO: 4511456 - DNA, 20 bp, Homo sapiens
tgtcataaagtgagaaaact

SEQ ID NO: 4511457 - DNA, 13 bp, Homo sapiens
tgtcatagaaata

SEQ ID NO: 4511458 - DNA, 16 bp, Homo sapiens
tgtcatcctcaaagaa

SEQ ID NO: 4511459 - DNA, 21 bp, Homo sapiens
tgtcatcctcaaagaaagtgt

SEQ ID NO: 4511460 - DNA, 12 bp, Homo sapiens
tgtcatctaaag

SEQ ID NO: 4511461 - DNA, 13 bp, Homo sapiens
tgtttaaagtggc

SEQ ID NO: 4511462 - DNA, 13 bp, Homo sapiens
tgtttaaagttca

SEQ ID NO: 4511463 - DNA, 17 bp, Homo sapiens
tgtttaagatatatttc

SEQ ID NO: 4511464 - DNA, 23 bp, Homo sapiens
tgtttaagtcattttttacttga

SEQ ID NO: 4511465 - DNA, 15 bp, Homo sapiens
tgtttaatggtagtt

SEQ ID NO: 4511466 - DNA, 19 bp, Homo sapiens
tgtttaatttttatttctt

SEQ ID NO: 4511467 - DNA, 21 bp, Homo sapiens
tgtttacagaggacagtattt

SEQ ID NO: 4511468 - DNA, 12 bp, Homo sapiens
tgtttactgtat

SEQ ID NO: 4511469 - DNA, 16 bp, Homo sapiens
tgtttagaagaagtgt

SEQ ID NO: 4511470 - DNA, 16 bp, Homo sapiens
tgtttagatagggctg

SEQ ID NO: 4511471 - DNA, 20 bp, Homo sapiens
tgtttagatgaatgtcagtt

SEQ ID NO: 4511472 - DNA, 16 bp, Homo sapiens
tgtttagtagcagtga

SEQ ID NO: 4511473 - DNA, 18 bp, Homo sapiens
tgtttagtagcagtgatt

SEQ ID NO: 4511474 - DNA, 16 bp, Homo sapiens
tgtttataaatgttct

SEQ ID NO: 4511475 - DNA, 17 bp, Homo sapiens
tgtttataaatgttctg

SEQ ID NO: 4511476 - DNA, 17 bp, Homo sapiens
tgtttatatcactgtct

SEQ ID NO: 4511477 - DNA, 23 bp, Homo sapiens
tgtttatgatatttcttgctttc

SEQ ID NO: 4511478 - DNA, 24 bp, Homo sapiens
tgtttatggcctcagctgcctcac

SEQ ID NO: 4511479 - DNA, 17 bp, Homo sapiens
tgtttatgtgctattaa

SEQ ID NO: 4511480 - DNA, 13 bp, Homo sapiens
tgtttatgtgtgt

SEQ ID NO: 4511481 - DNA, 18 bp, Homo sapiens
tgtttatgtgttatgaac

SEQ ID NO: 4511482 - DNA, 14 bp, Homo sapiens
tgtttattaatctt

SEQ ID NO: 4511483 - DNA, 13 bp, Homo sapiens
tgtttatttcagg

SEQ ID NO: 4511484 - DNA, 19 bp, Homo sapiens
tgtttatttttcttgtctt

SEQ ID NO: 4511485 - DNA, 14 bp, Homo sapiens
tgtttcaaaaaaat

SEQ ID NO: 4511486 - DNA, 20 bp, Homo sapiens
tgtttcaaaatagacaagtt

SEQ ID NO: 4511487 - DNA, 12 bp, Homo sapiens
tgtttcaaatgg

SEQ ID NO: 4511488 - DNA, 16 bp, Homo sapiens
tgtttcaaatggactg

SEQ ID NO: 4511489 - DNA, 16 bp, Homo sapiens
tgtttcaaatgtgcat

SEQ ID NO: 4511490 - DNA, 21 bp, Homo sapiens
tgtttcaaatgtgcattttgt

SEQ ID NO: 4511491 - DNA, 20 bp, Homo sapiens
tgtttcaactttcttatctg

SEQ ID NO: 4511492 - DNA, 16 bp, Homo sapiens
tgtttcaattgcatct

SEQ ID NO: 4511493 - DNA, 16 bp, Homo sapiens
tgtttcagagcataaa

SEQ ID NO: 4511494 - DNA, 21 bp, Homo sapiens
tgtttcagagcataaaaccta

SEQ ID NO: 4511495 - DNA, 13 bp, Homo sapiens
tgtttcagtgtga

SEQ ID NO: 4511496 - DNA, 16 bp, Homo sapiens
tgtttccatgttatgt

SEQ ID NO: 4511497 - DNA, 17 bp, Homo sapiens
tgtttcctcatctatgg

SEQ ID NO: 4511498 - DNA, 20 bp, Homo sapiens
tgtttctaccggagagagaa

SEQ ID NO: 4511499 - DNA, 21 bp, Homo sapiens
tgtttctagcactggcctgca

SEQ ID NO: 4511500 - DNA, 23 bp, Homo sapiens
tgtttctagttgaggagtttcct

SEQ ID NO: 4511501 - DNA, 19 bp, Homo sapiens
tgtttctggaagactgctc

SEQ ID NO: 4511502 - DNA, 24 bp, Homo sapiens
tgtttctggaagactgctcccggc

SEQ ID NO: 4511503 - DNA, 12 bp, Homo sapiens
tgtttctgtcct

SEQ ID NO: 4511504 - DNA, 18 bp, Homo sapiens
tgtttctgtcctgtaact

SEQ ID NO: 4511505 - DNA, 14 bp, Homo sapiens
tgtttcttgccttt

SEQ ID NO: 4511506 - DNA, 17 bp, Homo sapiens
tgtttcttgtttattga

SEQ ID NO: 4511507 - DNA, 17 bp, Homo sapiens
tgtttctttcttcctct

SEQ ID NO: 4511508 - DNA, 16 bp, Homo sapiens
tgtttgaaatatcatg

SEQ ID NO: 4511509 - DNA, 22 bp, Homo sapiens
tgtttgaaatgaggtctgttta

SEQ ID NO: 4511510 - DNA, 15 bp, Homo sapiens
tgtttgaatgttaga

SEQ ID NO: 4511511 - DNA, 22 bp, Homo sapiens
tgtttgacaaagaaacccaagt

SEQ ID NO: 4511512 - DNA, 14 bp, Homo sapiens
tgtttgacacctct

SEQ ID NO: 4511513 - DNA, 13 bp, Homo sapiens
tgtttgatagatt

SEQ ID NO: 4511514 - DNA, 14 bp, Homo sapiens
tgtttgctgtgaac

SEQ ID NO: 4511515 - DNA, 20 bp, Homo sapiens
tgtttgctgttgggtttttg

SEQ ID NO: 4511516 - DNA, 16 bp, Homo sapiens
tgtttgcttaaaatat

SEQ ID NO: 4511517 - DNA, 16 bp, Homo sapiens
tgtttgcttcttgcca

SEQ ID NO: 4511518 - DNA, 22 bp, Homo sapiens
tgtttggacctgcatatttagc

SEQ ID NO: 4511519 - DNA, 17 bp, Homo sapiens
tgtttggactttgtata

SEQ ID NO: 4511520 - DNA, 12 bp, Homo sapiens
tgtttggagagc

SEQ ID NO: 4511521 - DNA, 22 bp, Homo sapiens
tgtttggcgtagcagagttaaa

SEQ ID NO: 4511522 - DNA, 23 bp, Homo sapiens
tgtttggggatcgatgtgctcag

SEQ ID NO: 4511523 - DNA, 21 bp, Homo sapiens
tgtttgggggttctgtttcag

SEQ ID NO: 4511524 - DNA, 18 bp, Homo sapiens
tgtttgggtttttttcct

SEQ ID NO: 4511525 - DNA, 22 bp, Homo sapiens
tgtttgtaaatgcctcttaaat

SEQ ID NO: 4511526 - DNA, 23 bp, Homo sapiens
tgtttgtaatcattatctcactt

SEQ ID NO: 4511527 - DNA, 20 bp, Homo sapiens
tgtttgtactggttcattgt

SEQ ID NO: 4511528 - DNA, 13 bp, Homo sapiens
tgtttgtggcctc

SEQ ID NO: 4511529 - DNA, 13 bp, Homo sapiens
tgtttgtgtgttt

SEQ ID NO: 4511530 - DNA, 17 bp, Homo sapiens
tgtttgtgtttatgaaa

SEQ ID NO: 4511531 - DNA, 16 bp, Homo sapiens
tgtttgttactgtcat

SEQ ID NO: 4511532 - DNA, 15 bp, Homo sapiens
tgtttgttgtagatt

SEQ ID NO: 4511533 - DNA, 15 bp, Homo sapiens
tgtttgtttctttgt

SEQ ID NO: 4511534 - DNA, 15 bp, Homo sapiens
tgttttaaaatgtga

SEQ ID NO: 4511535 - DNA, 22 bp, Homo sapiens
tgttttaaaatgtgaggcaata

SEQ ID NO: 4511536 - DNA, 23 bp, Homo sapiens
tgttttaaaatgtgaggcaataa

SEQ ID NO: 4511537 - DNA, 15 bp, Homo sapiens
tgttttaaatgtaca

SEQ ID NO: 4511538 - DNA, 23 bp, Homo sapiens
tgttttaaatgtacagacatatt

SEQ ID NO: 4511539 - DNA, 14 bp, Homo sapiens
tgttttaacaaaaa

SEQ ID NO: 4511540 - DNA, 16 bp, Homo sapiens
tgttttaataacttat

SEQ ID NO: 4511541 - DNA, 21 bp, Homo sapiens
tgttttacaatagttctgtgg

SEQ ID NO: 4511542 - DNA, 23 bp, Homo sapiens
tgttttacagctgcctttcgtga

SEQ ID NO: 4511543 - DNA, 19 bp, Homo sapiens
tgttttactgtcagattaa

SEQ ID NO: 4511544 - DNA, 13 bp, Homo sapiens
tgttttagaaatt

SEQ ID NO: 4511545 - DNA, 16 bp, Homo sapiens
tgttttagaaccagcc

SEQ ID NO: 4511546 - DNA, 13 bp, Homo sapiens
tgttttatatatt

SEQ ID NO: 4511547 - DNA, 19 bp, Homo sapiens
tgttttatatattatgtga

SEQ ID NO: 4511548 - DNA, 12 bp, Homo sapiens
tgttttcaaaat

SEQ ID NO: 4511549 - DNA, 13 bp, Homo sapiens
tgttttcaaatgt

SEQ ID NO: 4511550 - DNA, 13 bp, Homo sapiens
tgttttcatcatt

SEQ ID NO: 4511551 - DNA, 21 bp, Homo sapiens
tgttttccaatattttaataa

SEQ ID NO: 4511552 - DNA, 21 bp, Homo sapiens
tgttttctctggagtattcta

SEQ ID NO: 4511553 - DNA, 21 bp, Homo sapiens
tgttttctgtagactctaaga

SEQ ID NO: 4511554 - DNA, 13 bp, Homo sapiens
tgttttgaataaa

SEQ ID NO: 4511555 - DNA, 15 bp, Homo sapiens
tgttttgaatattac

SEQ ID NO: 4511556 - DNA, 19 bp, Homo sapiens
tgttttgaatggtgttgta

SEQ ID NO: 4511557 - DNA, 22 bp, Homo sapiens
tgttttgaatggtgttgtatgc

SEQ ID NO: 4511558 - DNA, 14 bp, Homo sapiens
tgttttgatcaaat

SEQ ID NO: 4511559 - DNA, 20 bp, Homo sapiens
tgttttgatgtttgtggcct

SEQ ID NO: 4511560 - DNA, 18 bp, Homo sapiens
tgttttgcacagccaaat

SEQ ID NO: 4511561 - DNA, 16 bp, Homo sapiens
tgttttggactctctg

SEQ ID NO: 4511562 - DNA, 20 bp, Homo sapiens
tgttttggactctctgtggt

SEQ ID NO: 4511563 - DNA, 19 bp, Homo sapiens
tgttttggtctcaaaatgg

SEQ ID NO: 4511564 - DNA, 16 bp, Homo sapiens
tgttttgtaccagtga

SEQ ID NO: 4511565 - DNA, 13 bp, Homo sapiens
tgttttgtatttt

SEQ ID NO: 4511566 - DNA, 19 bp, Homo sapiens
tgttttgtcagacttccaa

SEQ ID NO: 4511567 - DNA, 16 bp, Homo sapiens
tgttttgttgtttgat

SEQ ID NO: 4511568 - DNA, 15 bp, Homo sapiens
tgttttgttttggac

SEQ ID NO: 4511569 - DNA, 18 bp, Homo sapiens
tgttttgttttggactct

SEQ ID NO: 4511570 - DNA, 13 bp, Homo sapiens
tgtttttactgaa

SEQ ID NO: 4511571 - DNA, 14 bp, Homo sapiens
tgtttttactgtat

SEQ ID NO: 4511572 - DNA, 18 bp, Homo sapiens
tgtttttccctccccaga

SEQ ID NO: 4511573 - DNA, 11 bp, Homo sapiens
tgtttttctca

SEQ ID NO: 4511574 - DNA, 16 bp, Homo sapiens
tgtttttctttctaca

SEQ ID NO: 4511575 - DNA, 16 bp, Homo sapiens
tgtttttgcatgaaat

SEQ ID NO: 4511576 - DNA, 14 bp, Homo sapiens
tgtttttgcatttt

SEQ ID NO: 4511577 - DNA, 15 bp, Homo sapiens
tgtttttgcattttt

SEQ ID NO: 4511578 - DNA, 23 bp, Homo sapiens
tgtttttgcgtgggagtgtgtgc

SEQ ID NO: 4511579 - DNA, 17 bp, Homo sapiens
tgtttttggatggctta

SEQ ID NO: 4511580 - DNA, 23 bp, Homo sapiens
tgtttttggtttcttattcaaag

SEQ ID NO: 4511581 - DNA, 16 bp, Homo sapiens
tgttttttaagatagt

SEQ ID NO: 4511582 - DNA, 20 bp, Homo sapiens
tgttttttaagatagtgtaa

SEQ ID NO: 4511583 - DNA, 14 bp, Homo sapiens
tgttttttcaaaat

SEQ ID NO: 4511584 - DNA, 16 bp, Homo sapiens
tgttttttcaaaatag

SEQ ID NO: 4511585 - DNA, 14 bp, Homo sapiens
tgttttttcatttg

SEQ ID NO: 4511586 - DNA, 17 bp, Homo sapiens
tgttttttcatttgtaa

SEQ ID NO: 4511587 - DNA, 9 bp, Homo sapiens
tgttttttt

SEQ ID NO: 4511588 - DNA, 16 bp, Homo sapiens
tgtttttttgttatta

SEQ ID NO: 4511589 - DNA, 17 bp, Homo sapiens
tgttttttttcagccac

SEQ ID NO: 4511590 - DNA, 16 bp, Homo sapiens
tgtttttttttttaag

SEQ ID NO: 4511591 - DNA, 23 bp, Homo sapiens
ttaaaaaaaaaaaaaagctttat

SEQ ID NO: 4511592 - DNA, 15 bp, Homo sapiens
ttaaaaaaaaaagtc

SEQ ID NO: 4511593 - DNA, 13 bp, Homo sapiens
ttaaaaaaaaaga

SEQ ID NO: 4511594 - DNA, 23 bp, Homo sapiens
ttaaaaaaacaaatgttagactt

SEQ ID NO: 4511595 - DNA, 13 bp, Homo sapiens
ttaaaaaacttca

SEQ ID NO: 4511596 - DNA, 22 bp, Homo sapiens
ttaaaaaataacttcattgttt

SEQ ID NO: 4511597 - DNA, 20 bp, Homo sapiens
ttaaaaaatattttctctgt

SEQ ID NO: 4511598 - DNA, 16 bp, Homo sapiens
ttaaaaaatggaacat

SEQ ID NO: 4511599 - DNA, 15 bp, Homo sapiens
ttaaaaaattaaaaa

SEQ ID NO: 4511600 - DNA, 21 bp, Homo sapiens
ttaaaaaattatggaatatca

SEQ ID NO: 4511601 - DNA, 14 bp, Homo sapiens
ttaaaaaatttgta

SEQ ID NO: 4511602 - DNA, 12 bp, Homo sapiens
ttaaaaacattt

SEQ ID NO: 4511603 - DNA, 13 bp, Homo sapiens
ttaaaaacatttt

SEQ ID NO: 4511604 - DNA, 22 bp, Homo sapiens
ttaaaaacattttttatacatt

SEQ ID NO: 4511605 - DNA, 23 bp, Homo sapiens
ttaaaaataccttctatgtatta

SEQ ID NO: 4511606 - DNA, 20 bp, Homo sapiens
ttaaaaatcatcttataatt

SEQ ID NO: 4511607 - DNA, 19 bp, Homo sapiens
ttaaaaatgagatttctta

SEQ ID NO: 4511608 - DNA, 17 bp, Homo sapiens
ttaaaaatggtatcaaa

SEQ ID NO: 4511609 - DNA, 19 bp, Homo sapiens
ttaaaaatggtatcaaaat

SEQ ID NO: 4511610 - DNA, 20 bp, Homo sapiens
ttaaaaatggtttaaatggt

SEQ ID NO: 4511611 - DNA, 12 bp, Homo sapiens
ttaaaacacatg

SEQ ID NO: 4511612 - DNA, 17 bp, Homo sapiens
ttaaaacagaagcaaat

SEQ ID NO: 4511613 - DNA, 17 bp, Homo sapiens
ttaaaacaggcaaagtt

SEQ ID NO: 4511614 - DNA, 22 bp, Homo sapiens
ttaaaacaggcaaagttttaca

SEQ ID NO: 4511615 - DNA, 14 bp, Homo sapiens
ttaaaaccaaagag

SEQ ID NO: 4511616 - DNA, 18 bp, Homo sapiens
ttaaaactcatcacataa

SEQ ID NO: 4511617 - DNA, 13 bp, Homo sapiens
ttaaaactctggt

SEQ ID NO: 4511618 - DNA, 22 bp, Homo sapiens
ttaaaactgaacttgaagctaa

SEQ ID NO: 4511619 - DNA, 16 bp, Homo sapiens
ttaaaactttctaaat

SEQ ID NO: 4511620 - DNA, 12 bp, Homo sapiens
ttaaaagaatga

SEQ ID NO: 4511621 - DNA, 14 bp, Homo sapiens
ttaaaagaatgact

SEQ ID NO: 4511622 - DNA, 15 bp, Homo sapiens
ttaaaagaatgacta

SEQ ID NO: 4511623 - DNA, 18 bp, Homo sapiens
ttaaaagcaaatcatttg

SEQ ID NO: 4511624 - DNA, 22 bp, Homo sapiens
ttaaaagcaattatattgtcct

SEQ ID NO: 4511625 - DNA, 19 bp, Homo sapiens
ttaaaagccttccagtttt

SEQ ID NO: 4511626 - DNA, 19 bp, Homo sapiens
ttaaaagctatcttcatgt

SEQ ID NO: 4511627 - DNA, 18 bp, Homo sapiens
ttaaaagtaaaatgtctt

SEQ ID NO: 4511628 - DNA, 21 bp, Homo sapiens
ttaaaagtgtgtaaatgctta

SEQ ID NO: 4511629 - DNA, 20 bp, Homo sapiens
ttaaaataaaataagttctt

SEQ ID NO: 4511630 - DNA, 14 bp, Homo sapiens
ttaaaataaaatga

SEQ ID NO: 4511631 - DNA, 19 bp, Homo sapiens
ttaaaataattcatatcta

SEQ ID NO: 4511632 - DNA, 20 bp, Homo sapiens
ttaaaataattcatatctaa

SEQ ID NO: 4511633 - DNA, 22 bp, Homo sapiens
ttaaaatagcaaaagaagaagt

SEQ ID NO: 4511634 - DNA, 23 bp, Homo sapiens
ttaaaatagcaaaagaagaagtt

SEQ ID NO: 4511635 - DNA, 14 bp, Homo sapiens
ttaaaatatatagt

SEQ ID NO: 4511636 - DNA, 13 bp, Homo sapiens
ttaaaatatgtga

SEQ ID NO: 4511637 - DNA, 14 bp, Homo sapiens
ttaaaatatgtgaa

SEQ ID NO: 4511638 - DNA, 12 bp, Homo sapiens
ttaaaatcacta

SEQ ID NO: 4511639 - DNA, 19 bp, Homo sapiens
ttaaaatcactaacattat

SEQ ID NO: 4511640 - DNA, 21 bp, Homo sapiens
ttaaaatcactaacattatat

SEQ ID NO: 4511641 - DNA, 15 bp, Homo sapiens
ttaaaatccagactt

SEQ ID NO: 4511642 - DNA, 12 bp, Homo sapiens
ttaaaatgcaat

SEQ ID NO: 4511643 - DNA, 20 bp, Homo sapiens
ttaaaatgcaatatttgtaa

SEQ ID NO: 4511644 - DNA, 18 bp, Homo sapiens
ttaaaatggttatgtgca

SEQ ID NO: 4511645 - DNA, 14 bp, Homo sapiens
ttaaaatgtgattt

SEQ ID NO: 4511646 - DNA, 14 bp, Homo sapiens
ttaaaattagtctt

SEQ ID NO: 4511647 - DNA, 14 bp, Homo sapiens
ttaaaattctgaat

SEQ ID NO: 4511648 - DNA, 15 bp, Homo sapiens
ttaaaattctgaatt

SEQ ID NO: 4511649 - DNA, 18 bp, Homo sapiens
ttaaaattctgaattttg

SEQ ID NO: 4511650 - DNA, 21 bp, Homo sapiens
ttaaaattggtatatttgaaa

SEQ ID NO: 4511651 - DNA, 13 bp, Homo sapiens
ttaaaattgtgat

SEQ ID NO: 4511652 - DNA, 13 bp, Homo sapiens
ttaaaatttgtag

SEQ ID NO: 4511653 - DNA, 14 bp, Homo sapiens
ttaaaatttgtaga

SEQ ID NO: 4511654 - DNA, 20 bp, Homo sapiens
ttaaaattttggaatatttg

SEQ ID NO: 4511655 - DNA, 17 bp, Homo sapiens
ttaaacaaaatttcaca

SEQ ID NO: 4511656 - DNA, 18 bp, Homo sapiens
ttaaacaatttattttat

SEQ ID NO: 4511657 - DNA, 14 bp, Homo sapiens
ttaaacacattgtc

SEQ ID NO: 4511658 - DNA, 21 bp, Homo sapiens
ttaaacacttatcttctggat

SEQ ID NO: 4511659 - DNA, 19 bp, Homo sapiens
ttaaacatacataatacaa

SEQ ID NO: 4511660 - DNA, 16 bp, Homo sapiens
ttaaacccatacaatg

SEQ ID NO: 4511661 - DNA, 17 bp, Homo sapiens
ttaaacccatacaatgt

SEQ ID NO: 4511662 - DNA, 18 bp, Homo sapiens
ttaaacccatacaatgta

SEQ ID NO: 4511663 - DNA, 19 bp, Homo sapiens
ttaaacccatacaatgtat

SEQ ID NO: 4511664 - DNA, 22 bp, Homo sapiens
ttaaacccatacaatgtatgta

SEQ ID NO: 4511665 - DNA, 13 bp, Homo sapiens
ttaaacctttcca

SEQ ID NO: 4511666 - DNA, 13 bp, Homo sapiens
ttaaaccttttat

SEQ ID NO: 4511667 - DNA, 23 bp, Homo sapiens
ttaaacgctctaggtacgatgac

SEQ ID NO: 4511668 - DNA, 13 bp, Homo sapiens
ttaaacgtagcat

SEQ ID NO: 4511669 - DNA, 14 bp, Homo sapiens
ttaaactaaatgtg

SEQ ID NO: 4511670 - DNA, 15 bp, Homo sapiens
ttaaactcaaatgta

SEQ ID NO: 4511671 - DNA, 16 bp, Homo sapiens
ttaaactctggacact

SEQ ID NO: 4511672 - DNA, 22 bp, Homo sapiens
ttaaactgaaagctttaatgtt

SEQ ID NO: 4511673 - DNA, 19 bp, Homo sapiens
ttaaactggtattttatct

SEQ ID NO: 4511674 - DNA, 22 bp, Homo sapiens
ttaaactggtattttatctttg

SEQ ID NO: 4511675 - DNA, 16 bp, Homo sapiens
ttaaacttccaaagaa

SEQ ID NO: 4511676 - DNA, 22 bp, Homo sapiens
ttaaacttgaaatatataatat

SEQ ID NO: 4511677 - DNA, 15 bp, Homo sapiens
ttaaacttgacccag

SEQ ID NO: 4511678 - DNA, 17 bp, Homo sapiens
ttaaacttgtgaatgct

SEQ ID NO: 4511679 - DNA, 16 bp, Homo sapiens
ttaaagaaaggaaaag

SEQ ID NO: 4511680 - DNA, 22 bp, Homo sapiens
ttaaagaagaaaagcgcgttgt

SEQ ID NO: 4511681 - DNA, 17 bp, Homo sapiens
ttaaagactacaataaa

SEQ ID NO: 4511682 - DNA, 13 bp, Homo sapiens
ttaaagactagga

SEQ ID NO: 4511683 - DNA, 15 bp, Homo sapiens
ttaaagagtgtgtta

SEQ ID NO: 4511684 - DNA, 16 bp, Homo sapiens
ttaaagagtgtgttat

SEQ ID NO: 4511685 - DNA, 22 bp, Homo sapiens
ttaaagattattgtgacttcac

SEQ ID NO: 4511686 - DNA, 14 bp, Homo sapiens
ttaaagctaaactg

SEQ ID NO: 4511687 - DNA, 15 bp, Homo sapiens
ttaaagctaaactga

SEQ ID NO: 4511688 - DNA, 14 bp, Homo sapiens
ttaaagcttgattt

SEQ ID NO: 4511689 - DNA, 16 bp, Homo sapiens
ttaaaggcagacagtt

SEQ ID NO: 4511690 - DNA, 16 bp, Homo sapiens
ttaaaggtttttgaaa

SEQ ID NO: 4511691 - DNA, 13 bp, Homo sapiens
ttaaagtaaactt

SEQ ID NO: 4511692 - DNA, 18 bp, Homo sapiens
ttaaagtaaacttgtgta

SEQ ID NO: 4511693 - DNA, 14 bp, Homo sapiens
ttaaagttcattgc

SEQ ID NO: 4511694 - DNA, 18 bp, Homo sapiens
ttaaagttcttattttag

SEQ ID NO: 4511695 - DNA, 20 bp, Homo sapiens
ttaaataaattaagatccta

SEQ ID NO: 4511696 - DNA, 17 bp, Homo sapiens
ttaaataaatttgactt

SEQ ID NO: 4511697 - DNA, 14 bp, Homo sapiens
ttaaataatttaac

SEQ ID NO: 4511698 - DNA, 20 bp, Homo sapiens
ttaaatagataaccaatttt

SEQ ID NO: 4511699 - DNA, 18 bp, Homo sapiens
ttaaatatatgtatgtaa

SEQ ID NO: 4511700 - DNA, 19 bp, Homo sapiens
ttaaatatatgtatgtaaa

SEQ ID NO: 4511701 - DNA, 19 bp, Homo sapiens
ttaaatatccatttatctt

SEQ ID NO: 4511702 - DNA, 15 bp, Homo sapiens
ttaaatatttcttaa

SEQ ID NO: 4511703 - DNA, 17 bp, Homo sapiens
tgttcatcttgtacaaa

SEQ ID NO: 4511704 - DNA, 20 bp, Homo sapiens
tgttcatcttgtacaaactt

SEQ ID NO: 4511705 - DNA, 19 bp, Homo sapiens
tgttcatgatagaaagaat

SEQ ID NO: 4511706 - DNA, 20 bp, Homo sapiens
tgttcatgatagaaagaata

SEQ ID NO: 4511707 - DNA, 10 bp, Homo sapiens
tgttccaaat

SEQ ID NO: 4511708 - DNA, 18 bp, Homo sapiens
tgttccaaattcagtttc

SEQ ID NO: 4511709 - DNA, 19 bp, Homo sapiens
tgttccaaattcagtttca

SEQ ID NO: 4511710 - DNA, 20 bp, Homo sapiens
tgttccaaattcagtttcat

SEQ ID NO: 4511711 - DNA, 21 bp, Homo sapiens
tgttccaaattcagtttcata

SEQ ID NO: 4511712 - DNA, 22 bp, Homo sapiens
tgttccaaattcagtttcataa

SEQ ID NO: 4511713 - DNA, 12 bp, Homo sapiens
tgttccaaattt

SEQ ID NO: 4511714 - DNA, 15 bp, Homo sapiens
tgttccaatgccaca

SEQ ID NO: 4511715 - DNA, 20 bp, Homo sapiens
tgttccaatgccacatactt

SEQ ID NO: 4511716 - DNA, 12 bp, Homo sapiens
tgttccagacat

SEQ ID NO: 4511717 - DNA, 23 bp, Homo sapiens
tgttccagactcaggttccagaa

SEQ ID NO: 4511718 - DNA, 18 bp, Homo sapiens
tgttccaggcatccatct

SEQ ID NO: 4511719 - DNA, 18 bp, Homo sapiens
tgttccaggccctccagt

SEQ ID NO: 4511720 - DNA, 22 bp, Homo sapiens
tgttcccaaagtgaactctcaa

SEQ ID NO: 4511721 - DNA, 23 bp, Homo sapiens
tgttcccaaagtgaactctcaaa

SEQ ID NO: 4511722 - DNA, 23 bp, Homo sapiens
tgttcccagcccctcctccctca

SEQ ID NO: 4511723 - DNA, 17 bp, Homo sapiens
tgttcccatttcagctg

SEQ ID NO: 4511724 - DNA, 17 bp, Homo sapiens
tgttccccttccactga

SEQ ID NO: 4511725 - DNA, 23 bp, Homo sapiens
tgttccccttccactgagggcag

SEQ ID NO: 4511726 - DNA, 21 bp, Homo sapiens
tgttccctatttttctctcct

SEQ ID NO: 4511727 - DNA, 22 bp, Homo sapiens
tgttcccttgaccattggctgc

SEQ ID NO: 4511728 - DNA, 18 bp, Homo sapiens
tgttccctttgtctttca

SEQ ID NO: 4511729 - DNA, 19 bp, Homo sapiens
tgttccctttgtctttcaa

SEQ ID NO: 4511730 - DNA, 20 bp, Homo sapiens
tgttccctttgtctttcaaa

SEQ ID NO: 4511731 - DNA, 14 bp, Homo sapiens
tgttcctagtgaaa

SEQ ID NO: 4511732 - DNA, 14 bp, Homo sapiens
tgttcctcaaatca

SEQ ID NO: 4511733 - DNA, 14 bp, Homo sapiens
tgttcctgaagctg

SEQ ID NO: 4511734 - DNA, 20 bp, Homo sapiens
tgttcctgaagctgctgtgt

SEQ ID NO: 4511735 - DNA, 22 bp, Homo sapiens
tgttcctgacactcaataaaca

SEQ ID NO: 4511736 - DNA, 18 bp, Homo sapiens
tgttcctttttctgggtt

SEQ ID NO: 4511737 - DNA, 23 bp, Homo sapiens
tgttcgcatggtcacacactgat

SEQ ID NO: 4511738 - DNA, 21 bp, Homo sapiens
tgttcggaaggggttcctcaa

SEQ ID NO: 4511739 - DNA, 16 bp, Homo sapiens
tgttctagacttcccc

SEQ ID NO: 4511740 - DNA, 20 bp, Homo sapiens
tgttctagacttccccatcc

SEQ ID NO: 4511741 - DNA, 13 bp, Homo sapiens
tgttctatccaaa

SEQ ID NO: 4511742 - DNA, 19 bp, Homo sapiens
tgttctcaacatactgtaa

SEQ ID NO: 4511743 - DNA, 11 bp, Homo sapiens
tgttctcagca

SEQ ID NO: 4511744 - DNA, 16 bp, Homo sapiens
tgttctcagcacatat

SEQ ID NO: 4511745 - DNA, 20 bp, Homo sapiens
tgttctccgggtgtggcctc

SEQ ID NO: 4511746 - DNA, 17 bp, Homo sapiens
tgttctcctgaatattt

SEQ ID NO: 4511747 - DNA, 23 bp, Homo sapiens
tgttctcttgggaactgaactca

SEQ ID NO: 4511748 - DNA, 17 bp, Homo sapiens
tgttctgaaaggagaca

SEQ ID NO: 4511749 - DNA, 21 bp, Homo sapiens
tgttctgagattcaatattga

SEQ ID NO: 4511750 - DNA, 14 bp, Homo sapiens
tgttctgcaactcc

SEQ ID NO: 4511751 - DNA, 20 bp, Homo sapiens
tgttctgctgtctgggactc

SEQ ID NO: 4511752 - DNA, 20 bp, Homo sapiens
tgttctgggtgttgaccact

SEQ ID NO: 4511753 - DNA, 23 bp, Homo sapiens
tgttctgggtgttgaccactcca

SEQ ID NO: 4511754 - DNA, 22 bp, Homo sapiens
tgttctgtagcttatctgcccc

SEQ ID NO: 4511755 - DNA, 21 bp, Homo sapiens
tgttcttatggggtgagaata

SEQ ID NO: 4511756 - DNA, 15 bp, Homo sapiens
tgttcttcgtaactt

SEQ ID NO: 4511757 - DNA, 24 bp, Homo sapiens
tgttcttcgtaactttatggagta

SEQ ID NO: 4511758 - DNA, 21 bp, Homo sapiens
tgttcttggtgtttgactgta

SEQ ID NO: 4511759 - DNA, 22 bp, Homo sapiens
tgttcttggtgtttgactgtaa

SEQ ID NO: 4511760 - DNA, 13 bp, Homo sapiens
tgttcttgtattt

SEQ ID NO: 4511761 - DNA, 14 bp, Homo sapiens
tgttctttcatatg

SEQ ID NO: 4511762 - DNA, 14 bp, Homo sapiens
tgttctttcctgcc

SEQ ID NO: 4511763 - DNA, 15 bp, Homo sapiens
tgttctttcctgccc

SEQ ID NO: 4511764 - DNA, 17 bp, Homo sapiens
tgttctttcctgccctg

SEQ ID NO: 4511765 - DNA, 21 bp, Homo sapiens
tgttcttttctcctttaccag

SEQ ID NO: 4511766 - DNA, 16 bp, Homo sapiens
tgttcttttgtcccag

SEQ ID NO: 4511767 - DNA, 23 bp, Homo sapiens
tgttctttttctgaactccattt

SEQ ID NO: 4511768 - DNA, 20 bp, Homo sapiens
tgttgaacaggtgtttttcc

SEQ ID NO: 4511769 - DNA, 13 bp, Homo sapiens
tgttgaacttttt

SEQ ID NO: 4511770 - DNA, 23 bp, Homo sapiens
tgttgaaggaacttgtctcttca

SEQ ID NO: 4511771 - DNA, 19 bp, Homo sapiens
tgttgaagtaattcttctg

SEQ ID NO: 4511772 - DNA, 17 bp, Homo sapiens
tgttgaagtctcaggag

SEQ ID NO: 4511773 - DNA, 14 bp, Homo sapiens
tgttgaataggaaa

SEQ ID NO: 4511774 - DNA, 15 bp, Homo sapiens
tgttgacaaatgaca

SEQ ID NO: 4511775 - DNA, 18 bp, Homo sapiens
tgttgacatatttaatgt

SEQ ID NO: 4511776 - DNA, 17 bp, Homo sapiens
tgttgactggactgctt

SEQ ID NO: 4511777 - DNA, 22 bp, Homo sapiens
tgttgagaatcccaaatttgat

SEQ ID NO: 4511778 - DNA, 16 bp, Homo sapiens
tgttgatattgtttgc

SEQ ID NO: 4511779 - DNA, 17 bp, Homo sapiens
tgttgatattgtttgct

SEQ ID NO: 4511780 - DNA, 13 bp, Homo sapiens
tgttgatcccagt

SEQ ID NO: 4511781 - DNA, 19 bp, Homo sapiens
tgttgatctttcactatac

SEQ ID NO: 4511782 - DNA, 19 bp, Homo sapiens
tgttgcacagttcatttaa

SEQ ID NO: 4511783 - DNA, 18 bp, Homo sapiens
tgttgcacccagccctgg

SEQ ID NO: 4511784 - DNA, 15 bp, Homo sapiens
tgttgcactgaacag

SEQ ID NO: 4511785 - DNA, 15 bp, Homo sapiens
tgttgcatgtttgaa

SEQ ID NO: 4511786 - DNA, 18 bp, Homo sapiens
tgttgccaaagctggtct

SEQ ID NO: 4511787 - DNA, 14 bp, Homo sapiens
tgttgccgagccca

SEQ ID NO: 4511788 - DNA, 18 bp, Homo sapiens
tgttgcctaattggaaag

SEQ ID NO: 4511789 - DNA, 16 bp, Homo sapiens
tgttgcctctctttga

SEQ ID NO: 4511790 - DNA, 16 bp, Homo sapiens
tgttgctatacatgtt

SEQ ID NO: 4511791 - DNA, 13 bp, Homo sapiens
tgttgctgtcaag

SEQ ID NO: 4511792 - DNA, 16 bp, Homo sapiens
tgttgcttctcaggct

SEQ ID NO: 4511793 - DNA, 16 bp, Homo sapiens
tgttgctttcttacct

SEQ ID NO: 4511794 - DNA, 13 bp, Homo sapiens
tgttggaaaaaat

SEQ ID NO: 4511795 - DNA, 17 bp, Homo sapiens
tgttggatttttgtctt

SEQ ID NO: 4511796 - DNA, 20 bp, Homo sapiens
tgttgggattacaggtgtga

SEQ ID NO: 4511797 - DNA, 20 bp, Homo sapiens
tgttggggaagggcctgccc

SEQ ID NO: 4511798 - DNA, 14 bp, Homo sapiens
tgttggtgttggct

SEQ ID NO: 4511799 - DNA, 14 bp, Homo sapiens
tgttggttcaaact

SEQ ID NO: 4511800 - DNA, 19 bp, Homo sapiens
tgttggttgcactttgtag

SEQ ID NO: 4511801 - DNA, 14 bp, Homo sapiens
tgttggtttaatat

SEQ ID NO: 4511802 - DNA, 15 bp, Homo sapiens
tgttggtttcatttg

SEQ ID NO: 4511803 - DNA, 13 bp, Homo sapiens
tgttgtaaaacaa

SEQ ID NO: 4511804 - DNA, 22 bp, Homo sapiens
tgttgtaaaacaaaatttgact

SEQ ID NO: 4511805 - DNA, 17 bp, Homo sapiens
tgttgtattcctgcctt

SEQ ID NO: 4511806 - DNA, 19 bp, Homo sapiens
tgttgtcaaggatggtttt

SEQ ID NO: 4511807 - DNA, 19 bp, Homo sapiens
tgttgtccctactttctct

SEQ ID NO: 4511808 - DNA, 20 bp, Homo sapiens
tgttgtcgtaaagatttggg

SEQ ID NO: 4511809 - DNA, 15 bp, Homo sapiens
tgttgtgctttcaag

SEQ ID NO: 4511810 - DNA, 16 bp, Homo sapiens
tgttgtggaagcatgt

SEQ ID NO: 4511811 - DNA, 22 bp, Homo sapiens
tgttgtgtctgtgccctccaaa

SEQ ID NO: 4511812 - DNA, 20 bp, Homo sapiens
tgttgtgtgtatatgtattt

SEQ ID NO: 4511813 - DNA, 18 bp, Homo sapiens
tgttgttctgcctggaga

SEQ ID NO: 4511814 - DNA, 15 bp, Homo sapiens
tgttgttgtctattt

SEQ ID NO: 4511815 - DNA, 16 bp, Homo sapiens
tgttgttgtgtgtata

SEQ ID NO: 4511816 - DNA, 13 bp, Homo sapiens
tgttgtttaagtg

SEQ ID NO: 4511817 - DNA, 15 bp, Homo sapiens
tgttgtttcttaaat

SEQ ID NO: 4511818 - DNA, 17 bp, Homo sapiens
tgttgtttcttaaataa

SEQ ID NO: 4511819 - DNA, 18 bp, Homo sapiens
tgtttaaaaaaccacatg

SEQ ID NO: 4511820 - DNA, 15 bp, Homo sapiens
tgtttaaaataaaat

SEQ ID NO: 4511821 - DNA, 19 bp, Homo sapiens
tgtttaaaataaaatgaaa

SEQ ID NO: 4511822 - DNA, 22 bp, Homo sapiens
tgtttaaaataaaatgaaaatt

SEQ ID NO: 4511823 - DNA, 18 bp, Homo sapiens
ttaaatattttctatttt

SEQ ID NO: 4511824 - DNA, 13 bp, Homo sapiens
ttaaatcaaggaa

SEQ ID NO: 4511825 - DNA, 14 bp, Homo sapiens
ttaaatcaaggaaa

SEQ ID NO: 4511826 - DNA, 20 bp, Homo sapiens
ttaaatcaaggaaaggctca

SEQ ID NO: 4511827 - DNA, 22 bp, Homo sapiens
ttaaatcacagcccaaaatttg

SEQ ID NO: 4511828 - DNA, 23 bp, Homo sapiens
ttaaatcacagcccaaaatttga

SEQ ID NO: 4511829 - DNA, 15 bp, Homo sapiens
ttaaatccaataaaa

SEQ ID NO: 4511830 - DNA, 14 bp, Homo sapiens
ttaaatctgtgatg

SEQ ID NO: 4511831 - DNA, 15 bp, Homo sapiens
ttaaatctgtgatga

SEQ ID NO: 4511832 - DNA, 22 bp, Homo sapiens
ttaaatgagaaaggatttcctt

SEQ ID NO: 4511833 - DNA, 20 bp, Homo sapiens
ttaaatgccaaaatgtactt

SEQ ID NO: 4511834 - DNA, 21 bp, Homo sapiens
ttaaatgccaaaatgtactta

SEQ ID NO: 4511835 - DNA, 16 bp, Homo sapiens
ttaaatgtacagacat

SEQ ID NO: 4511836 - DNA, 21 bp, Homo sapiens
ttaaatgtagcttcagtcatt

SEQ ID NO: 4511837 - DNA, 14 bp, Homo sapiens
ttaaatgtatacta

SEQ ID NO: 4511838 - DNA, 14 bp, Homo sapiens
ttaaatgtgtattt

SEQ ID NO: 4511839 - DNA, 19 bp, Homo sapiens
ttaaatgtgtatttcttaa

SEQ ID NO: 4511840 - DNA, 20 bp, Homo sapiens
ttaaatgtgtatttcttaag

SEQ ID NO: 4511841 - DNA, 12 bp, Homo sapiens
ttaaattaaaca

SEQ ID NO: 4511842 - DNA, 11 bp, Homo sapiens
ttaaattaata

SEQ ID NO: 4511843 - DNA, 12 bp, Homo sapiens
ttaaattacaat

SEQ ID NO: 4511844 - DNA, 17 bp, Homo sapiens
ttaaattacaattttat

SEQ ID NO: 4511845 - DNA, 15 bp, Homo sapiens
ttaaattagaaaata

SEQ ID NO: 4511846 - DNA, 14 bp, Homo sapiens
ttaaattagaatga

SEQ ID NO: 4511847 - DNA, 20 bp, Homo sapiens
ttaaattataaggactgcat

SEQ ID NO: 4511848 - DNA, 12 bp, Homo sapiens
ttaaattatata

SEQ ID NO: 4511849 - DNA, 15 bp, Homo sapiens
ttaaattatatgata

SEQ ID NO: 4511850 - DNA, 19 bp, Homo sapiens
ttaaattccactgaaaatt

SEQ ID NO: 4511851 - DNA, 22 bp, Homo sapiens
ttaaattcccgttttgtcactt

SEQ ID NO: 4511852 - DNA, 14 bp, Homo sapiens
ttaaatttcttatg

SEQ ID NO: 4511853 - DNA, 19 bp, Homo sapiens
ttaaatttcttatgtgaca

SEQ ID NO: 4511854 - DNA, 12 bp, Homo sapiens
ttaaattttatt

SEQ ID NO: 4511855 - DNA, 17 bp, Homo sapiens
ttaaattttcttcagtt

SEQ ID NO: 4511856 - DNA, 12 bp, Homo sapiens
ttaaattttgta

SEQ ID NO: 4511857 - DNA, 15 bp, Homo sapiens
ttaaattttgtaatg

SEQ ID NO: 4511858 - DNA, 16 bp, Homo sapiens
ttaaattttgtgtctc

SEQ ID NO: 4511859 - DNA, 14 bp, Homo sapiens
ttaaattttttggc

SEQ ID NO: 4511860 - DNA, 16 bp, Homo sapiens
ttaaattttttttaca

SEQ ID NO: 4511861 - DNA, 17 bp, Homo sapiens
ttaacaaatgactgtat

SEQ ID NO: 4511862 - DNA, 16 bp, Homo sapiens
ttaacaataataaaaa

SEQ ID NO: 4511863 - DNA, 20 bp, Homo sapiens
ttaacaatgcctattgtaat

SEQ ID NO: 4511864 - DNA, 21 bp, Homo sapiens
ttaacaatgcctattgtaata

SEQ ID NO: 4511865 - DNA, 15 bp, Homo sapiens
ttaacagaaattgta

SEQ ID NO: 4511866 - DNA, 16 bp, Homo sapiens
ttaacagaaattgtat

SEQ ID NO: 4511867 - DNA, 17 bp, Homo sapiens
ttaacagaaattgtata

SEQ ID NO: 4511868 - DNA, 19 bp, Homo sapiens
ttaacagaaattgtatatt

SEQ ID NO: 4511869 - DNA, 21 bp, Homo sapiens
ttaacagaaattgtatattgt

SEQ ID NO: 4511870 - DNA, 19 bp, Homo sapiens
ttaacagagctaagaaata

SEQ ID NO: 4511871 - DNA, 14 bp, Homo sapiens
ttaacagtatttct

SEQ ID NO: 4511872 - DNA, 14 bp, Homo sapiens
ttaacatacatcat

SEQ ID NO: 4511873 - DNA, 13 bp, Homo sapiens
ttaacataggttt

SEQ ID NO: 4511874 - DNA, 23 bp, Homo sapiens
ttaacataggtttttaaagacta

SEQ ID NO: 4511875 - DNA, 17 bp, Homo sapiens
ttaacatagtaagttca

SEQ ID NO: 4511876 - DNA, 23 bp, Homo sapiens
ttaacatcaaagactccgagaag

SEQ ID NO: 4511877 - DNA, 17 bp, Homo sapiens
ttaacatgcaataacaa

SEQ ID NO: 4511878 - DNA, 17 bp, Homo sapiens
ttaaccacttgcctctt

SEQ ID NO: 4511879 - DNA, 15 bp, Homo sapiens
ttaaccctttttcca

SEQ ID NO: 4511880 - DNA, 16 bp, Homo sapiens
ttaacctgttatttct

SEQ ID NO: 4511881 - DNA, 11 bp, Homo sapiens
ttaaccttgaa

SEQ ID NO: 4511882 - DNA, 12 bp, Homo sapiens
ttaacctttgat

SEQ ID NO: 4511883 - DNA, 13 bp, Homo sapiens
ttaactaaatgct

SEQ ID NO: 4511884 - DNA, 16 bp, Homo sapiens
ttaactaaatgctcat

SEQ ID NO: 4511885 - DNA, 17 bp, Homo sapiens
ttaactaaattttaaag

SEQ ID NO: 4511886 - DNA, 16 bp, Homo sapiens
ttaactacccttaatt

SEQ ID NO: 4511887 - DNA, 14 bp, Homo sapiens
ttaactatgtaata

SEQ ID NO: 4511888 - DNA, 17 bp, Homo sapiens
ttaactggcatgtcatt

SEQ ID NO: 4511889 - DNA, 22 bp, Homo sapiens
ttaactggcatgtcatttgcac

SEQ ID NO: 4511890 - DNA, 16 bp, Homo sapiens
ttaactgtaaacttgg

SEQ ID NO: 4511891 - DNA, 12 bp, Homo sapiens
ttaactgtattt

SEQ ID NO: 4511892 - DNA, 14 bp, Homo sapiens
ttaactgtatttca

SEQ ID NO: 4511893 - DNA, 19 bp, Homo sapiens
ttaactgtatttcagtatt

SEQ ID NO: 4511894 - DNA, 19 bp, Homo sapiens
ttaactgttagtattaact

SEQ ID NO: 4511895 - DNA, 13 bp, Homo sapiens
ttaacttaaatag

SEQ ID NO: 4511896 - DNA, 20 bp, Homo sapiens
ttaacttagtttttaaaatt

SEQ ID NO: 4511897 - DNA, 17 bp, Homo sapiens
ttaacttggtcagagcc

SEQ ID NO: 4511898 - DNA, 21 bp, Homo sapiens
ttaactttttgtttttatttc

SEQ ID NO: 4511899 - DNA, 20 bp, Homo sapiens
ttaacttttttttctctctt

SEQ ID NO: 4511900 - DNA, 12 bp, Homo sapiens
ttaagaaacctt

SEQ ID NO: 4511901 - DNA, 13 bp, Homo sapiens
ttaagaaaccttg

SEQ ID NO: 4511902 - DNA, 21 bp, Homo sapiens
ttaagaaaccttgctctcctc

SEQ ID NO: 4511903 - DNA, 23 bp, Homo sapiens
ttaagaaagcacttaaacagaag

SEQ ID NO: 4511904 - DNA, 13 bp, Homo sapiens
ttaagaaaggaag

SEQ ID NO: 4511905 - DNA, 14 bp, Homo sapiens
ttaagaaaggaagt

SEQ ID NO: 4511906 - DNA, 23 bp, Homo sapiens
ttaagaaattttgcctttaagtt

SEQ ID NO: 4511907 - DNA, 12 bp, Homo sapiens
ttaagaacattt

SEQ ID NO: 4511908 - DNA, 23 bp, Homo sapiens
ttaagaacattttataaaacata

SEQ ID NO: 4511909 - DNA, 16 bp, Homo sapiens
ttaagaactaaaatgt

SEQ ID NO: 4511910 - DNA, 13 bp, Homo sapiens
ttaagaactgtgt

SEQ ID NO: 4511911 - DNA, 16 bp, Homo sapiens
ttaagaagaaagattt

SEQ ID NO: 4511912 - DNA, 14 bp, Homo sapiens
ttaagaaggcaaaa

SEQ ID NO: 4511913 - DNA, 14 bp, Homo sapiens
ttaagactgatttt

SEQ ID NO: 4511914 - DNA, 18 bp, Homo sapiens
ttaagactgattttaata

SEQ ID NO: 4511915 - DNA, 15 bp, Homo sapiens
ttaagagaatgaatt

SEQ ID NO: 4511916 - DNA, 16 bp, Homo sapiens
ttaagagctattttag

SEQ ID NO: 4511917 - DNA, 20 bp, Homo sapiens
ttaagagctattttagaaag

SEQ ID NO: 4511918 - DNA, 17 bp, Homo sapiens
ttaagatagtgtaactt

SEQ ID NO: 4511919 - DNA, 18 bp, Homo sapiens
ttaagatcctaaactctc

SEQ ID NO: 4511920 - DNA, 23 bp, Homo sapiens
ttaagatcctaaactctctagct

SEQ ID NO: 4511921 - DNA, 18 bp, Homo sapiens
ttaagatgtacatttaat

SEQ ID NO: 4511922 - DNA, 16 bp, Homo sapiens
ttaagccaaaacaatg

SEQ ID NO: 4511923 - DNA, 21 bp, Homo sapiens
ttaagccccaacatgttcaga

SEQ ID NO: 4511924 - DNA, 15 bp, Homo sapiens
ttaagcttttatttc

SEQ ID NO: 4511925 - DNA, 16 bp, Homo sapiens
ttaagcttttcatttt

SEQ ID NO: 4511926 - DNA, 16 bp, Homo sapiens
ttaagctttttggaat

SEQ ID NO: 4511927 - DNA, 21 bp, Homo sapiens
ttaaggaaactttttaattgt

SEQ ID NO: 4511928 - DNA, 21 bp, Homo sapiens
ttaaggagaggagaaactgag

SEQ ID NO: 4511929 - DNA, 14 bp, Homo sapiens
ttaaggataaatca

SEQ ID NO: 4511930 - DNA, 18 bp, Homo sapiens
ttaaggatggggttatga

SEQ ID NO: 4511931 - DNA, 17 bp, Homo sapiens
ttaagggacatttctat

SEQ ID NO: 4511932 - DNA, 23 bp, Homo sapiens
ttaaggtacactgtttccatgtt

SEQ ID NO: 4511933 - DNA, 14 bp, Homo sapiens
ttaaggtacatcat

SEQ ID NO: 4511934 - DNA, 24 bp, Homo sapiens
ttaagtaacgtgctcactgtgtat

SEQ ID NO: 4511935 - DNA, 12 bp, Homo sapiens
ttaagtagattt

SEQ ID NO: 4511936 - DNA, 16 bp, Homo sapiens
ttaagtataaacctta

SEQ ID NO: 4511937 - DNA, 21 bp, Homo sapiens
ttaagtcagatttttatttat

SEQ ID NO: 4511938 - DNA, 17 bp, Homo sapiens
ttaagtctatctggtat

SEQ ID NO: 4511939 - DNA, 19 bp, Homo sapiens
ttaagtgaatacattaacg

SEQ ID NO: 4511940 - DNA, 14 bp, Homo sapiens
ttaagtgctgcagc

SEQ ID NO: 4511941 - DNA, 15 bp, Homo sapiens
ttaagtgtaaatgaa

SEQ ID NO: 4511942 - DNA, 15 bp, Homo sapiens
ttaagtgttcatttt

SEQ ID NO: 4511943 - DNA, 20 bp, Homo sapiens
ttaagtgttggaaaaaattt

SEQ ID NO: 4511944 - DNA, 18 bp, Homo sapiens
tgtggagcacgtggagat

SEQ ID NO: 4511945 - DNA, 15 bp, Homo sapiens
tgtggaggaagagcc

SEQ ID NO: 4511946 - DNA, 22 bp, Homo sapiens
tgtggaggaagagccacctgca

SEQ ID NO: 4511947 - DNA, 23 bp, Homo sapiens
tgtggaggaagagccacctgcaa

SEQ ID NO: 4511948 - DNA, 15 bp, Homo sapiens
tgtggataagtggct

SEQ ID NO: 4511949 - DNA, 16 bp, Homo sapiens
tgtggattaaaccttt

SEQ ID NO: 4511950 - DNA, 22 bp, Homo sapiens
tgtggattctgaggccctgccc

SEQ ID NO: 4511951 - DNA, 22 bp, Homo sapiens
tgtggattttttccttcaaagt

SEQ ID NO: 4511952 - DNA, 19 bp, Homo sapiens
tgtggcaaaacatatacca

SEQ ID NO: 4511953 - DNA, 15 bp, Homo sapiens
tgtggcaaactgaag

SEQ ID NO: 4511954 - DNA, 14 bp, Homo sapiens
tgtggcagagttac

SEQ ID NO: 4511955 - DNA, 18 bp, Homo sapiens
tgtggcagtaaagagaaa

SEQ ID NO: 4511956 - DNA, 12 bp, Homo sapiens
tgtggcagtggt

SEQ ID NO: 4511957 - DNA, 16 bp, Homo sapiens
tgtggcagtggttttg

SEQ ID NO: 4511958 - DNA, 19 bp, Homo sapiens
tgtggcatccagagtccct

SEQ ID NO: 4511959 - DNA, 17 bp, Homo sapiens
tgtggcatctttgcctt

SEQ ID NO: 4511960 - DNA, 14 bp, Homo sapiens
tgtggcattggggg

SEQ ID NO: 4511961 - DNA, 18 bp, Homo sapiens
tgtggccaagttcttagt

SEQ ID NO: 4511962 - DNA, 15 bp, Homo sapiens
tgtggccaggggtgc

SEQ ID NO: 4511963 - DNA, 16 bp, Homo sapiens
tgtggccccaagaggg

SEQ ID NO: 4511964 - DNA, 20 bp, Homo sapiens
tgtggccctggcctgctggg

SEQ ID NO: 4511965 - DNA, 15 bp, Homo sapiens
tgtggccggcctcct

SEQ ID NO: 4511966 - DNA, 14 bp, Homo sapiens
tgtggccggtgcca

SEQ ID NO: 4511967 - DNA, 16 bp, Homo sapiens
tgtggccggtgccagc

SEQ ID NO: 4511968 - DNA, 16 bp, Homo sapiens
tgtggccgtctcctcc

SEQ ID NO: 4511969 - DNA, 19 bp, Homo sapiens
tgtggccgtctcctccctc

SEQ ID NO: 4511970 - DNA, 10 bp, Homo sapiens
tgtggcctca

SEQ ID NO: 4511971 - DNA, 12 bp, Homo sapiens
tgtggcctcagc

SEQ ID NO: 4511972 - DNA, 18 bp, Homo sapiens
tgtggcctcagccctcag

SEQ ID NO: 4511973 - DNA, 20 bp, Homo sapiens
tgtggctcctcccagcccat

SEQ ID NO: 4511974 - DNA, 12 bp, Homo sapiens
tgtggctggctc

SEQ ID NO: 4511975 - DNA, 15 bp, Homo sapiens
tgtggctgggggcag

SEQ ID NO: 4511976 - DNA, 12 bp, Homo sapiens
tgtggctggtgt

SEQ ID NO: 4511977 - DNA, 11 bp, Homo sapiens
tgtggctttcc

SEQ ID NO: 4511978 - DNA, 19 bp, Homo sapiens
tgtggctttttgttcagaa

SEQ ID NO: 4511979 - DNA, 15 bp, Homo sapiens
tgtgggaagggagag

SEQ ID NO: 4511980 - DNA, 13 bp, Homo sapiens
tgtgggactgtac

SEQ ID NO: 4511981 - DNA, 20 bp, Homo sapiens
tgtgggactgtacacacttt

SEQ ID NO: 4511982 - DNA, 13 bp, Homo sapiens
tgtgggagtagaa

SEQ ID NO: 4511983 - DNA, 13 bp, Homo sapiens
tgtgggcagcacc

SEQ ID NO: 4511984 - DNA, 15 bp, Homo sapiens
tgtgggcagcaccct

SEQ ID NO: 4511985 - DNA, 17 bp, Homo sapiens
tgtgggcagcaccctcc

SEQ ID NO: 4511986 - DNA, 13 bp, Homo sapiens
tgtggggactccg

SEQ ID NO: 4511987 - DNA, 19 bp, Homo sapiens
tgtggggagggtgtctggg

SEQ ID NO: 4511988 - DNA, 21 bp, Homo sapiens
tgtgggggaggcgcacagtgt

SEQ ID NO: 4511989 - DNA, 19 bp, Homo sapiens
tgtggggggtaatccctgc

SEQ ID NO: 4511990 - DNA, 14 bp, Homo sapiens
tgtgggggtggcca

SEQ ID NO: 4511991 - DNA, 12 bp, Homo sapiens
tgtggggtgggg

SEQ ID NO: 4511992 - DNA, 12 bp, Homo sapiens
tgtgggtcccgc

SEQ ID NO: 4511993 - DNA, 14 bp, Homo sapiens
tgtgggtctctgaa

SEQ ID NO: 4511994 - DNA, 22 bp, Homo sapiens
tgtgggtgttaatttttgatac

SEQ ID NO: 4511995 - DNA, 19 bp, Homo sapiens
tgtggtacatggtgtttgt

SEQ ID NO: 4511996 - DNA, 22 bp, Homo sapiens
tgtggtcaacatttctcatgtt

SEQ ID NO: 4511997 - DNA, 20 bp, Homo sapiens
tgtggtcacaggaagtagag

SEQ ID NO: 4511998 - DNA, 20 bp, Homo sapiens
tgtggtgaagtgtggctggt

SEQ ID NO: 4511999 - DNA, 19 bp, Homo sapiens
tgtggtgacttctgctgct

SEQ ID NO: 4512000 - DNA, 22 bp, Homo sapiens
tgtggtgacttctgctgctggc

SEQ ID NO: 4512001 - DNA, 22 bp, Homo sapiens
tgtggtttagttataaaaggct

SEQ ID NO: 4512002 - DNA, 18 bp, Homo sapiens
tgtggtttggaatattaa

SEQ ID NO: 4512003 - DNA, 14 bp, Homo sapiens
tgtggttttatgga

SEQ ID NO: 4512004 - DNA, 17 bp, Homo sapiens
tgtggttttatggagac

SEQ ID NO: 4512005 - DNA, 15 bp, Homo sapiens
tgtgtaaagatttat

SEQ ID NO: 4512006 - DNA, 19 bp, Homo sapiens
tgtgtaacatctgccattt

SEQ ID NO: 4512007 - DNA, 13 bp, Homo sapiens
tgtgtaaggagta

SEQ ID NO: 4512008 - DNA, 15 bp, Homo sapiens
tgtgtaataaagtgt

SEQ ID NO: 4512009 - DNA, 18 bp, Homo sapiens
tgtgtaataaagtgtttt

SEQ ID NO: 4512010 - DNA, 20 bp, Homo sapiens
tgtgtaataaagtgttttca

SEQ ID NO: 4512011 - DNA, 21 bp, Homo sapiens
tgtgtaattagtgccacttaa

SEQ ID NO: 4512012 - DNA, 18 bp, Homo sapiens
tgtgtaatttaaaattgt

SEQ ID NO: 4512013 - DNA, 16 bp, Homo sapiens
tgtgtacctcactgtc

SEQ ID NO: 4512014 - DNA, 18 bp, Homo sapiens
tgtgtaccttaagatatt

SEQ ID NO: 4512015 - DNA, 10 bp, Homo sapiens
tgtgtactgt

SEQ ID NO: 4512016 - DNA, 17 bp, Homo sapiens
tgtgtagaagtccacag

SEQ ID NO: 4512017 - DNA, 13 bp, Homo sapiens
tgtgtagatttga

SEQ ID NO: 4512018 - DNA, 18 bp, Homo sapiens
tgtgtaggtgtctgcctt

SEQ ID NO: 4512019 - DNA, 14 bp, Homo sapiens
tgtgtataggaatt

SEQ ID NO: 4512020 - DNA, 20 bp, Homo sapiens
tgtgtatatatcttataact

SEQ ID NO: 4512021 - DNA, 16 bp, Homo sapiens
tgtgtatatctcttgg

SEQ ID NO: 4512022 - DNA, 19 bp, Homo sapiens
tgtgtatatctcttggaaa

SEQ ID NO: 4512023 - DNA, 14 bp, Homo sapiens
tgtgtatatgtatt

SEQ ID NO: 4512024 - DNA, 16 bp, Homo sapiens
tgtgtatatgtattta

SEQ ID NO: 4512025 - DNA, 18 bp, Homo sapiens
tgtgtatctgtgcttcta

SEQ ID NO: 4512026 - DNA, 11 bp, Homo sapiens
tgtgtatgtgg

SEQ ID NO: 4512027 - DNA, 15 bp, Homo sapiens
tgtgtattaaatggt

SEQ ID NO: 4512028 - DNA, 16 bp, Homo sapiens
tgtgtattaaatggtt

SEQ ID NO: 4512029 - DNA, 12 bp, Homo sapiens
tgtgtattctta

SEQ ID NO: 4512030 - DNA, 13 bp, Homo sapiens
tgtgtatttgcta

SEQ ID NO: 4512031 - DNA, 23 bp, Homo sapiens
tgtgtcacaatgagattgaattt

SEQ ID NO: 4512032 - DNA, 21 bp, Homo sapiens
tgtgtcagagcccagcccagg

SEQ ID NO: 4512033 - DNA, 18 bp, Homo sapiens
tgtgtccacgactgtctc

SEQ ID NO: 4512034 - DNA, 14 bp, Homo sapiens
tgtgtcccatgtcc

SEQ ID NO: 4512035 - DNA, 15 bp, Homo sapiens
tgtgtcccccccagg

SEQ ID NO: 4512036 - DNA, 16 bp, Homo sapiens
tgtgtcccccccaggc

SEQ ID NO: 4512037 - DNA, 15 bp, Homo sapiens
tgtgtcccctcactc

SEQ ID NO: 4512038 - DNA, 19 bp, Homo sapiens
tgtgtcccctcactctgtc

SEQ ID NO: 4512039 - DNA, 21 bp, Homo sapiens
tgtgtctgtgccctccaaaga

SEQ ID NO: 4512040 - DNA, 15 bp, Homo sapiens
tgtgtcttctgcccc

SEQ ID NO: 4512041 - DNA, 18 bp, Homo sapiens
tgtgtgaataccccaaga

SEQ ID NO: 4512042 - DNA, 18 bp, Homo sapiens
tgtgtgaatgaacactct

SEQ ID NO: 4512043 - DNA, 22 bp, Homo sapiens
tgtgtgaatgaacactcttttg

SEQ ID NO: 4512044 - DNA, 14 bp, Homo sapiens
tgtgtgacaattct

SEQ ID NO: 4512045 - DNA, 14 bp, Homo sapiens
tgtgtgagcagtgg

SEQ ID NO: 4512046 - DNA, 19 bp, Homo sapiens
tgtgtgatccggtttcttt

SEQ ID NO: 4512047 - DNA, 14 bp, Homo sapiens
tgtgtgattgaagg

SEQ ID NO: 4512048 - DNA, 18 bp, Homo sapiens
tgtgtgcaactaactgac

SEQ ID NO: 4512049 - DNA, 19 bp, Homo sapiens
tgtgtgcactttttttcta

SEQ ID NO: 4512050 - DNA, 15 bp, Homo sapiens
tgtgtgcatatttgt

SEQ ID NO: 4512051 - DNA, 14 bp, Homo sapiens
tgtgtgcatggaag

SEQ ID NO: 4512052 - DNA, 14 bp, Homo sapiens
tgtgtgccaagccc

SEQ ID NO: 4512053 - DNA, 18 bp, Homo sapiens
tgtgtgccaagccctggc

SEQ ID NO: 4512054 - DNA, 14 bp, Homo sapiens
tgtgtgccctggac

SEQ ID NO: 4512055 - DNA, 16 bp, Homo sapiens
tgtgtgctgtttgaaa

SEQ ID NO: 4512056 - DNA, 20 bp, Homo sapiens
tgtgtggccggcctcctcct

SEQ ID NO: 4512057 - DNA, 14 bp, Homo sapiens
tgtgtgggactgta

SEQ ID NO: 4512058 - DNA, 15 bp, Homo sapiens
tgtgtgggactgtac

SEQ ID NO: 4512059 - DNA, 17 bp, Homo sapiens
tgtgtgggactgtacac

SEQ ID NO: 4512060 - DNA, 14 bp, Homo sapiens
tgtgtgggagtgtg

SEQ ID NO: 4512061 - DNA, 15 bp, Homo sapiens
tgtgtgggagtgtgt

SEQ ID NO: 4512062 - DNA, 16 bp, Homo sapiens
tgtgtggtactttgca

SEQ ID NO: 4512063 - DNA, 23 bp, Homo sapiens
tgtgtggtcaacatttctcatgt

SEQ ID NO: 4512064 - DNA, 14 bp, Homo sapiens
tgtgtgtatatgta

SEQ ID NO: 4512065 - DNA, 11 bp, Homo sapiens
tgtgtgtatgt

SEQ ID NO: 4512066 - DNA, 14 bp, Homo sapiens
tgtgtgtatgtgta

SEQ ID NO: 4512067 - DNA, 14 bp, Homo sapiens
tgtgtgtatttgct

SEQ ID NO: 4512068 - DNA, 22 bp, Homo sapiens
tgtgtgtccacgactgtctcca

SEQ ID NO: 4512069 - DNA, 15 bp, Homo sapiens
tgtgtgtgccaagcc

SEQ ID NO: 4512070 - DNA, 12 bp, Homo sapiens
tgtgtgtggaat

SEQ ID NO: 4512071 - DNA, 14 bp, Homo sapiens
tgtgtgtggcaggg

SEQ ID NO: 4512072 - DNA, 20 bp, Homo sapiens
tgtgtgtgggagtgtgtaat

SEQ ID NO: 4512073 - DNA, 13 bp, Homo sapiens
tgtgtgtgtgaat

SEQ ID NO: 4512074 - DNA, 16 bp, Homo sapiens
tgtgtgtgtgtatgtg

SEQ ID NO: 4512075 - DNA, 18 bp, Homo sapiens
tgtgtgttgtgtgtggga

SEQ ID NO: 4512076 - DNA, 13 bp, Homo sapiens
tgtgtgtttggaa

SEQ ID NO: 4512077 - DNA, 23 bp, Homo sapiens
tgtgttacctgaaaacactgtgc

SEQ ID NO: 4512078 - DNA, 17 bp, Homo sapiens
tgtgttatctacctcaa

SEQ ID NO: 4512079 - DNA, 17 bp, Homo sapiens
tgtgttcacagacctca

SEQ ID NO: 4512080 - DNA, 14 bp, Homo sapiens
tgtgttcaccatcg

SEQ ID NO: 4512081 - DNA, 12 bp, Homo sapiens
tgtgttcctttt

SEQ ID NO: 4512082 - DNA, 20 bp, Homo sapiens
tgtgttctatccaaacatgt

SEQ ID NO: 4512083 - DNA, 16 bp, Homo sapiens
tgtgttctctaggcct

SEQ ID NO: 4512084 - DNA, 14 bp, Homo sapiens
tgtgttctgctcca

SEQ ID NO: 4512085 - DNA, 14 bp, Homo sapiens
tgtgttctgggctg

SEQ ID NO: 4512086 - DNA, 22 bp, Homo sapiens
tgtgttcttttctcctttacca

SEQ ID NO: 4512087 - DNA, 15 bp, Homo sapiens
tgtgttgactttata

SEQ ID NO: 4512088 - DNA, 22 bp, Homo sapiens
tgtgttgggattgagtctgtgc

SEQ ID NO: 4512089 - DNA, 15 bp, Homo sapiens
tgtgtttatgtgtgt

SEQ ID NO: 4512090 - DNA, 18 bp, Homo sapiens
tgtgtttcacttaatgtt

SEQ ID NO: 4512091 - DNA, 20 bp, Homo sapiens
tgtgtttcattacttgaatg

SEQ ID NO: 4512092 - DNA, 21 bp, Homo sapiens
tgtgtttccagatcgatcctg

SEQ ID NO: 4512093 - DNA, 17 bp, Homo sapiens
tgtgtttggaagactat

SEQ ID NO: 4512094 - DNA, 14 bp, Homo sapiens
tgtgtttgtgagca

SEQ ID NO: 4512095 - DNA, 16 bp, Homo sapiens
tgtgttttgtcttttt

SEQ ID NO: 4512096 - DNA, 16 bp, Homo sapiens
tgtgtttttctccagt

SEQ ID NO: 4512097 - DNA, 14 bp, Homo sapiens
tgtgtttttctttt

SEQ ID NO: 4512098 - DNA, 16 bp, Homo sapiens
tgtgtttttctttttc

SEQ ID NO: 4512099 - DNA, 19 bp, Homo sapiens
tgtgtttttgggatgtctt

SEQ ID NO: 4512100 - DNA, 20 bp, Homo sapiens
tgtgtttttgggatgtctta

SEQ ID NO: 4512101 - DNA, 22 bp, Homo sapiens
tgttaaaaccaaactggttcac

SEQ ID NO: 4512102 - DNA, 20 bp, Homo sapiens
tgttaaaagaaaataaatta

SEQ ID NO: 4512103 - DNA, 12 bp, Homo sapiens
tgttaaattcag

SEQ ID NO: 4512104 - DNA, 23 bp, Homo sapiens
tgttaacaatgcctattgtaata

SEQ ID NO: 4512105 - DNA, 19 bp, Homo sapiens
tgttaacctctgcttttat

SEQ ID NO: 4512106 - DNA, 15 bp, Homo sapiens
tgttaacctttctaa

SEQ ID NO: 4512107 - DNA, 15 bp, Homo sapiens
tgttaagtattttca

SEQ ID NO: 4512108 - DNA, 17 bp, Homo sapiens
tgttaagtattttcata

SEQ ID NO: 4512109 - DNA, 13 bp, Homo sapiens
tgttaatacatca

SEQ ID NO: 4512110 - DNA, 18 bp, Homo sapiens
tgttaatatcactcatta

SEQ ID NO: 4512111 - DNA, 22 bp, Homo sapiens
tgttaatcttaatgtatatcgt

SEQ ID NO: 4512112 - DNA, 13 bp, Homo sapiens
tgttaatgactct

SEQ ID NO: 4512113 - DNA, 14 bp, Homo sapiens
tgttaatgcattgt

SEQ ID NO: 4512114 - DNA, 13 bp, Homo sapiens
tgttaatgctttt

SEQ ID NO: 4512115 - DNA, 20 bp, Homo sapiens
tgttaatttagaaaacttta

SEQ ID NO: 4512116 - DNA, 14 bp, Homo sapiens
tgttaatttataat

SEQ ID NO: 4512117 - DNA, 15 bp, Homo sapiens
tgttacagactgaaa

SEQ ID NO: 4512118 - DNA, 14 bp, Homo sapiens
tgttacagtaatgt

SEQ ID NO: 4512119 - DNA, 17 bp, Homo sapiens
tgttacagtaatgtcat

SEQ ID NO: 4512120 - DNA, 21 bp, Homo sapiens
tgttacagtaatgtcataaag

SEQ ID NO: 4512121 - DNA, 19 bp, Homo sapiens
tgttacataaggatgactt

SEQ ID NO: 4512122 - DNA, 16 bp, Homo sapiens
tgttacctactttgac

SEQ ID NO: 4512123 - DNA, 16 bp, Homo sapiens
tgttacctgaaaacac

SEQ ID NO: 4512124 - DNA, 15 bp, Homo sapiens
tgttacgtttgaagt

SEQ ID NO: 4512125 - DNA, 20 bp, Homo sapiens
tgttactaaaaaaaagatga

SEQ ID NO: 4512126 - DNA, 19 bp, Homo sapiens
tgttactgccttaataaaa

SEQ ID NO: 4512127 - DNA, 17 bp, Homo sapiens
tgttactgctgattctt

SEQ ID NO: 4512128 - DNA, 13 bp, Homo sapiens
tgttactgcttct

SEQ ID NO: 4512129 - DNA, 15 bp, Homo sapiens
tgttactgcttctct

SEQ ID NO: 4512130 - DNA, 20 bp, Homo sapiens
tgttactgtatttttcagaa

SEQ ID NO: 4512131 - DNA, 16 bp, Homo sapiens
tgttactgtcattccc

SEQ ID NO: 4512132 - DNA, 15 bp, Homo sapiens
tgttacttccttatg

SEQ ID NO: 4512133 - DNA, 19 bp, Homo sapiens
tgttactttggcaatttcc

SEQ ID NO: 4512134 - DNA, 17 bp, Homo sapiens
tgttagaaaatgactta

SEQ ID NO: 4512135 - DNA, 20 bp, Homo sapiens
tgttagaaaatgacttattt

SEQ ID NO: 4512136 - DNA, 14 bp, Homo sapiens
tgttagaacactat

SEQ ID NO: 4512137 - DNA, 17 bp, Homo sapiens
tgttagaacactatttt

SEQ ID NO: 4512138 - DNA, 19 bp, Homo sapiens
tgttagaacactattttca

SEQ ID NO: 4512139 - DNA, 21 bp, Homo sapiens
tgttagaacactattttcaga

SEQ ID NO: 4512140 - DNA, 22 bp, Homo sapiens
tgttagaacactattttcagaa

SEQ ID NO: 4512141 - DNA, 17 bp, Homo sapiens
tgttagaacctagattc

SEQ ID NO: 4512142 - DNA, 19 bp, Homo sapiens
tgttagacttgtgtgcatg

SEQ ID NO: 4512143 - DNA, 22 bp, Homo sapiens
tgttagacttgtgtgcatggaa

SEQ ID NO: 4512144 - DNA, 16 bp, Homo sapiens
tgttagatattgctac

SEQ ID NO: 4512145 - DNA, 19 bp, Homo sapiens
tgttagcactgatagtcct

SEQ ID NO: 4512146 - DNA, 17 bp, Homo sapiens
tgttaggggccaataaa

SEQ ID NO: 4512147 - DNA, 19 bp, Homo sapiens
tgttaggggccaataaaat

SEQ ID NO: 4512148 - DNA, 22 bp, Homo sapiens
tgttaggggccaataaaatgta

SEQ ID NO: 4512149 - DNA, 22 bp, Homo sapiens
tgttagggtataagttgctgta

SEQ ID NO: 4512150 - DNA, 15 bp, Homo sapiens
tgttagtattaacta

SEQ ID NO: 4512151 - DNA, 12 bp, Homo sapiens
tgttataaaata

SEQ ID NO: 4512152 - DNA, 13 bp, Homo sapiens
tgttataaaataa

SEQ ID NO: 4512153 - DNA, 22 bp, Homo sapiens
tgttataaaataatgtactgaa

SEQ ID NO: 4512154 - DNA, 13 bp, Homo sapiens
tgttataaataaa

SEQ ID NO: 4512155 - DNA, 15 bp, Homo sapiens
tgttataactctgca

SEQ ID NO: 4512156 - DNA, 17 bp, Homo sapiens
tgttataactctgcact

SEQ ID NO: 4512157 - DNA, 21 bp, Homo sapiens
tgttatacaaccttcatttaa

SEQ ID NO: 4512158 - DNA, 22 bp, Homo sapiens
tgttatacaaccttcatttaaa

SEQ ID NO: 4512159 - DNA, 14 bp, Homo sapiens
tgttatattgcttc

SEQ ID NO: 4512160 - DNA, 21 bp, Homo sapiens
tgttatattgcttcctgtgta

SEQ ID NO: 4512161 - DNA, 18 bp, Homo sapiens
tgttatcaaactgctgtc

SEQ ID NO: 4512162 - DNA, 19 bp, Homo sapiens
tgttatcaccgtgggctcc

SEQ ID NO: 4512163 - DNA, 18 bp, Homo sapiens
tgttatcggattactgaa

SEQ ID NO: 4512164 - DNA, 21 bp, Homo sapiens
tgttatcttatactgtacaat

SEQ ID NO: 4512165 - DNA, 20 bp, Homo sapiens
tgttatgactatgtaaacta

SEQ ID NO: 4512166 - DNA, 21 bp, Homo sapiens
tgttatgaggatataatgtgt

SEQ ID NO: 4512167 - DNA, 17 bp, Homo sapiens
tgttatgtagataacaa

SEQ ID NO: 4512168 - DNA, 12 bp, Homo sapiens
tgttatgtattt

SEQ ID NO: 4512169 - DNA, 15 bp, Homo sapiens
tgttattaatgtttc

SEQ ID NO: 4512170 - DNA, 22 bp, Homo sapiens
tgttattcaaatttgatgatgt

SEQ ID NO: 4512171 - DNA, 15 bp, Homo sapiens
tgttatttattatta

SEQ ID NO: 4512172 - DNA, 18 bp, Homo sapiens
tgttatttattgaaatga

SEQ ID NO: 4512173 - DNA, 19 bp, Homo sapiens
tgttatttattgaaatgat

SEQ ID NO: 4512174 - DNA, 15 bp, Homo sapiens
tgttatttccccagc

SEQ ID NO: 4512175 - DNA, 13 bp, Homo sapiens
tgttatttcttcc

SEQ ID NO: 4512176 - DNA, 14 bp, Homo sapiens
tgttatttcttccc

SEQ ID NO: 4512177 - DNA, 17 bp, Homo sapiens
tgttattttcttctaag

SEQ ID NO: 4512178 - DNA, 14 bp, Homo sapiens
tgttattttgcaac

SEQ ID NO: 4512179 - DNA, 22 bp, Homo sapiens
tgttcaaagccagcgtcctcct

SEQ ID NO: 4512180 - DNA, 22 bp, Homo sapiens
tgttcaatagatttaggagcag

SEQ ID NO: 4512181 - DNA, 22 bp, Homo sapiens
tgttcaatatcagctttgataa

SEQ ID NO: 4512182 - DNA, 16 bp, Homo sapiens
tgttcacagccagact

SEQ ID NO: 4512183 - DNA, 12 bp, Homo sapiens
tgttcagaaaat

SEQ ID NO: 4512184 - DNA, 17 bp, Homo sapiens
tgttcagagttgtttgg

SEQ ID NO: 4512185 - DNA, 18 bp, Homo sapiens
tgttcagcggagctgact

SEQ ID NO: 4512186 - DNA, 21 bp, Homo sapiens
tgttcagcggagctgactggt

SEQ ID NO: 4512187 - DNA, 13 bp, Homo sapiens
tgtgagaccccca

SEQ ID NO: 4512188 - DNA, 14 bp, Homo sapiens
tgtgagacccccac

SEQ ID NO: 4512189 - DNA, 18 bp, Homo sapiens
tgtgagacccccacacct

SEQ ID NO: 4512190 - DNA, 16 bp, Homo sapiens
tgtgagaggtttgact

SEQ ID NO: 4512191 - DNA, 18 bp, Homo sapiens
tgtgagagtggctttcta

SEQ ID NO: 4512192 - DNA, 21 bp, Homo sapiens
tgtgagatagttttcatttta

SEQ ID NO: 4512193 - DNA, 18 bp, Homo sapiens
tgtgagatgtgtatcagt

SEQ ID NO: 4512194 - DNA, 12 bp, Homo sapiens
tgtgagatttcc

SEQ ID NO: 4512195 - DNA, 18 bp, Homo sapiens
tgtgagcatcagagggct

SEQ ID NO: 4512196 - DNA, 19 bp, Homo sapiens
tgtgagccaccgtgcctgg

SEQ ID NO: 4512197 - DNA, 14 bp, Homo sapiens
tgtgagctcttccc

SEQ ID NO: 4512198 - DNA, 17 bp, Homo sapiens
tgtgagctcttccctta

SEQ ID NO: 4512199 - DNA, 22 bp, Homo sapiens
tgtgaggagagtctgaatattt

SEQ ID NO: 4512200 - DNA, 13 bp, Homo sapiens
tgtgaggagctgc

SEQ ID NO: 4512201 - DNA, 17 bp, Homo sapiens
tgtgaggagctgctggc

SEQ ID NO: 4512202 - DNA, 12 bp, Homo sapiens
tgtgaggcaggg

SEQ ID NO: 4512203 - DNA, 13 bp, Homo sapiens
tgtgaggccaggg

SEQ ID NO: 4512204 - DNA, 14 bp, Homo sapiens
tgtgagggagggga

SEQ ID NO: 4512205 - DNA, 17 bp, Homo sapiens
tgtgagtcagaatgtga

SEQ ID NO: 4512206 - DNA, 13 bp, Homo sapiens
tgtgagtgtgaat

SEQ ID NO: 4512207 - DNA, 22 bp, Homo sapiens
tgtgagtgtgtttgtgtgcatg

SEQ ID NO: 4512208 - DNA, 16 bp, Homo sapiens
tgtgataaatcagtca

SEQ ID NO: 4512209 - DNA, 13 bp, Homo sapiens
tgtgatattctgt

SEQ ID NO: 4512210 - DNA, 13 bp, Homo sapiens
tgtgatcgtctga

SEQ ID NO: 4512211 - DNA, 14 bp, Homo sapiens
tgtgatctctgctg

SEQ ID NO: 4512212 - DNA, 14 bp, Homo sapiens
tgtgatctgggcat

SEQ ID NO: 4512213 - DNA, 21 bp, Homo sapiens
tgtgatcttaatatatttgaa

SEQ ID NO: 4512214 - DNA, 15 bp, Homo sapiens
tgtgatgaacatatt

SEQ ID NO: 4512215 - DNA, 14 bp, Homo sapiens
tgtgatgaatactg

SEQ ID NO: 4512216 - DNA, 16 bp, Homo sapiens
tgtgatgaatactgta

SEQ ID NO: 4512217 - DNA, 16 bp, Homo sapiens
tgtgatgatagcactg

SEQ ID NO: 4512218 - DNA, 21 bp, Homo sapiens
tgtgatgatagcactggtttg

SEQ ID NO: 4512219 - DNA, 19 bp, Homo sapiens
tgtgattactctttgcttt

SEQ ID NO: 4512220 - DNA, 22 bp, Homo sapiens
tgtgattcaatctgtaaactgt

SEQ ID NO: 4512221 - DNA, 20 bp, Homo sapiens
tgtgattcagaaaatgttct

SEQ ID NO: 4512222 - DNA, 19 bp, Homo sapiens
tgtgatttctttaaaagaa

SEQ ID NO: 4512223 - DNA, 22 bp, Homo sapiens
tgtgatttctttaaaagaatga

SEQ ID NO: 4512224 - DNA, 17 bp, Homo sapiens
tgtgattttaagacaag

SEQ ID NO: 4512225 - DNA, 20 bp, Homo sapiens
tgtgcaaaaaaattaaaatg

SEQ ID NO: 4512226 - DNA, 23 bp, Homo sapiens
tgtgcaaaaaaattaaaatggat

SEQ ID NO: 4512227 - DNA, 21 bp, Homo sapiens
tgtgcaaacatggagaaatct

SEQ ID NO: 4512228 - DNA, 18 bp, Homo sapiens
tgtgcaactttttaaagt

SEQ ID NO: 4512229 - DNA, 18 bp, Homo sapiens
tgtgcaatttgtaaatat

SEQ ID NO: 4512230 - DNA, 15 bp, Homo sapiens
tgtgcacatctgttt

SEQ ID NO: 4512231 - DNA, 17 bp, Homo sapiens
tgtgcacatctgttttg

SEQ ID NO: 4512232 - DNA, 14 bp, Homo sapiens
tgtgcacccatggg

SEQ ID NO: 4512233 - DNA, 20 bp, Homo sapiens
tgtgcactttttttctatat

SEQ ID NO: 4512234 - DNA, 20 bp, Homo sapiens
tgtgcagcttcgaggacagg

SEQ ID NO: 4512235 - DNA, 21 bp, Homo sapiens
tgtgcagcttcgaggacagga

SEQ ID NO: 4512236 - DNA, 20 bp, Homo sapiens
tgtgcaggcctgtccctggg

SEQ ID NO: 4512237 - DNA, 20 bp, Homo sapiens
tgtgcagggatattgcctta

SEQ ID NO: 4512238 - DNA, 19 bp, Homo sapiens
tgtgcagtactttgtgcat

SEQ ID NO: 4512239 - DNA, 17 bp, Homo sapiens
tgtgcagtcactggagg

SEQ ID NO: 4512240 - DNA, 17 bp, Homo sapiens
tgtgcatggaagtaatt

SEQ ID NO: 4512241 - DNA, 13 bp, Homo sapiens
tgtgcatgggtta

SEQ ID NO: 4512242 - DNA, 21 bp, Homo sapiens
tgtgcattattcataaaaaat

SEQ ID NO: 4512243 - DNA, 14 bp, Homo sapiens
tgtgccaagattta

SEQ ID NO: 4512244 - DNA, 16 bp, Homo sapiens
tgtgccaagccctggc

SEQ ID NO: 4512245 - DNA, 14 bp, Homo sapiens
tgtgccacagaggc

SEQ ID NO: 4512246 - DNA, 15 bp, Homo sapiens
tgtgccacagaggcc

SEQ ID NO: 4512247 - DNA, 17 bp, Homo sapiens
tgtgccacagaggcccc

SEQ ID NO: 4512248 - DNA, 16 bp, Homo sapiens
tgtgccagaggccaga

SEQ ID NO: 4512249 - DNA, 18 bp, Homo sapiens
tgtgccagggcaatgatg

SEQ ID NO: 4512250 - DNA, 12 bp, Homo sapiens
tgtgcccttggg

SEQ ID NO: 4512251 - DNA, 21 bp, Homo sapiens
tgtgcccttttataaggaaac

SEQ ID NO: 4512252 - DNA, 17 bp, Homo sapiens
tgtgccgctgccacccg

SEQ ID NO: 4512253 - DNA, 21 bp, Homo sapiens
tgtgccgggaggcagccacag

SEQ ID NO: 4512254 - DNA, 15 bp, Homo sapiens
tgtgcctaatgtgtt

SEQ ID NO: 4512255 - DNA, 17 bp, Homo sapiens
tgtgcctaatgtgtttg

SEQ ID NO: 4512256 - DNA, 15 bp, Homo sapiens
tgtgcctccccccag

SEQ ID NO: 4512257 - DNA, 17 bp, Homo sapiens
tgtgcctccccccagac

SEQ ID NO: 4512258 - DNA, 18 bp, Homo sapiens
tgtgcctccccccagacc

SEQ ID NO: 4512259 - DNA, 15 bp, Homo sapiens
tgtgcctctttgtct

SEQ ID NO: 4512260 - DNA, 15 bp, Homo sapiens
tgtgcctgattattt

SEQ ID NO: 4512261 - DNA, 23 bp, Homo sapiens
tgtgcctggccccagcctgggcc

SEQ ID NO: 4512262 - DNA, 18 bp, Homo sapiens
tgtgcctggctccctgat

SEQ ID NO: 4512263 - DNA, 20 bp, Homo sapiens
tgtgcctggctccctgatgg

SEQ ID NO: 4512264 - DNA, 19 bp, Homo sapiens
tgtgccttgattgattaga

SEQ ID NO: 4512265 - DNA, 18 bp, Homo sapiens
tgtgccttgttttttgtt

SEQ ID NO: 4512266 - DNA, 12 bp, Homo sapiens
tgtgcctttcct

SEQ ID NO: 4512267 - DNA, 12 bp, Homo sapiens
tgtgcctttctt

SEQ ID NO: 4512268 - DNA, 14 bp, Homo sapiens
tgtgcctttctttg

SEQ ID NO: 4512269 - DNA, 17 bp, Homo sapiens
tgtgcctttctttgcct

SEQ ID NO: 4512270 - DNA, 18 bp, Homo sapiens
tgtgcctttctttgcctc

SEQ ID NO: 4512271 - DNA, 16 bp, Homo sapiens
tgtgccttttgccatc

SEQ ID NO: 4512272 - DNA, 16 bp, Homo sapiens
tgtgctaaaccaagtt

SEQ ID NO: 4512273 - DNA, 20 bp, Homo sapiens
tgtgctagaaattttcaaga

SEQ ID NO: 4512274 - DNA, 18 bp, Homo sapiens
tgtgctatactgcatact

SEQ ID NO: 4512275 - DNA, 17 bp, Homo sapiens
tgtgctatagtatttga

SEQ ID NO: 4512276 - DNA, 17 bp, Homo sapiens
tgtgctattaatatttg

SEQ ID NO: 4512277 - DNA, 21 bp, Homo sapiens
tgtgctcaaattactaatgat

SEQ ID NO: 4512278 - DNA, 19 bp, Homo sapiens
tgtgctcacaatgttctgg

SEQ ID NO: 4512279 - DNA, 20 bp, Homo sapiens
tgtgctcaccctctcttggt

SEQ ID NO: 4512280 - DNA, 14 bp, Homo sapiens
tgtgctcagccaaa

SEQ ID NO: 4512281 - DNA, 14 bp, Homo sapiens
tgtgctcggacaca

SEQ ID NO: 4512282 - DNA, 13 bp, Homo sapiens
tgtgctgccctgt

SEQ ID NO: 4512283 - DNA, 13 bp, Homo sapiens
tgtgctgcttctc

SEQ ID NO: 4512284 - DNA, 14 bp, Homo sapiens
tgtgctggaggggt

SEQ ID NO: 4512285 - DNA, 20 bp, Homo sapiens
tgtgctggaggggtggccca

SEQ ID NO: 4512286 - DNA, 21 bp, Homo sapiens
tgtgctggaggggtggcccag

SEQ ID NO: 4512287 - DNA, 16 bp, Homo sapiens
tgtgctgtggaagcaa

SEQ ID NO: 4512288 - DNA, 15 bp, Homo sapiens
tgtgctgtgggcagc

SEQ ID NO: 4512289 - DNA, 21 bp, Homo sapiens
tgtgctgtgggcagcaccctc

SEQ ID NO: 4512290 - DNA, 16 bp, Homo sapiens
tgtgcttctccccaga

SEQ ID NO: 4512291 - DNA, 20 bp, Homo sapiens
tgtgcttctccccagaattc

SEQ ID NO: 4512292 - DNA, 12 bp, Homo sapiens
tgtgcttgggag

SEQ ID NO: 4512293 - DNA, 23 bp, Homo sapiens
tgtgcttgtttacagcactactc

SEQ ID NO: 4512294 - DNA, 13 bp, Homo sapiens
tgtgctttcaaga

SEQ ID NO: 4512295 - DNA, 15 bp, Homo sapiens
tgtgctttccagctc

SEQ ID NO: 4512296 - DNA, 16 bp, Homo sapiens
tgtgctttccagctca

SEQ ID NO: 4512297 - DNA, 18 bp, Homo sapiens
tgtgctttccagctcacc

SEQ ID NO: 4512298 - DNA, 17 bp, Homo sapiens
tgtgctttttaagaata

SEQ ID NO: 4512299 - DNA, 16 bp, Homo sapiens
tgtgctttttttgtgt

SEQ ID NO: 4512300 - DNA, 21 bp, Homo sapiens
tgtggaacataaaaaggacat

SEQ ID NO: 4512301 - DNA, 21 bp, Homo sapiens
tgtggaattttgagaaaaata

SEQ ID NO: 4512302 - DNA, 18 bp, Homo sapiens
tgtggacacctccctgtg

SEQ ID NO: 4512303 - DNA, 11 bp, Homo sapiens
tgtggacagga

SEQ ID NO: 4512304 - DNA, 23 bp, Homo sapiens
tgtggacaggatgaggacagagg

SEQ ID NO: 4512305 - DNA, 19 bp, Homo sapiens
tgtggagaagccacaggcc

SEQ ID NO: 4512306 - DNA, 16 bp, Homo sapiens
tgtggagagaagctga

SEQ ID NO: 4512307 - DNA, 15 bp, Homo sapiens
tgtggagcacgtgga

SEQ ID NO: 4512308 - DNA, 12 bp, Homo sapiens
tgtctattgtcc

SEQ ID NO: 4512309 - DNA, 13 bp, Homo sapiens
tgtctatttccaa

SEQ ID NO: 4512310 - DNA, 14 bp, Homo sapiens
tgtctatttgtctc

SEQ ID NO: 4512311 - DNA, 17 bp, Homo sapiens
tgtctatttgtctctta

SEQ ID NO: 4512312 - DNA, 15 bp, Homo sapiens
tgtctcagcctctgc

SEQ ID NO: 4512313 - DNA, 19 bp, Homo sapiens
tgtctcagtcattgctgtt

SEQ ID NO: 4512314 - DNA, 16 bp, Homo sapiens
tgtctcatccatcatc

SEQ ID NO: 4512315 - DNA, 17 bp, Homo sapiens
tgtctcatccatcatca

SEQ ID NO: 4512316 - DNA, 17 bp, Homo sapiens
tgtctccaaccccccag

SEQ ID NO: 4512317 - DNA, 20 bp, Homo sapiens
tgtctccaagtagtccacct

SEQ ID NO: 4512318 - DNA, 10 bp, Homo sapiens
tgtctcccaa

SEQ ID NO: 4512319 - DNA, 17 bp, Homo sapiens
tgtctcccaacatggga

SEQ ID NO: 4512320 - DNA, 22 bp, Homo sapiens
tgtctcccaacatgggagggat

SEQ ID NO: 4512321 - DNA, 22 bp, Homo sapiens
tgtctcctatatatttctatta

SEQ ID NO: 4512322 - DNA, 19 bp, Homo sapiens
tgtctcctctatggaagga

SEQ ID NO: 4512323 - DNA, 22 bp, Homo sapiens
tgtctctaaaaagaagccacag

SEQ ID NO: 4512324 - DNA, 23 bp, Homo sapiens
tgtctctaccaaaaaaaggaagg

SEQ ID NO: 4512325 - DNA, 17 bp, Homo sapiens
tgtctctactaaaaata

SEQ ID NO: 4512326 - DNA, 21 bp, Homo sapiens
tgtctctcttcagactctcag

SEQ ID NO: 4512327 - DNA, 14 bp, Homo sapiens
tgtctcttacatct

SEQ ID NO: 4512328 - DNA, 14 bp, Homo sapiens
tgtctgaccttcca

SEQ ID NO: 4512329 - DNA, 21 bp, Homo sapiens
tgtctgacttttgttaaattc

SEQ ID NO: 4512330 - DNA, 18 bp, Homo sapiens
tgtctgagtagtggccac

SEQ ID NO: 4512331 - DNA, 19 bp, Homo sapiens
tgtctgagtagtggccact

SEQ ID NO: 4512332 - DNA, 22 bp, Homo sapiens
tgtctgagtagtggccactggg

SEQ ID NO: 4512333 - DNA, 21 bp, Homo sapiens
tgtctgcacaccttgaatctg

SEQ ID NO: 4512334 - DNA, 16 bp, Homo sapiens
tgtctgcaccttagaa

SEQ ID NO: 4512335 - DNA, 16 bp, Homo sapiens
tgtctgcccttcaccc

SEQ ID NO: 4512336 - DNA, 23 bp, Homo sapiens
tgtctgcctatgcactgaagagc

SEQ ID NO: 4512337 - DNA, 20 bp, Homo sapiens
tgtctggatcagtaaaatta

SEQ ID NO: 4512338 - DNA, 22 bp, Homo sapiens
tgtctggctttggcactctctg

SEQ ID NO: 4512339 - DNA, 21 bp, Homo sapiens
tgtctggtatccatgttttat

SEQ ID NO: 4512340 - DNA, 15 bp, Homo sapiens
tgtctgtaaaaaatg

SEQ ID NO: 4512341 - DNA, 16 bp, Homo sapiens
tgtctgtaaaaaatgg

SEQ ID NO: 4512342 - DNA, 18 bp, Homo sapiens
tgtctgtaaatctaacat

SEQ ID NO: 4512343 - DNA, 21 bp, Homo sapiens
tgtctgtaaatctaacattat

SEQ ID NO: 4512344 - DNA, 22 bp, Homo sapiens
tgtctgtaaatctaacattatt

SEQ ID NO: 4512345 - DNA, 16 bp, Homo sapiens
tgtctgtagagggccc

SEQ ID NO: 4512346 - DNA, 17 bp, Homo sapiens
tgtctgtctacatttct

SEQ ID NO: 4512347 - DNA, 14 bp, Homo sapiens
tgtctgtgaacaga

SEQ ID NO: 4512348 - DNA, 12 bp, Homo sapiens
tgtctgtgcaca

SEQ ID NO: 4512349 - DNA, 24 bp, Homo sapiens
tgtctgtgcacatgcctctgtaga

SEQ ID NO: 4512350 - DNA, 19 bp, Homo sapiens
tgtctgtggcaaaagttta

SEQ ID NO: 4512351 - DNA, 13 bp, Homo sapiens
tgtctgttcccag

SEQ ID NO: 4512352 - DNA, 19 bp, Homo sapiens
tgtctgttcccagcccctg

SEQ ID NO: 4512353 - DNA, 13 bp, Homo sapiens
tgtctgttctaca

SEQ ID NO: 4512354 - DNA, 21 bp, Homo sapiens
tgtcttaaaaaatgtgaaatg

SEQ ID NO: 4512355 - DNA, 18 bp, Homo sapiens
tgtcttaaactaaatgtg

SEQ ID NO: 4512356 - DNA, 20 bp, Homo sapiens
tgtcttaagatggaaataca

SEQ ID NO: 4512357 - DNA, 13 bp, Homo sapiens
tgtcttaatctct

SEQ ID NO: 4512358 - DNA, 21 bp, Homo sapiens
tgtcttcccagggtagcccgc

SEQ ID NO: 4512359 - DNA, 11 bp, Homo sapiens
tgtcttccctg

SEQ ID NO: 4512360 - DNA, 12 bp, Homo sapiens
tgtcttccctgc

SEQ ID NO: 4512361 - DNA, 14 bp, Homo sapiens
tgtcttccctgcct

SEQ ID NO: 4512362 - DNA, 12 bp, Homo sapiens
tgtcttccctgg

SEQ ID NO: 4512363 - DNA, 13 bp, Homo sapiens
tgtcttccctggg

SEQ ID NO: 4512364 - DNA, 16 bp, Homo sapiens
tgtcttgaaaactgtg

SEQ ID NO: 4512365 - DNA, 22 bp, Homo sapiens
tgtcttgcactggccttctgat

SEQ ID NO: 4512366 - DNA, 18 bp, Homo sapiens
tgtcttgtgtttctttag

SEQ ID NO: 4512367 - DNA, 14 bp, Homo sapiens
tgtcttgtttcagt

SEQ ID NO: 4512368 - DNA, 16 bp, Homo sapiens
tgtctttattgtccac

SEQ ID NO: 4512369 - DNA, 20 bp, Homo sapiens
tgtctttcaaactccaaggt

SEQ ID NO: 4512370 - DNA, 22 bp, Homo sapiens
tgtctttcctgaaccatgtgga

SEQ ID NO: 4512371 - DNA, 13 bp, Homo sapiens
tgtctttctagcc

SEQ ID NO: 4512372 - DNA, 20 bp, Homo sapiens
tgtctttctttggtgccttt

SEQ ID NO: 4512373 - DNA, 13 bp, Homo sapiens
tgtctttgtaata

SEQ ID NO: 4512374 - DNA, 16 bp, Homo sapiens
tgtcttttaaaatgca

SEQ ID NO: 4512375 - DNA, 22 bp, Homo sapiens
tgtcttttatagtggaaaaaca

SEQ ID NO: 4512376 - DNA, 21 bp, Homo sapiens
tgtcttttcagaagcaagcca

SEQ ID NO: 4512377 - DNA, 17 bp, Homo sapiens
tgtcttttgttctctga

SEQ ID NO: 4512378 - DNA, 18 bp, Homo sapiens
tgtcttttttctctctta

SEQ ID NO: 4512379 - DNA, 15 bp, Homo sapiens
tgtctttttttttct

SEQ ID NO: 4512380 - DNA, 16 bp, Homo sapiens
tgtgaaaaaaaatttg

SEQ ID NO: 4512381 - DNA, 12 bp, Homo sapiens
tgtgaaaaagga

SEQ ID NO: 4512382 - DNA, 13 bp, Homo sapiens
tgtgaaaaaggaa

SEQ ID NO: 4512383 - DNA, 18 bp, Homo sapiens
tgtgaaaaaggaataaaa

SEQ ID NO: 4512384 - DNA, 14 bp, Homo sapiens
tgtgaaaatgaata

SEQ ID NO: 4512385 - DNA, 18 bp, Homo sapiens
tgtgaaaatggtccagga

SEQ ID NO: 4512386 - DNA, 19 bp, Homo sapiens
tgtgaaacactttgcctcc

SEQ ID NO: 4512387 - DNA, 14 bp, Homo sapiens
tgtgaaactttcat

SEQ ID NO: 4512388 - DNA, 15 bp, Homo sapiens
tgtgaaactttcatt

SEQ ID NO: 4512389 - DNA, 11 bp, Homo sapiens
tgtgaaagaag

SEQ ID NO: 4512390 - DNA, 12 bp, Homo sapiens
tgtgaaagaagt

SEQ ID NO: 4512391 - DNA, 14 bp, Homo sapiens
tgtgaaatatcatc

SEQ ID NO: 4512392 - DNA, 17 bp, Homo sapiens
tgtgaaatgctttctgt

SEQ ID NO: 4512393 - DNA, 22 bp, Homo sapiens
tgtgaaatgcttttatattcta

SEQ ID NO: 4512394 - DNA, 23 bp, Homo sapiens
tgtgaacagagagacccttgtgg

SEQ ID NO: 4512395 - DNA, 17 bp, Homo sapiens
tgtgaacagctttgtat

SEQ ID NO: 4512396 - DNA, 16 bp, Homo sapiens
tgtgaacctacctgcc

SEQ ID NO: 4512397 - DNA, 17 bp, Homo sapiens
tgtgaacctacctgcct

SEQ ID NO: 4512398 - DNA, 22 bp, Homo sapiens
tgtgaactcaccctgggagcca

SEQ ID NO: 4512399 - DNA, 13 bp, Homo sapiens
tgtgaactggaag

SEQ ID NO: 4512400 - DNA, 16 bp, Homo sapiens
tgtgaactggaagaaa

SEQ ID NO: 4512401 - DNA, 20 bp, Homo sapiens
tgtgaactggaagaaagcaa

SEQ ID NO: 4512402 - DNA, 14 bp, Homo sapiens
tgtgaactgtgtgt

SEQ ID NO: 4512403 - DNA, 22 bp, Homo sapiens
tgtgaagatgatatactatttt

SEQ ID NO: 4512404 - DNA, 16 bp, Homo sapiens
tgtgaataccccaaga

SEQ ID NO: 4512405 - DNA, 18 bp, Homo sapiens
tgtgaatagcctggccac

SEQ ID NO: 4512406 - DNA, 15 bp, Homo sapiens
tgtgaatataaatgt

SEQ ID NO: 4512407 - DNA, 20 bp, Homo sapiens
tgtgaatataaatgtgtgta

SEQ ID NO: 4512408 - DNA, 23 bp, Homo sapiens
tgtgaatattcctttattttgct

SEQ ID NO: 4512409 - DNA, 14 bp, Homo sapiens
tgtgaatcagaccc

SEQ ID NO: 4512410 - DNA, 15 bp, Homo sapiens
tgtgaatctgagagt

SEQ ID NO: 4512411 - DNA, 17 bp, Homo sapiens
tgtgaatgaacactctt

SEQ ID NO: 4512412 - DNA, 23 bp, Homo sapiens
tgtgaatgaacactcttttgctt

SEQ ID NO: 4512413 - DNA, 14 bp, Homo sapiens
tgtgaatgcttctc

SEQ ID NO: 4512414 - DNA, 16 bp, Homo sapiens
tgtgaatggaggcaga

SEQ ID NO: 4512415 - DNA, 16 bp, Homo sapiens
tgtgaattaagcccaa

SEQ ID NO: 4512416 - DNA, 23 bp, Homo sapiens
tgtgaattaggctgtaactactt

SEQ ID NO: 4512417 - DNA, 17 bp, Homo sapiens
tgtgaattattgacact

SEQ ID NO: 4512418 - DNA, 17 bp, Homo sapiens
tgtgaatttttaagctg

SEQ ID NO: 4512419 - DNA, 19 bp, Homo sapiens
tgtgaatttttaagctgca

SEQ ID NO: 4512420 - DNA, 22 bp, Homo sapiens
tgtgaatttttaagctgcaaat

SEQ ID NO: 4512421 - DNA, 14 bp, Homo sapiens
tgtgacaataataa

SEQ ID NO: 4512422 - DNA, 19 bp, Homo sapiens
tgtgacaggaaagccctcc

SEQ ID NO: 4512423 - DNA, 16 bp, Homo sapiens
tgtgaccagaaagctt

SEQ ID NO: 4512424 - DNA, 21 bp, Homo sapiens
tgtgactcttactccttaggt

SEQ ID NO: 4512425 - DNA, 14 bp, Homo sapiens
tgtgacttcactgt

SEQ ID NO: 4512426 - DNA, 18 bp, Homo sapiens
tgtgacttcactgtatat

SEQ ID NO: 4512427 - DNA, 18 bp, Homo sapiens
tgtgactttcaggctact

SEQ ID NO: 4512428 - DNA, 23 bp, Homo sapiens
tgtgactttcaggctactgttct

SEQ ID NO: 4512429 - DNA, 15 bp, Homo sapiens
ttcagcccctcctct

SEQ ID NO: 4512430 - DNA, 13 bp, Homo sapiens
ttcagccttggga

SEQ ID NO: 4512431 - DNA, 20 bp, Homo sapiens
ttcagctctgatctgaggct

SEQ ID NO: 4512432 - DNA, 22 bp, Homo sapiens
ttcagcttcgtttattttcaag

SEQ ID NO: 4512433 - DNA, 13 bp, Homo sapiens
ttcaggaaaatgt

SEQ ID NO: 4512434 - DNA, 22 bp, Homo sapiens
ttcaggaacctcgagtactgtg

SEQ ID NO: 4512435 - DNA, 23 bp, Homo sapiens
ttcaggagactttacaaaccttt

SEQ ID NO: 4512436 - DNA, 12 bp, Homo sapiens
ttcaggcactga

SEQ ID NO: 4512437 - DNA, 17 bp, Homo sapiens
ttcaggcagcactgaca

SEQ ID NO: 4512438 - DNA, 16 bp, Homo sapiens
ttcaggcatattttaa

SEQ ID NO: 4512439 - DNA, 18 bp, Homo sapiens
ttcaggccagcccagcca

SEQ ID NO: 4512440 - DNA, 17 bp, Homo sapiens
ttcaggccagtgtggtg

SEQ ID NO: 4512441 - DNA, 17 bp, Homo sapiens
ttcaggctactgttctt

SEQ ID NO: 4512442 - DNA, 17 bp, Homo sapiens
ttcaggggaagagaaga

SEQ ID NO: 4512443 - DNA, 23 bp, Homo sapiens
ttcaggggactcagccctgaggt

SEQ ID NO: 4512444 - DNA, 22 bp, Homo sapiens
ttcaggtaaagggcaaataatg

SEQ ID NO: 4512445 - DNA, 18 bp, Homo sapiens
ttcaggtgacctcctgca

SEQ ID NO: 4512446 - DNA, 23 bp, Homo sapiens
ttcaggtgtagtagttctgtgtt

SEQ ID NO: 4512447 - DNA, 15 bp, Homo sapiens
ttcaggttgcattgg

SEQ ID NO: 4512448 - DNA, 16 bp, Homo sapiens
ttcaggtttttccttt

SEQ ID NO: 4512449 - DNA, 16 bp, Homo sapiens
ttcagtaagctgtgtg

SEQ ID NO: 4512450 - DNA, 16 bp, Homo sapiens
ttcagtattttccagc

SEQ ID NO: 4512451 - DNA, 22 bp, Homo sapiens
ttcagtcatagcaagcttttgc

SEQ ID NO: 4512452 - DNA, 14 bp, Homo sapiens
ttcagtcttggtaa

SEQ ID NO: 4512453 - DNA, 17 bp, Homo sapiens
ttcagtgagcccctccc

SEQ ID NO: 4512454 - DNA, 19 bp, Homo sapiens
ttcagtgagcccctcccca

SEQ ID NO: 4512455 - DNA, 22 bp, Homo sapiens
ttcagtgagcccctccccagcc

SEQ ID NO: 4512456 - DNA, 19 bp, Homo sapiens
ttcagtgataatgttcatt

SEQ ID NO: 4512457 - DNA, 10 bp, Homo sapiens
ttcagtgccc

SEQ ID NO: 4512458 - DNA, 21 bp, Homo sapiens
ttcagtgcggcccctcggctg

SEQ ID NO: 4512459 - DNA, 21 bp, Homo sapiens
ttcagtggaccgaaatctgta

SEQ ID NO: 4512460 - DNA, 14 bp, Homo sapiens
ttcagtgggagaaa

SEQ ID NO: 4512461 - DNA, 14 bp, Homo sapiens
ttcagtggggcagt

SEQ ID NO: 4512462 - DNA, 17 bp, Homo sapiens
ttcagtggtgaaatctt

SEQ ID NO: 4512463 - DNA, 20 bp, Homo sapiens
ttcagtgtaaattaattaca

SEQ ID NO: 4512464 - DNA, 16 bp, Homo sapiens
ttcagttattttgctt

SEQ ID NO: 4512465 - DNA, 23 bp, Homo sapiens
ttcagtttttattaatctactgt

SEQ ID NO: 4512466 - DNA, 12 bp, Homo sapiens
ttcagtttttca

SEQ ID NO: 4512467 - DNA, 15 bp, Homo sapiens
ttcagtttttcactt

SEQ ID NO: 4512468 - DNA, 13 bp, Homo sapiens
ttcataaatcatg

SEQ ID NO: 4512469 - DNA, 14 bp, Homo sapiens
ttcataaatcatgt

SEQ ID NO: 4512470 - DNA, 18 bp, Homo sapiens
ttcataacagtgccattg

SEQ ID NO: 4512471 - DNA, 13 bp, Homo sapiens
ttcataacttatt

SEQ ID NO: 4512472 - DNA, 18 bp, Homo sapiens
ttcataacttattgctga

SEQ ID NO: 4512473 - DNA, 12 bp, Homo sapiens
ttcataagtatt

SEQ ID NO: 4512474 - DNA, 19 bp, Homo sapiens
ttcataagtattatgtctc

SEQ ID NO: 4512475 - DNA, 20 bp, Homo sapiens
ttcataagtattatgtctct

SEQ ID NO: 4512476 - DNA, 17 bp, Homo sapiens
ttcataataaattttct

SEQ ID NO: 4512477 - DNA, 11 bp, Homo sapiens
ttcataatggc

SEQ ID NO: 4512478 - DNA, 20 bp, Homo sapiens
ttcataatggcctgagactt

SEQ ID NO: 4512479 - DNA, 17 bp, Homo sapiens
ttcataattctgaaaca

SEQ ID NO: 4512480 - DNA, 15 bp, Homo sapiens
ttcataccacttgaa

SEQ ID NO: 4512481 - DNA, 16 bp, Homo sapiens
ttcataccacttgaat

SEQ ID NO: 4512482 - DNA, 13 bp, Homo sapiens
ttcatactgtaca

SEQ ID NO: 4512483 - DNA, 14 bp, Homo sapiens
ttcatactgtacac

SEQ ID NO: 4512484 - DNA, 16 bp, Homo sapiens
ttcatactgtacacat

SEQ ID NO: 4512485 - DNA, 20 bp, Homo sapiens
ttcatactgtacacatttct

SEQ ID NO: 4512486 - DNA, 16 bp, Homo sapiens
ttcatagaagtgttga

SEQ ID NO: 4512487 - DNA, 15 bp, Homo sapiens
ttcatagctgtactt

SEQ ID NO: 4512488 - DNA, 19 bp, Homo sapiens
ttcatagtgacctgtgttt

SEQ ID NO: 4512489 - DNA, 16 bp, Homo sapiens
ttcatatcatactgtt

SEQ ID NO: 4512490 - DNA, 22 bp, Homo sapiens
ttcatattaatataagtttctt

SEQ ID NO: 4512491 - DNA, 23 bp, Homo sapiens
ttcatattaatataagtttcttt

SEQ ID NO: 4512492 - DNA, 22 bp, Homo sapiens
ttcatattattttagtgtgtaa

SEQ ID NO: 4512493 - DNA, 23 bp, Homo sapiens
ttcatattattttagtgtgtaaa

SEQ ID NO: 4512494 - DNA, 20 bp, Homo sapiens
ttcatattgatctttttatc

SEQ ID NO: 4512495 - DNA, 14 bp, Homo sapiens
ttcatcaagagttt

SEQ ID NO: 4512496 - DNA, 12 bp, Homo sapiens
ttcatcaatgca

SEQ ID NO: 4512497 - DNA, 15 bp, Homo sapiens
ttcatcatttcagcc

SEQ ID NO: 4512498 - DNA, 14 bp, Homo sapiens
ttcatcatttttta

SEQ ID NO: 4512499 - DNA, 20 bp, Homo sapiens
ttcatcgaatctactaattc

SEQ ID NO: 4512500 - DNA, 15 bp, Homo sapiens
ttcatctaaatgaaa

SEQ ID NO: 4512501 - DNA, 19 bp, Homo sapiens
ttcatctaaatgaaagtgg

SEQ ID NO: 4512502 - DNA, 14 bp, Homo sapiens
ttcatctacctttt

SEQ ID NO: 4512503 - DNA, 23 bp, Homo sapiens
ttcatctatgagggtgtttcctc

SEQ ID NO: 4512504 - DNA, 21 bp, Homo sapiens
ttcatctattttattttattg

SEQ ID NO: 4512505 - DNA, 13 bp, Homo sapiens
ttcatctcattta

SEQ ID NO: 4512506 - DNA, 19 bp, Homo sapiens
ttcatctcatttaagggaa

SEQ ID NO: 4512507 - DNA, 23 bp, Homo sapiens
ttcatctcatttaagggaaaaat

SEQ ID NO: 4512508 - DNA, 15 bp, Homo sapiens
ttcatctgctctcct

SEQ ID NO: 4512509 - DNA, 21 bp, Homo sapiens
ttcatctgctctccttcctgg

SEQ ID NO: 4512510 - DNA, 18 bp, Homo sapiens
ttcatcttaaactaatac

SEQ ID NO: 4512511 - DNA, 22 bp, Homo sapiens
ttcatcttgtacaaactttgtt

SEQ ID NO: 4512512 - DNA, 16 bp, Homo sapiens
ttcatgaatattttca

SEQ ID NO: 4512513 - DNA, 17 bp, Homo sapiens
ttcatgaatattttcaa

SEQ ID NO: 4512514 - DNA, 21 bp, Homo sapiens
ttcatgaatattttcaagttt

SEQ ID NO: 4512515 - DNA, 22 bp, Homo sapiens
ttcatgaatattttcaagtttt

SEQ ID NO: 4512516 - DNA, 14 bp, Homo sapiens
ttcatgaatttctc

SEQ ID NO: 4512517 - DNA, 15 bp, Homo sapiens
ttcatgaatttctcc

SEQ ID NO: 4512518 - DNA, 16 bp, Homo sapiens
ttcatgacattatgtg

SEQ ID NO: 4512519 - DNA, 18 bp, Homo sapiens
ttcatgataatgaacaga

SEQ ID NO: 4512520 - DNA, 14 bp, Homo sapiens
ttcatgatagaaag

SEQ ID NO: 4512521 - DNA, 21 bp, Homo sapiens
ttcatgatagaaagaataaaa

SEQ ID NO: 4512522 - DNA, 22 bp, Homo sapiens
ttcatgatagaaagaataaaat

SEQ ID NO: 4512523 - DNA, 16 bp, Homo sapiens
ttcatgatgcagtctc

SEQ ID NO: 4512524 - DNA, 15 bp, Homo sapiens
ttcatgcagctgtgg

SEQ ID NO: 4512525 - DNA, 13 bp, Homo sapiens
ttcatgcttgaca

SEQ ID NO: 4512526 - DNA, 21 bp, Homo sapiens
ttcatggcaatgaaaatttta

SEQ ID NO: 4512527 - DNA, 17 bp, Homo sapiens
ttcatggcagaaggcaa

SEQ ID NO: 4512528 - DNA, 14 bp, Homo sapiens
ttcatgtaaactgt

SEQ ID NO: 4512529 - DNA, 21 bp, Homo sapiens
ttcatgtacaagatgaaggag

SEQ ID NO: 4512530 - DNA, 18 bp, Homo sapiens
ttcatgtatatctaactt

SEQ ID NO: 4512531 - DNA, 23 bp, Homo sapiens
ttcatgtcatcaaaatctgcaca

SEQ ID NO: 4512532 - DNA, 20 bp, Homo sapiens
ttcatgtccagagctcattt

SEQ ID NO: 4512533 - DNA, 22 bp, Homo sapiens
ttcatgtcccagaacttagcct

SEQ ID NO: 4512534 - DNA, 13 bp, Homo sapiens
ttcattaaataaa

SEQ ID NO: 4512535 - DNA, 16 bp, Homo sapiens
ttcattaattctataa

SEQ ID NO: 4512536 - DNA, 17 bp, Homo sapiens
ttcattacttgaatgta

SEQ ID NO: 4512537 - DNA, 20 bp, Homo sapiens
ttcattagaaatattttaaa

SEQ ID NO: 4512538 - DNA, 19 bp, Homo sapiens
ttcattagttttgaagatt

SEQ ID NO: 4512539 - DNA, 15 bp, Homo sapiens
ttcattattctctgc

SEQ ID NO: 4512540 - DNA, 16 bp, Homo sapiens
ttcattatttgtcaaa

SEQ ID NO: 4512541 - DNA, 11 bp, Homo sapiens
ttcattcacaa

SEQ ID NO: 4512542 - DNA, 15 bp, Homo sapiens
ttcattcacttctct

SEQ ID NO: 4512543 - DNA, 17 bp, Homo sapiens
ttcattcatacttaaaa

SEQ ID NO: 4512544 - DNA, 21 bp, Homo sapiens
ttcattccattgcctagctct

SEQ ID NO: 4512545 - DNA, 12 bp, Homo sapiens
ttcattcccaga

SEQ ID NO: 4512546 - DNA, 17 bp, Homo sapiens
ttcattcctcacaatga

SEQ ID NO: 4512547 - DNA, 22 bp, Homo sapiens
ttcattccttcagatttggctt

SEQ ID NO: 4512548 - DNA, 12 bp, Homo sapiens
ttcattctcaga

SEQ ID NO: 4512549 - DNA, 15 bp, Homo sapiens
ttatccaaaatgctt

SEQ ID NO: 4512550 - DNA, 21 bp, Homo sapiens
ttatccacaattattggcaaa

SEQ ID NO: 4512551 - DNA, 19 bp, Homo sapiens
ttatccagctagtgccaaa

SEQ ID NO: 4512552 - DNA, 17 bp, Homo sapiens
ttatccatgacaggcct

SEQ ID NO: 4512553 - DNA, 12 bp, Homo sapiens
ttatccctctct

SEQ ID NO: 4512554 - DNA, 14 bp, Homo sapiens
ttatccctctcttc

SEQ ID NO: 4512555 - DNA, 17 bp, Homo sapiens
ttatccctctcttcccc

SEQ ID NO: 4512556 - DNA, 17 bp, Homo sapiens
ttatcctggcatgtgct

SEQ ID NO: 4512557 - DNA, 18 bp, Homo sapiens
ttatcctgtattcttgtt

SEQ ID NO: 4512558 - DNA, 16 bp, Homo sapiens
ttatcctgtttgaaga

SEQ ID NO: 4512559 - DNA, 14 bp, Homo sapiens
ttatctagctaagc

SEQ ID NO: 4512560 - DNA, 15 bp, Homo sapiens
ttatctataatttac

SEQ ID NO: 4512561 - DNA, 16 bp, Homo sapiens
ttatctcactttgtaa

SEQ ID NO: 4512562 - DNA, 19 bp, Homo sapiens
ttatctcactttgtaaata

SEQ ID NO: 4512563 - DNA, 22 bp, Homo sapiens
ttatctcagatgttaaaataaa

SEQ ID NO: 4512564 - DNA, 14 bp, Homo sapiens
ttatctctctgtgc

SEQ ID NO: 4512565 - DNA, 18 bp, Homo sapiens
ttatctctttctctcttt

SEQ ID NO: 4512566 - DNA, 17 bp, Homo sapiens
ttatctgcccctccccc

SEQ ID NO: 4512567 - DNA, 14 bp, Homo sapiens
ttatctgtaattgt

SEQ ID NO: 4512568 - DNA, 16 bp, Homo sapiens
ttatctgtcagctgca

SEQ ID NO: 4512569 - DNA, 22 bp, Homo sapiens
ttatctgtttcctgacattgtc

SEQ ID NO: 4512570 - DNA, 16 bp, Homo sapiens
ttatctgtttgttact

SEQ ID NO: 4512571 - DNA, 21 bp, Homo sapiens
ttatcttacgtttaagcttaa

SEQ ID NO: 4512572 - DNA, 20 bp, Homo sapiens
ttatcttatactgtacaata

SEQ ID NO: 4512573 - DNA, 22 bp, Homo sapiens
ttatcttatactgtacaataaa

SEQ ID NO: 4512574 - DNA, 22 bp, Homo sapiens
ttatcttctggactatagctgt

SEQ ID NO: 4512575 - DNA, 12 bp, Homo sapiens
ttatctttacca

SEQ ID NO: 4512576 - DNA, 13 bp, Homo sapiens
ttatctttaccaa

SEQ ID NO: 4512577 - DNA, 16 bp, Homo sapiens
ttatcttttgtatatc

SEQ ID NO: 4512578 - DNA, 17 bp, Homo sapiens
ttatcttttgtatatct

SEQ ID NO: 4512579 - DNA, 21 bp, Homo sapiens
ttatcttttgtatatctaaga

SEQ ID NO: 4512580 - DNA, 15 bp, Homo sapiens
ttatctttttacctt

SEQ ID NO: 4512581 - DNA, 18 bp, Homo sapiens
ttatgaaaaagaagaatc

SEQ ID NO: 4512582 - DNA, 17 bp, Homo sapiens
ttatgaaacagccattt

SEQ ID NO: 4512583 - DNA, 16 bp, Homo sapiens
ttatgaacattgtact

SEQ ID NO: 4512584 - DNA, 19 bp, Homo sapiens
ttatgaacattgtactgtt

SEQ ID NO: 4512585 - DNA, 20 bp, Homo sapiens
ttatgaacccttcctgagct

SEQ ID NO: 4512586 - DNA, 11 bp, Homo sapiens
ttatgaatcaa

SEQ ID NO: 4512587 - DNA, 12 bp, Homo sapiens
ttatgacatttt

SEQ ID NO: 4512588 - DNA, 19 bp, Homo sapiens
ttatgacatttttctggct

SEQ ID NO: 4512589 - DNA, 22 bp, Homo sapiens
ttatgagaaacttaaatgttat

SEQ ID NO: 4512590 - DNA, 14 bp, Homo sapiens
ttatgagatttact

SEQ ID NO: 4512591 - DNA, 13 bp, Homo sapiens
ttatgagttcttg

SEQ ID NO: 4512592 - DNA, 19 bp, Homo sapiens
ttatgataaaatgctttaa

SEQ ID NO: 4512593 - DNA, 14 bp, Homo sapiens
ttatgatatttctt

SEQ ID NO: 4512594 - DNA, 18 bp, Homo sapiens
ttatgatgatacagtgtt

SEQ ID NO: 4512595 - DNA, 19 bp, Homo sapiens
ttatgattttcataactta

SEQ ID NO: 4512596 - DNA, 19 bp, Homo sapiens
ttatgcactaaatatgaac

SEQ ID NO: 4512597 - DNA, 20 bp, Homo sapiens
ttatgcagcaaatatatgat

SEQ ID NO: 4512598 - DNA, 14 bp, Homo sapiens
ttatgccagctcca

SEQ ID NO: 4512599 - DNA, 17 bp, Homo sapiens
ttatgctctcactgttt

SEQ ID NO: 4512600 - DNA, 14 bp, Homo sapiens
ttatgctgtcatgg

SEQ ID NO: 4512601 - DNA, 16 bp, Homo sapiens
ttatgctttgaacttt

SEQ ID NO: 4512602 - DNA, 14 bp, Homo sapiens
ttatggaattgatt

SEQ ID NO: 4512603 - DNA, 23 bp, Homo sapiens
ttatggaattgatttgcattgaa

SEQ ID NO: 4512604 - DNA, 14 bp, Homo sapiens
ttatggagacctct

SEQ ID NO: 4512605 - DNA, 21 bp, Homo sapiens
ttatggagacctctccttcct

SEQ ID NO: 4512606 - DNA, 16 bp, Homo sapiens
ttatggagtcttgtgc

SEQ ID NO: 4512607 - DNA, 14 bp, Homo sapiens
ttatggatgattaa

SEQ ID NO: 4512608 - DNA, 15 bp, Homo sapiens
ttatggcatttctat

SEQ ID NO: 4512609 - DNA, 12 bp, Homo sapiens
ttatggcctcag

SEQ ID NO: 4512610 - DNA, 15 bp, Homo sapiens
ttatggcctcagctg

SEQ ID NO: 4512611 - DNA, 22 bp, Homo sapiens
ttatggtaactgctttctgttc

SEQ ID NO: 4512612 - DNA, 23 bp, Homo sapiens
ttatggtaactgctttctgttcc

SEQ ID NO: 4512613 - DNA, 13 bp, Homo sapiens
ttatggtagaaaa

SEQ ID NO: 4512614 - DNA, 16 bp, Homo sapiens
ttatggtgatgactta

SEQ ID NO: 4512615 - DNA, 19 bp, Homo sapiens
ttatggtgatgtcactcac

SEQ ID NO: 4512616 - DNA, 17 bp, Homo sapiens
ttatggttttgtgatgt

SEQ ID NO: 4512617 - DNA, 19 bp, Homo sapiens
ttatgtacaaacatgttgt

SEQ ID NO: 4512618 - DNA, 12 bp, Homo sapiens
ttatgtacaacc

SEQ ID NO: 4512619 - DNA, 13 bp, Homo sapiens
ttatgtacaaccc

SEQ ID NO: 4512620 - DNA, 22 bp, Homo sapiens
ttatgtatcagtgtcctttcca

SEQ ID NO: 4512621 - DNA, 11 bp, Homo sapiens
ttatgtatttc

SEQ ID NO: 4512622 - DNA, 17 bp, Homo sapiens
ttatgtcctgtgagatg

SEQ ID NO: 4512623 - DNA, 21 bp, Homo sapiens
ttatgtctcttgagcatcaat

SEQ ID NO: 4512624 - DNA, 23 bp, Homo sapiens
ttatgtcttgtatttaaaaacat

SEQ ID NO: 4512625 - DNA, 12 bp, Homo sapiens
ttatgtgaagaa

SEQ ID NO: 4512626 - DNA, 19 bp, Homo sapiens
ttatgtgaatttttaagct

SEQ ID NO: 4512627 - DNA, 19 bp, Homo sapiens
ttatgtgacattttacatt

SEQ ID NO: 4512628 - DNA, 20 bp, Homo sapiens
ttatgtgacattttacatta

SEQ ID NO: 4512629 - DNA, 12 bp, Homo sapiens
ttatgtgacttg

SEQ ID NO: 4512630 - DNA, 14 bp, Homo sapiens
ttatgtgacttgca

SEQ ID NO: 4512631 - DNA, 13 bp, Homo sapiens
ttatgtgagattt

SEQ ID NO: 4512632 - DNA, 14 bp, Homo sapiens
ttatgtgagatttc

SEQ ID NO: 4512633 - DNA, 20 bp, Homo sapiens
ttatgtgggttatcatggaa

SEQ ID NO: 4512634 - DNA, 19 bp, Homo sapiens
ttatgtgtgaggagctgct

SEQ ID NO: 4512635 - DNA, 10 bp, Homo sapiens
ttatgtgtgt

SEQ ID NO: 4512636 - DNA, 14 bp, Homo sapiens
ttatgtgttatgaa

SEQ ID NO: 4512637 - DNA, 16 bp, Homo sapiens
ttatgttctaagtgcc

SEQ ID NO: 4512638 - DNA, 18 bp, Homo sapiens
ttatgttgaaaaaattta

SEQ ID NO: 4512639 - DNA, 23 bp, Homo sapiens
ttatgttgataaaccaaaaacat

SEQ ID NO: 4512640 - DNA, 21 bp, Homo sapiens
ttatgttgttcaaatgcattt

SEQ ID NO: 4512641 - DNA, 19 bp, Homo sapiens
ttatgttgttgaactaata

SEQ ID NO: 4512642 - DNA, 16 bp, Homo sapiens
ttattaaaaaatttgt

SEQ ID NO: 4512643 - DNA, 14 bp, Homo sapiens
ttattaaaattctg

SEQ ID NO: 4512644 - DNA, 22 bp, Homo sapiens
ttattaaacagtgaacttgtct

SEQ ID NO: 4512645 - DNA, 14 bp, Homo sapiens
ttattaaacttcag

SEQ ID NO: 4512646 - DNA, 15 bp, Homo sapiens
ttattaaacttcagc

SEQ ID NO: 4512647 - DNA, 15 bp, Homo sapiens
ttattaaatgcttca

SEQ ID NO: 4512648 - DNA, 18 bp, Homo sapiens
ttattaaatgtagcttca

SEQ ID NO: 4512649 - DNA, 24 bp, Homo sapiens
ttattaaatgtagcttcagtcatt

SEQ ID NO: 4512650 - DNA, 19 bp, Homo sapiens
ttattaaatgtttcaaaat

SEQ ID NO: 4512651 - DNA, 20 bp, Homo sapiens
ttattaaatgtttcaaaata

SEQ ID NO: 4512652 - DNA, 13 bp, Homo sapiens
ttattaaattgca

SEQ ID NO: 4512653 - DNA, 21 bp, Homo sapiens
ttattaacgatgtccaacccg

SEQ ID NO: 4512654 - DNA, 11 bp, Homo sapiens
ttattaatgca

SEQ ID NO: 4512655 - DNA, 17 bp, Homo sapiens
ttattaatgcactttct

SEQ ID NO: 4512656 - DNA, 20 bp, Homo sapiens
ttattaattttagtttttca

SEQ ID NO: 4512657 - DNA, 13 bp, Homo sapiens
ttattacatgtaa

SEQ ID NO: 4512658 - DNA, 15 bp, Homo sapiens
ttattacatgtaatt

SEQ ID NO: 4512659 - DNA, 21 bp, Homo sapiens
ttattacctcaggtgccaacc

SEQ ID NO: 4512660 - DNA, 15 bp, Homo sapiens
ttattactagtgttt

SEQ ID NO: 4512661 - DNA, 12 bp, Homo sapiens
ttattactttaa

SEQ ID NO: 4512662 - DNA, 11 bp, Homo sapiens
ttattagaaag

SEQ ID NO: 4512663 - DNA, 13 bp, Homo sapiens
ttattagaacatt

SEQ ID NO: 4512664 - DNA, 22 bp, Homo sapiens
ttattagccaggtaatgtgaat

SEQ ID NO: 4512665 - DNA, 23 bp, Homo sapiens
ttattagccctgcattttcatag

SEQ ID NO: 4512666 - DNA, 21 bp, Homo sapiens
ttattataatcttataattgt

SEQ ID NO: 4512667 - DNA, 18 bp, Homo sapiens
ttattattgtactttatt

SEQ ID NO: 4512668 - DNA, 13 bp, Homo sapiens
ttattatttttca

SEQ ID NO: 4512669 - DNA, 23 bp, Homo sapiens
ttattcaaagagaaaacatctca

SEQ ID NO: 4512670 - DNA, 15 bp, Homo sapiens
ttattcaaatttgat

SEQ ID NO: 4512671 - DNA, 23 bp, Homo sapiens
ttattcaaatttgatgatgttaa

SEQ ID NO: 4512672 - DNA, 17 bp, Homo sapiens
ttattcagctagaattt

SEQ ID NO: 4512673 - DNA, 21 bp, Homo sapiens
ttattcagctagaatttctgg

SEQ ID NO: 4512674 - DNA, 19 bp, Homo sapiens
ttattcattatttgtcaaa

SEQ ID NO: 4512675 - DNA, 15 bp, Homo sapiens
ttattcatttggtga

SEQ ID NO: 4512676 - DNA, 12 bp, Homo sapiens
ttattccacaaa

SEQ ID NO: 4512677 - DNA, 20 bp, Homo sapiens
ttattccagaatgctgtaca

SEQ ID NO: 4512678 - DNA, 20 bp, Homo sapiens
ttattcctcctgctcatatt

SEQ ID NO: 4512679 - DNA, 14 bp, Homo sapiens
ttattccttctgta

SEQ ID NO: 4512680 - DNA, 14 bp, Homo sapiens
ttattcctttgaat

SEQ ID NO: 4512681 - DNA, 16 bp, Homo sapiens
ttattcctttgaatat

SEQ ID NO: 4512682 - DNA, 11 bp, Homo sapiens
ttattctgtat

SEQ ID NO: 4512683 - DNA, 13 bp, Homo sapiens
ttattctgttccc

SEQ ID NO: 4512684 - DNA, 20 bp, Homo sapiens
ttattgaattagaaaattag

SEQ ID NO: 4512685 - DNA, 11 bp, Homo sapiens
ttattgacact

SEQ ID NO: 4512686 - DNA, 21 bp, Homo sapiens
ttattgacaggtcttttcaaa

SEQ ID NO: 4512687 - DNA, 16 bp, Homo sapiens
ttattgagattttcca

SEQ ID NO: 4512688 - DNA, 14 bp, Homo sapiens
ttattgatatatat

SEQ ID NO: 4512689 - DNA, 17 bp, Homo sapiens
ttattgcaaattgagga

SEQ ID NO: 4512690 - DNA, 17 bp, Homo sapiens
ttattgcaataaagtat

SEQ ID NO: 4512691 - DNA, 16 bp, Homo sapiens
ttattgcagtttatca

SEQ ID NO: 4512692 - DNA, 18 bp, Homo sapiens
ttattgcagtttatcatt

SEQ ID NO: 4512693 - DNA, 12 bp, Homo sapiens
ttattgccttct

SEQ ID NO: 4512694 - DNA, 14 bp, Homo sapiens
ttattgccttctca

SEQ ID NO: 4512695 - DNA, 17 bp, Homo sapiens
ttattgccttctcacca

SEQ ID NO: 4512696 - DNA, 21 bp, Homo sapiens
ttattggcaaagtttaaatgt

SEQ ID NO: 4512697 - DNA, 22 bp, Homo sapiens
ttattggcttgataaacataat

SEQ ID NO: 4512698 - DNA, 15 bp, Homo sapiens
ttattggttttgcag

SEQ ID NO: 4512699 - DNA, 16 bp, Homo sapiens
ttattgtagtttgaaa

SEQ ID NO: 4512700 - DNA, 19 bp, Homo sapiens
ttattgtagtttgaaagtt

SEQ ID NO: 4512701 - DNA, 14 bp, Homo sapiens
ttattgtctgtaaa

SEQ ID NO: 4512702 - DNA, 15 bp, Homo sapiens
ttattgtctgtaaat

SEQ ID NO: 4512703 - DNA, 16 bp, Homo sapiens
ttattgtctgtctaca

SEQ ID NO: 4512704 - DNA, 16 bp, Homo sapiens
ttatttaaaatagcaa

SEQ ID NO: 4512705 - DNA, 21 bp, Homo sapiens
ttatttaaaatagcaaaagaa

SEQ ID NO: 4512706 - DNA, 23 bp, Homo sapiens
ttatttaaaccgctaaaagaaac

SEQ ID NO: 4512707 - DNA, 16 bp, Homo sapiens
ttatttacatttaata

SEQ ID NO: 4512708 - DNA, 13 bp, Homo sapiens
ttatttacatttt

SEQ ID NO: 4512709 - DNA, 16 bp, Homo sapiens
ttatttagacaagaga

SEQ ID NO: 4512710 - DNA, 13 bp, Homo sapiens
ttatttattatta

SEQ ID NO: 4512711 - DNA, 12 bp, Homo sapiens
ttatttatttct

SEQ ID NO: 4512712 - DNA, 13 bp, Homo sapiens
ttatttcaaaatg

SEQ ID NO: 4512713 - DNA, 17 bp, Homo sapiens
ttatttcagattttgat

SEQ ID NO: 4512714 - DNA, 23 bp, Homo sapiens
ttatttcagattttgataactgt

SEQ ID NO: 4512715 - DNA, 15 bp, Homo sapiens
ttatttccagttgcc

SEQ ID NO: 4512716 - DNA, 18 bp, Homo sapiens
ttatttctagctttttaa

SEQ ID NO: 4512717 - DNA, 15 bp, Homo sapiens
ttatttctgatttca

SEQ ID NO: 4512718 - DNA, 14 bp, Homo sapiens
ttatttcttaacct

SEQ ID NO: 4512719 - DNA, 13 bp, Homo sapiens
ttatttcttccct

SEQ ID NO: 4512720 - DNA, 21 bp, Homo sapiens
ttatttcttccctgctttgca

SEQ ID NO: 4512721 - DNA, 17 bp, Homo sapiens
ttatttgactttttcac

SEQ ID NO: 4512722 - DNA, 13 bp, Homo sapiens
ttatttgcatgtg

SEQ ID NO: 4512723 - DNA, 16 bp, Homo sapiens
ttatttgtctgtaaaa

SEQ ID NO: 4512724 - DNA, 20 bp, Homo sapiens
ttattttaaaatatatgaag

SEQ ID NO: 4512725 - DNA, 22 bp, Homo sapiens
ttattttaaattataaggactg

SEQ ID NO: 4512726 - DNA, 23 bp, Homo sapiens
ttattttaaattataaggactgc

SEQ ID NO: 4512727 - DNA, 14 bp, Homo sapiens
ttattttagcaaat

SEQ ID NO: 4512728 - DNA, 19 bp, Homo sapiens
ttattttagtgtgtaaaat

SEQ ID NO: 4512729 - DNA, 22 bp, Homo sapiens
ttattttatatcatacagtttt

SEQ ID NO: 4512730 - DNA, 15 bp, Homo sapiens
ttattttcattgtga

SEQ ID NO: 4512731 - DNA, 12 bp, Homo sapiens
ttattttctaca

SEQ ID NO: 4512732 - DNA, 15 bp, Homo sapiens
ttattttgacataaa

SEQ ID NO: 4512733 - DNA, 12 bp, Homo sapiens
ttattttgtaat

SEQ ID NO: 4512734 - DNA, 13 bp, Homo sapiens
ttattttgtaata

SEQ ID NO: 4512735 - DNA, 17 bp, Homo sapiens
ttattttgtaatattga

SEQ ID NO: 4512736 - DNA, 19 bp, Homo sapiens
ttatttttctcttgtacca

SEQ ID NO: 4512737 - DNA, 14 bp, Homo sapiens
ttatttttctgtta

SEQ ID NO: 4512738 - DNA, 16 bp, Homo sapiens
ttatttttcttttaaa

SEQ ID NO: 4512739 - DNA, 23 bp, Homo sapiens
ttatttttggcgtggctgactta

SEQ ID NO: 4512740 - DNA, 13 bp, Homo sapiens
ttattttttgcat

SEQ ID NO: 4512741 - DNA, 23 bp, Homo sapiens
ttattttttggtggtgaaattga

SEQ ID NO: 4512742 - DNA, 22 bp, Homo sapiens
ttcaaaaaatcatgtttatttt

SEQ ID NO: 4512743 - DNA, 16 bp, Homo sapiens
ttcaaaacaaaatgaa

SEQ ID NO: 4512744 - DNA, 17 bp, Homo sapiens
ttcaaaaccttttgaaa

SEQ ID NO: 4512745 - DNA, 12 bp, Homo sapiens
ttcaaaatactt

SEQ ID NO: 4512746 - DNA, 16 bp, Homo sapiens
ttcaaaatacttcttt

SEQ ID NO: 4512747 - DNA, 16 bp, Homo sapiens
ttcaaaatattgagca

SEQ ID NO: 4512748 - DNA, 15 bp, Homo sapiens
ttcaaaatatttaaa

SEQ ID NO: 4512749 - DNA, 17 bp, Homo sapiens
ttcaaaatgaattttta

SEQ ID NO: 4512750 - DNA, 13 bp, Homo sapiens
ttcaaaatgctct

SEQ ID NO: 4512751 - DNA, 14 bp, Homo sapiens
ttcaaacttttgaa

SEQ ID NO: 4512752 - DNA, 15 bp, Homo sapiens
ttcaaagactcaaat

SEQ ID NO: 4512753 - DNA, 21 bp, Homo sapiens
ttcaaagccagcgtcctcctc

SEQ ID NO: 4512754 - DNA, 19 bp, Homo sapiens
ttcaaagctaaaatatata

SEQ ID NO: 4512755 - DNA, 23 bp, Homo sapiens
ttcaaagctgtgtgtttggaaga

SEQ ID NO: 4512756 - DNA, 15 bp, Homo sapiens
ttcaaaggacaaaag

SEQ ID NO: 4512757 - DNA, 20 bp, Homo sapiens
ttcaaagtctcaatgaaata

SEQ ID NO: 4512758 - DNA, 19 bp, Homo sapiens
ttcaaagtttaataaattt

SEQ ID NO: 4512759 - DNA, 14 bp, Homo sapiens
ttcaaataatgctt

SEQ ID NO: 4512760 - DNA, 13 bp, Homo sapiens
ttcaaatactttt

SEQ ID NO: 4512761 - DNA, 14 bp, Homo sapiens
ttcaaatgcatttt

SEQ ID NO: 4512762 - DNA, 22 bp, Homo sapiens
ttcaaatgtgcaatttgtaaat

SEQ ID NO: 4512763 - DNA, 13 bp, Homo sapiens
ttcaaatgttaga

SEQ ID NO: 4512764 - DNA, 14 bp, Homo sapiens
ttcaaatgttagat

SEQ ID NO: 4512765 - DNA, 18 bp, Homo sapiens
ttcaaattgctgcttgga

SEQ ID NO: 4512766 - DNA, 16 bp, Homo sapiens
ttcaaattggtctgaa

SEQ ID NO: 4512767 - DNA, 13 bp, Homo sapiens
ttcaaatttgtaa

SEQ ID NO: 4512768 - DNA, 21 bp, Homo sapiens
ttcaaattttttaaaagagac

SEQ ID NO: 4512769 - DNA, 19 bp, Homo sapiens
ttcaacaattggtgtcatt

SEQ ID NO: 4512770 - DNA, 13 bp, Homo sapiens
ttcaacacatttt

SEQ ID NO: 4512771 - DNA, 17 bp, Homo sapiens
ttcaacacatttttaag

SEQ ID NO: 4512772 - DNA, 13 bp, Homo sapiens
ttcaacagggaag

SEQ ID NO: 4512773 - DNA, 15 bp, Homo sapiens
ttcaacctaaatact

SEQ ID NO: 4512774 - DNA, 16 bp, Homo sapiens
ttcaacctaaatactg

SEQ ID NO: 4512775 - DNA, 17 bp, Homo sapiens
ttcaactacagtgattc

SEQ ID NO: 4512776 - DNA, 13 bp, Homo sapiens
ttcaactgcccag

SEQ ID NO: 4512777 - DNA, 16 bp, Homo sapiens
ttcaactgcccagcaa

SEQ ID NO: 4512778 - DNA, 19 bp, Homo sapiens
ttcaactgtcttcctcaaa

SEQ ID NO: 4512779 - DNA, 22 bp, Homo sapiens
ttcaactttgaataaagaatac

SEQ ID NO: 4512780 - DNA, 22 bp, Homo sapiens
ttcaagaagtaatcagtatgca

SEQ ID NO: 4512781 - DNA, 23 bp, Homo sapiens
ttcaagaagtatttttttaattt

SEQ ID NO: 4512782 - DNA, 13 bp, Homo sapiens
ttcaagaccagcc

SEQ ID NO: 4512783 - DNA, 19 bp, Homo sapiens
ttcaagacttgagcggagc

SEQ ID NO: 4512784 - DNA, 15 bp, Homo sapiens
ttcaagataaggaga

SEQ ID NO: 4512785 - DNA, 17 bp, Homo sapiens
ttcaagcacactggaat

SEQ ID NO: 4512786 - DNA, 18 bp, Homo sapiens
ttcaagcacactggaata

SEQ ID NO: 4512787 - DNA, 19 bp, Homo sapiens
ttcaagcacactggaatat

SEQ ID NO: 4512788 - DNA, 16 bp, Homo sapiens
ttcaagcctctaaaca

SEQ ID NO: 4512789 - DNA, 16 bp, Homo sapiens
ttcaaggaatttctta

SEQ ID NO: 4512790 - DNA, 16 bp, Homo sapiens
ttcaaggagaatatga

SEQ ID NO: 4512791 - DNA, 18 bp, Homo sapiens
ttcaaggagaatatgata

SEQ ID NO: 4512792 - DNA, 16 bp, Homo sapiens
ttcaaggaggcccact

SEQ ID NO: 4512793 - DNA, 17 bp, Homo sapiens
ttcaaggctcagaagga

SEQ ID NO: 4512794 - DNA, 16 bp, Homo sapiens
ttcaagtaattgtgaa

SEQ ID NO: 4512795 - DNA, 22 bp, Homo sapiens
ttcaagtgcatgctctctgcag

SEQ ID NO: 4512796 - DNA, 12 bp, Homo sapiens
ttcaagtgccaa

SEQ ID NO: 4512797 - DNA, 23 bp, Homo sapiens
ttcaagtgcctagactgttactt

SEQ ID NO: 4512798 - DNA, 19 bp, Homo sapiens
ttcaagtgcttaaaaatac

SEQ ID NO: 4512799 - DNA, 14 bp, Homo sapiens
ttcaagttttaaag

SEQ ID NO: 4512800 - DNA, 15 bp, Homo sapiens
ttcaagtttttcata

SEQ ID NO: 4512801 - DNA, 17 bp, Homo sapiens
ttcaagtttttcatact

SEQ ID NO: 4512802 - DNA, 21 bp, Homo sapiens
ttcaagtttttcatactgtac

SEQ ID NO: 4512803 - DNA, 22 bp, Homo sapiens
ttcaagtttttcatactgtaca

SEQ ID NO: 4512804 - DNA, 24 bp, Homo sapiens
ttcaagtttttcatactgtacaca

SEQ ID NO: 4512805 - DNA, 13 bp, Homo sapiens
ttcaataaaccac

SEQ ID NO: 4512806 - DNA, 18 bp, Homo sapiens
ttcaataaatctttcaaa

SEQ ID NO: 4512807 - DNA, 22 bp, Homo sapiens
ttcaatacaaacaatctcttaa

SEQ ID NO: 4512808 - DNA, 17 bp, Homo sapiens
ttcaatagcacatatgg

SEQ ID NO: 4512809 - DNA, 17 bp, Homo sapiens
ttcaatataagaagcaa

SEQ ID NO: 4512810 - DNA, 15 bp, Homo sapiens
ttcaatatattgaac

SEQ ID NO: 4512811 - DNA, 17 bp, Homo sapiens
ttcaatatattgaactt

SEQ ID NO: 4512812 - DNA, 11 bp, Homo sapiens
ttcaatatgca

SEQ ID NO: 4512813 - DNA, 19 bp, Homo sapiens
ttcaatctggattcatatt

SEQ ID NO: 4512814 - DNA, 23 bp, Homo sapiens
ttcaatctggattcatatttaat

SEQ ID NO: 4512815 - DNA, 15 bp, Homo sapiens
ttcaatctgtaaact

SEQ ID NO: 4512816 - DNA, 23 bp, Homo sapiens
ttcaatctgtgaagcctttatct

SEQ ID NO: 4512817 - DNA, 22 bp, Homo sapiens
ttcaatgccaatgagtctgtaa

SEQ ID NO: 4512818 - DNA, 18 bp, Homo sapiens
ttcaatgggaagactcag

SEQ ID NO: 4512819 - DNA, 15 bp, Homo sapiens
ttcaatgtgattctt

SEQ ID NO: 4512820 - DNA, 21 bp, Homo sapiens
ttcaatgtgtataaattgtct

SEQ ID NO: 4512821 - DNA, 15 bp, Homo sapiens
ttcaattcaaagctg

SEQ ID NO: 4512822 - DNA, 17 bp, Homo sapiens
ttcaattgcatctccca

SEQ ID NO: 4512823 - DNA, 19 bp, Homo sapiens
ttcaattgcatctcccaga

SEQ ID NO: 4512824 - DNA, 14 bp, Homo sapiens
ttcaattgtcactt

SEQ ID NO: 4512825 - DNA, 18 bp, Homo sapiens
ttcaatttcatgtttctt

SEQ ID NO: 4512826 - DNA, 18 bp, Homo sapiens
ttcacaaaaaaatgttca

SEQ ID NO: 4512827 - DNA, 18 bp, Homo sapiens
ttcacaaaatgcacttct

SEQ ID NO: 4512828 - DNA, 15 bp, Homo sapiens
ttcacaaaatttcca

SEQ ID NO: 4512829 - DNA, 14 bp, Homo sapiens
ttcacaaactgtga

SEQ ID NO: 4512830 - DNA, 22 bp, Homo sapiens
ttcacaaacttttatactcttt

SEQ ID NO: 4512831 - DNA, 21 bp, Homo sapiens
ttcacagcaccaaaggctcag

SEQ ID NO: 4512832 - DNA, 19 bp, Homo sapiens
ttcacagcctataaccaga

SEQ ID NO: 4512833 - DNA, 17 bp, Homo sapiens
ttcacaggtagcctatt

SEQ ID NO: 4512834 - DNA, 23 bp, Homo sapiens
ttcacaggtggacaaatgttgtc

SEQ ID NO: 4512835 - DNA, 17 bp, Homo sapiens
ttcacaggttttatgtg

SEQ ID NO: 4512836 - DNA, 15 bp, Homo sapiens
ttcacagtgctcttt

SEQ ID NO: 4512837 - DNA, 15 bp, Homo sapiens
ttcacagttctgtaa

SEQ ID NO: 4512838 - DNA, 16 bp, Homo sapiens
ttcacagttctgtaat

SEQ ID NO: 4512839 - DNA, 20 bp, Homo sapiens
ttcacagttctgtaatgtag

SEQ ID NO: 4512840 - DNA, 16 bp, Homo sapiens
ttcacattcttggctt

SEQ ID NO: 4512841 - DNA, 18 bp, Homo sapiens
ttcacccaccaggccagc

SEQ ID NO: 4512842 - DNA, 23 bp, Homo sapiens
ttcacccaccaggccagctcagg

SEQ ID NO: 4512843 - DNA, 22 bp, Homo sapiens
ttcaccccagtggccactcagc

SEQ ID NO: 4512844 - DNA, 13 bp, Homo sapiens
ttcacccccaact

SEQ ID NO: 4512845 - DNA, 14 bp, Homo sapiens
ttcacccccaactt

SEQ ID NO: 4512846 - DNA, 15 bp, Homo sapiens
ttcacccctcccttt

SEQ ID NO: 4512847 - DNA, 17 bp, Homo sapiens
ttcacccctccctttct

SEQ ID NO: 4512848 - DNA, 22 bp, Homo sapiens
ttcacccctccctttctcccct

SEQ ID NO: 4512849 - DNA, 18 bp, Homo sapiens
ttcacccgagttcctctg

SEQ ID NO: 4512850 - DNA, 21 bp, Homo sapiens
ttcacctccaagcatttcatg

SEQ ID NO: 4512851 - DNA, 22 bp, Homo sapiens
ttcacctccctgctcagtgctt

SEQ ID NO: 4512852 - DNA, 12 bp, Homo sapiens
ttcacctgcagg

SEQ ID NO: 4512853 - DNA, 13 bp, Homo sapiens
ttcacctgtaaaa

SEQ ID NO: 4512854 - DNA, 16 bp, Homo sapiens
ttcacctgtaaaactt

SEQ ID NO: 4512855 - DNA, 17 bp, Homo sapiens
ttcacctgtaaacctga

SEQ ID NO: 4512856 - DNA, 19 bp, Homo sapiens
ttcacgcctgaggcaatta

SEQ ID NO: 4512857 - DNA, 14 bp, Homo sapiens
ttcactaacctttt

SEQ ID NO: 4512858 - DNA, 12 bp, Homo sapiens
ttcactgtacgt

SEQ ID NO: 4512859 - DNA, 16 bp, Homo sapiens
ttcactgtcatcttca

SEQ ID NO: 4512860 - DNA, 15 bp, Homo sapiens
ttcacttctatttat

SEQ ID NO: 4512861 - DNA, 20 bp, Homo sapiens
ttcacttctttgcagagcct

SEQ ID NO: 4512862 - DNA, 14 bp, Homo sapiens
ttcactttcatttt

SEQ ID NO: 4512863 - DNA, 15 bp, Homo sapiens
ttcactttcattttt

SEQ ID NO: 4512864 - DNA, 23 bp, Homo sapiens
ttcactttgtgtattaaatggtt

SEQ ID NO: 4512865 - DNA, 15 bp, Homo sapiens
ttcacttttaaacta

SEQ ID NO: 4512866 - DNA, 15 bp, Homo sapiens
ttcagaaaatgttct

SEQ ID NO: 4512867 - DNA, 13 bp, Homo sapiens
ttcagaaaattaa

SEQ ID NO: 4512868 - DNA, 16 bp, Homo sapiens
ttcagaacctcttccc

SEQ ID NO: 4512869 - DNA, 18 bp, Homo sapiens
ttcagaacctcttcccca

SEQ ID NO: 4512870 - DNA, 17 bp, Homo sapiens
ttcagaactaaattttt

SEQ ID NO: 4512871 - DNA, 18 bp, Homo sapiens
ttcagaactaaatttttc

SEQ ID NO: 4512872 - DNA, 12 bp, Homo sapiens
ttcagaagaaaa

SEQ ID NO: 4512873 - DNA, 16 bp, Homo sapiens
ttcagaagaaataaat

SEQ ID NO: 4512874 - DNA, 18 bp, Homo sapiens
ttcagaaggagaaggaaa

SEQ ID NO: 4512875 - DNA, 19 bp, Homo sapiens
ttcagaaggttattttctt

SEQ ID NO: 4512876 - DNA, 23 bp, Homo sapiens
ttcagaaggttattttctttatc

SEQ ID NO: 4512877 - DNA, 20 bp, Homo sapiens
ttcagaagttagtttgtata

SEQ ID NO: 4512878 - DNA, 15 bp, Homo sapiens
ttcagaatctgaatg

SEQ ID NO: 4512879 - DNA, 15 bp, Homo sapiens
ttcagaatttagtgt

SEQ ID NO: 4512880 - DNA, 20 bp, Homo sapiens
ttcagacatagaattaacac

SEQ ID NO: 4512881 - DNA, 10 bp, Homo sapiens
ttcagacccc

SEQ ID NO: 4512882 - DNA, 12 bp, Homo sapiens
ttcagactcaga

SEQ ID NO: 4512883 - DNA, 14 bp, Homo sapiens
ttcagactcagact

SEQ ID NO: 4512884 - DNA, 13 bp, Homo sapiens
ttcagactgcctg

SEQ ID NO: 4512885 - DNA, 15 bp, Homo sapiens
ttcagacttgtcaag

SEQ ID NO: 4512886 - DNA, 20 bp, Homo sapiens
ttcagagaaaggactgtgga

SEQ ID NO: 4512887 - DNA, 18 bp, Homo sapiens
ttcagagcataaaaccta

SEQ ID NO: 4512888 - DNA, 20 bp, Homo sapiens
ttcagagcataaaacctaaa

SEQ ID NO: 4512889 - DNA, 15 bp, Homo sapiens
ttcagagggtaagta

SEQ ID NO: 4512890 - DNA, 15 bp, Homo sapiens
ttcagatataaaaga

SEQ ID NO: 4512891 - DNA, 19 bp, Homo sapiens
ttcagatataaaagactga

SEQ ID NO: 4512892 - DNA, 17 bp, Homo sapiens
ttcagatcagtgcttga

SEQ ID NO: 4512893 - DNA, 15 bp, Homo sapiens
ttcagatgtaatgtt

SEQ ID NO: 4512894 - DNA, 17 bp, Homo sapiens
ttcagatgtaatgtttt

SEQ ID NO: 4512895 - DNA, 14 bp, Homo sapiens
ttcagatgtcttct

SEQ ID NO: 4512896 - DNA, 17 bp, Homo sapiens
ttcagatgtcttctgcc

SEQ ID NO: 4512897 - DNA, 19 bp, Homo sapiens
ttcagatgtcttctgcctg

SEQ ID NO: 4512898 - DNA, 18 bp, Homo sapiens
ttcagatgtttcatcaat

SEQ ID NO: 4512899 - DNA, 16 bp, Homo sapiens
ttcagatttgccttat

SEQ ID NO: 4512900 - DNA, 19 bp, Homo sapiens
ttcagcaaccctacagtat

SEQ ID NO: 4512901 - DNA, 23 bp, Homo sapiens
ttcagcacctacagtgtacagtc

SEQ ID NO: 4512902 - DNA, 15 bp, Homo sapiens
ttcagcacttgtctc

SEQ ID NO: 4512903 - DNA, 21 bp, Homo sapiens
ttcagcacttgtctcatttta

SEQ ID NO: 4512904 - DNA, 19 bp, Homo sapiens
ttcagcagcaaattttcag

SEQ ID NO: 4512905 - DNA, 20 bp, Homo sapiens
ttcagcatagaaggaagtgt

SEQ ID NO: 4512906 - DNA, 17 bp, Homo sapiens
ttcagcattaagctgtt

SEQ ID NO: 4512907 - DNA, 19 bp, Homo sapiens
ttcagcattcttagcctgt

SEQ ID NO: 4512908 - DNA, 19 bp, Homo sapiens
ttcagcatttacttgaaga

SEQ ID NO: 4512909 - DNA, 15 bp, Homo sapiens
ttcagccacatgccc

SEQ ID NO: 4512910 - DNA, 17 bp, Homo sapiens
ttcagccagcttaaacc

SEQ ID NO: 4512911 - DNA, 22 bp, Homo sapiens
ttcagcccccatcacccaagcc

SEQ ID NO: 4512912 - DNA, 18 bp, Homo sapiens
ttagtgtatgattactgg

SEQ ID NO: 4512913 - DNA, 11 bp, Homo sapiens
ttagtgtatta

SEQ ID NO: 4512914 - DNA, 13 bp, Homo sapiens
ttagtgtattaat

SEQ ID NO: 4512915 - DNA, 16 bp, Homo sapiens
ttagtgtgaagttgat

SEQ ID NO: 4512916 - DNA, 14 bp, Homo sapiens
ttagtgtgaatatt

SEQ ID NO: 4512917 - DNA, 17 bp, Homo sapiens
ttagtgtgtaaaattaa

SEQ ID NO: 4512918 - DNA, 20 bp, Homo sapiens
ttagtgtgtaaaattaatgt

SEQ ID NO: 4512919 - DNA, 22 bp, Homo sapiens
ttagtgtgtaaaattaatgtaa

SEQ ID NO: 4512920 - DNA, 16 bp, Homo sapiens
ttagttaaaactcatc

SEQ ID NO: 4512921 - DNA, 20 bp, Homo sapiens
ttagttaccttatagttact

SEQ ID NO: 4512922 - DNA, 21 bp, Homo sapiens
ttagttaccttatagttactg

SEQ ID NO: 4512923 - DNA, 22 bp, Homo sapiens
ttagttaccttatagttactgt

SEQ ID NO: 4512924 - DNA, 20 bp, Homo sapiens
ttagttacgtataatgcttt

SEQ ID NO: 4512925 - DNA, 15 bp, Homo sapiens
ttagttactttagat

SEQ ID NO: 4512926 - DNA, 23 bp, Homo sapiens
ttagttccccaaatacaaagtta

SEQ ID NO: 4512927 - DNA, 20 bp, Homo sapiens
ttagttctgtatataaatat

SEQ ID NO: 4512928 - DNA, 15 bp, Homo sapiens
ttagttgccaacagt

SEQ ID NO: 4512929 - DNA, 13 bp, Homo sapiens
ttagttgctgtat

SEQ ID NO: 4512930 - DNA, 15 bp, Homo sapiens
ttagttgctgtatgt

SEQ ID NO: 4512931 - DNA, 16 bp, Homo sapiens
ttagtttgatcagaca

SEQ ID NO: 4512932 - DNA, 14 bp, Homo sapiens
ttagtttgcattta

SEQ ID NO: 4512933 - DNA, 18 bp, Homo sapiens
ttagtttgcctgcagttt

SEQ ID NO: 4512934 - DNA, 20 bp, Homo sapiens
ttagttttacactaggaaac

SEQ ID NO: 4512935 - DNA, 21 bp, Homo sapiens
ttagtttttaaaatttatttg

SEQ ID NO: 4512936 - DNA, 22 bp, Homo sapiens
ttagtttttaaaatttatttgc

SEQ ID NO: 4512937 - DNA, 18 bp, Homo sapiens
ttagtttttaacaatcta

SEQ ID NO: 4512938 - DNA, 23 bp, Homo sapiens
ttagtttttaacaatctaacaat

SEQ ID NO: 4512939 - DNA, 18 bp, Homo sapiens
ttagtttttgtgaagttt

SEQ ID NO: 4512940 - DNA, 20 bp, Homo sapiens
ttataaaaataaatagaaaa

SEQ ID NO: 4512941 - DNA, 17 bp, Homo sapiens
ttataaaaatataaatt

SEQ ID NO: 4512942 - DNA, 17 bp, Homo sapiens
ttataaaactatgtgtt

SEQ ID NO: 4512943 - DNA, 16 bp, Homo sapiens
ttataaaagtgttcat

SEQ ID NO: 4512944 - DNA, 17 bp, Homo sapiens
ttataaaataatgtact

SEQ ID NO: 4512945 - DNA, 13 bp, Homo sapiens
ttataaaatgctc

SEQ ID NO: 4512946 - DNA, 20 bp, Homo sapiens
ttataaaatggctgtaatca

SEQ ID NO: 4512947 - DNA, 20 bp, Homo sapiens
ttataaactaccaaattagt

SEQ ID NO: 4512948 - DNA, 22 bp, Homo sapiens
ttataaactaccaaattagtga

SEQ ID NO: 4512949 - DNA, 14 bp, Homo sapiens
ttataaactataaa

SEQ ID NO: 4512950 - DNA, 23 bp, Homo sapiens
ttataaactatttttttcttaaa

SEQ ID NO: 4512951 - DNA, 18 bp, Homo sapiens
ttataaagggacactttt

SEQ ID NO: 4512952 - DNA, 22 bp, Homo sapiens
ttataaagttcagatgtttcat

SEQ ID NO: 4512953 - DNA, 16 bp, Homo sapiens
ttataaatatatataa

SEQ ID NO: 4512954 - DNA, 18 bp, Homo sapiens
ttataaatcttatgctct

SEQ ID NO: 4512955 - DNA, 12 bp, Homo sapiens
ttataaattaaa

SEQ ID NO: 4512956 - DNA, 15 bp, Homo sapiens
ttataaattaaatat

SEQ ID NO: 4512957 - DNA, 17 bp, Homo sapiens
ttataacagatgtgaaa

SEQ ID NO: 4512958 - DNA, 21 bp, Homo sapiens
ttataacagatgtgaaaatat

SEQ ID NO: 4512959 - DNA, 23 bp, Homo sapiens
ttataacctagttaaagaaagga

SEQ ID NO: 4512960 - DNA, 20 bp, Homo sapiens
ttataagccaaaggttcaga

SEQ ID NO: 4512961 - DNA, 20 bp, Homo sapiens
ttataagcgtatttagactg

SEQ ID NO: 4512962 - DNA, 13 bp, Homo sapiens
ttataaggaaact

SEQ ID NO: 4512963 - DNA, 11 bp, Homo sapiens
ttataaggact

SEQ ID NO: 4512964 - DNA, 17 bp, Homo sapiens
ttataagttgaccttta

SEQ ID NO: 4512965 - DNA, 19 bp, Homo sapiens
ttataataaaggactgtaa

SEQ ID NO: 4512966 - DNA, 14 bp, Homo sapiens
ttataatactgttt

SEQ ID NO: 4512967 - DNA, 22 bp, Homo sapiens
ttataatgattaagggacattt

SEQ ID NO: 4512968 - DNA, 17 bp, Homo sapiens
ttataatgtatttgaaa

SEQ ID NO: 4512969 - DNA, 20 bp, Homo sapiens
ttataatgtatttgaaaatt

SEQ ID NO: 4512970 - DNA, 14 bp, Homo sapiens
ttataattctcatt

SEQ ID NO: 4512971 - DNA, 16 bp, Homo sapiens
ttatacaaaagagcat

SEQ ID NO: 4512972 - DNA, 22 bp, Homo sapiens
ttatacaaaagagcatggatgc

SEQ ID NO: 4512973 - DNA, 21 bp, Homo sapiens
ttataccagcttaatagctgt

SEQ ID NO: 4512974 - DNA, 22 bp, Homo sapiens
ttataccagcttaatagctgta

SEQ ID NO: 4512975 - DNA, 22 bp, Homo sapiens
ttatactgcacttatttgtcaa

SEQ ID NO: 4512976 - DNA, 15 bp, Homo sapiens
ttatactgtacaata

SEQ ID NO: 4512977 - DNA, 23 bp, Homo sapiens
ttatacttgagaccaacttttca

SEQ ID NO: 4512978 - DNA, 14 bp, Homo sapiens
ttatactttatatc

SEQ ID NO: 4512979 - DNA, 18 bp, Homo sapiens
ttatagaacttcatggat

SEQ ID NO: 4512980 - DNA, 13 bp, Homo sapiens
ttatagacaaaag

SEQ ID NO: 4512981 - DNA, 22 bp, Homo sapiens
ttatagacaaaagaataagaca

SEQ ID NO: 4512982 - DNA, 21 bp, Homo sapiens
ttatagaggctagcttctgct

SEQ ID NO: 4512983 - DNA, 14 bp, Homo sapiens
ttatagattgtctt

SEQ ID NO: 4512984 - DNA, 15 bp, Homo sapiens
ttatagattgtctta

SEQ ID NO: 4512985 - DNA, 17 bp, Homo sapiens
ttatagattgtcttaat

SEQ ID NO: 4512986 - DNA, 21 bp, Homo sapiens
ttatagcaaaaatgttttcca

SEQ ID NO: 4512987 - DNA, 18 bp, Homo sapiens
ttatagcaacaacaattg

SEQ ID NO: 4512988 - DNA, 17 bp, Homo sapiens
ttataggaaaaaaactg

SEQ ID NO: 4512989 - DNA, 22 bp, Homo sapiens
ttataggcagctgtcctgtgat

SEQ ID NO: 4512990 - DNA, 13 bp, Homo sapiens
ttatagtaatgag

SEQ ID NO: 4512991 - DNA, 14 bp, Homo sapiens
ttatagtagaacaa

SEQ ID NO: 4512992 - DNA, 14 bp, Homo sapiens
ttatagtgaagtgt

SEQ ID NO: 4512993 - DNA, 17 bp, Homo sapiens
ttatagtgaagtgttaa

SEQ ID NO: 4512994 - DNA, 18 bp, Homo sapiens
ttatagtgagttgcatgt

SEQ ID NO: 4512995 - DNA, 13 bp, Homo sapiens
ttatagtggaaaa

SEQ ID NO: 4512996 - DNA, 17 bp, Homo sapiens
ttatagtggaaaaacac

SEQ ID NO: 4512997 - DNA, 19 bp, Homo sapiens
ttatagttactgtgtaatt

SEQ ID NO: 4512998 - DNA, 14 bp, Homo sapiens
ttatagttatgtct

SEQ ID NO: 4512999 - DNA, 14 bp, Homo sapiens
ttatagtttataca

SEQ ID NO: 4513000 - DNA, 21 bp, Homo sapiens
ttatataaaacttaaaaacaa

SEQ ID NO: 4513001 - DNA, 20 bp, Homo sapiens
ttatataacaaaaaaggttt

SEQ ID NO: 4513002 - DNA, 16 bp, Homo sapiens
ttatataactgtattt

SEQ ID NO: 4513003 - DNA, 18 bp, Homo sapiens
ttatataactgtatttga

SEQ ID NO: 4513004 - DNA, 21 bp, Homo sapiens
ttatataatatctaaagttat

SEQ ID NO: 4513005 - DNA, 23 bp, Homo sapiens
ttatatacagtacacagatacct

SEQ ID NO: 4513006 - DNA, 18 bp, Homo sapiens
ttatatataaggtaatgt

SEQ ID NO: 4513007 - DNA, 18 bp, Homo sapiens
ttatatattatgtgaaga

SEQ ID NO: 4513008 - DNA, 19 bp, Homo sapiens
ttatatattatgtgaagaa

SEQ ID NO: 4513009 - DNA, 21 bp, Homo sapiens
ttatatattgaaagttgcttt

SEQ ID NO: 4513010 - DNA, 16 bp, Homo sapiens
ttatatcatacagttt

SEQ ID NO: 4513011 - DNA, 17 bp, Homo sapiens
ttatatcatacagtttt

SEQ ID NO: 4513012 - DNA, 16 bp, Homo sapiens
ttatatcatgcaaaat

SEQ ID NO: 4513013 - DNA, 19 bp, Homo sapiens
ttatatcttgtttacaata

SEQ ID NO: 4513014 - DNA, 15 bp, Homo sapiens
ttatatgatatgcat

SEQ ID NO: 4513015 - DNA, 19 bp, Homo sapiens
ttatatgtacatgagaagg

SEQ ID NO: 4513016 - DNA, 15 bp, Homo sapiens
ttatatgtactttta

SEQ ID NO: 4513017 - DNA, 13 bp, Homo sapiens
ttatatgtgttga

SEQ ID NO: 4513018 - DNA, 18 bp, Homo sapiens
ttatatgttgtaatattt

SEQ ID NO: 4513019 - DNA, 13 bp, Homo sapiens
ttatattcacaga

SEQ ID NO: 4513020 - DNA, 17 bp, Homo sapiens
ttatatttattgttaga

SEQ ID NO: 4513021 - DNA, 14 bp, Homo sapiens
ttatatttccttta

SEQ ID NO: 4513022 - DNA, 20 bp, Homo sapiens
ttatatttcctttatgtgaa

SEQ ID NO: 4513023 - DNA, 20 bp, Homo sapiens
ttatattttatgaacattgt

SEQ ID NO: 4513024 - DNA, 18 bp, Homo sapiens
ttatattttgaaagaagc

SEQ ID NO: 4513025 - DNA, 12 bp, Homo sapiens
ttatcaaaaagc

SEQ ID NO: 4513026 - DNA, 23 bp, Homo sapiens
ttatcaatgtgtctttctaagaa

SEQ ID NO: 4513027 - DNA, 18 bp, Homo sapiens
ttatcaattatattatgt

SEQ ID NO: 4513028 - DNA, 16 bp, Homo sapiens
ttatcacagaaataaa

SEQ ID NO: 4513029 - DNA, 22 bp, Homo sapiens
ttatcacataagagagatgaga

SEQ ID NO: 4513030 - DNA, 18 bp, Homo sapiens
ttatcaccgtgggctccc

SEQ ID NO: 4513031 - DNA, 19 bp, Homo sapiens
ttatcagtttgctaatgtt

SEQ ID NO: 4513032 - DNA, 18 bp, Homo sapiens
ttactggtccaaaagatt

SEQ ID NO: 4513033 - DNA, 19 bp, Homo sapiens
ttactgtaactgtcagtgt

SEQ ID NO: 4513034 - DNA, 16 bp, Homo sapiens
ttactgtagcctcaga

SEQ ID NO: 4513035 - DNA, 13 bp, Homo sapiens
ttactgtatgttt

SEQ ID NO: 4513036 - DNA, 12 bp, Homo sapiens
ttactgtcagat

SEQ ID NO: 4513037 - DNA, 21 bp, Homo sapiens
ttactgtcagattaaattaca

SEQ ID NO: 4513038 - DNA, 20 bp, Homo sapiens
ttactgtcctgttgattaat

SEQ ID NO: 4513039 - DNA, 20 bp, Homo sapiens
ttacttaaggcagtatcctt

SEQ ID NO: 4513040 - DNA, 15 bp, Homo sapiens
ttacttaagtgttca

SEQ ID NO: 4513041 - DNA, 16 bp, Homo sapiens
ttacttaatcaaaact

SEQ ID NO: 4513042 - DNA, 20 bp, Homo sapiens
ttacttaatgaccatgttat

SEQ ID NO: 4513043 - DNA, 23 bp, Homo sapiens
ttacttagaatgccataaaattg

SEQ ID NO: 4513044 - DNA, 21 bp, Homo sapiens
ttacttcactatacaaacaaa

SEQ ID NO: 4513045 - DNA, 11 bp, Homo sapiens
ttacttctctt

SEQ ID NO: 4513046 - DNA, 15 bp, Homo sapiens
ttacttgaactttcc

SEQ ID NO: 4513047 - DNA, 15 bp, Homo sapiens
ttacttgcttcagtg

SEQ ID NO: 4513048 - DNA, 14 bp, Homo sapiens
ttactttcctctga

SEQ ID NO: 4513049 - DNA, 14 bp, Homo sapiens
ttactttgtctttt

SEQ ID NO: 4513050 - DNA, 18 bp, Homo sapiens
ttacttttcctcttagaa

SEQ ID NO: 4513051 - DNA, 16 bp, Homo sapiens
ttacttttctgccaaa

SEQ ID NO: 4513052 - DNA, 17 bp, Homo sapiens
ttactttttaaaaataa

SEQ ID NO: 4513053 - DNA, 19 bp, Homo sapiens
ttagaaaacccaagttttt

SEQ ID NO: 4513054 - DNA, 14 bp, Homo sapiens
ttagaaaatgactt

SEQ ID NO: 4513055 - DNA, 20 bp, Homo sapiens
ttagaaaatgacttatttct

SEQ ID NO: 4513056 - DNA, 13 bp, Homo sapiens
ttagaaacactgc

SEQ ID NO: 4513057 - DNA, 13 bp, Homo sapiens
ttagaaagctaaa

SEQ ID NO: 4513058 - DNA, 22 bp, Homo sapiens
ttagaaagctgacattgccaaa

SEQ ID NO: 4513059 - DNA, 20 bp, Homo sapiens
ttagaaaggacaacagttct

SEQ ID NO: 4513060 - DNA, 23 bp, Homo sapiens
ttagaaaggacaacagttctgag

SEQ ID NO: 4513061 - DNA, 13 bp, Homo sapiens
ttagaaatattca

SEQ ID NO: 4513062 - DNA, 15 bp, Homo sapiens
ttagaaatattcaca

SEQ ID NO: 4513063 - DNA, 19 bp, Homo sapiens
ttagaaattacctgtggat

SEQ ID NO: 4513064 - DNA, 16 bp, Homo sapiens
ttagaacattcacttt

SEQ ID NO: 4513065 - DNA, 20 bp, Homo sapiens
ttagaacattcacttttgtt

SEQ ID NO: 4513066 - DNA, 15 bp, Homo sapiens
ttagaaccacagcag

SEQ ID NO: 4513067 - DNA, 22 bp, Homo sapiens
ttagaaccagccgtattttaca

SEQ ID NO: 4513068 - DNA, 16 bp, Homo sapiens
ttagaagaagtgtgtc

SEQ ID NO: 4513069 - DNA, 16 bp, Homo sapiens
ttagaataaattccca

SEQ ID NO: 4513070 - DNA, 15 bp, Homo sapiens
ttagaatcagaataa

SEQ ID NO: 4513071 - DNA, 16 bp, Homo sapiens
ttagaatcagaataaa

SEQ ID NO: 4513072 - DNA, 21 bp, Homo sapiens
ttagaatcagaataaagttgt

SEQ ID NO: 4513073 - DNA, 16 bp, Homo sapiens
ttagaatgaatttatc

SEQ ID NO: 4513074 - DNA, 23 bp, Homo sapiens
ttagaatgaatttatctttacca

SEQ ID NO: 4513075 - DNA, 20 bp, Homo sapiens
ttagaatggaggaagaacaa

SEQ ID NO: 4513076 - DNA, 23 bp, Homo sapiens
ttagaatttgtttcatctatttt

SEQ ID NO: 4513077 - DNA, 16 bp, Homo sapiens
ttagaccgctctcttt

SEQ ID NO: 4513078 - DNA, 18 bp, Homo sapiens
ttagactaaggccattat

SEQ ID NO: 4513079 - DNA, 22 bp, Homo sapiens
ttagactcatggtgtgttacac

SEQ ID NO: 4513080 - DNA, 15 bp, Homo sapiens
ttagactgtggccat

SEQ ID NO: 4513081 - DNA, 18 bp, Homo sapiens
ttagagataggaaactga

SEQ ID NO: 4513082 - DNA, 20 bp, Homo sapiens
ttagagataggaaactgaag

SEQ ID NO: 4513083 - DNA, 17 bp, Homo sapiens
ttagagccaagtgtctt

SEQ ID NO: 4513084 - DNA, 17 bp, Homo sapiens
ttagagtgtctttccac

SEQ ID NO: 4513085 - DNA, 15 bp, Homo sapiens
ttagagtttctgttt

SEQ ID NO: 4513086 - DNA, 17 bp, Homo sapiens
ttagagtttctgtttga

SEQ ID NO: 4513087 - DNA, 17 bp, Homo sapiens
ttagataaagatttcta

SEQ ID NO: 4513088 - DNA, 20 bp, Homo sapiens
ttagatattgctactataat

SEQ ID NO: 4513089 - DNA, 22 bp, Homo sapiens
ttagatattgctactataatca

SEQ ID NO: 4513090 - DNA, 20 bp, Homo sapiens
ttagatccattaatttaaat

SEQ ID NO: 4513091 - DNA, 17 bp, Homo sapiens
ttagatggttacactgt

SEQ ID NO: 4513092 - DNA, 21 bp, Homo sapiens
ttagatgtagatatttgaaat

SEQ ID NO: 4513093 - DNA, 22 bp, Homo sapiens
ttagatgtagatatttgaaata

SEQ ID NO: 4513094 - DNA, 22 bp, Homo sapiens
ttagatgttccagtaatctaat

SEQ ID NO: 4513095 - DNA, 22 bp, Homo sapiens
ttagatgttctaagtctttcca

SEQ ID NO: 4513096 - DNA, 15 bp, Homo sapiens
ttagattcactttga

SEQ ID NO: 4513097 - DNA, 18 bp, Homo sapiens
ttagatttcatagttcag

SEQ ID NO: 4513098 - DNA, 12 bp, Homo sapiens
ttagatttgtgc

SEQ ID NO: 4513099 - DNA, 22 bp, Homo sapiens
ttagcaaatcagtatattttct

SEQ ID NO: 4513100 - DNA, 18 bp, Homo sapiens
ttagcacgtttaaagttc

SEQ ID NO: 4513101 - DNA, 13 bp, Homo sapiens
ttagcagccctgg

SEQ ID NO: 4513102 - DNA, 18 bp, Homo sapiens
ttagcagggatgttcctt

SEQ ID NO: 4513103 - DNA, 22 bp, Homo sapiens
ttagcagggattctctcatcta

SEQ ID NO: 4513104 - DNA, 16 bp, Homo sapiens
ttagcagttctgcaaa

SEQ ID NO: 4513105 - DNA, 21 bp, Homo sapiens
ttagcagttctgcaaatagaa

SEQ ID NO: 4513106 - DNA, 16 bp, Homo sapiens
ttagcatgtgtgactt

SEQ ID NO: 4513107 - DNA, 19 bp, Homo sapiens
ttagccagcgtttattgta

SEQ ID NO: 4513108 - DNA, 14 bp, Homo sapiens
ttagccatacacat

SEQ ID NO: 4513109 - DNA, 13 bp, Homo sapiens
ttagcccaagagg

SEQ ID NO: 4513110 - DNA, 14 bp, Homo sapiens
ttagccctgtctgc

SEQ ID NO: 4513111 - DNA, 21 bp, Homo sapiens
ttagccgggcatgatggtgca

SEQ ID NO: 4513112 - DNA, 12 bp, Homo sapiens
ttagcctctccc

SEQ ID NO: 4513113 - DNA, 20 bp, Homo sapiens
ttagcctgtggcagtaaaga

SEQ ID NO: 4513114 - DNA, 19 bp, Homo sapiens
ttagcggcaaacctttccc

SEQ ID NO: 4513115 - DNA, 21 bp, Homo sapiens
ttagcggcaaacctttccccc

SEQ ID NO: 4513116 - DNA, 21 bp, Homo sapiens
ttagcgtcaagacatttgctg

SEQ ID NO: 4513117 - DNA, 17 bp, Homo sapiens
ttagctgtagagtcctt

SEQ ID NO: 4513118 - DNA, 12 bp, Homo sapiens
ttagcttcagga

SEQ ID NO: 4513119 - DNA, 14 bp, Homo sapiens
ttagcttcaggaac

SEQ ID NO: 4513120 - DNA, 16 bp, Homo sapiens
ttagcttcaggaacct

SEQ ID NO: 4513121 - DNA, 13 bp, Homo sapiens
ttagctttaactt

SEQ ID NO: 4513122 - DNA, 19 bp, Homo sapiens
ttagcttttgatgtctcca

SEQ ID NO: 4513123 - DNA, 18 bp, Homo sapiens
ttaggaagcaagcttaat

SEQ ID NO: 4513124 - DNA, 20 bp, Homo sapiens
ttaggaaggcagcattccat

SEQ ID NO: 4513125 - DNA, 11 bp, Homo sapiens
ttaggacagca

SEQ ID NO: 4513126 - DNA, 20 bp, Homo sapiens
ttaggagaagtcttctattt

SEQ ID NO: 4513127 - DNA, 18 bp, Homo sapiens
ttaggatggggctcccag

SEQ ID NO: 4513128 - DNA, 18 bp, Homo sapiens
ttaggatgttgaaaaagt

SEQ ID NO: 4513129 - DNA, 16 bp, Homo sapiens
ttaggattttcacatt

SEQ ID NO: 4513130 - DNA, 17 bp, Homo sapiens
ttaggcatgtcccaccc

SEQ ID NO: 4513131 - DNA, 14 bp, Homo sapiens
ttaggcctctgaga

SEQ ID NO: 4513132 - DNA, 15 bp, Homo sapiens
ttaggctgttggttc

SEQ ID NO: 4513133 - DNA, 14 bp, Homo sapiens
ttagggagagaaga

SEQ ID NO: 4513134 - DNA, 24 bp, Homo sapiens
ttaggggaagtaaaacagtcatct

SEQ ID NO: 4513135 - DNA, 17 bp, Homo sapiens
ttaggggccaataaaat

SEQ ID NO: 4513136 - DNA, 11 bp, Homo sapiens
ttagggtacag

SEQ ID NO: 4513137 - DNA, 12 bp, Homo sapiens
ttaggtctggtt

SEQ ID NO: 4513138 - DNA, 18 bp, Homo sapiens
ttaggtgctgttatgttt

SEQ ID NO: 4513139 - DNA, 13 bp, Homo sapiens
ttagtaaatgtta

SEQ ID NO: 4513140 - DNA, 12 bp, Homo sapiens
ttagtaacatgt

SEQ ID NO: 4513141 - DNA, 23 bp, Homo sapiens
ttagtaacctttaaaaatgtata

SEQ ID NO: 4513142 - DNA, 15 bp, Homo sapiens
ttagtaatctgtata

SEQ ID NO: 4513143 - DNA, 17 bp, Homo sapiens
ttagtaatctgtataat

SEQ ID NO: 4513144 - DNA, 17 bp, Homo sapiens
ttagtataaatgtacat

SEQ ID NO: 4513145 - DNA, 18 bp, Homo sapiens
ttagtataaatgtacatc

SEQ ID NO: 4513146 - DNA, 13 bp, Homo sapiens
ttagtattaacta

SEQ ID NO: 4513147 - DNA, 13 bp, Homo sapiens
ttagtattatctt

SEQ ID NO: 4513148 - DNA, 15 bp, Homo sapiens
ttagtctgaaactgg

SEQ ID NO: 4513149 - DNA, 16 bp, Homo sapiens
ttagtcttttgtaata

SEQ ID NO: 4513150 - DNA, 21 bp, Homo sapiens
ttagtgaaccaaaaatagaaa

SEQ ID NO: 4513151 - DNA, 22 bp, Homo sapiens
ttagtgaaccaaaaatagaaat

SEQ ID NO: 4513152 - DNA, 18 bp, Homo sapiens
ttagtgccacttaatgta

SEQ ID NO: 4513153 - DNA, 20 bp, Homo sapiens
ttacaactaaataacacaga

SEQ ID NO: 4513154 - DNA, 13 bp, Homo sapiens
ttacaacttgtat

SEQ ID NO: 4513155 - DNA, 14 bp, Homo sapiens
ttacaactttctaa

SEQ ID NO: 4513156 - DNA, 16 bp, Homo sapiens
ttacaagaagaactca

SEQ ID NO: 4513157 - DNA, 16 bp, Homo sapiens
ttacaagcttaaagct

SEQ ID NO: 4513158 - DNA, 12 bp, Homo sapiens
ttacaatcaaag

SEQ ID NO: 4513159 - DNA, 13 bp, Homo sapiens
ttacaatgtatta

SEQ ID NO: 4513160 - DNA, 13 bp, Homo sapiens
ttacaatttgcac

SEQ ID NO: 4513161 - DNA, 22 bp, Homo sapiens
ttacaatttgcacaatatttct

SEQ ID NO: 4513162 - DNA, 13 bp, Homo sapiens
ttacaattttatc

SEQ ID NO: 4513163 - DNA, 15 bp, Homo sapiens
ttacaattttttatc

SEQ ID NO: 4513164 - DNA, 20 bp, Homo sapiens
ttacacaatggtttttaaat

SEQ ID NO: 4513165 - DNA, 22 bp, Homo sapiens
ttacacaatggtttttaaattt

SEQ ID NO: 4513166 - DNA, 18 bp, Homo sapiens
ttacacactaacatcaat

SEQ ID NO: 4513167 - DNA, 17 bp, Homo sapiens
ttacacagagaaataca

SEQ ID NO: 4513168 - DNA, 21 bp, Homo sapiens
ttacacagagaaatacaaaat

SEQ ID NO: 4513169 - DNA, 15 bp, Homo sapiens
ttacacagcccaaga

SEQ ID NO: 4513170 - DNA, 15 bp, Homo sapiens
ttacacatttttcag

SEQ ID NO: 4513171 - DNA, 18 bp, Homo sapiens
ttacactaggaaacgtgt

SEQ ID NO: 4513172 - DNA, 13 bp, Homo sapiens
ttacactgttaga

SEQ ID NO: 4513173 - DNA, 17 bp, Homo sapiens
ttacactgttagaacac

SEQ ID NO: 4513174 - DNA, 20 bp, Homo sapiens
ttacactgttagaacactat

SEQ ID NO: 4513175 - DNA, 14 bp, Homo sapiens
ttacagactgaaag

SEQ ID NO: 4513176 - DNA, 19 bp, Homo sapiens
ttacagactgaaaggtgtg

SEQ ID NO: 4513177 - DNA, 17 bp, Homo sapiens
ttacagagaatttctaa

SEQ ID NO: 4513178 - DNA, 20 bp, Homo sapiens
ttacagagacagaaagcaga

SEQ ID NO: 4513179 - DNA, 18 bp, Homo sapiens
ttacagagaggatacatt

SEQ ID NO: 4513180 - DNA, 18 bp, Homo sapiens
ttacagatgtttttaatt

SEQ ID NO: 4513181 - DNA, 23 bp, Homo sapiens
ttacagatgtttttaattctagt

SEQ ID NO: 4513182 - DNA, 13 bp, Homo sapiens
ttacagcagcaat

SEQ ID NO: 4513183 - DNA, 21 bp, Homo sapiens
ttacagccaagttgtgacagt

SEQ ID NO: 4513184 - DNA, 16 bp, Homo sapiens
ttacaggaatgaagaa

SEQ ID NO: 4513185 - DNA, 17 bp, Homo sapiens
ttacaggaatgaagaac

SEQ ID NO: 4513186 - DNA, 19 bp, Homo sapiens
ttacaggaatgaagaactg

SEQ ID NO: 4513187 - DNA, 15 bp, Homo sapiens
ttacagggtgactca

SEQ ID NO: 4513188 - DNA, 14 bp, Homo sapiens
ttacagtaatgtca

SEQ ID NO: 4513189 - DNA, 19 bp, Homo sapiens
ttacagtaggagcccagct

SEQ ID NO: 4513190 - DNA, 14 bp, Homo sapiens
ttacagtgaagaaa

SEQ ID NO: 4513191 - DNA, 14 bp, Homo sapiens
ttacagttctgtgg

SEQ ID NO: 4513192 - DNA, 23 bp, Homo sapiens
ttacataagagaaagaggccaga

SEQ ID NO: 4513193 - DNA, 18 bp, Homo sapiens
ttacataaggatgacttt

SEQ ID NO: 4513194 - DNA, 22 bp, Homo sapiens
ttacataaggatgactttttta

SEQ ID NO: 4513195 - DNA, 21 bp, Homo sapiens
ttacataatttagttgtttct

SEQ ID NO: 4513196 - DNA, 24 bp, Homo sapiens
ttacatactttatcaatgtgtctt

SEQ ID NO: 4513197 - DNA, 16 bp, Homo sapiens
ttacatagtaaatggt

SEQ ID NO: 4513198 - DNA, 21 bp, Homo sapiens
ttacatccgtaggacaagttt

SEQ ID NO: 4513199 - DNA, 22 bp, Homo sapiens
ttacatccgtaggacaagtttt

SEQ ID NO: 4513200 - DNA, 17 bp, Homo sapiens
ttacatcctctgatagc

SEQ ID NO: 4513201 - DNA, 16 bp, Homo sapiens
ttacatctaagaattt

SEQ ID NO: 4513202 - DNA, 14 bp, Homo sapiens
ttacatctgcctta

SEQ ID NO: 4513203 - DNA, 15 bp, Homo sapiens
ttacatctgccttaa

SEQ ID NO: 4513204 - DNA, 16 bp, Homo sapiens
ttacatgctgtatatg

SEQ ID NO: 4513205 - DNA, 16 bp, Homo sapiens
ttacatgtaatttgat

SEQ ID NO: 4513206 - DNA, 16 bp, Homo sapiens
ttacatgttttaaaga

SEQ ID NO: 4513207 - DNA, 20 bp, Homo sapiens
ttacatgttttttcatttgt

SEQ ID NO: 4513208 - DNA, 22 bp, Homo sapiens
ttacatgttttttcatttgtaa

SEQ ID NO: 4513209 - DNA, 12 bp, Homo sapiens
ttacattattcc

SEQ ID NO: 4513210 - DNA, 14 bp, Homo sapiens
ttacattccagtag

SEQ ID NO: 4513211 - DNA, 20 bp, Homo sapiens
ttacatttgatgcatgtctt

SEQ ID NO: 4513212 - DNA, 12 bp, Homo sapiens
ttaccaacctgt

SEQ ID NO: 4513213 - DNA, 19 bp, Homo sapiens
ttaccaataggcaaattaa

SEQ ID NO: 4513214 - DNA, 19 bp, Homo sapiens
ttaccagatgctgactggc

SEQ ID NO: 4513215 - DNA, 16 bp, Homo sapiens
ttaccagcttttaacc

SEQ ID NO: 4513216 - DNA, 21 bp, Homo sapiens
ttaccaggcaccaaaagaagt

SEQ ID NO: 4513217 - DNA, 20 bp, Homo sapiens
ttaccagggactatctttgc

SEQ ID NO: 4513218 - DNA, 17 bp, Homo sapiens
ttaccagtcctattttt

SEQ ID NO: 4513219 - DNA, 23 bp, Homo sapiens
ttaccagtggcgttgttgcatgt

SEQ ID NO: 4513220 - DNA, 24 bp, Homo sapiens
ttaccagtggcgttgttgcatgtt

SEQ ID NO: 4513221 - DNA, 14 bp, Homo sapiens
ttaccatcatctct

SEQ ID NO: 4513222 - DNA, 21 bp, Homo sapiens
ttaccattacttgtataaata

SEQ ID NO: 4513223 - DNA, 13 bp, Homo sapiens
ttaccattcacaa

SEQ ID NO: 4513224 - DNA, 15 bp, Homo sapiens
ttaccattcacaata

SEQ ID NO: 4513225 - DNA, 21 bp, Homo sapiens
ttaccatttgctactgtacat

SEQ ID NO: 4513226 - DNA, 21 bp, Homo sapiens
ttaccattttaacgctgccta

SEQ ID NO: 4513227 - DNA, 16 bp, Homo sapiens
ttacccaggtgggtcc

SEQ ID NO: 4513228 - DNA, 14 bp, Homo sapiens
ttaccctttctttt

SEQ ID NO: 4513229 - DNA, 14 bp, Homo sapiens
ttacctaagattac

SEQ ID NO: 4513230 - DNA, 13 bp, Homo sapiens
ttacctactttga

SEQ ID NO: 4513231 - DNA, 21 bp, Homo sapiens
ttacctagtgcaaaaactgta

SEQ ID NO: 4513232 - DNA, 16 bp, Homo sapiens
ttacctggaatcaaat

SEQ ID NO: 4513233 - DNA, 15 bp, Homo sapiens
ttacctgtatacagt

SEQ ID NO: 4513234 - DNA, 19 bp, Homo sapiens
ttacctgtatacagtgcag

SEQ ID NO: 4513235 - DNA, 20 bp, Homo sapiens
ttacctttatctttcacctt

SEQ ID NO: 4513236 - DNA, 16 bp, Homo sapiens
ttacgatgtaaatttt

SEQ ID NO: 4513237 - DNA, 15 bp, Homo sapiens
ttacgctttgattca

SEQ ID NO: 4513238 - DNA, 13 bp, Homo sapiens
ttacgtaaaacat

SEQ ID NO: 4513239 - DNA, 21 bp, Homo sapiens
ttacgttcatcacctgctaga

SEQ ID NO: 4513240 - DNA, 18 bp, Homo sapiens
ttactaaaaaaaagatga

SEQ ID NO: 4513241 - DNA, 12 bp, Homo sapiens
ttactaatgatt

SEQ ID NO: 4513242 - DNA, 15 bp, Homo sapiens
ttactaatgatttag

SEQ ID NO: 4513243 - DNA, 21 bp, Homo sapiens
ttactaatgatttagtgttgt

SEQ ID NO: 4513244 - DNA, 17 bp, Homo sapiens
ttactaattatactact

SEQ ID NO: 4513245 - DNA, 22 bp, Homo sapiens
ttactacagtttttaactctac

SEQ ID NO: 4513246 - DNA, 21 bp, Homo sapiens
ttactagtactagtactatga

SEQ ID NO: 4513247 - DNA, 17 bp, Homo sapiens
ttactagtgtttaagtc

SEQ ID NO: 4513248 - DNA, 21 bp, Homo sapiens
ttactagtgtttaagtcattt

SEQ ID NO: 4513249 - DNA, 18 bp, Homo sapiens
ttactatagcaaagtagt

SEQ ID NO: 4513250 - DNA, 22 bp, Homo sapiens
ttactatagcaaagtagtactt

SEQ ID NO: 4513251 - DNA, 21 bp, Homo sapiens
ttactatttgccaatgtatat

SEQ ID NO: 4513252 - DNA, 14 bp, Homo sapiens
ttactcacctctct

SEQ ID NO: 4513253 - DNA, 12 bp, Homo sapiens
ttactcactgct

SEQ ID NO: 4513254 - DNA, 22 bp, Homo sapiens
ttactcagccctgggccccacc

SEQ ID NO: 4513255 - DNA, 20 bp, Homo sapiens
ttactcccttctgtagtttt

SEQ ID NO: 4513256 - DNA, 19 bp, Homo sapiens
ttactctccaacctggaca

SEQ ID NO: 4513257 - DNA, 21 bp, Homo sapiens
ttactcttaaatcatttggtt

SEQ ID NO: 4513258 - DNA, 22 bp, Homo sapiens
ttactcttaaatcatttggtta

SEQ ID NO: 4513259 - DNA, 14 bp, Homo sapiens
ttactcttagagat

SEQ ID NO: 4513260 - DNA, 16 bp, Homo sapiens
ttactgaatgatctat

SEQ ID NO: 4513261 - DNA, 12 bp, Homo sapiens
ttactgaccatg

SEQ ID NO: 4513262 - DNA, 21 bp, Homo sapiens
ttactgataaaaatgatattg

SEQ ID NO: 4513263 - DNA, 15 bp, Homo sapiens
ttactgatgtgatat

SEQ ID NO: 4513264 - DNA, 20 bp, Homo sapiens
ttactgatgtgatattctgt

SEQ ID NO: 4513265 - DNA, 23 bp, Homo sapiens
ttactgcctgtagcaatggccag

SEQ ID NO: 4513266 - DNA, 18 bp, Homo sapiens
ttactgctgattcttgta

SEQ ID NO: 4513267 - DNA, 21 bp, Homo sapiens
ttactgctgattcttgtaaat

SEQ ID NO: 4513268 - DNA, 22 bp, Homo sapiens
ttactgctgattcttgtaaatc

SEQ ID NO: 4513269 - DNA, 17 bp, Homo sapiens
ttactgctttaatcaga

SEQ ID NO: 4513270 - DNA, 13 bp, Homo sapiens
ttactggcctttt

SEQ ID NO: 4513271 - DNA, 16 bp, Homo sapiens
ttactggcctttttca

SEQ ID NO: 4513272 - DNA, 15 bp, Homo sapiens
ttactggtccaaaag

SEQ ID NO: 4513273 - DNA, 12 bp, Homo sapiens
ttaagttcttat

SEQ ID NO: 4513274 - DNA, 17 bp, Homo sapiens
ttaagttggcttctgtt

SEQ ID NO: 4513275 - DNA, 13 bp, Homo sapiens
ttaagttgtcaaa

SEQ ID NO: 4513276 - DNA, 18 bp, Homo sapiens
ttaagttgtcaaagaagc

SEQ ID NO: 4513277 - DNA, 13 bp, Homo sapiens
ttaataaaaagga

SEQ ID NO: 4513278 - DNA, 15 bp, Homo sapiens
ttaataaaatatcta

SEQ ID NO: 4513279 - DNA, 13 bp, Homo sapiens
ttaataagaacag

SEQ ID NO: 4513280 - DNA, 15 bp, Homo sapiens
ttaataagaacagat

SEQ ID NO: 4513281 - DNA, 18 bp, Homo sapiens
ttaataagatatttagta

SEQ ID NO: 4513282 - DNA, 19 bp, Homo sapiens
ttaataagatttttcaaaa

SEQ ID NO: 4513283 - DNA, 20 bp, Homo sapiens
ttaataagatttttcaaaat

SEQ ID NO: 4513284 - DNA, 14 bp, Homo sapiens
ttaataatatcaaa

SEQ ID NO: 4513285 - DNA, 13 bp, Homo sapiens
ttaataatattta

SEQ ID NO: 4513286 - DNA, 14 bp, Homo sapiens
ttaatacaggaaat

SEQ ID NO: 4513287 - DNA, 18 bp, Homo sapiens
ttaatactgtattgctgt

SEQ ID NO: 4513288 - DNA, 13 bp, Homo sapiens
ttaatacttttcc

SEQ ID NO: 4513289 - DNA, 15 bp, Homo sapiens
ttaatagcaaagaat

SEQ ID NO: 4513290 - DNA, 16 bp, Homo sapiens
ttaatagcaaagaatt

SEQ ID NO: 4513291 - DNA, 18 bp, Homo sapiens
ttaatagcaaagaattga

SEQ ID NO: 4513292 - DNA, 18 bp, Homo sapiens
ttaatagccaaagatttc

SEQ ID NO: 4513293 - DNA, 18 bp, Homo sapiens
ttaatagtaatttgtaaa

SEQ ID NO: 4513294 - DNA, 19 bp, Homo sapiens
ttaatagtaatttgtaaag

SEQ ID NO: 4513295 - DNA, 14 bp, Homo sapiens
ttaatataaattca

SEQ ID NO: 4513296 - DNA, 19 bp, Homo sapiens
ttaatataccccaaattgt

SEQ ID NO: 4513297 - DNA, 21 bp, Homo sapiens
ttaatatagtgaaatggccac

SEQ ID NO: 4513298 - DNA, 13 bp, Homo sapiens
ttaatatataatt

SEQ ID NO: 4513299 - DNA, 18 bp, Homo sapiens
ttaatatatcattatctt

SEQ ID NO: 4513300 - DNA, 16 bp, Homo sapiens
ttaatatattaaaatt

SEQ ID NO: 4513301 - DNA, 20 bp, Homo sapiens
ttaatatattaaaattccaa

SEQ ID NO: 4513302 - DNA, 18 bp, Homo sapiens
ttaatatatttgaaaaaa

SEQ ID NO: 4513303 - DNA, 14 bp, Homo sapiens
ttaatatcctaaac

SEQ ID NO: 4513304 - DNA, 17 bp, Homo sapiens
ttaatatcctaaacatc

SEQ ID NO: 4513305 - DNA, 19 bp, Homo sapiens
ttaatatcctaaacatcat

SEQ ID NO: 4513306 - DNA, 16 bp, Homo sapiens
ttaatatctttctgca

SEQ ID NO: 4513307 - DNA, 19 bp, Homo sapiens
ttaatatgagcttcaatat

SEQ ID NO: 4513308 - DNA, 20 bp, Homo sapiens
ttaatatgagcttcaatata

SEQ ID NO: 4513309 - DNA, 18 bp, Homo sapiens
ttaatatgctgcaacaaa

SEQ ID NO: 4513310 - DNA, 14 bp, Homo sapiens
ttaatatgtctttt

SEQ ID NO: 4513311 - DNA, 16 bp, Homo sapiens
ttaatattttgtaata

SEQ ID NO: 4513312 - DNA, 20 bp, Homo sapiens
ttaatcacattttgtatgga

SEQ ID NO: 4513313 - DNA, 20 bp, Homo sapiens
ttaatcacttaacattccta

SEQ ID NO: 4513314 - DNA, 17 bp, Homo sapiens
ttaatcagatagatatt

SEQ ID NO: 4513315 - DNA, 12 bp, Homo sapiens
ttaatcatttta

SEQ ID NO: 4513316 - DNA, 13 bp, Homo sapiens
ttaatcccagcac

SEQ ID NO: 4513317 - DNA, 15 bp, Homo sapiens
ttaatctactgtatc

SEQ ID NO: 4513318 - DNA, 19 bp, Homo sapiens
ttaatctcctattccttca

SEQ ID NO: 4513319 - DNA, 13 bp, Homo sapiens
ttaatctggacac

SEQ ID NO: 4513320 - DNA, 16 bp, Homo sapiens
ttaatcttagtgtatg

SEQ ID NO: 4513321 - DNA, 19 bp, Homo sapiens
ttaatcttggatagctaat

SEQ ID NO: 4513322 - DNA, 16 bp, Homo sapiens
ttaatgaaaaggaatc

SEQ ID NO: 4513323 - DNA, 20 bp, Homo sapiens
ttaatgaaatgataaagact

SEQ ID NO: 4513324 - DNA, 18 bp, Homo sapiens
ttaatgaagaaagtggaa

SEQ ID NO: 4513325 - DNA, 15 bp, Homo sapiens
ttaatgacaacactt

SEQ ID NO: 4513326 - DNA, 20 bp, Homo sapiens
ttaatgaccatgttatattg

SEQ ID NO: 4513327 - DNA, 16 bp, Homo sapiens
ttaatgactctttctg

SEQ ID NO: 4513328 - DNA, 19 bp, Homo sapiens
ttaatgatatactgatctt

SEQ ID NO: 4513329 - DNA, 21 bp, Homo sapiens
ttaatgcaccaatcttgttta

SEQ ID NO: 4513330 - DNA, 11 bp, Homo sapiens
ttaatgcactt

SEQ ID NO: 4513331 - DNA, 13 bp, Homo sapiens
ttaatgcactttc

SEQ ID NO: 4513332 - DNA, 23 bp, Homo sapiens
ttaatgccgatatactctagatg

SEQ ID NO: 4513333 - DNA, 16 bp, Homo sapiens
ttaatgcctgcttttt

SEQ ID NO: 4513334 - DNA, 18 bp, Homo sapiens
ttaatgcctgctttttgg

SEQ ID NO: 4513335 - DNA, 14 bp, Homo sapiens
ttaatgctatttga

SEQ ID NO: 4513336 - DNA, 21 bp, Homo sapiens
ttaatgcttacctaatttcat

SEQ ID NO: 4513337 - DNA, 16 bp, Homo sapiens
ttaatgggcacaaaat

SEQ ID NO: 4513338 - DNA, 14 bp, Homo sapiens
ttaatgtaataaag

SEQ ID NO: 4513339 - DNA, 15 bp, Homo sapiens
ttaatgtaataaagt

SEQ ID NO: 4513340 - DNA, 17 bp, Homo sapiens
ttaatgtaataaagtga

SEQ ID NO: 4513341 - DNA, 22 bp, Homo sapiens
ttaatgtaggatgacaggctct

SEQ ID NO: 4513342 - DNA, 14 bp, Homo sapiens
ttaatgtatataaa

SEQ ID NO: 4513343 - DNA, 21 bp, Homo sapiens
ttaatgtatctatttgtacaa

SEQ ID NO: 4513344 - DNA, 22 bp, Homo sapiens
ttaatgtatctatttgtacaat

SEQ ID NO: 4513345 - DNA, 23 bp, Homo sapiens
ttaatgtatctatttgtacaatt

SEQ ID NO: 4513346 - DNA, 13 bp, Homo sapiens
ttaatgtatgtta

SEQ ID NO: 4513347 - DNA, 17 bp, Homo sapiens
ttaatgtatgttaccaa

SEQ ID NO: 4513348 - DNA, 23 bp, Homo sapiens
ttaatgtctcactttactttcaa

SEQ ID NO: 4513349 - DNA, 18 bp, Homo sapiens
ttaatgtggactggaaca

SEQ ID NO: 4513350 - DNA, 15 bp, Homo sapiens
ttaatgtttcttaga

SEQ ID NO: 4513351 - DNA, 13 bp, Homo sapiens
ttaattaaaaact

SEQ ID NO: 4513352 - DNA, 16 bp, Homo sapiens
ttaattaaagccttaa

SEQ ID NO: 4513353 - DNA, 21 bp, Homo sapiens
ttaattaaagccttaagcaca

SEQ ID NO: 4513354 - DNA, 22 bp, Homo sapiens
ttaattaagcaaagcacccatt

SEQ ID NO: 4513355 - DNA, 14 bp, Homo sapiens
ttaattaggaatta

SEQ ID NO: 4513356 - DNA, 19 bp, Homo sapiens
ttaattattataaaaatat

SEQ ID NO: 4513357 - DNA, 18 bp, Homo sapiens
ttaattcaagaaatgaca

SEQ ID NO: 4513358 - DNA, 18 bp, Homo sapiens
ttaattcttaaaactata

SEQ ID NO: 4513359 - DNA, 21 bp, Homo sapiens
ttaattcttaaaactataaca

SEQ ID NO: 4513360 - DNA, 14 bp, Homo sapiens
ttaattgtaaactg

SEQ ID NO: 4513361 - DNA, 13 bp, Homo sapiens
ttaattgtgttta

SEQ ID NO: 4513362 - DNA, 23 bp, Homo sapiens
ttaatttaaatgatttaaattta

SEQ ID NO: 4513363 - DNA, 20 bp, Homo sapiens
ttaatttagagcgtttggtt

SEQ ID NO: 4513364 - DNA, 15 bp, Homo sapiens
ttaatttataatgta

SEQ ID NO: 4513365 - DNA, 17 bp, Homo sapiens
ttaatttataatgtatt

SEQ ID NO: 4513366 - DNA, 21 bp, Homo sapiens
ttaatttcaaatctgtaatta

SEQ ID NO: 4513367 - DNA, 20 bp, Homo sapiens
ttaatttcagtcctgtagtt

SEQ ID NO: 4513368 - DNA, 21 bp, Homo sapiens
ttaatttcatgtatatctaac

SEQ ID NO: 4513369 - DNA, 23 bp, Homo sapiens
ttaatttcctttttgacactgaa

SEQ ID NO: 4513370 - DNA, 13 bp, Homo sapiens
ttaatttctgaag

SEQ ID NO: 4513371 - DNA, 20 bp, Homo sapiens
ttaatttctgccatttcatg

SEQ ID NO: 4513372 - DNA, 21 bp, Homo sapiens
ttaatttctgccatttcatgt

SEQ ID NO: 4513373 - DNA, 20 bp, Homo sapiens
ttaatttggtagatgacaaa

SEQ ID NO: 4513374 - DNA, 17 bp, Homo sapiens
ttaattttaaagagtgt

SEQ ID NO: 4513375 - DNA, 20 bp, Homo sapiens
ttaattttaaagagtgtgtt

SEQ ID NO: 4513376 - DNA, 11 bp, Homo sapiens
ttaattttacc

SEQ ID NO: 4513377 - DNA, 15 bp, Homo sapiens
ttaattttagttttt

SEQ ID NO: 4513378 - DNA, 13 bp, Homo sapiens
ttaattttcctgg

SEQ ID NO: 4513379 - DNA, 23 bp, Homo sapiens
ttaattttgaagtgctgtttatt

SEQ ID NO: 4513380 - DNA, 20 bp, Homo sapiens
ttaattttttggtacaaaaa

SEQ ID NO: 4513381 - DNA, 14 bp, Homo sapiens
ttacaaaaacactt

SEQ ID NO: 4513382 - DNA, 17 bp, Homo sapiens
ttacaaaactacatgag

SEQ ID NO: 4513383 - DNA, 20 bp, Homo sapiens
ttacaaaactacatgagaac

SEQ ID NO: 4513384 - DNA, 16 bp, Homo sapiens
ttacaaaatttattct

SEQ ID NO: 4513385 - DNA, 17 bp, Homo sapiens
ttacaaaatttattctc

SEQ ID NO: 4513386 - DNA, 16 bp, Homo sapiens
ttacaaacctttgttt

SEQ ID NO: 4513387 - DNA, 16 bp, Homo sapiens
ttacaaatcagaagtc

SEQ ID NO: 4513388 - DNA, 22 bp, Homo sapiens
ttacaaatcagaagtcatcttg

SEQ ID NO: 4513389 - DNA, 21 bp, Homo sapiens
ttacaaatgaaaaattccact

SEQ ID NO: 4513390 - DNA, 18 bp, Homo sapiens
ttacaacatttatgtgag

SEQ ID NO: 4513391 - DNA, 12 bp, Homo sapiens
ttacaactaaat

SEQ ID NO: 4513392 - DNA, 14 bp, Homo sapiens
ttacaactaaataa

SEQ ID NO: 4513393 - DNA, 15 bp, Homo sapiens
ttacaactaaataac

SEQ ID NO: 4513394 - DNA, 19 bp, Homo sapiens
ttctaatccttttccttat

SEQ ID NO: 4513395 - DNA, 18 bp, Homo sapiens
ttctacacattgctacct

SEQ ID NO: 4513396 - DNA, 11 bp, Homo sapiens
ttctacactct

SEQ ID NO: 4513397 - DNA, 15 bp, Homo sapiens
ttctacatactatgg

SEQ ID NO: 4513398 - DNA, 15 bp, Homo sapiens
ttctacatagatgct

SEQ ID NO: 4513399 - DNA, 12 bp, Homo sapiens
ttctacatgtga

SEQ ID NO: 4513400 - DNA, 20 bp, Homo sapiens
ttctaccacacacagcctgt

SEQ ID NO: 4513401 - DNA, 20 bp, Homo sapiens
ttctacccagatggaaaaat

SEQ ID NO: 4513402 - DNA, 17 bp, Homo sapiens
ttctaccccaaggccag

SEQ ID NO: 4513403 - DNA, 21 bp, Homo sapiens
ttctaccccaaggccagtagt

SEQ ID NO: 4513404 - DNA, 22 bp, Homo sapiens
ttctacccccagagataaatgt

SEQ ID NO: 4513405 - DNA, 19 bp, Homo sapiens
ttctaccctcatcatcata

SEQ ID NO: 4513406 - DNA, 18 bp, Homo sapiens
ttctaccggagagagaat

SEQ ID NO: 4513407 - DNA, 22 bp, Homo sapiens
ttctacctacatatttgtatgt

SEQ ID NO: 4513408 - DNA, 13 bp, Homo sapiens
ttctacctgccct

SEQ ID NO: 4513409 - DNA, 14 bp, Homo sapiens
ttctacggatcatc

SEQ ID NO: 4513410 - DNA, 22 bp, Homo sapiens
ttctacggatcatcaacaagat

SEQ ID NO: 4513411 - DNA, 16 bp, Homo sapiens
ttctactcctgcctca

SEQ ID NO: 4513412 - DNA, 16 bp, Homo sapiens
ttctactctagatggc

SEQ ID NO: 4513413 - DNA, 22 bp, Homo sapiens
ttctactctagatggcaacatt

SEQ ID NO: 4513414 - DNA, 13 bp, Homo sapiens
ttctacttgtaaa

SEQ ID NO: 4513415 - DNA, 22 bp, Homo sapiens
ttctagaaagagaaacagttgg

SEQ ID NO: 4513416 - DNA, 14 bp, Homo sapiens
ttctagagacacat

SEQ ID NO: 4513417 - DNA, 15 bp, Homo sapiens
ttctagagttatctt

SEQ ID NO: 4513418 - DNA, 19 bp, Homo sapiens
ttctagatacaataaattg

SEQ ID NO: 4513419 - DNA, 15 bp, Homo sapiens
ttctagatcctgcac

SEQ ID NO: 4513420 - DNA, 16 bp, Homo sapiens
ttctagccataataaa

SEQ ID NO: 4513421 - DNA, 16 bp, Homo sapiens
ttctaggatgaacaat

SEQ ID NO: 4513422 - DNA, 18 bp, Homo sapiens
ttctaggatgaacaatgt

SEQ ID NO: 4513423 - DNA, 19 bp, Homo sapiens
ttctaggatgaacaatgta

SEQ ID NO: 4513424 - DNA, 20 bp, Homo sapiens
ttctaggatgaacaatgtat

SEQ ID NO: 4513425 - DNA, 22 bp, Homo sapiens
ttctaggatgaacaatgtatac

SEQ ID NO: 4513426 - DNA, 17 bp, Homo sapiens
ttctagttctgccagga

SEQ ID NO: 4513427 - DNA, 20 bp, Homo sapiens
ttctagttgaggagtttcct

SEQ ID NO: 4513428 - DNA, 19 bp, Homo sapiens
ttctataaatttaagaaaa

SEQ ID NO: 4513429 - DNA, 21 bp, Homo sapiens
ttctataagttttatgttaaa

SEQ ID NO: 4513430 - DNA, 22 bp, Homo sapiens
ttctataagttttatgttaaat

SEQ ID NO: 4513431 - DNA, 14 bp, Homo sapiens
ttctatagccaaaa

SEQ ID NO: 4513432 - DNA, 17 bp, Homo sapiens
ttctatagccaaaaata

SEQ ID NO: 4513433 - DNA, 23 bp, Homo sapiens
ttctatagccaaaaatagctaaa

SEQ ID NO: 4513434 - DNA, 20 bp, Homo sapiens
ttctatccaaacatgtattt

SEQ ID NO: 4513435 - DNA, 14 bp, Homo sapiens
ttctatcctctgta

SEQ ID NO: 4513436 - DNA, 14 bp, Homo sapiens
ttctatcctgttta

SEQ ID NO: 4513437 - DNA, 20 bp, Homo sapiens
ttctatcttgaatttcatgc

SEQ ID NO: 4513438 - DNA, 13 bp, Homo sapiens
ttctatcttttgt

SEQ ID NO: 4513439 - DNA, 18 bp, Homo sapiens
ttctatggattcacttct

SEQ ID NO: 4513440 - DNA, 22 bp, Homo sapiens
ttctatggattcacttctattt

SEQ ID NO: 4513441 - DNA, 14 bp, Homo sapiens
ttctatgtatgtta

SEQ ID NO: 4513442 - DNA, 18 bp, Homo sapiens
ttctattatggaaaactg

SEQ ID NO: 4513443 - DNA, 19 bp, Homo sapiens
ttctattatggaaaactgt

SEQ ID NO: 4513444 - DNA, 18 bp, Homo sapiens
ttctatttatatgtacat

SEQ ID NO: 4513445 - DNA, 16 bp, Homo sapiens
ttctatttcttgaaga

SEQ ID NO: 4513446 - DNA, 18 bp, Homo sapiens
ttctatttgctgggcttt

SEQ ID NO: 4513447 - DNA, 19 bp, Homo sapiens
ttctcaaagatctgaatta

SEQ ID NO: 4513448 - DNA, 16 bp, Homo sapiens
ttctcaacatactgta

SEQ ID NO: 4513449 - DNA, 20 bp, Homo sapiens
ttctcaacatactgtaatca

SEQ ID NO: 4513450 - DNA, 13 bp, Homo sapiens
ttctcaagaatct

SEQ ID NO: 4513451 - DNA, 18 bp, Homo sapiens
ttctcaagcgctatccac

SEQ ID NO: 4513452 - DNA, 23 bp, Homo sapiens
ttctcacaatagccgatatcaga

SEQ ID NO: 4513453 - DNA, 19 bp, Homo sapiens
ttctcaccagctgcaaagt

SEQ ID NO: 4513454 - DNA, 22 bp, Homo sapiens
ttctcaccagctgcaaagtgtt

SEQ ID NO: 4513455 - DNA, 20 bp, Homo sapiens
ttctcacctttcccacctct

SEQ ID NO: 4513456 - DNA, 21 bp, Homo sapiens
ttctcacctttcccacctctc

SEQ ID NO: 4513457 - DNA, 15 bp, Homo sapiens
ttctcacgctttgtt

SEQ ID NO: 4513458 - DNA, 21 bp, Homo sapiens
ttctcacgctttgtttactct

SEQ ID NO: 4513459 - DNA, 22 bp, Homo sapiens
ttctcacgctttgtttactctc

SEQ ID NO: 4513460 - DNA, 14 bp, Homo sapiens
ttctcactccacca

SEQ ID NO: 4513461 - DNA, 15 bp, Homo sapiens
ttctcactccaccac

SEQ ID NO: 4513462 - DNA, 21 bp, Homo sapiens
ttctcagaattcggtgtgctg

SEQ ID NO: 4513463 - DNA, 21 bp, Homo sapiens
ttctcagagctctcgaggaaa

SEQ ID NO: 4513464 - DNA, 18 bp, Homo sapiens
ttctcagccaggcgtggt

SEQ ID NO: 4513465 - DNA, 17 bp, Homo sapiens
ttctcaggagcttcaat

SEQ ID NO: 4513466 - DNA, 14 bp, Homo sapiens
ttctcagttttcat

SEQ ID NO: 4513467 - DNA, 19 bp, Homo sapiens
ttctcataattcctacagc

SEQ ID NO: 4513468 - DNA, 23 bp, Homo sapiens
ttctcataattcctacagcacta

SEQ ID NO: 4513469 - DNA, 21 bp, Homo sapiens
ttctcatagaggaaattcaaa

SEQ ID NO: 4513470 - DNA, 21 bp, Homo sapiens
ttctcatagcaggaaatgtag

SEQ ID NO: 4513471 - DNA, 14 bp, Homo sapiens
ttctcatctcccca

SEQ ID NO: 4513472 - DNA, 22 bp, Homo sapiens
ttctcatgttgaaactttaaga

SEQ ID NO: 4513473 - DNA, 15 bp, Homo sapiens
ttctcatttcacccc

SEQ ID NO: 4513474 - DNA, 22 bp, Homo sapiens
ttctcattttttaaaaaagctt

SEQ ID NO: 4513475 - DNA, 23 bp, Homo sapiens
ttctcattttttaaaaaagctta

SEQ ID NO: 4513476 - DNA, 19 bp, Homo sapiens
ttctccaaaaatctgcctg

SEQ ID NO: 4513477 - DNA, 21 bp, Homo sapiens
ttctccaaaaatctgcctggg

SEQ ID NO: 4513478 - DNA, 16 bp, Homo sapiens
ttctccaagagctaca

SEQ ID NO: 4513479 - DNA, 20 bp, Homo sapiens
ttctccaggattttaatttc

SEQ ID NO: 4513480 - DNA, 15 bp, Homo sapiens
ttctccagttagaat

SEQ ID NO: 4513481 - DNA, 20 bp, Homo sapiens
ttctccatccacatgggagc

SEQ ID NO: 4513482 - DNA, 20 bp, Homo sapiens
ttctccatcccctccctgcc

SEQ ID NO: 4513483 - DNA, 17 bp, Homo sapiens
ttctccatttaagacac

SEQ ID NO: 4513484 - DNA, 18 bp, Homo sapiens
ttctccatttaagacaca

SEQ ID NO: 4513485 - DNA, 15 bp, Homo sapiens
ttctcccaagaaacc

SEQ ID NO: 4513486 - DNA, 22 bp, Homo sapiens
ttctcccacatgaggccatctc

SEQ ID NO: 4513487 - DNA, 12 bp, Homo sapiens
ttctccccagaa

SEQ ID NO: 4513488 - DNA, 16 bp, Homo sapiens
ttctcccctgccccca

SEQ ID NO: 4513489 - DNA, 17 bp, Homo sapiens
ttctcccctgcccccag

SEQ ID NO: 4513490 - DNA, 22 bp, Homo sapiens
ttctcccctgcccccaggactg

SEQ ID NO: 4513491 - DNA, 23 bp, Homo sapiens
ttctcccctgcccccaggactgg

SEQ ID NO: 4513492 - DNA, 16 bp, Homo sapiens
ttctccgccagcctcc

SEQ ID NO: 4513493 - DNA, 17 bp, Homo sapiens
ttctccgccagcctcct

SEQ ID NO: 4513494 - DNA, 18 bp, Homo sapiens
ttctccgccagcctcctc

SEQ ID NO: 4513495 - DNA, 19 bp, Homo sapiens
ttctccgccagcctcctct

SEQ ID NO: 4513496 - DNA, 15 bp, Homo sapiens
ttctcctcagtggct

SEQ ID NO: 4513497 - DNA, 20 bp, Homo sapiens
ttctcctcagtggcttctcc

SEQ ID NO: 4513498 - DNA, 19 bp, Homo sapiens
ttctcctcccttccttttc

SEQ ID NO: 4513499 - DNA, 20 bp, Homo sapiens
ttctcctcccttccttttcc

SEQ ID NO: 4513500 - DNA, 23 bp, Homo sapiens
ttctcctggtagaggggccggct

SEQ ID NO: 4513501 - DNA, 15 bp, Homo sapiens
ttctcctgtgaatgg

SEQ ID NO: 4513502 - DNA, 20 bp, Homo sapiens
ttctcctgtgaatggaggca

SEQ ID NO: 4513503 - DNA, 21 bp, Homo sapiens
ttctccttgaatatctttcga

SEQ ID NO: 4513504 - DNA, 13 bp, Homo sapiens
ttctcctttgcaa

SEQ ID NO: 4513505 - DNA, 12 bp, Homo sapiens
ttctccttttcc

SEQ ID NO: 4513506 - DNA, 18 bp, Homo sapiens
ttctccttttcctatcct

SEQ ID NO: 4513507 - DNA, 13 bp, Homo sapiens
ttctcgtgtttgc

SEQ ID NO: 4513508 - DNA, 16 bp, Homo sapiens
ttctctacatgcataa

SEQ ID NO: 4513509 - DNA, 19 bp, Homo sapiens
ttctctacttgtcatatca

SEQ ID NO: 4513510 - DNA, 18 bp, Homo sapiens
ttctctataaaaaatatg

SEQ ID NO: 4513511 - DNA, 22 bp, Homo sapiens
ttctctattttacttttctgcc

SEQ ID NO: 4513512 - DNA, 20 bp, Homo sapiens
ttctctcatagaacattgat

SEQ ID NO: 4513513 - DNA, 11 bp, Homo sapiens
ttcctcagctc

SEQ ID NO: 4513514 - DNA, 12 bp, Homo sapiens
ttcctcagctct

SEQ ID NO: 4513515 - DNA, 18 bp, Homo sapiens
ttcctcatctatggttct

SEQ ID NO: 4513516 - DNA, 23 bp, Homo sapiens
ttcctcattaatagctgccttca

SEQ ID NO: 4513517 - DNA, 17 bp, Homo sapiens
ttcctccagagacactg

SEQ ID NO: 4513518 - DNA, 14 bp, Homo sapiens
ttcctccagcctcc

SEQ ID NO: 4513519 - DNA, 15 bp, Homo sapiens
ttcctccagcctccc

SEQ ID NO: 4513520 - DNA, 17 bp, Homo sapiens
ttcctccagcctcccct

SEQ ID NO: 4513521 - DNA, 20 bp, Homo sapiens
ttcctccagcctcccctccc

SEQ ID NO: 4513522 - DNA, 20 bp, Homo sapiens
ttcctccagtgcatactgta

SEQ ID NO: 4513523 - DNA, 20 bp, Homo sapiens
ttcctcctcaggcacacagc

SEQ ID NO: 4513524 - DNA, 14 bp, Homo sapiens
ttcctcctcatcct

SEQ ID NO: 4513525 - DNA, 20 bp, Homo sapiens
ttcctcctctgacttgggga

SEQ ID NO: 4513526 - DNA, 12 bp, Homo sapiens
ttcctcctctgc

SEQ ID NO: 4513527 - DNA, 20 bp, Homo sapiens
ttcctcctctgcctacagcc

SEQ ID NO: 4513528 - DNA, 14 bp, Homo sapiens
ttcctcctgggccc

SEQ ID NO: 4513529 - DNA, 21 bp, Homo sapiens
ttcctcctgggccctctctgc

SEQ ID NO: 4513530 - DNA, 23 bp, Homo sapiens
ttcctcctgggccctctctgctc

SEQ ID NO: 4513531 - DNA, 18 bp, Homo sapiens
ttcctccttcatttcagc

SEQ ID NO: 4513532 - DNA, 23 bp, Homo sapiens
ttcctccttccagatgcccgagc

SEQ ID NO: 4513533 - DNA, 15 bp, Homo sapiens
ttcctcctttacctt

SEQ ID NO: 4513534 - DNA, 18 bp, Homo sapiens
ttcctcgagaggcacctc

SEQ ID NO: 4513535 - DNA, 14 bp, Homo sapiens
ttcctctgcctgcc

SEQ ID NO: 4513536 - DNA, 16 bp, Homo sapiens
ttcctctgcctgcccc

SEQ ID NO: 4513537 - DNA, 15 bp, Homo sapiens
ttcctctggccgcag

SEQ ID NO: 4513538 - DNA, 13 bp, Homo sapiens
ttcctctgtacag

SEQ ID NO: 4513539 - DNA, 14 bp, Homo sapiens
ttcctctgtacagc

SEQ ID NO: 4513540 - DNA, 19 bp, Homo sapiens
ttcctcttagaagaatatt

SEQ ID NO: 4513541 - DNA, 13 bp, Homo sapiens
ttcctctttcttc

SEQ ID NO: 4513542 - DNA, 21 bp, Homo sapiens
ttcctcttttgtgctgcttct

SEQ ID NO: 4513543 - DNA, 15 bp, Homo sapiens
ttcctgacattgtct

SEQ ID NO: 4513544 - DNA, 21 bp, Homo sapiens
ttcctgaggaagagggactgt

SEQ ID NO: 4513545 - DNA, 14 bp, Homo sapiens
ttcctgcccttccc

SEQ ID NO: 4513546 - DNA, 19 bp, Homo sapiens
ttcctgcccttccctctgg

SEQ ID NO: 4513547 - DNA, 22 bp, Homo sapiens
ttcctgcgtagaagatatggaa

SEQ ID NO: 4513548 - DNA, 16 bp, Homo sapiens
ttcctgctgagtcctt

SEQ ID NO: 4513549 - DNA, 19 bp, Homo sapiens
ttcctggacatcaccagtc

SEQ ID NO: 4513550 - DNA, 19 bp, Homo sapiens
ttcctggaggtcagcattt

SEQ ID NO: 4513551 - DNA, 17 bp, Homo sapiens
ttcctgggaaatattcc

SEQ ID NO: 4513552 - DNA, 16 bp, Homo sapiens
ttcctgggaacatcac

SEQ ID NO: 4513553 - DNA, 19 bp, Homo sapiens
ttcctgggtgttagaacct

SEQ ID NO: 4513554 - DNA, 14 bp, Homo sapiens
ttcctggtccctca

SEQ ID NO: 4513555 - DNA, 13 bp, Homo sapiens
ttcctgtaatata

SEQ ID NO: 4513556 - DNA, 13 bp, Homo sapiens
ttcctgtccctga

SEQ ID NO: 4513557 - DNA, 13 bp, Homo sapiens
ttcctgtctgttt

SEQ ID NO: 4513558 - DNA, 16 bp, Homo sapiens
ttcctgtctgtttata

SEQ ID NO: 4513559 - DNA, 17 bp, Homo sapiens
ttcctgtctgtttatat

SEQ ID NO: 4513560 - DNA, 15 bp, Homo sapiens
ttcctgtgccctaga

SEQ ID NO: 4513561 - DNA, 18 bp, Homo sapiens
ttcctgtgcctttcctat

SEQ ID NO: 4513562 - DNA, 18 bp, Homo sapiens
ttcctgtggaataaagat

SEQ ID NO: 4513563 - DNA, 22 bp, Homo sapiens
ttcctgtgggtgttctttcctg

SEQ ID NO: 4513564 - DNA, 22 bp, Homo sapiens
ttcctgtggttttattacaaat

SEQ ID NO: 4513565 - DNA, 17 bp, Homo sapiens
ttcctgtgtaacatctg

SEQ ID NO: 4513566 - DNA, 21 bp, Homo sapiens
ttcctgttcagcattcttagc

SEQ ID NO: 4513567 - DNA, 14 bp, Homo sapiens
ttcctgttcagtaa

SEQ ID NO: 4513568 - DNA, 19 bp, Homo sapiens
ttcctgttcagtaataaaa

SEQ ID NO: 4513569 - DNA, 15 bp, Homo sapiens
ttcctgttggtttca

SEQ ID NO: 4513570 - DNA, 15 bp, Homo sapiens
ttccttatccctctc

SEQ ID NO: 4513571 - DNA, 21 bp, Homo sapiens
ttccttatccctctcttcccc

SEQ ID NO: 4513572 - DNA, 23 bp, Homo sapiens
ttccttatgtatcagtgtccttt

SEQ ID NO: 4513573 - DNA, 12 bp, Homo sapiens
ttccttcagatt

SEQ ID NO: 4513574 - DNA, 14 bp, Homo sapiens
ttccttcatttcca

SEQ ID NO: 4513575 - DNA, 20 bp, Homo sapiens
ttccttccatccctaccccc

SEQ ID NO: 4513576 - DNA, 20 bp, Homo sapiens
ttccttctcccatctcttcc

SEQ ID NO: 4513577 - DNA, 17 bp, Homo sapiens
ttccttgagtttcatat

SEQ ID NO: 4513578 - DNA, 15 bp, Homo sapiens
ttccttgcgcctcag

SEQ ID NO: 4513579 - DNA, 18 bp, Homo sapiens
ttccttgcgcctcagccc

SEQ ID NO: 4513580 - DNA, 17 bp, Homo sapiens
ttccttggactcatttt

SEQ ID NO: 4513581 - DNA, 20 bp, Homo sapiens
ttcctttacaactaaataac

SEQ ID NO: 4513582 - DNA, 20 bp, Homo sapiens
ttcctttatatttgctcccc

SEQ ID NO: 4513583 - DNA, 18 bp, Homo sapiens
ttcctttcttttccccct

SEQ ID NO: 4513584 - DNA, 23 bp, Homo sapiens
ttcctttgaagctttaggcagag

SEQ ID NO: 4513585 - DNA, 17 bp, Homo sapiens
ttccttttccctgcttc

SEQ ID NO: 4513586 - DNA, 13 bp, Homo sapiens
ttcctttttctat

SEQ ID NO: 4513587 - DNA, 15 bp, Homo sapiens
ttcctttttctatga

SEQ ID NO: 4513588 - DNA, 16 bp, Homo sapiens
ttcctttttctatgaa

SEQ ID NO: 4513589 - DNA, 16 bp, Homo sapiens
ttcctttttcttcgct

SEQ ID NO: 4513590 - DNA, 18 bp, Homo sapiens
ttcctttttgacactgaa

SEQ ID NO: 4513591 - DNA, 15 bp, Homo sapiens
ttccttttttcaata

SEQ ID NO: 4513592 - DNA, 13 bp, Homo sapiens
ttccttttttccc

SEQ ID NO: 4513593 - DNA, 22 bp, Homo sapiens
ttccttttttcccataagacaa

SEQ ID NO: 4513594 - DNA, 16 bp, Homo sapiens
ttcctttttttgtacc

SEQ ID NO: 4513595 - DNA, 22 bp, Homo sapiens
ttcgaatatatctgtaaagata

SEQ ID NO: 4513596 - DNA, 18 bp, Homo sapiens
ttcgaatctctgcccctc

SEQ ID NO: 4513597 - DNA, 11 bp, Homo sapiens
ttcgaccctgg

SEQ ID NO: 4513598 - DNA, 15 bp, Homo sapiens
ttcgaccctggggcg

SEQ ID NO: 4513599 - DNA, 14 bp, Homo sapiens
ttcgcatggtcaca

SEQ ID NO: 4513600 - DNA, 19 bp, Homo sapiens
ttcgcatggtcacacactg

SEQ ID NO: 4513601 - DNA, 20 bp, Homo sapiens
ttcgcccgagctgtttatgt

SEQ ID NO: 4513602 - DNA, 14 bp, Homo sapiens
ttcgccttaaactc

SEQ ID NO: 4513603 - DNA, 16 bp, Homo sapiens
ttcgctggactattgt

SEQ ID NO: 4513604 - DNA, 20 bp, Homo sapiens
ttcgctggactattgtgcca

SEQ ID NO: 4513605 - DNA, 23 bp, Homo sapiens
ttcgctggactattgtgccaact

SEQ ID NO: 4513606 - DNA, 15 bp, Homo sapiens
ttcggagtgaatgtg

SEQ ID NO: 4513607 - DNA, 17 bp, Homo sapiens
ttcggagtgaatgtggc

SEQ ID NO: 4513608 - DNA, 14 bp, Homo sapiens
ttcggcaccttccc

SEQ ID NO: 4513609 - DNA, 13 bp, Homo sapiens
ttcggtgtgaact

SEQ ID NO: 4513610 - DNA, 18 bp, Homo sapiens
ttcgtgatcttattgctt

SEQ ID NO: 4513611 - DNA, 14 bp, Homo sapiens
ttcgttctttttaa

SEQ ID NO: 4513612 - DNA, 14 bp, Homo sapiens
ttctaaaaagatgt

SEQ ID NO: 4513613 - DNA, 18 bp, Homo sapiens
ttctaaaacattcccctc

SEQ ID NO: 4513614 - DNA, 17 bp, Homo sapiens
ttctaaaagctttcatg

SEQ ID NO: 4513615 - DNA, 14 bp, Homo sapiens
ttctaaaatagcaa

SEQ ID NO: 4513616 - DNA, 15 bp, Homo sapiens
ttctaaaatgattgt

SEQ ID NO: 4513617 - DNA, 13 bp, Homo sapiens
ttctaaaccaaaa

SEQ ID NO: 4513618 - DNA, 23 bp, Homo sapiens
ttctaaaccaaaaattatgtgtt

SEQ ID NO: 4513619 - DNA, 19 bp, Homo sapiens
ttctaaagtaaaattgaag

SEQ ID NO: 4513620 - DNA, 22 bp, Homo sapiens
ttctaaatatcccttggacatt

SEQ ID NO: 4513621 - DNA, 23 bp, Homo sapiens
ttctaaatattgcttcaatttca

SEQ ID NO: 4513622 - DNA, 12 bp, Homo sapiens
ttctaaatgcaa

SEQ ID NO: 4513623 - DNA, 14 bp, Homo sapiens
ttctaaatgcaata

SEQ ID NO: 4513624 - DNA, 17 bp, Homo sapiens
ttctaaattaatggtaa

SEQ ID NO: 4513625 - DNA, 16 bp, Homo sapiens
ttctaacattaaatca

SEQ ID NO: 4513626 - DNA, 22 bp, Homo sapiens
ttctaaccacggttatttaagc

SEQ ID NO: 4513627 - DNA, 23 bp, Homo sapiens
ttctaaccttcacgattaactgt

SEQ ID NO: 4513628 - DNA, 19 bp, Homo sapiens
ttctaagaaatatctgtga

SEQ ID NO: 4513629 - DNA, 20 bp, Homo sapiens
ttctaagacattctgttgga

SEQ ID NO: 4513630 - DNA, 17 bp, Homo sapiens
ttctaagtaaaaccaca

SEQ ID NO: 4513631 - DNA, 19 bp, Homo sapiens
ttctaagtaaaaccacagc

SEQ ID NO: 4513632 - DNA, 22 bp, Homo sapiens
ttctaagtgaaatttctagcct

SEQ ID NO: 4513633 - DNA, 16 bp, Homo sapiens
ttctaatagtttttca

SEQ ID NO: 4513634 - DNA, 18 bp, Homo sapiens
ttcccacaggacatttct

SEQ ID NO: 4513635 - DNA, 14 bp, Homo sapiens
ttcccacgaggaat

SEQ ID NO: 4513636 - DNA, 15 bp, Homo sapiens
ttcccactcaccccg

SEQ ID NO: 4513637 - DNA, 19 bp, Homo sapiens
ttcccactgcactccagcc

SEQ ID NO: 4513638 - DNA, 21 bp, Homo sapiens
ttcccactgcactccagcctg

SEQ ID NO: 4513639 - DNA, 21 bp, Homo sapiens
ttcccagcactatgctttcct

SEQ ID NO: 4513640 - DNA, 23 bp, Homo sapiens
ttcccagcactatgctttccttc

SEQ ID NO: 4513641 - DNA, 16 bp, Homo sapiens
ttcccagcccctcctc

SEQ ID NO: 4513642 - DNA, 17 bp, Homo sapiens
ttcccagcccctcctcc

SEQ ID NO: 4513643 - DNA, 18 bp, Homo sapiens
ttcccagcccctcctccc

SEQ ID NO: 4513644 - DNA, 21 bp, Homo sapiens
ttcccagcccctcctccctca

SEQ ID NO: 4513645 - DNA, 22 bp, Homo sapiens
ttcccagcccctcctccctcag

SEQ ID NO: 4513646 - DNA, 14 bp, Homo sapiens
ttcccagcccctgc

SEQ ID NO: 4513647 - DNA, 15 bp, Homo sapiens
ttcccagcccctgca

SEQ ID NO: 4513648 - DNA, 16 bp, Homo sapiens
ttcccagcccctgcag

SEQ ID NO: 4513649 - DNA, 16 bp, Homo sapiens
ttcccagctctccctc

SEQ ID NO: 4513650 - DNA, 23 bp, Homo sapiens
ttcccagctctccctctggccct

SEQ ID NO: 4513651 - DNA, 21 bp, Homo sapiens
ttcccaggagatgggtccagg

SEQ ID NO: 4513652 - DNA, 21 bp, Homo sapiens
ttcccaggatctgctccaaca

SEQ ID NO: 4513653 - DNA, 11 bp, Homo sapiens
ttcccagggca

SEQ ID NO: 4513654 - DNA, 16 bp, Homo sapiens
ttcccagggctggaga

SEQ ID NO: 4513655 - DNA, 20 bp, Homo sapiens
ttcccagggtagcccgcctg

SEQ ID NO: 4513656 - DNA, 19 bp, Homo sapiens
ttcccaggtaatttaaatt

SEQ ID NO: 4513657 - DNA, 23 bp, Homo sapiens
ttcccatcactggagcaccaggc

SEQ ID NO: 4513658 - DNA, 14 bp, Homo sapiens
ttcccatctgcacc

SEQ ID NO: 4513659 - DNA, 17 bp, Homo sapiens
ttcccatgtcccaccct

SEQ ID NO: 4513660 - DNA, 13 bp, Homo sapiens
ttcccattaaaaa

SEQ ID NO: 4513661 - DNA, 14 bp, Homo sapiens
ttcccatttcagct

SEQ ID NO: 4513662 - DNA, 13 bp, Homo sapiens
ttcccatttcttc

SEQ ID NO: 4513663 - DNA, 14 bp, Homo sapiens
ttcccatttcttcc

SEQ ID NO: 4513664 - DNA, 14 bp, Homo sapiens
ttccccactccccc

SEQ ID NO: 4513665 - DNA, 20 bp, Homo sapiens
ttccccagacccagaggtcc

SEQ ID NO: 4513666 - DNA, 12 bp, Homo sapiens
ttccccagccac

SEQ ID NO: 4513667 - DNA, 13 bp, Homo sapiens
ttccccagccaca

SEQ ID NO: 4513668 - DNA, 22 bp, Homo sapiens
ttccccatcccaaggcaagcat

SEQ ID NO: 4513669 - DNA, 17 bp, Homo sapiens
ttccccatcttctaaac

SEQ ID NO: 4513670 - DNA, 21 bp, Homo sapiens
ttccccgatgtcccctgcggg

SEQ ID NO: 4513671 - DNA, 17 bp, Homo sapiens
ttccccggtcccttgag

SEQ ID NO: 4513672 - DNA, 16 bp, Homo sapiens
ttcccctccctggctc

SEQ ID NO: 4513673 - DNA, 19 bp, Homo sapiens
ttccccttagaaacactgc

SEQ ID NO: 4513674 - DNA, 21 bp, Homo sapiens
ttccccttccactgagggcag

SEQ ID NO: 4513675 - DNA, 14 bp, Homo sapiens
ttccccttccctta

SEQ ID NO: 4513676 - DNA, 15 bp, Homo sapiens
ttccccttcccttat

SEQ ID NO: 4513677 - DNA, 12 bp, Homo sapiens
ttcccgcctccc

SEQ ID NO: 4513678 - DNA, 21 bp, Homo sapiens
ttcccgggagctgggccctgc

SEQ ID NO: 4513679 - DNA, 23 bp, Homo sapiens
ttcccgggagctgggccctgcct

SEQ ID NO: 4513680 - DNA, 17 bp, Homo sapiens
ttcccgtgcctgggaga

SEQ ID NO: 4513681 - DNA, 23 bp, Homo sapiens
ttcccgtggaacgtttttcctgt

SEQ ID NO: 4513682 - DNA, 15 bp, Homo sapiens
ttccctacctcaggc

SEQ ID NO: 4513683 - DNA, 13 bp, Homo sapiens
ttccctcaccccc

SEQ ID NO: 4513684 - DNA, 18 bp, Homo sapiens
ttccctcaccccctccca

SEQ ID NO: 4513685 - DNA, 12 bp, Homo sapiens
ttccctccattt

SEQ ID NO: 4513686 - DNA, 23 bp, Homo sapiens
ttccctccatttttctcccaaga

SEQ ID NO: 4513687 - DNA, 19 bp, Homo sapiens
ttccctcccagaggagcca

SEQ ID NO: 4513688 - DNA, 13 bp, Homo sapiens
ttccctccccaga

SEQ ID NO: 4513689 - DNA, 15 bp, Homo sapiens
ttccctccccagaat

SEQ ID NO: 4513690 - DNA, 11 bp, Homo sapiens
ttccctccccc

SEQ ID NO: 4513691 - DNA, 13 bp, Homo sapiens
ttccctccccctc

SEQ ID NO: 4513692 - DNA, 22 bp, Homo sapiens
ttccctccccctccttgtgcct

SEQ ID NO: 4513693 - DNA, 21 bp, Homo sapiens
ttccctctctcataccctccc

SEQ ID NO: 4513694 - DNA, 23 bp, Homo sapiens
ttccctctctccctgcctcactc

SEQ ID NO: 4513695 - DNA, 12 bp, Homo sapiens
ttccctctctga

SEQ ID NO: 4513696 - DNA, 21 bp, Homo sapiens
ttccctctctgatgtcccagt

SEQ ID NO: 4513697 - DNA, 22 bp, Homo sapiens
ttccctctctgatgtcccagtg

SEQ ID NO: 4513698 - DNA, 16 bp, Homo sapiens
ttccctctgctgcttt

SEQ ID NO: 4513699 - DNA, 19 bp, Homo sapiens
ttccctgaaaacccagaga

SEQ ID NO: 4513700 - DNA, 16 bp, Homo sapiens
ttccctgagtcaccag

SEQ ID NO: 4513701 - DNA, 11 bp, Homo sapiens
ttccctgcaga

SEQ ID NO: 4513702 - DNA, 16 bp, Homo sapiens
ttccctgcagacctca

SEQ ID NO: 4513703 - DNA, 12 bp, Homo sapiens
ttccctgcccaa

SEQ ID NO: 4513704 - DNA, 23 bp, Homo sapiens
ttccctgcctctcatcaactgaa

SEQ ID NO: 4513705 - DNA, 15 bp, Homo sapiens
ttccctgcttccagg

SEQ ID NO: 4513706 - DNA, 19 bp, Homo sapiens
ttccctggaactcctggcc

SEQ ID NO: 4513707 - DNA, 15 bp, Homo sapiens
ttccctgtcagcctg

SEQ ID NO: 4513708 - DNA, 15 bp, Homo sapiens
ttccctgttctccct

SEQ ID NO: 4513709 - DNA, 12 bp, Homo sapiens
ttcccttgacca

SEQ ID NO: 4513710 - DNA, 13 bp, Homo sapiens
ttcccttgaccat

SEQ ID NO: 4513711 - DNA, 22 bp, Homo sapiens
ttcccttgcaggggtcccccct

SEQ ID NO: 4513712 - DNA, 14 bp, Homo sapiens
ttcccttggcctca

SEQ ID NO: 4513713 - DNA, 19 bp, Homo sapiens
ttcccttgtagaaagtgag

SEQ ID NO: 4513714 - DNA, 23 bp, Homo sapiens
ttcccttgtgtcaagacatttct

SEQ ID NO: 4513715 - DNA, 21 bp, Homo sapiens
ttccctttagcacgtttaaag

SEQ ID NO: 4513716 - DNA, 23 bp, Homo sapiens
ttccctttagcacgtttaaagtt

SEQ ID NO: 4513717 - DNA, 14 bp, Homo sapiens
ttccctttgtcttt

SEQ ID NO: 4513718 - DNA, 12 bp, Homo sapiens
ttccctttgtga

SEQ ID NO: 4513719 - DNA, 15 bp, Homo sapiens
ttccctttgtgtatc

SEQ ID NO: 4513720 - DNA, 20 bp, Homo sapiens
ttccctttgtgtatcttacc

SEQ ID NO: 4513721 - DNA, 16 bp, Homo sapiens
ttccgacatcccagac

SEQ ID NO: 4513722 - DNA, 22 bp, Homo sapiens
ttccgacatcccagaccagcca

SEQ ID NO: 4513723 - DNA, 22 bp, Homo sapiens
ttccgactctttctgagtgcct

SEQ ID NO: 4513724 - DNA, 15 bp, Homo sapiens
ttccgactgcccaga

SEQ ID NO: 4513725 - DNA, 16 bp, Homo sapiens
ttccgactgcccagaa

SEQ ID NO: 4513726 - DNA, 12 bp, Homo sapiens
ttccgctgaggg

SEQ ID NO: 4513727 - DNA, 22 bp, Homo sapiens
ttccgctgtcgccccaggccct

SEQ ID NO: 4513728 - DNA, 19 bp, Homo sapiens
ttccgtggtcagagtgcca

SEQ ID NO: 4513729 - DNA, 18 bp, Homo sapiens
ttccgtgtggccctttgg

SEQ ID NO: 4513730 - DNA, 14 bp, Homo sapiens
ttcctaaaacaccc

SEQ ID NO: 4513731 - DNA, 15 bp, Homo sapiens
ttcctaactgtgatt

SEQ ID NO: 4513732 - DNA, 18 bp, Homo sapiens
ttcctaagacatttttca

SEQ ID NO: 4513733 - DNA, 19 bp, Homo sapiens
ttcctaataaagttctgta

SEQ ID NO: 4513734 - DNA, 16 bp, Homo sapiens
ttcctaatatcaaatg

SEQ ID NO: 4513735 - DNA, 19 bp, Homo sapiens
ttcctaatatcaaatgcag

SEQ ID NO: 4513736 - DNA, 14 bp, Homo sapiens
ttcctacaaagacg

SEQ ID NO: 4513737 - DNA, 20 bp, Homo sapiens
ttcctacaagagcagcctgt

SEQ ID NO: 4513738 - DNA, 23 bp, Homo sapiens
ttcctacaagagcagcctgtggc

SEQ ID NO: 4513739 - DNA, 17 bp, Homo sapiens
ttcctacaggcagtctc

SEQ ID NO: 4513740 - DNA, 20 bp, Homo sapiens
ttcctacaggcagtctctct

SEQ ID NO: 4513741 - DNA, 19 bp, Homo sapiens
ttcctaccaagtcaaactt

SEQ ID NO: 4513742 - DNA, 16 bp, Homo sapiens
ttcctaccctgcctcc

SEQ ID NO: 4513743 - DNA, 17 bp, Homo sapiens
ttcctagattacatctg

SEQ ID NO: 4513744 - DNA, 22 bp, Homo sapiens
ttcctagattacatctgcctta

SEQ ID NO: 4513745 - DNA, 16 bp, Homo sapiens
ttcctagctgttctaa

SEQ ID NO: 4513746 - DNA, 14 bp, Homo sapiens
ttcctagtctttcc

SEQ ID NO: 4513747 - DNA, 19 bp, Homo sapiens
ttcctatacgcagcgtgct

SEQ ID NO: 4513748 - DNA, 15 bp, Homo sapiens
ttcctatcatgttaa

SEQ ID NO: 4513749 - DNA, 18 bp, Homo sapiens
ttcctatgctattgacaa

SEQ ID NO: 4513750 - DNA, 16 bp, Homo sapiens
ttcctcaaaaagcaga

SEQ ID NO: 4513751 - DNA, 20 bp, Homo sapiens
ttcctcaaaataaagaagta

SEQ ID NO: 4513752 - DNA, 18 bp, Homo sapiens
ttcctcaaatcaaaaaca

SEQ ID NO: 4513753 - DNA, 22 bp, Homo sapiens
ttcctcagcaggttggcttttt

SEQ ID NO: 4513754 - DNA, 12 bp, Homo sapiens
ttcattctcata

SEQ ID NO: 4513755 - DNA, 18 bp, Homo sapiens
ttcattctgccaaagtaa

SEQ ID NO: 4513756 - DNA, 19 bp, Homo sapiens
ttcattctttttgaaatgt

SEQ ID NO: 4513757 - DNA, 16 bp, Homo sapiens
ttcattgcaattaaac

SEQ ID NO: 4513758 - DNA, 15 bp, Homo sapiens
ttcattgccagtgtc

SEQ ID NO: 4513759 - DNA, 16 bp, Homo sapiens
ttcattgccagtgtct

SEQ ID NO: 4513760 - DNA, 17 bp, Homo sapiens
ttcattgccagtgtctt

SEQ ID NO: 4513761 - DNA, 19 bp, Homo sapiens
ttcattgccagtgtctttc

SEQ ID NO: 4513762 - DNA, 12 bp, Homo sapiens
ttcattgtacaa

SEQ ID NO: 4513763 - DNA, 21 bp, Homo sapiens
ttcatttagctaaacggattc

SEQ ID NO: 4513764 - DNA, 17 bp, Homo sapiens
ttcatttatctataatt

SEQ ID NO: 4513765 - DNA, 15 bp, Homo sapiens
ttcatttcacatttt

SEQ ID NO: 4513766 - DNA, 18 bp, Homo sapiens
ttcatttcacatttttgt

SEQ ID NO: 4513767 - DNA, 15 bp, Homo sapiens
ttcatttcatttcag

SEQ ID NO: 4513768 - DNA, 21 bp, Homo sapiens
ttcatttcctagctgttctaa

SEQ ID NO: 4513769 - DNA, 15 bp, Homo sapiens
ttcatttctaattaa

SEQ ID NO: 4513770 - DNA, 14 bp, Homo sapiens
ttcatttctagact

SEQ ID NO: 4513771 - DNA, 16 bp, Homo sapiens
ttcatttgcacaagta

SEQ ID NO: 4513772 - DNA, 19 bp, Homo sapiens
ttcatttgctgttcatctt

SEQ ID NO: 4513773 - DNA, 15 bp, Homo sapiens
ttcattttaaaaagt

SEQ ID NO: 4513774 - DNA, 16 bp, Homo sapiens
ttcattttaaaaagtc

SEQ ID NO: 4513775 - DNA, 15 bp, Homo sapiens
ttcattttagattaa

SEQ ID NO: 4513776 - DNA, 23 bp, Homo sapiens
ttcattttagtccagatttttag

SEQ ID NO: 4513777 - DNA, 18 bp, Homo sapiens
ttcattttatatttaaaa

SEQ ID NO: 4513778 - DNA, 22 bp, Homo sapiens
ttcattttctagatacaataaa

SEQ ID NO: 4513779 - DNA, 13 bp, Homo sapiens
ttcattttgaaaa

SEQ ID NO: 4513780 - DNA, 19 bp, Homo sapiens
ttcattttgttttgctctg

SEQ ID NO: 4513781 - DNA, 23 bp, Homo sapiens
ttcatttttgatagctgtcccat

SEQ ID NO: 4513782 - DNA, 18 bp, Homo sapiens
ttcattttttttaattga

SEQ ID NO: 4513783 - DNA, 14 bp, Homo sapiens
ttccaaaacaaaaa

SEQ ID NO: 4513784 - DNA, 22 bp, Homo sapiens
ttccaaaacatttctggacagt

SEQ ID NO: 4513785 - DNA, 16 bp, Homo sapiens
ttccaaaatccaaaaa

SEQ ID NO: 4513786 - DNA, 19 bp, Homo sapiens
ttccaaaatctcccatttt

SEQ ID NO: 4513787 - DNA, 16 bp, Homo sapiens
ttccaaacctggttca

SEQ ID NO: 4513788 - DNA, 17 bp, Homo sapiens
ttccaaacctggttcat

SEQ ID NO: 4513789 - DNA, 14 bp, Homo sapiens
ttccaaagaaagtt

SEQ ID NO: 4513790 - DNA, 16 bp, Homo sapiens
ttccaaagaatatttt

SEQ ID NO: 4513791 - DNA, 11 bp, Homo sapiens
ttccaaagcaa

SEQ ID NO: 4513792 - DNA, 15 bp, Homo sapiens
ttccaaataaaatgt

SEQ ID NO: 4513793 - DNA, 13 bp, Homo sapiens
ttccaaatccaaa

SEQ ID NO: 4513794 - DNA, 17 bp, Homo sapiens
ttccaaatcctggaagg

SEQ ID NO: 4513795 - DNA, 22 bp, Homo sapiens
ttccaaatcctggaaggacaca

SEQ ID NO: 4513796 - DNA, 18 bp, Homo sapiens
ttccaaattatttcttaa

SEQ ID NO: 4513797 - DNA, 23 bp, Homo sapiens
ttccaaattatttcttaattatt

SEQ ID NO: 4513798 - DNA, 19 bp, Homo sapiens
ttccaaattcagtttcata

SEQ ID NO: 4513799 - DNA, 17 bp, Homo sapiens
ttccaacttcctgtggc

SEQ ID NO: 4513800 - DNA, 19 bp, Homo sapiens
ttccaagcaaaatctaaaa

SEQ ID NO: 4513801 - DNA, 21 bp, Homo sapiens
ttccaagcaaaatctaaaatg

SEQ ID NO: 4513802 - DNA, 20 bp, Homo sapiens
ttccaagtcatttttgtttt

SEQ ID NO: 4513803 - DNA, 15 bp, Homo sapiens
ttccaatagaaagaa

SEQ ID NO: 4513804 - DNA, 17 bp, Homo sapiens
ttccaatagaaagaaac

SEQ ID NO: 4513805 - DNA, 16 bp, Homo sapiens
ttccacaaaattagaa

SEQ ID NO: 4513806 - DNA, 22 bp, Homo sapiens
ttccacaaaattagaaaggaca

SEQ ID NO: 4513807 - DNA, 14 bp, Homo sapiens
ttccacaaagaaaa

SEQ ID NO: 4513808 - DNA, 15 bp, Homo sapiens
ttccacaccttttat

SEQ ID NO: 4513809 - DNA, 16 bp, Homo sapiens
ttccacacgcattaat

SEQ ID NO: 4513810 - DNA, 22 bp, Homo sapiens
ttccacagcagtgtcacagacg

SEQ ID NO: 4513811 - DNA, 10 bp, Homo sapiens
ttccacagtg

SEQ ID NO: 4513812 - DNA, 15 bp, Homo sapiens
ttccacataaatttt

SEQ ID NO: 4513813 - DNA, 15 bp, Homo sapiens
ttccacatgttactg

SEQ ID NO: 4513814 - DNA, 17 bp, Homo sapiens
ttccacctggaaactgc

SEQ ID NO: 4513815 - DNA, 18 bp, Homo sapiens
ttccactaaaaatattgt

SEQ ID NO: 4513816 - DNA, 15 bp, Homo sapiens
ttccactacacctgg

SEQ ID NO: 4513817 - DNA, 18 bp, Homo sapiens
ttccactacacctggctg

SEQ ID NO: 4513818 - DNA, 17 bp, Homo sapiens
ttccactccttccagaa

SEQ ID NO: 4513819 - DNA, 19 bp, Homo sapiens
ttccactcgtgtgtttcta

SEQ ID NO: 4513820 - DNA, 13 bp, Homo sapiens
ttccactgcttct

SEQ ID NO: 4513821 - DNA, 22 bp, Homo sapiens
ttccactgtgcaggttcccact

SEQ ID NO: 4513822 - DNA, 16 bp, Homo sapiens
ttccagaacaaattgt

SEQ ID NO: 4513823 - DNA, 17 bp, Homo sapiens
ttccagaacaaattgtt

SEQ ID NO: 4513824 - DNA, 15 bp, Homo sapiens
ttccagaacactctt

SEQ ID NO: 4513825 - DNA, 16 bp, Homo sapiens
ttccagaacagccctc

SEQ ID NO: 4513826 - DNA, 18 bp, Homo sapiens
ttccagaatgctgtacat

SEQ ID NO: 4513827 - DNA, 20 bp, Homo sapiens
ttccagactcaggttccaga

SEQ ID NO: 4513828 - DNA, 15 bp, Homo sapiens
ttccagagcccaagg

SEQ ID NO: 4513829 - DNA, 15 bp, Homo sapiens
ttccagagttgttgt

SEQ ID NO: 4513830 - DNA, 15 bp, Homo sapiens
ttccagatcccaggc

SEQ ID NO: 4513831 - DNA, 18 bp, Homo sapiens
ttccagatcctctctggg

SEQ ID NO: 4513832 - DNA, 18 bp, Homo sapiens
ttccagccaaagcatgcc

SEQ ID NO: 4513833 - DNA, 19 bp, Homo sapiens
ttccagcctatagcagaag

SEQ ID NO: 4513834 - DNA, 17 bp, Homo sapiens
ttccagccttatgtgtt

SEQ ID NO: 4513835 - DNA, 15 bp, Homo sapiens
ttccagctctgcccc

SEQ ID NO: 4513836 - DNA, 21 bp, Homo sapiens
ttccagctctgcccccgcggg

SEQ ID NO: 4513837 - DNA, 22 bp, Homo sapiens
ttccaggaaactccacatctgc

SEQ ID NO: 4513838 - DNA, 17 bp, Homo sapiens
ttccaggagttctgaag

SEQ ID NO: 4513839 - DNA, 16 bp, Homo sapiens
ttccaggcaccctcag

SEQ ID NO: 4513840 - DNA, 21 bp, Homo sapiens
ttccaggcaccctcagggagc

SEQ ID NO: 4513841 - DNA, 13 bp, Homo sapiens
ttccaggccctcc

SEQ ID NO: 4513842 - DNA, 16 bp, Homo sapiens
ttccaggccctccagt

SEQ ID NO: 4513843 - DNA, 17 bp, Homo sapiens
ttccaggccctccagtg

SEQ ID NO: 4513844 - DNA, 14 bp, Homo sapiens
ttccaggctgagag

SEQ ID NO: 4513845 - DNA, 18 bp, Homo sapiens
ttccagggctcttccaga

SEQ ID NO: 4513846 - DNA, 18 bp, Homo sapiens
ttccaggtctgcctggtt

SEQ ID NO: 4513847 - DNA, 17 bp, Homo sapiens
ttccagtcacattgcca

SEQ ID NO: 4513848 - DNA, 20 bp, Homo sapiens
ttccataaatttggactgtc

SEQ ID NO: 4513849 - DNA, 16 bp, Homo sapiens
ttccatactgtttgcc

SEQ ID NO: 4513850 - DNA, 21 bp, Homo sapiens
ttccatagtgttaactgtcag

SEQ ID NO: 4513851 - DNA, 22 bp, Homo sapiens
ttccatagtttaggtactcaaa

SEQ ID NO: 4513852 - DNA, 13 bp, Homo sapiens
ttccatcatcact

SEQ ID NO: 4513853 - DNA, 19 bp, Homo sapiens
ttccatccacctttcccaa

SEQ ID NO: 4513854 - DNA, 16 bp, Homo sapiens
ttccatctcttccttc

SEQ ID NO: 4513855 - DNA, 13 bp, Homo sapiens
ttccatctttaca

SEQ ID NO: 4513856 - DNA, 21 bp, Homo sapiens
ttccatgagttatcatgaatt

SEQ ID NO: 4513857 - DNA, 18 bp, Homo sapiens
ttccatgattctatttat

SEQ ID NO: 4513858 - DNA, 14 bp, Homo sapiens
ttccatgcaactgg

SEQ ID NO: 4513859 - DNA, 18 bp, Homo sapiens
ttccatgcgtgtttctga

SEQ ID NO: 4513860 - DNA, 16 bp, Homo sapiens
ttccatgctaagcaag

SEQ ID NO: 4513861 - DNA, 15 bp, Homo sapiens
ttccatgtcggcctc

SEQ ID NO: 4513862 - DNA, 16 bp, Homo sapiens
ttccatgtcggcctct

SEQ ID NO: 4513863 - DNA, 14 bp, Homo sapiens
ttccatgtgccttt

SEQ ID NO: 4513864 - DNA, 16 bp, Homo sapiens
ttccatgttctgggtg

SEQ ID NO: 4513865 - DNA, 23 bp, Homo sapiens
ttccattaactatttttttcaaa

SEQ ID NO: 4513866 - DNA, 20 bp, Homo sapiens
ttccattatgaaaatcttat

SEQ ID NO: 4513867 - DNA, 15 bp, Homo sapiens
ttccattccatctag

SEQ ID NO: 4513868 - DNA, 16 bp, Homo sapiens
ttccattggatctcat

SEQ ID NO: 4513869 - DNA, 17 bp, Homo sapiens
ttccattggatctcatt

SEQ ID NO: 4513870 - DNA, 20 bp, Homo sapiens
ttccattgtagtggcctgtg

SEQ ID NO: 4513871 - DNA, 17 bp, Homo sapiens
ttccatttgcaagggaa

SEQ ID NO: 4513872 - DNA, 19 bp, Homo sapiens
ttcccaaaatgttgaaata

SEQ ID NO: 4513873 - DNA, 12 bp, Homo sapiens
ttcccaaatttc

SEQ ID NO: 4513874 - DNA, 14 bp, Homo sapiens
ttcccaattcacat

SEQ ID NO: 4513875 - DNA, 20 bp, Homo sapiens
ttctgtagtttttaattaaa

SEQ ID NO: 4513876 - DNA, 21 bp, Homo sapiens
ttctgtagtttttaattaaaa

SEQ ID NO: 4513877 - DNA, 20 bp, Homo sapiens
ttctgtatttttttttctaa

SEQ ID NO: 4513878 - DNA, 22 bp, Homo sapiens
ttctgtatttttttttctaaga

SEQ ID NO: 4513879 - DNA, 16 bp, Homo sapiens
ttctgtcccctcttcc

SEQ ID NO: 4513880 - DNA, 11 bp, Homo sapiens
ttctgtctcca

SEQ ID NO: 4513881 - DNA, 12 bp, Homo sapiens
ttctgtcttgtc

SEQ ID NO: 4513882 - DNA, 13 bp, Homo sapiens
ttctgtgaaagaa

SEQ ID NO: 4513883 - DNA, 14 bp, Homo sapiens
ttctgtgcctcccc

SEQ ID NO: 4513884 - DNA, 21 bp, Homo sapiens
ttctgtgcctccccccagacc

SEQ ID NO: 4513885 - DNA, 14 bp, Homo sapiens
ttctgtggctggct

SEQ ID NO: 4513886 - DNA, 16 bp, Homo sapiens
ttctgtggttcctctg

SEQ ID NO: 4513887 - DNA, 16 bp, Homo sapiens
ttctgtgtattaacat

SEQ ID NO: 4513888 - DNA, 16 bp, Homo sapiens
ttctgtgtatttaatt

SEQ ID NO: 4513889 - DNA, 22 bp, Homo sapiens
ttctgtgtatttaattgtaaac

SEQ ID NO: 4513890 - DNA, 23 bp, Homo sapiens
ttctgtgtatttaattgtaaact

SEQ ID NO: 4513891 - DNA, 23 bp, Homo sapiens
ttctgtgtcagagcccagcccag

SEQ ID NO: 4513892 - DNA, 15 bp, Homo sapiens
ttctgtgttttcaga

SEQ ID NO: 4513893 - DNA, 23 bp, Homo sapiens
ttctgttaggggccaataaaatg

SEQ ID NO: 4513894 - DNA, 19 bp, Homo sapiens
ttctgttccaaattcagtt

SEQ ID NO: 4513895 - DNA, 17 bp, Homo sapiens
ttctgttctgcaactcc

SEQ ID NO: 4513896 - DNA, 19 bp, Homo sapiens
ttctgttgaaaagcacaca

SEQ ID NO: 4513897 - DNA, 14 bp, Homo sapiens
ttctgtttctagtt

SEQ ID NO: 4513898 - DNA, 15 bp, Homo sapiens
ttctgtttctagttg

SEQ ID NO: 4513899 - DNA, 17 bp, Homo sapiens
ttctgttttcttctcag

SEQ ID NO: 4513900 - DNA, 22 bp, Homo sapiens
ttctgttttcttctcagtcttt

SEQ ID NO: 4513901 - DNA, 13 bp, Homo sapiens
ttctgtttttaat

SEQ ID NO: 4513902 - DNA, 20 bp, Homo sapiens
ttcttaaaagaaatcttgct

SEQ ID NO: 4513903 - DNA, 23 bp, Homo sapiens
ttcttaaaatgcaatatttgtaa

SEQ ID NO: 4513904 - DNA, 11 bp, Homo sapiens
ttcttaaataa

SEQ ID NO: 4513905 - DNA, 18 bp, Homo sapiens
ttcttaaataagaaactt

SEQ ID NO: 4513906 - DNA, 19 bp, Homo sapiens
ttcttaaataagaaacttt

SEQ ID NO: 4513907 - DNA, 12 bp, Homo sapiens
ttcttaaattat

SEQ ID NO: 4513908 - DNA, 14 bp, Homo sapiens
ttcttaagaattca

SEQ ID NO: 4513909 - DNA, 23 bp, Homo sapiens
ttcttaagacgtgattttgctgt

SEQ ID NO: 4513910 - DNA, 19 bp, Homo sapiens
ttcttaattattataaaaa

SEQ ID NO: 4513911 - DNA, 20 bp, Homo sapiens
ttcttaattattataaaaat

SEQ ID NO: 4513912 - DNA, 19 bp, Homo sapiens
ttcttaattcatgaggagg

SEQ ID NO: 4513913 - DNA, 19 bp, Homo sapiens
ttcttacaagcttaaagct

SEQ ID NO: 4513914 - DNA, 22 bp, Homo sapiens
ttcttacaataaaccctccttg

SEQ ID NO: 4513915 - DNA, 14 bp, Homo sapiens
ttcttacttttatt

SEQ ID NO: 4513916 - DNA, 20 bp, Homo sapiens
ttcttagaacagtggaaact

SEQ ID NO: 4513917 - DNA, 13 bp, Homo sapiens
ttcttagagtttt

SEQ ID NO: 4513918 - DNA, 18 bp, Homo sapiens
ttcttagcctgtggcagt

SEQ ID NO: 4513919 - DNA, 22 bp, Homo sapiens
ttcttagtgttggtttaatatt

SEQ ID NO: 4513920 - DNA, 14 bp, Homo sapiens
ttcttagttgctgt

SEQ ID NO: 4513921 - DNA, 20 bp, Homo sapiens
ttcttatacagataaaacat

SEQ ID NO: 4513922 - DNA, 21 bp, Homo sapiens
ttcttatacagataaaacatg

SEQ ID NO: 4513923 - DNA, 14 bp, Homo sapiens
ttcttatcacataa

SEQ ID NO: 4513924 - DNA, 14 bp, Homo sapiens
ttcttatgaggagg

SEQ ID NO: 4513925 - DNA, 18 bp, Homo sapiens
ttcttatggggtgagaat

SEQ ID NO: 4513926 - DNA, 12 bp, Homo sapiens
ttcttattttag

SEQ ID NO: 4513927 - DNA, 17 bp, Homo sapiens
ttcttatttttgtactt

SEQ ID NO: 4513928 - DNA, 21 bp, Homo sapiens
ttcttcaaaaggtaaatacaa

SEQ ID NO: 4513929 - DNA, 18 bp, Homo sapiens
ttcttcactcaaattttg

SEQ ID NO: 4513930 - DNA, 17 bp, Homo sapiens
ttcttcagatcagtgct

SEQ ID NO: 4513931 - DNA, 12 bp, Homo sapiens
ttcttcagattg

SEQ ID NO: 4513932 - DNA, 16 bp, Homo sapiens
ttcttcaggtaacact

SEQ ID NO: 4513933 - DNA, 17 bp, Homo sapiens
ttcttcaggtaacacta

SEQ ID NO: 4513934 - DNA, 19 bp, Homo sapiens
ttcttcaggtaacactaca

SEQ ID NO: 4513935 - DNA, 13 bp, Homo sapiens
ttcttcagttggt

SEQ ID NO: 4513936 - DNA, 21 bp, Homo sapiens
ttcttcatccatagacacagt

SEQ ID NO: 4513937 - DNA, 16 bp, Homo sapiens
ttcttcatttctctgc

SEQ ID NO: 4513938 - DNA, 23 bp, Homo sapiens
ttcttccatcatcactgtaaaga

SEQ ID NO: 4513939 - DNA, 19 bp, Homo sapiens
ttcttcccatcactggagc

SEQ ID NO: 4513940 - DNA, 21 bp, Homo sapiens
ttcttccctgctttgcatctt

SEQ ID NO: 4513941 - DNA, 15 bp, Homo sapiens
ttcttccctgtcagc

SEQ ID NO: 4513942 - DNA, 18 bp, Homo sapiens
ttcttcctaccaagtcaa

SEQ ID NO: 4513943 - DNA, 14 bp, Homo sapiens
ttcttcctgtgaag

SEQ ID NO: 4513944 - DNA, 20 bp, Homo sapiens
ttcttccttccctcctttta

SEQ ID NO: 4513945 - DNA, 19 bp, Homo sapiens
ttcttcctttgaagcttta

SEQ ID NO: 4513946 - DNA, 23 bp, Homo sapiens
ttcttcgctggactattgtgcca

SEQ ID NO: 4513947 - DNA, 16 bp, Homo sapiens
ttcttctaagaagaca

SEQ ID NO: 4513948 - DNA, 17 bp, Homo sapiens
ttcttctaagaagacat

SEQ ID NO: 4513949 - DNA, 19 bp, Homo sapiens
ttcttctaagaagacattt

SEQ ID NO: 4513950 - DNA, 20 bp, Homo sapiens
ttcttctattaatcaagaga

SEQ ID NO: 4513951 - DNA, 14 bp, Homo sapiens
ttcttctggtgcta

SEQ ID NO: 4513952 - DNA, 23 bp, Homo sapiens
ttcttctggtgctactccatgca

SEQ ID NO: 4513953 - DNA, 13 bp, Homo sapiens
ttcttctgtaata

SEQ ID NO: 4513954 - DNA, 23 bp, Homo sapiens
ttcttctgtaatatttacaatgt

SEQ ID NO: 4513955 - DNA, 14 bp, Homo sapiens
ttcttcttgggccc

SEQ ID NO: 4513956 - DNA, 17 bp, Homo sapiens
ttcttgaatataaaaaa

SEQ ID NO: 4513957 - DNA, 20 bp, Homo sapiens
ttcttgacaatcatctccaa

SEQ ID NO: 4513958 - DNA, 21 bp, Homo sapiens
ttcttgatcaacatcttttct

SEQ ID NO: 4513959 - DNA, 21 bp, Homo sapiens
ttcttgatgtcactatttgtt

SEQ ID NO: 4513960 - DNA, 22 bp, Homo sapiens
ttcttgcaagggaagagccttt

SEQ ID NO: 4513961 - DNA, 20 bp, Homo sapiens
ttcttgccatcactggtcca

SEQ ID NO: 4513962 - DNA, 20 bp, Homo sapiens
ttcttgcctctgtccccttc

SEQ ID NO: 4513963 - DNA, 13 bp, Homo sapiens
ttcttgctagcta

SEQ ID NO: 4513964 - DNA, 23 bp, Homo sapiens
ttcttgctttctctctcatgcct

SEQ ID NO: 4513965 - DNA, 22 bp, Homo sapiens
ttcttgggggaggccaccccaa

SEQ ID NO: 4513966 - DNA, 20 bp, Homo sapiens
ttcttggtgtttgactgtaa

SEQ ID NO: 4513967 - DNA, 16 bp, Homo sapiens
ttcttggttgttaatt

SEQ ID NO: 4513968 - DNA, 14 bp, Homo sapiens
ttcttgtaaatctt

SEQ ID NO: 4513969 - DNA, 20 bp, Homo sapiens
ttcttgtaaatctttttgct

SEQ ID NO: 4513970 - DNA, 12 bp, Homo sapiens
ttcttgtatctg

SEQ ID NO: 4513971 - DNA, 16 bp, Homo sapiens
ttcttgtcttttcaga

SEQ ID NO: 4513972 - DNA, 19 bp, Homo sapiens
ttcttgtgtagatttgaaa

SEQ ID NO: 4513973 - DNA, 20 bp, Homo sapiens
ttcttgtgttttactgtcag

SEQ ID NO: 4513974 - DNA, 13 bp, Homo sapiens
ttcttgtttgaat

SEQ ID NO: 4513975 - DNA, 23 bp, Homo sapiens
ttctttaaaaaacaactatggat

SEQ ID NO: 4513976 - DNA, 18 bp, Homo sapiens
ttctttaaaagaatgact

SEQ ID NO: 4513977 - DNA, 12 bp, Homo sapiens
ttctttagtctt

SEQ ID NO: 4513978 - DNA, 12 bp, Homo sapiens
ttctttccagaa

SEQ ID NO: 4513979 - DNA, 16 bp, Homo sapiens
ttctttcccagtgagt

SEQ ID NO: 4513980 - DNA, 15 bp, Homo sapiens
ttctttcctgccctg

SEQ ID NO: 4513981 - DNA, 18 bp, Homo sapiens
ttctttctcacccaggca

SEQ ID NO: 4513982 - DNA, 12 bp, Homo sapiens
ttctttctctaa

SEQ ID NO: 4513983 - DNA, 12 bp, Homo sapiens
ttctttctggac

SEQ ID NO: 4513984 - DNA, 14 bp, Homo sapiens
ttctttctggactg

SEQ ID NO: 4513985 - DNA, 15 bp, Homo sapiens
ttctttctggactgg

SEQ ID NO: 4513986 - DNA, 9 bp, Homo sapiens
ttctttctt

SEQ ID NO: 4513987 - DNA, 13 bp, Homo sapiens
ttctttcttcctc

SEQ ID NO: 4513988 - DNA, 12 bp, Homo sapiens
ttctttgcaaag

SEQ ID NO: 4513989 - DNA, 14 bp, Homo sapiens
ttctttgcaccaaa

SEQ ID NO: 4513990 - DNA, 21 bp, Homo sapiens
ttctttgcaccaaagacatca

SEQ ID NO: 4513991 - DNA, 13 bp, Homo sapiens
ttctttgctgccc

SEQ ID NO: 4513992 - DNA, 20 bp, Homo sapiens
ttctttggaaagtacactct

SEQ ID NO: 4513993 - DNA, 20 bp, Homo sapiens
ttctttggagttaaaatgca

SEQ ID NO: 4513994 - DNA, 14 bp, Homo sapiens
ttctttggtgcctt

SEQ ID NO: 4513995 - DNA, 23 bp, Homo sapiens
ttctctcatctcttagctcccct

SEQ ID NO: 4513996 - DNA, 19 bp, Homo sapiens
ttctctccagctgactaaa

SEQ ID NO: 4513997 - DNA, 19 bp, Homo sapiens
ttctctcccctcctctgaa

SEQ ID NO: 4513998 - DNA, 19 bp, Homo sapiens
ttctctcccttcctctctc

SEQ ID NO: 4513999 - DNA, 21 bp, Homo sapiens
ttctctcccttcctctctcct

SEQ ID NO: 4514000 - DNA, 12 bp, Homo sapiens
ttctctcctccc

SEQ ID NO: 4514001 - DNA, 17 bp, Homo sapiens
ttctctcctccccaaat

SEQ ID NO: 4514002 - DNA, 19 bp, Homo sapiens
ttctctcctgtcctccctc

SEQ ID NO: 4514003 - DNA, 21 bp, Homo sapiens
ttctctcctgtcctccctcac

SEQ ID NO: 4514004 - DNA, 18 bp, Homo sapiens
ttctctctcatgcctcct

SEQ ID NO: 4514005 - DNA, 16 bp, Homo sapiens
ttctctctcctgtcca

SEQ ID NO: 4514006 - DNA, 11 bp, Homo sapiens
ttctctctttt

SEQ ID NO: 4514007 - DNA, 17 bp, Homo sapiens
ttctctgcaattttact

SEQ ID NO: 4514008 - DNA, 11 bp, Homo sapiens
ttctctgcaga

SEQ ID NO: 4514009 - DNA, 14 bp, Homo sapiens
ttctctgcagtaaa

SEQ ID NO: 4514010 - DNA, 13 bp, Homo sapiens
ttctctgcccagc

SEQ ID NO: 4514011 - DNA, 14 bp, Homo sapiens
ttctctgcccagcc

SEQ ID NO: 4514012 - DNA, 11 bp, Homo sapiens
ttctctgcctt

SEQ ID NO: 4514013 - DNA, 21 bp, Homo sapiens
ttctctgctatatataaaacg

SEQ ID NO: 4514014 - DNA, 14 bp, Homo sapiens
ttctctgctccacc

SEQ ID NO: 4514015 - DNA, 15 bp, Homo sapiens
ttctctgctccacca

SEQ ID NO: 4514016 - DNA, 16 bp, Homo sapiens
ttctctggcaaacttt

SEQ ID NO: 4514017 - DNA, 19 bp, Homo sapiens
ttctctggtggtcttcctt

SEQ ID NO: 4514018 - DNA, 13 bp, Homo sapiens
ttctctgtacttt

SEQ ID NO: 4514019 - DNA, 21 bp, Homo sapiens
ttctctgtacttttcattctc

SEQ ID NO: 4514020 - DNA, 17 bp, Homo sapiens
ttctctgtctcatccat

SEQ ID NO: 4514021 - DNA, 15 bp, Homo sapiens
ttctctgttcccttg

SEQ ID NO: 4514022 - DNA, 22 bp, Homo sapiens
ttctctgttgtttggttcaggg

SEQ ID NO: 4514023 - DNA, 17 bp, Homo sapiens
ttctcttccccttagaa

SEQ ID NO: 4514024 - DNA, 16 bp, Homo sapiens
ttctcttgacagtctg

SEQ ID NO: 4514025 - DNA, 13 bp, Homo sapiens
ttctcttgtacca

SEQ ID NO: 4514026 - DNA, 13 bp, Homo sapiens
ttctctttctctc

SEQ ID NO: 4514027 - DNA, 14 bp, Homo sapiens
ttctctttggagga

SEQ ID NO: 4514028 - DNA, 15 bp, Homo sapiens
ttctcttttattctg

SEQ ID NO: 4514029 - DNA, 19 bp, Homo sapiens
ttctgaaaacctaccagcc

SEQ ID NO: 4514030 - DNA, 17 bp, Homo sapiens
ttctgaactcaaactga

SEQ ID NO: 4514031 - DNA, 22 bp, Homo sapiens
ttctgaactcaaactgaggaat

SEQ ID NO: 4514032 - DNA, 22 bp, Homo sapiens
ttctgaactccatacagcctct

SEQ ID NO: 4514033 - DNA, 12 bp, Homo sapiens
ttctgaagaagt

SEQ ID NO: 4514034 - DNA, 19 bp, Homo sapiens
ttctgaagaagttaattct

SEQ ID NO: 4514035 - DNA, 20 bp, Homo sapiens
ttctgaagaagttaattctt

SEQ ID NO: 4514036 - DNA, 16 bp, Homo sapiens
ttctgaagctgacagc

SEQ ID NO: 4514037 - DNA, 18 bp, Homo sapiens
ttctgaaggaagagaaga

SEQ ID NO: 4514038 - DNA, 19 bp, Homo sapiens
ttctgaaggtagcattctt

SEQ ID NO: 4514039 - DNA, 17 bp, Homo sapiens
ttctgaagttttatttt

SEQ ID NO: 4514040 - DNA, 23 bp, Homo sapiens
ttctgaagttttattttaaatta

SEQ ID NO: 4514041 - DNA, 16 bp, Homo sapiens
ttctgaataaagcaat

SEQ ID NO: 4514042 - DNA, 16 bp, Homo sapiens
ttctgaattgtccttt

SEQ ID NO: 4514043 - DNA, 13 bp, Homo sapiens
ttctgaatttgca

SEQ ID NO: 4514044 - DNA, 18 bp, Homo sapiens
ttctgacatgtaagaaaa

SEQ ID NO: 4514045 - DNA, 16 bp, Homo sapiens
ttctgactctgagcta

SEQ ID NO: 4514046 - DNA, 13 bp, Homo sapiens
ttctgactgtcca

SEQ ID NO: 4514047 - DNA, 21 bp, Homo sapiens
ttctgagaaagactattcaaa

SEQ ID NO: 4514048 - DNA, 13 bp, Homo sapiens
ttctgagaccaaa

SEQ ID NO: 4514049 - DNA, 19 bp, Homo sapiens
ttctgagcaaaggccctgg

SEQ ID NO: 4514050 - DNA, 16 bp, Homo sapiens
ttctgagctatttcat

SEQ ID NO: 4514051 - DNA, 15 bp, Homo sapiens
ttctgaggtccttat

SEQ ID NO: 4514052 - DNA, 15 bp, Homo sapiens
ttctgagttttgtgt

SEQ ID NO: 4514053 - DNA, 19 bp, Homo sapiens
ttctgataaaagatggcca

SEQ ID NO: 4514054 - DNA, 18 bp, Homo sapiens
ttctgatgaatctcaaag

SEQ ID NO: 4514055 - DNA, 20 bp, Homo sapiens
ttctgattatgtaagcattt

SEQ ID NO: 4514056 - DNA, 18 bp, Homo sapiens
ttctgattcttttttcag

SEQ ID NO: 4514057 - DNA, 13 bp, Homo sapiens
ttctgatttcata

SEQ ID NO: 4514058 - DNA, 17 bp, Homo sapiens
ttctgcaactccatcct

SEQ ID NO: 4514059 - DNA, 15 bp, Homo sapiens
ttctgcagcaactcc

SEQ ID NO: 4514060 - DNA, 16 bp, Homo sapiens
ttctgcagcaactccc

SEQ ID NO: 4514061 - DNA, 20 bp, Homo sapiens
ttctgcagcaactcccacga

SEQ ID NO: 4514062 - DNA, 16 bp, Homo sapiens
ttctgcatcagctgct

SEQ ID NO: 4514063 - DNA, 12 bp, Homo sapiens
ttctgcattact

SEQ ID NO: 4514064 - DNA, 19 bp, Homo sapiens
ttctgcattcatttttata

SEQ ID NO: 4514065 - DNA, 11 bp, Homo sapiens
ttctgccaaaa

SEQ ID NO: 4514066 - DNA, 12 bp, Homo sapiens
ttctgccaggag

SEQ ID NO: 4514067 - DNA, 16 bp, Homo sapiens
ttctgccatttcatgt

SEQ ID NO: 4514068 - DNA, 13 bp, Homo sapiens
ttctgcctcctgg

SEQ ID NO: 4514069 - DNA, 12 bp, Homo sapiens
ttctgcctcctt

SEQ ID NO: 4514070 - DNA, 16 bp, Homo sapiens
ttctgcctctccaggc

SEQ ID NO: 4514071 - DNA, 13 bp, Homo sapiens
ttctgcctgttat

SEQ ID NO: 4514072 - DNA, 20 bp, Homo sapiens
ttctgcctgttataactctg

SEQ ID NO: 4514073 - DNA, 22 bp, Homo sapiens
ttctgcctttggggacttttct

SEQ ID NO: 4514074 - DNA, 17 bp, Homo sapiens
ttctgctaagattcctt

SEQ ID NO: 4514075 - DNA, 15 bp, Homo sapiens
ttctgctacttcact

SEQ ID NO: 4514076 - DNA, 22 bp, Homo sapiens
ttctgctacttcactgtcatct

SEQ ID NO: 4514077 - DNA, 19 bp, Homo sapiens
ttctgctagagcagacagg

SEQ ID NO: 4514078 - DNA, 13 bp, Homo sapiens
ttctgctcatcat

SEQ ID NO: 4514079 - DNA, 14 bp, Homo sapiens
ttctgctcatcatt

SEQ ID NO: 4514080 - DNA, 21 bp, Homo sapiens
ttctgctcatcattctctgtc

SEQ ID NO: 4514081 - DNA, 13 bp, Homo sapiens
ttctgctctggaa

SEQ ID NO: 4514082 - DNA, 17 bp, Homo sapiens
ttctgctctggttgttt

SEQ ID NO: 4514083 - DNA, 14 bp, Homo sapiens
ttctgctctttaca

SEQ ID NO: 4514084 - DNA, 17 bp, Homo sapiens
ttctgctgtacagatat

SEQ ID NO: 4514085 - DNA, 19 bp, Homo sapiens
ttctgcttttctgccctgg

SEQ ID NO: 4514086 - DNA, 13 bp, Homo sapiens
ttctggaagactg

SEQ ID NO: 4514087 - DNA, 17 bp, Homo sapiens
ttctggactatagctgt

SEQ ID NO: 4514088 - DNA, 22 bp, Homo sapiens
ttctggagctgggagacaaagg

SEQ ID NO: 4514089 - DNA, 20 bp, Homo sapiens
ttctggatggtgtgccttcc

SEQ ID NO: 4514090 - DNA, 23 bp, Homo sapiens
ttctggatggtgtgccttccaga

SEQ ID NO: 4514091 - DNA, 18 bp, Homo sapiens
ttctggattagcttttcc

SEQ ID NO: 4514092 - DNA, 17 bp, Homo sapiens
ttctggcaggtcctccc

SEQ ID NO: 4514093 - DNA, 19 bp, Homo sapiens
ttctggcaggtcctcccct

SEQ ID NO: 4514094 - DNA, 16 bp, Homo sapiens
ttctggccagtgttta

SEQ ID NO: 4514095 - DNA, 13 bp, Homo sapiens
ttctgggaaggga

SEQ ID NO: 4514096 - DNA, 21 bp, Homo sapiens
ttctgggagggcagcagggct

SEQ ID NO: 4514097 - DNA, 23 bp, Homo sapiens
ttctgggcaccacaaaatataca

SEQ ID NO: 4514098 - DNA, 15 bp, Homo sapiens
ttctgggcctgacca

SEQ ID NO: 4514099 - DNA, 16 bp, Homo sapiens
ttctgggcttcatctg

SEQ ID NO: 4514100 - DNA, 19 bp, Homo sapiens
ttctggggcaggctgggcc

SEQ ID NO: 4514101 - DNA, 20 bp, Homo sapiens
ttctggggcaggctgggcca

SEQ ID NO: 4514102 - DNA, 15 bp, Homo sapiens
ttctgggtccaggga

SEQ ID NO: 4514103 - DNA, 22 bp, Homo sapiens
ttctgggtgatggaaactgcca

SEQ ID NO: 4514104 - DNA, 17 bp, Homo sapiens
ttctgggtgttgaccac

SEQ ID NO: 4514105 - DNA, 22 bp, Homo sapiens
ttctggtaagactgctggttga

SEQ ID NO: 4514106 - DNA, 18 bp, Homo sapiens
ttctggtgtatattttaa

SEQ ID NO: 4514107 - DNA, 22 bp, Homo sapiens
ttctggtttaaacttgtttgct

SEQ ID NO: 4514108 - DNA, 15 bp, Homo sapiens
ttctgtaataaaact

SEQ ID NO: 4514109 - DNA, 18 bp, Homo sapiens
ttctgtaatgtaaataaa

SEQ ID NO: 4514110 - DNA, 21 bp, Homo sapiens
ttctgtaattcaggtttttcc

SEQ ID NO: 4514111 - DNA, 13 bp, Homo sapiens
ttctgtaattgtg

SEQ ID NO: 4514112 - DNA, 12 bp, Homo sapiens
ttctgtaccagt

SEQ ID NO: 4514113 - DNA, 21 bp, Homo sapiens
ttctgtaccagttaatttttc

SEQ ID NO: 4514114 - DNA, 13 bp, Homo sapiens
ttctgtacttcct

SEQ ID NO: 4514115 - DNA, 18 bp, Homo sapiens
ttctgtagcttatctgcc

SEQ ID NO: 4514116 - DNA, 12 bp, Homo sapiens
ttgacagtctga

SEQ ID NO: 4514117 - DNA, 20 bp, Homo sapiens
ttgacatacctaccagtatt

SEQ ID NO: 4514118 - DNA, 13 bp, Homo sapiens
ttgacatatttaa

SEQ ID NO: 4514119 - DNA, 20 bp, Homo sapiens
ttgaccgcgactaatttcaa

SEQ ID NO: 4514120 - DNA, 17 bp, Homo sapiens
ttgacctgcattgtaaa

SEQ ID NO: 4514121 - DNA, 19 bp, Homo sapiens
ttgacctgcattgtaaata

SEQ ID NO: 4514122 - DNA, 17 bp, Homo sapiens
ttgaccttcccaaggtt

SEQ ID NO: 4514123 - DNA, 13 bp, Homo sapiens
ttgacctttattt

SEQ ID NO: 4514124 - DNA, 23 bp, Homo sapiens
ttgacgtcactttttggccatgt

SEQ ID NO: 4514125 - DNA, 23 bp, Homo sapiens
ttgactagatgatggatgccaat

SEQ ID NO: 4514126 - DNA, 21 bp, Homo sapiens
ttgactagggattcaggctgc

SEQ ID NO: 4514127 - DNA, 20 bp, Homo sapiens
ttgactatggagtcttgtga

SEQ ID NO: 4514128 - DNA, 21 bp, Homo sapiens
ttgactatggagtcttgtgaa

SEQ ID NO: 4514129 - DNA, 22 bp, Homo sapiens
ttgactatggagtcttgtgaaa

SEQ ID NO: 4514130 - DNA, 17 bp, Homo sapiens
ttgactcctttccaata

SEQ ID NO: 4514131 - DNA, 20 bp, Homo sapiens
ttgactgaaaaaaaaaaaga

SEQ ID NO: 4514132 - DNA, 17 bp, Homo sapiens
ttgactgtagccacagc

SEQ ID NO: 4514133 - DNA, 14 bp, Homo sapiens
ttgactgtcagcaa

SEQ ID NO: 4514134 - DNA, 15 bp, Homo sapiens
ttgactgtgattaga

SEQ ID NO: 4514135 - DNA, 21 bp, Homo sapiens
ttgactgtgattagatcacat

SEQ ID NO: 4514136 - DNA, 13 bp, Homo sapiens
ttgacttcagatt

SEQ ID NO: 4514137 - DNA, 13 bp, Homo sapiens
ttgacttttctgt

SEQ ID NO: 4514138 - DNA, 18 bp, Homo sapiens
ttgacttttctgtaattc

SEQ ID NO: 4514139 - DNA, 19 bp, Homo sapiens
ttgactttttaaaaaagtt

SEQ ID NO: 4514140 - DNA, 16 bp, Homo sapiens
ttgactttttgcattt

SEQ ID NO: 4514141 - DNA, 13 bp, Homo sapiens
ttgactttttgga

SEQ ID NO: 4514142 - DNA, 23 bp, Homo sapiens
ttgagaaaaatagagcaaaatca

SEQ ID NO: 4514143 - DNA, 15 bp, Homo sapiens
ttgagacctcagcca

SEQ ID NO: 4514144 - DNA, 14 bp, Homo sapiens
ttgagactttcttc

SEQ ID NO: 4514145 - DNA, 12 bp, Homo sapiens
ttgagacttttt

SEQ ID NO: 4514146 - DNA, 15 bp, Homo sapiens
ttgagactttttggt

SEQ ID NO: 4514147 - DNA, 23 bp, Homo sapiens
ttgagactttttggtggatgtaa

SEQ ID NO: 4514148 - DNA, 11 bp, Homo sapiens
ttgagatggag

SEQ ID NO: 4514149 - DNA, 22 bp, Homo sapiens
ttgagatggggtctcgctctgt

SEQ ID NO: 4514150 - DNA, 19 bp, Homo sapiens
ttgagattttttttccgtg

SEQ ID NO: 4514151 - DNA, 21 bp, Homo sapiens
ttgagattttttttccgtgtg

SEQ ID NO: 4514152 - DNA, 23 bp, Homo sapiens
ttgagcagcaggtagcctgctgg

SEQ ID NO: 4514153 - DNA, 14 bp, Homo sapiens
ttgagcatcaatct

SEQ ID NO: 4514154 - DNA, 20 bp, Homo sapiens
ttgagccactccttccttca

SEQ ID NO: 4514155 - DNA, 13 bp, Homo sapiens
ttgagccctggct

SEQ ID NO: 4514156 - DNA, 15 bp, Homo sapiens
ttgagcgtgcgcact

SEQ ID NO: 4514157 - DNA, 15 bp, Homo sapiens
ttgagctattgctgt

SEQ ID NO: 4514158 - DNA, 21 bp, Homo sapiens
ttgagctcagccccaactctt

SEQ ID NO: 4514159 - DNA, 19 bp, Homo sapiens
ttgagctcaggaggtcaag

SEQ ID NO: 4514160 - DNA, 15 bp, Homo sapiens
ttgagctgccttccc

SEQ ID NO: 4514161 - DNA, 19 bp, Homo sapiens
ttgaggggccctggccagg

SEQ ID NO: 4514162 - DNA, 13 bp, Homo sapiens
ttgaggtccatgg

SEQ ID NO: 4514163 - DNA, 19 bp, Homo sapiens
ttgaggtggaagccctcct

SEQ ID NO: 4514164 - DNA, 16 bp, Homo sapiens
ttgaggttctcttttg

SEQ ID NO: 4514165 - DNA, 18 bp, Homo sapiens
ttgagtcattgacttcat

SEQ ID NO: 4514166 - DNA, 20 bp, Homo sapiens
ttgagtcctaggacttaaaa

SEQ ID NO: 4514167 - DNA, 14 bp, Homo sapiens
ttgagtctgtgcca

SEQ ID NO: 4514168 - DNA, 12 bp, Homo sapiens
ttgagtgagaag

SEQ ID NO: 4514169 - DNA, 13 bp, Homo sapiens
ttgagtggctgtc

SEQ ID NO: 4514170 - DNA, 18 bp, Homo sapiens
ttgagttcttcctgtaat

SEQ ID NO: 4514171 - DNA, 23 bp, Homo sapiens
ttgagttcttcctgtaatcttgt

SEQ ID NO: 4514172 - DNA, 17 bp, Homo sapiens
ttgagtttacttataaa

SEQ ID NO: 4514173 - DNA, 19 bp, Homo sapiens
ttgagttttcagtggggca

SEQ ID NO: 4514174 - DNA, 16 bp, Homo sapiens
ttgagtttttcctccc

SEQ ID NO: 4514175 - DNA, 15 bp, Homo sapiens
ttgataaaaatactg

SEQ ID NO: 4514176 - DNA, 13 bp, Homo sapiens
ttgataaacataa

SEQ ID NO: 4514177 - DNA, 22 bp, Homo sapiens
ttgataaacataattatttcta

SEQ ID NO: 4514178 - DNA, 18 bp, Homo sapiens
ttgataaaccaaaaacat

SEQ ID NO: 4514179 - DNA, 19 bp, Homo sapiens
ttgataaaccaaaaacatt

SEQ ID NO: 4514180 - DNA, 14 bp, Homo sapiens
ttgataaagatttt

SEQ ID NO: 4514181 - DNA, 20 bp, Homo sapiens
ttgataaagattttttaata

SEQ ID NO: 4514182 - DNA, 14 bp, Homo sapiens
ttgataaattttaa

SEQ ID NO: 4514183 - DNA, 18 bp, Homo sapiens
ttgataataatattgttt

SEQ ID NO: 4514184 - DNA, 14 bp, Homo sapiens
ttgataatgataaa

SEQ ID NO: 4514185 - DNA, 18 bp, Homo sapiens
ttgatagttctataagaa

SEQ ID NO: 4514186 - DNA, 16 bp, Homo sapiens
ttgatatcgtgaaatc

SEQ ID NO: 4514187 - DNA, 15 bp, Homo sapiens
ttgatattctaagaa

SEQ ID NO: 4514188 - DNA, 18 bp, Homo sapiens
ttgatattctaagaaata

SEQ ID NO: 4514189 - DNA, 23 bp, Homo sapiens
ttgatattctaagaaatatctgt

SEQ ID NO: 4514190 - DNA, 20 bp, Homo sapiens
ttgatattgtttgctgttgg

SEQ ID NO: 4514191 - DNA, 17 bp, Homo sapiens
ttgatatttttatacaa

SEQ ID NO: 4514192 - DNA, 15 bp, Homo sapiens
ttgatcacacagtgt

SEQ ID NO: 4514193 - DNA, 15 bp, Homo sapiens
ttgatcactgtgaac

SEQ ID NO: 4514194 - DNA, 13 bp, Homo sapiens
ttgatcagacagc

SEQ ID NO: 4514195 - DNA, 16 bp, Homo sapiens
ttgatcatgtactttt

SEQ ID NO: 4514196 - DNA, 18 bp, Homo sapiens
ttgatcattttcccccca

SEQ ID NO: 4514197 - DNA, 19 bp, Homo sapiens
ttgatcattttccccccac

SEQ ID NO: 4514198 - DNA, 22 bp, Homo sapiens
ttgatcattttccccccactct

SEQ ID NO: 4514199 - DNA, 20 bp, Homo sapiens
ttgatccagaagagcccata

SEQ ID NO: 4514200 - DNA, 19 bp, Homo sapiens
ttgatcgcctttcccaggt

SEQ ID NO: 4514201 - DNA, 15 bp, Homo sapiens
ttgatctatctacaa

SEQ ID NO: 4514202 - DNA, 18 bp, Homo sapiens
ttgatctctcttgtcctc

SEQ ID NO: 4514203 - DNA, 13 bp, Homo sapiens
ttgatctgtttta

SEQ ID NO: 4514204 - DNA, 15 bp, Homo sapiens
ttgatctttgtttaa

SEQ ID NO: 4514205 - DNA, 16 bp, Homo sapiens
ttgatctttgtttaaa

SEQ ID NO: 4514206 - DNA, 20 bp, Homo sapiens
ttgatctttgtttaaatgcc

SEQ ID NO: 4514207 - DNA, 22 bp, Homo sapiens
ttgatctttgtttaaatgccaa

SEQ ID NO: 4514208 - DNA, 15 bp, Homo sapiens
ttgatctttttatca

SEQ ID NO: 4514209 - DNA, 19 bp, Homo sapiens
ttgatctttttatcatgat

SEQ ID NO: 4514210 - DNA, 14 bp, Homo sapiens
ttgatgatgcagtt

SEQ ID NO: 4514211 - DNA, 22 bp, Homo sapiens
ttgatgccaaaaaaaaatacat

SEQ ID NO: 4514212 - DNA, 20 bp, Homo sapiens
ttgatgtacataactcctgt

SEQ ID NO: 4514213 - DNA, 15 bp, Homo sapiens
ttgatgtacattaca

SEQ ID NO: 4514214 - DNA, 16 bp, Homo sapiens
ttgatgtttgtggcct

SEQ ID NO: 4514215 - DNA, 17 bp, Homo sapiens
ttgatgtttgtggcctc

SEQ ID NO: 4514216 - DNA, 18 bp, Homo sapiens
ttgatgtttgtggcctca

SEQ ID NO: 4514217 - DNA, 18 bp, Homo sapiens
ttgatgttttttctgtaa

SEQ ID NO: 4514218 - DNA, 16 bp, Homo sapiens
ttgattaagaaaggaa

SEQ ID NO: 4514219 - DNA, 13 bp, Homo sapiens
ttgattataaagt

SEQ ID NO: 4514220 - DNA, 17 bp, Homo sapiens
ttgattattcagtgtca

SEQ ID NO: 4514221 - DNA, 15 bp, Homo sapiens
ttgattcaaaatatt

SEQ ID NO: 4514222 - DNA, 16 bp, Homo sapiens
ttgattccattttaag

SEQ ID NO: 4514223 - DNA, 17 bp, Homo sapiens
ttgattctccttcagcc

SEQ ID NO: 4514224 - DNA, 20 bp, Homo sapiens
ttgattctccttttatgtgt

SEQ ID NO: 4514225 - DNA, 14 bp, Homo sapiens
ttgatttgaagaac

SEQ ID NO: 4514226 - DNA, 20 bp, Homo sapiens
ttgcaaagagacatttcaaa

SEQ ID NO: 4514227 - DNA, 22 bp, Homo sapiens
ttgcaaagagacatttcaaaac

SEQ ID NO: 4514228 - DNA, 14 bp, Homo sapiens
ttgcaaagtactgt

SEQ ID NO: 4514229 - DNA, 17 bp, Homo sapiens
ttgcaaagtattgtaaa

SEQ ID NO: 4514230 - DNA, 12 bp, Homo sapiens
ttgcaaatcttg

SEQ ID NO: 4514231 - DNA, 15 bp, Homo sapiens
ttgcaaatcttgaaa

SEQ ID NO: 4514232 - DNA, 22 bp, Homo sapiens
ttgcaagatgtgaattattgac

SEQ ID NO: 4514233 - DNA, 20 bp, Homo sapiens
ttgcaatagcagttataaca

SEQ ID NO: 4514234 - DNA, 18 bp, Homo sapiens
ttgcaatccaggctgttc

SEQ ID NO: 4514235 - DNA, 21 bp, Homo sapiens
ttgcaatccaggctgttctca

SEQ ID NO: 4514236 - DNA, 19 bp, Homo sapiens
ttgcaatctaatctgaact

SEQ ID NO: 4514237 - DNA, 15 bp, Homo sapiens
ttctttggtgccttt

SEQ ID NO: 4514238 - DNA, 19 bp, Homo sapiens
ttctttggtgcctttcctg

SEQ ID NO: 4514239 - DNA, 16 bp, Homo sapiens
ttctttgtactaatac

SEQ ID NO: 4514240 - DNA, 21 bp, Homo sapiens
ttctttgtagaataaatggtt

SEQ ID NO: 4514241 - DNA, 12 bp, Homo sapiens
ttctttgtgcct

SEQ ID NO: 4514242 - DNA, 10 bp, Homo sapiens
ttctttgtgt

SEQ ID NO: 4514243 - DNA, 13 bp, Homo sapiens
ttcttttagaaaa

SEQ ID NO: 4514244 - DNA, 23 bp, Homo sapiens
ttcttttgaatcaatctggcttc

SEQ ID NO: 4514245 - DNA, 15 bp, Homo sapiens
ttcttttgaattgtt

SEQ ID NO: 4514246 - DNA, 22 bp, Homo sapiens
ttcttttggtaaagactggctt

SEQ ID NO: 4514247 - DNA, 20 bp, Homo sapiens
ttctttttattttgcactct

SEQ ID NO: 4514248 - DNA, 18 bp, Homo sapiens
ttctttttctacatgtga

SEQ ID NO: 4514249 - DNA, 19 bp, Homo sapiens
ttcttttttaaattttctt

SEQ ID NO: 4514250 - DNA, 23 bp, Homo sapiens
ttcttttttaaattttcttcagt

SEQ ID NO: 4514251 - DNA, 14 bp, Homo sapiens
ttcttttttaagtt

SEQ ID NO: 4514252 - DNA, 13 bp, Homo sapiens
ttctttttttcct

SEQ ID NO: 4514253 - DNA, 19 bp, Homo sapiens
ttctttttttcctttttaa

SEQ ID NO: 4514254 - DNA, 17 bp, Homo sapiens
ttctttttttttaagtt

SEQ ID NO: 4514255 - DNA, 22 bp, Homo sapiens
ttcttttttttttttttacagt

SEQ ID NO: 4514256 - DNA, 20 bp, Homo sapiens
ttgaaaaaaacttcattctc

SEQ ID NO: 4514257 - DNA, 20 bp, Homo sapiens
ttgaaaaaaattgaaataaa

SEQ ID NO: 4514258 - DNA, 15 bp, Homo sapiens
ttgaaaaaagctcat

SEQ ID NO: 4514259 - DNA, 17 bp, Homo sapiens
ttgaaaaaagctcattt

SEQ ID NO: 4514260 - DNA, 20 bp, Homo sapiens
ttgaaaaaagctcatttcat

SEQ ID NO: 4514261 - DNA, 20 bp, Homo sapiens
ttgaaaaaatagagcctgag

SEQ ID NO: 4514262 - DNA, 22 bp, Homo sapiens
ttgaaaaaatagagcctgaggg

SEQ ID NO: 4514263 - DNA, 13 bp, Homo sapiens
ttgaaaaactttt

SEQ ID NO: 4514264 - DNA, 17 bp, Homo sapiens
ttgaaaattacatgttt

SEQ ID NO: 4514265 - DNA, 16 bp, Homo sapiens
ttgaaaattgaaaagt

SEQ ID NO: 4514266 - DNA, 23 bp, Homo sapiens
ttgaaaattgtataccaatgtgt

SEQ ID NO: 4514267 - DNA, 20 bp, Homo sapiens
ttgaaaccaagttgaaaaat

SEQ ID NO: 4514268 - DNA, 21 bp, Homo sapiens
ttgaaaccaccgtgaaccaga

SEQ ID NO: 4514269 - DNA, 14 bp, Homo sapiens
ttgaaacctcaggg

SEQ ID NO: 4514270 - DNA, 14 bp, Homo sapiens
ttgaaacctgctct

SEQ ID NO: 4514271 - DNA, 18 bp, Homo sapiens
ttgaaagatgtatggatt

SEQ ID NO: 4514272 - DNA, 17 bp, Homo sapiens
ttgaaagccaagtgttt

SEQ ID NO: 4514273 - DNA, 21 bp, Homo sapiens
ttgaaagcttttaaaatgtag

SEQ ID NO: 4514274 - DNA, 15 bp, Homo sapiens
ttgaaagttgctttt

SEQ ID NO: 4514275 - DNA, 18 bp, Homo sapiens
ttgaaagttgtacatgat

SEQ ID NO: 4514276 - DNA, 21 bp, Homo sapiens
ttgaaagttgtacatgataag

SEQ ID NO: 4514277 - DNA, 17 bp, Homo sapiens
ttgaaatagaaaatgta

SEQ ID NO: 4514278 - DNA, 13 bp, Homo sapiens
ttgaaatgaaagg

SEQ ID NO: 4514279 - DNA, 17 bp, Homo sapiens
ttgaaatgaaagggaaa

SEQ ID NO: 4514280 - DNA, 20 bp, Homo sapiens
ttgaaatgcattgctctgga

SEQ ID NO: 4514281 - DNA, 20 bp, Homo sapiens
ttgaaattaagaaggcaaaa

SEQ ID NO: 4514282 - DNA, 17 bp, Homo sapiens
ttgaaattatgtgacat

SEQ ID NO: 4514283 - DNA, 13 bp, Homo sapiens
ttgaaattctgaa

SEQ ID NO: 4514284 - DNA, 14 bp, Homo sapiens
ttgaaattctgaat

SEQ ID NO: 4514285 - DNA, 15 bp, Homo sapiens
ttgaaattctgaatt

SEQ ID NO: 4514286 - DNA, 16 bp, Homo sapiens
ttgaaattctgaattt

SEQ ID NO: 4514287 - DNA, 13 bp, Homo sapiens
ttgaaatttacac

SEQ ID NO: 4514288 - DNA, 16 bp, Homo sapiens
ttgaacaaattttctg

SEQ ID NO: 4514289 - DNA, 18 bp, Homo sapiens
ttgaacacaaactgtaaa

SEQ ID NO: 4514290 - DNA, 13 bp, Homo sapiens
ttgaacacagtat

SEQ ID NO: 4514291 - DNA, 16 bp, Homo sapiens
ttgaacccaaattgag

SEQ ID NO: 4514292 - DNA, 18 bp, Homo sapiens
ttgaacccgggaggcaga

SEQ ID NO: 4514293 - DNA, 19 bp, Homo sapiens
ttgaacccgggaggcagag

SEQ ID NO: 4514294 - DNA, 17 bp, Homo sapiens
ttgaacgttatgttcag

SEQ ID NO: 4514295 - DNA, 18 bp, Homo sapiens
ttgaactaatatatgaaa

SEQ ID NO: 4514296 - DNA, 13 bp, Homo sapiens
ttgaacttttgta

SEQ ID NO: 4514297 - DNA, 14 bp, Homo sapiens
ttgaagagacagag

SEQ ID NO: 4514298 - DNA, 17 bp, Homo sapiens
ttgaagcaactacaact

SEQ ID NO: 4514299 - DNA, 21 bp, Homo sapiens
ttgaagcaactacaacttctc

SEQ ID NO: 4514300 - DNA, 14 bp, Homo sapiens
ttgaagcacgtaca

SEQ ID NO: 4514301 - DNA, 18 bp, Homo sapiens
ttgaagcacgtacatttt

SEQ ID NO: 4514302 - DNA, 14 bp, Homo sapiens
ttgaagccaaagaa

SEQ ID NO: 4514303 - DNA, 15 bp, Homo sapiens
ttgaagccaaagaaa

SEQ ID NO: 4514304 - DNA, 11 bp, Homo sapiens
ttgaaggccag

SEQ ID NO: 4514305 - DNA, 23 bp, Homo sapiens
ttgaagggctttattaaagaaat

SEQ ID NO: 4514306 - DNA, 14 bp, Homo sapiens
ttgaaggggagaga

SEQ ID NO: 4514307 - DNA, 14 bp, Homo sapiens
ttgaagggtcctgc

SEQ ID NO: 4514308 - DNA, 16 bp, Homo sapiens
ttgaaggtagaatgtt

SEQ ID NO: 4514309 - DNA, 22 bp, Homo sapiens
ttgaaggtgataagggaaaaga

SEQ ID NO: 4514310 - DNA, 18 bp, Homo sapiens
ttgaaggtttcagatgag

SEQ ID NO: 4514311 - DNA, 12 bp, Homo sapiens
ttgaagtaatga

SEQ ID NO: 4514312 - DNA, 17 bp, Homo sapiens
ttgaagtaatgaatttt

SEQ ID NO: 4514313 - DNA, 18 bp, Homo sapiens
ttgaagtattttgctgga

SEQ ID NO: 4514314 - DNA, 15 bp, Homo sapiens
ttgaagtgttccctt

SEQ ID NO: 4514315 - DNA, 20 bp, Homo sapiens
ttgaataaaaatagaaacct

SEQ ID NO: 4514316 - DNA, 22 bp, Homo sapiens
ttgaataaagaatacttgaact

SEQ ID NO: 4514317 - DNA, 22 bp, Homo sapiens
ttgaataagcagaacatactgt

SEQ ID NO: 4514318 - DNA, 12 bp, Homo sapiens
ttgaataataag

SEQ ID NO: 4514319 - DNA, 18 bp, Homo sapiens
ttgaatactctgccctct

SEQ ID NO: 4514320 - DNA, 16 bp, Homo sapiens
ttgaatactgtctgta

SEQ ID NO: 4514321 - DNA, 18 bp, Homo sapiens
ttgaatactgtctgtatc

SEQ ID NO: 4514322 - DNA, 19 bp, Homo sapiens
ttgaatactgtctgtatct

SEQ ID NO: 4514323 - DNA, 19 bp, Homo sapiens
ttgaataggaaataaaatt

SEQ ID NO: 4514324 - DNA, 15 bp, Homo sapiens
ttgaatagtattgtg

SEQ ID NO: 4514325 - DNA, 19 bp, Homo sapiens
ttgaatagtggaacatttt

SEQ ID NO: 4514326 - DNA, 14 bp, Homo sapiens
ttgaatatatttta

SEQ ID NO: 4514327 - DNA, 21 bp, Homo sapiens
ttgaatatattttatcttggt

SEQ ID NO: 4514328 - DNA, 22 bp, Homo sapiens
ttgaatatctttcgataaacaa

SEQ ID NO: 4514329 - DNA, 17 bp, Homo sapiens
ttgaatattttttgaag

SEQ ID NO: 4514330 - DNA, 10 bp, Homo sapiens
ttgaatcaat

SEQ ID NO: 4514331 - DNA, 22 bp, Homo sapiens
ttgaatcaataatatattttct

SEQ ID NO: 4514332 - DNA, 19 bp, Homo sapiens
ttgaatcaatctggcttct

SEQ ID NO: 4514333 - DNA, 15 bp, Homo sapiens
ttgaatgaaattcca

SEQ ID NO: 4514334 - DNA, 23 bp, Homo sapiens
ttgaatgccatagtcaaagagag

SEQ ID NO: 4514335 - DNA, 20 bp, Homo sapiens
ttgaatggctatgtttttaa

SEQ ID NO: 4514336 - DNA, 15 bp, Homo sapiens
ttgaatgtgaaacat

SEQ ID NO: 4514337 - DNA, 19 bp, Homo sapiens
ttgaatgtggcttgagaaa

SEQ ID NO: 4514338 - DNA, 17 bp, Homo sapiens
ttgaatgttagatgctt

SEQ ID NO: 4514339 - DNA, 17 bp, Homo sapiens
ttgaattagaaaattag

SEQ ID NO: 4514340 - DNA, 21 bp, Homo sapiens
ttgaattgtgtcttaatctct

SEQ ID NO: 4514341 - DNA, 13 bp, Homo sapiens
ttgaattgttaca

SEQ ID NO: 4514342 - DNA, 19 bp, Homo sapiens
ttgacaaaatgactggctc

SEQ ID NO: 4514343 - DNA, 21 bp, Homo sapiens
ttgacaaaatgactggctcct

SEQ ID NO: 4514344 - DNA, 13 bp, Homo sapiens
ttgacaaacacaa

SEQ ID NO: 4514345 - DNA, 22 bp, Homo sapiens
ttgacaaacccggaagatcaga

SEQ ID NO: 4514346 - DNA, 12 bp, Homo sapiens
ttgacaataaaa

SEQ ID NO: 4514347 - DNA, 19 bp, Homo sapiens
ttgacaataaaatattatt

SEQ ID NO: 4514348 - DNA, 16 bp, Homo sapiens
ttgacaattgggagct

SEQ ID NO: 4514349 - DNA, 12 bp, Homo sapiens
ttgacactgaaa

SEQ ID NO: 4514350 - DNA, 17 bp, Homo sapiens
ttgacactgaaagtttt

SEQ ID NO: 4514351 - DNA, 15 bp, Homo sapiens
ttgacactgaaataa

SEQ ID NO: 4514352 - DNA, 14 bp, Homo sapiens
ttgacactgaactt

SEQ ID NO: 4514353 - DNA, 22 bp, Homo sapiens
ttgacactgaacttaataactg

SEQ ID NO: 4514354 - DNA, 16 bp, Homo sapiens
ttgacactgctctaac

SEQ ID NO: 4514355 - DNA, 22 bp, Homo sapiens
ttgacactgctctaacagccct

SEQ ID NO: 4514356 - DNA, 17 bp, Homo sapiens
ttgacagactatttgct

SEQ ID NO: 4514357 - DNA, 19 bp, Homo sapiens
ttgacaggtcttttcaaat

SEQ ID NO: 4514358 - DNA, 14 bp, Homo sapiens
ttgtactgaatttt

SEQ ID NO: 4514359 - DNA, 20 bp, Homo sapiens
ttgtactgtatctattcttc

SEQ ID NO: 4514360 - DNA, 16 bp, Homo sapiens
ttgtactgtgttttta

SEQ ID NO: 4514361 - DNA, 18 bp, Homo sapiens
ttgtactgttgctttaat

SEQ ID NO: 4514362 - DNA, 19 bp, Homo sapiens
ttgtactttatatcttgtt

SEQ ID NO: 4514363 - DNA, 18 bp, Homo sapiens
ttgtagaataaatggttt

SEQ ID NO: 4514364 - DNA, 19 bp, Homo sapiens
ttgtagaataaatggtttc

SEQ ID NO: 4514365 - DNA, 19 bp, Homo sapiens
ttgtagattgattgtattg

SEQ ID NO: 4514366 - DNA, 17 bp, Homo sapiens
ttgtagtaaactattct

SEQ ID NO: 4514367 - DNA, 17 bp, Homo sapiens
ttgtataaaaattaagc

SEQ ID NO: 4514368 - DNA, 19 bp, Homo sapiens
ttgtataaactgtattttg

SEQ ID NO: 4514369 - DNA, 21 bp, Homo sapiens
ttgtataaactgtattttgaa

SEQ ID NO: 4514370 - DNA, 16 bp, Homo sapiens
ttgtataccaatgtgt

SEQ ID NO: 4514371 - DNA, 22 bp, Homo sapiens
ttgtataccaatgtgttttctg

SEQ ID NO: 4514372 - DNA, 22 bp, Homo sapiens
ttgtatactttaaataatttaa

SEQ ID NO: 4514373 - DNA, 16 bp, Homo sapiens
ttgtatagcttttatc

SEQ ID NO: 4514374 - DNA, 19 bp, Homo sapiens
ttgtatatattattataat

SEQ ID NO: 4514375 - DNA, 21 bp, Homo sapiens
ttgtatatattattataatct

SEQ ID NO: 4514376 - DNA, 14 bp, Homo sapiens
ttgtatattgtaat

SEQ ID NO: 4514377 - DNA, 20 bp, Homo sapiens
ttgtatctcagtctaaggtc

SEQ ID NO: 4514378 - DNA, 14 bp, Homo sapiens
ttgtatcttttatc

SEQ ID NO: 4514379 - DNA, 22 bp, Homo sapiens
ttgtatcttttatcctgggagc

SEQ ID NO: 4514380 - DNA, 22 bp, Homo sapiens
ttgtatgaaatatatgtgaaag

SEQ ID NO: 4514381 - DNA, 21 bp, Homo sapiens
ttgtatgcctttaaatctgtg

SEQ ID NO: 4514382 - DNA, 17 bp, Homo sapiens
ttgtatgttgaggatct

SEQ ID NO: 4514383 - DNA, 18 bp, Homo sapiens
ttgtatgttgaggatcta

SEQ ID NO: 4514384 - DNA, 12 bp, Homo sapiens
ttgtatgtttgc

SEQ ID NO: 4514385 - DNA, 15 bp, Homo sapiens
ttgtatgtttgctga

SEQ ID NO: 4514386 - DNA, 22 bp, Homo sapiens
ttgtattattacaaatattgtc

SEQ ID NO: 4514387 - DNA, 20 bp, Homo sapiens
ttgtattcctgcctttgatg

SEQ ID NO: 4514388 - DNA, 16 bp, Homo sapiens
ttgtattctctgagct

SEQ ID NO: 4514389 - DNA, 23 bp, Homo sapiens
ttgtattctctgcaattttactg

SEQ ID NO: 4514390 - DNA, 17 bp, Homo sapiens
ttgtattcttcatgaaa

SEQ ID NO: 4514391 - DNA, 18 bp, Homo sapiens
ttgtattcttcatgaaat

SEQ ID NO: 4514392 - DNA, 22 bp, Homo sapiens
ttgtattcttcatgaaatgtgt

SEQ ID NO: 4514393 - DNA, 12 bp, Homo sapiens
ttgtattgtaaa

SEQ ID NO: 4514394 - DNA, 20 bp, Homo sapiens
ttgtattgttagatgtttgt

SEQ ID NO: 4514395 - DNA, 16 bp, Homo sapiens
ttgtattgtttcaatt

SEQ ID NO: 4514396 - DNA, 13 bp, Homo sapiens
ttgtatttaacag

SEQ ID NO: 4514397 - DNA, 14 bp, Homo sapiens
ttgtatttcaaata

SEQ ID NO: 4514398 - DNA, 15 bp, Homo sapiens
ttgtatttcaaatat

SEQ ID NO: 4514399 - DNA, 19 bp, Homo sapiens
ttgtatttgtattctctgc

SEQ ID NO: 4514400 - DNA, 22 bp, Homo sapiens
ttgtcaaaataaagattctcac

SEQ ID NO: 4514401 - DNA, 14 bp, Homo sapiens
ttgtcaaaattgtt

SEQ ID NO: 4514402 - DNA, 13 bp, Homo sapiens
ttgtcaaagaagc

SEQ ID NO: 4514403 - DNA, 20 bp, Homo sapiens
ttgtcacacccatggcctca

SEQ ID NO: 4514404 - DNA, 19 bp, Homo sapiens
ttgtcacagtcttgtgaac

SEQ ID NO: 4514405 - DNA, 13 bp, Homo sapiens
ttgtcacgccaga

SEQ ID NO: 4514406 - DNA, 13 bp, Homo sapiens
ttgtcacttgcca

SEQ ID NO: 4514407 - DNA, 16 bp, Homo sapiens
ttgtcacttgccacat

SEQ ID NO: 4514408 - DNA, 23 bp, Homo sapiens
ttgtcatatgtagccttcacaca

SEQ ID NO: 4514409 - DNA, 13 bp, Homo sapiens
ttgtccagcgcct

SEQ ID NO: 4514410 - DNA, 17 bp, Homo sapiens
ttgtccaggaaagaaac

SEQ ID NO: 4514411 - DNA, 13 bp, Homo sapiens
ttgtccattgtcc

SEQ ID NO: 4514412 - DNA, 19 bp, Homo sapiens
ttgtcccaattaaaatact

SEQ ID NO: 4514413 - DNA, 17 bp, Homo sapiens
ttgtccccaatgaatat

SEQ ID NO: 4514414 - DNA, 18 bp, Homo sapiens
ttgtccccaatgaatata

SEQ ID NO: 4514415 - DNA, 11 bp, Homo sapiens
ttgtccccagt

SEQ ID NO: 4514416 - DNA, 17 bp, Homo sapiens
ttgtcctgggcctgccc

SEQ ID NO: 4514417 - DNA, 16 bp, Homo sapiens
ttgtccttcctgtgcc

SEQ ID NO: 4514418 - DNA, 22 bp, Homo sapiens
ttgtcgaaaagagtcttccaat

SEQ ID NO: 4514419 - DNA, 16 bp, Homo sapiens
ttgtctaaaatgtcag

SEQ ID NO: 4514420 - DNA, 17 bp, Homo sapiens
ttgtctactcctagaag

SEQ ID NO: 4514421 - DNA, 20 bp, Homo sapiens
ttgtctaggagatgctttct

SEQ ID NO: 4514422 - DNA, 15 bp, Homo sapiens
ttgtctattctccag

SEQ ID NO: 4514423 - DNA, 23 bp, Homo sapiens
ttgtctcaacgcctccccctccc

SEQ ID NO: 4514424 - DNA, 16 bp, Homo sapiens
ttgtctccacttgtat

SEQ ID NO: 4514425 - DNA, 19 bp, Homo sapiens
ttgtctctcttcagactct

SEQ ID NO: 4514426 - DNA, 16 bp, Homo sapiens
ttgtctcttacatctc

SEQ ID NO: 4514427 - DNA, 12 bp, Homo sapiens
ttgtctgtctac

SEQ ID NO: 4514428 - DNA, 17 bp, Homo sapiens
ttgtctgtgatctctgc

SEQ ID NO: 4514429 - DNA, 18 bp, Homo sapiens
ttgtcttaaaaaatgtga

SEQ ID NO: 4514430 - DNA, 14 bp, Homo sapiens
ttgtctttatatga

SEQ ID NO: 4514431 - DNA, 16 bp, Homo sapiens
ttgtctttatatgaac

SEQ ID NO: 4514432 - DNA, 14 bp, Homo sapiens
ttgtgaactggaag

SEQ ID NO: 4514433 - DNA, 12 bp, Homo sapiens
ttgtgaactttg

SEQ ID NO: 4514434 - DNA, 22 bp, Homo sapiens
ttgtgaaggcaggggaatgtat

SEQ ID NO: 4514435 - DNA, 18 bp, Homo sapiens
ttgtgaattaggctgtaa

SEQ ID NO: 4514436 - DNA, 17 bp, Homo sapiens
ttgtgacaggaaagccc

SEQ ID NO: 4514437 - DNA, 16 bp, Homo sapiens
ttgtgacttacaattt

SEQ ID NO: 4514438 - DNA, 16 bp, Homo sapiens
ttgtgacttcactgta

SEQ ID NO: 4514439 - DNA, 17 bp, Homo sapiens
ttgtgacttcactgtat

SEQ ID NO: 4514440 - DNA, 18 bp, Homo sapiens
ttgtgacttcactgtata

SEQ ID NO: 4514441 - DNA, 21 bp, Homo sapiens
ttgtgagctctggttattttt

SEQ ID NO: 4514442 - DNA, 11 bp, Homo sapiens
ttgtgatgaac

SEQ ID NO: 4514443 - DNA, 12 bp, Homo sapiens
ttgtgatgtgtc

SEQ ID NO: 4514444 - DNA, 21 bp, Homo sapiens
ttgtgcaaacatggagaaatc

SEQ ID NO: 4514445 - DNA, 23 bp, Homo sapiens
ttgtgcaaacatggagaaatcta

SEQ ID NO: 4514446 - DNA, 17 bp, Homo sapiens
ttgtgcaatgtaaatat

SEQ ID NO: 4514447 - DNA, 23 bp, Homo sapiens
ttgtgcaatgtaaatattttaaa

SEQ ID NO: 4514448 - DNA, 18 bp, Homo sapiens
ttgtgcctaatgtgtttg

SEQ ID NO: 4514449 - DNA, 16 bp, Homo sapiens
ttgtgctcaaggaatc

SEQ ID NO: 4514450 - DNA, 19 bp, Homo sapiens
ttgtggaatgttggataag

SEQ ID NO: 4514451 - DNA, 14 bp, Homo sapiens
ttgtggagagaatg

SEQ ID NO: 4514452 - DNA, 15 bp, Homo sapiens
ttgtggcaattttat

SEQ ID NO: 4514453 - DNA, 23 bp, Homo sapiens
ttgtggcctcaagcaatccacct

SEQ ID NO: 4514454 - DNA, 12 bp, Homo sapiens
ttgtggcctcag

SEQ ID NO: 4514455 - DNA, 18 bp, Homo sapiens
ttgtggctcctatctgtg

SEQ ID NO: 4514456 - DNA, 17 bp, Homo sapiens
ttgtgggcactgtgcca

SEQ ID NO: 4514457 - DNA, 20 bp, Homo sapiens
ttgtggggcctcaggctccg

SEQ ID NO: 4514458 - DNA, 17 bp, Homo sapiens
ttgtggtaatctacacc

SEQ ID NO: 4514459 - DNA, 16 bp, Homo sapiens
ttgtggtggtgctaaa

SEQ ID NO: 4514460 - DNA, 22 bp, Homo sapiens
ttgtggtggtgctaaaggaggc

SEQ ID NO: 4514461 - DNA, 14 bp, Homo sapiens
ttgtggtttagtta

SEQ ID NO: 4514462 - DNA, 15 bp, Homo sapiens
ttgtggttttatgga

SEQ ID NO: 4514463 - DNA, 21 bp, Homo sapiens
ttgtgtaataaagtgttttca

SEQ ID NO: 4514464 - DNA, 14 bp, Homo sapiens
ttgtgtaatctaag

SEQ ID NO: 4514465 - DNA, 21 bp, Homo sapiens
ttgtgtaatctaagtatatgt

SEQ ID NO: 4514466 - DNA, 14 bp, Homo sapiens
ttgtgtagatttga

SEQ ID NO: 4514467 - DNA, 16 bp, Homo sapiens
ttgtgtagatttgaaa

SEQ ID NO: 4514468 - DNA, 21 bp, Homo sapiens
ttgtgtatcttcgtaacttca

SEQ ID NO: 4514469 - DNA, 20 bp, Homo sapiens
ttgtgtatttacgctttgat

SEQ ID NO: 4514470 - DNA, 23 bp, Homo sapiens
ttgtgtatttacgctttgattca

SEQ ID NO: 4514471 - DNA, 15 bp, Homo sapiens
ttgtgtcaagacatt

SEQ ID NO: 4514472 - DNA, 16 bp, Homo sapiens
ttgtgtggattcttta

SEQ ID NO: 4514473 - DNA, 17 bp, Homo sapiens
ttgtgtggtattcaact

SEQ ID NO: 4514474 - DNA, 18 bp, Homo sapiens
ttgtgtgtatatgtattt

SEQ ID NO: 4514475 - DNA, 16 bp, Homo sapiens
ttgtgtgtatttgcta

SEQ ID NO: 4514476 - DNA, 10 bp, Homo sapiens
ttgtgtgtgg

SEQ ID NO: 4514477 - DNA, 17 bp, Homo sapiens
ttgtgtgttggctttgc

SEQ ID NO: 4514478 - DNA, 13 bp, Homo sapiens
ttggcattatctc

SEQ ID NO: 4514479 - DNA, 18 bp, Homo sapiens
ttggcattatctctttct

SEQ ID NO: 4514480 - DNA, 12 bp, Homo sapiens
ttggccacagac

SEQ ID NO: 4514481 - DNA, 15 bp, Homo sapiens
ttggccactggatcc

SEQ ID NO: 4514482 - DNA, 16 bp, Homo sapiens
ttggccactggatcct

SEQ ID NO: 4514483 - DNA, 14 bp, Homo sapiens
ttggccctttcctt

SEQ ID NO: 4514484 - DNA, 12 bp, Homo sapiens
ttggcctcagaa

SEQ ID NO: 4514485 - DNA, 23 bp, Homo sapiens
ttggcctcttcaggcctgctagt

SEQ ID NO: 4514486 - DNA, 21 bp, Homo sapiens
ttggcctggggtgcatctcct

SEQ ID NO: 4514487 - DNA, 21 bp, Homo sapiens
ttggccttaagaactgtgtct

SEQ ID NO: 4514488 - DNA, 19 bp, Homo sapiens
ttggctatgaaaatgagcc

SEQ ID NO: 4514489 - DNA, 17 bp, Homo sapiens
ttggctcagcccgctga

SEQ ID NO: 4514490 - DNA, 21 bp, Homo sapiens
ttggctggtagcagcaggctc

SEQ ID NO: 4514491 - DNA, 20 bp, Homo sapiens
ttggctgtgctgtattttga

SEQ ID NO: 4514492 - DNA, 22 bp, Homo sapiens
ttggctgtgctgtattttgata

SEQ ID NO: 4514493 - DNA, 15 bp, Homo sapiens
ttggctgttccagac

SEQ ID NO: 4514494 - DNA, 18 bp, Homo sapiens
ttggcttctgtttctagt

SEQ ID NO: 4514495 - DNA, 18 bp, Homo sapiens
ttggctttgcagctgctg

SEQ ID NO: 4514496 - DNA, 20 bp, Homo sapiens
ttggctttgcagctgctgtc

SEQ ID NO: 4514497 - DNA, 13 bp, Homo sapiens
ttggcttttttcc

SEQ ID NO: 4514498 - DNA, 23 bp, Homo sapiens
ttgggaaattaaatccaataaaa

SEQ ID NO: 4514499 - DNA, 18 bp, Homo sapiens
ttgggaagaatccagtat

SEQ ID NO: 4514500 - DNA, 20 bp, Homo sapiens
ttgggaatgaaattaacaca

SEQ ID NO: 4514501 - DNA, 22 bp, Homo sapiens
ttgggactgctaaataaaattt

SEQ ID NO: 4514502 - DNA, 12 bp, Homo sapiens
ttgggacttcta

SEQ ID NO: 4514503 - DNA, 19 bp, Homo sapiens
ttgggagcctgtggccagc

SEQ ID NO: 4514504 - DNA, 17 bp, Homo sapiens
ttgggatgtcttatttt

SEQ ID NO: 4514505 - DNA, 13 bp, Homo sapiens
ttgggatttgctg

SEQ ID NO: 4514506 - DNA, 11 bp, Homo sapiens
ttgggcagcca

SEQ ID NO: 4514507 - DNA, 14 bp, Homo sapiens
ttgggcagccagga

SEQ ID NO: 4514508 - DNA, 23 bp, Homo sapiens
ttgggcagccaggagtgcccccg

SEQ ID NO: 4514509 - DNA, 18 bp, Homo sapiens
ttgggcccggtccacagg

SEQ ID NO: 4514510 - DNA, 22 bp, Homo sapiens
ttgggctgaatgtatgtaaata

SEQ ID NO: 4514511 - DNA, 22 bp, Homo sapiens
ttggggaggagggggccgggcg

SEQ ID NO: 4514512 - DNA, 15 bp, Homo sapiens
ttggggattttcaaa

SEQ ID NO: 4514513 - DNA, 23 bp, Homo sapiens
ttggggcgcccacccggcccggc

SEQ ID NO: 4514514 - DNA, 14 bp, Homo sapiens
ttggggctcccagc

SEQ ID NO: 4514515 - DNA, 13 bp, Homo sapiens
ttggggcttcaca

SEQ ID NO: 4514516 - DNA, 16 bp, Homo sapiens
ttgggggaatgcacct

SEQ ID NO: 4514517 - DNA, 21 bp, Homo sapiens
ttgggggaatgcacctcccca

SEQ ID NO: 4514518 - DNA, 18 bp, Homo sapiens
ttgggggacagggctggc

SEQ ID NO: 4514519 - DNA, 21 bp, Homo sapiens
ttgggggacagggctggccca

SEQ ID NO: 4514520 - DNA, 21 bp, Homo sapiens
ttgggggggccaaaaggaaaa

SEQ ID NO: 4514521 - DNA, 17 bp, Homo sapiens
ttgggggtgtggctctg

SEQ ID NO: 4514522 - DNA, 18 bp, Homo sapiens
ttggggtgtggggtgggg

SEQ ID NO: 4514523 - DNA, 19 bp, Homo sapiens
ttggggtgtggggtggggt

SEQ ID NO: 4514524 - DNA, 17 bp, Homo sapiens
ttgggtatgtctacctg

SEQ ID NO: 4514525 - DNA, 19 bp, Homo sapiens
ttgggtgtagatttctgac

SEQ ID NO: 4514526 - DNA, 17 bp, Homo sapiens
ttgggttcatgatgcag

SEQ ID NO: 4514527 - DNA, 22 bp, Homo sapiens
ttgggttcatgatgcagtctcc

SEQ ID NO: 4514528 - DNA, 16 bp, Homo sapiens
ttgggtttttgctgtt

SEQ ID NO: 4514529 - DNA, 18 bp, Homo sapiens
ttggtaaaaatgctgctc

SEQ ID NO: 4514530 - DNA, 19 bp, Homo sapiens
ttggtaaaacagtttcatc

SEQ ID NO: 4514531 - DNA, 20 bp, Homo sapiens
ttggtaaaactcactgtgat

SEQ ID NO: 4514532 - DNA, 16 bp, Homo sapiens
ttggtaaagactggct

SEQ ID NO: 4514533 - DNA, 19 bp, Homo sapiens
ttggtaaagactggctttt

SEQ ID NO: 4514534 - DNA, 14 bp, Homo sapiens
ttggtacaaaaata

SEQ ID NO: 4514535 - DNA, 23 bp, Homo sapiens
ttggtacctctcatttgggcacc

SEQ ID NO: 4514536 - DNA, 18 bp, Homo sapiens
ttggtatagccatgattt

SEQ ID NO: 4514537 - DNA, 17 bp, Homo sapiens
ttggtcagagccactct

SEQ ID NO: 4514538 - DNA, 14 bp, Homo sapiens
ttggtgaagtaaat

SEQ ID NO: 4514539 - DNA, 21 bp, Homo sapiens
ttggtgacaaaattcatttgc

SEQ ID NO: 4514540 - DNA, 22 bp, Homo sapiens
ttggtgacaaaattcatttgct

SEQ ID NO: 4514541 - DNA, 20 bp, Homo sapiens
ttggtgaccagtttcttaaa

SEQ ID NO: 4514542 - DNA, 21 bp, Homo sapiens
ttggtgaccccatacatttgt

SEQ ID NO: 4514543 - DNA, 11 bp, Homo sapiens
ttggtgactca

SEQ ID NO: 4514544 - DNA, 16 bp, Homo sapiens
ttggtgcaacccttac

SEQ ID NO: 4514545 - DNA, 21 bp, Homo sapiens
ttggtgcaacccttacccctt

SEQ ID NO: 4514546 - DNA, 19 bp, Homo sapiens
ttggtgctcatttaaatat

SEQ ID NO: 4514547 - DNA, 21 bp, Homo sapiens
ttggtgttcgtttccatcatg

SEQ ID NO: 4514548 - DNA, 20 bp, Homo sapiens
ttggttcattaattctataa

SEQ ID NO: 4514549 - DNA, 18 bp, Homo sapiens
ttggttcccccactgatc

SEQ ID NO: 4514550 - DNA, 18 bp, Homo sapiens
ttggttcgatacctggag

SEQ ID NO: 4514551 - DNA, 17 bp, Homo sapiens
ttggtttaaagaaagtg

SEQ ID NO: 4514552 - DNA, 18 bp, Homo sapiens
ttggtttaaagaaagtgt

SEQ ID NO: 4514553 - DNA, 23 bp, Homo sapiens
ttggtttaaagaaagtgtatttg

SEQ ID NO: 4514554 - DNA, 23 bp, Homo sapiens
ttggttttatggttacttcttct

SEQ ID NO: 4514555 - DNA, 14 bp, Homo sapiens
ttggttttccatga

SEQ ID NO: 4514556 - DNA, 16 bp, Homo sapiens
ttggttttgctacata

SEQ ID NO: 4514557 - DNA, 14 bp, Homo sapiens
ttggttttgttccc

SEQ ID NO: 4514558 - DNA, 17 bp, Homo sapiens
ttggttttgttcccctc

SEQ ID NO: 4514559 - DNA, 14 bp, Homo sapiens
ttggtttttcctca

SEQ ID NO: 4514560 - DNA, 16 bp, Homo sapiens
ttgtaaaaatgagtca

SEQ ID NO: 4514561 - DNA, 13 bp, Homo sapiens
ttgtaaaagaaat

SEQ ID NO: 4514562 - DNA, 18 bp, Homo sapiens
ttgtaaaatattatgttt

SEQ ID NO: 4514563 - DNA, 12 bp, Homo sapiens
ttgtaaaatggt

SEQ ID NO: 4514564 - DNA, 13 bp, Homo sapiens
ttgtaaaatggtg

SEQ ID NO: 4514565 - DNA, 17 bp, Homo sapiens
ttgtaaaattatttcat

SEQ ID NO: 4514566 - DNA, 15 bp, Homo sapiens
ttgtaaactgtacta

SEQ ID NO: 4514567 - DNA, 21 bp, Homo sapiens
ttgtaaagactggttttctgc

SEQ ID NO: 4514568 - DNA, 17 bp, Homo sapiens
ttgtaaatcctgtgttt

SEQ ID NO: 4514569 - DNA, 21 bp, Homo sapiens
ttgtaaatctttttgcttcta

SEQ ID NO: 4514570 - DNA, 12 bp, Homo sapiens
ttgtaaatgcct

SEQ ID NO: 4514571 - DNA, 11 bp, Homo sapiens
ttgtaaatgtg

SEQ ID NO: 4514572 - DNA, 20 bp, Homo sapiens
ttgtaaattatatttgtgct

SEQ ID NO: 4514573 - DNA, 14 bp, Homo sapiens
ttgtaactccacca

SEQ ID NO: 4514574 - DNA, 16 bp, Homo sapiens
ttgtaacttcaaatat

SEQ ID NO: 4514575 - DNA, 14 bp, Homo sapiens
ttgtaagtatgtga

SEQ ID NO: 4514576 - DNA, 19 bp, Homo sapiens
ttgtaataaaactatttgt

SEQ ID NO: 4514577 - DNA, 20 bp, Homo sapiens
ttgtaataaaactatttgta

SEQ ID NO: 4514578 - DNA, 14 bp, Homo sapiens
ttgtaataaaatgt

SEQ ID NO: 4514579 - DNA, 13 bp, Homo sapiens
ttgtaataagcaa

SEQ ID NO: 4514580 - DNA, 13 bp, Homo sapiens
ttgtaatacttta

SEQ ID NO: 4514581 - DNA, 21 bp, Homo sapiens
ttgtaatagatgtttgataga

SEQ ID NO: 4514582 - DNA, 21 bp, Homo sapiens
ttgtaatatgtatattaagaa

SEQ ID NO: 4514583 - DNA, 19 bp, Homo sapiens
ttgtaatcattatctcact

SEQ ID NO: 4514584 - DNA, 18 bp, Homo sapiens
ttgtaatgaattcctaga

SEQ ID NO: 4514585 - DNA, 14 bp, Homo sapiens
ttgtaatgagcacc

SEQ ID NO: 4514586 - DNA, 16 bp, Homo sapiens
ttgtaatggtgaaaac

SEQ ID NO: 4514587 - DNA, 23 bp, Homo sapiens
ttgtaattaaaagcaaatcattt

SEQ ID NO: 4514588 - DNA, 15 bp, Homo sapiens
ttgtacaaactttgt

SEQ ID NO: 4514589 - DNA, 17 bp, Homo sapiens
ttgtacaaactttgttt

SEQ ID NO: 4514590 - DNA, 14 bp, Homo sapiens
ttgtacaagctcag

SEQ ID NO: 4514591 - DNA, 20 bp, Homo sapiens
ttgtacaattttaaagttct

SEQ ID NO: 4514592 - DNA, 12 bp, Homo sapiens
ttgtacagtttt

SEQ ID NO: 4514593 - DNA, 22 bp, Homo sapiens
ttgtacatacagaggtaactat

SEQ ID NO: 4514594 - DNA, 18 bp, Homo sapiens
ttgtacatgataagacat

SEQ ID NO: 4514595 - DNA, 21 bp, Homo sapiens
ttgtacatgataagacatttt

SEQ ID NO: 4514596 - DNA, 22 bp, Homo sapiens
ttgtaccagtgaatttttgcaa

SEQ ID NO: 4514597 - DNA, 23 bp, Homo sapiens
ttgtaccagtgaatttttgcaat

SEQ ID NO: 4514598 - DNA, 21 bp, Homo sapiens
ttgcaatctaatctgaactga

SEQ ID NO: 4514599 - DNA, 19 bp, Homo sapiens
ttgcaattaaacttccaaa

SEQ ID NO: 4514600 - DNA, 18 bp, Homo sapiens
ttgcacaatatttctttt

SEQ ID NO: 4514601 - DNA, 18 bp, Homo sapiens
ttgcacagccaaatttaa

SEQ ID NO: 4514602 - DNA, 14 bp, Homo sapiens
ttgcacatggattc

SEQ ID NO: 4514603 - DNA, 12 bp, Homo sapiens
ttgcaccaaaga

SEQ ID NO: 4514604 - DNA, 16 bp, Homo sapiens
ttgcaccatctgcttg

SEQ ID NO: 4514605 - DNA, 12 bp, Homo sapiens
ttgcacccagcc

SEQ ID NO: 4514606 - DNA, 18 bp, Homo sapiens
ttgcacgcgccctttcta

SEQ ID NO: 4514607 - DNA, 20 bp, Homo sapiens
ttgcacgcgccctttctacc

SEQ ID NO: 4514608 - DNA, 19 bp, Homo sapiens
ttgcactgaagagagcatt

SEQ ID NO: 4514609 - DNA, 12 bp, Homo sapiens
ttgcactgtggt

SEQ ID NO: 4514610 - DNA, 13 bp, Homo sapiens
ttgcactgtttgc

SEQ ID NO: 4514611 - DNA, 13 bp, Homo sapiens
ttgcactttgtag

SEQ ID NO: 4514612 - DNA, 17 bp, Homo sapiens
ttgcagaaaattctgtg

SEQ ID NO: 4514613 - DNA, 19 bp, Homo sapiens
ttgcagaagttcttagtgt

SEQ ID NO: 4514614 - DNA, 17 bp, Homo sapiens
ttgcagcagataacttt

SEQ ID NO: 4514615 - DNA, 15 bp, Homo sapiens
ttgcagcggctcctg

SEQ ID NO: 4514616 - DNA, 13 bp, Homo sapiens
ttgcagctgctgt

SEQ ID NO: 4514617 - DNA, 18 bp, Homo sapiens
ttgcagctgcttttgcag

SEQ ID NO: 4514618 - DNA, 23 bp, Homo sapiens
ttgcagctgcttttgcagaaatc

SEQ ID NO: 4514619 - DNA, 14 bp, Homo sapiens
ttgcagcttcaact

SEQ ID NO: 4514620 - DNA, 22 bp, Homo sapiens
ttgcagctttaacctgctggga

SEQ ID NO: 4514621 - DNA, 18 bp, Homo sapiens
ttgcagggagcatggctg

SEQ ID NO: 4514622 - DNA, 22 bp, Homo sapiens
ttgcagggtgggtgagctctca

SEQ ID NO: 4514623 - DNA, 18 bp, Homo sapiens
ttgcaggtggaactcagt

SEQ ID NO: 4514624 - DNA, 20 bp, Homo sapiens
ttgcaggtggaactcagtca

SEQ ID NO: 4514625 - DNA, 16 bp, Homo sapiens
ttgcaggttcatggat

SEQ ID NO: 4514626 - DNA, 21 bp, Homo sapiens
ttgcagttggactctcaggga

SEQ ID NO: 4514627 - DNA, 13 bp, Homo sapiens
ttgcagtttatca

SEQ ID NO: 4514628 - DNA, 23 bp, Homo sapiens
ttgcagtttatcattcaagtgta

SEQ ID NO: 4514629 - DNA, 19 bp, Homo sapiens
ttgcataacaattcctcta

SEQ ID NO: 4514630 - DNA, 18 bp, Homo sapiens
ttgcatagattccctgag

SEQ ID NO: 4514631 - DNA, 20 bp, Homo sapiens
ttgcatattttgagaaactg

SEQ ID NO: 4514632 - DNA, 21 bp, Homo sapiens
ttgcatattttgagaaactgc

SEQ ID NO: 4514633 - DNA, 14 bp, Homo sapiens
ttgcatctgcacat

SEQ ID NO: 4514634 - DNA, 21 bp, Homo sapiens
ttgcatctgcacataggcagt

SEQ ID NO: 4514635 - DNA, 22 bp, Homo sapiens
ttgcatgaaaatagctattttt

SEQ ID NO: 4514636 - DNA, 23 bp, Homo sapiens
ttgcatgaaattgtatctcagtc

SEQ ID NO: 4514637 - DNA, 20 bp, Homo sapiens
ttgcatgcgcccgaggcaga

SEQ ID NO: 4514638 - DNA, 13 bp, Homo sapiens
ttgcatgtagtaa

SEQ ID NO: 4514639 - DNA, 21 bp, Homo sapiens
ttgcatgtagtaacactaata

SEQ ID NO: 4514640 - DNA, 17 bp, Homo sapiens
ttgcatgttccactaac

SEQ ID NO: 4514641 - DNA, 13 bp, Homo sapiens
ttgcatgtttgaa

SEQ ID NO: 4514642 - DNA, 17 bp, Homo sapiens
ttgcatgtttttgaaaa

SEQ ID NO: 4514643 - DNA, 14 bp, Homo sapiens
ttgcattgaacaca

SEQ ID NO: 4514644 - DNA, 22 bp, Homo sapiens
ttgcattgaacacaaactgtaa

SEQ ID NO: 4514645 - DNA, 21 bp, Homo sapiens
ttgcatttaaaacagacactg

SEQ ID NO: 4514646 - DNA, 22 bp, Homo sapiens
ttgcatttaaaacagacactgg

SEQ ID NO: 4514647 - DNA, 17 bp, Homo sapiens
ttgcatttaaacatgtt

SEQ ID NO: 4514648 - DNA, 19 bp, Homo sapiens
ttgcatttatgatgcagtt

SEQ ID NO: 4514649 - DNA, 18 bp, Homo sapiens
ttgcatttttgttttgaa

SEQ ID NO: 4514650 - DNA, 19 bp, Homo sapiens
ttgcatttttgttttgaaa

SEQ ID NO: 4514651 - DNA, 20 bp, Homo sapiens
ttgcatttttgttttgaaag

SEQ ID NO: 4514652 - DNA, 13 bp, Homo sapiens
ttgccaaaaccaa

SEQ ID NO: 4514653 - DNA, 14 bp, Homo sapiens
ttgccaaaatacca

SEQ ID NO: 4514654 - DNA, 18 bp, Homo sapiens
ttgccaaaataccagagc

SEQ ID NO: 4514655 - DNA, 19 bp, Homo sapiens
ttgccaaaataccagagcc

SEQ ID NO: 4514656 - DNA, 13 bp, Homo sapiens
ttgccaaaattca

SEQ ID NO: 4514657 - DNA, 19 bp, Homo sapiens
ttgccaaaattcatttcta

SEQ ID NO: 4514658 - DNA, 11 bp, Homo sapiens
ttgccaaagct

SEQ ID NO: 4514659 - DNA, 14 bp, Homo sapiens
ttgccaacagttgt

SEQ ID NO: 4514660 - DNA, 20 bp, Homo sapiens
ttgccaacagttgtatgttt

SEQ ID NO: 4514661 - DNA, 15 bp, Homo sapiens
ttgccaagaaaatga

SEQ ID NO: 4514662 - DNA, 21 bp, Homo sapiens
ttgccaagaaaatgaagggat

SEQ ID NO: 4514663 - DNA, 14 bp, Homo sapiens
ttgccaagtcagca

SEQ ID NO: 4514664 - DNA, 20 bp, Homo sapiens
ttgccacaagtccagctggg

SEQ ID NO: 4514665 - DNA, 18 bp, Homo sapiens
ttgccacagtagaactgt

SEQ ID NO: 4514666 - DNA, 14 bp, Homo sapiens
ttgccacatcccta

SEQ ID NO: 4514667 - DNA, 24 bp, Homo sapiens
ttgccacatccctatagaccactg

SEQ ID NO: 4514668 - DNA, 14 bp, Homo sapiens
ttgccaccaggaga

SEQ ID NO: 4514669 - DNA, 15 bp, Homo sapiens
ttgccaccaggagaa

SEQ ID NO: 4514670 - DNA, 16 bp, Homo sapiens
ttgccaccaggagaac

SEQ ID NO: 4514671 - DNA, 12 bp, Homo sapiens
ttgccagaggcc

SEQ ID NO: 4514672 - DNA, 20 bp, Homo sapiens
ttgccagaggccctggaggg

SEQ ID NO: 4514673 - DNA, 21 bp, Homo sapiens
ttgccagaggccctggaggga

SEQ ID NO: 4514674 - DNA, 20 bp, Homo sapiens
ttgccagcagagccagggca

SEQ ID NO: 4514675 - DNA, 20 bp, Homo sapiens
ttgccaggaggaacaaagag

SEQ ID NO: 4514676 - DNA, 21 bp, Homo sapiens
ttgccagtcttttgtcctgca

SEQ ID NO: 4514677 - DNA, 15 bp, Homo sapiens
ttgccagtgtctttc

SEQ ID NO: 4514678 - DNA, 16 bp, Homo sapiens
ttgccagttttccctg

SEQ ID NO: 4514679 - DNA, 17 bp, Homo sapiens
ttgccagttttccctgg

SEQ ID NO: 4514680 - DNA, 16 bp, Homo sapiens
ttgcccagagatgcct

SEQ ID NO: 4514681 - DNA, 19 bp, Homo sapiens
ttgcccagagatgcctcca

SEQ ID NO: 4514682 - DNA, 22 bp, Homo sapiens
ttgcccagagatgcctccaccg

SEQ ID NO: 4514683 - DNA, 21 bp, Homo sapiens
ttgcccagtgagccctgctct

SEQ ID NO: 4514684 - DNA, 17 bp, Homo sapiens
ttgcccatcctgactga

SEQ ID NO: 4514685 - DNA, 16 bp, Homo sapiens
ttgcccatttacactt

SEQ ID NO: 4514686 - DNA, 14 bp, Homo sapiens
ttgcccctggcttt

SEQ ID NO: 4514687 - DNA, 21 bp, Homo sapiens
ttgcccgaaactaagccaggc

SEQ ID NO: 4514688 - DNA, 18 bp, Homo sapiens
ttgccctccaaatgtcct

SEQ ID NO: 4514689 - DNA, 14 bp, Homo sapiens
ttgccctcctgggc

SEQ ID NO: 4514690 - DNA, 13 bp, Homo sapiens
ttgccctgttaaa

SEQ ID NO: 4514691 - DNA, 15 bp, Homo sapiens
ttgccgctgtataaa

SEQ ID NO: 4514692 - DNA, 15 bp, Homo sapiens
ttgccgtctaggatt

SEQ ID NO: 4514693 - DNA, 18 bp, Homo sapiens
ttgccgtggcatcttaaa

SEQ ID NO: 4514694 - DNA, 18 bp, Homo sapiens
ttgcctaactaactggca

SEQ ID NO: 4514695 - DNA, 16 bp, Homo sapiens
ttgcctaattggaaag

SEQ ID NO: 4514696 - DNA, 21 bp, Homo sapiens
ttgcctaggctggaaatagga

SEQ ID NO: 4514697 - DNA, 15 bp, Homo sapiens
ttgcctcatttccct

SEQ ID NO: 4514698 - DNA, 21 bp, Homo sapiens
ttgcctcatttccctatcttc

SEQ ID NO: 4514699 - DNA, 17 bp, Homo sapiens
ttgcctccccatttccc

SEQ ID NO: 4514700 - DNA, 19 bp, Homo sapiens
ttgcctctgcagtctcatt

SEQ ID NO: 4514701 - DNA, 15 bp, Homo sapiens
ttgcctctgccctgg

SEQ ID NO: 4514702 - DNA, 19 bp, Homo sapiens
ttgcctctgtccccttctc

SEQ ID NO: 4514703 - DNA, 15 bp, Homo sapiens
ttgcctcttctttgt

SEQ ID NO: 4514704 - DNA, 15 bp, Homo sapiens
ttgcctgaactccag

SEQ ID NO: 4514705 - DNA, 13 bp, Homo sapiens
ttgcctgaagctt

SEQ ID NO: 4514706 - DNA, 21 bp, Homo sapiens
ttgcctgagaagaagtggctg

SEQ ID NO: 4514707 - DNA, 20 bp, Homo sapiens
ttgcctgcagtttcttgtgt

SEQ ID NO: 4514708 - DNA, 15 bp, Homo sapiens
ttgcctgtaagaaaa

SEQ ID NO: 4514709 - DNA, 12 bp, Homo sapiens
ttgcctgtcaag

SEQ ID NO: 4514710 - DNA, 16 bp, Homo sapiens
ttgccttatttctcat

SEQ ID NO: 4514711 - DNA, 12 bp, Homo sapiens
ttgccttatttg

SEQ ID NO: 4514712 - DNA, 20 bp, Homo sapiens
ttgccttatttgtctgtaaa

SEQ ID NO: 4514713 - DNA, 19 bp, Homo sapiens
ttgccttgaaatttacaca

SEQ ID NO: 4514714 - DNA, 14 bp, Homo sapiens
ttgcggttcaggaa

SEQ ID NO: 4514715 - DNA, 16 bp, Homo sapiens
ttgcgtacttgtaata

SEQ ID NO: 4514716 - DNA, 14 bp, Homo sapiens
ttgcgtcaagtcta

SEQ ID NO: 4514717 - DNA, 23 bp, Homo sapiens
ttgctaaaaaagcatatataact

SEQ ID NO: 4514718 - DNA, 15 bp, Homo sapiens
ttgctaaaagcatgt

SEQ ID NO: 4514719 - DNA, 13 bp, Homo sapiens
ttgctaatgttgc

SEQ ID NO: 4514720 - DNA, 15 bp, Homo sapiens
ttgctaatttttatt

SEQ ID NO: 4514721 - DNA, 23 bp, Homo sapiens
ttgctaccagtatttagaagcca

SEQ ID NO: 4514722 - DNA, 17 bp, Homo sapiens
ttgctacctcagtgctc

SEQ ID NO: 4514723 - DNA, 19 bp, Homo sapiens
ttgctacctcagtgctcct

SEQ ID NO: 4514724 - DNA, 20 bp, Homo sapiens
ttgctactataatcaaatga

SEQ ID NO: 4514725 - DNA, 14 bp, Homo sapiens
ttgctatacatgtt

SEQ ID NO: 4514726 - DNA, 22 bp, Homo sapiens
ttgctatacatgttggaaatgt

SEQ ID NO: 4514727 - DNA, 18 bp, Homo sapiens
ttgctatcaacaataaaa

SEQ ID NO: 4514728 - DNA, 22 bp, Homo sapiens
ttgctatcaacaataaaatttt

SEQ ID NO: 4514729 - DNA, 23 bp, Homo sapiens
ttgctcaaaacacttccagtctg

SEQ ID NO: 4514730 - DNA, 14 bp, Homo sapiens
ttgctcaaaatctg

SEQ ID NO: 4514731 - DNA, 13 bp, Homo sapiens
ttgctccctctcc

SEQ ID NO: 4514732 - DNA, 23 bp, Homo sapiens
ttgctccctctccaagacagcag

SEQ ID NO: 4514733 - DNA, 19 bp, Homo sapiens
ttgctcctgcatgcaacta

SEQ ID NO: 4514734 - DNA, 14 bp, Homo sapiens
ttgctcgcttttcc

SEQ ID NO: 4514735 - DNA, 12 bp, Homo sapiens
ttgctctatgtc

SEQ ID NO: 4514736 - DNA, 16 bp, Homo sapiens
ttgctctcctcatctc

SEQ ID NO: 4514737 - DNA, 22 bp, Homo sapiens
ttgctctgacctcctctgggcc

SEQ ID NO: 4514738 - DNA, 20 bp, Homo sapiens
ttgctctgtcccccaggctg

SEQ ID NO: 4514739 - DNA, 19 bp, Homo sapiens
ttgctcttcataataaacc

SEQ ID NO: 4514740 - DNA, 14 bp, Homo sapiens
ttgctgaactcagc

SEQ ID NO: 4514741 - DNA, 15 bp, Homo sapiens
ttgctgaactcagca

SEQ ID NO: 4514742 - DNA, 19 bp, Homo sapiens
ttgctgaagggcattcttt

SEQ ID NO: 4514743 - DNA, 16 bp, Homo sapiens
ttgctgaatgttgcat

SEQ ID NO: 4514744 - DNA, 14 bp, Homo sapiens
ttgctgaattctaa

SEQ ID NO: 4514745 - DNA, 23 bp, Homo sapiens
ttgctgacaaccattaaagtcag

SEQ ID NO: 4514746 - DNA, 17 bp, Homo sapiens
ttgctgattatttatga

SEQ ID NO: 4514747 - DNA, 18 bp, Homo sapiens
ttgctgattttaatggat

SEQ ID NO: 4514748 - DNA, 20 bp, Homo sapiens
ttgctgcaagcacagccctt

SEQ ID NO: 4514749 - DNA, 20 bp, Homo sapiens
ttgctgccccatcagtgctc

SEQ ID NO: 4514750 - DNA, 18 bp, Homo sapiens
ttgctgcccgcgggagac

SEQ ID NO: 4514751 - DNA, 15 bp, Homo sapiens
ttgctgcttggattt

SEQ ID NO: 4514752 - DNA, 19 bp, Homo sapiens
ttgctggaacacaggggcc

SEQ ID NO: 4514753 - DNA, 21 bp, Homo sapiens
ttgctggaataagttcaaatt

SEQ ID NO: 4514754 - DNA, 17 bp, Homo sapiens
ttgctggatcaggaagc

SEQ ID NO: 4514755 - DNA, 20 bp, Homo sapiens
ttgctgtagaagatggcact

SEQ ID NO: 4514756 - DNA, 18 bp, Homo sapiens
ttgctgtgaacaattgtc

SEQ ID NO: 4514757 - DNA, 15 bp, Homo sapiens
ttgctgttactgctt

SEQ ID NO: 4514758 - DNA, 19 bp, Homo sapiens
ttgctgttagttataaaac

SEQ ID NO: 4514759 - DNA, 20 bp, Homo sapiens
ttgctgttgacatatttaat

SEQ ID NO: 4514760 - DNA, 17 bp, Homo sapiens
ttgcttaaaatatgtga

SEQ ID NO: 4514761 - DNA, 23 bp, Homo sapiens
ttgcttaaaatatgtgaagtttt

SEQ ID NO: 4514762 - DNA, 16 bp, Homo sapiens
ttgcttaacttccatg

SEQ ID NO: 4514763 - DNA, 16 bp, Homo sapiens
ttgcttcaatttcaaa

SEQ ID NO: 4514764 - DNA, 21 bp, Homo sapiens
ttgcttcaatttcaaactttt

SEQ ID NO: 4514765 - DNA, 19 bp, Homo sapiens
ttgcttcctgtgtaacatc

SEQ ID NO: 4514766 - DNA, 20 bp, Homo sapiens
ttgcttcctgtgtaacatct

SEQ ID NO: 4514767 - DNA, 21 bp, Homo sapiens
ttgcttcctgtgtaacatctg

SEQ ID NO: 4514768 - DNA, 17 bp, Homo sapiens
ttgcttctacatgatgc

SEQ ID NO: 4514769 - DNA, 16 bp, Homo sapiens
ttgcttctactttcat

SEQ ID NO: 4514770 - DNA, 23 bp, Homo sapiens
ttgcttctaggagtcaactggct

SEQ ID NO: 4514771 - DNA, 13 bp, Homo sapiens
ttgcttgaacaca

SEQ ID NO: 4514772 - DNA, 15 bp, Homo sapiens
ttgcttgagctcagg

SEQ ID NO: 4514773 - DNA, 16 bp, Homo sapiens
ttgctttaatatgagc

SEQ ID NO: 4514774 - DNA, 13 bp, Homo sapiens
ttgctttaatgag

SEQ ID NO: 4514775 - DNA, 12 bp, Homo sapiens
ttgctttcaatt

SEQ ID NO: 4514776 - DNA, 15 bp, Homo sapiens
ttgctttctctctca

SEQ ID NO: 4514777 - DNA, 13 bp, Homo sapiens
ttgcttttagaaa

SEQ ID NO: 4514778 - DNA, 22 bp, Homo sapiens
ttggaaaaatgggtcttttata

SEQ ID NO: 4514779 - DNA, 18 bp, Homo sapiens
ttggaaaacaaaagtttt

SEQ ID NO: 4514780 - DNA, 20 bp, Homo sapiens
ttggaaagtgccagcattcc

SEQ ID NO: 4514781 - DNA, 15 bp, Homo sapiens
ttggaaataaaaatg

SEQ ID NO: 4514782 - DNA, 15 bp, Homo sapiens
ttggaaataaaagat

SEQ ID NO: 4514783 - DNA, 21 bp, Homo sapiens
ttggaaataaagtcagatgga

SEQ ID NO: 4514784 - DNA, 18 bp, Homo sapiens
ttggaaatagaaagaagc

SEQ ID NO: 4514785 - DNA, 23 bp, Homo sapiens
ttggaaatcagtagaaagctaaa

SEQ ID NO: 4514786 - DNA, 21 bp, Homo sapiens
ttggaaatggatgcaaagtac

SEQ ID NO: 4514787 - DNA, 16 bp, Homo sapiens
ttggaacaaagtgaag

SEQ ID NO: 4514788 - DNA, 14 bp, Homo sapiens
ttggaaccagcccc

SEQ ID NO: 4514789 - DNA, 16 bp, Homo sapiens
ttggaaccagccccat

SEQ ID NO: 4514790 - DNA, 16 bp, Homo sapiens
ttggaactgtgtttca

SEQ ID NO: 4514791 - DNA, 22 bp, Homo sapiens
ttggaagaagttttttactttg

SEQ ID NO: 4514792 - DNA, 21 bp, Homo sapiens
ttggaagctgtttggaaaaga

SEQ ID NO: 4514793 - DNA, 13 bp, Homo sapiens
ttggaatattaaa

SEQ ID NO: 4514794 - DNA, 17 bp, Homo sapiens
ttggaatattaaaaaac

SEQ ID NO: 4514795 - DNA, 20 bp, Homo sapiens
ttggaatcctccttaattta

SEQ ID NO: 4514796 - DNA, 23 bp, Homo sapiens
ttggaatgggagaggcaataaat

SEQ ID NO: 4514797 - DNA, 20 bp, Homo sapiens
ttggacaaatcacatatttt

SEQ ID NO: 4514798 - DNA, 20 bp, Homo sapiens
ttggacattttatgtctttc

SEQ ID NO: 4514799 - DNA, 15 bp, Homo sapiens
ttggaccatgccaga

SEQ ID NO: 4514800 - DNA, 14 bp, Homo sapiens
ttggacccacctgt

SEQ ID NO: 4514801 - DNA, 17 bp, Homo sapiens
ttggacccagggcctga

SEQ ID NO: 4514802 - DNA, 13 bp, Homo sapiens
ttggacccttcca

SEQ ID NO: 4514803 - DNA, 14 bp, Homo sapiens
ttggacccttccat

SEQ ID NO: 4514804 - DNA, 16 bp, Homo sapiens
ttggacttgtcccggg

SEQ ID NO: 4514805 - DNA, 16 bp, Homo sapiens
ttggagaagatttatg

SEQ ID NO: 4514806 - DNA, 17 bp, Homo sapiens
ttggagagttaaatggt

SEQ ID NO: 4514807 - DNA, 15 bp, Homo sapiens
ttggagcacaaaatt

SEQ ID NO: 4514808 - DNA, 23 bp, Homo sapiens
ttggagcattaactaaatgctca

SEQ ID NO: 4514809 - DNA, 22 bp, Homo sapiens
ttggagctgttccattgggtcc

SEQ ID NO: 4514810 - DNA, 20 bp, Homo sapiens
ttggagctttggaatatttt

SEQ ID NO: 4514811 - DNA, 21 bp, Homo sapiens
ttggaggaggggtatgaagta

SEQ ID NO: 4514812 - DNA, 17 bp, Homo sapiens
ttggagggtcccaagct

SEQ ID NO: 4514813 - DNA, 23 bp, Homo sapiens
ttggagtcccaggggcagccaca

SEQ ID NO: 4514814 - DNA, 16 bp, Homo sapiens
ttggagtgttatgtat

SEQ ID NO: 4514815 - DNA, 17 bp, Homo sapiens
ttggagtttgggctgga

SEQ ID NO: 4514816 - DNA, 20 bp, Homo sapiens
ttggatatgtaaaacattta

SEQ ID NO: 4514817 - DNA, 15 bp, Homo sapiens
ttggatattctcctc

SEQ ID NO: 4514818 - DNA, 20 bp, Homo sapiens
ttggatctattgatttgaaa

SEQ ID NO: 4514819 - DNA, 19 bp, Homo sapiens
ttggatctccaattgcctc

SEQ ID NO: 4514820 - DNA, 13 bp, Homo sapiens
ttggatctggggt

SEQ ID NO: 4514821 - DNA, 21 bp, Homo sapiens
ttggatggcttaagcctgtgt

SEQ ID NO: 4514822 - DNA, 23 bp, Homo sapiens
ttggattccatgctaagcaagct

SEQ ID NO: 4514823 - DNA, 21 bp, Homo sapiens
ttggatttaaaagcctgctca

SEQ ID NO: 4514824 - DNA, 16 bp, Homo sapiens
ttggatttagtttcag

SEQ ID NO: 4514825 - DNA, 15 bp, Homo sapiens
ttggatttctgtgaa

SEQ ID NO: 4514826 - DNA, 17 bp, Homo sapiens
ttggatttctgtgaagt

SEQ ID NO: 4514827 - DNA, 13 bp, Homo sapiens
ttggatttgctgt

SEQ ID NO: 4514828 - DNA, 19 bp, Homo sapiens
ttggatttgtgtgtatgtg

SEQ ID NO: 4514829 - DNA, 20 bp, Homo sapiens
ttggcaccatggtatcatat

SEQ ID NO: 4514830 - DNA, 18 bp, Homo sapiens
ttggcacccccatgctgc

SEQ ID NO: 4514831 - DNA, 14 bp, Homo sapiens
ttggcactctctgc

SEQ ID NO: 4514832 - DNA, 20 bp, Homo sapiens
ttggcacttgccattccaaa

SEQ ID NO: 4514833 - DNA, 16 bp, Homo sapiens
ttggcagctctactct

SEQ ID NO: 4514834 - DNA, 21 bp, Homo sapiens
ttggcaggcccactccccagc

SEQ ID NO: 4514835 - DNA, 14 bp, Homo sapiens
ttggcagtctgaat

SEQ ID NO: 4514836 - DNA, 20 bp, Homo sapiens
ttggcataatagtcaatttc

SEQ ID NO: 4514837 - DNA, 16 bp, Homo sapiens
ttggcataatttgtct

SEQ ID NO: 4514838 - DNA, 15 bp, Homo sapiens
tttaaacaagtattt

SEQ ID NO: 4514839 - DNA, 17 bp, Homo sapiens
tttaaacccaaaatata

SEQ ID NO: 4514840 - DNA, 17 bp, Homo sapiens
tttaaaccgctaaaaga

SEQ ID NO: 4514841 - DNA, 11 bp, Homo sapiens
tttaaactttc

SEQ ID NO: 4514842 - DNA, 13 bp, Homo sapiens
tttaaagaattgt

SEQ ID NO: 4514843 - DNA, 22 bp, Homo sapiens
tttaaagcaccgaggttgcatt

SEQ ID NO: 4514844 - DNA, 17 bp, Homo sapiens
tttaaagcgtttgcaca

SEQ ID NO: 4514845 - DNA, 15 bp, Homo sapiens
tttaaagtatgcatt

SEQ ID NO: 4514846 - DNA, 12 bp, Homo sapiens
tttaaagttctg

SEQ ID NO: 4514847 - DNA, 13 bp, Homo sapiens
tttaaagttctgt

SEQ ID NO: 4514848 - DNA, 17 bp, Homo sapiens
tttaaataaaagcacaa

SEQ ID NO: 4514849 - DNA, 12 bp, Homo sapiens
tttaaataataa

SEQ ID NO: 4514850 - DNA, 20 bp, Homo sapiens
tttaaatacagtcttccatt

SEQ ID NO: 4514851 - DNA, 13 bp, Homo sapiens
tttaaatatatat

SEQ ID NO: 4514852 - DNA, 20 bp, Homo sapiens
tttaaatatccatttatctt

SEQ ID NO: 4514853 - DNA, 23 bp, Homo sapiens
tttaaatatctgaacatttacta

SEQ ID NO: 4514854 - DNA, 15 bp, Homo sapiens
tttaaatattttcta

SEQ ID NO: 4514855 - DNA, 22 bp, Homo sapiens
tttaaatcaaggaaaggctcat

SEQ ID NO: 4514856 - DNA, 14 bp, Homo sapiens
tttaaatgacagta

SEQ ID NO: 4514857 - DNA, 17 bp, Homo sapiens
tttaaatggaattttct

SEQ ID NO: 4514858 - DNA, 15 bp, Homo sapiens
tttaaatgtaaagat

SEQ ID NO: 4514859 - DNA, 20 bp, Homo sapiens
tttaaatgtacagacatatt

SEQ ID NO: 4514860 - DNA, 15 bp, Homo sapiens
tttaaatgtatacta

SEQ ID NO: 4514861 - DNA, 17 bp, Homo sapiens
tttaaatgtgtacaatg

SEQ ID NO: 4514862 - DNA, 19 bp, Homo sapiens
tttaaatgtgtacaatgta

SEQ ID NO: 4514863 - DNA, 19 bp, Homo sapiens
tttaaattacctttacata

SEQ ID NO: 4514864 - DNA, 15 bp, Homo sapiens
tttaaattagaaaat

SEQ ID NO: 4514865 - DNA, 15 bp, Homo sapiens
tttaaattataagga

SEQ ID NO: 4514866 - DNA, 19 bp, Homo sapiens
tttaaattataaggactgc

SEQ ID NO: 4514867 - DNA, 22 bp, Homo sapiens
tttaaattataaggactgcatg

SEQ ID NO: 4514868 - DNA, 21 bp, Homo sapiens
tttaaattatatgatatgcat

SEQ ID NO: 4514869 - DNA, 21 bp, Homo sapiens
tttaaattattatcttcttaa

SEQ ID NO: 4514870 - DNA, 19 bp, Homo sapiens
tttaaattccactgaaaat

SEQ ID NO: 4514871 - DNA, 20 bp, Homo sapiens
tttaaattccactgaaaatt

SEQ ID NO: 4514872 - DNA, 20 bp, Homo sapiens
tttaaattggtcatggtaga

SEQ ID NO: 4514873 - DNA, 14 bp, Homo sapiens
tttaaatttgttat

SEQ ID NO: 4514874 - DNA, 17 bp, Homo sapiens
tttaaattttcttcagt

SEQ ID NO: 4514875 - DNA, 21 bp, Homo sapiens
tttaaattttcttcagttggt

SEQ ID NO: 4514876 - DNA, 19 bp, Homo sapiens
tttaacaaaaagtgcttca

SEQ ID NO: 4514877 - DNA, 21 bp, Homo sapiens
tttaacagaaattgtatattg

SEQ ID NO: 4514878 - DNA, 16 bp, Homo sapiens
tttaacattgtttttg

SEQ ID NO: 4514879 - DNA, 13 bp, Homo sapiens
tttaacccctcca

SEQ ID NO: 4514880 - DNA, 18 bp, Homo sapiens
tttaacctgttatttcta

SEQ ID NO: 4514881 - DNA, 13 bp, Homo sapiens
tttaacgctgcct

SEQ ID NO: 4514882 - DNA, 18 bp, Homo sapiens
tttaactacccttaatta

SEQ ID NO: 4514883 - DNA, 18 bp, Homo sapiens
tttaactctactgtgtaa

SEQ ID NO: 4514884 - DNA, 21 bp, Homo sapiens
tttaactctactgtgtaatat

SEQ ID NO: 4514885 - DNA, 14 bp, Homo sapiens
tttaactgattaaa

SEQ ID NO: 4514886 - DNA, 21 bp, Homo sapiens
tttaactgatttaacactttt

SEQ ID NO: 4514887 - DNA, 21 bp, Homo sapiens
tttaactgccgtaatttaact

SEQ ID NO: 4514888 - DNA, 19 bp, Homo sapiens
tttaactggtgcactttgt

SEQ ID NO: 4514889 - DNA, 23 bp, Homo sapiens
tttaactggtgcactttgtaaat

SEQ ID NO: 4514890 - DNA, 14 bp, Homo sapiens
tttaacttaaatag

SEQ ID NO: 4514891 - DNA, 14 bp, Homo sapiens
tttaactttaatac

SEQ ID NO: 4514892 - DNA, 19 bp, Homo sapiens
tttaagaaaaaaagcaaaa

SEQ ID NO: 4514893 - DNA, 14 bp, Homo sapiens
tttaagaaatagaa

SEQ ID NO: 4514894 - DNA, 21 bp, Homo sapiens
tttaagaaccttaatgacaac

SEQ ID NO: 4514895 - DNA, 16 bp, Homo sapiens
tttaagacgtgaatgt

SEQ ID NO: 4514896 - DNA, 20 bp, Homo sapiens
tttaagaggctttggcccaa

SEQ ID NO: 4514897 - DNA, 14 bp, Homo sapiens
tttaagatagtgta

SEQ ID NO: 4514898 - DNA, 15 bp, Homo sapiens
tttaagatccagaaa

SEQ ID NO: 4514899 - DNA, 15 bp, Homo sapiens
tttaagatgtacatt

SEQ ID NO: 4514900 - DNA, 18 bp, Homo sapiens
tttaagatgtacatttaa

SEQ ID NO: 4514901 - DNA, 19 bp, Homo sapiens
tttaagatgtacatttaat

SEQ ID NO: 4514902 - DNA, 15 bp, Homo sapiens
tttaagatttctcta

SEQ ID NO: 4514903 - DNA, 16 bp, Homo sapiens
tttaagatttctctaa

SEQ ID NO: 4514904 - DNA, 16 bp, Homo sapiens
tttaagcaaatactta

SEQ ID NO: 4514905 - DNA, 12 bp, Homo sapiens
tttaagccaaaa

SEQ ID NO: 4514906 - DNA, 20 bp, Homo sapiens
tttaagctgcaaatctgatg

SEQ ID NO: 4514907 - DNA, 18 bp, Homo sapiens
tttaaggctaaaacttaa

SEQ ID NO: 4514908 - DNA, 22 bp, Homo sapiens
tttaagtagtgggcatttcata

SEQ ID NO: 4514909 - DNA, 18 bp, Homo sapiens
tttaagtcattttttact

SEQ ID NO: 4514910 - DNA, 19 bp, Homo sapiens
tttaagtcattttttactt

SEQ ID NO: 4514911 - DNA, 20 bp, Homo sapiens
tttaagtgaatacattaacg

SEQ ID NO: 4514912 - DNA, 12 bp, Homo sapiens
tttaagtgacat

SEQ ID NO: 4514913 - DNA, 21 bp, Homo sapiens
tttaagttgtcaaagaagctt

SEQ ID NO: 4514914 - DNA, 21 bp, Homo sapiens
tttaagttgtctgtctgaatg

SEQ ID NO: 4514915 - DNA, 21 bp, Homo sapiens
tttaataaaactgcgaggaca

SEQ ID NO: 4514916 - DNA, 19 bp, Homo sapiens
tttaataaactactctttg

SEQ ID NO: 4514917 - DNA, 14 bp, Homo sapiens
tttaatatataatt

SEQ ID NO: 4514918 - DNA, 19 bp, Homo sapiens
tttaatatataatttaatg

SEQ ID NO: 4514919 - DNA, 14 bp, Homo sapiens
tttaatatgagctt

SEQ ID NO: 4514920 - DNA, 21 bp, Homo sapiens
tttaatatgagcttcaatata

SEQ ID NO: 4514921 - DNA, 15 bp, Homo sapiens
tttaatattacctaa

SEQ ID NO: 4514922 - DNA, 22 bp, Homo sapiens
tttaatattgagaaagaaacta

SEQ ID NO: 4514923 - DNA, 18 bp, Homo sapiens
tttaatattttgtaatat

SEQ ID NO: 4514924 - DNA, 20 bp, Homo sapiens
tttaatcatgaatatgatga

SEQ ID NO: 4514925 - DNA, 16 bp, Homo sapiens
tttaatcccagcactt

SEQ ID NO: 4514926 - DNA, 17 bp, Homo sapiens
tttaatgagaatagaaa

SEQ ID NO: 4514927 - DNA, 21 bp, Homo sapiens
tttaatgagaatagaaacgta

SEQ ID NO: 4514928 - DNA, 15 bp, Homo sapiens
tttaatgctatttga

SEQ ID NO: 4514929 - DNA, 17 bp, Homo sapiens
tttaatggcagcagaaa

SEQ ID NO: 4514930 - DNA, 14 bp, Homo sapiens
tttaatggcagcta

SEQ ID NO: 4514931 - DNA, 16 bp, Homo sapiens
tttaatgtaaagattt

SEQ ID NO: 4514932 - DNA, 19 bp, Homo sapiens
tttaatgtaaataaaacat

SEQ ID NO: 4514933 - DNA, 15 bp, Homo sapiens
tttaatgtatctatt

SEQ ID NO: 4514934 - DNA, 18 bp, Homo sapiens
tttaatgtgctctgtacc

SEQ ID NO: 4514935 - DNA, 19 bp, Homo sapiens
tttaatgtgctctgtacct

SEQ ID NO: 4514936 - DNA, 17 bp, Homo sapiens
tttaatgttacatagta

SEQ ID NO: 4514937 - DNA, 16 bp, Homo sapiens
tttaattaaaaacttt

SEQ ID NO: 4514938 - DNA, 13 bp, Homo sapiens
tttaattatgaaa

SEQ ID NO: 4514939 - DNA, 12 bp, Homo sapiens
tttaattcaaga

SEQ ID NO: 4514940 - DNA, 15 bp, Homo sapiens
tttaattgctttgaa

SEQ ID NO: 4514941 - DNA, 12 bp, Homo sapiens
tttaattgtaaa

SEQ ID NO: 4514942 - DNA, 16 bp, Homo sapiens
tttaatttagtaaatg

SEQ ID NO: 4514943 - DNA, 14 bp, Homo sapiens
tttaatttccaaaa

SEQ ID NO: 4514944 - DNA, 12 bp, Homo sapiens
tttaatttgatg

SEQ ID NO: 4514945 - DNA, 15 bp, Homo sapiens
tttaattttcaggtc

SEQ ID NO: 4514946 - DNA, 13 bp, Homo sapiens
tttacaaaccttt

SEQ ID NO: 4514947 - DNA, 16 bp, Homo sapiens
tttacaaacctttgtt

SEQ ID NO: 4514948 - DNA, 11 bp, Homo sapiens
tttacaagaag

SEQ ID NO: 4514949 - DNA, 17 bp, Homo sapiens
tttacaatagttctgtg

SEQ ID NO: 4514950 - DNA, 21 bp, Homo sapiens
tttacactattgtgaatattt

SEQ ID NO: 4514951 - DNA, 13 bp, Homo sapiens
tttacagagacag

SEQ ID NO: 4514952 - DNA, 21 bp, Homo sapiens
tttacagcactactctgtgcc

SEQ ID NO: 4514953 - DNA, 18 bp, Homo sapiens
tttacaggggttgtgggg

SEQ ID NO: 4514954 - DNA, 14 bp, Homo sapiens
tttacagtaaaatt

SEQ ID NO: 4514955 - DNA, 19 bp, Homo sapiens
tttacagtgaagaaagcct

SEQ ID NO: 4514956 - DNA, 19 bp, Homo sapiens
tttacataacggaaagttt

SEQ ID NO: 4514957 - DNA, 14 bp, Homo sapiens
tttacatactttat

SEQ ID NO: 4514958 - DNA, 16 bp, Homo sapiens
tttacatttcttttaa

SEQ ID NO: 4514959 - DNA, 20 bp, Homo sapiens
ttgtgttcccatttcagctg

SEQ ID NO: 4514960 - DNA, 15 bp, Homo sapiens
ttgttaaaagatggt

SEQ ID NO: 4514961 - DNA, 14 bp, Homo sapiens
ttgttaacagcaac

SEQ ID NO: 4514962 - DNA, 18 bp, Homo sapiens
ttgttaacctttctaacc

SEQ ID NO: 4514963 - DNA, 22 bp, Homo sapiens
ttgttaatatcactcattaatt

SEQ ID NO: 4514964 - DNA, 13 bp, Homo sapiens
ttgttaatgcttt

SEQ ID NO: 4514965 - DNA, 19 bp, Homo sapiens
ttgttaatttagaaaactt

SEQ ID NO: 4514966 - DNA, 20 bp, Homo sapiens
ttgttaatttagaaaacttt

SEQ ID NO: 4514967 - DNA, 17 bp, Homo sapiens
ttgttaatttcagtcct

SEQ ID NO: 4514968 - DNA, 17 bp, Homo sapiens
ttgttacaattctagga

SEQ ID NO: 4514969 - DNA, 21 bp, Homo sapiens
ttgttacataaggatgacttt

SEQ ID NO: 4514970 - DNA, 15 bp, Homo sapiens
ttgttactcttacga

SEQ ID NO: 4514971 - DNA, 14 bp, Homo sapiens
ttgttactgcatca

SEQ ID NO: 4514972 - DNA, 19 bp, Homo sapiens
ttgttactgctgattcttg

SEQ ID NO: 4514973 - DNA, 24 bp, Homo sapiens
ttgttactgctgattcttgtaaat

SEQ ID NO: 4514974 - DNA, 21 bp, Homo sapiens
ttgttagcaaactatttcagt

SEQ ID NO: 4514975 - DNA, 16 bp, Homo sapiens
ttgttagcaaatgaca

SEQ ID NO: 4514976 - DNA, 19 bp, Homo sapiens
ttgttaggagatgtcatca

SEQ ID NO: 4514977 - DNA, 14 bp, Homo sapiens
ttgttataaataaa

SEQ ID NO: 4514978 - DNA, 16 bp, Homo sapiens
ttgttatcagtcaata

SEQ ID NO: 4514979 - DNA, 18 bp, Homo sapiens
ttgttatgtagataacaa

SEQ ID NO: 4514980 - DNA, 14 bp, Homo sapiens
ttgttattaaatgt

SEQ ID NO: 4514981 - DNA, 15 bp, Homo sapiens
ttgttattataacat

SEQ ID NO: 4514982 - DNA, 15 bp, Homo sapiens
ttgttatttattgaa

SEQ ID NO: 4514983 - DNA, 20 bp, Homo sapiens
ttgttatttattgaaatgat

SEQ ID NO: 4514984 - DNA, 23 bp, Homo sapiens
ttgttatttgaaaacatgtttat

SEQ ID NO: 4514985 - DNA, 15 bp, Homo sapiens
ttgttattttgcaac

SEQ ID NO: 4514986 - DNA, 16 bp, Homo sapiens
ttgttcagcatgcaat

SEQ ID NO: 4514987 - DNA, 15 bp, Homo sapiens
ttgttcccctcctcc

SEQ ID NO: 4514988 - DNA, 14 bp, Homo sapiens
ttgttccttttgta

SEQ ID NO: 4514989 - DNA, 11 bp, Homo sapiens
ttgttctagac

SEQ ID NO: 4514990 - DNA, 21 bp, Homo sapiens
ttgttctagacttccccatcc

SEQ ID NO: 4514991 - DNA, 22 bp, Homo sapiens
ttgttctccgggtgtggcctca

SEQ ID NO: 4514992 - DNA, 20 bp, Homo sapiens
ttgttctctgaattttcaga

SEQ ID NO: 4514993 - DNA, 13 bp, Homo sapiens
ttgttctgttcct

SEQ ID NO: 4514994 - DNA, 15 bp, Homo sapiens
ttgttcttgtattta

SEQ ID NO: 4514995 - DNA, 14 bp, Homo sapiens
ttgttctttcatat

SEQ ID NO: 4514996 - DNA, 17 bp, Homo sapiens
ttgttgaacaggtgttt

SEQ ID NO: 4514997 - DNA, 17 bp, Homo sapiens
ttgttgacagcttggaa

SEQ ID NO: 4514998 - DNA, 17 bp, Homo sapiens
ttgttgactgtgattag

SEQ ID NO: 4514999 - DNA, 18 bp, Homo sapiens
ttgttgagctattgctgt

SEQ ID NO: 4515000 - DNA, 15 bp, Homo sapiens
ttgttgatattgttt

SEQ ID NO: 4515001 - DNA, 20 bp, Homo sapiens
ttgttgcaagatgtgaatta

SEQ ID NO: 4515002 - DNA, 19 bp, Homo sapiens
ttgttgcaagtactgctgt

SEQ ID NO: 4515003 - DNA, 16 bp, Homo sapiens
ttgttgcgttcctttc

SEQ ID NO: 4515004 - DNA, 23 bp, Homo sapiens
ttgttggagagttaaatggtctc

SEQ ID NO: 4515005 - DNA, 16 bp, Homo sapiens
ttgttggggctttaca

SEQ ID NO: 4515006 - DNA, 21 bp, Homo sapiens
ttgttgtaaaacaaaatttga

SEQ ID NO: 4515007 - DNA, 23 bp, Homo sapiens
ttgttgtagattgattgtattgt

SEQ ID NO: 4515008 - DNA, 15 bp, Homo sapiens
ttgttgtattcctgc

SEQ ID NO: 4515009 - DNA, 12 bp, Homo sapiens
ttgttgtctcca

SEQ ID NO: 4515010 - DNA, 14 bp, Homo sapiens
ttgttgtgtgtata

SEQ ID NO: 4515011 - DNA, 15 bp, Homo sapiens
ttgtttaaacaatct

SEQ ID NO: 4515012 - DNA, 16 bp, Homo sapiens
ttgtttaaacccaagt

SEQ ID NO: 4515013 - DNA, 13 bp, Homo sapiens
ttgtttaaatgcc

SEQ ID NO: 4515014 - DNA, 13 bp, Homo sapiens
ttgtttacaataa

SEQ ID NO: 4515015 - DNA, 21 bp, Homo sapiens
ttgtttacagcactactctgt

SEQ ID NO: 4515016 - DNA, 15 bp, Homo sapiens
ttgtttacatgagtt

SEQ ID NO: 4515017 - DNA, 13 bp, Homo sapiens
ttgtttagaaaaa

SEQ ID NO: 4515018 - DNA, 18 bp, Homo sapiens
ttgtttagaagaagtgtg

SEQ ID NO: 4515019 - DNA, 13 bp, Homo sapiens
ttgtttatcaact

SEQ ID NO: 4515020 - DNA, 13 bp, Homo sapiens
ttgtttattgagt

SEQ ID NO: 4515021 - DNA, 15 bp, Homo sapiens
ttgtttattgagttt

SEQ ID NO: 4515022 - DNA, 21 bp, Homo sapiens
ttgtttcaatgaggtgtccaa

SEQ ID NO: 4515023 - DNA, 11 bp, Homo sapiens
ttgtttcagtg

SEQ ID NO: 4515024 - DNA, 14 bp, Homo sapiens
ttgtttcatctatt

SEQ ID NO: 4515025 - DNA, 16 bp, Homo sapiens
ttgtttctgttccaaa

SEQ ID NO: 4515026 - DNA, 17 bp, Homo sapiens
ttgtttctgttccaaat

SEQ ID NO: 4515027 - DNA, 12 bp, Homo sapiens
ttgtttcttaaa

SEQ ID NO: 4515028 - DNA, 13 bp, Homo sapiens
ttgtttcttgttt

SEQ ID NO: 4515029 - DNA, 17 bp, Homo sapiens
ttgtttcttgtttattg

SEQ ID NO: 4515030 - DNA, 15 bp, Homo sapiens
ttgtttgaatatttg

SEQ ID NO: 4515031 - DNA, 22 bp, Homo sapiens
ttgtttgagtttttcctcccag

SEQ ID NO: 4515032 - DNA, 16 bp, Homo sapiens
ttgtttgtaaatgcct

SEQ ID NO: 4515033 - DNA, 18 bp, Homo sapiens
ttgtttgtgtttatgaaa

SEQ ID NO: 4515034 - DNA, 14 bp, Homo sapiens
ttgtttgtttcttt

SEQ ID NO: 4515035 - DNA, 12 bp, Homo sapiens
ttgttttacaat

SEQ ID NO: 4515036 - DNA, 13 bp, Homo sapiens
ttgttttcttaaa

SEQ ID NO: 4515037 - DNA, 22 bp, Homo sapiens
ttgttttggactctctgtggtc

SEQ ID NO: 4515038 - DNA, 12 bp, Homo sapiens
ttgtttttactg

SEQ ID NO: 4515039 - DNA, 17 bp, Homo sapiens
ttgtttttagaatcatt

SEQ ID NO: 4515040 - DNA, 16 bp, Homo sapiens
ttgtttttatatatta

SEQ ID NO: 4515041 - DNA, 14 bp, Homo sapiens
ttgtttttatttct

SEQ ID NO: 4515042 - DNA, 19 bp, Homo sapiens
ttgtttttcattcagtctt

SEQ ID NO: 4515043 - DNA, 16 bp, Homo sapiens
ttgtttttcttcagca

SEQ ID NO: 4515044 - DNA, 21 bp, Homo sapiens
ttgtttttgagtactgtacta

SEQ ID NO: 4515045 - DNA, 14 bp, Homo sapiens
ttgtttttgcattt

SEQ ID NO: 4515046 - DNA, 15 bp, Homo sapiens
tttaaaaaactaaaa

SEQ ID NO: 4515047 - DNA, 23 bp, Homo sapiens
tttaaaaaagcttaaaactttga

SEQ ID NO: 4515048 - DNA, 17 bp, Homo sapiens
tttaaaaaatattttct

SEQ ID NO: 4515049 - DNA, 16 bp, Homo sapiens
tttaaaaaatggtcac

SEQ ID NO: 4515050 - DNA, 20 bp, Homo sapiens
tttaaaaaattaaaaatgaa

SEQ ID NO: 4515051 - DNA, 16 bp, Homo sapiens
tttaaaaaattatgga

SEQ ID NO: 4515052 - DNA, 23 bp, Homo sapiens
tttaaaaaattatggaatatcat

SEQ ID NO: 4515053 - DNA, 19 bp, Homo sapiens
tttaaaaacattttttata

SEQ ID NO: 4515054 - DNA, 15 bp, Homo sapiens
tttaaaaataaagga

SEQ ID NO: 4515055 - DNA, 14 bp, Homo sapiens
tttaaaaatacata

SEQ ID NO: 4515056 - DNA, 17 bp, Homo sapiens
tttaaaaatagacactc

SEQ ID NO: 4515057 - DNA, 23 bp, Homo sapiens
tttaaaaatcaactttttattgc

SEQ ID NO: 4515058 - DNA, 19 bp, Homo sapiens
tttaaaaatggtatcaaaa

SEQ ID NO: 4515059 - DNA, 12 bp, Homo sapiens
tttaaaaatgta

SEQ ID NO: 4515060 - DNA, 14 bp, Homo sapiens
tttaaaaatgtctt

SEQ ID NO: 4515061 - DNA, 17 bp, Homo sapiens
tttaaaaatgtcttgct

SEQ ID NO: 4515062 - DNA, 15 bp, Homo sapiens
tttaaaacagacact

SEQ ID NO: 4515063 - DNA, 15 bp, Homo sapiens
tttaaaacaggcaaa

SEQ ID NO: 4515064 - DNA, 21 bp, Homo sapiens
tttaaaacccatttaaatttt

SEQ ID NO: 4515065 - DNA, 12 bp, Homo sapiens
tttaaaactctg

SEQ ID NO: 4515066 - DNA, 13 bp, Homo sapiens
tttaaaactctgg

SEQ ID NO: 4515067 - DNA, 16 bp, Homo sapiens
tttaaaagagacaaac

SEQ ID NO: 4515068 - DNA, 20 bp, Homo sapiens
tttaaaagcaattatattgt

SEQ ID NO: 4515069 - DNA, 13 bp, Homo sapiens
tttaaaagtaaaa

SEQ ID NO: 4515070 - DNA, 17 bp, Homo sapiens
tttaaaataaaatgaaa

SEQ ID NO: 4515071 - DNA, 19 bp, Homo sapiens
tttaaaatacacactcaaa

SEQ ID NO: 4515072 - DNA, 13 bp, Homo sapiens
tttaaaatagaaa

SEQ ID NO: 4515073 - DNA, 21 bp, Homo sapiens
tttaaaatagaaattttgtaa

SEQ ID NO: 4515074 - DNA, 23 bp, Homo sapiens
tttaaaatagaaattttgtaaga

SEQ ID NO: 4515075 - DNA, 19 bp, Homo sapiens
tttaaaatcactaacatta

SEQ ID NO: 4515076 - DNA, 19 bp, Homo sapiens
tttaaaatcatcagaaagg

SEQ ID NO: 4515077 - DNA, 17 bp, Homo sapiens
tttaaaattggtatatt

SEQ ID NO: 4515078 - DNA, 13 bp, Homo sapiens
tttaaaatttcat

SEQ ID NO: 4515079 - DNA, 12 bp, Homo sapiens
tttaaaatttgt

SEQ ID NO: 4515080 - DNA, 17 bp, Homo sapiens
tttaaaatttgtagaat

SEQ ID NO: 4515081 - DNA, 16 bp, Homo sapiens
tttatcgcagaccttt

SEQ ID NO: 4515082 - DNA, 20 bp, Homo sapiens
tttatctataatttacctaa

SEQ ID NO: 4515083 - DNA, 15 bp, Homo sapiens
tttatctatataaaa

SEQ ID NO: 4515084 - DNA, 16 bp, Homo sapiens
tttatctcagatgtta

SEQ ID NO: 4515085 - DNA, 14 bp, Homo sapiens
tttatctgcggctt

SEQ ID NO: 4515086 - DNA, 17 bp, Homo sapiens
tttatctgggattatgg

SEQ ID NO: 4515087 - DNA, 22 bp, Homo sapiens
tttatctgtcttgactttttaa

SEQ ID NO: 4515088 - DNA, 14 bp, Homo sapiens
tttatctgtttcct

SEQ ID NO: 4515089 - DNA, 16 bp, Homo sapiens
tttatcttaattgcaa

SEQ ID NO: 4515090 - DNA, 13 bp, Homo sapiens
tttatctttacca

SEQ ID NO: 4515091 - DNA, 16 bp, Homo sapiens
tttatctttaccaaaa

SEQ ID NO: 4515092 - DNA, 19 bp, Homo sapiens
tttatctttgattctcctt

SEQ ID NO: 4515093 - DNA, 23 bp, Homo sapiens
tttatcttttgtatatctaagac

SEQ ID NO: 4515094 - DNA, 19 bp, Homo sapiens
tttatgaaaaagaagaatc

SEQ ID NO: 4515095 - DNA, 21 bp, Homo sapiens
tttatgaacattgtactgttg

SEQ ID NO: 4515096 - DNA, 14 bp, Homo sapiens
tttatgaatgggtg

SEQ ID NO: 4515097 - DNA, 23 bp, Homo sapiens
tttatgacctgaaataatatatt

SEQ ID NO: 4515098 - DNA, 16 bp, Homo sapiens
tttatgagatttactg

SEQ ID NO: 4515099 - DNA, 17 bp, Homo sapiens
tttatgagatttactgc

SEQ ID NO: 4515100 - DNA, 18 bp, Homo sapiens
tttatgagttcttgtttt

SEQ ID NO: 4515101 - DNA, 22 bp, Homo sapiens
tttatgatgatacagtgttaaa

SEQ ID NO: 4515102 - DNA, 17 bp, Homo sapiens
tttatgattttcataac

SEQ ID NO: 4515103 - DNA, 22 bp, Homo sapiens
tttatgattttcataacttatt

SEQ ID NO: 4515104 - DNA, 18 bp, Homo sapiens
tttatgcagcaaatatat

SEQ ID NO: 4515105 - DNA, 17 bp, Homo sapiens
tttatggatgattaaat

SEQ ID NO: 4515106 - DNA, 12 bp, Homo sapiens
tttatggcctca

SEQ ID NO: 4515107 - DNA, 16 bp, Homo sapiens
tttatggctagacagg

SEQ ID NO: 4515108 - DNA, 22 bp, Homo sapiens
tttatggggctgaacggggaga

SEQ ID NO: 4515109 - DNA, 19 bp, Homo sapiens
tttatggtaaaaaatttat

SEQ ID NO: 4515110 - DNA, 21 bp, Homo sapiens
tttatggttacttcttctctt

SEQ ID NO: 4515111 - DNA, 22 bp, Homo sapiens
tttatgtaatgaagtaaagcca

SEQ ID NO: 4515112 - DNA, 16 bp, Homo sapiens
tttatgtacaaccctg

SEQ ID NO: 4515113 - DNA, 17 bp, Homo sapiens
tttatgtacaaccctga

SEQ ID NO: 4515114 - DNA, 13 bp, Homo sapiens
tttatgtgaaatg

SEQ ID NO: 4515115 - DNA, 13 bp, Homo sapiens
tttatgtgaattt

SEQ ID NO: 4515116 - DNA, 20 bp, Homo sapiens
tttatgtgaatttttaagct

SEQ ID NO: 4515117 - DNA, 14 bp, Homo sapiens
tttatgtgagattt

SEQ ID NO: 4515118 - DNA, 12 bp, Homo sapiens
tttatgtgatgg

SEQ ID NO: 4515119 - DNA, 16 bp, Homo sapiens
tttatgtgctattaat

SEQ ID NO: 4515120 - DNA, 18 bp, Homo sapiens
tttatgtgtgaggagctg

SEQ ID NO: 4515121 - DNA, 11 bp, Homo sapiens
tttatgtgtgt

SEQ ID NO: 4515122 - DNA, 16 bp, Homo sapiens
tttatgtgttatgaac

SEQ ID NO: 4515123 - DNA, 14 bp, Homo sapiens
tttatgtttagata

SEQ ID NO: 4515124 - DNA, 20 bp, Homo sapiens
tttattaataatatttatgt

SEQ ID NO: 4515125 - DNA, 18 bp, Homo sapiens
tttattaatctactgtat

SEQ ID NO: 4515126 - DNA, 14 bp, Homo sapiens
tttattacataatt

SEQ ID NO: 4515127 - DNA, 21 bp, Homo sapiens
tttattactagtgtttaagtc

SEQ ID NO: 4515128 - DNA, 24 bp, Homo sapiens
tttattatatatttacagaagaaa

SEQ ID NO: 4515129 - DNA, 18 bp, Homo sapiens
tttattcaaggaagtttt

SEQ ID NO: 4515130 - DNA, 19 bp, Homo sapiens
tttattccagaatgctgta

SEQ ID NO: 4515131 - DNA, 22 bp, Homo sapiens
tttattccagaatgctgtacat

SEQ ID NO: 4515132 - DNA, 18 bp, Homo sapiens
tttattcctttccttttt

SEQ ID NO: 4515133 - DNA, 18 bp, Homo sapiens
tttattgaattagaaaat

SEQ ID NO: 4515134 - DNA, 12 bp, Homo sapiens
tttattgacaca

SEQ ID NO: 4515135 - DNA, 13 bp, Homo sapiens
tttattgacacag

SEQ ID NO: 4515136 - DNA, 23 bp, Homo sapiens
tttattgccttttaatttttaat

SEQ ID NO: 4515137 - DNA, 22 bp, Homo sapiens
tttattgctcgcccagacacca

SEQ ID NO: 4515138 - DNA, 19 bp, Homo sapiens
tttattggggaattaaata

SEQ ID NO: 4515139 - DNA, 17 bp, Homo sapiens
tttattggggtgacctt

SEQ ID NO: 4515140 - DNA, 17 bp, Homo sapiens
tttattggttttgcaga

SEQ ID NO: 4515141 - DNA, 12 bp, Homo sapiens
tttattgtctgt

SEQ ID NO: 4515142 - DNA, 15 bp, Homo sapiens
tttatttaaaactct

SEQ ID NO: 4515143 - DNA, 15 bp, Homo sapiens
tttatttagctattt

SEQ ID NO: 4515144 - DNA, 15 bp, Homo sapiens
tttatttagttttta

SEQ ID NO: 4515145 - DNA, 22 bp, Homo sapiens
tttatttattaaacttcagcaa

SEQ ID NO: 4515146 - DNA, 16 bp, Homo sapiens
tttatttatttattca

SEQ ID NO: 4515147 - DNA, 13 bp, Homo sapiens
tttatttatttct

SEQ ID NO: 4515148 - DNA, 15 bp, Homo sapiens
tttatttcagatttt

SEQ ID NO: 4515149 - DNA, 20 bp, Homo sapiens
tttatttccactaaaaatat

SEQ ID NO: 4515150 - DNA, 20 bp, Homo sapiens
tttatttctagcaaacagat

SEQ ID NO: 4515151 - DNA, 21 bp, Homo sapiens
tttatttctctggcaaacttt

SEQ ID NO: 4515152 - DNA, 16 bp, Homo sapiens
tttatttctgcatatg

SEQ ID NO: 4515153 - DNA, 13 bp, Homo sapiens
tttatttctttta

SEQ ID NO: 4515154 - DNA, 20 bp, Homo sapiens
tttatttcttttagaaaagg

SEQ ID NO: 4515155 - DNA, 19 bp, Homo sapiens
tttattttacagctcatta

SEQ ID NO: 4515156 - DNA, 11 bp, Homo sapiens
tttattttata

SEQ ID NO: 4515157 - DNA, 21 bp, Homo sapiens
tttattttatataataaagta

SEQ ID NO: 4515158 - DNA, 16 bp, Homo sapiens
tttattttatgtttag

SEQ ID NO: 4515159 - DNA, 14 bp, Homo sapiens
tttattttgtaata

SEQ ID NO: 4515160 - DNA, 13 bp, Homo sapiens
tttatttttacct

SEQ ID NO: 4515161 - DNA, 13 bp, Homo sapiens
tttatttttctgt

SEQ ID NO: 4515162 - DNA, 16 bp, Homo sapiens
tttattttttattatt

SEQ ID NO: 4515163 - DNA, 21 bp, Homo sapiens
tttcaaaatagaaaagttatt

SEQ ID NO: 4515164 - DNA, 20 bp, Homo sapiens
tttcaaaatagacaagtttt

SEQ ID NO: 4515165 - DNA, 15 bp, Homo sapiens
tttcaaaatgataga

SEQ ID NO: 4515166 - DNA, 15 bp, Homo sapiens
tttcaaaccagcttc

SEQ ID NO: 4515167 - DNA, 12 bp, Homo sapiens
tttcaaactttt

SEQ ID NO: 4515168 - DNA, 15 bp, Homo sapiens
tttcaaacttttgaa

SEQ ID NO: 4515169 - DNA, 22 bp, Homo sapiens
tttcaaagctaaaatatataat

SEQ ID NO: 4515170 - DNA, 20 bp, Homo sapiens
tttcaaataatgcttttcta

SEQ ID NO: 4515171 - DNA, 21 bp, Homo sapiens
tttcaaataatgcttttctaa

SEQ ID NO: 4515172 - DNA, 22 bp, Homo sapiens
tttcaaataatgcttttctaat

SEQ ID NO: 4515173 - DNA, 20 bp, Homo sapiens
tttcaaatagggtctaactc

SEQ ID NO: 4515174 - DNA, 15 bp, Homo sapiens
tttcaaatggactgt

SEQ ID NO: 4515175 - DNA, 11 bp, Homo sapiens
tttcaaatgtg

SEQ ID NO: 4515176 - DNA, 22 bp, Homo sapiens
tttcaacatttttttttctcca

SEQ ID NO: 4515177 - DNA, 23 bp, Homo sapiens
tttcaacggaaagtgctgtctta

SEQ ID NO: 4515178 - DNA, 15 bp, Homo sapiens
tttcaactgtttcag

SEQ ID NO: 4515179 - DNA, 13 bp, Homo sapiens
tttcaactttctt

SEQ ID NO: 4515180 - DNA, 18 bp, Homo sapiens
tttcaactttcttatctg

SEQ ID NO: 4515181 - DNA, 13 bp, Homo sapiens
tttcaactttgaa

SEQ ID NO: 4515182 - DNA, 23 bp, Homo sapiens
tttcaagaataatcacgctttcc

SEQ ID NO: 4515183 - DNA, 11 bp, Homo sapiens
tttcaaggaag

SEQ ID NO: 4515184 - DNA, 19 bp, Homo sapiens
tttcaaggaagtagaaaca

SEQ ID NO: 4515185 - DNA, 21 bp, Homo sapiens
tttcaagtgcctagactgtta

SEQ ID NO: 4515186 - DNA, 17 bp, Homo sapiens
tttcaagttttaaagtt

SEQ ID NO: 4515187 - DNA, 16 bp, Homo sapiens
tttcaagtttttcata

SEQ ID NO: 4515188 - DNA, 21 bp, Homo sapiens
tttcaataacaaaacgaaact

SEQ ID NO: 4515189 - DNA, 15 bp, Homo sapiens
tttcaatagcacata

SEQ ID NO: 4515190 - DNA, 13 bp, Homo sapiens
tttcaatatattg

SEQ ID NO: 4515191 - DNA, 22 bp, Homo sapiens
tttcaatcgtaaaatttcccat

SEQ ID NO: 4515192 - DNA, 15 bp, Homo sapiens
tttcaatcttctact

SEQ ID NO: 4515193 - DNA, 21 bp, Homo sapiens
tttcaatgtgattcttctaaa

SEQ ID NO: 4515194 - DNA, 13 bp, Homo sapiens
tttcacactggat

SEQ ID NO: 4515195 - DNA, 14 bp, Homo sapiens
tttcacagaaaata

SEQ ID NO: 4515196 - DNA, 13 bp, Homo sapiens
tttcacagttctg

SEQ ID NO: 4515197 - DNA, 19 bp, Homo sapiens
tttcacagttctgtaatgt

SEQ ID NO: 4515198 - DNA, 16 bp, Homo sapiens
tttcacattcttggct

SEQ ID NO: 4515199 - DNA, 17 bp, Homo sapiens
tttcacatttttgtaat

SEQ ID NO: 4515200 - DNA, 19 bp, Homo sapiens
tttcaccaaaatttctaca

SEQ ID NO: 4515201 - DNA, 14 bp, Homo sapiens
tttcacctgtaaac

SEQ ID NO: 4515202 - DNA, 17 bp, Homo sapiens
tttcacctgtaaacctg

SEQ ID NO: 4515203 - DNA, 15 bp, Homo sapiens
tttcacgattcattt

SEQ ID NO: 4515204 - DNA, 17 bp, Homo sapiens
tttcacttaaactttgt

SEQ ID NO: 4515205 - DNA, 19 bp, Homo sapiens
tttcacttaaactttgtca

SEQ ID NO: 4515206 - DNA, 16 bp, Homo sapiens
tttcacttaatgtttc

SEQ ID NO: 4515207 - DNA, 21 bp, Homo sapiens
tttcacttaatgtttcttaga

SEQ ID NO: 4515208 - DNA, 22 bp, Homo sapiens
tttcacttctacctacatattt

SEQ ID NO: 4515209 - DNA, 16 bp, Homo sapiens
tttcacttgctctttg

SEQ ID NO: 4515210 - DNA, 16 bp, Homo sapiens
tttcactttctgtcta

SEQ ID NO: 4515211 - DNA, 18 bp, Homo sapiens
tttcactttctgtctagg

SEQ ID NO: 4515212 - DNA, 13 bp, Homo sapiens
tttcacttttaaa

SEQ ID NO: 4515213 - DNA, 18 bp, Homo sapiens
tttcagaacctcttcccc

SEQ ID NO: 4515214 - DNA, 23 bp, Homo sapiens
tttcagaacctcttccccagaaa

SEQ ID NO: 4515215 - DNA, 13 bp, Homo sapiens
tttcagaagaaat

SEQ ID NO: 4515216 - DNA, 16 bp, Homo sapiens
tttcagaagttagttt

SEQ ID NO: 4515217 - DNA, 17 bp, Homo sapiens
tttcagaatctgaatgt

SEQ ID NO: 4515218 - DNA, 10 bp, Homo sapiens
tttcagaccc

SEQ ID NO: 4515219 - DNA, 20 bp, Homo sapiens
tttcagagactttttttata

SEQ ID NO: 4515220 - DNA, 18 bp, Homo sapiens
tttcagagccagcctggc

SEQ ID NO: 4515221 - DNA, 21 bp, Homo sapiens
tttcagagggtaagtaaacag

SEQ ID NO: 4515222 - DNA, 17 bp, Homo sapiens
tttcagatgtaatgttt

SEQ ID NO: 4515223 - DNA, 18 bp, Homo sapiens
tttcagatgtaatgtttt

SEQ ID NO: 4515224 - DNA, 17 bp, Homo sapiens
tttcagatgtcttctgc

SEQ ID NO: 4515225 - DNA, 22 bp, Homo sapiens
tttcagatgtcttctgcctgtt

SEQ ID NO: 4515226 - DNA, 23 bp, Homo sapiens
tttcagcacctacagtgtacagt

SEQ ID NO: 4515227 - DNA, 19 bp, Homo sapiens
tttcagcagcaaaaccaaa

SEQ ID NO: 4515228 - DNA, 18 bp, Homo sapiens
tttcagcattaagctgtt

SEQ ID NO: 4515229 - DNA, 19 bp, Homo sapiens
tttcaggcattggatattt

SEQ ID NO: 4515230 - DNA, 19 bp, Homo sapiens
tttcaggccaaatctagaa

SEQ ID NO: 4515231 - DNA, 19 bp, Homo sapiens
tttcagtgatcttcactgt

SEQ ID NO: 4515232 - DNA, 22 bp, Homo sapiens
tttcagtgatcttcactgtata

SEQ ID NO: 4515233 - DNA, 19 bp, Homo sapiens
tttcagtgggtctctgtgt

SEQ ID NO: 4515234 - DNA, 22 bp, Homo sapiens
tttcagtgtcaaataaacactg

SEQ ID NO: 4515235 - DNA, 11 bp, Homo sapiens
tttcagtgtga

SEQ ID NO: 4515236 - DNA, 15 bp, Homo sapiens
tttcagttttcagga

SEQ ID NO: 4515237 - DNA, 22 bp, Homo sapiens
tttcataacttattgctgattt

SEQ ID NO: 4515238 - DNA, 14 bp, Homo sapiens
tttcataagtattt

SEQ ID NO: 4515239 - DNA, 19 bp, Homo sapiens
tttcataagtatttcaaat

SEQ ID NO: 4515240 - DNA, 14 bp, Homo sapiens
tttcataattcaga

SEQ ID NO: 4515241 - DNA, 14 bp, Homo sapiens
tttcatactgtaca

SEQ ID NO: 4515242 - DNA, 18 bp, Homo sapiens
tttcatactgtacacatt

SEQ ID NO: 4515243 - DNA, 14 bp, Homo sapiens
tttcatagaagtgt

SEQ ID NO: 4515244 - DNA, 23 bp, Homo sapiens
tttcatagatttgaaaaactttt

SEQ ID NO: 4515245 - DNA, 19 bp, Homo sapiens
tttcataggaagacacatt

SEQ ID NO: 4515246 - DNA, 14 bp, Homo sapiens
tttcatagttcaga

SEQ ID NO: 4515247 - DNA, 18 bp, Homo sapiens
tttcatattattttagtg

SEQ ID NO: 4515248 - DNA, 19 bp, Homo sapiens
tttcatattattttagtgt

SEQ ID NO: 4515249 - DNA, 21 bp, Homo sapiens
tttcatcagtaagcagccttt

SEQ ID NO: 4515250 - DNA, 14 bp, Homo sapiens
tttcatcatttcag

SEQ ID NO: 4515251 - DNA, 15 bp, Homo sapiens
tttcatcatttcagc

SEQ ID NO: 4515252 - DNA, 13 bp, Homo sapiens
tttcatcattttt

SEQ ID NO: 4515253 - DNA, 17 bp, Homo sapiens
tttcatccagtttgttc

SEQ ID NO: 4515254 - DNA, 15 bp, Homo sapiens
tttcatctaaatgaa

SEQ ID NO: 4515255 - DNA, 16 bp, Homo sapiens
tttcatctaaatgaaa

SEQ ID NO: 4515256 - DNA, 19 bp, Homo sapiens
tttcatctattttatttta

SEQ ID NO: 4515257 - DNA, 19 bp, Homo sapiens
tttcatctcagagtccact

SEQ ID NO: 4515258 - DNA, 21 bp, Homo sapiens
tttcatctcatttaagggaaa

SEQ ID NO: 4515259 - DNA, 16 bp, Homo sapiens
tttcatctgctctcct

SEQ ID NO: 4515260 - DNA, 18 bp, Homo sapiens
tttcatctgctctccttc

SEQ ID NO: 4515261 - DNA, 20 bp, Homo sapiens
tttcatctgctctccttcct

SEQ ID NO: 4515262 - DNA, 15 bp, Homo sapiens
tttcatcttttgaag

SEQ ID NO: 4515263 - DNA, 22 bp, Homo sapiens
tttcatgaaaatggagttatca

SEQ ID NO: 4515264 - DNA, 12 bp, Homo sapiens
tttcatgtacaa

SEQ ID NO: 4515265 - DNA, 15 bp, Homo sapiens
tttcatgtccataaa

SEQ ID NO: 4515266 - DNA, 13 bp, Homo sapiens
tttcatgtcttgt

SEQ ID NO: 4515267 - DNA, 14 bp, Homo sapiens
tttcattaaataaa

SEQ ID NO: 4515268 - DNA, 18 bp, Homo sapiens
tttcattaaataaatttg

SEQ ID NO: 4515269 - DNA, 22 bp, Homo sapiens
tttcattaaataaatttgactt

SEQ ID NO: 4515270 - DNA, 15 bp, Homo sapiens
tttcattacttgaat

SEQ ID NO: 4515271 - DNA, 18 bp, Homo sapiens
tttcattacttgaatgta

SEQ ID NO: 4515272 - DNA, 14 bp, Homo sapiens
tttcattcatgaat

SEQ ID NO: 4515273 - DNA, 12 bp, Homo sapiens
tttcattccatt

SEQ ID NO: 4515274 - DNA, 17 bp, Homo sapiens
tttcattccattgccta

SEQ ID NO: 4515275 - DNA, 13 bp, Homo sapiens
tttcattccttca

SEQ ID NO: 4515276 - DNA, 21 bp, Homo sapiens
tttcattccttcagatttggc

SEQ ID NO: 4515277 - DNA, 16 bp, Homo sapiens
tttcattctgccaaag

SEQ ID NO: 4515278 - DNA, 17 bp, Homo sapiens
tttcattgattatatgg

SEQ ID NO: 4515279 - DNA, 19 bp, Homo sapiens
tttcattgattatatgggt

SEQ ID NO: 4515280 - DNA, 13 bp, Homo sapiens
tttcattgccagt

SEQ ID NO: 4515281 - DNA, 18 bp, Homo sapiens
tttcattgccagtgtctt

SEQ ID NO: 4515282 - DNA, 19 bp, Homo sapiens
tttcattgccagtgtcttt

SEQ ID NO: 4515283 - DNA, 13 bp, Homo sapiens
tttcattgtacaa

SEQ ID NO: 4515284 - DNA, 17 bp, Homo sapiens
tttcattgtgatttata

SEQ ID NO: 4515285 - DNA, 20 bp, Homo sapiens
tttcattgtgatttatatat

SEQ ID NO: 4515286 - DNA, 19 bp, Homo sapiens
tttcatttggttcattaat

SEQ ID NO: 4515287 - DNA, 15 bp, Homo sapiens
tttcatttgtaaaaa

SEQ ID NO: 4515288 - DNA, 16 bp, Homo sapiens
tttcattttaatatat

SEQ ID NO: 4515289 - DNA, 22 bp, Homo sapiens
tttccaaaacaaaaagatgtct

SEQ ID NO: 4515290 - DNA, 21 bp, Homo sapiens
tttccaaaacatttctggaca

SEQ ID NO: 4515291 - DNA, 19 bp, Homo sapiens
tttccaaaataatctatat

SEQ ID NO: 4515292 - DNA, 16 bp, Homo sapiens
tttccaaatgaaaaat

SEQ ID NO: 4515293 - DNA, 19 bp, Homo sapiens
tttccaaccggctttgtgg

SEQ ID NO: 4515294 - DNA, 12 bp, Homo sapiens
tttccaactact

SEQ ID NO: 4515295 - DNA, 18 bp, Homo sapiens
tttccaactactaataga

SEQ ID NO: 4515296 - DNA, 17 bp, Homo sapiens
tttccaagagaactaaa

SEQ ID NO: 4515297 - DNA, 19 bp, Homo sapiens
tttccaagcctctctggca

SEQ ID NO: 4515298 - DNA, 17 bp, Homo sapiens
tttccaatattttaata

SEQ ID NO: 4515299 - DNA, 17 bp, Homo sapiens
tttccaatgttttattg

SEQ ID NO: 4515300 - DNA, 19 bp, Homo sapiens
tttccacaaaatctgtcca

SEQ ID NO: 4515301 - DNA, 20 bp, Homo sapiens
tttccacaagattcccagag

SEQ ID NO: 4515302 - DNA, 18 bp, Homo sapiens
tttccacacgcattaata

SEQ ID NO: 4515303 - DNA, 21 bp, Homo sapiens
tttccacagatttttttgtaa

SEQ ID NO: 4515304 - DNA, 17 bp, Homo sapiens
tttccacataaatttta

SEQ ID NO: 4515305 - DNA, 23 bp, Homo sapiens
tttccactggcttttgcctgtaa

SEQ ID NO: 4515306 - DNA, 12 bp, Homo sapiens
tttccagttttt

SEQ ID NO: 4515307 - DNA, 23 bp, Homo sapiens
tttccagtttttctttactttct

SEQ ID NO: 4515308 - DNA, 24 bp, Homo sapiens
tttccataagcttggtgacaaaat

SEQ ID NO: 4515309 - DNA, 17 bp, Homo sapiens
tttccatcaactcccaa

SEQ ID NO: 4515310 - DNA, 14 bp, Homo sapiens
tttccatcataatt

SEQ ID NO: 4515311 - DNA, 12 bp, Homo sapiens
tttccatcttta

SEQ ID NO: 4515312 - DNA, 19 bp, Homo sapiens
tttccatgcgtgtttctga

SEQ ID NO: 4515313 - DNA, 17 bp, Homo sapiens
tttccatgttatgtttc

SEQ ID NO: 4515314 - DNA, 18 bp, Homo sapiens
tttcccaaaacaatctat

SEQ ID NO: 4515315 - DNA, 21 bp, Homo sapiens
tttcccacgtctaactggaaa

SEQ ID NO: 4515316 - DNA, 14 bp, Homo sapiens
tttcccatgtattt

SEQ ID NO: 4515317 - DNA, 20 bp, Homo sapiens
tttccccactaataaagtgc

SEQ ID NO: 4515318 - DNA, 20 bp, Homo sapiens
tttccccagaggctcccaat

SEQ ID NO: 4515319 - DNA, 18 bp, Homo sapiens
tttcccccctccttctgc

SEQ ID NO: 4515320 - DNA, 14 bp, Homo sapiens
tttcccccttccca

SEQ ID NO: 4515321 - DNA, 18 bp, Homo sapiens
tttccctccccagaatca

SEQ ID NO: 4515322 - DNA, 14 bp, Homo sapiens
tttaccaaaaattt

SEQ ID NO: 4515323 - DNA, 15 bp, Homo sapiens
tttaccaaagcatca

SEQ ID NO: 4515324 - DNA, 21 bp, Homo sapiens
tttaccaaatgaaatgccaaa

SEQ ID NO: 4515325 - DNA, 22 bp, Homo sapiens
tttaccaaatgaaatgccaaag

SEQ ID NO: 4515326 - DNA, 14 bp, Homo sapiens
tttaccacttatgc

SEQ ID NO: 4515327 - DNA, 14 bp, Homo sapiens
tttaccagctttta

SEQ ID NO: 4515328 - DNA, 22 bp, Homo sapiens
tttacccagaatgtcagattcc

SEQ ID NO: 4515329 - DNA, 23 bp, Homo sapiens
tttacccagaatgtcagattcct

SEQ ID NO: 4515330 - DNA, 21 bp, Homo sapiens
tttaccctcttgaatataatc

SEQ ID NO: 4515331 - DNA, 13 bp, Homo sapiens
tttacccttcagg

SEQ ID NO: 4515332 - DNA, 17 bp, Homo sapiens
tttacccttttccccct

SEQ ID NO: 4515333 - DNA, 22 bp, Homo sapiens
tttacctagtgcaaaaactgta

SEQ ID NO: 4515334 - DNA, 13 bp, Homo sapiens
tttacgctttgat

SEQ ID NO: 4515335 - DNA, 18 bp, Homo sapiens
tttacgctttgattcata

SEQ ID NO: 4515336 - DNA, 14 bp, Homo sapiens
tttactacttatgc

SEQ ID NO: 4515337 - DNA, 21 bp, Homo sapiens
tttactatatagaatttcctg

SEQ ID NO: 4515338 - DNA, 15 bp, Homo sapiens
tttactcttaaatca

SEQ ID NO: 4515339 - DNA, 20 bp, Homo sapiens
tttactgaatgatctattcc

SEQ ID NO: 4515340 - DNA, 13 bp, Homo sapiens
tttactgcctgta

SEQ ID NO: 4515341 - DNA, 16 bp, Homo sapiens
tttactgctctagaaa

SEQ ID NO: 4515342 - DNA, 19 bp, Homo sapiens
tttactggccatacaaaat

SEQ ID NO: 4515343 - DNA, 18 bp, Homo sapiens
tttactgtaactgtcagt

SEQ ID NO: 4515344 - DNA, 19 bp, Homo sapiens
tttactgtatcaatttcta

SEQ ID NO: 4515345 - DNA, 22 bp, Homo sapiens
tttactgtgaaaaaaaatttgt

SEQ ID NO: 4515346 - DNA, 17 bp, Homo sapiens
tttacttatcttatgcc

SEQ ID NO: 4515347 - DNA, 18 bp, Homo sapiens
tttactttagaagcctgc

SEQ ID NO: 4515348 - DNA, 16 bp, Homo sapiens
tttacttttaaactgt

SEQ ID NO: 4515349 - DNA, 18 bp, Homo sapiens
tttacttttctgccaaaa

SEQ ID NO: 4515350 - DNA, 15 bp, Homo sapiens
tttagaaaaaaaact

SEQ ID NO: 4515351 - DNA, 22 bp, Homo sapiens
tttagaaaaagaacatgcagtt

SEQ ID NO: 4515352 - DNA, 15 bp, Homo sapiens
tttagaaaactttaa

SEQ ID NO: 4515353 - DNA, 11 bp, Homo sapiens
tttagaaaata

SEQ ID NO: 4515354 - DNA, 14 bp, Homo sapiens
tttagaaagctaaa

SEQ ID NO: 4515355 - DNA, 16 bp, Homo sapiens
tttagaaatcattttg

SEQ ID NO: 4515356 - DNA, 13 bp, Homo sapiens
tttagaaccagcc

SEQ ID NO: 4515357 - DNA, 14 bp, Homo sapiens
tttagaagccaact

SEQ ID NO: 4515358 - DNA, 22 bp, Homo sapiens
tttagaagccaactatgattat

SEQ ID NO: 4515359 - DNA, 15 bp, Homo sapiens
tttagaatcagaata

SEQ ID NO: 4515360 - DNA, 21 bp, Homo sapiens
tttagaatggaggaagaacaa

SEQ ID NO: 4515361 - DNA, 13 bp, Homo sapiens
tttagaattaaaa

SEQ ID NO: 4515362 - DNA, 18 bp, Homo sapiens
tttagagataggaaactg

SEQ ID NO: 4515363 - DNA, 17 bp, Homo sapiens
tttagatgaatgtcagt

SEQ ID NO: 4515364 - DNA, 21 bp, Homo sapiens
tttagatgataaagagacagt

SEQ ID NO: 4515365 - DNA, 14 bp, Homo sapiens
tttagatggttaca

SEQ ID NO: 4515366 - DNA, 17 bp, Homo sapiens
tttagatggttacactg

SEQ ID NO: 4515367 - DNA, 22 bp, Homo sapiens
tttagatgtagatatttgaaat

SEQ ID NO: 4515368 - DNA, 18 bp, Homo sapiens
tttagattgagaaatgtg

SEQ ID NO: 4515369 - DNA, 21 bp, Homo sapiens
tttagcagttctgcaaataga

SEQ ID NO: 4515370 - DNA, 23 bp, Homo sapiens
tttagcagttctgcaaatagaaa

SEQ ID NO: 4515371 - DNA, 22 bp, Homo sapiens
tttagcatgttcctccttttct

SEQ ID NO: 4515372 - DNA, 14 bp, Homo sapiens
tttagcatgttgtt

SEQ ID NO: 4515373 - DNA, 19 bp, Homo sapiens
tttagccagcgtttattgt

SEQ ID NO: 4515374 - DNA, 20 bp, Homo sapiens
tttagctacctttttatatt

SEQ ID NO: 4515375 - DNA, 14 bp, Homo sapiens
tttagctattactg

SEQ ID NO: 4515376 - DNA, 17 bp, Homo sapiens
tttagctgttttggaac

SEQ ID NO: 4515377 - DNA, 23 bp, Homo sapiens
tttaggatgtgtatttcatttat

SEQ ID NO: 4515378 - DNA, 16 bp, Homo sapiens
tttaggcaaagataat

SEQ ID NO: 4515379 - DNA, 18 bp, Homo sapiens
tttagggttctaaatgca

SEQ ID NO: 4515380 - DNA, 22 bp, Homo sapiens
tttagggttctaaatgcaataa

SEQ ID NO: 4515381 - DNA, 17 bp, Homo sapiens
tttagggttctgcctct

SEQ ID NO: 4515382 - DNA, 15 bp, Homo sapiens
tttagtaatttcttt

SEQ ID NO: 4515383 - DNA, 13 bp, Homo sapiens
tttagtacatttt

SEQ ID NO: 4515384 - DNA, 16 bp, Homo sapiens
tttagtatacgtataa

SEQ ID NO: 4515385 - DNA, 22 bp, Homo sapiens
tttagtattttaggtgctgtta

SEQ ID NO: 4515386 - DNA, 23 bp, Homo sapiens
tttagtctttttttccttccttt

SEQ ID NO: 4515387 - DNA, 15 bp, Homo sapiens
tttagtggaaaatag

SEQ ID NO: 4515388 - DNA, 15 bp, Homo sapiens
tttagtgtgtaaaat

SEQ ID NO: 4515389 - DNA, 16 bp, Homo sapiens
tttagtgtgtaaaatt

SEQ ID NO: 4515390 - DNA, 21 bp, Homo sapiens
tttagttaaaactcatcacat

SEQ ID NO: 4515391 - DNA, 16 bp, Homo sapiens
tttagttacgtataat

SEQ ID NO: 4515392 - DNA, 18 bp, Homo sapiens
tttagttataaaaggctt

SEQ ID NO: 4515393 - DNA, 20 bp, Homo sapiens
tttagttgattttaattact

SEQ ID NO: 4515394 - DNA, 14 bp, Homo sapiens
tttagtttgttaaa

SEQ ID NO: 4515395 - DNA, 12 bp, Homo sapiens
tttagtttgttt

SEQ ID NO: 4515396 - DNA, 16 bp, Homo sapiens
tttagtttttaacaat

SEQ ID NO: 4515397 - DNA, 12 bp, Homo sapiens
tttagtttttca

SEQ ID NO: 4515398 - DNA, 23 bp, Homo sapiens
tttataaaaataaatagaaaagt

SEQ ID NO: 4515399 - DNA, 21 bp, Homo sapiens
tttataaagctgttcttgaaa

SEQ ID NO: 4515400 - DNA, 18 bp, Homo sapiens
tttataaattaaatatat

SEQ ID NO: 4515401 - DNA, 13 bp, Homo sapiens
tttataatgtatt

SEQ ID NO: 4515402 - DNA, 21 bp, Homo sapiens
tttataatgtatttgaaaatt

SEQ ID NO: 4515403 - DNA, 20 bp, Homo sapiens
tttataattctcattaaaag

SEQ ID NO: 4515404 - DNA, 21 bp, Homo sapiens
tttataatttaataaaaagga

SEQ ID NO: 4515405 - DNA, 19 bp, Homo sapiens
tttatacagttttaaagaa

SEQ ID NO: 4515406 - DNA, 18 bp, Homo sapiens
tttatactctttctgtat

SEQ ID NO: 4515407 - DNA, 16 bp, Homo sapiens
tttatactgagctttt

SEQ ID NO: 4515408 - DNA, 15 bp, Homo sapiens
tttatactgcactta

SEQ ID NO: 4515409 - DNA, 16 bp, Homo sapiens
tttatactgtttactg

SEQ ID NO: 4515410 - DNA, 22 bp, Homo sapiens
tttatacttgagaccaactttt

SEQ ID NO: 4515411 - DNA, 21 bp, Homo sapiens
tttatactttgcaatccaaat

SEQ ID NO: 4515412 - DNA, 12 bp, Homo sapiens
tttatagcttcc

SEQ ID NO: 4515413 - DNA, 20 bp, Homo sapiens
tttataggaatagaggaaga

SEQ ID NO: 4515414 - DNA, 22 bp, Homo sapiens
tttatagtgaagtgttaataca

SEQ ID NO: 4515415 - DNA, 21 bp, Homo sapiens
tttatagtgagttgcatgttt

SEQ ID NO: 4515416 - DNA, 18 bp, Homo sapiens
tttatagtgcacaaaatg

SEQ ID NO: 4515417 - DNA, 13 bp, Homo sapiens
tttatagtggaaa

SEQ ID NO: 4515418 - DNA, 17 bp, Homo sapiens
tttatagttattaaatg

SEQ ID NO: 4515419 - DNA, 15 bp, Homo sapiens
tttatagtttataca

SEQ ID NO: 4515420 - DNA, 22 bp, Homo sapiens
tttatataatatctaaagttat

SEQ ID NO: 4515421 - DNA, 20 bp, Homo sapiens
tttatatagatgtcagcaat

SEQ ID NO: 4515422 - DNA, 21 bp, Homo sapiens
tttatatagatgtcagcaatt

SEQ ID NO: 4515423 - DNA, 15 bp, Homo sapiens
tttatatcacatgtt

SEQ ID NO: 4515424 - DNA, 19 bp, Homo sapiens
tttatatcatacagttttc

SEQ ID NO: 4515425 - DNA, 15 bp, Homo sapiens
tttatatcatgcaaa

SEQ ID NO: 4515426 - DNA, 17 bp, Homo sapiens
tttatatcatgcaaaat

SEQ ID NO: 4515427 - DNA, 16 bp, Homo sapiens
tttatatctgtaatga

SEQ ID NO: 4515428 - DNA, 18 bp, Homo sapiens
tttatatctgtaatgata

SEQ ID NO: 4515429 - DNA, 13 bp, Homo sapiens
tttatatctgtct

SEQ ID NO: 4515430 - DNA, 21 bp, Homo sapiens
tttatatgaagaaaatcactt

SEQ ID NO: 4515431 - DNA, 14 bp, Homo sapiens
tttatatgtacatg

SEQ ID NO: 4515432 - DNA, 13 bp, Homo sapiens
tttatatgttgta

SEQ ID NO: 4515433 - DNA, 12 bp, Homo sapiens
tttatattctaa

SEQ ID NO: 4515434 - DNA, 13 bp, Homo sapiens
tttatattctaat

SEQ ID NO: 4515435 - DNA, 21 bp, Homo sapiens
tttatatttaaaaaattaaaa

SEQ ID NO: 4515436 - DNA, 13 bp, Homo sapiens
tttatatttcctt

SEQ ID NO: 4515437 - DNA, 20 bp, Homo sapiens
tttatatttcctttatgtga

SEQ ID NO: 4515438 - DNA, 15 bp, Homo sapiens
tttatcacacttctg

SEQ ID NO: 4515439 - DNA, 14 bp, Homo sapiens
tttatcagcaaaaa

SEQ ID NO: 4515440 - DNA, 15 bp, Homo sapiens
tttatcatgaagcct

SEQ ID NO: 4515441 - DNA, 16 bp, Homo sapiens
tttatcatgcatgtcc

SEQ ID NO: 4515442 - DNA, 18 bp, Homo sapiens
tttccctgcagacctcaa

SEQ ID NO: 4515443 - DNA, 22 bp, Homo sapiens
tttccctggctaacagtctagt

SEQ ID NO: 4515444 - DNA, 21 bp, Homo sapiens
tttccctggtgcctctcactt

SEQ ID NO: 4515445 - DNA, 20 bp, Homo sapiens
tttcccttgtgtcaagacat

SEQ ID NO: 4515446 - DNA, 22 bp, Homo sapiens
tttccgctgtcgccccaggccc

SEQ ID NO: 4515447 - DNA, 13 bp, Homo sapiens
tttccggctgctg

SEQ ID NO: 4515448 - DNA, 14 bp, Homo sapiens
tttcctaaaagttc

SEQ ID NO: 4515449 - DNA, 17 bp, Homo sapiens
tttcctaagacattttt

SEQ ID NO: 4515450 - DNA, 19 bp, Homo sapiens
tttcctagctgttctaatt

SEQ ID NO: 4515451 - DNA, 21 bp, Homo sapiens
tttcctatctagcatttattt

SEQ ID NO: 4515452 - DNA, 15 bp, Homo sapiens
tttcctatgctattg

SEQ ID NO: 4515453 - DNA, 21 bp, Homo sapiens
tttcctcattaatagctgcct

SEQ ID NO: 4515454 - DNA, 23 bp, Homo sapiens
tttcctcattgagaattcaaatc

SEQ ID NO: 4515455 - DNA, 13 bp, Homo sapiens
tttcctcccagtg

SEQ ID NO: 4515456 - DNA, 16 bp, Homo sapiens
tttcctccccctgcaa

SEQ ID NO: 4515457 - DNA, 18 bp, Homo sapiens
tttcctcctcaggcacac

SEQ ID NO: 4515458 - DNA, 13 bp, Homo sapiens
tttcctcctctgc

SEQ ID NO: 4515459 - DNA, 11 bp, Homo sapiens
tttcctcctgg

SEQ ID NO: 4515460 - DNA, 12 bp, Homo sapiens
tttcctcgagag

SEQ ID NO: 4515461 - DNA, 21 bp, Homo sapiens
tttcctctaatccagcaaagt

SEQ ID NO: 4515462 - DNA, 13 bp, Homo sapiens
tttcctctgcctt

SEQ ID NO: 4515463 - DNA, 12 bp, Homo sapiens
tttcctcttgtg

SEQ ID NO: 4515464 - DNA, 18 bp, Homo sapiens
tttcctgaaccatgtgga

SEQ ID NO: 4515465 - DNA, 14 bp, Homo sapiens
tttcctgcatctct

SEQ ID NO: 4515466 - DNA, 15 bp, Homo sapiens
tttcctgccctgtcc

SEQ ID NO: 4515467 - DNA, 15 bp, Homo sapiens
tttcctggcagctgc

SEQ ID NO: 4515468 - DNA, 16 bp, Homo sapiens
tttcctggcagctgct

SEQ ID NO: 4515469 - DNA, 17 bp, Homo sapiens
tttcctggcagctgctg

SEQ ID NO: 4515470 - DNA, 12 bp, Homo sapiens
tttcctgggcct

SEQ ID NO: 4515471 - DNA, 15 bp, Homo sapiens
tttcctgtaatatat

SEQ ID NO: 4515472 - DNA, 20 bp, Homo sapiens
tttcctgtaatatatttata

SEQ ID NO: 4515473 - DNA, 15 bp, Homo sapiens
tttcctgttcagcat

SEQ ID NO: 4515474 - DNA, 16 bp, Homo sapiens
tttcctgttcagcatt

SEQ ID NO: 4515475 - DNA, 21 bp, Homo sapiens
tttcctgtttgaaatatcatg

SEQ ID NO: 4515476 - DNA, 13 bp, Homo sapiens
tttccttacacat

SEQ ID NO: 4515477 - DNA, 14 bp, Homo sapiens
tttccttactgtgc

SEQ ID NO: 4515478 - DNA, 18 bp, Homo sapiens
tttccttcaaagtttaat

SEQ ID NO: 4515479 - DNA, 19 bp, Homo sapiens
tttccttccatccctaccc

SEQ ID NO: 4515480 - DNA, 20 bp, Homo sapiens
tttccttcccttttctgttc

SEQ ID NO: 4515481 - DNA, 22 bp, Homo sapiens
tttccttccttcctcctttcct

SEQ ID NO: 4515482 - DNA, 19 bp, Homo sapiens
tttccttctggttctaact

SEQ ID NO: 4515483 - DNA, 13 bp, Homo sapiens
tttcctttaaaaa

SEQ ID NO: 4515484 - DNA, 21 bp, Homo sapiens
tttcctttaactgacaagcca

SEQ ID NO: 4515485 - DNA, 14 bp, Homo sapiens
tttcctttatgtga

SEQ ID NO: 4515486 - DNA, 15 bp, Homo sapiens
tttcctttatgtgaa

SEQ ID NO: 4515487 - DNA, 21 bp, Homo sapiens
tttcctttgtggttttatgga

SEQ ID NO: 4515488 - DNA, 21 bp, Homo sapiens
tttcctttttaaggtctttca

SEQ ID NO: 4515489 - DNA, 15 bp, Homo sapiens
tttcgaccctggggc

SEQ ID NO: 4515490 - DNA, 16 bp, Homo sapiens
tttcgatgaagttctg

SEQ ID NO: 4515491 - DNA, 15 bp, Homo sapiens
tttcgccttaaactc

SEQ ID NO: 4515492 - DNA, 17 bp, Homo sapiens
tttcgccttaaactctg

SEQ ID NO: 4515493 - DNA, 15 bp, Homo sapiens
tttcgcttgcttctg

SEQ ID NO: 4515494 - DNA, 18 bp, Homo sapiens
tttcgcttgcttctgcag

SEQ ID NO: 4515495 - DNA, 17 bp, Homo sapiens
tttcggattttttccaa

SEQ ID NO: 4515496 - DNA, 19 bp, Homo sapiens
tttcgtgatcttattgctt

SEQ ID NO: 4515497 - DNA, 20 bp, Homo sapiens
tttcgtttagaatcagaata

SEQ ID NO: 4515498 - DNA, 12 bp, Homo sapiens
tttcgtttgttt

SEQ ID NO: 4515499 - DNA, 14 bp, Homo sapiens
tttctaaaaagtca

SEQ ID NO: 4515500 - DNA, 15 bp, Homo sapiens
tttctaaaaagtcag

SEQ ID NO: 4515501 - DNA, 20 bp, Homo sapiens
tttctaaaaagtcagatgtt

SEQ ID NO: 4515502 - DNA, 19 bp, Homo sapiens
tttctaaaagctttcatgt

SEQ ID NO: 4515503 - DNA, 12 bp, Homo sapiens
tttctaaagtaa

SEQ ID NO: 4515504 - DNA, 16 bp, Homo sapiens
tttctaaagtaaaatt

SEQ ID NO: 4515505 - DNA, 23 bp, Homo sapiens
tttctaacactagcttatttcca

SEQ ID NO: 4515506 - DNA, 11 bp, Homo sapiens
tttctaacttt

SEQ ID NO: 4515507 - DNA, 12 bp, Homo sapiens
tttctaactttt

SEQ ID NO: 4515508 - DNA, 11 bp, Homo sapiens
tttctaagaga

SEQ ID NO: 4515509 - DNA, 16 bp, Homo sapiens
tttctaagagaagtta

SEQ ID NO: 4515510 - DNA, 23 bp, Homo sapiens
tttctaatgaggagagaaaatat

SEQ ID NO: 4515511 - DNA, 18 bp, Homo sapiens
tttctaatgtttactata

SEQ ID NO: 4515512 - DNA, 22 bp, Homo sapiens
tttctaatgtttactatataga

SEQ ID NO: 4515513 - DNA, 23 bp, Homo sapiens
tttctacaaagcactagagaatg

SEQ ID NO: 4515514 - DNA, 19 bp, Homo sapiens
tttctacagtggttttata

SEQ ID NO: 4515515 - DNA, 15 bp, Homo sapiens
tttctacattattgc

SEQ ID NO: 4515516 - DNA, 17 bp, Homo sapiens
tttctacattattgctt

SEQ ID NO: 4515517 - DNA, 20 bp, Homo sapiens
tttctacattattgcttatt

SEQ ID NO: 4515518 - DNA, 18 bp, Homo sapiens
tttctaccacacacagcc

SEQ ID NO: 4515519 - DNA, 10 bp, Homo sapiens
tttctactga

SEQ ID NO: 4515520 - DNA, 22 bp, Homo sapiens
tttctactttgaagtcatacca

SEQ ID NO: 4515521 - DNA, 23 bp, Homo sapiens
tttctagacatcattgtcagcct

SEQ ID NO: 4515522 - DNA, 17 bp, Homo sapiens
tttctagatacaataaa

SEQ ID NO: 4515523 - DNA, 17 bp, Homo sapiens
tttctagggacatgaaa

SEQ ID NO: 4515524 - DNA, 13 bp, Homo sapiens
tttctagtttgtt

SEQ ID NO: 4515525 - DNA, 14 bp, Homo sapiens
tttctagtttgttt

SEQ ID NO: 4515526 - DNA, 18 bp, Homo sapiens
tttctatagccaaaaata

SEQ ID NO: 4515527 - DNA, 14 bp, Homo sapiens
tttctatgaaaatg

SEQ ID NO: 4515528 - DNA, 20 bp, Homo sapiens
tttctatggattcacttcta

SEQ ID NO: 4515529 - DNA, 13 bp, Homo sapiens
tttctatggcttt

SEQ ID NO: 4515530 - DNA, 17 bp, Homo sapiens
tttctatggctttcaaa

SEQ ID NO: 4515531 - DNA, 20 bp, Homo sapiens
tttctatgtcatttttaatg

SEQ ID NO: 4515532 - DNA, 21 bp, Homo sapiens
tttctatgtcatttttaatgt

SEQ ID NO: 4515533 - DNA, 22 bp, Homo sapiens
tttctatgtcatttttaatgta

SEQ ID NO: 4515534 - DNA, 20 bp, Homo sapiens
tttctatgtgttttttgcaa

SEQ ID NO: 4515535 - DNA, 16 bp, Homo sapiens
tttctattgtacagaa

SEQ ID NO: 4515536 - DNA, 15 bp, Homo sapiens
tttctattttaagac

SEQ ID NO: 4515537 - DNA, 13 bp, Homo sapiens
tttctcacaaaaa

SEQ ID NO: 4515538 - DNA, 22 bp, Homo sapiens
tttctcacaaaaaggcaaatat

SEQ ID NO: 4515539 - DNA, 19 bp, Homo sapiens
tttctcacactctaactgt

SEQ ID NO: 4515540 - DNA, 22 bp, Homo sapiens
tttctcacactctaactgtata

SEQ ID NO: 4515541 - DNA, 14 bp, Homo sapiens
tttctcactatata

SEQ ID NO: 4515542 - DNA, 22 bp, Homo sapiens
tttctcaggagcttcaatgagt

SEQ ID NO: 4515543 - DNA, 15 bp, Homo sapiens
tttctcatatttgag

SEQ ID NO: 4515544 - DNA, 15 bp, Homo sapiens
tttctcatgttgaaa

SEQ ID NO: 4515545 - DNA, 15 bp, Homo sapiens
tttctcattgcctct

SEQ ID NO: 4515546 - DNA, 20 bp, Homo sapiens
tttctcattgcctcttctac

SEQ ID NO: 4515547 - DNA, 21 bp, Homo sapiens
tttctccaagagctacataat

SEQ ID NO: 4515548 - DNA, 14 bp, Homo sapiens
tttctccatcccct

SEQ ID NO: 4515549 - DNA, 19 bp, Homo sapiens
tttctcccaagaaacctga

SEQ ID NO: 4515550 - DNA, 17 bp, Homo sapiens
tttctcccagtatgttt

SEQ ID NO: 4515551 - DNA, 22 bp, Homo sapiens
tttctcccagtatgttttaaca

SEQ ID NO: 4515552 - DNA, 17 bp, Homo sapiens
tttctcccagtcattta

SEQ ID NO: 4515553 - DNA, 18 bp, Homo sapiens
tttctcccagtcatttaa

SEQ ID NO: 4515554 - DNA, 13 bp, Homo sapiens
tttctcccctgcc

SEQ ID NO: 4515555 - DNA, 24 bp, Homo sapiens
tttctcccctgcccccaggactgg

SEQ ID NO: 4515556 - DNA, 16 bp, Homo sapiens
tttctcctgcaaattt

SEQ ID NO: 4515557 - DNA, 14 bp, Homo sapiens
tttctcctgtgaat

SEQ ID NO: 4515558 - DNA, 17 bp, Homo sapiens
tttctccttaccgtctt

SEQ ID NO: 4515559 - DNA, 19 bp, Homo sapiens
tttctcctttgcaatagca

SEQ ID NO: 4515560 - DNA, 15 bp, Homo sapiens
tttctccttttccta

SEQ ID NO: 4515561 - DNA, 23 bp, Homo sapiens
tttctctataaagggtcaggccc

SEQ ID NO: 4515562 - DNA, 16 bp, Homo sapiens
tttctctattaaaatg

SEQ ID NO: 4515563 - DNA, 15 bp, Homo sapiens
ttttaaataaaagca

SEQ ID NO: 4515564 - DNA, 16 bp, Homo sapiens
ttttaaataaaagcac

SEQ ID NO: 4515565 - DNA, 14 bp, Homo sapiens
ttttaaatgtacag

SEQ ID NO: 4515566 - DNA, 16 bp, Homo sapiens
ttttaaatgtatacta

SEQ ID NO: 4515567 - DNA, 17 bp, Homo sapiens
ttttaaattaatatctt

SEQ ID NO: 4515568 - DNA, 16 bp, Homo sapiens
ttttaaattataagga

SEQ ID NO: 4515569 - DNA, 21 bp, Homo sapiens
ttttaaattataaggactgca

SEQ ID NO: 4515570 - DNA, 17 bp, Homo sapiens
ttttaaattattatctt

SEQ ID NO: 4515571 - DNA, 12 bp, Homo sapiens
ttttaaattcca

SEQ ID NO: 4515572 - DNA, 20 bp, Homo sapiens
ttttaaatttcttttattaa

SEQ ID NO: 4515573 - DNA, 17 bp, Homo sapiens
ttttaaattttcttcag

SEQ ID NO: 4515574 - DNA, 18 bp, Homo sapiens
ttttaaattttcttcagt

SEQ ID NO: 4515575 - DNA, 19 bp, Homo sapiens
ttttaaattttcttcagtt

SEQ ID NO: 4515576 - DNA, 20 bp, Homo sapiens
ttttaaattttcttcagttg

SEQ ID NO: 4515577 - DNA, 24 bp, Homo sapiens
ttttaactaaattttaaagccatt

SEQ ID NO: 4515578 - DNA, 16 bp, Homo sapiens
ttttaactggcatgtc

SEQ ID NO: 4515579 - DNA, 14 bp, Homo sapiens
ttttaagatagtgt

SEQ ID NO: 4515580 - DNA, 12 bp, Homo sapiens
ttttaagcaaat

SEQ ID NO: 4515581 - DNA, 21 bp, Homo sapiens
ttttaaggaaactttttaatt

SEQ ID NO: 4515582 - DNA, 23 bp, Homo sapiens
ttttaaggataaatcataaagtc

SEQ ID NO: 4515583 - DNA, 23 bp, Homo sapiens
ttttaaggtctttcagtactttt

SEQ ID NO: 4515584 - DNA, 20 bp, Homo sapiens
ttttaagtccagcttggcca

SEQ ID NO: 4515585 - DNA, 15 bp, Homo sapiens
ttttaagttaataga

SEQ ID NO: 4515586 - DNA, 21 bp, Homo sapiens
ttttaagttacacatttttca

SEQ ID NO: 4515587 - DNA, 22 bp, Homo sapiens
ttttaagttacacatttttcag

SEQ ID NO: 4515588 - DNA, 19 bp, Homo sapiens
ttttaataaactactcttt

SEQ ID NO: 4515589 - DNA, 19 bp, Homo sapiens
ttttaataaactgcagggt

SEQ ID NO: 4515590 - DNA, 19 bp, Homo sapiens
ttttaataccacagctatt

SEQ ID NO: 4515591 - DNA, 15 bp, Homo sapiens
ttttaatgaaaagga

SEQ ID NO: 4515592 - DNA, 17 bp, Homo sapiens
ttttaatgatgacaaaa

SEQ ID NO: 4515593 - DNA, 17 bp, Homo sapiens
ttttaatggcagcagaa

SEQ ID NO: 4515594 - DNA, 19 bp, Homo sapiens
ttttaatgtatctatttgt

SEQ ID NO: 4515595 - DNA, 15 bp, Homo sapiens
ttttaatgtgctctg

SEQ ID NO: 4515596 - DNA, 20 bp, Homo sapiens
ttttaatttagtaaatgtta

SEQ ID NO: 4515597 - DNA, 11 bp, Homo sapiens
ttttaatttca

SEQ ID NO: 4515598 - DNA, 19 bp, Homo sapiens
ttttaattttaaagagtgt

SEQ ID NO: 4515599 - DNA, 13 bp, Homo sapiens
ttttacaagaagt

SEQ ID NO: 4515600 - DNA, 18 bp, Homo sapiens
ttttacaagtataacagt

SEQ ID NO: 4515601 - DNA, 22 bp, Homo sapiens
ttttacactattgtgaatattt

SEQ ID NO: 4515602 - DNA, 13 bp, Homo sapiens
ttttacagtaaat

SEQ ID NO: 4515603 - DNA, 21 bp, Homo sapiens
ttttacatgaagctgtataat

SEQ ID NO: 4515604 - DNA, 18 bp, Homo sapiens
ttttacatgtttataaat

SEQ ID NO: 4515605 - DNA, 12 bp, Homo sapiens
ttttaccaaagc

SEQ ID NO: 4515606 - DNA, 13 bp, Homo sapiens
ttttaccaaagca

SEQ ID NO: 4515607 - DNA, 15 bp, Homo sapiens
ttttaccaaagcatc

SEQ ID NO: 4515608 - DNA, 13 bp, Homo sapiens
ttttaccagcttt

SEQ ID NO: 4515609 - DNA, 13 bp, Homo sapiens
ttttacctgcttt

SEQ ID NO: 4515610 - DNA, 14 bp, Homo sapiens
ttttacctttcata

SEQ ID NO: 4515611 - DNA, 23 bp, Homo sapiens
ttttactccaggttattgcaata

SEQ ID NO: 4515612 - DNA, 19 bp, Homo sapiens
ttttactgaatgatctatt

SEQ ID NO: 4515613 - DNA, 13 bp, Homo sapiens
ttttactgtatgt

SEQ ID NO: 4515614 - DNA, 17 bp, Homo sapiens
ttttactgtcagattaa

SEQ ID NO: 4515615 - DNA, 18 bp, Homo sapiens
ttttactgtcagattaaa

SEQ ID NO: 4515616 - DNA, 12 bp, Homo sapiens
ttttactttttt

SEQ ID NO: 4515617 - DNA, 16 bp, Homo sapiens
ttttactttttttagt

SEQ ID NO: 4515618 - DNA, 17 bp, Homo sapiens
ttttactttttttagta

SEQ ID NO: 4515619 - DNA, 20 bp, Homo sapiens
ttttagaatgttgaaaagta

SEQ ID NO: 4515620 - DNA, 14 bp, Homo sapiens
ttttagaattaaaa

SEQ ID NO: 4515621 - DNA, 21 bp, Homo sapiens
ttttagacagtctcactttgt

SEQ ID NO: 4515622 - DNA, 19 bp, Homo sapiens
ttttagatggttacactgt

SEQ ID NO: 4515623 - DNA, 12 bp, Homo sapiens
ttttaggaaagg

SEQ ID NO: 4515624 - DNA, 18 bp, Homo sapiens
ttttaggaagcaagctta

SEQ ID NO: 4515625 - DNA, 22 bp, Homo sapiens
ttttagggaataatattcaata

SEQ ID NO: 4515626 - DNA, 16 bp, Homo sapiens
ttttaggttgttacca

SEQ ID NO: 4515627 - DNA, 22 bp, Homo sapiens
ttttagtagagatggggtttca

SEQ ID NO: 4515628 - DNA, 19 bp, Homo sapiens
ttttagtataaatgtacat

SEQ ID NO: 4515629 - DNA, 13 bp, Homo sapiens
ttttagtgtgtaa

SEQ ID NO: 4515630 - DNA, 15 bp, Homo sapiens
ttttagtgtgtaaaa

SEQ ID NO: 4515631 - DNA, 16 bp, Homo sapiens
ttttagtgtgtaaaat

SEQ ID NO: 4515632 - DNA, 14 bp, Homo sapiens
ttttagtttgttct

SEQ ID NO: 4515633 - DNA, 12 bp, Homo sapiens
ttttataaacta

SEQ ID NO: 4515634 - DNA, 12 bp, Homo sapiens
ttttataaatta

SEQ ID NO: 4515635 - DNA, 15 bp, Homo sapiens
ttttataaattaaat

SEQ ID NO: 4515636 - DNA, 21 bp, Homo sapiens
ttttataacatctttattgaa

SEQ ID NO: 4515637 - DNA, 19 bp, Homo sapiens
ttttataattctcattaaa

SEQ ID NO: 4515638 - DNA, 19 bp, Homo sapiens
ttttatactctttctgtat

SEQ ID NO: 4515639 - DNA, 15 bp, Homo sapiens
ttttatactgcactt

SEQ ID NO: 4515640 - DNA, 20 bp, Homo sapiens
ttttataggggatacttgaa

SEQ ID NO: 4515641 - DNA, 20 bp, Homo sapiens
ttttataggggctttgctga

SEQ ID NO: 4515642 - DNA, 14 bp, Homo sapiens
ttttatagtggaaa

SEQ ID NO: 4515643 - DNA, 15 bp, Homo sapiens
ttttatatattatgt

SEQ ID NO: 4515644 - DNA, 19 bp, Homo sapiens
ttttatatattatgtgaag

SEQ ID NO: 4515645 - DNA, 15 bp, Homo sapiens
ttttatatgtaaatg

SEQ ID NO: 4515646 - DNA, 16 bp, Homo sapiens
ttttatatgtaaatgt

SEQ ID NO: 4515647 - DNA, 9 bp, Homo sapiens
ttttatatt

SEQ ID NO: 4515648 - DNA, 11 bp, Homo sapiens
ttttatattta

SEQ ID NO: 4515649 - DNA, 14 bp, Homo sapiens
ttttatatttaaaa

SEQ ID NO: 4515650 - DNA, 21 bp, Homo sapiens
ttttatatttaaaaaattaaa

SEQ ID NO: 4515651 - DNA, 21 bp, Homo sapiens
ttttatatttcctttatgtga

SEQ ID NO: 4515652 - DNA, 16 bp, Homo sapiens
ttttatcatgcatgtc

SEQ ID NO: 4515653 - DNA, 13 bp, Homo sapiens
ttttatctcagat

SEQ ID NO: 4515654 - DNA, 19 bp, Homo sapiens
ttttatctgcggctttaaa

SEQ ID NO: 4515655 - DNA, 22 bp, Homo sapiens
ttttatcttggtagtacatttt

SEQ ID NO: 4515656 - DNA, 18 bp, Homo sapiens
ttttatgaacattgtact

SEQ ID NO: 4515657 - DNA, 18 bp, Homo sapiens
ttttatgagttcttgttt

SEQ ID NO: 4515658 - DNA, 13 bp, Homo sapiens
ttttatgccatgt

SEQ ID NO: 4515659 - DNA, 20 bp, Homo sapiens
ttttatgccatgttaatatt

SEQ ID NO: 4515660 - DNA, 17 bp, Homo sapiens
ttttatggatgattaaa

SEQ ID NO: 4515661 - DNA, 13 bp, Homo sapiens
ttttatgtacaac

SEQ ID NO: 4515662 - DNA, 19 bp, Homo sapiens
ttttatgtagtaattgaca

SEQ ID NO: 4515663 - DNA, 12 bp, Homo sapiens
ttttatgtgaga

SEQ ID NO: 4515664 - DNA, 14 bp, Homo sapiens
ttttatgtgttctt

SEQ ID NO: 4515665 - DNA, 20 bp, Homo sapiens
ttttatgttggttgatataa

SEQ ID NO: 4515666 - DNA, 15 bp, Homo sapiens
ttttatgtttagata

SEQ ID NO: 4515667 - DNA, 13 bp, Homo sapiens
ttttattaatcta

SEQ ID NO: 4515668 - DNA, 18 bp, Homo sapiens
ttttattaatctactgta

SEQ ID NO: 4515669 - DNA, 14 bp, Homo sapiens
ttttattaatgcac

SEQ ID NO: 4515670 - DNA, 18 bp, Homo sapiens
ttttattactagtgttta

SEQ ID NO: 4515671 - DNA, 13 bp, Homo sapiens
ttttattataaag

SEQ ID NO: 4515672 - DNA, 13 bp, Homo sapiens
ttttattatgtta

SEQ ID NO: 4515673 - DNA, 14 bp, Homo sapiens
ttttattctgactt

SEQ ID NO: 4515674 - DNA, 14 bp, Homo sapiens
ttttattgaatact

SEQ ID NO: 4515675 - DNA, 15 bp, Homo sapiens
ttttattgagatttt

SEQ ID NO: 4515676 - DNA, 12 bp, Homo sapiens
ttttattgcctt

SEQ ID NO: 4515677 - DNA, 13 bp, Homo sapiens
ttttattgccttc

SEQ ID NO: 4515678 - DNA, 15 bp, Homo sapiens
ttttattgccttctc

SEQ ID NO: 4515679 - DNA, 22 bp, Homo sapiens
ttttattgccttctcaccagct

SEQ ID NO: 4515680 - DNA, 23 bp, Homo sapiens
ttttattgccttctcaccagctg

SEQ ID NO: 4515681 - DNA, 24 bp, Homo sapiens
ttttattgccttctcaccagctgc

SEQ ID NO: 4515682 - DNA, 14 bp, Homo sapiens
ttttattggggaat

SEQ ID NO: 4515683 - DNA, 15 bp, Homo sapiens
ttttatttctgattt

SEQ ID NO: 4515684 - DNA, 14 bp, Homo sapiens
ttttattttaaatt

SEQ ID NO: 4515685 - DNA, 14 bp, Homo sapiens
tttctctcagtgaa

SEQ ID NO: 4515686 - DNA, 12 bp, Homo sapiens
tttctctctcct

SEQ ID NO: 4515687 - DNA, 18 bp, Homo sapiens
tttctctctcctctctgc

SEQ ID NO: 4515688 - DNA, 14 bp, Homo sapiens
tttctctctctcta

SEQ ID NO: 4515689 - DNA, 12 bp, Homo sapiens
tttctctctgtt

SEQ ID NO: 4515690 - DNA, 9 bp, Homo sapiens
tttctctgg

SEQ ID NO: 4515691 - DNA, 18 bp, Homo sapiens
tttctctgtacttttcat

SEQ ID NO: 4515692 - DNA, 18 bp, Homo sapiens
tttctcttccccttagaa

SEQ ID NO: 4515693 - DNA, 21 bp, Homo sapiens
tttctcttccttttatataaa

SEQ ID NO: 4515694 - DNA, 17 bp, Homo sapiens
tttctcttttctagttt

SEQ ID NO: 4515695 - DNA, 14 bp, Homo sapiens
tttctgaaggaaga

SEQ ID NO: 4515696 - DNA, 21 bp, Homo sapiens
tttctgaaggaagagaagaca

SEQ ID NO: 4515697 - DNA, 17 bp, Homo sapiens
tttctgaagtgcttgta

SEQ ID NO: 4515698 - DNA, 23 bp, Homo sapiens
tttctgagtgagttttactctta

SEQ ID NO: 4515699 - DNA, 19 bp, Homo sapiens
tttctgatctgtactttgt

SEQ ID NO: 4515700 - DNA, 18 bp, Homo sapiens
tttctgatggtataaaca

SEQ ID NO: 4515701 - DNA, 15 bp, Homo sapiens
tttctgatttcataa

SEQ ID NO: 4515702 - DNA, 15 bp, Homo sapiens
tttctgatttctgaa

SEQ ID NO: 4515703 - DNA, 13 bp, Homo sapiens
tttctgcatatgt

SEQ ID NO: 4515704 - DNA, 19 bp, Homo sapiens
tttctgccaagtcagttct

SEQ ID NO: 4515705 - DNA, 16 bp, Homo sapiens
tttctgccagggagct

SEQ ID NO: 4515706 - DNA, 21 bp, Homo sapiens
tttctgcccggctacatcagc

SEQ ID NO: 4515707 - DNA, 15 bp, Homo sapiens
tttctgctctggaat

SEQ ID NO: 4515708 - DNA, 21 bp, Homo sapiens
tttctggaagactgctcccgg

SEQ ID NO: 4515709 - DNA, 23 bp, Homo sapiens
tttctggcaggtcctcccctctc

SEQ ID NO: 4515710 - DNA, 23 bp, Homo sapiens
tttctgggagacagaaaacatgt

SEQ ID NO: 4515711 - DNA, 10 bp, Homo sapiens
tttctggtgc

SEQ ID NO: 4515712 - DNA, 24 bp, Homo sapiens
tttctggtgccatttctgaactgt

SEQ ID NO: 4515713 - DNA, 15 bp, Homo sapiens
tttctggtgctgtct

SEQ ID NO: 4515714 - DNA, 19 bp, Homo sapiens
tttctgtaatgtaaataaa

SEQ ID NO: 4515715 - DNA, 11 bp, Homo sapiens
tttctgtactt

SEQ ID NO: 4515716 - DNA, 19 bp, Homo sapiens
tttctgtcacagtaaaaat

SEQ ID NO: 4515717 - DNA, 18 bp, Homo sapiens
tttctgtcagtaaaactc

SEQ ID NO: 4515718 - DNA, 19 bp, Homo sapiens
tttctgtcagtaaaactct

SEQ ID NO: 4515719 - DNA, 12 bp, Homo sapiens
tttctgtcccac

SEQ ID NO: 4515720 - DNA, 18 bp, Homo sapiens
tttctgtcctgtaactgt

SEQ ID NO: 4515721 - DNA, 21 bp, Homo sapiens
tttctgtctaggttaaagcta

SEQ ID NO: 4515722 - DNA, 20 bp, Homo sapiens
tttctgttccaaattcagtt

SEQ ID NO: 4515723 - DNA, 15 bp, Homo sapiens
tttctgttgaagttt

SEQ ID NO: 4515724 - DNA, 16 bp, Homo sapiens
tttctgtttgattctt

SEQ ID NO: 4515725 - DNA, 16 bp, Homo sapiens
tttcttaaaccttcag

SEQ ID NO: 4515726 - DNA, 19 bp, Homo sapiens
tttcttaaataagaaactt

SEQ ID NO: 4515727 - DNA, 20 bp, Homo sapiens
tttcttaaataagaaacttt

SEQ ID NO: 4515728 - DNA, 17 bp, Homo sapiens
tttcttaacttcttgct

SEQ ID NO: 4515729 - DNA, 18 bp, Homo sapiens
tttcttaagaattcaaat

SEQ ID NO: 4515730 - DNA, 21 bp, Homo sapiens
tttcttaaggtcattaaaaca

SEQ ID NO: 4515731 - DNA, 22 bp, Homo sapiens
tttcttatcacataagagagat

SEQ ID NO: 4515732 - DNA, 13 bp, Homo sapiens
tttcttatgtgac

SEQ ID NO: 4515733 - DNA, 14 bp, Homo sapiens
tttcttatgtgaca

SEQ ID NO: 4515734 - DNA, 18 bp, Homo sapiens
tttcttcaccaaatcttg

SEQ ID NO: 4515735 - DNA, 16 bp, Homo sapiens
tttcttcacttcaagc

SEQ ID NO: 4515736 - DNA, 18 bp, Homo sapiens
tttcttcatttctctgca

SEQ ID NO: 4515737 - DNA, 12 bp, Homo sapiens
tttcttccccaa

SEQ ID NO: 4515738 - DNA, 12 bp, Homo sapiens
tttcttccctgc

SEQ ID NO: 4515739 - DNA, 20 bp, Homo sapiens
tttcttccctgctttgcatc

SEQ ID NO: 4515740 - DNA, 13 bp, Homo sapiens
tttcttcctttga

SEQ ID NO: 4515741 - DNA, 20 bp, Homo sapiens
tttcttcctttgaagcttta

SEQ ID NO: 4515742 - DNA, 20 bp, Homo sapiens
tttcttgaagaataaattct

SEQ ID NO: 4515743 - DNA, 21 bp, Homo sapiens
tttcttgatcaacatcttttc

SEQ ID NO: 4515744 - DNA, 21 bp, Homo sapiens
tttcttgcctctgtccccttc

SEQ ID NO: 4515745 - DNA, 19 bp, Homo sapiens
tttcttgtgtagatttgaa

SEQ ID NO: 4515746 - DNA, 20 bp, Homo sapiens
tttcttgtgtagatttgaaa

SEQ ID NO: 4515747 - DNA, 15 bp, Homo sapiens
tttctttaaaaaaca

SEQ ID NO: 4515748 - DNA, 12 bp, Homo sapiens
tttctttaactg

SEQ ID NO: 4515749 - DNA, 14 bp, Homo sapiens
tttctttcccatgt

SEQ ID NO: 4515750 - DNA, 14 bp, Homo sapiens
tttctttctgtctt

SEQ ID NO: 4515751 - DNA, 13 bp, Homo sapiens
tttctttcttcct

SEQ ID NO: 4515752 - DNA, 12 bp, Homo sapiens
tttctttgcctc

SEQ ID NO: 4515753 - DNA, 22 bp, Homo sapiens
tttctttgcctctgcagtctca

SEQ ID NO: 4515754 - DNA, 20 bp, Homo sapiens
tttcttttatggcaaaagta

SEQ ID NO: 4515755 - DNA, 21 bp, Homo sapiens
tttcttttcccccattaatca

SEQ ID NO: 4515756 - DNA, 16 bp, Homo sapiens
tttcttttctaacttt

SEQ ID NO: 4515757 - DNA, 14 bp, Homo sapiens
tttctttttcttct

SEQ ID NO: 4515758 - DNA, 19 bp, Homo sapiens
tttcttttttgctttcttg

SEQ ID NO: 4515759 - DNA, 13 bp, Homo sapiens
tttgaaaagaatt

SEQ ID NO: 4515760 - DNA, 16 bp, Homo sapiens
tttgaaaagaatttgt

SEQ ID NO: 4515761 - DNA, 11 bp, Homo sapiens
tttgaaaatgg

SEQ ID NO: 4515762 - DNA, 21 bp, Homo sapiens
tttgaaactaactcatagatt

SEQ ID NO: 4515763 - DNA, 21 bp, Homo sapiens
tttgaaagaatagaacacagt

SEQ ID NO: 4515764 - DNA, 13 bp, Homo sapiens
tttgaaagatgta

SEQ ID NO: 4515765 - DNA, 22 bp, Homo sapiens
tttgaaagggatcatcatgcag

SEQ ID NO: 4515766 - DNA, 16 bp, Homo sapiens
tttgaaagttgtacat

SEQ ID NO: 4515767 - DNA, 22 bp, Homo sapiens
tttgaaataaaaaaagattttt

SEQ ID NO: 4515768 - DNA, 16 bp, Homo sapiens
tttgaaatatcatgtt

SEQ ID NO: 4515769 - DNA, 14 bp, Homo sapiens
tttgaaattctgaa

SEQ ID NO: 4515770 - DNA, 18 bp, Homo sapiens
tttgaaattctgaatttg

SEQ ID NO: 4515771 - DNA, 21 bp, Homo sapiens
tttgaaattctgaatttgcaa

SEQ ID NO: 4515772 - DNA, 22 bp, Homo sapiens
tttgaaattctgaatttgcaaa

SEQ ID NO: 4515773 - DNA, 21 bp, Homo sapiens
tttgaactcagatctgtctga

SEQ ID NO: 4515774 - DNA, 16 bp, Homo sapiens
tttgaactttagtttg

SEQ ID NO: 4515775 - DNA, 13 bp, Homo sapiens
tttgaaggcaaaa

SEQ ID NO: 4515776 - DNA, 18 bp, Homo sapiens
tttgaaggtagttgcaaa

SEQ ID NO: 4515777 - DNA, 15 bp, Homo sapiens
tttgaagtgctgttt

SEQ ID NO: 4515778 - DNA, 16 bp, Homo sapiens
tttgaataaagaatac

SEQ ID NO: 4515779 - DNA, 20 bp, Homo sapiens
tttgaataaagaatacttga

SEQ ID NO: 4515780 - DNA, 19 bp, Homo sapiens
tttgaatatattttatctt

SEQ ID NO: 4515781 - DNA, 13 bp, Homo sapiens
tttgaatatgaaa

SEQ ID NO: 4515782 - DNA, 17 bp, Homo sapiens
tttgaatatttgtttta

SEQ ID NO: 4515783 - DNA, 16 bp, Homo sapiens
tttgaatgttaatttt

SEQ ID NO: 4515784 - DNA, 22 bp, Homo sapiens
tttgaattgtgtcttaatctct

SEQ ID NO: 4515785 - DNA, 15 bp, Homo sapiens
tttgacaaacacaat

SEQ ID NO: 4515786 - DNA, 12 bp, Homo sapiens
tttgacactgaa

SEQ ID NO: 4515787 - DNA, 13 bp, Homo sapiens
tttgacactgaaa

SEQ ID NO: 4515788 - DNA, 18 bp, Homo sapiens
tttgacactgaaagtttt

SEQ ID NO: 4515789 - DNA, 18 bp, Homo sapiens
tttgacacttcccagtgg

SEQ ID NO: 4515790 - DNA, 15 bp, Homo sapiens
tttgacagactattt

SEQ ID NO: 4515791 - DNA, 13 bp, Homo sapiens
tttgacagtgttt

SEQ ID NO: 4515792 - DNA, 20 bp, Homo sapiens
tttgacattgcgtttgacct

SEQ ID NO: 4515793 - DNA, 14 bp, Homo sapiens
tttgaccagtttct

SEQ ID NO: 4515794 - DNA, 22 bp, Homo sapiens
tttgaccatatagattttatta

SEQ ID NO: 4515795 - DNA, 18 bp, Homo sapiens
tttgacctcgactggttt

SEQ ID NO: 4515796 - DNA, 23 bp, Homo sapiens
tttgacctgttgggagtgaggat

SEQ ID NO: 4515797 - DNA, 22 bp, Homo sapiens
tttgactctggggtgcagcttc

SEQ ID NO: 4515798 - DNA, 14 bp, Homo sapiens
tttgactgtaatgt

SEQ ID NO: 4515799 - DNA, 15 bp, Homo sapiens
tttgacttttctgta

SEQ ID NO: 4515800 - DNA, 17 bp, Homo sapiens
tttgacttttctgtaat

SEQ ID NO: 4515801 - DNA, 22 bp, Homo sapiens
tttgactttttttgtatgtgtg

SEQ ID NO: 4515802 - DNA, 13 bp, Homo sapiens
tttgagaaaaata

SEQ ID NO: 4515803 - DNA, 21 bp, Homo sapiens
tttgagaaacaacaatttcta

SEQ ID NO: 4515804 - DNA, 18 bp, Homo sapiens
tttgagattaagaatgcc

SEQ ID NO: 4515805 - DNA, 18 bp, Homo sapiens
tttgagctactggattct

SEQ ID NO: 4515806 - DNA, 12 bp, Homo sapiens
tttgagctgcct

SEQ ID NO: 4515807 - DNA, 14 bp, Homo sapiens
tttgagctgccttc

SEQ ID NO: 4515808 - DNA, 15 bp, Homo sapiens
tttgagcttaatctt

SEQ ID NO: 4515809 - DNA, 20 bp, Homo sapiens
tttgaggaagtggctgtccc

SEQ ID NO: 4515810 - DNA, 20 bp, Homo sapiens
tttgagtaaaaagacatttt

SEQ ID NO: 4515811 - DNA, 14 bp, Homo sapiens
tttgagtaaatatt

SEQ ID NO: 4515812 - DNA, 12 bp, Homo sapiens
tttgagtcattg

SEQ ID NO: 4515813 - DNA, 15 bp, Homo sapiens
tttgagtcattgact

SEQ ID NO: 4515814 - DNA, 22 bp, Homo sapiens
tttgagtcattgacttcatttt

SEQ ID NO: 4515815 - DNA, 23 bp, Homo sapiens
tttgagtcattgacttcatttta

SEQ ID NO: 4515816 - DNA, 16 bp, Homo sapiens
tttgagtttttcctcc

SEQ ID NO: 4515817 - DNA, 17 bp, Homo sapiens
tttgatactaagcattg

SEQ ID NO: 4515818 - DNA, 18 bp, Homo sapiens
tttgataggaaggaaact

SEQ ID NO: 4515819 - DNA, 14 bp, Homo sapiens
tttgatcagacagc

SEQ ID NO: 4515820 - DNA, 16 bp, Homo sapiens
tttgatgaaataaaat

SEQ ID NO: 4515821 - DNA, 16 bp, Homo sapiens
tttgatgcagcatttg

SEQ ID NO: 4515822 - DNA, 20 bp, Homo sapiens
tttgatgcagcatttgataa

SEQ ID NO: 4515823 - DNA, 22 bp, Homo sapiens
tttgatgtacattacagattaa

SEQ ID NO: 4515824 - DNA, 16 bp, Homo sapiens
tttgatgtcatgtgtt

SEQ ID NO: 4515825 - DNA, 16 bp, Homo sapiens
tttgatgtctccaagt

SEQ ID NO: 4515826 - DNA, 19 bp, Homo sapiens
tttgatgtttgtggcctca

SEQ ID NO: 4515827 - DNA, 19 bp, Homo sapiens
tttgattatgtatggatat

SEQ ID NO: 4515828 - DNA, 15 bp, Homo sapiens
tttgattcaaaatat

SEQ ID NO: 4515829 - DNA, 20 bp, Homo sapiens
tttgattcatagtaacttct

SEQ ID NO: 4515830 - DNA, 16 bp, Homo sapiens
tttgattctccttcag

SEQ ID NO: 4515831 - DNA, 15 bp, Homo sapiens
tttgattgatttgaa

SEQ ID NO: 4515832 - DNA, 22 bp, Homo sapiens
tttgattggatattctcctcgg

SEQ ID NO: 4515833 - DNA, 16 bp, Homo sapiens
tttgcaaagtactgta

SEQ ID NO: 4515834 - DNA, 19 bp, Homo sapiens
tttgcaaatatactttact

SEQ ID NO: 4515835 - DNA, 17 bp, Homo sapiens
tttgcaacagcagtgtt

SEQ ID NO: 4515836 - DNA, 22 bp, Homo sapiens
tttgcaagaatgaaatgaatga

SEQ ID NO: 4515837 - DNA, 20 bp, Homo sapiens
tttgcaagggaaaagtctct

SEQ ID NO: 4515838 - DNA, 21 bp, Homo sapiens
tttgcaaggtgcatttttact

SEQ ID NO: 4515839 - DNA, 13 bp, Homo sapiens
tttgcaataatgc

SEQ ID NO: 4515840 - DNA, 22 bp, Homo sapiens
tttgcaataatgcagtatggta

SEQ ID NO: 4515841 - DNA, 15 bp, Homo sapiens
tttgcaatagcagtt

SEQ ID NO: 4515842 - DNA, 21 bp, Homo sapiens
tttgcacaaacttgtgagcat

SEQ ID NO: 4515843 - DNA, 22 bp, Homo sapiens
tttgcacactttggcccagggt

SEQ ID NO: 4515844 - DNA, 16 bp, Homo sapiens
tttgcaccaaagacat

SEQ ID NO: 4515845 - DNA, 14 bp, Homo sapiens
tttgcagctgcttt

SEQ ID NO: 4515846 - DNA, 16 bp, Homo sapiens
tttgcaggtctttaaa

SEQ ID NO: 4515847 - DNA, 22 bp, Homo sapiens
tttgcaggtctttaaatcattt

SEQ ID NO: 4515848 - DNA, 22 bp, Homo sapiens
tttgcagttggactctcaggga

SEQ ID NO: 4515849 - DNA, 21 bp, Homo sapiens
tttgcatattctctattttac

SEQ ID NO: 4515850 - DNA, 13 bp, Homo sapiens
tttgcatattttg

SEQ ID NO: 4515851 - DNA, 20 bp, Homo sapiens
tttgcatattttgagaaact

SEQ ID NO: 4515852 - DNA, 14 bp, Homo sapiens
tttgcatcatttaa

SEQ ID NO: 4515853 - DNA, 14 bp, Homo sapiens
tttgcatgttccac

SEQ ID NO: 4515854 - DNA, 21 bp, Homo sapiens
tttgcattaaattcacaaact

SEQ ID NO: 4515855 - DNA, 22 bp, Homo sapiens
tttgcattaaattcacaaactt

SEQ ID NO: 4515856 - DNA, 12 bp, Homo sapiens
tttgcattgcca

SEQ ID NO: 4515857 - DNA, 17 bp, Homo sapiens
tttgcatttaaaacaga

SEQ ID NO: 4515858 - DNA, 24 bp, Homo sapiens
tttgcatttttgttttgaaagttt

SEQ ID NO: 4515859 - DNA, 15 bp, Homo sapiens
tttgcccatttacac

SEQ ID NO: 4515860 - DNA, 17 bp, Homo sapiens
tttgccccgggatatta

SEQ ID NO: 4515861 - DNA, 17 bp, Homo sapiens
tttgccgtgagcatgca

SEQ ID NO: 4515862 - DNA, 10 bp, Homo sapiens
tttgcctaaa

SEQ ID NO: 4515863 - DNA, 14 bp, Homo sapiens
tttgcctgcagttt

SEQ ID NO: 4515864 - DNA, 14 bp, Homo sapiens
tttgcctgtaagaa

SEQ ID NO: 4515865 - DNA, 22 bp, Homo sapiens
tttgccttctactccccttaat

SEQ ID NO: 4515866 - DNA, 12 bp, Homo sapiens
tttgccttctct

SEQ ID NO: 4515867 - DNA, 19 bp, Homo sapiens
tttgcgtggaaatctcaga

SEQ ID NO: 4515868 - DNA, 19 bp, Homo sapiens
tttgcgtgggagtgtgtgc

SEQ ID NO: 4515869 - DNA, 18 bp, Homo sapiens
tttgctaaaaaagcatat

SEQ ID NO: 4515870 - DNA, 14 bp, Homo sapiens
tttgctaaagacat

SEQ ID NO: 4515871 - DNA, 21 bp, Homo sapiens
tttgctaatttttattaattt

SEQ ID NO: 4515872 - DNA, 15 bp, Homo sapiens
tttgctatgtaaggg

SEQ ID NO: 4515873 - DNA, 12 bp, Homo sapiens
tttgctcaacag

SEQ ID NO: 4515874 - DNA, 20 bp, Homo sapiens
tttgctccaccttcatattg

SEQ ID NO: 4515875 - DNA, 20 bp, Homo sapiens
tttgctcttcaagaaatctg

SEQ ID NO: 4515876 - DNA, 23 bp, Homo sapiens
tttgctcttcataataaaccttg

SEQ ID NO: 4515877 - DNA, 19 bp, Homo sapiens
tttgctgccaaatgcgtat

SEQ ID NO: 4515878 - DNA, 18 bp, Homo sapiens
tttgctgcccctgtctgg

SEQ ID NO: 4515879 - DNA, 13 bp, Homo sapiens
tttgctgcttctg

SEQ ID NO: 4515880 - DNA, 15 bp, Homo sapiens
tttgctggaataagt

SEQ ID NO: 4515881 - DNA, 20 bp, Homo sapiens
tttgctggagctctgcccat

SEQ ID NO: 4515882 - DNA, 15 bp, Homo sapiens
tttgctgtgaacaat

SEQ ID NO: 4515883 - DNA, 17 bp, Homo sapiens
tttgctgttactgcttc

SEQ ID NO: 4515884 - DNA, 10 bp, Homo sapiens
tttgctgttt

SEQ ID NO: 4515885 - DNA, 19 bp, Homo sapiens
tttgctgtttatacttgag

SEQ ID NO: 4515886 - DNA, 14 bp, Homo sapiens
tttgcttattgtgt

SEQ ID NO: 4515887 - DNA, 14 bp, Homo sapiens
tttgcttgaacaca

SEQ ID NO: 4515888 - DNA, 22 bp, Homo sapiens
tttgcttgcaatctaatctgaa

SEQ ID NO: 4515889 - DNA, 23 bp, Homo sapiens
tttgctttatgggtttggcttgt

SEQ ID NO: 4515890 - DNA, 18 bp, Homo sapiens
tttgctttcttgtctttt

SEQ ID NO: 4515891 - DNA, 22 bp, Homo sapiens
tttggaaagtacactctgctgt

SEQ ID NO: 4515892 - DNA, 14 bp, Homo sapiens
tttggaaataaaaa

SEQ ID NO: 4515893 - DNA, 15 bp, Homo sapiens
tttggaacgcagttg

SEQ ID NO: 4515894 - DNA, 21 bp, Homo sapiens
tttggaagaagttttttactt

SEQ ID NO: 4515895 - DNA, 17 bp, Homo sapiens
tttggaatactttttgt

SEQ ID NO: 4515896 - DNA, 16 bp, Homo sapiens
tttggaatatttgctt

SEQ ID NO: 4515897 - DNA, 15 bp, Homo sapiens
tttggacccagggcc

SEQ ID NO: 4515898 - DNA, 14 bp, Homo sapiens
tttggactctctgt

SEQ ID NO: 4515899 - DNA, 18 bp, Homo sapiens
tttggaggtgcttgatct

SEQ ID NO: 4515900 - DNA, 19 bp, Homo sapiens
tttggagtgttatgtattt

SEQ ID NO: 4515901 - DNA, 19 bp, Homo sapiens
tttggatatgtaaaacatt

SEQ ID NO: 4515902 - DNA, 14 bp, Homo sapiens
tttggatggtttgt

SEQ ID NO: 4515903 - DNA, 20 bp, Homo sapiens
tttggatttaaaagcctgct

SEQ ID NO: 4515904 - DNA, 13 bp, Homo sapiens
tttggatttctgt

SEQ ID NO: 4515905 - DNA, 18 bp, Homo sapiens
tttggatttctgtgaagt

SEQ ID NO: 4515906 - DNA, 17 bp, Homo sapiens
tttggcactatggtttg

SEQ ID NO: 4515907 - DNA, 17 bp, Homo sapiens
tttggcactctctgcca

SEQ ID NO: 4515908 - DNA, 21 bp, Homo sapiens
tttggcattatctctttctct

SEQ ID NO: 4515909 - DNA, 22 bp, Homo sapiens
tttggcctggggtgcatctcct

SEQ ID NO: 4515910 - DNA, 12 bp, Homo sapiens
tttggccttaag

SEQ ID NO: 4515911 - DNA, 19 bp, Homo sapiens
tttggccttaagaactgtg

SEQ ID NO: 4515912 - DNA, 12 bp, Homo sapiens
tttgggaagggg

SEQ ID NO: 4515913 - DNA, 22 bp, Homo sapiens
tttgggaagtgaagactggaag

SEQ ID NO: 4515914 - DNA, 14 bp, Homo sapiens
tttgggatgtctta

SEQ ID NO: 4515915 - DNA, 22 bp, Homo sapiens
tttgggatgtcttatttttaga

SEQ ID NO: 4515916 - DNA, 14 bp, Homo sapiens
tttgggcccaggga

SEQ ID NO: 4515917 - DNA, 14 bp, Homo sapiens
tttgggctgaatgt

SEQ ID NO: 4515918 - DNA, 19 bp, Homo sapiens
tttgggctgaatgtatgta

SEQ ID NO: 4515919 - DNA, 19 bp, Homo sapiens
tttggggatcgatgtgctc

SEQ ID NO: 4515920 - DNA, 16 bp, Homo sapiens
tttgggtttttttcct

SEQ ID NO: 4515921 - DNA, 16 bp, Homo sapiens
tttggtaaaaatgctg

SEQ ID NO: 4515922 - DNA, 13 bp, Homo sapiens
tttggtacacatg

SEQ ID NO: 4515923 - DNA, 14 bp, Homo sapiens
tttggtacacatgt

SEQ ID NO: 4515924 - DNA, 16 bp, Homo sapiens
tttggtacacatgtgt

SEQ ID NO: 4515925 - DNA, 17 bp, Homo sapiens
tttggtagatgacaaat

SEQ ID NO: 4515926 - DNA, 19 bp, Homo sapiens
tttggtagctgggaaagca

SEQ ID NO: 4515927 - DNA, 15 bp, Homo sapiens
ttttattttattgaa

SEQ ID NO: 4515928 - DNA, 17 bp, Homo sapiens
ttttattttattgaata

SEQ ID NO: 4515929 - DNA, 15 bp, Homo sapiens
ttttattttcattgt

SEQ ID NO: 4515930 - DNA, 13 bp, Homo sapiens
ttttattttgtaa

SEQ ID NO: 4515931 - DNA, 12 bp, Homo sapiens
ttttcaaagcaa

SEQ ID NO: 4515932 - DNA, 15 bp, Homo sapiens
ttttcaactttgaat

SEQ ID NO: 4515933 - DNA, 13 bp, Homo sapiens
ttttcaagaaatg

SEQ ID NO: 4515934 - DNA, 16 bp, Homo sapiens
ttttcaagaataatca

SEQ ID NO: 4515935 - DNA, 15 bp, Homo sapiens
ttttcaagcagcatc

SEQ ID NO: 4515936 - DNA, 20 bp, Homo sapiens
ttttcaaggcatttgtcttt

SEQ ID NO: 4515937 - DNA, 13 bp, Homo sapiens
ttttcaagttgta

SEQ ID NO: 4515938 - DNA, 22 bp, Homo sapiens
ttttcaatatattgaacttttg

SEQ ID NO: 4515939 - DNA, 23 bp, Homo sapiens
ttttcaatatattgaacttttgt

SEQ ID NO: 4515940 - DNA, 17 bp, Homo sapiens
ttttcaatatgcaagca

SEQ ID NO: 4515941 - DNA, 18 bp, Homo sapiens
ttttcaatgaattttata

SEQ ID NO: 4515942 - DNA, 14 bp, Homo sapiens
ttttcaatgtgatt

SEQ ID NO: 4515943 - DNA, 20 bp, Homo sapiens
ttttcaccttttcaggaaaa

SEQ ID NO: 4515944 - DNA, 20 bp, Homo sapiens
ttttcactttgtgtattaaa

SEQ ID NO: 4515945 - DNA, 12 bp, Homo sapiens
ttttcagaagca

SEQ ID NO: 4515946 - DNA, 20 bp, Homo sapiens
ttttcagaagcaagccagac

SEQ ID NO: 4515947 - DNA, 22 bp, Homo sapiens
ttttcagaagcaagccagacct

SEQ ID NO: 4515948 - DNA, 21 bp, Homo sapiens
ttttcagaaggttattttctt

SEQ ID NO: 4515949 - DNA, 11 bp, Homo sapiens
ttttcagaatc

SEQ ID NO: 4515950 - DNA, 20 bp, Homo sapiens
ttttcagaatctgaatgtaa

SEQ ID NO: 4515951 - DNA, 22 bp, Homo sapiens
ttttcagaatctgaatgtaatt

SEQ ID NO: 4515952 - DNA, 11 bp, Homo sapiens
ttttcagaccc

SEQ ID NO: 4515953 - DNA, 14 bp, Homo sapiens
ttttcagactcaga

SEQ ID NO: 4515954 - DNA, 14 bp, Homo sapiens
ttttcagcagcaaa

SEQ ID NO: 4515955 - DNA, 18 bp, Homo sapiens
ttttcagtgatcttcact

SEQ ID NO: 4515956 - DNA, 12 bp, Homo sapiens
ttttcagttttc

SEQ ID NO: 4515957 - DNA, 14 bp, Homo sapiens
ttttcagttttcag

SEQ ID NO: 4515958 - DNA, 13 bp, Homo sapiens
ttttcatactgta

SEQ ID NO: 4515959 - DNA, 16 bp, Homo sapiens
ttttcatatcatttct

SEQ ID NO: 4515960 - DNA, 13 bp, Homo sapiens
ttttcatcatttc

SEQ ID NO: 4515961 - DNA, 21 bp, Homo sapiens
ttttcatcccgtatcacagtg

SEQ ID NO: 4515962 - DNA, 18 bp, Homo sapiens
ttttcattaaataaattt

SEQ ID NO: 4515963 - DNA, 13 bp, Homo sapiens
ttttcattcatga

SEQ ID NO: 4515964 - DNA, 16 bp, Homo sapiens
ttttcattcatgaata

SEQ ID NO: 4515965 - DNA, 17 bp, Homo sapiens
ttttcattcctaaagaa

SEQ ID NO: 4515966 - DNA, 13 bp, Homo sapiens
ttttcattctgtt

SEQ ID NO: 4515967 - DNA, 13 bp, Homo sapiens
ttttcatttgtaa

SEQ ID NO: 4515968 - DNA, 14 bp, Homo sapiens
ttttcattttaata

SEQ ID NO: 4515969 - DNA, 16 bp, Homo sapiens
ttttcattttaatata

SEQ ID NO: 4515970 - DNA, 19 bp, Homo sapiens
ttttccaatattttaataa

SEQ ID NO: 4515971 - DNA, 20 bp, Homo sapiens
ttttccaatattttaataaa

SEQ ID NO: 4515972 - DNA, 22 bp, Homo sapiens
ttttccaatattttaataaagt

SEQ ID NO: 4515973 - DNA, 23 bp, Homo sapiens
ttttccaatattttaataaagta

SEQ ID NO: 4515974 - DNA, 13 bp, Homo sapiens
ttttccacataaa

SEQ ID NO: 4515975 - DNA, 16 bp, Homo sapiens
ttttccacataaattt

SEQ ID NO: 4515976 - DNA, 18 bp, Homo sapiens
ttttccacataaatttta

SEQ ID NO: 4515977 - DNA, 18 bp, Homo sapiens
ttttccactccattgtcg

SEQ ID NO: 4515978 - DNA, 21 bp, Homo sapiens
ttttccagccttatgtgttac

SEQ ID NO: 4515979 - DNA, 20 bp, Homo sapiens
ttttccagctggatgagaat

SEQ ID NO: 4515980 - DNA, 12 bp, Homo sapiens
ttttccaggctg

SEQ ID NO: 4515981 - DNA, 9 bp, Homo sapiens
ttttccagt

SEQ ID NO: 4515982 - DNA, 18 bp, Homo sapiens
ttttccagtgacttgcaa

SEQ ID NO: 4515983 - DNA, 18 bp, Homo sapiens
ttttcccaaaatgttgaa

SEQ ID NO: 4515984 - DNA, 23 bp, Homo sapiens
ttttccccggtcccttgagacct

SEQ ID NO: 4515985 - DNA, 14 bp, Homo sapiens
ttttccctggaact

SEQ ID NO: 4515986 - DNA, 19 bp, Homo sapiens
ttttccctggaactcctgg

SEQ ID NO: 4515987 - DNA, 20 bp, Homo sapiens
ttttcctaagacatttttca

SEQ ID NO: 4515988 - DNA, 17 bp, Homo sapiens
ttttcctatcatgttaa

SEQ ID NO: 4515989 - DNA, 13 bp, Homo sapiens
ttttcctcctctg

SEQ ID NO: 4515990 - DNA, 15 bp, Homo sapiens
ttttcctcctctgcc

SEQ ID NO: 4515991 - DNA, 16 bp, Homo sapiens
ttttcctcctctgcct

SEQ ID NO: 4515992 - DNA, 11 bp, Homo sapiens
ttttcctctgg

SEQ ID NO: 4515993 - DNA, 16 bp, Homo sapiens
ttttcctcttgtgatt

SEQ ID NO: 4515994 - DNA, 14 bp, Homo sapiens
ttttccttactgtg

SEQ ID NO: 4515995 - DNA, 16 bp, Homo sapiens
ttttccttatttgcct

SEQ ID NO: 4515996 - DNA, 20 bp, Homo sapiens
ttttccttatttgccttcta

SEQ ID NO: 4515997 - DNA, 16 bp, Homo sapiens
ttttccttcaaagttt

SEQ ID NO: 4515998 - DNA, 19 bp, Homo sapiens
ttttccttcccttttctgt

SEQ ID NO: 4515999 - DNA, 20 bp, Homo sapiens
ttttccttgctatttcaata

SEQ ID NO: 4516000 - DNA, 14 bp, Homo sapiens
ttttcctttaatga

SEQ ID NO: 4516001 - DNA, 20 bp, Homo sapiens
ttttcgcttgcttctgcagc

SEQ ID NO: 4516002 - DNA, 19 bp, Homo sapiens
ttttcggccccatgtatct

SEQ ID NO: 4516003 - DNA, 23 bp, Homo sapiens
ttttcgtttagaatcagaataaa

SEQ ID NO: 4516004 - DNA, 14 bp, Homo sapiens
ttttctaaaagctt

SEQ ID NO: 4516005 - DNA, 11 bp, Homo sapiens
ttttctaaaat

SEQ ID NO: 4516006 - DNA, 13 bp, Homo sapiens
ttttctaaaatct

SEQ ID NO: 4516007 - DNA, 17 bp, Homo sapiens
ttttctaaactcaataa

SEQ ID NO: 4516008 - DNA, 13 bp, Homo sapiens
ttttctacagtgg

SEQ ID NO: 4516009 - DNA, 13 bp, Homo sapiens
ttttctagagaca

SEQ ID NO: 4516010 - DNA, 16 bp, Homo sapiens
ttttctagagacacat

SEQ ID NO: 4516011 - DNA, 13 bp, Homo sapiens
ttttctagagtta

SEQ ID NO: 4516012 - DNA, 15 bp, Homo sapiens
ttttctagatacaat

SEQ ID NO: 4516013 - DNA, 19 bp, Homo sapiens
ttttctattatggaaaact

SEQ ID NO: 4516014 - DNA, 19 bp, Homo sapiens
ttttctcccaagaaacctg

SEQ ID NO: 4516015 - DNA, 20 bp, Homo sapiens
ttttctcccaagaaacctga

SEQ ID NO: 4516016 - DNA, 16 bp, Homo sapiens
ttttctcctgcaaatt

SEQ ID NO: 4516017 - DNA, 12 bp, Homo sapiens
ttttctctctta

SEQ ID NO: 4516018 - DNA, 14 bp, Homo sapiens
ttttctctgtactt

SEQ ID NO: 4516019 - DNA, 18 bp, Homo sapiens
ttttctctgtacttttca

SEQ ID NO: 4516020 - DNA, 16 bp, Homo sapiens
ttttctcttgtaccat

SEQ ID NO: 4516021 - DNA, 15 bp, Homo sapiens
ttttctctttctctc

SEQ ID NO: 4516022 - DNA, 17 bp, Homo sapiens
ttttctctttctctcct

SEQ ID NO: 4516023 - DNA, 18 bp, Homo sapiens
ttttctgagaaagactat

SEQ ID NO: 4516024 - DNA, 23 bp, Homo sapiens
ttttctgaggtccttatgtcctg

SEQ ID NO: 4516025 - DNA, 15 bp, Homo sapiens
ttttctgccctggct

SEQ ID NO: 4516026 - DNA, 14 bp, Homo sapiens
ttttctgtaatgta

SEQ ID NO: 4516027 - DNA, 14 bp, Homo sapiens
ttttctgtaattca

SEQ ID NO: 4516028 - DNA, 14 bp, Homo sapiens
ttttcttactttta

SEQ ID NO: 4516029 - DNA, 16 bp, Homo sapiens
ttttcttcagcattta

SEQ ID NO: 4516030 - DNA, 11 bp, Homo sapiens
ttttcttcagg

SEQ ID NO: 4516031 - DNA, 14 bp, Homo sapiens
ttttcttcctttga

SEQ ID NO: 4516032 - DNA, 14 bp, Homo sapiens
ttttcttcttccct

SEQ ID NO: 4516033 - DNA, 18 bp, Homo sapiens
ttttcttcttccctccct

SEQ ID NO: 4516034 - DNA, 19 bp, Homo sapiens
ttttcttgtatctggattc

SEQ ID NO: 4516035 - DNA, 14 bp, Homo sapiens
ttttcttgttaact

SEQ ID NO: 4516036 - DNA, 17 bp, Homo sapiens
ttttctttacttatctc

SEQ ID NO: 4516037 - DNA, 17 bp, Homo sapiens
ttttctttcctcctttc

SEQ ID NO: 4516038 - DNA, 21 bp, Homo sapiens
ttttcttttaaagatttgttt

SEQ ID NO: 4516039 - DNA, 22 bp, Homo sapiens
ttttcttttgctttatgggttt

SEQ ID NO: 4516040 - DNA, 16 bp, Homo sapiens
ttttctttttctttct

SEQ ID NO: 4516041 - DNA, 22 bp, Homo sapiens
ttttcttttttttaatgtttct

SEQ ID NO: 4516042 - DNA, 14 bp, Homo sapiens
ttttgaaaaaagct

SEQ ID NO: 4516043 - DNA, 16 bp, Homo sapiens
ttttgaaaaaagctca

SEQ ID NO: 4516044 - DNA, 20 bp, Homo sapiens
ttttgaaaagcagacatttt

SEQ ID NO: 4516045 - DNA, 21 bp, Homo sapiens
ttttgaaaatatgtactgtat

SEQ ID NO: 4516046 - DNA, 13 bp, Homo sapiens
ttttgaaatgtca

SEQ ID NO: 4516047 - DNA, 14 bp, Homo sapiens
ttttgaaggaatac

SEQ ID NO: 4516048 - DNA, 16 bp, Homo sapiens
ttttgaaggtttcaga

SEQ ID NO: 4516049 - DNA, 21 bp, Homo sapiens
tttggtgagagtcaaagctga

SEQ ID NO: 4516050 - DNA, 15 bp, Homo sapiens
tttggtgcctttcct

SEQ ID NO: 4516051 - DNA, 21 bp, Homo sapiens
tttggtgcttctcagatttct

SEQ ID NO: 4516052 - DNA, 17 bp, Homo sapiens
tttggtggatgtaaata

SEQ ID NO: 4516053 - DNA, 16 bp, Homo sapiens
tttggtgtttgtctgt

SEQ ID NO: 4516054 - DNA, 13 bp, Homo sapiens
tttggttaaagta

SEQ ID NO: 4516055 - DNA, 13 bp, Homo sapiens
tttggttcccttc

SEQ ID NO: 4516056 - DNA, 21 bp, Homo sapiens
tttggttttgttcccctcctc

SEQ ID NO: 4516057 - DNA, 13 bp, Homo sapiens
tttgtaaatgcat

SEQ ID NO: 4516058 - DNA, 17 bp, Homo sapiens
tttgtaaatttatgtga

SEQ ID NO: 4516059 - DNA, 23 bp, Homo sapiens
tttgtaactgtttagatgaatgt

SEQ ID NO: 4516060 - DNA, 14 bp, Homo sapiens
tttgtaacttcaaa

SEQ ID NO: 4516061 - DNA, 19 bp, Homo sapiens
tttgtaagatatttgcagt

SEQ ID NO: 4516062 - DNA, 21 bp, Homo sapiens
tttgtaagcaacttgcttcta

SEQ ID NO: 4516063 - DNA, 20 bp, Homo sapiens
tttgtaagttgaagcaaatc

SEQ ID NO: 4516064 - DNA, 23 bp, Homo sapiens
tttgtaataagcaatcaaggtta

SEQ ID NO: 4516065 - DNA, 15 bp, Homo sapiens
tttgtaatattttcc

SEQ ID NO: 4516066 - DNA, 14 bp, Homo sapiens
tttgtaatttttgc

SEQ ID NO: 4516067 - DNA, 12 bp, Homo sapiens
tttgtacatctt

SEQ ID NO: 4516068 - DNA, 19 bp, Homo sapiens
tttgtacatttttcagcag

SEQ ID NO: 4516069 - DNA, 22 bp, Homo sapiens
tttgtactgaatttttttgtaa

SEQ ID NO: 4516070 - DNA, 23 bp, Homo sapiens
tttgtactgtatctattcttctg

SEQ ID NO: 4516071 - DNA, 20 bp, Homo sapiens
tttgtactttatcatgaatg

SEQ ID NO: 4516072 - DNA, 17 bp, Homo sapiens
tttgtagggttctgctt

SEQ ID NO: 4516073 - DNA, 20 bp, Homo sapiens
tttgtaggtaaaatgtattt

SEQ ID NO: 4516074 - DNA, 17 bp, Homo sapiens
tttgtagtagcgttttt

SEQ ID NO: 4516075 - DNA, 15 bp, Homo sapiens
tttgtagtgattttt

SEQ ID NO: 4516076 - DNA, 17 bp, Homo sapiens
tttgtagttaatataaa

SEQ ID NO: 4516077 - DNA, 20 bp, Homo sapiens
tttgtataaaaattaagctt

SEQ ID NO: 4516078 - DNA, 14 bp, Homo sapiens
tttgtataaaagtg

SEQ ID NO: 4516079 - DNA, 20 bp, Homo sapiens
tttgtataaaagtgtgaaat

SEQ ID NO: 4516080 - DNA, 20 bp, Homo sapiens
tttgtatactttaaataatt

SEQ ID NO: 4516081 - DNA, 19 bp, Homo sapiens
tttgtatataggcttctca

SEQ ID NO: 4516082 - DNA, 17 bp, Homo sapiens
tttgtatatctaagact

SEQ ID NO: 4516083 - DNA, 20 bp, Homo sapiens
tttgtatattacaacattta

SEQ ID NO: 4516084 - DNA, 20 bp, Homo sapiens
tttgtatgaaatatatgtga

SEQ ID NO: 4516085 - DNA, 13 bp, Homo sapiens
tttgtatgacagt

SEQ ID NO: 4516086 - DNA, 21 bp, Homo sapiens
tttgtatgccaatcttaaaga

SEQ ID NO: 4516087 - DNA, 16 bp, Homo sapiens
tttgtattattacaaa

SEQ ID NO: 4516088 - DNA, 17 bp, Homo sapiens
tttgtattattacaaat

SEQ ID NO: 4516089 - DNA, 16 bp, Homo sapiens
tttgtattctctgagc

SEQ ID NO: 4516090 - DNA, 15 bp, Homo sapiens
tttgtattctctgca

SEQ ID NO: 4516091 - DNA, 16 bp, Homo sapiens
tttgtattgcttcctg

SEQ ID NO: 4516092 - DNA, 21 bp, Homo sapiens
tttgtattgtttcaattgcat

SEQ ID NO: 4516093 - DNA, 20 bp, Homo sapiens
tttgtattttggaggtgctt

SEQ ID NO: 4516094 - DNA, 11 bp, Homo sapiens
tttgtcaatga

SEQ ID NO: 4516095 - DNA, 23 bp, Homo sapiens
tttgtcacttgccacatggtgtc

SEQ ID NO: 4516096 - DNA, 20 bp, Homo sapiens
tttgtcacttttttataaaa

SEQ ID NO: 4516097 - DNA, 22 bp, Homo sapiens
tttgtcagaactagaatttgat

SEQ ID NO: 4516098 - DNA, 15 bp, Homo sapiens
tttgtcagacttcca

SEQ ID NO: 4516099 - DNA, 14 bp, Homo sapiens
tttgtctcttacat

SEQ ID NO: 4516100 - DNA, 12 bp, Homo sapiens
tttgtgaactgg

SEQ ID NO: 4516101 - DNA, 18 bp, Homo sapiens
tttgtgaactggaagaaa

SEQ ID NO: 4516102 - DNA, 17 bp, Homo sapiens
tttgtgatgaacatatt

SEQ ID NO: 4516103 - DNA, 20 bp, Homo sapiens
tttgtgattcaatctgtaaa

SEQ ID NO: 4516104 - DNA, 21 bp, Homo sapiens
tttgtgcaaacatggagaaat

SEQ ID NO: 4516105 - DNA, 13 bp, Homo sapiens
tttgtgcattctg

SEQ ID NO: 4516106 - DNA, 14 bp, Homo sapiens
tttgtgctagaaat

SEQ ID NO: 4516107 - DNA, 22 bp, Homo sapiens
tttgtgctgtgggcagcaccct

SEQ ID NO: 4516108 - DNA, 12 bp, Homo sapiens
tttgtggctggg

SEQ ID NO: 4516109 - DNA, 17 bp, Homo sapiens
tttgtgtaataaagtgt

SEQ ID NO: 4516110 - DNA, 15 bp, Homo sapiens
tttgtgtattaaatg

SEQ ID NO: 4516111 - DNA, 16 bp, Homo sapiens
tttgtgtgtatttgct

SEQ ID NO: 4516112 - DNA, 14 bp, Homo sapiens
tttgtgtgtttcaa

SEQ ID NO: 4516113 - DNA, 16 bp, Homo sapiens
tttgttaatatcactc

SEQ ID NO: 4516114 - DNA, 14 bp, Homo sapiens
tttgttaattaaat

SEQ ID NO: 4516115 - DNA, 15 bp, Homo sapiens
tttgttactgtcatt

SEQ ID NO: 4516116 - DNA, 16 bp, Homo sapiens
tttgttacttccttat

SEQ ID NO: 4516117 - DNA, 15 bp, Homo sapiens
tttgttagcaaagat

SEQ ID NO: 4516118 - DNA, 20 bp, Homo sapiens
tttgttaggatagatcttaa

SEQ ID NO: 4516119 - DNA, 17 bp, Homo sapiens
tttgttaggattttcac

SEQ ID NO: 4516120 - DNA, 12 bp, Homo sapiens
tttgttcccctc

SEQ ID NO: 4516121 - DNA, 15 bp, Homo sapiens
tttgttcccctcctc

SEQ ID NO: 4516122 - DNA, 18 bp, Homo sapiens
tttgttcccctcctccac

SEQ ID NO: 4516123 - DNA, 21 bp, Homo sapiens
tttgttctagacttccccatc

SEQ ID NO: 4516124 - DNA, 22 bp, Homo sapiens
tttgttgcgttcctttcttttc

SEQ ID NO: 4516125 - DNA, 12 bp, Homo sapiens
tttgttgtaaaa

SEQ ID NO: 4516126 - DNA, 16 bp, Homo sapiens
tttgttgtactttata

SEQ ID NO: 4516127 - DNA, 12 bp, Homo sapiens
tttgttgtttat

SEQ ID NO: 4516128 - DNA, 14 bp, Homo sapiens
tttgtttaaaaagg

SEQ ID NO: 4516129 - DNA, 22 bp, Homo sapiens
tttgtttaaatgccaaaatgta

SEQ ID NO: 4516130 - DNA, 11 bp, Homo sapiens
tttgtttagaa

SEQ ID NO: 4516131 - DNA, 13 bp, Homo sapiens
tttgtttcacttt

SEQ ID NO: 4516132 - DNA, 19 bp, Homo sapiens
tttgtttcccccacagttt

SEQ ID NO: 4516133 - DNA, 13 bp, Homo sapiens
tttgtttgatgca

SEQ ID NO: 4516134 - DNA, 11 bp, Homo sapiens
tttgtttgttt

SEQ ID NO: 4516135 - DNA, 13 bp, Homo sapiens
tttgttttcttaa

SEQ ID NO: 4516136 - DNA, 12 bp, Homo sapiens
tttgttttgcac

SEQ ID NO: 4516137 - DNA, 13 bp, Homo sapiens
tttgtttttactg

SEQ ID NO: 4516138 - DNA, 16 bp, Homo sapiens
tttgtttttatttctt

SEQ ID NO: 4516139 - DNA, 21 bp, Homo sapiens
tttgtttttcaagaaatgatt

SEQ ID NO: 4516140 - DNA, 18 bp, Homo sapiens
tttgtttttgcatgaaat

SEQ ID NO: 4516141 - DNA, 23 bp, Homo sapiens
tttgttttttttttaaaaaagac

SEQ ID NO: 4516142 - DNA, 14 bp, Homo sapiens
ttttaaaaaagctt

SEQ ID NO: 4516143 - DNA, 15 bp, Homo sapiens
ttttaaaaaagctta

SEQ ID NO: 4516144 - DNA, 20 bp, Homo sapiens
ttttaaaaaagcttaaaact

SEQ ID NO: 4516145 - DNA, 22 bp, Homo sapiens
ttttaaaaaagcttaaaacttt

SEQ ID NO: 4516146 - DNA, 13 bp, Homo sapiens
ttttaaaacccag

SEQ ID NO: 4516147 - DNA, 14 bp, Homo sapiens
ttttaaaagagaca

SEQ ID NO: 4516148 - DNA, 23 bp, Homo sapiens
ttttaaaagagacaaactgtaaa

SEQ ID NO: 4516149 - DNA, 18 bp, Homo sapiens
ttttaaaagcaattatat

SEQ ID NO: 4516150 - DNA, 13 bp, Homo sapiens
ttttaaaagcctt

SEQ ID NO: 4516151 - DNA, 10 bp, Homo sapiens
ttttaaaata

SEQ ID NO: 4516152 - DNA, 14 bp, Homo sapiens
ttttaaaatagaaa

SEQ ID NO: 4516153 - DNA, 23 bp, Homo sapiens
ttttaaaatagaaattttgtaag

SEQ ID NO: 4516154 - DNA, 14 bp, Homo sapiens
ttttaaaatcagct

SEQ ID NO: 4516155 - DNA, 22 bp, Homo sapiens
ttttaaaatcagctattttgtg

SEQ ID NO: 4516156 - DNA, 22 bp, Homo sapiens
ttttaaaatccagactttcttt

SEQ ID NO: 4516157 - DNA, 15 bp, Homo sapiens
ttttaaaattgaata

SEQ ID NO: 4516158 - DNA, 17 bp, Homo sapiens
ttttaaaattgaatagt

SEQ ID NO: 4516159 - DNA, 11 bp, Homo sapiens
ttttaaaattt

SEQ ID NO: 4516160 - DNA, 20 bp, Homo sapiens
ttttaaaatttgttcttgta

SEQ ID NO: 4516161 - DNA, 20 bp, Homo sapiens
ttttaaacaaaatttcacag

SEQ ID NO: 4516162 - DNA, 16 bp, Homo sapiens
ttttaaacttgaaata

SEQ ID NO: 4516163 - DNA, 11 bp, Homo sapiens
ttttaaagaat

SEQ ID NO: 4516164 - DNA, 20 bp, Homo sapiens
ttttaaagagtgtgttataa

SEQ ID NO: 4516165 - DNA, 19 bp, Homo sapiens
ttttaaaggcattagagtc

SEQ ID NO: 4516166 - DNA, 9 bp, Homo sapiens
ttttaaagt

SEQ ID NO: 4516167 - DNA, 14 bp, Homo sapiens
ttttaaagtaaact

SEQ ID NO: 4516168 - DNA, 22 bp, Homo sapiens
ttttaaagtaaacttgtgtatt

SEQ ID NO: 4516169 - DNA, 22 bp, Homo sapiens
ttttaaagttcttattttagta

SEQ ID NO: 4516170 - DNA, 15 bp, Homo sapiens
tttttattatgcatt

SEQ ID NO: 4516171 - DNA, 10 bp, Homo sapiens
tttttattca

SEQ ID NO: 4516172 - DNA, 13 bp, Homo sapiens
tttttatttaaaa

SEQ ID NO: 4516173 - DNA, 13 bp, Homo sapiens
tttttatttaaat

SEQ ID NO: 4516174 - DNA, 12 bp, Homo sapiens
tttttatttctt

SEQ ID NO: 4516175 - DNA, 15 bp, Homo sapiens
tttttatttcttcct

SEQ ID NO: 4516176 - DNA, 11 bp, Homo sapiens
tttttcaaaat

SEQ ID NO: 4516177 - DNA, 15 bp, Homo sapiens
tttttcaaaatagaa

SEQ ID NO: 4516178 - DNA, 15 bp, Homo sapiens
tttttcaaagcaatt

SEQ ID NO: 4516179 - DNA, 20 bp, Homo sapiens
tttttcaagataaggagaaa

SEQ ID NO: 4516180 - DNA, 20 bp, Homo sapiens
tttttcaatatattgaactt

SEQ ID NO: 4516181 - DNA, 22 bp, Homo sapiens
tttttcacataaagggaacaaa

SEQ ID NO: 4516182 - DNA, 13 bp, Homo sapiens
tttttcacatttt

SEQ ID NO: 4516183 - DNA, 22 bp, Homo sapiens
tttttcactgcctaaaatttta

SEQ ID NO: 4516184 - DNA, 13 bp, Homo sapiens
tttttcacttcta

SEQ ID NO: 4516185 - DNA, 20 bp, Homo sapiens
tttttcactttgtgtattaa

SEQ ID NO: 4516186 - DNA, 22 bp, Homo sapiens
tttttcagtgatcttcactgta

SEQ ID NO: 4516187 - DNA, 15 bp, Homo sapiens
tttttcagttttcag

SEQ ID NO: 4516188 - DNA, 15 bp, Homo sapiens
tttttcatactgtac

SEQ ID NO: 4516189 - DNA, 16 bp, Homo sapiens
tttttcatgataatga

SEQ ID NO: 4516190 - DNA, 20 bp, Homo sapiens
tttttcattaaataaatttg

SEQ ID NO: 4516191 - DNA, 16 bp, Homo sapiens
tttttcatttgtaaaa

SEQ ID NO: 4516192 - DNA, 15 bp, Homo sapiens
tttttccaatgtttt

SEQ ID NO: 4516193 - DNA, 12 bp, Homo sapiens
tttttccaggct

SEQ ID NO: 4516194 - DNA, 10 bp, Homo sapiens
tttttccagt

SEQ ID NO: 4516195 - DNA, 18 bp, Homo sapiens
tttttcccataagacaat

SEQ ID NO: 4516196 - DNA, 17 bp, Homo sapiens
tttttcctgtcctgccc

SEQ ID NO: 4516197 - DNA, 18 bp, Homo sapiens
tttttccttcaaagttta

SEQ ID NO: 4516198 - DNA, 10 bp, Homo sapiens
tttttccttt

SEQ ID NO: 4516199 - DNA, 21 bp, Homo sapiens
tttttctaaaacattcccctc

SEQ ID NO: 4516200 - DNA, 15 bp, Homo sapiens
tttttctaagagaag

SEQ ID NO: 4516201 - DNA, 22 bp, Homo sapiens
tttttctctataaagggtcagg

SEQ ID NO: 4516202 - DNA, 12 bp, Homo sapiens
tttttctctcct

SEQ ID NO: 4516203 - DNA, 12 bp, Homo sapiens
tttttcttcagc

SEQ ID NO: 4516204 - DNA, 15 bp, Homo sapiens
tttttcttcattgta

SEQ ID NO: 4516205 - DNA, 21 bp, Homo sapiens
tttttctttactttctcccag

SEQ ID NO: 4516206 - DNA, 14 bp, Homo sapiens
tttttctttccaag

SEQ ID NO: 4516207 - DNA, 22 bp, Homo sapiens
tttttgaaaaattgtctttcct

SEQ ID NO: 4516208 - DNA, 18 bp, Homo sapiens
tttttgacactgaaagtt

SEQ ID NO: 4516209 - DNA, 22 bp, Homo sapiens
tttttgacactgaaagttttgt

SEQ ID NO: 4516210 - DNA, 13 bp, Homo sapiens
tttttgaccagtt

SEQ ID NO: 4516211 - DNA, 23 bp, Homo sapiens
tttttgactttttttgtatgtgt

SEQ ID NO: 4516212 - DNA, 13 bp, Homo sapiens
tttttgatactaa

SEQ ID NO: 4516213 - DNA, 12 bp, Homo sapiens
tttttgcaataa

SEQ ID NO: 4516214 - DNA, 13 bp, Homo sapiens
tttttgcatgaaa

SEQ ID NO: 4516215 - DNA, 21 bp, Homo sapiens
tttttgccagttttccctgga

SEQ ID NO: 4516216 - DNA, 14 bp, Homo sapiens
tttttgctgttagt

SEQ ID NO: 4516217 - DNA, 17 bp, Homo sapiens
tttttggaaagtcagaa

SEQ ID NO: 4516218 - DNA, 15 bp, Homo sapiens
tttttgggatgtctt

SEQ ID NO: 4516219 - DNA, 23 bp, Homo sapiens
tttttgggcagcaatttaaatgt

SEQ ID NO: 4516220 - DNA, 12 bp, Homo sapiens
tttttggtacaa

SEQ ID NO: 4516221 - DNA, 18 bp, Homo sapiens
tttttggtggatgtaaat

SEQ ID NO: 4516222 - DNA, 15 bp, Homo sapiens
tttttggtttccaaa

SEQ ID NO: 4516223 - DNA, 14 bp, Homo sapiens
tttttggtttttta

SEQ ID NO: 4516224 - DNA, 16 bp, Homo sapiens
tttttgtaacttcaaa

SEQ ID NO: 4516225 - DNA, 12 bp, Homo sapiens
tttttgtaataa

SEQ ID NO: 4516226 - DNA, 23 bp, Homo sapiens
tttttgtaccattttaaagttag

SEQ ID NO: 4516227 - DNA, 21 bp, Homo sapiens
tttttgtacgttatatattgt

SEQ ID NO: 4516228 - DNA, 11 bp, Homo sapiens
tttttgtagta

SEQ ID NO: 4516229 - DNA, 15 bp, Homo sapiens
tttttgtatattaca

SEQ ID NO: 4516230 - DNA, 12 bp, Homo sapiens
tttttgtatgtg

SEQ ID NO: 4516231 - DNA, 14 bp, Homo sapiens
tttttgtatgtgtg

SEQ ID NO: 4516232 - DNA, 16 bp, Homo sapiens
tttttgtttggtataa

SEQ ID NO: 4516233 - DNA, 14 bp, Homo sapiens
tttttgttttgaaa

SEQ ID NO: 4516234 - DNA, 17 bp, Homo sapiens
tttttgttttgaaagtt

SEQ ID NO: 4516235 - DNA, 9 bp, Homo sapiens
ttttttaaa

SEQ ID NO: 4516236 - DNA, 18 bp, Homo sapiens
ttttttaatgtgctctgt

SEQ ID NO: 4516237 - DNA, 12 bp, Homo sapiens
ttttttacattt

SEQ ID NO: 4516238 - DNA, 12 bp, Homo sapiens
ttttttacttga

SEQ ID NO: 4516239 - DNA, 12 bp, Homo sapiens
ttttttcaatat

SEQ ID NO: 4516240 - DNA, 12 bp, Homo sapiens
ttttttccaaaa

SEQ ID NO: 4516241 - DNA, 22 bp, Homo sapiens
ttttttccatctttacaaaact

SEQ ID NO: 4516242 - DNA, 10 bp, Homo sapiens
ttttttcctt

SEQ ID NO: 4516243 - DNA, 13 bp, Homo sapiens
ttttttcgtttgt

SEQ ID NO: 4516244 - DNA, 20 bp, Homo sapiens
ttttttggtggtgaaattga

SEQ ID NO: 4516245 - DNA, 13 bp, Homo sapiens
ttttttgtaactt

SEQ ID NO: 4516246 - DNA, 12 bp, Homo sapiens
ttttttgttatt

SEQ ID NO: 4516247 - DNA, 13 bp, Homo sapiens
ttttttgtttcat

SEQ ID NO: 4516248 - DNA, 16 bp, Homo sapiens
ttttttgtttgtttct

SEQ ID NO: 4516249 - DNA, 16 bp, Homo sapiens
ttttttgtttgtttgt

SEQ ID NO: 4516250 - DNA, 12 bp, Homo sapiens
tttttttacatt

SEQ ID NO: 4516251 - DNA, 10 bp, Homo sapiens
tttttttccg

SEQ ID NO: 4516252 - DNA, 13 bp, Homo sapiens
tttttttcctttt

SEQ ID NO: 4516253 - DNA, 13 bp, Homo sapiens
tttttttctaaaa

SEQ ID NO: 4516254 - DNA, 14 bp, Homo sapiens
tttttttctaagag

SEQ ID NO: 4516255 - DNA, 12 bp, Homo sapiens
tttttttcttta

SEQ ID NO: 4516256 - DNA, 14 bp, Homo sapiens
tttttttgttatta

SEQ ID NO: 4516257 - DNA, 11 bp, Homo sapiens
ttttgaagtgt

SEQ ID NO: 4516258 - DNA, 16 bp, Homo sapiens
ttttgaattgttacat

SEQ ID NO: 4516259 - DNA, 12 bp, Homo sapiens
ttttgacactga

SEQ ID NO: 4516260 - DNA, 20 bp, Homo sapiens
ttttgacagactatttgcta

SEQ ID NO: 4516261 - DNA, 23 bp, Homo sapiens
ttttgacagactatttgctaatg

SEQ ID NO: 4516262 - DNA, 22 bp, Homo sapiens
ttttgagattttttttccgtgt

SEQ ID NO: 4516263 - DNA, 19 bp, Homo sapiens
ttttgagtcattgacttca

SEQ ID NO: 4516264 - DNA, 13 bp, Homo sapiens
ttttgataactgt

SEQ ID NO: 4516265 - DNA, 20 bp, Homo sapiens
ttttgataataatattgttt

SEQ ID NO: 4516266 - DNA, 17 bp, Homo sapiens
ttttgatagatgataat

SEQ ID NO: 4516267 - DNA, 20 bp, Homo sapiens
ttttgatataattgtactgt

SEQ ID NO: 4516268 - DNA, 14 bp, Homo sapiens
ttttgatctgcttt

SEQ ID NO: 4516269 - DNA, 21 bp, Homo sapiens
ttttgatgcagcatttgataa

SEQ ID NO: 4516270 - DNA, 17 bp, Homo sapiens
ttttgatgtatatatct

SEQ ID NO: 4516271 - DNA, 14 bp, Homo sapiens
ttttgatgtctcca

SEQ ID NO: 4516272 - DNA, 15 bp, Homo sapiens
ttttgatgtttgtgg

SEQ ID NO: 4516273 - DNA, 22 bp, Homo sapiens
ttttgatgtttgtggcctcaga

SEQ ID NO: 4516274 - DNA, 19 bp, Homo sapiens
ttttgcaaattatattttg

SEQ ID NO: 4516275 - DNA, 17 bp, Homo sapiens
ttttgcaacctcgctgg

SEQ ID NO: 4516276 - DNA, 17 bp, Homo sapiens
ttttgcaataatgcagt

SEQ ID NO: 4516277 - DNA, 18 bp, Homo sapiens
ttttgcaataatgcagta

SEQ ID NO: 4516278 - DNA, 10 bp, Homo sapiens
ttttgcacaa

SEQ ID NO: 4516279 - DNA, 18 bp, Homo sapiens
ttttgcatttaaaacaga

SEQ ID NO: 4516280 - DNA, 19 bp, Homo sapiens
ttttgccagttttccctgg

SEQ ID NO: 4516281 - DNA, 15 bp, Homo sapiens
ttttgccttttgcaa

SEQ ID NO: 4516282 - DNA, 14 bp, Homo sapiens
ttttgctgaattcc

SEQ ID NO: 4516283 - DNA, 15 bp, Homo sapiens
ttttgcttgcaatgt

SEQ ID NO: 4516284 - DNA, 17 bp, Homo sapiens
ttttggaaagtcagaat

SEQ ID NO: 4516285 - DNA, 22 bp, Homo sapiens
ttttggaagagacaaagatttc

SEQ ID NO: 4516286 - DNA, 23 bp, Homo sapiens
ttttggaagagacaaagatttct

SEQ ID NO: 4516287 - DNA, 19 bp, Homo sapiens
ttttggactctctgtggtc

SEQ ID NO: 4516288 - DNA, 18 bp, Homo sapiens
ttttggattgtcaaagag

SEQ ID NO: 4516289 - DNA, 22 bp, Homo sapiens
ttttggcattatctctttctct

SEQ ID NO: 4516290 - DNA, 22 bp, Homo sapiens
ttttggggattttcaaaagata

SEQ ID NO: 4516291 - DNA, 19 bp, Homo sapiens
ttttgggggtttttaatct

SEQ ID NO: 4516292 - DNA, 17 bp, Homo sapiens
ttttggtagagaaggag

SEQ ID NO: 4516293 - DNA, 18 bp, Homo sapiens
ttttggtggatgtaaata

SEQ ID NO: 4516294 - DNA, 16 bp, Homo sapiens
ttttggtggtgaaatt

SEQ ID NO: 4516295 - DNA, 17 bp, Homo sapiens
ttttggttatggagtct

SEQ ID NO: 4516296 - DNA, 16 bp, Homo sapiens
ttttggttttgttccc

SEQ ID NO: 4516297 - DNA, 14 bp, Homo sapiens
ttttggtttttcct

SEQ ID NO: 4516298 - DNA, 17 bp, Homo sapiens
ttttggtttttcctcat

SEQ ID NO: 4516299 - DNA, 12 bp, Homo sapiens
ttttgtaaaaga

SEQ ID NO: 4516300 - DNA, 13 bp, Homo sapiens
ttttgtaaaatat

SEQ ID NO: 4516301 - DNA, 14 bp, Homo sapiens
ttttgtaaggggaa

SEQ ID NO: 4516302 - DNA, 19 bp, Homo sapiens
ttttgtaagttgaagcaaa

SEQ ID NO: 4516303 - DNA, 13 bp, Homo sapiens
ttttgtaatgaat

SEQ ID NO: 4516304 - DNA, 20 bp, Homo sapiens
ttttgtacatttttcagcag

SEQ ID NO: 4516305 - DNA, 14 bp, Homo sapiens
ttttgtaccagtga

SEQ ID NO: 4516306 - DNA, 20 bp, Homo sapiens
ttttgtacgttatatattgt

SEQ ID NO: 4516307 - DNA, 23 bp, Homo sapiens
ttttgtataattggatttcctaa

SEQ ID NO: 4516308 - DNA, 13 bp, Homo sapiens
ttttgtattttaa

SEQ ID NO: 4516309 - DNA, 13 bp, Homo sapiens
ttttgtcttgtgt

SEQ ID NO: 4516310 - DNA, 13 bp, Homo sapiens
ttttgtgatgaac

SEQ ID NO: 4516311 - DNA, 17 bp, Homo sapiens
ttttgtggtttggaata

SEQ ID NO: 4516312 - DNA, 16 bp, Homo sapiens
ttttgtgtaggtgtct

SEQ ID NO: 4516313 - DNA, 16 bp, Homo sapiens
ttttgtgtttgttgta

SEQ ID NO: 4516314 - DNA, 13 bp, Homo sapiens
ttttgttaacagt

SEQ ID NO: 4516315 - DNA, 16 bp, Homo sapiens
ttttgttaatgcattg

SEQ ID NO: 4516316 - DNA, 21 bp, Homo sapiens
ttttgttccacattctctctc

SEQ ID NO: 4516317 - DNA, 19 bp, Homo sapiens
ttttgttcccctcctccac

SEQ ID NO: 4516318 - DNA, 13 bp, Homo sapiens
ttttgttccctat

SEQ ID NO: 4516319 - DNA, 23 bp, Homo sapiens
ttttgttcgcatggtcacacact

SEQ ID NO: 4516320 - DNA, 14 bp, Homo sapiens
ttttgttctagact

SEQ ID NO: 4516321 - DNA, 21 bp, Homo sapiens
ttttgttggcatagctctggg

SEQ ID NO: 4516322 - DNA, 21 bp, Homo sapiens
ttttgttgtttcttaaataag

SEQ ID NO: 4516323 - DNA, 17 bp, Homo sapiens
ttttgtttataaaaaac

SEQ ID NO: 4516324 - DNA, 19 bp, Homo sapiens
ttttgtttcatattgatgt

SEQ ID NO: 4516325 - DNA, 20 bp, Homo sapiens
ttttgtttgatgcaggcact

SEQ ID NO: 4516326 - DNA, 13 bp, Homo sapiens
ttttgtttggtta

SEQ ID NO: 4516327 - DNA, 21 bp, Homo sapiens
ttttgtttgtttctttgtgtt

SEQ ID NO: 4516328 - DNA, 16 bp, Homo sapiens
ttttgttttaaggaaa

SEQ ID NO: 4516329 - DNA, 15 bp, Homo sapiens
ttttgttttcattat

SEQ ID NO: 4516330 - DNA, 15 bp, Homo sapiens
ttttgttttgttgga

SEQ ID NO: 4516331 - DNA, 22 bp, Homo sapiens
tttttaaaaaagacatttaaag

SEQ ID NO: 4516332 - DNA, 22 bp, Homo sapiens
tttttaaaaaagcttaaaactt

SEQ ID NO: 4516333 - DNA, 23 bp, Homo sapiens
tttttaaaaaagcttaaaacttt

SEQ ID NO: 4516334 - DNA, 19 bp, Homo sapiens
tttttaaaaaatattttct

SEQ ID NO: 4516335 - DNA, 20 bp, Homo sapiens
tttttaaaagagacaaactg

SEQ ID NO: 4516336 - DNA, 16 bp, Homo sapiens
tttttaaaataaaata

SEQ ID NO: 4516337 - DNA, 13 bp, Homo sapiens
tttttaaaatact

SEQ ID NO: 4516338 - DNA, 13 bp, Homo sapiens
tttttaaaatcca

SEQ ID NO: 4516339 - DNA, 19 bp, Homo sapiens
tttttaaaatccagacttt

SEQ ID NO: 4516340 - DNA, 12 bp, Homo sapiens
tttttaaacttg

SEQ ID NO: 4516341 - DNA, 17 bp, Homo sapiens
tttttaaacttgtaaag

SEQ ID NO: 4516342 - DNA, 12 bp, Homo sapiens
tttttaaagtaa

SEQ ID NO: 4516343 - DNA, 17 bp, Homo sapiens
tttttaaagtaaattat

SEQ ID NO: 4516344 - DNA, 19 bp, Homo sapiens
tttttaaataaaagcacaa

SEQ ID NO: 4516345 - DNA, 23 bp, Homo sapiens
tttttaaatgtatactatagtac

SEQ ID NO: 4516346 - DNA, 12 bp, Homo sapiens
tttttaaatttg

SEQ ID NO: 4516347 - DNA, 23 bp, Homo sapiens
tttttaaccaacagaacccacag

SEQ ID NO: 4516348 - DNA, 12 bp, Homo sapiens
tttttaactgat

SEQ ID NO: 4516349 - DNA, 23 bp, Homo sapiens
tttttaactgattcttatgatta

SEQ ID NO: 4516350 - DNA, 11 bp, Homo sapiens
tttttaagata

SEQ ID NO: 4516351 - DNA, 22 bp, Homo sapiens
tttttaagttgtcaaagaagct

SEQ ID NO: 4516352 - DNA, 19 bp, Homo sapiens
tttttaagttgtctgtctg

SEQ ID NO: 4516353 - DNA, 15 bp, Homo sapiens
tttttaataaactac

SEQ ID NO: 4516354 - DNA, 16 bp, Homo sapiens
tttttaatagcactaa

SEQ ID NO: 4516355 - DNA, 22 bp, Homo sapiens
tttttaatcgtttttgttttaa

SEQ ID NO: 4516356 - DNA, 13 bp, Homo sapiens
tttttaatgatat

SEQ ID NO: 4516357 - DNA, 10 bp, Homo sapiens
tttttaatgg

SEQ ID NO: 4516358 - DNA, 19 bp, Homo sapiens
tttttaatggcagcagaaa

SEQ ID NO: 4516359 - DNA, 15 bp, Homo sapiens
tttttaatgtgctct

SEQ ID NO: 4516360 - DNA, 11 bp, Homo sapiens
tttttaatttc

SEQ ID NO: 4516361 - DNA, 12 bp, Homo sapiens
tttttacagaaa

SEQ ID NO: 4516362 - DNA, 12 bp, Homo sapiens
tttttactgaat

SEQ ID NO: 4516363 - DNA, 14 bp, Homo sapiens
tttttactgtatgt

SEQ ID NO: 4516364 - DNA, 20 bp, Homo sapiens
tttttagattgagaaatgtg

SEQ ID NO: 4516365 - DNA, 16 bp, Homo sapiens
tttttaggcaaagata

SEQ ID NO: 4516366 - DNA, 12 bp, Homo sapiens
tttttagtttgt

SEQ ID NO: 4516367 - DNA, 18 bp, Homo sapiens
tttttataaaatggctgt

SEQ ID NO: 4516368 - DNA, 23 bp, Homo sapiens
tttttataacatctttattgaaa

SEQ ID NO: 4516369 - DNA, 14 bp, Homo sapiens
tttttatactttat

SEQ ID NO: 4516370 - DNA, 18 bp, Homo sapiens
tttttatagcaacaacaa

SEQ ID NO: 4516371 - DNA, 16 bp, Homo sapiens
tttttatagttattaa

SEQ ID NO: 4516372 - DNA, 13 bp, Homo sapiens
tttttatatatta

SEQ ID NO: 4516373 - DNA, 21 bp, Homo sapiens
tttttatatcatgcaaaatat

SEQ ID NO: 4516374 - DNA, 15 bp, Homo sapiens
tttttatatttcctt

SEQ ID NO: 4516375 - DNA, 14 bp, Homo sapiens
tttttatctttata

SEQ ID NO: 4516376 - DNA, 14 bp, Homo sapiens
tttttatcttttta

SEQ ID NO: 4516377 - DNA, 14 bp, Homo sapiens
tttttattatgcat

SEQ ID NO: 4516378 - DNA, 19 bp, Homo sapiens
ctggttgcctcccccgcct

SEQ ID NO: 4516379 - DNA, 23 bp, Homo sapiens
ctggttggagagctagaacctgg

SEQ ID NO: 4516380 - DNA, 18 bp, Homo sapiens
ctggttgtgggcactggc

SEQ ID NO: 4516381 - DNA, 19 bp, Homo sapiens
ctggtttaattcagcagag

SEQ ID NO: 4516382 - DNA, 12 bp, Homo sapiens
ctggtttcttcc

SEQ ID NO: 4516383 - DNA, 13 bp, Homo sapiens
ctggtttgcaaga

SEQ ID NO: 4516384 - DNA, 15 bp, Homo sapiens
ctggtttgcaagaat

SEQ ID NO: 4516385 - DNA, 17 bp, Homo sapiens
ctggtttgcaagaatga

SEQ ID NO: 4516386 - DNA, 21 bp, Homo sapiens
ctggtttgtttctcaagcgct

SEQ ID NO: 4516387 - DNA, 16 bp, Homo sapiens
ctggttttatttatat

SEQ ID NO: 4516388 - DNA, 14 bp, Homo sapiens
ctggttttgcttcc

SEQ ID NO: 4516389 - DNA, 15 bp, Homo sapiens
ctggttttgcttccc

SEQ ID NO: 4516390 - DNA, 16 bp, Homo sapiens
ctggtttttcagtttt

SEQ ID NO: 4516391 - DNA, 12 bp, Homo sapiens
ctgtaaagatgt

SEQ ID NO: 4516392 - DNA, 13 bp, Homo sapiens
ctgtaaatatatc

SEQ ID NO: 4516393 - DNA, 14 bp, Homo sapiens
ctgtaaatatccct

SEQ ID NO: 4516394 - DNA, 14 bp, Homo sapiens
ctgtaaatctacac

SEQ ID NO: 4516395 - DNA, 17 bp, Homo sapiens
ctgtaaattgcagaatt

SEQ ID NO: 4516396 - DNA, 22 bp, Homo sapiens
ctgtaacaagttccattatgaa

SEQ ID NO: 4516397 - DNA, 15 bp, Homo sapiens
ctgtaacctcttcag

SEQ ID NO: 4516398 - DNA, 18 bp, Homo sapiens
ctgtaagaataatttata

SEQ ID NO: 4516399 - DNA, 19 bp, Homo sapiens
ctgtaagaataatttatag

SEQ ID NO: 4516400 - DNA, 20 bp, Homo sapiens
ctgtaatacgtagctctctt

SEQ ID NO: 4516401 - DNA, 21 bp, Homo sapiens
ctgtaatatttacaatgtatt

SEQ ID NO: 4516402 - DNA, 22 bp, Homo sapiens
ctgtaatatttacaatgtatta

SEQ ID NO: 4516403 - DNA, 15 bp, Homo sapiens
ctgtaatcaaaagga

SEQ ID NO: 4516404 - DNA, 18 bp, Homo sapiens
ctgtaatcatttgtttac

SEQ ID NO: 4516405 - DNA, 16 bp, Homo sapiens
ctgtaatcccagaact

SEQ ID NO: 4516406 - DNA, 13 bp, Homo sapiens
ctgtaatcccagc

SEQ ID NO: 4516407 - DNA, 18 bp, Homo sapiens
ctgtaatcccagcacttt

SEQ ID NO: 4516408 - DNA, 19 bp, Homo sapiens
ctgtaatcccagctactca

SEQ ID NO: 4516409 - DNA, 17 bp, Homo sapiens
ctgtaatgtaaataaac

SEQ ID NO: 4516410 - DNA, 15 bp, Homo sapiens
ctgtaattcaggttt

SEQ ID NO: 4516411 - DNA, 18 bp, Homo sapiens
ctgtaatttcagctagtt

SEQ ID NO: 4516412 - DNA, 20 bp, Homo sapiens
ctgtacaaataatagcaatg

SEQ ID NO: 4516413 - DNA, 19 bp, Homo sapiens
ctgtacaaatgacactgca

SEQ ID NO: 4516414 - DNA, 18 bp, Homo sapiens
ctgtacacacccgcctga

SEQ ID NO: 4516415 - DNA, 21 bp, Homo sapiens
ctgtacacacccgcctgacac

SEQ ID NO: 4516416 - DNA, 15 bp, Homo sapiens
ctgtacacactttat

SEQ ID NO: 4516417 - DNA, 12 bp, Homo sapiens
ctgtacacattt

SEQ ID NO: 4516418 - DNA, 17 bp, Homo sapiens
ctgtacagcaagatgtt

SEQ ID NO: 4516419 - DNA, 11 bp, Homo sapiens
ctgtacagggg

SEQ ID NO: 4516420 - DNA, 17 bp, Homo sapiens
ctgtacattgtgagctc

SEQ ID NO: 4516421 - DNA, 19 bp, Homo sapiens
ctgtacattgtgagctctg

SEQ ID NO: 4516422 - DNA, 17 bp, Homo sapiens
ctgtacatttgcaatta

SEQ ID NO: 4516423 - DNA, 16 bp, Homo sapiens
ctgtaccagttaattt

SEQ ID NO: 4516424 - DNA, 23 bp, Homo sapiens
ctgtacctcagtggatcttcaga

SEQ ID NO: 4516425 - DNA, 17 bp, Homo sapiens
ctgtactaaggagcatg

SEQ ID NO: 4516426 - DNA, 17 bp, Homo sapiens
ctgtacttcttgaatat

SEQ ID NO: 4516427 - DNA, 13 bp, Homo sapiens
ctgtactttgtgt

SEQ ID NO: 4516428 - DNA, 23 bp, Homo sapiens
ctgtagaaaaaaaaattcacatg

SEQ ID NO: 4516429 - DNA, 19 bp, Homo sapiens
ctgtagaaaggggagaatg

SEQ ID NO: 4516430 - DNA, 16 bp, Homo sapiens
ctgtagaatcaattta

SEQ ID NO: 4516431 - DNA, 14 bp, Homo sapiens
ctgtagacatctgt

SEQ ID NO: 4516432 - DNA, 17 bp, Homo sapiens
ctgtagacatctgtcct

SEQ ID NO: 4516433 - DNA, 21 bp, Homo sapiens
ctgtagcaaatttgtttaatc

SEQ ID NO: 4516434 - DNA, 22 bp, Homo sapiens
ctgtagcaatggccagagcctc

SEQ ID NO: 4516435 - DNA, 23 bp, Homo sapiens
ctgtagcaatggccagagcctct

SEQ ID NO: 4516436 - DNA, 24 bp, Homo sapiens
ctgtagcaatggccagagcctctg

SEQ ID NO: 4516437 - DNA, 15 bp, Homo sapiens
ctgtagccacagctg

SEQ ID NO: 4516438 - DNA, 18 bp, Homo sapiens
ctgtagccacagctgctg

SEQ ID NO: 4516439 - DNA, 23 bp, Homo sapiens
ctgtagccacagctgctgttctc

SEQ ID NO: 4516440 - DNA, 21 bp, Homo sapiens
ctgtagcctatttttttagat

SEQ ID NO: 4516441 - DNA, 15 bp, Homo sapiens
ctgtagcctcagatg

SEQ ID NO: 4516442 - DNA, 22 bp, Homo sapiens
ctgtagcttatctgcccctccc

SEQ ID NO: 4516443 - DNA, 14 bp, Homo sapiens
ctgtaggaaaccca

SEQ ID NO: 4516444 - DNA, 22 bp, Homo sapiens
ctgtaggctaaaaggcttccag

SEQ ID NO: 4516445 - DNA, 21 bp, Homo sapiens
ctgtagggtttggacagaccc

SEQ ID NO: 4516446 - DNA, 22 bp, Homo sapiens
ctgtagtaaaatgttttcattt

SEQ ID NO: 4516447 - DNA, 18 bp, Homo sapiens
ctgtagtgatggagttcc

SEQ ID NO: 4516448 - DNA, 20 bp, Homo sapiens
ctgtagtgatggagttcctt

SEQ ID NO: 4516449 - DNA, 18 bp, Homo sapiens
ctgtagttcaatttcatg

SEQ ID NO: 4516450 - DNA, 13 bp, Homo sapiens
ctgtagtttatgg

SEQ ID NO: 4516451 - DNA, 21 bp, Homo sapiens
ctgtagtttatggcagaaggg

SEQ ID NO: 4516452 - DNA, 17 bp, Homo sapiens
ctgtagttttattttat

SEQ ID NO: 4516453 - DNA, 19 bp, Homo sapiens
ctgtagttttccctgcact

SEQ ID NO: 4516454 - DNA, 15 bp, Homo sapiens
ctgtataaagcatgt

SEQ ID NO: 4516455 - DNA, 21 bp, Homo sapiens
ctgtataatactttgtataca

SEQ ID NO: 4516456 - DNA, 19 bp, Homo sapiens
ctgtataatctatttacat

SEQ ID NO: 4516457 - DNA, 21 bp, Homo sapiens
ctgtatacagtgcagagcctt

SEQ ID NO: 4516458 - DNA, 16 bp, Homo sapiens
ctgtatactcctgtca

SEQ ID NO: 4516459 - DNA, 15 bp, Homo sapiens
ctgtatactcttgaa

SEQ ID NO: 4516460 - DNA, 20 bp, Homo sapiens
ctgtatagctgcttccagtg

SEQ ID NO: 4516461 - DNA, 14 bp, Homo sapiens
ctgtatataaacat

SEQ ID NO: 4516462 - DNA, 13 bp, Homo sapiens
ctgtatatgtaaa

SEQ ID NO: 4516463 - DNA, 15 bp, Homo sapiens
ctgtatatgtaaatt

SEQ ID NO: 4516464 - DNA, 13 bp, Homo sapiens
ctgtatatttctt

SEQ ID NO: 4516465 - DNA, 14 bp, Homo sapiens
ctgtatatttcttt

SEQ ID NO: 4516466 - DNA, 15 bp, Homo sapiens
ctgtatcaatttcta

SEQ ID NO: 4516467 - DNA, 18 bp, Homo sapiens
ctgtatcaatttctaatg

SEQ ID NO: 4516468 - DNA, 22 bp, Homo sapiens
ctgtatcaatttctaatgttta

SEQ ID NO: 4516469 - DNA, 16 bp, Homo sapiens
ctgtatcatctttgcc

SEQ ID NO: 4516470 - DNA, 16 bp, Homo sapiens
ctgtatctaggcattt

SEQ ID NO: 4516471 - DNA, 20 bp, Homo sapiens
ctgtatgtctcgtggtagga

SEQ ID NO: 4516472 - DNA, 13 bp, Homo sapiens
ctgtattgccctt

SEQ ID NO: 4516473 - DNA, 14 bp, Homo sapiens
ctgtatttaagcaa

SEQ ID NO: 4516474 - DNA, 15 bp, Homo sapiens
ctgtatttaagcaaa

SEQ ID NO: 4516475 - DNA, 16 bp, Homo sapiens
ctgtatttaagcaaat

SEQ ID NO: 4516476 - DNA, 23 bp, Homo sapiens
ctgtatttaattataaaaaatta

SEQ ID NO: 4516477 - DNA, 19 bp, Homo sapiens
ctgtatttcagtattttcc

SEQ ID NO: 4516478 - DNA, 17 bp, Homo sapiens
ctgtatttctttgtaga

SEQ ID NO: 4516479 - DNA, 14 bp, Homo sapiens
ctgtattttaatgt

SEQ ID NO: 4516480 - DNA, 23 bp, Homo sapiens
ctgtattttatttagacaagaga

SEQ ID NO: 4516481 - DNA, 12 bp, Homo sapiens
ctgtattttgat

SEQ ID NO: 4516482 - DNA, 21 bp, Homo sapiens
ctgtatttttacagctacttt

SEQ ID NO: 4516483 - DNA, 21 bp, Homo sapiens
ctgtatttttttttctaagag

SEQ ID NO: 4516484 - DNA, 20 bp, Homo sapiens
ctgtcaaaaattttgaatgt

SEQ ID NO: 4516485 - DNA, 19 bp, Homo sapiens
ctgtcaagagtagttatat

SEQ ID NO: 4516486 - DNA, 13 bp, Homo sapiens
ctgtcaagctggt

SEQ ID NO: 4516487 - DNA, 21 bp, Homo sapiens
ctgtcaagtgggatctgtcac

SEQ ID NO: 4516488 - DNA, 19 bp, Homo sapiens
ctgtcaagttcctttgggt

SEQ ID NO: 4516489 - DNA, 16 bp, Homo sapiens
ctgtcaagttgtacat

SEQ ID NO: 4516490 - DNA, 11 bp, Homo sapiens
ctgtcacaata

SEQ ID NO: 4516491 - DNA, 13 bp, Homo sapiens
ctgtcacaataaa

SEQ ID NO: 4516492 - DNA, 12 bp, Homo sapiens
ctgtcacaggca

SEQ ID NO: 4516493 - DNA, 14 bp, Homo sapiens
ctgtcacaggcata

SEQ ID NO: 4516494 - DNA, 22 bp, Homo sapiens
ctgtcacagtaaaaataaaata

SEQ ID NO: 4516495 - DNA, 18 bp, Homo sapiens
ctgtcacctagaacgtgc

SEQ ID NO: 4516496 - DNA, 18 bp, Homo sapiens
ctgtcacctctcagctgc

SEQ ID NO: 4516497 - DNA, 19 bp, Homo sapiens
ctgtcacctctcagctgct

SEQ ID NO: 4516498 - DNA, 20 bp, Homo sapiens
ctgtcacctctcagctgctg

SEQ ID NO: 4516499 - DNA, 21 bp, Homo sapiens
ctgtcacctctcagctgctgg

SEQ ID NO: 4516500 - DNA, 22 bp, Homo sapiens
ctgtcacggggttccctcctag

SEQ ID NO: 4516501 - DNA, 11 bp, Homo sapiens
ctgtcactgtt

SEQ ID NO: 4516502 - DNA, 21 bp, Homo sapiens
ctgtcactgttggacgtcagc

SEQ ID NO: 4516503 - DNA, 17 bp, Homo sapiens
ctgtcagattaaattac

SEQ ID NO: 4516504 - DNA, 21 bp, Homo sapiens
ctgtcagattaaattacagct

SEQ ID NO: 4516505 - DNA, 19 bp, Homo sapiens
ctgtcagccagccgccctg

SEQ ID NO: 4516506 - DNA, 14 bp, Homo sapiens
ctgtcagtaaaact

SEQ ID NO: 4516507 - DNA, 15 bp, Homo sapiens
ctgtcagtggggcag

SEQ ID NO: 4516508 - DNA, 22 bp, Homo sapiens
ctgtcagtggggcagcctctcc

SEQ ID NO: 4516509 - DNA, 20 bp, Homo sapiens
ctgtcagtgtacacgtctgg

SEQ ID NO: 4516510 - DNA, 19 bp, Homo sapiens
ctgtcagtgtttgtatttg

SEQ ID NO: 4516511 - DNA, 23 bp, Homo sapiens
ctgtcatcctcaaagaaagtgta

SEQ ID NO: 4516512 - DNA, 13 bp, Homo sapiens
ctgtcatctctct

SEQ ID NO: 4516513 - DNA, 17 bp, Homo sapiens
ctgtcatctctctgggg

SEQ ID NO: 4516514 - DNA, 19 bp, Homo sapiens
ctgtcatgaacatgttcct

SEQ ID NO: 4516515 - DNA, 14 bp, Homo sapiens
ctgtcatggtcctt

SEQ ID NO: 4516516 - DNA, 19 bp, Homo sapiens
ctgtcatggtcctttctgg

SEQ ID NO: 4516517 - DNA, 17 bp, Homo sapiens
ctgtcattatattctaa

SEQ ID NO: 4516518 - DNA, 19 bp, Homo sapiens
ctgtcattatattctaatt

SEQ ID NO: 4516519 - DNA, 20 bp, Homo sapiens
ctgtcattatattctaatta

SEQ ID NO: 4516520 - DNA, 23 bp, Homo sapiens
ctgtcattatattctaattaaaa

SEQ ID NO: 4516521 - DNA, 15 bp, Homo sapiens
ctgtcatttgaacct

SEQ ID NO: 4516522 - DNA, 20 bp, Homo sapiens
ctgtccaaaagcgccctcac

SEQ ID NO: 4516523 - DNA, 21 bp, Homo sapiens
ctgtccaaaagcgccctcact

SEQ ID NO: 4516524 - DNA, 22 bp, Homo sapiens
ctgtccaaaagcgccctcacta

SEQ ID NO: 4516525 - DNA, 21 bp, Homo sapiens
ctgtccaaaggaggctggcag

SEQ ID NO: 4516526 - DNA, 16 bp, Homo sapiens
ctgtccaacctaaccc

SEQ ID NO: 4516527 - DNA, 20 bp, Homo sapiens
ctgtccaacctaaccccttt

SEQ ID NO: 4516528 - DNA, 13 bp, Homo sapiens
ctgtccaccctgc

SEQ ID NO: 4516529 - DNA, 16 bp, Homo sapiens
ctgtccaccctgccaa

SEQ ID NO: 4516530 - DNA, 23 bp, Homo sapiens
ctgtccaccctgccaagactcct

SEQ ID NO: 4516531 - DNA, 13 bp, Homo sapiens
ctgtccagacagc

SEQ ID NO: 4516532 - DNA, 13 bp, Homo sapiens
ctgtccagcctgg

SEQ ID NO: 4516533 - DNA, 15 bp, Homo sapiens
ctgtccagcctgggc

SEQ ID NO: 4516534 - DNA, 17 bp, Homo sapiens
ctgtccagcctgggcag

SEQ ID NO: 4516535 - DNA, 20 bp, Homo sapiens
ctgtccagctggggccagag

SEQ ID NO: 4516536 - DNA, 21 bp, Homo sapiens
ctgtccagctggggccagagg

SEQ ID NO: 4516537 - DNA, 19 bp, Homo sapiens
ctgtccaggcactgagata

SEQ ID NO: 4516538 - DNA, 16 bp, Homo sapiens
ctgtccagggaaacag

SEQ ID NO: 4516539 - DNA, 14 bp, Homo sapiens
ctgtccatgcttct

SEQ ID NO: 4516540 - DNA, 16 bp, Homo sapiens
ctgtccatgcttctca

SEQ ID NO: 4516541 - DNA, 20 bp, Homo sapiens
ctgtcccaattctgcccgct

SEQ ID NO: 4516542 - DNA, 22 bp, Homo sapiens
ctgtcccagccccggcaagcca

SEQ ID NO: 4516543 - DNA, 18 bp, Homo sapiens
ctgtcccaggccggccca

SEQ ID NO: 4516544 - DNA, 13 bp, Homo sapiens
ctgtcccagttgt

SEQ ID NO: 4516545 - DNA, 21 bp, Homo sapiens
ctgtcccatctggtcatttgg

SEQ ID NO: 4516546 - DNA, 22 bp, Homo sapiens
ctgtcccattctagatcctgca

SEQ ID NO: 4516547 - DNA, 19 bp, Homo sapiens
ctgtccccaaacaggacag

SEQ ID NO: 4516548 - DNA, 22 bp, Homo sapiens
ctgtccccaaacaggacagcac

SEQ ID NO: 4516549 - DNA, 13 bp, Homo sapiens
ctgtccccaaagg

SEQ ID NO: 4516550 - DNA, 16 bp, Homo sapiens
ctgtccccactgcccc

SEQ ID NO: 4516551 - DNA, 14 bp, Homo sapiens
ctgtcccccaggct

SEQ ID NO: 4516552 - DNA, 17 bp, Homo sapiens
ctgtcccccaggctgga

SEQ ID NO: 4516553 - DNA, 23 bp, Homo sapiens
ctgtccccttctctcatctctta

SEQ ID NO: 4516554 - DNA, 17 bp, Homo sapiens
ctgtccctctagtgcct

SEQ ID NO: 4516555 - DNA, 15 bp, Homo sapiens
ctgtccctgaaacct

SEQ ID NO: 4516556 - DNA, 12 bp, Homo sapiens
ctgtccctgagg

SEQ ID NO: 4516557 - DNA, 13 bp, Homo sapiens
ctgtccctgggag

SEQ ID NO: 4516558 - DNA, 22 bp, Homo sapiens
ctgtccctgggagtgttcccgt

SEQ ID NO: 4516559 - DNA, 24 bp, Homo sapiens
ctgtccctgggagtgttcccgtgc

SEQ ID NO: 4516560 - DNA, 15 bp, Homo sapiens
ctgtccctgtcacca

SEQ ID NO: 4516561 - DNA, 12 bp, Homo sapiens
ctgtccctgtgg

SEQ ID NO: 4516562 - DNA, 16 bp, Homo sapiens
ctgtcccttgcctctg

SEQ ID NO: 4516563 - DNA, 18 bp, Homo sapiens
ctgtccggcccagtgcca

SEQ ID NO: 4516564 - DNA, 20 bp, Homo sapiens
ctgtccggcccagtgccact

SEQ ID NO: 4516565 - DNA, 17 bp, Homo sapiens
ctgtcctaaggaacctt

SEQ ID NO: 4516566 - DNA, 17 bp, Homo sapiens
ctgtcctaccatcagct

SEQ ID NO: 4516567 - DNA, 20 bp, Homo sapiens
ctgtcctaccatcagctctg

SEQ ID NO: 4516568 - DNA, 14 bp, Homo sapiens
ctgtcctcctggtg

SEQ ID NO: 4516569 - DNA, 13 bp, Homo sapiens
ctgtcctctcgag

SEQ ID NO: 4516570 - DNA, 19 bp, Homo sapiens
ctgtcctctcgagcccaga

SEQ ID NO: 4516571 - DNA, 20 bp, Homo sapiens
ctgtcctgttgattaatttc

SEQ ID NO: 4516572 - DNA, 21 bp, Homo sapiens
ctgtccttccattttcattct

SEQ ID NO: 4516573 - DNA, 22 bp, Homo sapiens
ctgtccttccctgttctccctt

SEQ ID NO: 4516574 - DNA, 15 bp, Homo sapiens
ctgtcgcccaggctg

SEQ ID NO: 4516575 - DNA, 13 bp, Homo sapiens
ctgtcgccccagg

SEQ ID NO: 4516576 - DNA, 17 bp, Homo sapiens
ctgtcgccccaggccct

SEQ ID NO: 4516577 - DNA, 18 bp, Homo sapiens
ctgtcgccccaggccctc

SEQ ID NO: 4516578 - DNA, 20 bp, Homo sapiens
ctgtcgccccaggccctccc

SEQ ID NO: 4516579 - DNA, 22 bp, Homo sapiens
ctgtcgccccaggccctccctg

SEQ ID NO: 4516580 - DNA, 23 bp, Homo sapiens
ctgtcgttgttgtggaagcatgt

SEQ ID NO: 4516581 - DNA, 14 bp, Homo sapiens
ctgtctacatttct

SEQ ID NO: 4516582 - DNA, 18 bp, Homo sapiens
ctgtctagtctctcctgt

SEQ ID NO: 4516583 - DNA, 20 bp, Homo sapiens
ctgtctcaaagcataaaatg

SEQ ID NO: 4516584 - DNA, 15 bp, Homo sapiens
ctgtctcatccatca

SEQ ID NO: 4516585 - DNA, 16 bp, Homo sapiens
ctgtctcatccatcat

SEQ ID NO: 4516586 - DNA, 21 bp, Homo sapiens
ctgtctcatccccaggggtcc

SEQ ID NO: 4516587 - DNA, 22 bp, Homo sapiens
ctgtctctaccaaaaaaaggaa

SEQ ID NO: 4516588 - DNA, 18 bp, Homo sapiens
ctgtctctactaaaaata

SEQ ID NO: 4516589 - DNA, 14 bp, Homo sapiens
ctgtctctgcctgc

SEQ ID NO: 4516590 - DNA, 16 bp, Homo sapiens
ctgtctgaatgatctt

SEQ ID NO: 4516591 - DNA, 18 bp, Homo sapiens
ctgtctgagtagtggcca

SEQ ID NO: 4516592 - DNA, 16 bp, Homo sapiens
ctgtctgatctgtgct

SEQ ID NO: 4516593 - DNA, 17 bp, Homo sapiens
ctgtctgccaacctaaa

SEQ ID NO: 4516594 - DNA, 20 bp, Homo sapiens
ctgtctgccaacctaaaact

SEQ ID NO: 4516595 - DNA, 19 bp, Homo sapiens
ctgtctgcttgcatctgca

SEQ ID NO: 4516596 - DNA, 20 bp, Homo sapiens
ctgtctggaagacgtggctc

SEQ ID NO: 4516597 - DNA, 15 bp, Homo sapiens
ctgtctggccaggcc

SEQ ID NO: 4516598 - DNA, 15 bp, Homo sapiens
ctgtctggccctggg

SEQ ID NO: 4516599 - DNA, 20 bp, Homo sapiens
ctgtctggctcggacccacc

SEQ ID NO: 4516600 - DNA, 20 bp, Homo sapiens
ctgtctgtagagggccctgg

SEQ ID NO: 4516601 - DNA, 22 bp, Homo sapiens
ctgtctgtcaccagctatctgt

SEQ ID NO: 4516602 - DNA, 12 bp, Homo sapiens
ctgtctgtgcac

SEQ ID NO: 4516603 - DNA, 16 bp, Homo sapiens
ctgtctgtgcacatgc

SEQ ID NO: 4516604 - DNA, 23 bp, Homo sapiens
ctgtctgtgcacatgcctctgta

SEQ ID NO: 4516605 - DNA, 21 bp, Homo sapiens
ctgtcttaaactaaatgtgca

SEQ ID NO: 4516606 - DNA, 19 bp, Homo sapiens
ctgtcttactattatagca

SEQ ID NO: 4516607 - DNA, 16 bp, Homo sapiens
ctgtcttagactgcta

SEQ ID NO: 4516608 - DNA, 12 bp, Homo sapiens
ctgtcttcccag

SEQ ID NO: 4516609 - DNA, 14 bp, Homo sapiens
ctgtcttcccaggg

SEQ ID NO: 4516610 - DNA, 21 bp, Homo sapiens
ctgtcttgtccccacccatgc

SEQ ID NO: 4516611 - DNA, 19 bp, Homo sapiens
ctgtcttgttaatgctttt

SEQ ID NO: 4516612 - DNA, 16 bp, Homo sapiens
ctgtctttaattctgt

SEQ ID NO: 4516613 - DNA, 16 bp, Homo sapiens
ctgtcttttttctctc

SEQ ID NO: 4516614 - DNA, 17 bp, Homo sapiens
ctgtcttttttctctct

SEQ ID NO: 4516615 - DNA, 18 bp, Homo sapiens
ctgtcttttttctctctt

SEQ ID NO: 4516616 - DNA, 20 bp, Homo sapiens
ctgtgaaaaaaaatttgttt

SEQ ID NO: 4516617 - DNA, 22 bp, Homo sapiens
ctgtgaaaaaaaatttgttttc

SEQ ID NO: 4516618 - DNA, 16 bp, Homo sapiens
ctgtgaaaatagtgta

SEQ ID NO: 4516619 - DNA, 17 bp, Homo sapiens
ctgtgaaagctttggaa

SEQ ID NO: 4516620 - DNA, 11 bp, Homo sapiens
ctgtgaaatac

SEQ ID NO: 4516621 - DNA, 13 bp, Homo sapiens
ctgtgaaatacca

SEQ ID NO: 4516622 - DNA, 24 bp, Homo sapiens
ctgtgaaataccacaagcctgaga

SEQ ID NO: 4516623 - DNA, 16 bp, Homo sapiens
ctgtgaagcctttatc

SEQ ID NO: 4516624 - DNA, 18 bp, Homo sapiens
ctgtgaagcctttatcta

SEQ ID NO: 4516625 - DNA, 13 bp, Homo sapiens
ctgtgaagtgtta

SEQ ID NO: 4516626 - DNA, 15 bp, Homo sapiens
ctgtgaagttgaata

SEQ ID NO: 4516627 - DNA, 13 bp, Homo sapiens
ctgtgaattaagc

SEQ ID NO: 4516628 - DNA, 16 bp, Homo sapiens
ctgtgacatggtgcct

SEQ ID NO: 4516629 - DNA, 21 bp, Homo sapiens
ctgtgacatggtgcctgagag

SEQ ID NO: 4516630 - DNA, 15 bp, Homo sapiens
ctgtgaccaatgtct

SEQ ID NO: 4516631 - DNA, 16 bp, Homo sapiens
ctgtgaccacaacatg

SEQ ID NO: 4516632 - DNA, 13 bp, Homo sapiens
ctgtgacccatct

SEQ ID NO: 4516633 - DNA, 14 bp, Homo sapiens
ctgtgacctgtcag

SEQ ID NO: 4516634 - DNA, 20 bp, Homo sapiens
ctgtgacctgtcagaataaa

SEQ ID NO: 4516635 - DNA, 16 bp, Homo sapiens
ctgtgagacccccaca

SEQ ID NO: 4516636 - DNA, 20 bp, Homo sapiens
ctgtgagacccccacacctc

SEQ ID NO: 4516637 - DNA, 13 bp, Homo sapiens
ctgtgaggcaggg

SEQ ID NO: 4516638 - DNA, 18 bp, Homo sapiens
ctgtgaggcaggggcgga

SEQ ID NO: 4516639 - DNA, 20 bp, Homo sapiens
ctgtgatcaatatttttata

SEQ ID NO: 4516640 - DNA, 16 bp, Homo sapiens
ctgtgatgtcagcggt

SEQ ID NO: 4516641 - DNA, 16 bp, Homo sapiens
ctgtgattagatcaca

SEQ ID NO: 4516642 - DNA, 19 bp, Homo sapiens
ctgtgattagatcacatct

SEQ ID NO: 4516643 - DNA, 13 bp, Homo sapiens
ctgtgattcagaa

SEQ ID NO: 4516644 - DNA, 16 bp, Homo sapiens
ctgtgcaaaaaaatta

SEQ ID NO: 4516645 - DNA, 19 bp, Homo sapiens
ctgtgcacatctgtgtctt

SEQ ID NO: 4516646 - DNA, 14 bp, Homo sapiens
ctgtgcacatgcct

SEQ ID NO: 4516647 - DNA, 16 bp, Homo sapiens
ctgtgcacatgcctct

SEQ ID NO: 4516648 - DNA, 20 bp, Homo sapiens
ctgtgcacatgcctctgtag

SEQ ID NO: 4516649 - DNA, 14 bp, Homo sapiens
ctgtgcaccaagca

SEQ ID NO: 4516650 - DNA, 16 bp, Homo sapiens
ctgtgcagccgctgag

SEQ ID NO: 4516651 - DNA, 17 bp, Homo sapiens
ctgtgcagccgctgagc

SEQ ID NO: 4516652 - DNA, 19 bp, Homo sapiens
ctgtgcagccgctgagcga

SEQ ID NO: 4516653 - DNA, 15 bp, Homo sapiens
ctgtgcaggagctag

SEQ ID NO: 4516654 - DNA, 13 bp, Homo sapiens
ctgtgcaggcctg

SEQ ID NO: 4516655 - DNA, 19 bp, Homo sapiens
ctgtgcaggcctgtccctg

SEQ ID NO: 4516656 - DNA, 21 bp, Homo sapiens
ctgtgcaggcctgtccctggg

SEQ ID NO: 4516657 - DNA, 23 bp, Homo sapiens
ctgtgcaggcctgtccctgggag

SEQ ID NO: 4516658 - DNA, 17 bp, Homo sapiens
ctgtgcaggctgcagtg

SEQ ID NO: 4516659 - DNA, 21 bp, Homo sapiens
ctgtgcaggctgcagtggctc

SEQ ID NO: 4516660 - DNA, 23 bp, Homo sapiens
ctgtgcaggctgcagtggctccc

SEQ ID NO: 4516661 - DNA, 22 bp, Homo sapiens
ctgtgccaatacagacaaagca

SEQ ID NO: 4516662 - DNA, 13 bp, Homo sapiens
ctgtgccagaggc

SEQ ID NO: 4516663 - DNA, 17 bp, Homo sapiens
ctgtgcccgcatgtgtg

SEQ ID NO: 4516664 - DNA, 19 bp, Homo sapiens
ctgtgccgggaggcagcca

SEQ ID NO: 4516665 - DNA, 14 bp, Homo sapiens
ctgtgcctcccccc

SEQ ID NO: 4516666 - DNA, 17 bp, Homo sapiens
ctgtgcctccccccaga

SEQ ID NO: 4516667 - DNA, 21 bp, Homo sapiens
ctgtgcctgattattttagct

SEQ ID NO: 4516668 - DNA, 14 bp, Homo sapiens
ctgtgcctggcccc

SEQ ID NO: 4516669 - DNA, 15 bp, Homo sapiens
ctgtgcctggcccca

SEQ ID NO: 4516670 - DNA, 20 bp, Homo sapiens
ctgtgcctggccccagcctg

SEQ ID NO: 4516671 - DNA, 13 bp, Homo sapiens
ctgtgcctggctc

SEQ ID NO: 4516672 - DNA, 15 bp, Homo sapiens
ctgtgcctggctccc

SEQ ID NO: 4516673 - DNA, 17 bp, Homo sapiens
ctgtgcctggctccctg

SEQ ID NO: 4516674 - DNA, 23 bp, Homo sapiens
ctgtgccttgttttttgtttgtt

SEQ ID NO: 4516675 - DNA, 13 bp, Homo sapiens
ctgtgcctttcct

SEQ ID NO: 4516676 - DNA, 14 bp, Homo sapiens
ctgtgcctttccta

SEQ ID NO: 4516677 - DNA, 18 bp, Homo sapiens
ctgtgcctttcctatcac

SEQ ID NO: 4516678 - DNA, 16 bp, Homo sapiens
ctgtgccttttgccat

SEQ ID NO: 4516679 - DNA, 19 bp, Homo sapiens
ctgtgcgtcttggtgtaat

SEQ ID NO: 4516680 - DNA, 22 bp, Homo sapiens
ctgtgcgtcttggtgtaatttg

SEQ ID NO: 4516681 - DNA, 16 bp, Homo sapiens
ctgtgctatgaatttt

SEQ ID NO: 4516682 - DNA, 18 bp, Homo sapiens
ctgtgctcaccctctctt

SEQ ID NO: 4516683 - DNA, 21 bp, Homo sapiens
ctgtgctcaccctctcttggt

SEQ ID NO: 4516684 - DNA, 16 bp, Homo sapiens
ctgtgctctggaggct

SEQ ID NO: 4516685 - DNA, 20 bp, Homo sapiens
ctgtgctctggaggctgcag

SEQ ID NO: 4516686 - DNA, 22 bp, Homo sapiens
ctgtgctctggggatttctggg

SEQ ID NO: 4516687 - DNA, 14 bp, Homo sapiens
ctgtgctgaccctc

SEQ ID NO: 4516688 - DNA, 17 bp, Homo sapiens
ctgtgctgaccctcctg

SEQ ID NO: 4516689 - DNA, 18 bp, Homo sapiens
ctgtgctgaccctcctgt

SEQ ID NO: 4516690 - DNA, 21 bp, Homo sapiens
ctgtgctgtggaagcaacagg

SEQ ID NO: 4516691 - DNA, 21 bp, Homo sapiens
ctgtgctgtggagagaagctg

SEQ ID NO: 4516692 - DNA, 19 bp, Homo sapiens
ctgtgcttcgggcccttcc

SEQ ID NO: 4516693 - DNA, 20 bp, Homo sapiens
ctgtgcttcgggcccttccc

SEQ ID NO: 4516694 - DNA, 22 bp, Homo sapiens
ctgtgcttggatttgcatattt

SEQ ID NO: 4516695 - DNA, 15 bp, Homo sapiens
ctgtgctttccagct

SEQ ID NO: 4516696 - DNA, 22 bp, Homo sapiens
ctgtgctttccagctcaccccc

SEQ ID NO: 4516697 - DNA, 22 bp, Homo sapiens
ctgtgctttctattgtacagaa

SEQ ID NO: 4516698 - DNA, 13 bp, Homo sapiens
ctgtggaggggct

SEQ ID NO: 4516699 - DNA, 21 bp, Homo sapiens
ctgtggaggggcttgggcctg

SEQ ID NO: 4516700 - DNA, 22 bp, Homo sapiens
ctgtggatgctgctgcccctgc

SEQ ID NO: 4516701 - DNA, 23 bp, Homo sapiens
ctgtggatgctgctgcccctgca

SEQ ID NO: 4516702 - DNA, 23 bp, Homo sapiens
ctgtggattttttccttcaaagt

SEQ ID NO: 4516703 - DNA, 13 bp, Homo sapiens
ctgtggcactggc

SEQ ID NO: 4516704 - DNA, 17 bp, Homo sapiens
ctgtggcactggccacc

SEQ ID NO: 4516705 - DNA, 18 bp, Homo sapiens
ctgtggcagagttacagt

SEQ ID NO: 4516706 - DNA, 20 bp, Homo sapiens
ctgtggcagtaaagagaaac

SEQ ID NO: 4516707 - DNA, 16 bp, Homo sapiens
ctgtggcccctcccct

SEQ ID NO: 4516708 - DNA, 15 bp, Homo sapiens
ctgtggccggtgcca

SEQ ID NO: 4516709 - DNA, 16 bp, Homo sapiens
ctgtggccggtgccag

SEQ ID NO: 4516710 - DNA, 18 bp, Homo sapiens
ctgtggccggtgccagct

SEQ ID NO: 4516711 - DNA, 22 bp, Homo sapiens
ctgtggccggtgccagctgccc

SEQ ID NO: 4516712 - DNA, 23 bp, Homo sapiens
ctgtggccggtgccagctgccct

SEQ ID NO: 4516713 - DNA, 18 bp, Homo sapiens
ctgtggccgtctcctccc

SEQ ID NO: 4516714 - DNA, 19 bp, Homo sapiens
ctgtggcctgaagaagcac

SEQ ID NO: 4516715 - DNA, 15 bp, Homo sapiens
ctgtggcctgctcat

SEQ ID NO: 4516716 - DNA, 23 bp, Homo sapiens
ctgtggcgagccatttgtcccaa

SEQ ID NO: 4516717 - DNA, 21 bp, Homo sapiens
ctgtggctgtgtgtctgcttg

SEQ ID NO: 4516718 - DNA, 22 bp, Homo sapiens
ctgtgggactcagttgttctga

SEQ ID NO: 4516719 - DNA, 21 bp, Homo sapiens
ctgtgggagccgcagagcctg

SEQ ID NO: 4516720 - DNA, 22 bp, Homo sapiens
ctgtgggagccgcagagcctga

SEQ ID NO: 4516721 - DNA, 14 bp, Homo sapiens
ctgtgggatgggat

SEQ ID NO: 4516722 - DNA, 14 bp, Homo sapiens
ctgtgggcaattta

SEQ ID NO: 4516723 - DNA, 11 bp, Homo sapiens
ctgtgggcagc

SEQ ID NO: 4516724 - DNA, 14 bp, Homo sapiens
ctgtgggcagcacc

SEQ ID NO: 4516725 - DNA, 15 bp, Homo sapiens
ctgtgggctggcagt

SEQ ID NO: 4516726 - DNA, 22 bp, Homo sapiens
ctgtggggactccggctgtgct

SEQ ID NO: 4516727 - DNA, 23 bp, Homo sapiens
ctgtggggactccggctgtgctg

SEQ ID NO: 4516728 - DNA, 15 bp, Homo sapiens
ctgtggggactgaac

SEQ ID NO: 4516729 - DNA, 14 bp, Homo sapiens
ctgtggggcctggg

SEQ ID NO: 4516730 - DNA, 21 bp, Homo sapiens
ctgtggggcctggggagccca

SEQ ID NO: 4516731 - DNA, 17 bp, Homo sapiens
ctgtgggggtggccatc

SEQ ID NO: 4516732 - DNA, 20 bp, Homo sapiens
ctgtgggggtggccatccct

SEQ ID NO: 4516733 - DNA, 21 bp, Homo sapiens
ctgtgggggtggccatccctg

SEQ ID NO: 4516734 - DNA, 13 bp, Homo sapiens
ctgtgggtctctg

SEQ ID NO: 4516735 - DNA, 16 bp, Homo sapiens
ctgtggtagctccagc

SEQ ID NO: 4516736 - DNA, 23 bp, Homo sapiens
ctgtggtcgtcaactttcctcaa

SEQ ID NO: 4516737 - DNA, 19 bp, Homo sapiens
ctgtggtgaagtgtggctg

SEQ ID NO: 4516738 - DNA, 20 bp, Homo sapiens
ctgtggtgaagtgtggctgg

SEQ ID NO: 4516739 - DNA, 24 bp, Homo sapiens
ctgtggtgaagtgtggctggtgtc

SEQ ID NO: 4516740 - DNA, 18 bp, Homo sapiens
ctgtggtgacttctgctg

SEQ ID NO: 4516741 - DNA, 14 bp, Homo sapiens
ctgtggtgtgtccc

SEQ ID NO: 4516742 - DNA, 19 bp, Homo sapiens
ctgtggttttattacaaat

SEQ ID NO: 4516743 - DNA, 17 bp, Homo sapiens
ctgtgtaacatctgcca

SEQ ID NO: 4516744 - DNA, 18 bp, Homo sapiens
ctgtgtacctcactgtcc

SEQ ID NO: 4516745 - DNA, 15 bp, Homo sapiens
ctgtgtactgcagtt

SEQ ID NO: 4516746 - DNA, 12 bp, Homo sapiens
ctgtgtactgtg

SEQ ID NO: 4516747 - DNA, 21 bp, Homo sapiens
ctgtgtatatctcttggaaaa

SEQ ID NO: 4516748 - DNA, 22 bp, Homo sapiens
ctgtgtatatctcttggaaaat

SEQ ID NO: 4516749 - DNA, 23 bp, Homo sapiens
ctgtgtattaaacctttccattt

SEQ ID NO: 4516750 - DNA, 15 bp, Homo sapiens
ctgtgtattccaaga

SEQ ID NO: 4516751 - DNA, 17 bp, Homo sapiens
ctgtgtatttaattgta

SEQ ID NO: 4516752 - DNA, 20 bp, Homo sapiens
ctgtgtatttaattgtaaac

SEQ ID NO: 4516753 - DNA, 22 bp, Homo sapiens
ctgtgtatttatttaaaactct

SEQ ID NO: 4516754 - DNA, 22 bp, Homo sapiens
ctgtgtcagagcccagcccagg

SEQ ID NO: 4516755 - DNA, 23 bp, Homo sapiens
ctgtgtcataaacagatgaataa

SEQ ID NO: 4516756 - DNA, 14 bp, Homo sapiens
ctgtgtcatttctt

SEQ ID NO: 4516757 - DNA, 20 bp, Homo sapiens
ctgtgtcccatgtcccgtgt

SEQ ID NO: 4516758 - DNA, 19 bp, Homo sapiens
ctgtgtctgcctgtcccca

SEQ ID NO: 4516759 - DNA, 20 bp, Homo sapiens
ctgtgtctggcgttctcaag

SEQ ID NO: 4516760 - DNA, 21 bp, Homo sapiens
ctgtgtctggcgttctcaaga

SEQ ID NO: 4516761 - DNA, 18 bp, Homo sapiens
ctgtgtgaatacctgctc

SEQ ID NO: 4516762 - DNA, 19 bp, Homo sapiens
ctgtgtgaatacctgctca

SEQ ID NO: 4516763 - DNA, 18 bp, Homo sapiens
ctgtgtgaccctgggcag

SEQ ID NO: 4516764 - DNA, 15 bp, Homo sapiens
ctgtgtggctgtgca

SEQ ID NO: 4516765 - DNA, 18 bp, Homo sapiens
ctgtgtgtcttctgcccc

SEQ ID NO: 4516766 - DNA, 14 bp, Homo sapiens
ctgtgtgtgtgaat

SEQ ID NO: 4516767 - DNA, 16 bp, Homo sapiens
ctgtgtgtgtgaatga

SEQ ID NO: 4516768 - DNA, 18 bp, Homo sapiens
ctgtgtgtttatgtgtgt

SEQ ID NO: 4516769 - DNA, 13 bp, Homo sapiens
ctgtgttaaacac

SEQ ID NO: 4516770 - DNA, 22 bp, Homo sapiens
ctgtgttaaacactacacattt

SEQ ID NO: 4516771 - DNA, 22 bp, Homo sapiens
ctgtgttgccacagtagaactg

SEQ ID NO: 4516772 - DNA, 16 bp, Homo sapiens
ctgtgtttatatggaa

SEQ ID NO: 4516773 - DNA, 22 bp, Homo sapiens
ctgtgtttatatggaagaaagt

SEQ ID NO: 4516774 - DNA, 19 bp, Homo sapiens
ctgtgtttcaaatggactg

SEQ ID NO: 4516775 - DNA, 16 bp, Homo sapiens
ctgtgtttcattactt

SEQ ID NO: 4516776 - DNA, 15 bp, Homo sapiens
ctgtgtttccatctc

SEQ ID NO: 4516777 - DNA, 16 bp, Homo sapiens
ctgtgttttgaaagaa

SEQ ID NO: 4516778 - DNA, 18 bp, Homo sapiens
ctgtgttttgaaagaata

SEQ ID NO: 4516779 - DNA, 19 bp, Homo sapiens
ctgttaaaagatgaaaata

SEQ ID NO: 4516780 - DNA, 21 bp, Homo sapiens
ctgttaaaagatgaaaatatt

SEQ ID NO: 4516781 - DNA, 14 bp, Homo sapiens
ctgttaaaataaag

SEQ ID NO: 4516782 - DNA, 17 bp, Homo sapiens
ctgttaaatacaggaaa

SEQ ID NO: 4516783 - DNA, 23 bp, Homo sapiens
ctgttaaatacaggaaacagttg

SEQ ID NO: 4516784 - DNA, 15 bp, Homo sapiens
ctgttaacttattca

SEQ ID NO: 4516785 - DNA, 19 bp, Homo sapiens
ctgttaacttattcaaaga

SEQ ID NO: 4516786 - DNA, 21 bp, Homo sapiens
ctgttaatgtggactggaaca

SEQ ID NO: 4516787 - DNA, 20 bp, Homo sapiens
ctgttaatttataatgtatt

SEQ ID NO: 4516788 - DNA, 22 bp, Homo sapiens
ctgttacacactaacatcaatg

SEQ ID NO: 4516789 - DNA, 17 bp, Homo sapiens
ctgttacacgtgcctgt

SEQ ID NO: 4516790 - DNA, 20 bp, Homo sapiens
ctgttacagtaatgtcataa

SEQ ID NO: 4516791 - DNA, 15 bp, Homo sapiens
ctgttacttgcttca

SEQ ID NO: 4516792 - DNA, 16 bp, Homo sapiens
ctgttagaacactatt

SEQ ID NO: 4516793 - DNA, 18 bp, Homo sapiens
ctgttagaacactatttt

SEQ ID NO: 4516794 - DNA, 19 bp, Homo sapiens
ctgttagaacactattttc

SEQ ID NO: 4516795 - DNA, 23 bp, Homo sapiens
ctgttagaacactattttcagaa

SEQ ID NO: 4516796 - DNA, 22 bp, Homo sapiens
ctgttaggacagcaaagcagca

SEQ ID NO: 4516797 - DNA, 19 bp, Homo sapiens
ctgttaggggccaataaaa

SEQ ID NO: 4516798 - DNA, 21 bp, Homo sapiens
ctgttaggggccaataaaatg

SEQ ID NO: 4516799 - DNA, 22 bp, Homo sapiens
ctgttaggggccaataaaatgt

SEQ ID NO: 4516800 - DNA, 17 bp, Homo sapiens
ctgttagtattaactat

SEQ ID NO: 4516801 - DNA, 23 bp, Homo sapiens
ctgttatcaaacaccaacataaa

SEQ ID NO: 4516802 - DNA, 14 bp, Homo sapiens
ctgttatgctgtga

SEQ ID NO: 4516803 - DNA, 12 bp, Homo sapiens
ctgttatttcta

SEQ ID NO: 4516804 - DNA, 19 bp, Homo sapiens
ctgttatttctatgaaaat

SEQ ID NO: 4516805 - DNA, 13 bp, Homo sapiens
ctgttatttcttc

SEQ ID NO: 4516806 - DNA, 23 bp, Homo sapiens
ctgttatttcttccctgctttgc

SEQ ID NO: 4516807 - DNA, 14 bp, Homo sapiens
ctgttatttttaag

SEQ ID NO: 4516808 - DNA, 12 bp, Homo sapiens
ctgttcacagcc

SEQ ID NO: 4516809 - DNA, 14 bp, Homo sapiens
ctgttcagcattct

SEQ ID NO: 4516810 - DNA, 16 bp, Homo sapiens
ctgttcagtaataaaa

SEQ ID NO: 4516811 - DNA, 16 bp, Homo sapiens
ctgttcatcttgtaca

SEQ ID NO: 4516812 - DNA, 21 bp, Homo sapiens
ctgttccaaattcagtttcat

SEQ ID NO: 4516813 - DNA, 12 bp, Homo sapiens
ctgttccagact

SEQ ID NO: 4516814 - DNA, 14 bp, Homo sapiens
ctgttccaggccct

SEQ ID NO: 4516815 - DNA, 17 bp, Homo sapiens
ctgttccaggccctcca

SEQ ID NO: 4516816 - DNA, 19 bp, Homo sapiens
ctgttccataggaaggctg

SEQ ID NO: 4516817 - DNA, 15 bp, Homo sapiens
ctgttcccagcccct

SEQ ID NO: 4516818 - DNA, 21 bp, Homo sapiens
ctgttcccagcccctcctccc

SEQ ID NO: 4516819 - DNA, 23 bp, Homo sapiens
ctgttcccagcccctcctccctc

SEQ ID NO: 4516820 - DNA, 19 bp, Homo sapiens
ctgttcccagcccctgcag

SEQ ID NO: 4516821 - DNA, 20 bp, Homo sapiens
ctgttcccagcccctgcaga

SEQ ID NO: 4516822 - DNA, 21 bp, Homo sapiens
ctgttcccagcccctgcagat

SEQ ID NO: 4516823 - DNA, 15 bp, Homo sapiens
ctgttccccagcaac

SEQ ID NO: 4516824 - DNA, 14 bp, Homo sapiens
ctgttcctcatgtt

SEQ ID NO: 4516825 - DNA, 19 bp, Homo sapiens
ctgttcctcatgttgctga

SEQ ID NO: 4516826 - DNA, 23 bp, Homo sapiens
ctgttcggaaggggttcctcaaa

SEQ ID NO: 4516827 - DNA, 19 bp, Homo sapiens
ctgttctacatagatgctt

SEQ ID NO: 4516828 - DNA, 14 bp, Homo sapiens
ctgttctccctttc

SEQ ID NO: 4516829 - DNA, 18 bp, Homo sapiens
ctgttctccctttctctc

SEQ ID NO: 4516830 - DNA, 22 bp, Homo sapiens
ctgttctccctttctctctcct

SEQ ID NO: 4516831 - DNA, 15 bp, Homo sapiens
ctgttctcttgggaa

SEQ ID NO: 4516832 - DNA, 19 bp, Homo sapiens
ctgttctgaaaggagacat

SEQ ID NO: 4516833 - DNA, 13 bp, Homo sapiens
ctgttctgtagct

SEQ ID NO: 4516834 - DNA, 22 bp, Homo sapiens
ctgttctgtagcttatctgccc

SEQ ID NO: 4516835 - DNA, 20 bp, Homo sapiens
ctgttctgtggttcctctgc

SEQ ID NO: 4516836 - DNA, 21 bp, Homo sapiens
ctgttctgtggttcctctgct

SEQ ID NO: 4516837 - DNA, 15 bp, Homo sapiens
ctgttcttgacaatc

SEQ ID NO: 4516838 - DNA, 23 bp, Homo sapiens
ctgttgaaaagcacacacaataa

SEQ ID NO: 4516839 - DNA, 16 bp, Homo sapiens
ctgttgaatcacagta

SEQ ID NO: 4516840 - DNA, 18 bp, Homo sapiens
ctgttgacatatttaatg

SEQ ID NO: 4516841 - DNA, 20 bp, Homo sapiens
ctgttgacatatttaatgtt

SEQ ID NO: 4516842 - DNA, 16 bp, Homo sapiens
ctgttgcaagcccctc

SEQ ID NO: 4516843 - DNA, 14 bp, Homo sapiens
ctgttgcacccagc

SEQ ID NO: 4516844 - DNA, 18 bp, Homo sapiens
ctgttgcacccagccctg

SEQ ID NO: 4516845 - DNA, 21 bp, Homo sapiens
ctgttgcacccagccctggtc

SEQ ID NO: 4516846 - DNA, 23 bp, Homo sapiens
ctgttgcacccagccctggtctc

SEQ ID NO: 4516847 - DNA, 14 bp, Homo sapiens
ctgttgctttacag

SEQ ID NO: 4516848 - DNA, 19 bp, Homo sapiens
ctgttgctttgaaaaatct

SEQ ID NO: 4516849 - DNA, 22 bp, Homo sapiens
ctgttggcaggcccactcccca

SEQ ID NO: 4516850 - DNA, 21 bp, Homo sapiens
ctgttggtgttctaagactct

SEQ ID NO: 4516851 - DNA, 17 bp, Homo sapiens
ctgttggtttcatttga

SEQ ID NO: 4516852 - DNA, 19 bp, Homo sapiens
ctgttgtttggttcaggga

SEQ ID NO: 4516853 - DNA, 16 bp, Homo sapiens
ctgtttaaaaaaccac

SEQ ID NO: 4516854 - DNA, 17 bp, Homo sapiens
ctgtttaccatttttca

SEQ ID NO: 4516855 - DNA, 18 bp, Homo sapiens
ctgtttactcccttctgt

SEQ ID NO: 4516856 - DNA, 19 bp, Homo sapiens
ctgtttacttgaatagtat

SEQ ID NO: 4516857 - DNA, 12 bp, Homo sapiens
ctgtttataaat

SEQ ID NO: 4516858 - DNA, 15 bp, Homo sapiens
ctgtttataaatgtt

SEQ ID NO: 4516859 - DNA, 15 bp, Homo sapiens
ctgtttatacttgag

SEQ ID NO: 4516860 - DNA, 19 bp, Homo sapiens
ctgtttatatattgaaagt

SEQ ID NO: 4516861 - DNA, 14 bp, Homo sapiens
ctgtttattaatct

SEQ ID NO: 4516862 - DNA, 18 bp, Homo sapiens
ctgtttcaaagccaagac

SEQ ID NO: 4516863 - DNA, 21 bp, Homo sapiens
ctgtttcaaagccaagacctc

SEQ ID NO: 4516864 - DNA, 21 bp, Homo sapiens
ctgtttcagagcataaaacct

SEQ ID NO: 4516865 - DNA, 14 bp, Homo sapiens
ctgtttcagtgtga

SEQ ID NO: 4516866 - DNA, 19 bp, Homo sapiens
ctgtttcctatttaataca

SEQ ID NO: 4516867 - DNA, 19 bp, Homo sapiens
ctgtttcctgacattgtct

SEQ ID NO: 4516868 - DNA, 22 bp, Homo sapiens
ctgtttctcgttgtcacaccca

SEQ ID NO: 4516869 - DNA, 14 bp, Homo sapiens
ctgtttctctgctg

SEQ ID NO: 4516870 - DNA, 23 bp, Homo sapiens
ctgtttctggaagactgctcccg

SEQ ID NO: 4516871 - DNA, 23 bp, Homo sapiens
ctgtttgatataccaaattaaaa

SEQ ID NO: 4516872 - DNA, 14 bp, Homo sapiens
ctgtttgattcttt

SEQ ID NO: 4516873 - DNA, 16 bp, Homo sapiens
ctgtttgcatgcgccc

SEQ ID NO: 4516874 - DNA, 16 bp, Homo sapiens
ctgtttggactttgta

SEQ ID NO: 4516875 - DNA, 12 bp, Homo sapiens
ctgtttgtaatc

SEQ ID NO: 4516876 - DNA, 17 bp, Homo sapiens
ctgtttgtagtgaaata

SEQ ID NO: 4516877 - DNA, 13 bp, Homo sapiens
ctgtttgtctttt

SEQ ID NO: 4516878 - DNA, 14 bp, Homo sapiens
ctgtttgtgggact

SEQ ID NO: 4516879 - DNA, 18 bp, Homo sapiens
ctgtttgtggggtgacgg

SEQ ID NO: 4516880 - DNA, 16 bp, Homo sapiens
ctgttttacagctgcc

SEQ ID NO: 4516881 - DNA, 16 bp, Homo sapiens
ctgttttatatattat

SEQ ID NO: 4516882 - DNA, 22 bp, Homo sapiens
ctgttttatatattatgtgaag

SEQ ID NO: 4516883 - DNA, 16 bp, Homo sapiens
ctgttttcccacgagg

SEQ ID NO: 4516884 - DNA, 20 bp, Homo sapiens
ctgttttccctctgctgctt

SEQ ID NO: 4516885 - DNA, 16 bp, Homo sapiens
ctgttttctgtaaatt

SEQ ID NO: 4516886 - DNA, 12 bp, Homo sapiens
ctgttttgatag

SEQ ID NO: 4516887 - DNA, 19 bp, Homo sapiens
ctgttttgtggtttggaat

SEQ ID NO: 4516888 - DNA, 14 bp, Homo sapiens
ctgtttttagtgct

SEQ ID NO: 4516889 - DNA, 13 bp, Homo sapiens
ctgtttttcacat

SEQ ID NO: 4516890 - DNA, 19 bp, Homo sapiens
ctgtttttggctgttttcc

SEQ ID NO: 4516891 - DNA, 15 bp, Homo sapiens
ctgtttttgtttctt

SEQ ID NO: 4516892 - DNA, 14 bp, Homo sapiens
ctgtttttttgtta

SEQ ID NO: 4516893 - DNA, 19 bp, Homo sapiens
cttaaaaaaaaaaaaaagc

SEQ ID NO: 4516894 - DNA, 17 bp, Homo sapiens
cttaaaaaataatacaa

SEQ ID NO: 4516895 - DNA, 12 bp, Homo sapiens
cttaaaaaatgt

SEQ ID NO: 4516896 - DNA, 18 bp, Homo sapiens
cttaaaaaatttatactt

SEQ ID NO: 4516897 - DNA, 20 bp, Homo sapiens
cttaaaaatggtttaaatgg

SEQ ID NO: 4516898 - DNA, 21 bp, Homo sapiens
cttaaaaatggtttaaatggt

SEQ ID NO: 4516899 - DNA, 16 bp, Homo sapiens
cttaaaacacatgata

SEQ ID NO: 4516900 - DNA, 11 bp, Homo sapiens
cttaaaacact

SEQ ID NO: 4516901 - DNA, 14 bp, Homo sapiens
cttaaaaccaaaga

SEQ ID NO: 4516902 - DNA, 12 bp, Homo sapiens
cttaaaactttg

SEQ ID NO: 4516903 - DNA, 14 bp, Homo sapiens
cttaaaagcatttt

SEQ ID NO: 4516904 - DNA, 22 bp, Homo sapiens
cttaaaagctatcttcatgtaa

SEQ ID NO: 4516905 - DNA, 18 bp, Homo sapiens
cttaaaataaaaataaat

SEQ ID NO: 4516906 - DNA, 13 bp, Homo sapiens
cttaaaataattc

SEQ ID NO: 4516907 - DNA, 19 bp, Homo sapiens
cttaaaataattcatatct

SEQ ID NO: 4516908 - DNA, 15 bp, Homo sapiens
cttaaaatgcaatat

SEQ ID NO: 4516909 - DNA, 19 bp, Homo sapiens
cttaaaatgcaatatttgt

SEQ ID NO: 4516910 - DNA, 22 bp, Homo sapiens
cttaaaatgcaatatttgtaag

SEQ ID NO: 4516911 - DNA, 24 bp, Homo sapiens
cttaaaatgttcacttttgacaaa

SEQ ID NO: 4516912 - DNA, 17 bp, Homo sapiens
cttaaacacaggctgtc

SEQ ID NO: 4516913 - DNA, 21 bp, Homo sapiens
cttaaacacaggctgtcctta

SEQ ID NO: 4516914 - DNA, 12 bp, Homo sapiens
cttaaacagcac

SEQ ID NO: 4516915 - DNA, 14 bp, Homo sapiens
cttaaactaaatgt

SEQ ID NO: 4516916 - DNA, 16 bp, Homo sapiens
cttaaactctggacac

SEQ ID NO: 4516917 - DNA, 14 bp, Homo sapiens
cttaaagcaaacta

SEQ ID NO: 4516918 - DNA, 18 bp, Homo sapiens
cttaaaggccgtcatttc

SEQ ID NO: 4516919 - DNA, 19 bp, Homo sapiens
cttaaaggccgtcatttca

SEQ ID NO: 4516920 - DNA, 21 bp, Homo sapiens
cttaaaggtgtcttcctccca

SEQ ID NO: 4516921 - DNA, 22 bp, Homo sapiens
cttaaagttggtattaataaaa

SEQ ID NO: 4516922 - DNA, 16 bp, Homo sapiens
cttaaataagaaactt

SEQ ID NO: 4516923 - DNA, 14 bp, Homo sapiens
cttaaataggaaag

SEQ ID NO: 4516924 - DNA, 15 bp, Homo sapiens
cttaaataggaaagt

SEQ ID NO: 4516925 - DNA, 22 bp, Homo sapiens
cttaaatcatttggttaaatca

SEQ ID NO: 4516926 - DNA, 17 bp, Homo sapiens
cttaaatgagttactta

SEQ ID NO: 4516927 - DNA, 16 bp, Homo sapiens
cttaaatgttattatc

SEQ ID NO: 4516928 - DNA, 11 bp, Homo sapiens
cttaaattaaa

SEQ ID NO: 4516929 - DNA, 19 bp, Homo sapiens
cttaaattaaacaatttat

SEQ ID NO: 4516930 - DNA, 20 bp, Homo sapiens
cttaaattaaacaatttatt

SEQ ID NO: 4516931 - DNA, 21 bp, Homo sapiens
cttaaattaaacaatttattt

SEQ ID NO: 4516932 - DNA, 19 bp, Homo sapiens
cttaaattcatttctagac

SEQ ID NO: 4516933 - DNA, 18 bp, Homo sapiens
cttaaatttcttatgtga

SEQ ID NO: 4516934 - DNA, 13 bp, Homo sapiens
cttaaattttaac

SEQ ID NO: 4516935 - DNA, 18 bp, Homo sapiens
cttaaattttaactaaat

SEQ ID NO: 4516936 - DNA, 22 bp, Homo sapiens
cttaacaaacgtaatttgttat

SEQ ID NO: 4516937 - DNA, 16 bp, Homo sapiens
cttaacattcctaaaa

SEQ ID NO: 4516938 - DNA, 16 bp, Homo sapiens
cttaacccacctctcc

SEQ ID NO: 4516939 - DNA, 17 bp, Homo sapiens
cttaacccacctctcct

SEQ ID NO: 4516940 - DNA, 18 bp, Homo sapiens
cttaaccttaaccttaaa

SEQ ID NO: 4516941 - DNA, 21 bp, Homo sapiens
cttaaccttgaaatggaaagt

SEQ ID NO: 4516942 - DNA, 18 bp, Homo sapiens
cttaacctttccgctgtc

SEQ ID NO: 4516943 - DNA, 13 bp, Homo sapiens
cttaacctttgct

SEQ ID NO: 4516944 - DNA, 23 bp, Homo sapiens
cttaactattaaggccttttcca

SEQ ID NO: 4516945 - DNA, 14 bp, Homo sapiens
cttaactgtatttc

SEQ ID NO: 4516946 - DNA, 17 bp, Homo sapiens
cttaactgtatttcagt

SEQ ID NO: 4516947 - DNA, 21 bp, Homo sapiens
cttaactgtatttcagtattt

SEQ ID NO: 4516948 - DNA, 21 bp, Homo sapiens
cttaacttccatgttctgggt

SEQ ID NO: 4516949 - DNA, 15 bp, Homo sapiens
cttaacttcttgctt

SEQ ID NO: 4516950 - DNA, 18 bp, Homo sapiens
cttaagaattcaaatttg

SEQ ID NO: 4516951 - DNA, 17 bp, Homo sapiens
cttaagatattgaagga

SEQ ID NO: 4516952 - DNA, 15 bp, Homo sapiens
cttaagcagcaacag

SEQ ID NO: 4516953 - DNA, 15 bp, Homo sapiens
cttaagcatctggct

SEQ ID NO: 4516954 - DNA, 23 bp, Homo sapiens
cttaagcgaagtctttgccttct

SEQ ID NO: 4516955 - DNA, 22 bp, Homo sapiens
cttaaggagaggagaaactgag

SEQ ID NO: 4516956 - DNA, 15 bp, Homo sapiens
cttaagtataaacct

SEQ ID NO: 4516957 - DNA, 22 bp, Homo sapiens
cttaagtcagatttttatttat

SEQ ID NO: 4516958 - DNA, 15 bp, Homo sapiens
cttaagtgctgcagc

SEQ ID NO: 4516959 - DNA, 17 bp, Homo sapiens
cttaagtgttcatttta

SEQ ID NO: 4516960 - DNA, 20 bp, Homo sapiens
cttaagtgttcattttaagt

SEQ ID NO: 4516961 - DNA, 20 bp, Homo sapiens
cttaataactgtgtactgtt

SEQ ID NO: 4516962 - DNA, 14 bp, Homo sapiens
cttaataataatgc

SEQ ID NO: 4516963 - DNA, 13 bp, Homo sapiens
cttaatactaagg

SEQ ID NO: 4516964 - DNA, 12 bp, Homo sapiens
cttaatagcaac

SEQ ID NO: 4516965 - DNA, 12 bp, Homo sapiens
cttaatataaat

SEQ ID NO: 4516966 - DNA, 14 bp, Homo sapiens
cttaatatattccc

SEQ ID NO: 4516967 - DNA, 23 bp, Homo sapiens
cttaatatgctgcaacaaaatgt

SEQ ID NO: 4516968 - DNA, 19 bp, Homo sapiens
cttaatatttcttcaaata

SEQ ID NO: 4516969 - DNA, 20 bp, Homo sapiens
cttaatatttcttcaaatat

SEQ ID NO: 4516970 - DNA, 13 bp, Homo sapiens
cttaatcatttta

SEQ ID NO: 4516971 - DNA, 22 bp, Homo sapiens
cttaatctaatctaaaagctct

SEQ ID NO: 4516972 - DNA, 18 bp, Homo sapiens
cttaatctggacacactg

SEQ ID NO: 4516973 - DNA, 23 bp, Homo sapiens
cttaatcttcagaggtgctaaat

SEQ ID NO: 4516974 - DNA, 15 bp, Homo sapiens
cttaatgacaacact

SEQ ID NO: 4516975 - DNA, 19 bp, Homo sapiens
cttaatgaccatgttatat

SEQ ID NO: 4516976 - DNA, 21 bp, Homo sapiens
cttaatgcttacctaatttca

SEQ ID NO: 4516977 - DNA, 20 bp, Homo sapiens
cttaatggctgataatttta

SEQ ID NO: 4516978 - DNA, 24 bp, Homo sapiens
cttaatggtaggtcaagtaataaa

SEQ ID NO: 4516979 - DNA, 17 bp, Homo sapiens
cttaatgtatgttacca

SEQ ID NO: 4516980 - DNA, 17 bp, Homo sapiens
cttaattaaaagaatat

SEQ ID NO: 4516981 - DNA, 19 bp, Homo sapiens
cttaattaaaagaatattt

SEQ ID NO: 4516982 - DNA, 12 bp, Homo sapiens
cttaattactta

SEQ ID NO: 4516983 - DNA, 16 bp, Homo sapiens
cttaattacttaaaaa

SEQ ID NO: 4516984 - DNA, 10 bp, Homo sapiens
cttaattatt

SEQ ID NO: 4516985 - DNA, 21 bp, Homo sapiens
cttaattattataaaaatatt

SEQ ID NO: 4516986 - DNA, 15 bp, Homo sapiens
cttaattgtgtttat

SEQ ID NO: 4516987 - DNA, 17 bp, Homo sapiens
cttaattgtgtttattt

SEQ ID NO: 4516988 - DNA, 22 bp, Homo sapiens
cttaatttacttaagtgttcat

SEQ ID NO: 4516989 - DNA, 14 bp, Homo sapiens
cttaatttatttct

SEQ ID NO: 4516990 - DNA, 13 bp, Homo sapiens
cttaatttccttt

SEQ ID NO: 4516991 - DNA, 14 bp, Homo sapiens
cttaatttcctttt

SEQ ID NO: 4516992 - DNA, 17 bp, Homo sapiens
cttaatttcctttttga

SEQ ID NO: 4516993 - DNA, 14 bp, Homo sapiens
cttaatttgaaatc

SEQ ID NO: 4516994 - DNA, 16 bp, Homo sapiens
cttaatttgaaatcta

SEQ ID NO: 4516995 - DNA, 14 bp, Homo sapiens
cttacaaatgaaaa

SEQ ID NO: 4516996 - DNA, 18 bp, Homo sapiens
cttacaagaaaggcctga

SEQ ID NO: 4516997 - DNA, 13 bp, Homo sapiens
cttacagccaagt

SEQ ID NO: 4516998 - DNA, 15 bp, Homo sapiens
cttacaggtcctgct

SEQ ID NO: 4516999 - DNA, 15 bp, Homo sapiens
cttacattgtgaaac

SEQ ID NO: 4517000 - DNA, 19 bp, Homo sapiens
cttaccattaacatttttt

SEQ ID NO: 4517001 - DNA, 23 bp, Homo sapiens
cttaccatttgctactgtacata

SEQ ID NO: 4517002 - DNA, 18 bp, Homo sapiens
cttacctaacttgaacat

SEQ ID NO: 4517003 - DNA, 15 bp, Homo sapiens
cttacctcctgccca

SEQ ID NO: 4517004 - DNA, 17 bp, Homo sapiens
cttacctcctgcccagg

SEQ ID NO: 4517005 - DNA, 19 bp, Homo sapiens
cttacctcctgcccaggag

SEQ ID NO: 4517006 - DNA, 13 bp, Homo sapiens
cttacctttttat

SEQ ID NO: 4517007 - DNA, 23 bp, Homo sapiens
cttacgaatacttttgccctttg

SEQ ID NO: 4517008 - DNA, 17 bp, Homo sapiens
cttacgaatattttcag

SEQ ID NO: 4517009 - DNA, 20 bp, Homo sapiens
cttacgaatattttcagtaa

SEQ ID NO: 4517010 - DNA, 13 bp, Homo sapiens
cttactcacctct

SEQ ID NO: 4517011 - DNA, 13 bp, Homo sapiens
cttactgcagaat

SEQ ID NO: 4517012 - DNA, 16 bp, Homo sapiens
cttactgtagcctcag

SEQ ID NO: 4517013 - DNA, 14 bp, Homo sapiens
cttacttagtgtta

SEQ ID NO: 4517014 - DNA, 24 bp, Homo sapiens
cttacttgcataccaagttgatac

SEQ ID NO: 4517015 - DNA, 17 bp, Homo sapiens
cttacttttattatttt

SEQ ID NO: 4517016 - DNA, 16 bp, Homo sapiens
cttagaaaaaaaaaga

SEQ ID NO: 4517017 - DNA, 14 bp, Homo sapiens
cttagaaacactgc

SEQ ID NO: 4517018 - DNA, 11 bp, Homo sapiens
cttagaaactg

SEQ ID NO: 4517019 - DNA, 20 bp, Homo sapiens
cttagaagtggaccaggaca

SEQ ID NO: 4517020 - DNA, 23 bp, Homo sapiens
cttagaagtggaccaggacagga

SEQ ID NO: 4517021 - DNA, 23 bp, Homo sapiens
cttagaatttgtttcatctattt

SEQ ID NO: 4517022 - DNA, 20 bp, Homo sapiens
cttagacctgccagccactg

SEQ ID NO: 4517023 - DNA, 15 bp, Homo sapiens
cttagactcttttcc

SEQ ID NO: 4517024 - DNA, 13 bp, Homo sapiens
cttagagaccccg

SEQ ID NO: 4517025 - DNA, 12 bp, Homo sapiens
cttagagatgat

SEQ ID NO: 4517026 - DNA, 16 bp, Homo sapiens
cttagagccaggcaca

SEQ ID NO: 4517027 - DNA, 23 bp, Homo sapiens
cttagagccaggcacacactgtg

SEQ ID NO: 4517028 - DNA, 22 bp, Homo sapiens
cttagagtttctgtttgattct

SEQ ID NO: 4517029 - DNA, 23 bp, Homo sapiens
cttagagtttctgtttgattctt

SEQ ID NO: 4517030 - DNA, 19 bp, Homo sapiens
cttagataacttcttgaaa

SEQ ID NO: 4517031 - DNA, 20 bp, Homo sapiens
cttagatgttccaaatttag

SEQ ID NO: 4517032 - DNA, 20 bp, Homo sapiens
cttagatgttccagtaatct

SEQ ID NO: 4517033 - DNA, 23 bp, Homo sapiens
cttagatttaaaggcagacagtt

SEQ ID NO: 4517034 - DNA, 15 bp, Homo sapiens
cttagcaaaaagtgg

SEQ ID NO: 4517035 - DNA, 17 bp, Homo sapiens
cttagcaccttcagggc

SEQ ID NO: 4517036 - DNA, 19 bp, Homo sapiens
cttagcagccctggatggt

SEQ ID NO: 4517037 - DNA, 12 bp, Homo sapiens
cttagcccaaga

SEQ ID NO: 4517038 - DNA, 14 bp, Homo sapiens
cttagcccaagagg

SEQ ID NO: 4517039 - DNA, 17 bp, Homo sapiens
cttagcccaagaggtct

SEQ ID NO: 4517040 - DNA, 12 bp, Homo sapiens
cttagcctctcc

SEQ ID NO: 4517041 - DNA, 22 bp, Homo sapiens
cttagcgttctggactctgccc

SEQ ID NO: 4517042 - DNA, 20 bp, Homo sapiens
cttagctttagaaacagtgc

SEQ ID NO: 4517043 - DNA, 16 bp, Homo sapiens
cttaggagcagagctc

SEQ ID NO: 4517044 - DNA, 18 bp, Homo sapiens
cttaggagcagagctctg

SEQ ID NO: 4517045 - DNA, 23 bp, Homo sapiens
cttaggatgggggatgtggccag

SEQ ID NO: 4517046 - DNA, 22 bp, Homo sapiens
cttagggaaagatgtagaaaga

SEQ ID NO: 4517047 - DNA, 15 bp, Homo sapiens
cttagtaaaatttat

SEQ ID NO: 4517048 - DNA, 20 bp, Homo sapiens
cttagtaaaatttatttcat

SEQ ID NO: 4517049 - DNA, 16 bp, Homo sapiens
cttagtgccacccacc

SEQ ID NO: 4517050 - DNA, 11 bp, Homo sapiens
cttagtgtatg

SEQ ID NO: 4517051 - DNA, 15 bp, Homo sapiens
cttagtgtatgatta

SEQ ID NO: 4517052 - DNA, 12 bp, Homo sapiens
cttagtgttcaa

SEQ ID NO: 4517053 - DNA, 13 bp, Homo sapiens
cttagttaaaaaa

SEQ ID NO: 4517054 - DNA, 19 bp, Homo sapiens
cttataacctagttaaaga

SEQ ID NO: 4517055 - DNA, 22 bp, Homo sapiens
cttataacctagttaaagaaag

SEQ ID NO: 4517056 - DNA, 16 bp, Homo sapiens
cttataataaaggact

SEQ ID NO: 4517057 - DNA, 21 bp, Homo sapiens
cttataattgttctcagaatc

SEQ ID NO: 4517058 - DNA, 15 bp, Homo sapiens
cttatactgtacaat

SEQ ID NO: 4517059 - DNA, 19 bp, Homo sapiens
cttataggaattgacccac

SEQ ID NO: 4517060 - DNA, 16 bp, Homo sapiens
cttataggcctgtccc

SEQ ID NO: 4517061 - DNA, 18 bp, Homo sapiens
cttataggcctgtccctt

SEQ ID NO: 4517062 - DNA, 17 bp, Homo sapiens
cttatagtacatgataa

SEQ ID NO: 4517063 - DNA, 22 bp, Homo sapiens
cttatagtgtttggacagctga

SEQ ID NO: 4517064 - DNA, 16 bp, Homo sapiens
cttatagttactgtgt

SEQ ID NO: 4517065 - DNA, 18 bp, Homo sapiens
cttatagttactgtgtaa

SEQ ID NO: 4517066 - DNA, 21 bp, Homo sapiens
cttatagttactgtgtaatta

SEQ ID NO: 4517067 - DNA, 22 bp, Homo sapiens
cttatatatgcacttaatttgt

SEQ ID NO: 4517068 - DNA, 23 bp, Homo sapiens
cttatatatgcacttaatttgtt

SEQ ID NO: 4517069 - DNA, 14 bp, Homo sapiens
cttatatgtacttt

SEQ ID NO: 4517070 - DNA, 20 bp, Homo sapiens
cttatattaatagtaatttg

SEQ ID NO: 4517071 - DNA, 20 bp, Homo sapiens
cttatattggtttgcacaag

SEQ ID NO: 4517072 - DNA, 17 bp, Homo sapiens
cttatcagtttgctaat

SEQ ID NO: 4517073 - DNA, 12 bp, Homo sapiens
cttatctgcccc

SEQ ID NO: 4517074 - DNA, 13 bp, Homo sapiens
cttatctgcccct

SEQ ID NO: 4517075 - DNA, 18 bp, Homo sapiens
cttatctgcccctccccc

SEQ ID NO: 4517076 - DNA, 22 bp, Homo sapiens
cttatctgcccctcccccactt

SEQ ID NO: 4517077 - DNA, 14 bp, Homo sapiens
cttatcttatgcca

SEQ ID NO: 4517078 - DNA, 16 bp, Homo sapiens
cttatcttctggatta

SEQ ID NO: 4517079 - DNA, 17 bp, Homo sapiens
cttatctttattggctt

SEQ ID NO: 4517080 - DNA, 14 bp, Homo sapiens
cttatgccacggga

SEQ ID NO: 4517081 - DNA, 17 bp, Homo sapiens
cttatgcggttaatttt

SEQ ID NO: 4517082 - DNA, 14 bp, Homo sapiens
cttatggaattgat

SEQ ID NO: 4517083 - DNA, 19 bp, Homo sapiens
cttatggaattgatttgca

SEQ ID NO: 4517084 - DNA, 20 bp, Homo sapiens
cttatggaattgatttgcat

SEQ ID NO: 4517085 - DNA, 14 bp, Homo sapiens
cttatggactgttt

SEQ ID NO: 4517086 - DNA, 19 bp, Homo sapiens
cttatggactgttttgata

SEQ ID NO: 4517087 - DNA, 14 bp, Homo sapiens
cttatggggtgaga

SEQ ID NO: 4517088 - DNA, 15 bp, Homo sapiens
cttatgtacagaaaa

SEQ ID NO: 4517089 - DNA, 14 bp, Homo sapiens
cttatgtgttacat

SEQ ID NO: 4517090 - DNA, 15 bp, Homo sapiens
cttatgtgttacatt

SEQ ID NO: 4517091 - DNA, 17 bp, Homo sapiens
cttatgttgaaaaaatt

SEQ ID NO: 4517092 - DNA, 13 bp, Homo sapiens
cttattaaaaaat

SEQ ID NO: 4517093 - DNA, 16 bp, Homo sapiens
cttattacattttatt

SEQ ID NO: 4517094 - DNA, 17 bp, Homo sapiens
cttattagagtgtcttt

SEQ ID NO: 4517095 - DNA, 18 bp, Homo sapiens
cttattagctgtagagtc

SEQ ID NO: 4517096 - DNA, 22 bp, Homo sapiens
cttattcaaagatgataattta

SEQ ID NO: 4517097 - DNA, 21 bp, Homo sapiens
cttattccaggtattaaaggt

SEQ ID NO: 4517098 - DNA, 15 bp, Homo sapiens
cttattcctcagtga

SEQ ID NO: 4517099 - DNA, 23 bp, Homo sapiens
cttattgatattctaagaaatat

SEQ ID NO: 4517100 - DNA, 14 bp, Homo sapiens
cttattgctgattt

SEQ ID NO: 4517101 - DNA, 14 bp, Homo sapiens
cttattgcttagta

SEQ ID NO: 4517102 - DNA, 15 bp, Homo sapiens
cttattggaactctg

SEQ ID NO: 4517103 - DNA, 17 bp, Homo sapiens
cttattggaactctgct

SEQ ID NO: 4517104 - DNA, 19 bp, Homo sapiens
cttattgtattcctcatgt

SEQ ID NO: 4517105 - DNA, 15 bp, Homo sapiens
cttatttaactgatt

SEQ ID NO: 4517106 - DNA, 23 bp, Homo sapiens
cttatttacctataaaatgagat

SEQ ID NO: 4517107 - DNA, 12 bp, Homo sapiens
cttatttattta

SEQ ID NO: 4517108 - DNA, 17 bp, Homo sapiens
cttatttattttagcaa

SEQ ID NO: 4517109 - DNA, 23 bp, Homo sapiens
cttatttattttagcaaatcagt

SEQ ID NO: 4517110 - DNA, 12 bp, Homo sapiens
cttatttctcat

SEQ ID NO: 4517111 - DNA, 22 bp, Homo sapiens
cttatttgccttctactcccct

SEQ ID NO: 4517112 - DNA, 23 bp, Homo sapiens
cttatttgccttctactcccctt

SEQ ID NO: 4517113 - DNA, 16 bp, Homo sapiens
cttatttttagatggt

SEQ ID NO: 4517114 - DNA, 23 bp, Homo sapiens
cttatttttagatggttacactg

SEQ ID NO: 4517115 - DNA, 23 bp, Homo sapiens
cttatttttataacatctttatt

SEQ ID NO: 4517116 - DNA, 15 bp, Homo sapiens
cttatttttcctgtc

SEQ ID NO: 4517117 - DNA, 16 bp, Homo sapiens
cttatttttcctgtcc

SEQ ID NO: 4517118 - DNA, 18 bp, Homo sapiens
cttatttttcctgtcctg

SEQ ID NO: 4517119 - DNA, 14 bp, Homo sapiens
cttcaaaaataaaa

SEQ ID NO: 4517120 - DNA, 14 bp, Homo sapiens
cttcaaaatattga

SEQ ID NO: 4517121 - DNA, 20 bp, Homo sapiens
cttcaaagtctcaatgaaat

SEQ ID NO: 4517122 - DNA, 22 bp, Homo sapiens
cttcaaagtctcaatgaaatag

SEQ ID NO: 4517123 - DNA, 15 bp, Homo sapiens
cttcaaagtttaata

SEQ ID NO: 4517124 - DNA, 16 bp, Homo sapiens
cttcaaatatagagat

SEQ ID NO: 4517125 - DNA, 22 bp, Homo sapiens
cttcaaattcttcacatgttta

SEQ ID NO: 4517126 - DNA, 21 bp, Homo sapiens
cttcaaattttttaaaagaga

SEQ ID NO: 4517127 - DNA, 14 bp, Homo sapiens
cttcaacccagtgg

SEQ ID NO: 4517128 - DNA, 14 bp, Homo sapiens
cttcaactgcccag

SEQ ID NO: 4517129 - DNA, 18 bp, Homo sapiens
cttcaagaatcagaagaa

SEQ ID NO: 4517130 - DNA, 22 bp, Homo sapiens
cttcaagcatggctattttata

SEQ ID NO: 4517131 - DNA, 22 bp, Homo sapiens
cttcaagtgcatgctctctgca

SEQ ID NO: 4517132 - DNA, 15 bp, Homo sapiens
cttcaagtgccaaac

SEQ ID NO: 4517133 - DNA, 11 bp, Homo sapiens
cttcaataaac

SEQ ID NO: 4517134 - DNA, 23 bp, Homo sapiens
cttcaataaaccacaagcatctc

SEQ ID NO: 4517135 - DNA, 17 bp, Homo sapiens
cttcaatacttaaaaat

SEQ ID NO: 4517136 - DNA, 16 bp, Homo sapiens
cttcaatataagaagc

SEQ ID NO: 4517137 - DNA, 13 bp, Homo sapiens
cttcaatcccagc

SEQ ID NO: 4517138 - DNA, 15 bp, Homo sapiens
cttcaatgtgtcatt

SEQ ID NO: 4517139 - DNA, 20 bp, Homo sapiens
cttcaatgtgtcatttccgg

SEQ ID NO: 4517140 - DNA, 20 bp, Homo sapiens
cttcaatttattactgaaaa

SEQ ID NO: 4517141 - DNA, 20 bp, Homo sapiens
cttcaatttcaaacttttga

SEQ ID NO: 4517142 - DNA, 16 bp, Homo sapiens
cttcacaaaatgcact

SEQ ID NO: 4517143 - DNA, 12 bp, Homo sapiens
cttcacaacaga

SEQ ID NO: 4517144 - DNA, 12 bp, Homo sapiens
cttcacactgca

SEQ ID NO: 4517145 - DNA, 13 bp, Homo sapiens
cttcacactgcaa

SEQ ID NO: 4517146 - DNA, 15 bp, Homo sapiens
cttcacactgcaaga

SEQ ID NO: 4517147 - DNA, 19 bp, Homo sapiens
cttcaccaagtgcaataga

SEQ ID NO: 4517148 - DNA, 13 bp, Homo sapiens
cttcaccaccccc

SEQ ID NO: 4517149 - DNA, 19 bp, Homo sapiens
cttcaccaccccctgtccc

SEQ ID NO: 4517150 - DNA, 22 bp, Homo sapiens
cttcacccaccaggccagctca

SEQ ID NO: 4517151 - DNA, 17 bp, Homo sapiens
cttcacccgagttcctc

SEQ ID NO: 4517152 - DNA, 16 bp, Homo sapiens
cttcaccctcatcctt

SEQ ID NO: 4517153 - DNA, 14 bp, Homo sapiens
cttcacgtattctt

SEQ ID NO: 4517154 - DNA, 17 bp, Homo sapiens
cttcactcaaattttgg

SEQ ID NO: 4517155 - DNA, 22 bp, Homo sapiens
cttcactctgacagtattaaca

SEQ ID NO: 4517156 - DNA, 14 bp, Homo sapiens
cttcactgtatata

SEQ ID NO: 4517157 - DNA, 17 bp, Homo sapiens
cttcactgtatataaac

SEQ ID NO: 4517158 - DNA, 18 bp, Homo sapiens
cttcactgtcatcttcaa

SEQ ID NO: 4517159 - DNA, 21 bp, Homo sapiens
cttcacttacaagaaaggcct

SEQ ID NO: 4517160 - DNA, 16 bp, Homo sapiens
cttcagaactgccctt

SEQ ID NO: 4517161 - DNA, 22 bp, Homo sapiens
cttcagaccatcagttacagag

SEQ ID NO: 4517162 - DNA, 15 bp, Homo sapiens
cttcagactttgctt

SEQ ID NO: 4517163 - DNA, 23 bp, Homo sapiens
cttcagaggccctcgctgccagc

SEQ ID NO: 4517164 - DNA, 20 bp, Homo sapiens
cttcagatcagtgcttgagt

SEQ ID NO: 4517165 - DNA, 11 bp, Homo sapiens
cttcagcaacc

SEQ ID NO: 4517166 - DNA, 20 bp, Homo sapiens
cttcagcaagttagaactag

SEQ ID NO: 4517167 - DNA, 14 bp, Homo sapiens
cttcagcaggaggc

SEQ ID NO: 4517168 - DNA, 17 bp, Homo sapiens
cttcagccctcacccct

SEQ ID NO: 4517169 - DNA, 14 bp, Homo sapiens
cttcaggactctgc

SEQ ID NO: 4517170 - DNA, 15 bp, Homo sapiens
cttcaggactctgcg

SEQ ID NO: 4517171 - DNA, 12 bp, Homo sapiens
cttcaggcctcc

SEQ ID NO: 4517172 - DNA, 15 bp, Homo sapiens
cttcagggctgagtt

SEQ ID NO: 4517173 - DNA, 15 bp, Homo sapiens
cttcaggtaacacta

SEQ ID NO: 4517174 - DNA, 18 bp, Homo sapiens
cttcaggtggagagcact

SEQ ID NO: 4517175 - DNA, 14 bp, Homo sapiens
cttcaggtgtgact

SEQ ID NO: 4517176 - DNA, 13 bp, Homo sapiens
cttcagtcattaa

SEQ ID NO: 4517177 - DNA, 16 bp, Homo sapiens
cttcagtgagcccctc

SEQ ID NO: 4517178 - DNA, 17 bp, Homo sapiens
cttcagtgagcccctcc

SEQ ID NO: 4517179 - DNA, 18 bp, Homo sapiens
cttcagtgagcccctccc

SEQ ID NO: 4517180 - DNA, 17 bp, Homo sapiens
cttcagtgcccaccaac

SEQ ID NO: 4517181 - DNA, 23 bp, Homo sapiens
cttcagtggaccgaaatctgtat

SEQ ID NO: 4517182 - DNA, 15 bp, Homo sapiens
cttcagtttcacaga

SEQ ID NO: 4517183 - DNA, 21 bp, Homo sapiens
cttcatacagaaggcaacagg

SEQ ID NO: 4517184 - DNA, 20 bp, Homo sapiens
cttcatatcatactgttttg

SEQ ID NO: 4517185 - DNA, 20 bp, Homo sapiens
cttcatatgaaaggtgccat

SEQ ID NO: 4517186 - DNA, 20 bp, Homo sapiens
cttcatatgtcacctttgct

SEQ ID NO: 4517187 - DNA, 13 bp, Homo sapiens
cttcatattggct

SEQ ID NO: 4517188 - DNA, 13 bp, Homo sapiens
cttcatccataga

SEQ ID NO: 4517189 - DNA, 18 bp, Homo sapiens
cttcatccatagacacag

SEQ ID NO: 4517190 - DNA, 15 bp, Homo sapiens
cttcatgaaatgtgt

SEQ ID NO: 4517191 - DNA, 10 bp, Homo sapiens
cttcatggat

SEQ ID NO: 4517192 - DNA, 15 bp, Homo sapiens
cttcatggcagaagg

SEQ ID NO: 4517193 - DNA, 14 bp, Homo sapiens
cttcattctcgtga

SEQ ID NO: 4517194 - DNA, 12 bp, Homo sapiens
cttcatttaaaa

SEQ ID NO: 4517195 - DNA, 18 bp, Homo sapiens
cttcatttaactctttga

SEQ ID NO: 4517196 - DNA, 21 bp, Homo sapiens
cttcatttctctttttatctc

SEQ ID NO: 4517197 - DNA, 22 bp, Homo sapiens
cttcattttagattaagctttt

SEQ ID NO: 4517198 - DNA, 16 bp, Homo sapiens
cttccaaatcctggaa

SEQ ID NO: 4517199 - DNA, 23 bp, Homo sapiens
cttccacaaagaaaattcctata

SEQ ID NO: 4517200 - DNA, 18 bp, Homo sapiens
cttccacagctggcctgg

SEQ ID NO: 4517201 - DNA, 14 bp, Homo sapiens
cttccacagtggcg

SEQ ID NO: 4517202 - DNA, 23 bp, Homo sapiens
cttccacccgtctctctgcccac

SEQ ID NO: 4517203 - DNA, 16 bp, Homo sapiens
cttccactgtgcacct

SEQ ID NO: 4517204 - DNA, 20 bp, Homo sapiens
cttccagatgcccgagcacc

SEQ ID NO: 4517205 - DNA, 12 bp, Homo sapiens
cttccagatttt

SEQ ID NO: 4517206 - DNA, 18 bp, Homo sapiens
cttccagattttaaattt

SEQ ID NO: 4517207 - DNA, 23 bp, Homo sapiens
cttccagattttaaattttatgt

SEQ ID NO: 4517208 - DNA, 21 bp, Homo sapiens
cttccagccacattgagactt

SEQ ID NO: 4517209 - DNA, 19 bp, Homo sapiens
cttccaggaaactccacat

SEQ ID NO: 4517210 - DNA, 21 bp, Homo sapiens
cttccaggctgagagccggcc

SEQ ID NO: 4517211 - DNA, 15 bp, Homo sapiens
cttccaggggaacct

SEQ ID NO: 4517212 - DNA, 16 bp, Homo sapiens
cttccaggggaacctg

SEQ ID NO: 4517213 - DNA, 16 bp, Homo sapiens
cttccaggtgttactg

SEQ ID NO: 4517214 - DNA, 18 bp, Homo sapiens
cttccatcatcactgtaa

SEQ ID NO: 4517215 - DNA, 17 bp, Homo sapiens
cttccatctagtcacaa

SEQ ID NO: 4517216 - DNA, 21 bp, Homo sapiens
cttccatgcctgtagctttcc

SEQ ID NO: 4517217 - DNA, 16 bp, Homo sapiens
cttccatgttctgggt

SEQ ID NO: 4517218 - DNA, 15 bp, Homo sapiens
cttcccaaaaacagc

SEQ ID NO: 4517219 - DNA, 14 bp, Homo sapiens
cttcccacatgcct

SEQ ID NO: 4517220 - DNA, 15 bp, Homo sapiens
cttcccactcacccc

SEQ ID NO: 4517221 - DNA, 20 bp, Homo sapiens
cttcccagctctccctctgg

SEQ ID NO: 4517222 - DNA, 15 bp, Homo sapiens
cttcccagggcaccc

SEQ ID NO: 4517223 - DNA, 21 bp, Homo sapiens
cttcccagggcacccaggcag

SEQ ID NO: 4517224 - DNA, 21 bp, Homo sapiens
cttcccagggtagcccgcctg

SEQ ID NO: 4517225 - DNA, 14 bp, Homo sapiens
cttcccatgccggt

SEQ ID NO: 4517226 - DNA, 22 bp, Homo sapiens
cttcccatgccggtacacagcc

SEQ ID NO: 4517227 - DNA, 16 bp, Homo sapiens
cttcccatgtcccacc

SEQ ID NO: 4517228 - DNA, 22 bp, Homo sapiens
cttcccattaaaaatgagattt

SEQ ID NO: 4517229 - DNA, 16 bp, Homo sapiens
cttcccatttcttccc

SEQ ID NO: 4517230 - DNA, 15 bp, Homo sapiens
cttccccagacccag

SEQ ID NO: 4517231 - DNA, 16 bp, Homo sapiens
cttccccagacccaga

SEQ ID NO: 4517232 - DNA, 20 bp, Homo sapiens
cttccccagacccagaggtc

SEQ ID NO: 4517233 - DNA, 21 bp, Homo sapiens
cttccccagacccagaggtcc

SEQ ID NO: 4517234 - DNA, 19 bp, Homo sapiens
cttccccagggtgtctcta

SEQ ID NO: 4517235 - DNA, 21 bp, Homo sapiens
cttccccagggtgtctctatg

SEQ ID NO: 4517236 - DNA, 18 bp, Homo sapiens
cttccccatcttctaaac

SEQ ID NO: 4517237 - DNA, 14 bp, Homo sapiens
cttccccatgggaa

SEQ ID NO: 4517238 - DNA, 23 bp, Homo sapiens
cttcccccatccctaccactgtg

SEQ ID NO: 4517239 - DNA, 21 bp, Homo sapiens
cttcccctgaggacctttctg

SEQ ID NO: 4517240 - DNA, 13 bp, Homo sapiens
cttcccctgctga

SEQ ID NO: 4517241 - DNA, 14 bp, Homo sapiens
cttccccttccctt

SEQ ID NO: 4517242 - DNA, 20 bp, Homo sapiens
cttcccggcccccggccaag

SEQ ID NO: 4517243 - DNA, 22 bp, Homo sapiens
cttcccggcccccggccaagga

SEQ ID NO: 4517244 - DNA, 15 bp, Homo sapiens
cttccctacctcagg

SEQ ID NO: 4517245 - DNA, 17 bp, Homo sapiens
cttccctacctcaggca

SEQ ID NO: 4517246 - DNA, 20 bp, Homo sapiens
cttccctacctcaggcagga

SEQ ID NO: 4517247 - DNA, 23 bp, Homo sapiens
cttccctagctttagaccctggg

SEQ ID NO: 4517248 - DNA, 13 bp, Homo sapiens
cttccctctctcc

SEQ ID NO: 4517249 - DNA, 16 bp, Homo sapiens
cttccctctctccctg

SEQ ID NO: 4517250 - DNA, 18 bp, Homo sapiens
cttccctctctccctgcc

SEQ ID NO: 4517251 - DNA, 12 bp, Homo sapiens
cttccctctctg

SEQ ID NO: 4517252 - DNA, 20 bp, Homo sapiens
cttccctctctgatgtccca

SEQ ID NO: 4517253 - DNA, 16 bp, Homo sapiens
cttccctctgggcacg

SEQ ID NO: 4517254 - DNA, 17 bp, Homo sapiens
cttccctgacttgcttt

SEQ ID NO: 4517255 - DNA, 18 bp, Homo sapiens
cttccctgacttgcttta

SEQ ID NO: 4517256 - DNA, 19 bp, Homo sapiens
cttccctgatggcctttgg

SEQ ID NO: 4517257 - DNA, 20 bp, Homo sapiens
cttccctgatggcctttgga

SEQ ID NO: 4517258 - DNA, 22 bp, Homo sapiens
cttccctgatggcctttggacc

SEQ ID NO: 4517259 - DNA, 12 bp, Homo sapiens
cttccctgcttc

SEQ ID NO: 4517260 - DNA, 13 bp, Homo sapiens
cttccctgcttca

SEQ ID NO: 4517261 - DNA, 10 bp, Homo sapiens
cttccctggc

SEQ ID NO: 4517262 - DNA, 12 bp, Homo sapiens
cttccctggctt

SEQ ID NO: 4517263 - DNA, 13 bp, Homo sapiens
cttccctgtccca

SEQ ID NO: 4517264 - DNA, 19 bp, Homo sapiens
cttccctgttctccctttc

SEQ ID NO: 4517265 - DNA, 21 bp, Homo sapiens
cttcccttagcctctcccacc

SEQ ID NO: 4517266 - DNA, 13 bp, Homo sapiens
cttccgacaggag

SEQ ID NO: 4517267 - DNA, 12 bp, Homo sapiens
cttccgctgagg

SEQ ID NO: 4517268 - DNA, 14 bp, Homo sapiens
cttccgctgagggg

SEQ ID NO: 4517269 - DNA, 23 bp, Homo sapiens
cttccgtggtcagagtgccactg

SEQ ID NO: 4517270 - DNA, 19 bp, Homo sapiens
cttcctaccaagtcaaact

SEQ ID NO: 4517271 - DNA, 23 bp, Homo sapiens
cttcctacccacacctctgccag

SEQ ID NO: 4517272 - DNA, 16 bp, Homo sapiens
cttcctaccctgcctc

SEQ ID NO: 4517273 - DNA, 22 bp, Homo sapiens
cttcctattccaagcttccata

SEQ ID NO: 4517274 - DNA, 14 bp, Homo sapiens
cttcctcaaataca

SEQ ID NO: 4517275 - DNA, 19 bp, Homo sapiens
cttcctcaaatacatgcac

SEQ ID NO: 4517276 - DNA, 20 bp, Homo sapiens
cttcctcaaatacatgcaca

SEQ ID NO: 4517277 - DNA, 22 bp, Homo sapiens
cttcctcaaatacatgcacagt

SEQ ID NO: 4517278 - DNA, 12 bp, Homo sapiens
cttcctcccaag

SEQ ID NO: 4517279 - DNA, 20 bp, Homo sapiens
cttcctccgaggccagtacc

SEQ ID NO: 4517280 - DNA, 21 bp, Homo sapiens
cttcctccgaggccagtacct

SEQ ID NO: 4517281 - DNA, 13 bp, Homo sapiens
cttcctcctcagg

SEQ ID NO: 4517282 - DNA, 22 bp, Homo sapiens
cttcctcctgcagacacctgga

SEQ ID NO: 4517283 - DNA, 19 bp, Homo sapiens
cttcctctagaagccaagg

SEQ ID NO: 4517284 - DNA, 19 bp, Homo sapiens
cttcctctcctgtctccct

SEQ ID NO: 4517285 - DNA, 15 bp, Homo sapiens
cttcctctctcctta

SEQ ID NO: 4517286 - DNA, 21 bp, Homo sapiens
cttcctctggtaaacattcct

SEQ ID NO: 4517287 - DNA, 12 bp, Homo sapiens
cttcctctgtga

SEQ ID NO: 4517288 - DNA, 15 bp, Homo sapiens
cttcctgagctttat

SEQ ID NO: 4517289 - DNA, 21 bp, Homo sapiens
cttcctgcgtcctcctcacct

SEQ ID NO: 4517290 - DNA, 17 bp, Homo sapiens
cttcctgctgctgctac

SEQ ID NO: 4517291 - DNA, 22 bp, Homo sapiens
cttcctgctgctgctactgctg

SEQ ID NO: 4517292 - DNA, 20 bp, Homo sapiens
cttcctggaacttgctctca

SEQ ID NO: 4517293 - DNA, 21 bp, Homo sapiens
cttcctggaacttgctctcat

SEQ ID NO: 4517294 - DNA, 14 bp, Homo sapiens
cttcctggagactg

SEQ ID NO: 4517295 - DNA, 22 bp, Homo sapiens
cttcctggagactgcccagcta

SEQ ID NO: 4517296 - DNA, 16 bp, Homo sapiens
cttcctggagcccaga

SEQ ID NO: 4517297 - DNA, 17 bp, Homo sapiens
cttcctggagcccagag

SEQ ID NO: 4517298 - DNA, 17 bp, Homo sapiens
cttcctgggtgttagaa

SEQ ID NO: 4517299 - DNA, 15 bp, Homo sapiens
cttcctgtccctgag

SEQ ID NO: 4517300 - DNA, 16 bp, Homo sapiens
cttcctgtccctgagg

SEQ ID NO: 4517301 - DNA, 12 bp, Homo sapiens
cttcctgtctca

SEQ ID NO: 4517302 - DNA, 15 bp, Homo sapiens
cttcctgtctcactc

SEQ ID NO: 4517303 - DNA, 16 bp, Homo sapiens
cttcctgtctcactct

SEQ ID NO: 4517304 - DNA, 15 bp, Homo sapiens
cttcctgtctgttta

SEQ ID NO: 4517305 - DNA, 16 bp, Homo sapiens
cttcctgtctgtttat

SEQ ID NO: 4517306 - DNA, 14 bp, Homo sapiens
cttcctgtggcctg

SEQ ID NO: 4517307 - DNA, 22 bp, Homo sapiens
cttcctgtgtaacatctgccat

SEQ ID NO: 4517308 - DNA, 22 bp, Homo sapiens
cttcctgtttaaaaaaccacat

SEQ ID NO: 4517309 - DNA, 18 bp, Homo sapiens
cttcctgtttttcacatt

SEQ ID NO: 4517310 - DNA, 12 bp, Homo sapiens
cttccttcagga

SEQ ID NO: 4517311 - DNA, 22 bp, Homo sapiens
cttccttcaggactctgcggga

SEQ ID NO: 4517312 - DNA, 14 bp, Homo sapiens
cttccttccctggc

SEQ ID NO: 4517313 - DNA, 14 bp, Homo sapiens
cttccttcctctcc

SEQ ID NO: 4517314 - DNA, 22 bp, Homo sapiens
cttccttgacctgcattgtaaa

SEQ ID NO: 4517315 - DNA, 23 bp, Homo sapiens
cttccttgacctgcattgtaaat

SEQ ID NO: 4517316 - DNA, 19 bp, Homo sapiens
cttccttggactcatttta

SEQ ID NO: 4517317 - DNA, 15 bp, Homo sapiens
cttcctttgaaagac

SEQ ID NO: 4517318 - DNA, 17 bp, Homo sapiens
cttccttttatcagtag

SEQ ID NO: 4517319 - DNA, 15 bp, Homo sapiens
cttccttttccctgc

SEQ ID NO: 4517320 - DNA, 17 bp, Homo sapiens
cttccttttccctgctt

SEQ ID NO: 4517321 - DNA, 14 bp, Homo sapiens
cttcgaggacagga

SEQ ID NO: 4517322 - DNA, 22 bp, Homo sapiens
cttcggagggaaattgtaaatc

SEQ ID NO: 4517323 - DNA, 16 bp, Homo sapiens
cttcggccacaggcag

SEQ ID NO: 4517324 - DNA, 16 bp, Homo sapiens
cttcgggcccttccca

SEQ ID NO: 4517325 - DNA, 14 bp, Homo sapiens
cttcgtaacttcat

SEQ ID NO: 4517326 - DNA, 21 bp, Homo sapiens
cttcgtaagaaggaatgcgag

SEQ ID NO: 4517327 - DNA, 21 bp, Homo sapiens
cttcgttagtaatctgtataa

SEQ ID NO: 4517328 - DNA, 17 bp, Homo sapiens
cttcgttcgcagagctt

SEQ ID NO: 4517329 - DNA, 21 bp, Homo sapiens
cttcgttggtgaccagtttct

SEQ ID NO: 4517330 - DNA, 23 bp, Homo sapiens
cttcgttggtgaccagtttctta

SEQ ID NO: 4517331 - DNA, 22 bp, Homo sapiens
cttctaaacttccccatcttct

SEQ ID NO: 4517332 - DNA, 15 bp, Homo sapiens
cttctaaatgcccag

SEQ ID NO: 4517333 - DNA, 13 bp, Homo sapiens
cttctaagaagac

SEQ ID NO: 4517334 - DNA, 16 bp, Homo sapiens
cttctaagaagacatt

SEQ ID NO: 4517335 - DNA, 20 bp, Homo sapiens
cttctaagaagacattttgt

SEQ ID NO: 4517336 - DNA, 13 bp, Homo sapiens
cttctaagtaaaa

SEQ ID NO: 4517337 - DNA, 13 bp, Homo sapiens
cttctacactctc

SEQ ID NO: 4517338 - DNA, 12 bp, Homo sapiens
cttctacccaga

SEQ ID NO: 4517339 - DNA, 17 bp, Homo sapiens
cttctacctacatattt

SEQ ID NO: 4517340 - DNA, 14 bp, Homo sapiens
cttctacctgccac

SEQ ID NO: 4517341 - DNA, 14 bp, Homo sapiens
cttctacctgccct

SEQ ID NO: 4517342 - DNA, 19 bp, Homo sapiens
cttctacctgccctcaagg

SEQ ID NO: 4517343 - DNA, 15 bp, Homo sapiens
cttctactcccctta

SEQ ID NO: 4517344 - DNA, 17 bp, Homo sapiens
cttctacttgtaaaatg

SEQ ID NO: 4517345 - DNA, 19 bp, Homo sapiens
cttctacttgtaaaatgct

SEQ ID NO: 4517346 - DNA, 13 bp, Homo sapiens
cttctactttcat

SEQ ID NO: 4517347 - DNA, 16 bp, Homo sapiens
cttctactttcatctt

SEQ ID NO: 4517348 - DNA, 13 bp, Homo sapiens
cttctagagctta

SEQ ID NO: 4517349 - DNA, 20 bp, Homo sapiens
cttctagatggaccccagca

SEQ ID NO: 4517350 - DNA, 20 bp, Homo sapiens
cttctaggagtcaactggct

SEQ ID NO: 4517351 - DNA, 23 bp, Homo sapiens
cttctaggagtcaactggctggc

SEQ ID NO: 4517352 - DNA, 22 bp, Homo sapiens
cttctaggatagctaactgtaa

SEQ ID NO: 4517353 - DNA, 18 bp, Homo sapiens
cttctagtgcttttcagt

SEQ ID NO: 4517354 - DNA, 16 bp, Homo sapiens
cttctagttctgccag

SEQ ID NO: 4517355 - DNA, 18 bp, Homo sapiens
cttctagttctgccagga

SEQ ID NO: 4517356 - DNA, 17 bp, Homo sapiens
cttctatacccacccag

SEQ ID NO: 4517357 - DNA, 13 bp, Homo sapiens
cttctatgtatta

SEQ ID NO: 4517358 - DNA, 18 bp, Homo sapiens
cttctattaacaaattat

SEQ ID NO: 4517359 - DNA, 18 bp, Homo sapiens
cttctattaatcaagaga

SEQ ID NO: 4517360 - DNA, 13 bp, Homo sapiens
cttctattctagc

SEQ ID NO: 4517361 - DNA, 13 bp, Homo sapiens
cttctatttagcc

SEQ ID NO: 4517362 - DNA, 22 bp, Homo sapiens
cttctatttatttatttattca

SEQ ID NO: 4517363 - DNA, 14 bp, Homo sapiens
cttctcaccagctg

SEQ ID NO: 4517364 - DNA, 15 bp, Homo sapiens
cttctcaccagctgc

SEQ ID NO: 4517365 - DNA, 16 bp, Homo sapiens
cttctcaccagctgca

SEQ ID NO: 4517366 - DNA, 17 bp, Homo sapiens
cttctcaccagctgcaa

SEQ ID NO: 4517367 - DNA, 21 bp, Homo sapiens
cttctcaccagctgcaaagtg

SEQ ID NO: 4517368 - DNA, 19 bp, Homo sapiens
cttctcacgctttgtttac

SEQ ID NO: 4517369 - DNA, 21 bp, Homo sapiens
cttctcacgctttgtttactc

SEQ ID NO: 4517370 - DNA, 13 bp, Homo sapiens
cttctcagaagca

SEQ ID NO: 4517371 - DNA, 14 bp, Homo sapiens
cttctcagatttct

SEQ ID NO: 4517372 - DNA, 19 bp, Homo sapiens
cttctcataggtgtccagc

SEQ ID NO: 4517373 - DNA, 16 bp, Homo sapiens
cttctcatcttgtgaa

SEQ ID NO: 4517374 - DNA, 14 bp, Homo sapiens
cttctcatttcacc

SEQ ID NO: 4517375 - DNA, 15 bp, Homo sapiens
cttctcatttcaccc

SEQ ID NO: 4517376 - DNA, 20 bp, Homo sapiens
cttctcattttttaaaaaag

SEQ ID NO: 4517377 - DNA, 21 bp, Homo sapiens
cttctccaaaaatctgcctgg

SEQ ID NO: 4517378 - DNA, 19 bp, Homo sapiens
cttctccaacaagttgcct

SEQ ID NO: 4517379 - DNA, 21 bp, Homo sapiens
cttctccaacaagttgcctcc

SEQ ID NO: 4517380 - DNA, 14 bp, Homo sapiens
cttctccatccaca

SEQ ID NO: 4517381 - DNA, 16 bp, Homo sapiens
cttctccatccacatg

SEQ ID NO: 4517382 - DNA, 14 bp, Homo sapiens
cttctccatctggc

SEQ ID NO: 4517383 - DNA, 16 bp, Homo sapiens
cttctcccacatgagg

SEQ ID NO: 4517384 - DNA, 17 bp, Homo sapiens
cttctcccatctcttcc

SEQ ID NO: 4517385 - DNA, 13 bp, Homo sapiens
cttctccccagaa

SEQ ID NO: 4517386 - DNA, 20 bp, Homo sapiens
cttctcccccacggtatcct

SEQ ID NO: 4517387 - DNA, 19 bp, Homo sapiens
cttctccccgcagcccgcc

SEQ ID NO: 4517388 - DNA, 15 bp, Homo sapiens
cttctccgccagcct

SEQ ID NO: 4517389 - DNA, 16 bp, Homo sapiens
cttctccgccagcctc

SEQ ID NO: 4517390 - DNA, 21 bp, Homo sapiens
cttctccttagacactttgga

SEQ ID NO: 4517391 - DNA, 23 bp, Homo sapiens
cttctcgctgcgcagcctccagg

SEQ ID NO: 4517392 - DNA, 18 bp, Homo sapiens
cttctcggggtgggacag

SEQ ID NO: 4517393 - DNA, 22 bp, Homo sapiens
cttctcgtgtttgcttaaaata

SEQ ID NO: 4517394 - DNA, 18 bp, Homo sapiens
cttctctataaaaaatat

SEQ ID NO: 4517395 - DNA, 14 bp, Homo sapiens
cttctctcatctct

SEQ ID NO: 4517396 - DNA, 15 bp, Homo sapiens
cttctctccagctga

SEQ ID NO: 4517397 - DNA, 17 bp, Homo sapiens
cttctctccagctgact

SEQ ID NO: 4517398 - DNA, 19 bp, Homo sapiens
cttctctccagctgactaa

SEQ ID NO: 4517399 - DNA, 14 bp, Homo sapiens
cttctctccccagc

SEQ ID NO: 4517400 - DNA, 15 bp, Homo sapiens
cttctctccccagcc

SEQ ID NO: 4517401 - DNA, 17 bp, Homo sapiens
cttctctccccagcccc

SEQ ID NO: 4517402 - DNA, 13 bp, Homo sapiens
cttctctcctccc

SEQ ID NO: 4517403 - DNA, 21 bp, Homo sapiens
cttctctgcagtaaaacacat

SEQ ID NO: 4517404 - DNA, 22 bp, Homo sapiens
cttctctgctccaccacatcct

SEQ ID NO: 4517405 - DNA, 21 bp, Homo sapiens
cttctctgttcccttgcaggg

SEQ ID NO: 4517406 - DNA, 19 bp, Homo sapiens
cttctcttaaacttgtgaa

SEQ ID NO: 4517407 - DNA, 20 bp, Homo sapiens
cttctcttaaacttgtgaat

SEQ ID NO: 4517408 - DNA, 22 bp, Homo sapiens
cttctcttccttttatcagtag

SEQ ID NO: 4517409 - DNA, 15 bp, Homo sapiens
cttctctttgtgcag

SEQ ID NO: 4517410 - DNA, 17 bp, Homo sapiens
cttctgaactcaaactg

SEQ ID NO: 4517411 - DNA, 18 bp, Homo sapiens
cttctgaataaagcaatt

SEQ ID NO: 4517412 - DNA, 22 bp, Homo sapiens
cttctgaataaagcaattagca

SEQ ID NO: 4517413 - DNA, 20 bp, Homo sapiens
cttctgactgccccctcctg

SEQ ID NO: 4517414 - DNA, 13 bp, Homo sapiens
cttctgagcaggg

SEQ ID NO: 4517415 - DNA, 16 bp, Homo sapiens
cttctgagctatttca

SEQ ID NO: 4517416 - DNA, 18 bp, Homo sapiens
cttctgagctatttcatc

SEQ ID NO: 4517417 - DNA, 20 bp, Homo sapiens
cttctgagctatttcatcta

SEQ ID NO: 4517418 - DNA, 18 bp, Homo sapiens
cttctgcaagcctcatgc

SEQ ID NO: 4517419 - DNA, 20 bp, Homo sapiens
cttctgcagcaactcccacg

SEQ ID NO: 4517420 - DNA, 17 bp, Homo sapiens
cttctgccaccagcccc

SEQ ID NO: 4517421 - DNA, 18 bp, Homo sapiens
cttctgccaccagcccct

SEQ ID NO: 4517422 - DNA, 14 bp, Homo sapiens
cttctgcctgttat

SEQ ID NO: 4517423 - DNA, 17 bp, Homo sapiens
cttctgctccacccttg

SEQ ID NO: 4517424 - DNA, 19 bp, Homo sapiens
cttctgctccacccttggc

SEQ ID NO: 4517425 - DNA, 17 bp, Homo sapiens
cttctgctcttttcctg

SEQ ID NO: 4517426 - DNA, 13 bp, Homo sapiens
cttctgctgcatc

SEQ ID NO: 4517427 - DNA, 11 bp, Homo sapiens
cttctgctgct

SEQ ID NO: 4517428 - DNA, 12 bp, Homo sapiens
cttctgctgctg

SEQ ID NO: 4517429 - DNA, 14 bp, Homo sapiens
cttctggcctagga

SEQ ID NO: 4517430 - DNA, 19 bp, Homo sapiens
cttctggctacctgtttga

SEQ ID NO: 4517431 - DNA, 19 bp, Homo sapiens
cttctgggagggcagcagg

SEQ ID NO: 4517432 - DNA, 23 bp, Homo sapiens
cttctgggagggcagcagggcta

SEQ ID NO: 4517433 - DNA, 15 bp, Homo sapiens
cttctgggctttttc

SEQ ID NO: 4517434 - DNA, 14 bp, Homo sapiens
cttctggggcaggc

SEQ ID NO: 4517435 - DNA, 15 bp, Homo sapiens
cttctggggcaggct

SEQ ID NO: 4517436 - DNA, 21 bp, Homo sapiens
cttctggggcaggctgggcca

SEQ ID NO: 4517437 - DNA, 18 bp, Homo sapiens
cttctgggtccagggagg

SEQ ID NO: 4517438 - DNA, 15 bp, Homo sapiens
cttctgggtgtgctt

SEQ ID NO: 4517439 - DNA, 18 bp, Homo sapiens
cttctgtagtttttaatt

SEQ ID NO: 4517440 - DNA, 20 bp, Homo sapiens
cttctgtagtttttaattaa

SEQ ID NO: 4517441 - DNA, 14 bp, Homo sapiens
cttctgtctccagc

SEQ ID NO: 4517442 - DNA, 22 bp, Homo sapiens
cttctgtcttcacaacagatta

SEQ ID NO: 4517443 - DNA, 17 bp, Homo sapiens
cttctgtcttgtcccca

SEQ ID NO: 4517444 - DNA, 19 bp, Homo sapiens
cttctgtgagacccccaca

SEQ ID NO: 4517445 - DNA, 13 bp, Homo sapiens
cttctgtttctag

SEQ ID NO: 4517446 - DNA, 14 bp, Homo sapiens
cttctgtttctagt

SEQ ID NO: 4517447 - DNA, 22 bp, Homo sapiens
cttcttagagttttattccttt

SEQ ID NO: 4517448 - DNA, 23 bp, Homo sapiens
cttcttagagttttattcctttc

SEQ ID NO: 4517449 - DNA, 19 bp, Homo sapiens
cttcttataacttgtaagt

SEQ ID NO: 4517450 - DNA, 22 bp, Homo sapiens
cttcttatggaattgatttgca

SEQ ID NO: 4517451 - DNA, 17 bp, Homo sapiens
cttcttattctcactcc

SEQ ID NO: 4517452 - DNA, 21 bp, Homo sapiens
cttcttcatccatagacacag

SEQ ID NO: 4517453 - DNA, 23 bp, Homo sapiens
cttcttcatccatagacacagta

SEQ ID NO: 4517454 - DNA, 20 bp, Homo sapiens
cttcttccccaggtccttcc

SEQ ID NO: 4517455 - DNA, 13 bp, Homo sapiens
cttcttcctgtga

SEQ ID NO: 4517456 - DNA, 20 bp, Homo sapiens
cttcttcggggaactcctgg

SEQ ID NO: 4517457 - DNA, 19 bp, Homo sapiens
cttcttggagctttggaat

SEQ ID NO: 4517458 - DNA, 20 bp, Homo sapiens
cttcttgggcccggtccaca

SEQ ID NO: 4517459 - DNA, 10 bp, Homo sapiens
ctttcatttt

SEQ ID NO: 4517460 - DNA, 16 bp, Homo sapiens
ctttccaatgccacag

SEQ ID NO: 4517461 - DNA, 18 bp, Homo sapiens
ctttccaatgccacagac

SEQ ID NO: 4517462 - DNA, 21 bp, Homo sapiens
ctttccacggagccactcctc

SEQ ID NO: 4517463 - DNA, 12 bp, Homo sapiens
ctttccagctca

SEQ ID NO: 4517464 - DNA, 23 bp, Homo sapiens
ctttccaggggccaattttggat

SEQ ID NO: 4517465 - DNA, 18 bp, Homo sapiens
ctttccattggatctcat

SEQ ID NO: 4517466 - DNA, 19 bp, Homo sapiens
ctttccatttttttcttta

SEQ ID NO: 4517467 - DNA, 17 bp, Homo sapiens
ctttcccaacacctctt

SEQ ID NO: 4517468 - DNA, 19 bp, Homo sapiens
ctttcccaggtaatttaaa

SEQ ID NO: 4517469 - DNA, 19 bp, Homo sapiens
ctttcccatgtatttgtta

SEQ ID NO: 4517470 - DNA, 23 bp, Homo sapiens
ctttccccaattacagggtgact

SEQ ID NO: 4517471 - DNA, 11 bp, Homo sapiens
ctttccccaga

SEQ ID NO: 4517472 - DNA, 22 bp, Homo sapiens
ctttccccagcagtttctgtcc

SEQ ID NO: 4517473 - DNA, 18 bp, Homo sapiens
ctttccctcaccccctcc

SEQ ID NO: 4517474 - DNA, 13 bp, Homo sapiens
ctttccctgcctc

SEQ ID NO: 4517475 - DNA, 15 bp, Homo sapiens
ctttccgctgtcgcc

SEQ ID NO: 4517476 - DNA, 19 bp, Homo sapiens
ctttccgctgtcgccccag

SEQ ID NO: 4517477 - DNA, 20 bp, Homo sapiens
ctttccgctgtcgccccagg

SEQ ID NO: 4517478 - DNA, 21 bp, Homo sapiens
ctttcctaaagtctctgctgc

SEQ ID NO: 4517479 - DNA, 17 bp, Homo sapiens
ctttcctatctagcatt

SEQ ID NO: 4517480 - DNA, 17 bp, Homo sapiens
ctttcctcaaaaagcag

SEQ ID NO: 4517481 - DNA, 13 bp, Homo sapiens
ctttcctcacatt

SEQ ID NO: 4517482 - DNA, 14 bp, Homo sapiens
ctttcctcctttcc

SEQ ID NO: 4517483 - DNA, 15 bp, Homo sapiens
ctttcctgaatccaa

SEQ ID NO: 4517484 - DNA, 22 bp, Homo sapiens
ctttcctgccctgtccaaaagc

SEQ ID NO: 4517485 - DNA, 13 bp, Homo sapiens
ctttcctgggcct

SEQ ID NO: 4517486 - DNA, 17 bp, Homo sapiens
ctttcctgggcctttgc

SEQ ID NO: 4517487 - DNA, 14 bp, Homo sapiens
ctttctagtttgtt

SEQ ID NO: 4517488 - DNA, 20 bp, Homo sapiens
ctttctatatcttcttataa

SEQ ID NO: 4517489 - DNA, 16 bp, Homo sapiens
ctttctattgtacaga

SEQ ID NO: 4517490 - DNA, 17 bp, Homo sapiens
ctttctcacccaggcaa

SEQ ID NO: 4517491 - DNA, 17 bp, Homo sapiens
ctttctcactaaatctt

SEQ ID NO: 4517492 - DNA, 12 bp, Homo sapiens
ctttctcagagg

SEQ ID NO: 4517493 - DNA, 24 bp, Homo sapiens
ctttctcccctgcccccaggactg

SEQ ID NO: 4517494 - DNA, 11 bp, Homo sapiens
ctttctcctgt

SEQ ID NO: 4517495 - DNA, 15 bp, Homo sapiens
ctttctctcctttct

SEQ ID NO: 4517496 - DNA, 15 bp, Homo sapiens
ctttctctctcctct

SEQ ID NO: 4517497 - DNA, 16 bp, Homo sapiens
ctttctctctcttttt

SEQ ID NO: 4517498 - DNA, 22 bp, Homo sapiens
ctttctctctttccatctccct

SEQ ID NO: 4517499 - DNA, 10 bp, Homo sapiens
ctttctctgg

SEQ ID NO: 4517500 - DNA, 20 bp, Homo sapiens
ctttctctggtggtcttcct

SEQ ID NO: 4517501 - DNA, 19 bp, Homo sapiens
ctttctcttccttttatat

SEQ ID NO: 4517502 - DNA, 19 bp, Homo sapiens
ctttctgagtgccttctgt

SEQ ID NO: 4517503 - DNA, 12 bp, Homo sapiens
ctttctggactg

SEQ ID NO: 4517504 - DNA, 13 bp, Homo sapiens
ctttctggactgg

SEQ ID NO: 4517505 - DNA, 19 bp, Homo sapiens
ctttctgtatatacttttt

SEQ ID NO: 4517506 - DNA, 22 bp, Homo sapiens
ctttctgtctaggttaaagcta

SEQ ID NO: 4517507 - DNA, 15 bp, Homo sapiens
ctttctgtgcttgga

SEQ ID NO: 4517508 - DNA, 16 bp, Homo sapiens
ctttctgttccaaatt

SEQ ID NO: 4517509 - DNA, 16 bp, Homo sapiens
ctttctgttgaaaagc

SEQ ID NO: 4517510 - DNA, 21 bp, Homo sapiens
ctttctgttgaaaagcacaca

SEQ ID NO: 4517511 - DNA, 22 bp, Homo sapiens
ctttcttacctactattggccc

SEQ ID NO: 4517512 - DNA, 13 bp, Homo sapiens
ctttcttcaccaa

SEQ ID NO: 4517513 - DNA, 14 bp, Homo sapiens
ctttcttcaccaag

SEQ ID NO: 4517514 - DNA, 16 bp, Homo sapiens
ctttcttcaccaagtg

SEQ ID NO: 4517515 - DNA, 23 bp, Homo sapiens
ctttcttcaccaagtgcaataga

SEQ ID NO: 4517516 - DNA, 22 bp, Homo sapiens
ctttcttccaaacaggctcaga

SEQ ID NO: 4517517 - DNA, 11 bp, Homo sapiens
ctttcttcctc

SEQ ID NO: 4517518 - DNA, 12 bp, Homo sapiens
ctttcttctagt

SEQ ID NO: 4517519 - DNA, 21 bp, Homo sapiens
ctttctttccaaaacatttct

SEQ ID NO: 4517520 - DNA, 13 bp, Homo sapiens
ctttctttctcta

SEQ ID NO: 4517521 - DNA, 13 bp, Homo sapiens
ctttctttctttt

SEQ ID NO: 4517522 - DNA, 18 bp, Homo sapiens
ctttctttgcaacagcag

SEQ ID NO: 4517523 - DNA, 19 bp, Homo sapiens
ctttctttgcaacagcagt

SEQ ID NO: 4517524 - DNA, 17 bp, Homo sapiens
ctttctttgcaccaaag

SEQ ID NO: 4517525 - DNA, 15 bp, Homo sapiens
ctttctttgcctctg

SEQ ID NO: 4517526 - DNA, 16 bp, Homo sapiens
ctttctttgcctctgc

SEQ ID NO: 4517527 - DNA, 15 bp, Homo sapiens
ctttctttggtgcct

SEQ ID NO: 4517528 - DNA, 20 bp, Homo sapiens
ctttcttttgaatcaatctg

SEQ ID NO: 4517529 - DNA, 23 bp, Homo sapiens
ctttcttttgaatcaatctggct

SEQ ID NO: 4517530 - DNA, 14 bp, Homo sapiens
ctttctttttcttc

SEQ ID NO: 4517531 - DNA, 20 bp, Homo sapiens
ctttctttttcttcttccct

SEQ ID NO: 4517532 - DNA, 14 bp, Homo sapiens
ctttgaaacctcag

SEQ ID NO: 4517533 - DNA, 17 bp, Homo sapiens
ctttgaaacctcagggc

SEQ ID NO: 4517534 - DNA, 17 bp, Homo sapiens
ctttgaaacctgctctg

SEQ ID NO: 4517535 - DNA, 13 bp, Homo sapiens
ctttgaaactgta

SEQ ID NO: 4517536 - DNA, 11 bp, Homo sapiens
ctttgaaagac

SEQ ID NO: 4517537 - DNA, 14 bp, Homo sapiens
ctttgaaataaaaa

SEQ ID NO: 4517538 - DNA, 14 bp, Homo sapiens
ctttgaactttagt

SEQ ID NO: 4517539 - DNA, 16 bp, Homo sapiens
ctttgaagtcatacca

SEQ ID NO: 4517540 - DNA, 21 bp, Homo sapiens
ctttgaagttagctttaactt

SEQ ID NO: 4517541 - DNA, 12 bp, Homo sapiens
ctttgaatattt

SEQ ID NO: 4517542 - DNA, 15 bp, Homo sapiens
ctttgaatcaaaata

SEQ ID NO: 4517543 - DNA, 14 bp, Homo sapiens
ctttgaatgttaat

SEQ ID NO: 4517544 - DNA, 21 bp, Homo sapiens
ctttgacctaaattatttact

SEQ ID NO: 4517545 - DNA, 14 bp, Homo sapiens
ctttgacctgttgg

SEQ ID NO: 4517546 - DNA, 12 bp, Homo sapiens
ctttgactgaaa

SEQ ID NO: 4517547 - DNA, 17 bp, Homo sapiens
ctttgactgtcagcaag

SEQ ID NO: 4517548 - DNA, 22 bp, Homo sapiens
ctttgacttaagggttgcttgc

SEQ ID NO: 4517549 - DNA, 15 bp, Homo sapiens
ctttgactttttgca

SEQ ID NO: 4517550 - DNA, 14 bp, Homo sapiens
ctttgagaggctga

SEQ ID NO: 4517551 - DNA, 20 bp, Homo sapiens
ctttgagcccattcttctgg

SEQ ID NO: 4517552 - DNA, 14 bp, Homo sapiens
ctttgagtccacgc

SEQ ID NO: 4517553 - DNA, 23 bp, Homo sapiens
ctttgagtccacgcccaccagcc

SEQ ID NO: 4517554 - DNA, 24 bp, Homo sapiens
ctttgagtccacgcccaccagcct

SEQ ID NO: 4517555 - DNA, 16 bp, Homo sapiens
ctttgatgtcatgtgt

SEQ ID NO: 4517556 - DNA, 19 bp, Homo sapiens
ctttgattcatagtaactt

SEQ ID NO: 4517557 - DNA, 21 bp, Homo sapiens
ctttgattcatagtaacttct

SEQ ID NO: 4517558 - DNA, 15 bp, Homo sapiens
ctttgattctccttc

SEQ ID NO: 4517559 - DNA, 20 bp, Homo sapiens
ctttgattctccttcagccc

SEQ ID NO: 4517560 - DNA, 22 bp, Homo sapiens
ctttgattctccttttatgtgt

SEQ ID NO: 4517561 - DNA, 14 bp, Homo sapiens
ctttgatttagatt

SEQ ID NO: 4517562 - DNA, 20 bp, Homo sapiens
ctttgcaaagtattgtaaat

SEQ ID NO: 4517563 - DNA, 18 bp, Homo sapiens
ctttgcaacagcagtgtt

SEQ ID NO: 4517564 - DNA, 19 bp, Homo sapiens
ctttgcaatagcagttata

SEQ ID NO: 4517565 - DNA, 22 bp, Homo sapiens
ctttgcaatagcagttataaca

SEQ ID NO: 4517566 - DNA, 18 bp, Homo sapiens
ctttgcaatccaaataaa

SEQ ID NO: 4517567 - DNA, 13 bp, Homo sapiens
ctttgcagagcct

SEQ ID NO: 4517568 - DNA, 21 bp, Homo sapiens
ctttgcagctgctgtctgagt

SEQ ID NO: 4517569 - DNA, 22 bp, Homo sapiens
ctttgcagttggactctcaggg

SEQ ID NO: 4517570 - DNA, 20 bp, Homo sapiens
ctttgcatgttccactaacc

SEQ ID NO: 4517571 - DNA, 20 bp, Homo sapiens
ctttgcattgtctgtctgca

SEQ ID NO: 4517572 - DNA, 23 bp, Homo sapiens
ctttgccaaggctctcccctctc

SEQ ID NO: 4517573 - DNA, 14 bp, Homo sapiens
ctttgccagcagag

SEQ ID NO: 4517574 - DNA, 16 bp, Homo sapiens
ctttgccagcagagcc

SEQ ID NO: 4517575 - DNA, 19 bp, Homo sapiens
ctttgccagcagagccagg

SEQ ID NO: 4517576 - DNA, 20 bp, Homo sapiens
ctttgccagcagagccaggg

SEQ ID NO: 4517577 - DNA, 21 bp, Homo sapiens
ctttgccagcagagccagggc

SEQ ID NO: 4517578 - DNA, 14 bp, Homo sapiens
ctttgcctcctgtg

SEQ ID NO: 4517579 - DNA, 23 bp, Homo sapiens
ctttgcctctgcagtctcatttc

SEQ ID NO: 4517580 - DNA, 22 bp, Homo sapiens
cttgttgtattcctgcctttga

SEQ ID NO: 4517581 - DNA, 22 bp, Homo sapiens
cttgttgtctccacttgtatat

SEQ ID NO: 4517582 - DNA, 13 bp, Homo sapiens
cttgtttacaata

SEQ ID NO: 4517583 - DNA, 12 bp, Homo sapiens
cttgtttatagc

SEQ ID NO: 4517584 - DNA, 14 bp, Homo sapiens
cttgtttgaatatt

SEQ ID NO: 4517585 - DNA, 20 bp, Homo sapiens
cttgtttgattttagctgca

SEQ ID NO: 4517586 - DNA, 22 bp, Homo sapiens
cttgtttggtttggtttgcttt

SEQ ID NO: 4517587 - DNA, 22 bp, Homo sapiens
cttgtttgttactgtcattccc

SEQ ID NO: 4517588 - DNA, 21 bp, Homo sapiens
cttgtttttcttcagcattta

SEQ ID NO: 4517589 - DNA, 13 bp, Homo sapiens
ctttaaaaacaaa

SEQ ID NO: 4517590 - DNA, 14 bp, Homo sapiens
ctttaaaaatgtat

SEQ ID NO: 4517591 - DNA, 14 bp, Homo sapiens
ctttaaaacaaaac

SEQ ID NO: 4517592 - DNA, 15 bp, Homo sapiens
ctttaaaacaaaaca

SEQ ID NO: 4517593 - DNA, 16 bp, Homo sapiens
ctttaaaagaatgact

SEQ ID NO: 4517594 - DNA, 20 bp, Homo sapiens
ctttaaaagtcattattcct

SEQ ID NO: 4517595 - DNA, 14 bp, Homo sapiens
ctttaaaatattgt

SEQ ID NO: 4517596 - DNA, 18 bp, Homo sapiens
ctttaaagggatggcaag

SEQ ID NO: 4517597 - DNA, 13 bp, Homo sapiens
ctttaaataataa

SEQ ID NO: 4517598 - DNA, 15 bp, Homo sapiens
ctttaaataatttaa

SEQ ID NO: 4517599 - DNA, 17 bp, Homo sapiens
ctttaaataatttaact

SEQ ID NO: 4517600 - DNA, 18 bp, Homo sapiens
ctttaaatgacagtaata

SEQ ID NO: 4517601 - DNA, 20 bp, Homo sapiens
ctttaaatgacagtaatatt

SEQ ID NO: 4517602 - DNA, 10 bp, Homo sapiens
ctttaaatta

SEQ ID NO: 4517603 - DNA, 17 bp, Homo sapiens
ctttaacctatgataat

SEQ ID NO: 4517604 - DNA, 18 bp, Homo sapiens
ctttaacctatgataatt

SEQ ID NO: 4517605 - DNA, 18 bp, Homo sapiens
ctttaactgacaagccat

SEQ ID NO: 4517606 - DNA, 23 bp, Homo sapiens
ctttaactgccgtaatttaactt

SEQ ID NO: 4517607 - DNA, 20 bp, Homo sapiens
ctttaacttttttttctctc

SEQ ID NO: 4517608 - DNA, 23 bp, Homo sapiens
ctttaagaaccttaatgacaaca

SEQ ID NO: 4517609 - DNA, 22 bp, Homo sapiens
ctttaagagtttaaaatcatca

SEQ ID NO: 4517610 - DNA, 12 bp, Homo sapiens
ctttaagccata

SEQ ID NO: 4517611 - DNA, 19 bp, Homo sapiens
ctttaagccatagaccctg

SEQ ID NO: 4517612 - DNA, 22 bp, Homo sapiens
ctttaagccatagaccctgagg

SEQ ID NO: 4517613 - DNA, 23 bp, Homo sapiens
ctttaagccatagaccctgaggc

SEQ ID NO: 4517614 - DNA, 20 bp, Homo sapiens
ctttaaggatttgaaccatg

SEQ ID NO: 4517615 - DNA, 13 bp, Homo sapiens
ctttaataagtaa

SEQ ID NO: 4517616 - DNA, 13 bp, Homo sapiens
ctttaatatgagc

SEQ ID NO: 4517617 - DNA, 18 bp, Homo sapiens
ctttaatgagaatagaaa

SEQ ID NO: 4517618 - DNA, 19 bp, Homo sapiens
ctttaatgagaatagaaac

SEQ ID NO: 4517619 - DNA, 22 bp, Homo sapiens
ctttaatgagaatagaaacgta

SEQ ID NO: 4517620 - DNA, 19 bp, Homo sapiens
ctttaattaccaacctgtt

SEQ ID NO: 4517621 - DNA, 12 bp, Homo sapiens
ctttaattatat

SEQ ID NO: 4517622 - DNA, 14 bp, Homo sapiens
ctttaattatatat

SEQ ID NO: 4517623 - DNA, 18 bp, Homo sapiens
ctttacatactttatcaa

SEQ ID NO: 4517624 - DNA, 16 bp, Homo sapiens
ctttacatttctttta

SEQ ID NO: 4517625 - DNA, 18 bp, Homo sapiens
ctttacatttcttttaaa

SEQ ID NO: 4517626 - DNA, 19 bp, Homo sapiens
ctttacatttcttttaaaa

SEQ ID NO: 4517627 - DNA, 18 bp, Homo sapiens
ctttaccaaaaaccatgt

SEQ ID NO: 4517628 - DNA, 19 bp, Homo sapiens
ctttaccaaaaaccatgtt

SEQ ID NO: 4517629 - DNA, 20 bp, Homo sapiens
ctttaccaaaaaccatgttg

SEQ ID NO: 4517630 - DNA, 16 bp, Homo sapiens
ctttacctctctgtca

SEQ ID NO: 4517631 - DNA, 14 bp, Homo sapiens
ctttacctttgccc

SEQ ID NO: 4517632 - DNA, 14 bp, Homo sapiens
ctttacttatctct

SEQ ID NO: 4517633 - DNA, 16 bp, Homo sapiens
ctttactttcaagtaa

SEQ ID NO: 4517634 - DNA, 20 bp, Homo sapiens
ctttactttcaagtaatatt

SEQ ID NO: 4517635 - DNA, 15 bp, Homo sapiens
ctttacttttgctgt

SEQ ID NO: 4517636 - DNA, 22 bp, Homo sapiens
ctttagaaaacccaagttttta

SEQ ID NO: 4517637 - DNA, 23 bp, Homo sapiens
ctttagaaacagtgcaacactgg

SEQ ID NO: 4517638 - DNA, 19 bp, Homo sapiens
ctttagaaagctgacattg

SEQ ID NO: 4517639 - DNA, 23 bp, Homo sapiens
ctttagaaataaaccttaatatt

SEQ ID NO: 4517640 - DNA, 14 bp, Homo sapiens
ctttagaagcctgc

SEQ ID NO: 4517641 - DNA, 14 bp, Homo sapiens
ctttagaccctggg

SEQ ID NO: 4517642 - DNA, 16 bp, Homo sapiens
ctttagggttctgcct

SEQ ID NO: 4517643 - DNA, 14 bp, Homo sapiens
ctttaggtcaaact

SEQ ID NO: 4517644 - DNA, 19 bp, Homo sapiens
ctttaggtcaaactcccta

SEQ ID NO: 4517645 - DNA, 14 bp, Homo sapiens
ctttaggtctggtt

SEQ ID NO: 4517646 - DNA, 20 bp, Homo sapiens
ctttaggtttttttaatgat

SEQ ID NO: 4517647 - DNA, 17 bp, Homo sapiens
ctttagttatattcact

SEQ ID NO: 4517648 - DNA, 15 bp, Homo sapiens
ctttagtttttgtga

SEQ ID NO: 4517649 - DNA, 20 bp, Homo sapiens
ctttataaatctttctctca

SEQ ID NO: 4517650 - DNA, 13 bp, Homo sapiens
ctttataaatgta

SEQ ID NO: 4517651 - DNA, 20 bp, Homo sapiens
ctttatagtgcacaaaatga

SEQ ID NO: 4517652 - DNA, 18 bp, Homo sapiens
ctttatatcttgtttaca

SEQ ID NO: 4517653 - DNA, 20 bp, Homo sapiens
ctttatcaatgtgtctttct

SEQ ID NO: 4517654 - DNA, 22 bp, Homo sapiens
ctttatcagggaaactaagatt

SEQ ID NO: 4517655 - DNA, 20 bp, Homo sapiens
ctttatccccgtttcttgca

SEQ ID NO: 4517656 - DNA, 16 bp, Homo sapiens
ctttatctatgggaga

SEQ ID NO: 4517657 - DNA, 23 bp, Homo sapiens
ctttatctatgggagattaaaac

SEQ ID NO: 4517658 - DNA, 17 bp, Homo sapiens
ctttatctgaaaatgat

SEQ ID NO: 4517659 - DNA, 13 bp, Homo sapiens
ctttatctttgtg

SEQ ID NO: 4517660 - DNA, 14 bp, Homo sapiens
ctttatctttgtgt

SEQ ID NO: 4517661 - DNA, 11 bp, Homo sapiens
ctttattataa

SEQ ID NO: 4517662 - DNA, 17 bp, Homo sapiens
ctttattataaaatgct

SEQ ID NO: 4517663 - DNA, 12 bp, Homo sapiens
ctttattattcc

SEQ ID NO: 4517664 - DNA, 14 bp, Homo sapiens
ctttattgaaattc

SEQ ID NO: 4517665 - DNA, 12 bp, Homo sapiens
ctttattgaatt

SEQ ID NO: 4517666 - DNA, 16 bp, Homo sapiens
ctttattgaattagaa

SEQ ID NO: 4517667 - DNA, 17 bp, Homo sapiens
ctttattgaattagaaa

SEQ ID NO: 4517668 - DNA, 17 bp, Homo sapiens
ctttattgatatctcca

SEQ ID NO: 4517669 - DNA, 18 bp, Homo sapiens
ctttattggctgagatat

SEQ ID NO: 4517670 - DNA, 15 bp, Homo sapiens
ctttattgtctgtaa

SEQ ID NO: 4517671 - DNA, 22 bp, Homo sapiens
ctttattttaacctttgataga

SEQ ID NO: 4517672 - DNA, 12 bp, Homo sapiens
ctttattttccc

SEQ ID NO: 4517673 - DNA, 19 bp, Homo sapiens
ctttcaaaaccttttgaaa

SEQ ID NO: 4517674 - DNA, 12 bp, Homo sapiens
ctttcaaaatga

SEQ ID NO: 4517675 - DNA, 14 bp, Homo sapiens
ctttcaaaatgaat

SEQ ID NO: 4517676 - DNA, 19 bp, Homo sapiens
ctttcaaatttagaaacta

SEQ ID NO: 4517677 - DNA, 21 bp, Homo sapiens
ctttcaaatttagaaactaat

SEQ ID NO: 4517678 - DNA, 16 bp, Homo sapiens
ctttcaagtaatattg

SEQ ID NO: 4517679 - DNA, 15 bp, Homo sapiens
ctttcaatattttaa

SEQ ID NO: 4517680 - DNA, 14 bp, Homo sapiens
ctttcacaagcaac

SEQ ID NO: 4517681 - DNA, 18 bp, Homo sapiens
ctttcaccctcatgaaaa

SEQ ID NO: 4517682 - DNA, 15 bp, Homo sapiens
ctttcagagccagcc

SEQ ID NO: 4517683 - DNA, 18 bp, Homo sapiens
ctttcagagccagcctgg

SEQ ID NO: 4517684 - DNA, 22 bp, Homo sapiens
ctttcagagccagcctggctct

SEQ ID NO: 4517685 - DNA, 19 bp, Homo sapiens
ctttcagatgtcttctgcc

SEQ ID NO: 4517686 - DNA, 12 bp, Homo sapiens
ctttcagccaca

SEQ ID NO: 4517687 - DNA, 15 bp, Homo sapiens
ctttcagtacttttt

SEQ ID NO: 4517688 - DNA, 18 bp, Homo sapiens
ctttcataccacttgaat

SEQ ID NO: 4517689 - DNA, 17 bp, Homo sapiens
ctttcatagcactgcag

SEQ ID NO: 4517690 - DNA, 22 bp, Homo sapiens
ctttcatcctgactctgccccc

SEQ ID NO: 4517691 - DNA, 16 bp, Homo sapiens
ctttcatccttgacta

SEQ ID NO: 4517692 - DNA, 15 bp, Homo sapiens
ctttcatcttaaact

SEQ ID NO: 4517693 - DNA, 20 bp, Homo sapiens
ctttcatgtaaactgtgcac

SEQ ID NO: 4517694 - DNA, 16 bp, Homo sapiens
ctttcatgtcttgtca

SEQ ID NO: 4517695 - DNA, 18 bp, Homo sapiens
ctttcattccttcagatt

SEQ ID NO: 4517696 - DNA, 17 bp, Homo sapiens
ctttcattcggtgtgaa

SEQ ID NO: 4517697 - DNA, 21 bp, Homo sapiens
ctttcattcggtgtgaacttt

SEQ ID NO: 4517698 - DNA, 18 bp, Homo sapiens
ctttcattgccagtgtct

SEQ ID NO: 4517699 - DNA, 15 bp, Homo sapiens
ctttcattgctaaga

SEQ ID NO: 4517700 - DNA, 17 bp, Homo sapiens
ctttcattgctaagact

SEQ ID NO: 4517701 - DNA, 20 bp, Homo sapiens
cttgctgaaggagaaaaaga

SEQ ID NO: 4517702 - DNA, 16 bp, Homo sapiens
cttgctgcactctgta

SEQ ID NO: 4517703 - DNA, 21 bp, Homo sapiens
cttgctgcactcttgcacatg

SEQ ID NO: 4517704 - DNA, 23 bp, Homo sapiens
cttgctgcactcttgcacatgga

SEQ ID NO: 4517705 - DNA, 18 bp, Homo sapiens
cttgctggaacacagggg

SEQ ID NO: 4517706 - DNA, 21 bp, Homo sapiens
cttgctggaacacaggggcct

SEQ ID NO: 4517707 - DNA, 20 bp, Homo sapiens
cttgctgttgacatatttaa

SEQ ID NO: 4517708 - DNA, 21 bp, Homo sapiens
cttgctgttgacatatttaat

SEQ ID NO: 4517709 - DNA, 13 bp, Homo sapiens
cttgcttaaattt

SEQ ID NO: 4517710 - DNA, 21 bp, Homo sapiens
cttgcttagatgttccaaatt

SEQ ID NO: 4517711 - DNA, 13 bp, Homo sapiens
cttgcttcagtgg

SEQ ID NO: 4517712 - DNA, 14 bp, Homo sapiens
cttgcttcagtgga

SEQ ID NO: 4517713 - DNA, 19 bp, Homo sapiens
cttgcttctaaatgcccag

SEQ ID NO: 4517714 - DNA, 15 bp, Homo sapiens
cttgcttctgcagca

SEQ ID NO: 4517715 - DNA, 18 bp, Homo sapiens
cttgcttctttctagaaa

SEQ ID NO: 4517716 - DNA, 16 bp, Homo sapiens
cttgctttcctgggcc

SEQ ID NO: 4517717 - DNA, 21 bp, Homo sapiens
cttgctttctatgctgtttgt

SEQ ID NO: 4517718 - DNA, 15 bp, Homo sapiens
cttggaaaataagac

SEQ ID NO: 4517719 - DNA, 20 bp, Homo sapiens
cttggaaacagttggcactg

SEQ ID NO: 4517720 - DNA, 16 bp, Homo sapiens
cttggaaccagcccca

SEQ ID NO: 4517721 - DNA, 18 bp, Homo sapiens
cttggaattacaagccct

SEQ ID NO: 4517722 - DNA, 18 bp, Homo sapiens
cttggacattttatgtct

SEQ ID NO: 4517723 - DNA, 18 bp, Homo sapiens
cttggactacacaataca

SEQ ID NO: 4517724 - DNA, 14 bp, Homo sapiens
cttggagaccttac

SEQ ID NO: 4517725 - DNA, 16 bp, Homo sapiens
cttggagactcctggt

SEQ ID NO: 4517726 - DNA, 19 bp, Homo sapiens
cttggagactcctggtctg

SEQ ID NO: 4517727 - DNA, 14 bp, Homo sapiens
cttggagcaatcag

SEQ ID NO: 4517728 - DNA, 15 bp, Homo sapiens
cttggagctgcttgg

SEQ ID NO: 4517729 - DNA, 15 bp, Homo sapiens
cttggaggaatgaca

SEQ ID NO: 4517730 - DNA, 21 bp, Homo sapiens
cttggaggacctggcgtgctc

SEQ ID NO: 4517731 - DNA, 15 bp, Homo sapiens
cttggagggtcccaa

SEQ ID NO: 4517732 - DNA, 17 bp, Homo sapiens
cttggagggtcccaagc

SEQ ID NO: 4517733 - DNA, 18 bp, Homo sapiens
cttggagggtcccaagct

SEQ ID NO: 4517734 - DNA, 19 bp, Homo sapiens
cttggagggtcccaagctg

SEQ ID NO: 4517735 - DNA, 19 bp, Homo sapiens
cttggagtcccaggggcag

SEQ ID NO: 4517736 - DNA, 20 bp, Homo sapiens
cttggagtgccaagtttgca

SEQ ID NO: 4517737 - DNA, 23 bp, Homo sapiens
cttggataatgctgttgcctcat

SEQ ID NO: 4517738 - DNA, 13 bp, Homo sapiens
cttggatctgggg

SEQ ID NO: 4517739 - DNA, 15 bp, Homo sapiens
cttggatttcgtgtg

SEQ ID NO: 4517740 - DNA, 17 bp, Homo sapiens
cttggcacccccatgct

SEQ ID NO: 4517741 - DNA, 16 bp, Homo sapiens
cttggcatacaaaata

SEQ ID NO: 4517742 - DNA, 19 bp, Homo sapiens
cttggccacagactgaact

SEQ ID NO: 4517743 - DNA, 15 bp, Homo sapiens
cttggccatgcagaa

SEQ ID NO: 4517744 - DNA, 12 bp, Homo sapiens
cttggcccagag

SEQ ID NO: 4517745 - DNA, 20 bp, Homo sapiens
cttggccctttccttccaga

SEQ ID NO: 4517746 - DNA, 19 bp, Homo sapiens
cttggcctaaacctcagtt

SEQ ID NO: 4517747 - DNA, 15 bp, Homo sapiens
cttggcctcccaaag

SEQ ID NO: 4517748 - DNA, 16 bp, Homo sapiens
cttggcctcccaaagt

SEQ ID NO: 4517749 - DNA, 22 bp, Homo sapiens
cttggcctcccaaagtgctgag

SEQ ID NO: 4517750 - DNA, 12 bp, Homo sapiens
cttggcctgctg

SEQ ID NO: 4517751 - DNA, 14 bp, Homo sapiens
cttggcttaatcat

SEQ ID NO: 4517752 - DNA, 18 bp, Homo sapiens
cttggctttcagagccag

SEQ ID NO: 4517753 - DNA, 20 bp, Homo sapiens
cttggctttcagagccagcc

SEQ ID NO: 4517754 - DNA, 18 bp, Homo sapiens
cttgggaagtcgaggctg

SEQ ID NO: 4517755 - DNA, 21 bp, Homo sapiens
cttgggaggaaacctgagatc

SEQ ID NO: 4517756 - DNA, 14 bp, Homo sapiens
cttgggaggctgag

SEQ ID NO: 4517757 - DNA, 17 bp, Homo sapiens
cttgggcagtgccccag

SEQ ID NO: 4517758 - DNA, 15 bp, Homo sapiens
cttgggcctgcaccc

SEQ ID NO: 4517759 - DNA, 18 bp, Homo sapiens
cttgggcctgcacccttc

SEQ ID NO: 4517760 - DNA, 18 bp, Homo sapiens
cttggggaatttcctcta

SEQ ID NO: 4517761 - DNA, 11 bp, Homo sapiens
cttggggaggc

SEQ ID NO: 4517762 - DNA, 21 bp, Homo sapiens
cttggggagtttagggtgggg

SEQ ID NO: 4517763 - DNA, 18 bp, Homo sapiens
cttgggggacagggctgg

SEQ ID NO: 4517764 - DNA, 20 bp, Homo sapiens
cttgggggaggccaccccaa

SEQ ID NO: 4517765 - DNA, 18 bp, Homo sapiens
cttgggggttcaggcccg

SEQ ID NO: 4517766 - DNA, 19 bp, Homo sapiens
cttggggtaagccagagcc

SEQ ID NO: 4517767 - DNA, 18 bp, Homo sapiens
cttggggtccctccaccc

SEQ ID NO: 4517768 - DNA, 16 bp, Homo sapiens
cttggggtgtggggtg

SEQ ID NO: 4517769 - DNA, 23 bp, Homo sapiens
cttgggtctctctcggcccctgt

SEQ ID NO: 4517770 - DNA, 14 bp, Homo sapiens
cttggtagttctgt

SEQ ID NO: 4517771 - DNA, 20 bp, Homo sapiens
cttggtagttctgtgcctcc

SEQ ID NO: 4517772 - DNA, 13 bp, Homo sapiens
cttggtcagagcc

SEQ ID NO: 4517773 - DNA, 14 bp, Homo sapiens
cttggtcagagcca

SEQ ID NO: 4517774 - DNA, 16 bp, Homo sapiens
cttggtgtaatttgaa

SEQ ID NO: 4517775 - DNA, 16 bp, Homo sapiens
cttggtgtccacctgg

SEQ ID NO: 4517776 - DNA, 15 bp, Homo sapiens
cttggtgtcgtttcc

SEQ ID NO: 4517777 - DNA, 22 bp, Homo sapiens
cttggtgtctgcggggggtgtc

SEQ ID NO: 4517778 - DNA, 13 bp, Homo sapiens
cttggttggctgg

SEQ ID NO: 4517779 - DNA, 21 bp, Homo sapiens
cttggttttgctacataatta

SEQ ID NO: 4517780 - DNA, 11 bp, Homo sapiens
cttgtaaaatg

SEQ ID NO: 4517781 - DNA, 23 bp, Homo sapiens
cttgtaaagactggttttctgcc

SEQ ID NO: 4517782 - DNA, 19 bp, Homo sapiens
cttgtaccatagaaaaatg

SEQ ID NO: 4517783 - DNA, 20 bp, Homo sapiens
cttgtaccatagaaaaatgt

SEQ ID NO: 4517784 - DNA, 13 bp, Homo sapiens
cttgtattaagtt

SEQ ID NO: 4517785 - DNA, 22 bp, Homo sapiens
cttgtattaagttgttaataaa

SEQ ID NO: 4517786 - DNA, 23 bp, Homo sapiens
cttgtattaagttgttaataaaa

SEQ ID NO: 4517787 - DNA, 14 bp, Homo sapiens
cttgtattgtaaat

SEQ ID NO: 4517788 - DNA, 19 bp, Homo sapiens
cttgtatttaaaaacattt

SEQ ID NO: 4517789 - DNA, 20 bp, Homo sapiens
cttgtatttaaaaacatttt

SEQ ID NO: 4517790 - DNA, 18 bp, Homo sapiens
cttgtcaagcctgtgcaa

SEQ ID NO: 4517791 - DNA, 19 bp, Homo sapiens
cttgtcaagcctgtgcaaa

SEQ ID NO: 4517792 - DNA, 16 bp, Homo sapiens
cttgtcacgccagact

SEQ ID NO: 4517793 - DNA, 19 bp, Homo sapiens
cttgtccaagacaggggcc

SEQ ID NO: 4517794 - DNA, 14 bp, Homo sapiens
cttgtccagcgcct

SEQ ID NO: 4517795 - DNA, 16 bp, Homo sapiens
cttgtccccacccatg

SEQ ID NO: 4517796 - DNA, 19 bp, Homo sapiens
cttgtctcattttaatgta

SEQ ID NO: 4517797 - DNA, 23 bp, Homo sapiens
cttgtctcattttaatgtaaaga

SEQ ID NO: 4517798 - DNA, 20 bp, Homo sapiens
cttgtctgtgatctctgctg

SEQ ID NO: 4517799 - DNA, 15 bp, Homo sapiens
cttgtcttgaaaact

SEQ ID NO: 4517800 - DNA, 16 bp, Homo sapiens
cttgtgaaagtgtaat

SEQ ID NO: 4517801 - DNA, 16 bp, Homo sapiens
cttgtgaactttgaat

SEQ ID NO: 4517802 - DNA, 15 bp, Homo sapiens
cttgtgagagcccat

SEQ ID NO: 4517803 - DNA, 19 bp, Homo sapiens
cttgtgagagcccattccc

SEQ ID NO: 4517804 - DNA, 22 bp, Homo sapiens
cttgtgatttctttaaaagaat

SEQ ID NO: 4517805 - DNA, 14 bp, Homo sapiens
cttgtggagcccca

SEQ ID NO: 4517806 - DNA, 16 bp, Homo sapiens
cttgtggagccccaca

SEQ ID NO: 4517807 - DNA, 14 bp, Homo sapiens
cttgtggcctcaag

SEQ ID NO: 4517808 - DNA, 16 bp, Homo sapiens
cttgtgggtccatgct

SEQ ID NO: 4517809 - DNA, 21 bp, Homo sapiens
cttgtgtcaagacatttctct

SEQ ID NO: 4517810 - DNA, 23 bp, Homo sapiens
cttgtgtgtgtacctgtggctgt

SEQ ID NO: 4517811 - DNA, 19 bp, Homo sapiens
cttgtgttcaatctgtgaa

SEQ ID NO: 4517812 - DNA, 13 bp, Homo sapiens
cttgttactgctg

SEQ ID NO: 4517813 - DNA, 12 bp, Homo sapiens
cttgttattaat

SEQ ID NO: 4517814 - DNA, 15 bp, Homo sapiens
cttgttattaatgtt

SEQ ID NO: 4517815 - DNA, 17 bp, Homo sapiens
cttgttattaatgtttc

SEQ ID NO: 4517816 - DNA, 19 bp, Homo sapiens
cttgttcaggaaaaggttg

SEQ ID NO: 4517817 - DNA, 21 bp, Homo sapiens
cttgttccaatgccacatact

SEQ ID NO: 4517818 - DNA, 13 bp, Homo sapiens
cttgttccagctc

SEQ ID NO: 4517819 - DNA, 15 bp, Homo sapiens
cttgttccagctttg

SEQ ID NO: 4517820 - DNA, 14 bp, Homo sapiens
cttgttctgttcct

SEQ ID NO: 4517821 - DNA, 21 bp, Homo sapiens
cttcttgggcccggtccacag

SEQ ID NO: 4517822 - DNA, 23 bp, Homo sapiens
cttcttgggcccggtccacaggt

SEQ ID NO: 4517823 - DNA, 15 bp, Homo sapiens
cttcttgtgttttac

SEQ ID NO: 4517824 - DNA, 15 bp, Homo sapiens
cttcttgttctgaga

SEQ ID NO: 4517825 - DNA, 16 bp, Homo sapiens
cttctttattattcct

SEQ ID NO: 4517826 - DNA, 17 bp, Homo sapiens
cttctttctggactggc

SEQ ID NO: 4517827 - DNA, 16 bp, Homo sapiens
cttctttgtgcctttg

SEQ ID NO: 4517828 - DNA, 20 bp, Homo sapiens
cttctttgtgcctttggcct

SEQ ID NO: 4517829 - DNA, 16 bp, Homo sapiens
cttgaaaaaaaacagt

SEQ ID NO: 4517830 - DNA, 18 bp, Homo sapiens
cttgaaaaaaaacagtgg

SEQ ID NO: 4517831 - DNA, 17 bp, Homo sapiens
cttgaaaaagatggctt

SEQ ID NO: 4517832 - DNA, 20 bp, Homo sapiens
cttgaaacagattcaggcca

SEQ ID NO: 4517833 - DNA, 16 bp, Homo sapiens
cttgaaaccagtattt

SEQ ID NO: 4517834 - DNA, 23 bp, Homo sapiens
cttgaaagccaagtgttttgtat

SEQ ID NO: 4517835 - DNA, 19 bp, Homo sapiens
cttgaaatatataatattc

SEQ ID NO: 4517836 - DNA, 14 bp, Homo sapiens
cttgaaatgaaagg

SEQ ID NO: 4517837 - DNA, 15 bp, Homo sapiens
cttgaaatgaaaggg

SEQ ID NO: 4517838 - DNA, 18 bp, Homo sapiens
cttgaaatgaaagggaaa

SEQ ID NO: 4517839 - DNA, 21 bp, Homo sapiens
cttgaaattaagaaggcaaaa

SEQ ID NO: 4517840 - DNA, 18 bp, Homo sapiens
cttgaaatttacacagtg

SEQ ID NO: 4517841 - DNA, 14 bp, Homo sapiens
cttgaaattttaac

SEQ ID NO: 4517842 - DNA, 17 bp, Homo sapiens
cttgaacaaaagggtca

SEQ ID NO: 4517843 - DNA, 16 bp, Homo sapiens
cttgaacattaatcca

SEQ ID NO: 4517844 - DNA, 14 bp, Homo sapiens
cttgaacttgcctc

SEQ ID NO: 4517845 - DNA, 15 bp, Homo sapiens
cttgaactttccaaa

SEQ ID NO: 4517846 - DNA, 15 bp, Homo sapiens
cttgaagccaaagaa

SEQ ID NO: 4517847 - DNA, 12 bp, Homo sapiens
cttgaagctaac

SEQ ID NO: 4517848 - DNA, 14 bp, Homo sapiens
cttgaataataagc

SEQ ID NO: 4517849 - DNA, 13 bp, Homo sapiens
cttgaatagtatt

SEQ ID NO: 4517850 - DNA, 20 bp, Homo sapiens
cttgaatataaaaaatcatg

SEQ ID NO: 4517851 - DNA, 12 bp, Homo sapiens
cttgaatgaaaa

SEQ ID NO: 4517852 - DNA, 23 bp, Homo sapiens
cttgaatgccatagtcaaagaga

SEQ ID NO: 4517853 - DNA, 17 bp, Homo sapiens
cttgaattcctctcaaa

SEQ ID NO: 4517854 - DNA, 21 bp, Homo sapiens
cttgaattgtaactgttcttg

SEQ ID NO: 4517855 - DNA, 18 bp, Homo sapiens
cttgacaatcatctccaa

SEQ ID NO: 4517856 - DNA, 20 bp, Homo sapiens
cttgacacatagtttttcag

SEQ ID NO: 4517857 - DNA, 15 bp, Homo sapiens
cttgacatacctacc

SEQ ID NO: 4517858 - DNA, 20 bp, Homo sapiens
cttgacatttatcacctctg

SEQ ID NO: 4517859 - DNA, 13 bp, Homo sapiens
cttgaccatgttg

SEQ ID NO: 4517860 - DNA, 18 bp, Homo sapiens
cttgaccttttcgacgct

SEQ ID NO: 4517861 - DNA, 17 bp, Homo sapiens
cttgactctaatatgat

SEQ ID NO: 4517862 - DNA, 12 bp, Homo sapiens
cttgactgcatt

SEQ ID NO: 4517863 - DNA, 18 bp, Homo sapiens
cttgactgcattgccgct

SEQ ID NO: 4517864 - DNA, 19 bp, Homo sapiens
cttgactgggtgagaccca

SEQ ID NO: 4517865 - DNA, 16 bp, Homo sapiens
cttgactttttaaaaa

SEQ ID NO: 4517866 - DNA, 21 bp, Homo sapiens
cttgagaaccagtctcctcac

SEQ ID NO: 4517867 - DNA, 19 bp, Homo sapiens
cttgagaccaacttttcaa

SEQ ID NO: 4517868 - DNA, 18 bp, Homo sapiens
cttgagaggagaaatgca

SEQ ID NO: 4517869 - DNA, 20 bp, Homo sapiens
cttgagcatcaatcttgtta

SEQ ID NO: 4517870 - DNA, 19 bp, Homo sapiens
cttgagcggagcccgatat

SEQ ID NO: 4517871 - DNA, 12 bp, Homo sapiens
cttgagctcagg

SEQ ID NO: 4517872 - DNA, 21 bp, Homo sapiens
cttgaggaggagctggcctgc

SEQ ID NO: 4517873 - DNA, 17 bp, Homo sapiens
cttgagtgagaagagct

SEQ ID NO: 4517874 - DNA, 22 bp, Homo sapiens
cttgagtgcttgttagagagaa

SEQ ID NO: 4517875 - DNA, 23 bp, Homo sapiens
cttgagtgcttgttagagagaaa

SEQ ID NO: 4517876 - DNA, 10 bp, Homo sapiens
cttgatctat

SEQ ID NO: 4517877 - DNA, 20 bp, Homo sapiens
cttgatctatctacaaagaa

SEQ ID NO: 4517878 - DNA, 13 bp, Homo sapiens
cttgatctctctt

SEQ ID NO: 4517879 - DNA, 20 bp, Homo sapiens
cttgatctctcttgtcctct

SEQ ID NO: 4517880 - DNA, 23 bp, Homo sapiens
cttgatctctcttgtcctcttct

SEQ ID NO: 4517881 - DNA, 14 bp, Homo sapiens
cttgatctttgagc

SEQ ID NO: 4517882 - DNA, 19 bp, Homo sapiens
cttgatgttttttctgtaa

SEQ ID NO: 4517883 - DNA, 23 bp, Homo sapiens
cttgatgttttttctgtaatgta

SEQ ID NO: 4517884 - DNA, 13 bp, Homo sapiens
cttgattaaatca

SEQ ID NO: 4517885 - DNA, 14 bp, Homo sapiens
cttgattaaatcaa

SEQ ID NO: 4517886 - DNA, 15 bp, Homo sapiens
cttgattaaatcaac

SEQ ID NO: 4517887 - DNA, 18 bp, Homo sapiens
cttgatttatttgcttct

SEQ ID NO: 4517888 - DNA, 17 bp, Homo sapiens
cttgatttcacatttct

SEQ ID NO: 4517889 - DNA, 17 bp, Homo sapiens
cttgatttgatctttgt

SEQ ID NO: 4517890 - DNA, 12 bp, Homo sapiens
cttgatttttgc

SEQ ID NO: 4517891 - DNA, 21 bp, Homo sapiens
cttgcaacctcaccttcctgt

SEQ ID NO: 4517892 - DNA, 20 bp, Homo sapiens
cttgcacagccaacgagaca

SEQ ID NO: 4517893 - DNA, 20 bp, Homo sapiens
cttgcacagggattctcaca

SEQ ID NO: 4517894 - DNA, 12 bp, Homo sapiens
cttgcacctgca

SEQ ID NO: 4517895 - DNA, 22 bp, Homo sapiens
cttgcacgcgccctttctacca

SEQ ID NO: 4517896 - DNA, 18 bp, Homo sapiens
cttgcactggccttctga

SEQ ID NO: 4517897 - DNA, 17 bp, Homo sapiens
cttgcagcggctcctgc

SEQ ID NO: 4517898 - DNA, 19 bp, Homo sapiens
cttgcaggggtcccccctc

SEQ ID NO: 4517899 - DNA, 16 bp, Homo sapiens
cttgccaactccatct

SEQ ID NO: 4517900 - DNA, 17 bp, Homo sapiens
cttgccaagaaaatgaa

SEQ ID NO: 4517901 - DNA, 23 bp, Homo sapiens
cttgccacatggtgtctcccaac

SEQ ID NO: 4517902 - DNA, 20 bp, Homo sapiens
cttgccaccccaccctccct

SEQ ID NO: 4517903 - DNA, 22 bp, Homo sapiens
cttgccaccccaccctccctgg

SEQ ID NO: 4517904 - DNA, 23 bp, Homo sapiens
cttgccaccccaccctccctgga

SEQ ID NO: 4517905 - DNA, 23 bp, Homo sapiens
cttgccagggatgggcagcccaa

SEQ ID NO: 4517906 - DNA, 13 bp, Homo sapiens
cttgccatcactg

SEQ ID NO: 4517907 - DNA, 17 bp, Homo sapiens
cttgccattccaaaata

SEQ ID NO: 4517908 - DNA, 16 bp, Homo sapiens
cttgccatttgtagct

SEQ ID NO: 4517909 - DNA, 18 bp, Homo sapiens
cttgcccactggccgctg

SEQ ID NO: 4517910 - DNA, 20 bp, Homo sapiens
cttgcccactggccgctgag

SEQ ID NO: 4517911 - DNA, 19 bp, Homo sapiens
cttgcccagactacagggc

SEQ ID NO: 4517912 - DNA, 23 bp, Homo sapiens
cttgcccagagatgcctccaccg

SEQ ID NO: 4517913 - DNA, 16 bp, Homo sapiens
cttgcccagcctggat

SEQ ID NO: 4517914 - DNA, 11 bp, Homo sapiens
cttgcccagct

SEQ ID NO: 4517915 - DNA, 13 bp, Homo sapiens
cttgcccatcctg

SEQ ID NO: 4517916 - DNA, 14 bp, Homo sapiens
cttgcccgctccca

SEQ ID NO: 4517917 - DNA, 13 bp, Homo sapiens
cttgccctcctgg

SEQ ID NO: 4517918 - DNA, 24 bp, Homo sapiens
cttgccctgagcactcctggtgca

SEQ ID NO: 4517919 - DNA, 21 bp, Homo sapiens
cttgcctctaaatagcacttt

SEQ ID NO: 4517920 - DNA, 14 bp, Homo sapiens
cttgcctctgcaca

SEQ ID NO: 4517921 - DNA, 17 bp, Homo sapiens
cttgcctctgccctgga

SEQ ID NO: 4517922 - DNA, 17 bp, Homo sapiens
cttgcctctgtcccctt

SEQ ID NO: 4517923 - DNA, 19 bp, Homo sapiens
cttgcctctgtccccttct

SEQ ID NO: 4517924 - DNA, 12 bp, Homo sapiens
cttgcctgaagc

SEQ ID NO: 4517925 - DNA, 21 bp, Homo sapiens
cttgccttattagagtgtctt

SEQ ID NO: 4517926 - DNA, 18 bp, Homo sapiens
cttgccttcctcagctgc

SEQ ID NO: 4517927 - DNA, 23 bp, Homo sapiens
cttgccttcctcagctgcctcct

SEQ ID NO: 4517928 - DNA, 19 bp, Homo sapiens
cttgccttgaaatttacac

SEQ ID NO: 4517929 - DNA, 19 bp, Homo sapiens
cttgcgcctcagccctcag

SEQ ID NO: 4517930 - DNA, 20 bp, Homo sapiens
cttgcgcctcagccctcagt

SEQ ID NO: 4517931 - DNA, 17 bp, Homo sapiens
cttgcggcaaaaggaaa

SEQ ID NO: 4517932 - DNA, 18 bp, Homo sapiens
cttgctcaaaatctgtga

SEQ ID NO: 4517933 - DNA, 12 bp, Homo sapiens
cttgctcccaac

SEQ ID NO: 4517934 - DNA, 14 bp, Homo sapiens
cttgctcgcttgct

SEQ ID NO: 4517935 - DNA, 14 bp, Homo sapiens
cttgctctcctcat

SEQ ID NO: 4517936 - DNA, 15 bp, Homo sapiens
cttgctctcctcatc

SEQ ID NO: 4517937 - DNA, 13 bp, Homo sapiens
cttgctctcttca

SEQ ID NO: 4517938 - DNA, 20 bp, Homo sapiens
cttgctctcttcaataaacc

SEQ ID NO: 4517939 - DNA, 22 bp, Homo sapiens
cttgctctgtcccccaggctgg

SEQ ID NO: 4517940 - DNA, 19 bp, Homo sapiens
cttgctcttcagtgggaga

SEQ ID NO: 4517941 - DNA, 11 bp, Homo sapiens
ctttgcctctt

SEQ ID NO: 4517942 - DNA, 15 bp, Homo sapiens
ctttgcctcttcttt

SEQ ID NO: 4517943 - DNA, 13 bp, Homo sapiens
ctttgccttctct

SEQ ID NO: 4517944 - DNA, 23 bp, Homo sapiens
ctttgccttgggctgctcctcat

SEQ ID NO: 4517945 - DNA, 19 bp, Homo sapiens
ctttgcgggatatttaggg

SEQ ID NO: 4517946 - DNA, 18 bp, Homo sapiens
ctttgctaaagacatgaa

SEQ ID NO: 4517947 - DNA, 14 bp, Homo sapiens
ctttgctatgtaag

SEQ ID NO: 4517948 - DNA, 11 bp, Homo sapiens
ctttgctgcag

SEQ ID NO: 4517949 - DNA, 11 bp, Homo sapiens
ctttgctgccc

SEQ ID NO: 4517950 - DNA, 17 bp, Homo sapiens
ctttgctgcccctgtct

SEQ ID NO: 4517951 - DNA, 18 bp, Homo sapiens
ctttgctgcccctgtctg

SEQ ID NO: 4517952 - DNA, 22 bp, Homo sapiens
ctttgctgcccctgtctggaag

SEQ ID NO: 4517953 - DNA, 13 bp, Homo sapiens
ctttgctgttact

SEQ ID NO: 4517954 - DNA, 19 bp, Homo sapiens
ctttgctgttattgacagc

SEQ ID NO: 4517955 - DNA, 14 bp, Homo sapiens
ctttgcttgaacac

SEQ ID NO: 4517956 - DNA, 14 bp, Homo sapiens
ctttgctttgtagg

SEQ ID NO: 4517957 - DNA, 17 bp, Homo sapiens
ctttggaatattttatc

SEQ ID NO: 4517958 - DNA, 15 bp, Homo sapiens
ctttggacccagggc

SEQ ID NO: 4517959 - DNA, 18 bp, Homo sapiens
ctttggacccagggcctg

SEQ ID NO: 4517960 - DNA, 16 bp, Homo sapiens
ctttggcactctctgc

SEQ ID NO: 4517961 - DNA, 18 bp, Homo sapiens
ctttggcactctctgcca

SEQ ID NO: 4517962 - DNA, 15 bp, Homo sapiens
ctttggcccagggtg

SEQ ID NO: 4517963 - DNA, 18 bp, Homo sapiens
ctttggctggtagcagca

SEQ ID NO: 4517964 - DNA, 20 bp, Homo sapiens
ctttggctggtagcagcagg

SEQ ID NO: 4517965 - DNA, 13 bp, Homo sapiens
ctttgggaagggg

SEQ ID NO: 4517966 - DNA, 13 bp, Homo sapiens
ctttgggaggcag

SEQ ID NO: 4517967 - DNA, 14 bp, Homo sapiens
ctttgggaggcagg

SEQ ID NO: 4517968 - DNA, 15 bp, Homo sapiens
ctttgggcccaggga

SEQ ID NO: 4517969 - DNA, 18 bp, Homo sapiens
ctttggggctaatttaac

SEQ ID NO: 4517970 - DNA, 22 bp, Homo sapiens
ctttggggtcctagcccagtgc

SEQ ID NO: 4517971 - DNA, 23 bp, Homo sapiens
ctttggggtcctagcccagtgct

SEQ ID NO: 4517972 - DNA, 14 bp, Homo sapiens
ctttggtcctggtg

SEQ ID NO: 4517973 - DNA, 18 bp, Homo sapiens
ctttggtgaacagttttg

SEQ ID NO: 4517974 - DNA, 20 bp, Homo sapiens
ctttggtgcctttcctgttc

SEQ ID NO: 4517975 - DNA, 19 bp, Homo sapiens
ctttggttaagggctccct

SEQ ID NO: 4517976 - DNA, 14 bp, Homo sapiens
ctttggttaataca

SEQ ID NO: 4517977 - DNA, 21 bp, Homo sapiens
ctttggttatttcagccccca

SEQ ID NO: 4517978 - DNA, 23 bp, Homo sapiens
ctttggtttatggttttcattca

SEQ ID NO: 4517979 - DNA, 11 bp, Homo sapiens
ctttggttttg

SEQ ID NO: 4517980 - DNA, 17 bp, Homo sapiens
ctttggttttggaggag

SEQ ID NO: 4517981 - DNA, 18 bp, Homo sapiens
ctttggttttggaggagg

SEQ ID NO: 4517982 - DNA, 11 bp, Homo sapiens
ctttggttttt

SEQ ID NO: 4517983 - DNA, 12 bp, Homo sapiens
ctttgtaaatag

SEQ ID NO: 4517984 - DNA, 21 bp, Homo sapiens
ctttgtaaatgcatattaaat

SEQ ID NO: 4517985 - DNA, 19 bp, Homo sapiens
ctttgtacagagtgctttt

SEQ ID NO: 4517986 - DNA, 15 bp, Homo sapiens
ctttgtaccaaaatt

SEQ ID NO: 4517987 - DNA, 16 bp, Homo sapiens
ctttgtatacaagtac

SEQ ID NO: 4517988 - DNA, 14 bp, Homo sapiens
ctttgtatacttta

SEQ ID NO: 4517989 - DNA, 17 bp, Homo sapiens
ctttgtatactttaaat

SEQ ID NO: 4517990 - DNA, 19 bp, Homo sapiens
ctttgtatactttaaataa

SEQ ID NO: 4517991 - DNA, 18 bp, Homo sapiens
ctttgtatataggcttct

SEQ ID NO: 4517992 - DNA, 18 bp, Homo sapiens
ctttgtatcattcatctt

SEQ ID NO: 4517993 - DNA, 13 bp, Homo sapiens
ctttgtatctttc

SEQ ID NO: 4517994 - DNA, 17 bp, Homo sapiens
ctttgtattcttcatga

SEQ ID NO: 4517995 - DNA, 19 bp, Homo sapiens
ctttgtattcttcatgaaa

SEQ ID NO: 4517996 - DNA, 21 bp, Homo sapiens
ctttgtattcttcatgaaatg

SEQ ID NO: 4517997 - DNA, 17 bp, Homo sapiens
ctttgtcacttgccaca

SEQ ID NO: 4517998 - DNA, 18 bp, Homo sapiens
ctttgtccttttgctctt

SEQ ID NO: 4517999 - DNA, 13 bp, Homo sapiens
ctttgtctttcaa

SEQ ID NO: 4518000 - DNA, 14 bp, Homo sapiens
ctttgtctttcaaa

SEQ ID NO: 4518001 - DNA, 17 bp, Homo sapiens
ctttgtcttttcaatct

SEQ ID NO: 4518002 - DNA, 14 bp, Homo sapiens
ctttgtgacaggaa

SEQ ID NO: 4518003 - DNA, 14 bp, Homo sapiens
ctttgtgaccagaa

SEQ ID NO: 4518004 - DNA, 19 bp, Homo sapiens
ctttgtgagagtgagctgt

SEQ ID NO: 4518005 - DNA, 16 bp, Homo sapiens
ctttgtgcacatttat

SEQ ID NO: 4518006 - DNA, 23 bp, Homo sapiens
ctttgtgcacatttatttcctcc

SEQ ID NO: 4518007 - DNA, 16 bp, Homo sapiens
ctttgtgctgcgcctg

SEQ ID NO: 4518008 - DNA, 19 bp, Homo sapiens
ctttgtggaccaattattg

SEQ ID NO: 4518009 - DNA, 17 bp, Homo sapiens
ctttgtgtaatctaagt

SEQ ID NO: 4518010 - DNA, 18 bp, Homo sapiens
ctttgtgtaatctaagta

SEQ ID NO: 4518011 - DNA, 15 bp, Homo sapiens
ctttgtgttcatttc

SEQ ID NO: 4518012 - DNA, 11 bp, Homo sapiens
ctttgtgttgg

SEQ ID NO: 4518013 - DNA, 19 bp, Homo sapiens
ctttgttgcaagatgtgaa

SEQ ID NO: 4518014 - DNA, 21 bp, Homo sapiens
ctttgttgcaagatgtgaatt

SEQ ID NO: 4518015 - DNA, 13 bp, Homo sapiens
ctttgtttagaaa

SEQ ID NO: 4518016 - DNA, 13 bp, Homo sapiens
ctttgtttatgca

SEQ ID NO: 4518017 - DNA, 15 bp, Homo sapiens
ctttgtttcaacttt

SEQ ID NO: 4518018 - DNA, 15 bp, Homo sapiens
ctttgtttcttgttt

SEQ ID NO: 4518019 - DNA, 17 bp, Homo sapiens
ctttgtttctttcttcc

SEQ ID NO: 4518020 - DNA, 19 bp, Homo sapiens
ctttgtttctttcttcctc

SEQ ID NO: 4518021 - DNA, 20 bp, Homo sapiens
cttttaaaatgtagaaactt

SEQ ID NO: 4518022 - DNA, 20 bp, Homo sapiens
cttttaaaattgaatagttt

SEQ ID NO: 4518023 - DNA, 22 bp, Homo sapiens
cttttaaactactatttttctt

SEQ ID NO: 4518024 - DNA, 15 bp, Homo sapiens
cttttaaactgtgta

SEQ ID NO: 4518025 - DNA, 14 bp, Homo sapiens
cttttaaagatttg

SEQ ID NO: 4518026 - DNA, 21 bp, Homo sapiens
cttttaaagtatttataaaaa

SEQ ID NO: 4518027 - DNA, 19 bp, Homo sapiens
cttttaaattagaaaatat

SEQ ID NO: 4518028 - DNA, 18 bp, Homo sapiens
cttttaaccatctgatat

SEQ ID NO: 4518029 - DNA, 17 bp, Homo sapiens
cttttaactatgtaata

SEQ ID NO: 4518030 - DNA, 18 bp, Homo sapiens
cttttaactatgtaataa

SEQ ID NO: 4518031 - DNA, 14 bp, Homo sapiens
cttttaactgccgc

SEQ ID NO: 4518032 - DNA, 23 bp, Homo sapiens
cttttaaggataaatcataaagt

SEQ ID NO: 4518033 - DNA, 17 bp, Homo sapiens
cttttaagtgccttgga

SEQ ID NO: 4518034 - DNA, 21 bp, Homo sapiens
cttttaagtttgaaactaact

SEQ ID NO: 4518035 - DNA, 13 bp, Homo sapiens
cttttaatgaaaa

SEQ ID NO: 4518036 - DNA, 18 bp, Homo sapiens
cttttaccagcttttaac

SEQ ID NO: 4518037 - DNA, 14 bp, Homo sapiens
cttttacctgctgc

SEQ ID NO: 4518038 - DNA, 16 bp, Homo sapiens
cttttaggttgttacc

SEQ ID NO: 4518039 - DNA, 24 bp, Homo sapiens
cttttataaattaaatatatgtat

SEQ ID NO: 4518040 - DNA, 15 bp, Homo sapiens
cttttataaggaaac

SEQ ID NO: 4518041 - DNA, 16 bp, Homo sapiens
cttttataaggaaact

SEQ ID NO: 4518042 - DNA, 12 bp, Homo sapiens
cttttataattc

SEQ ID NO: 4518043 - DNA, 21 bp, Homo sapiens
cttttatacaataattgaagt

SEQ ID NO: 4518044 - DNA, 17 bp, Homo sapiens
cttttatactctttctg

SEQ ID NO: 4518045 - DNA, 21 bp, Homo sapiens
cttttatagtggaaaaacaca

SEQ ID NO: 4518046 - DNA, 19 bp, Homo sapiens
cttttatattcaaattcat

SEQ ID NO: 4518047 - DNA, 22 bp, Homo sapiens
cttttatattctaatagttttt

SEQ ID NO: 4518048 - DNA, 22 bp, Homo sapiens
cttttatcacttaatttgaaat

SEQ ID NO: 4518049 - DNA, 17 bp, Homo sapiens
cttttatgcagcaaata

SEQ ID NO: 4518050 - DNA, 18 bp, Homo sapiens
cttttatggatgattaaa

SEQ ID NO: 4518051 - DNA, 21 bp, Homo sapiens
cttttatgtgagatttcctta

SEQ ID NO: 4518052 - DNA, 15 bp, Homo sapiens
cttttattaatactt

SEQ ID NO: 4518053 - DNA, 19 bp, Homo sapiens
cttttattaatgcactttc

SEQ ID NO: 4518054 - DNA, 18 bp, Homo sapiens
cttttattcctttgaata

SEQ ID NO: 4518055 - DNA, 11 bp, Homo sapiens
cttttattctg

SEQ ID NO: 4518056 - DNA, 20 bp, Homo sapiens
cttttattctgttatatagt

SEQ ID NO: 4518057 - DNA, 22 bp, Homo sapiens
cttttatttaacaaaaaatgta

SEQ ID NO: 4518058 - DNA, 17 bp, Homo sapiens
cttttcaatgtctaaaa

SEQ ID NO: 4518059 - DNA, 18 bp, Homo sapiens
cttttcaatgtctaaaaa

SEQ ID NO: 4518060 - DNA, 21 bp, Homo sapiens
cttttcaatgtgattcttcta

SEQ ID NO: 4518061 - DNA, 15 bp, Homo sapiens
cttttcactttctgt

SEQ ID NO: 4518062 - DNA, 14 bp, Homo sapiens
cttttcaggaaaat

SEQ ID NO: 4518063 - DNA, 15 bp, Homo sapiens
cttttcatatcattt

SEQ ID NO: 4518064 - DNA, 13 bp, Homo sapiens
cttttcccatcac

SEQ ID NO: 4518065 - DNA, 14 bp, Homo sapiens
cttttccccggtcc

SEQ ID NO: 4518066 - DNA, 13 bp, Homo sapiens
cttttccctgctt

SEQ ID NO: 4518067 - DNA, 22 bp, Homo sapiens
cttttcccttacaaggtgggga

SEQ ID NO: 4518068 - DNA, 14 bp, Homo sapiens
cttttcctctgcct

SEQ ID NO: 4518069 - DNA, 13 bp, Homo sapiens
cttttcctgctgc

SEQ ID NO: 4518070 - DNA, 16 bp, Homo sapiens
cttttcctggcagctg

SEQ ID NO: 4518071 - DNA, 19 bp, Homo sapiens
cttttcctggcagctgctg

SEQ ID NO: 4518072 - DNA, 21 bp, Homo sapiens
cttttcctggcagctgctgtg

SEQ ID NO: 4518073 - DNA, 16 bp, Homo sapiens
cttttcctttgtggtt

SEQ ID NO: 4518074 - DNA, 21 bp, Homo sapiens
cttttcgcttgcttctgcagc

SEQ ID NO: 4518075 - DNA, 22 bp, Homo sapiens
cttttcgtttagaatcagaata

SEQ ID NO: 4518076 - DNA, 23 bp, Homo sapiens
cttttcgtttagaatcagaataa

SEQ ID NO: 4518077 - DNA, 16 bp, Homo sapiens
cttttctaacagaaag

SEQ ID NO: 4518078 - DNA, 14 bp, Homo sapiens
cttttctaactttt

SEQ ID NO: 4518079 - DNA, 13 bp, Homo sapiens
cttttctaattaa

SEQ ID NO: 4518080 - DNA, 16 bp, Homo sapiens
cttttctaattaatag

SEQ ID NO: 4518081 - DNA, 19 bp, Homo sapiens
cttttctacacactcagcc

SEQ ID NO: 4518082 - DNA, 16 bp, Homo sapiens
cttttctaggaagcac

SEQ ID NO: 4518083 - DNA, 12 bp, Homo sapiens
cttttctagttt

SEQ ID NO: 4518084 - DNA, 15 bp, Homo sapiens
cttttctcaggagct

SEQ ID NO: 4518085 - DNA, 17 bp, Homo sapiens
cttttctcctttaccag

SEQ ID NO: 4518086 - DNA, 18 bp, Homo sapiens
cttttctcctttaccagt

SEQ ID NO: 4518087 - DNA, 21 bp, Homo sapiens
cttttctctttaattttaact

SEQ ID NO: 4518088 - DNA, 13 bp, Homo sapiens
cttttctcttttc

SEQ ID NO: 4518089 - DNA, 14 bp, Homo sapiens
cttttctgccaaaa

SEQ ID NO: 4518090 - DNA, 16 bp, Homo sapiens
cttttctgctgttgcc

SEQ ID NO: 4518091 - DNA, 13 bp, Homo sapiens
cttttctgtactt

SEQ ID NO: 4518092 - DNA, 13 bp, Homo sapiens
cttttctgtattt

SEQ ID NO: 4518093 - DNA, 17 bp, Homo sapiens
cttttctgtggctggct

SEQ ID NO: 4518094 - DNA, 18 bp, Homo sapiens
cttttctgtggctggctc

SEQ ID NO: 4518095 - DNA, 17 bp, Homo sapiens
cttttctgttctagttt

SEQ ID NO: 4518096 - DNA, 11 bp, Homo sapiens
cttttcttatt

SEQ ID NO: 4518097 - DNA, 19 bp, Homo sapiens
cttttcttattccttttta

SEQ ID NO: 4518098 - DNA, 20 bp, Homo sapiens
cttttcttggaactgtccca

SEQ ID NO: 4518099 - DNA, 21 bp, Homo sapiens
cttttcttggaactgtcccag

SEQ ID NO: 4518100 - DNA, 12 bp, Homo sapiens
cttttctttgta

SEQ ID NO: 4518101 - DNA, 19 bp, Homo sapiens
cttttgaaaaaaaagtttt

SEQ ID NO: 4518102 - DNA, 22 bp, Homo sapiens
cttttgaatcaatctggcttct

SEQ ID NO: 4518103 - DNA, 17 bp, Homo sapiens
cttttgacactgctcta

SEQ ID NO: 4518104 - DNA, 13 bp, Homo sapiens
cttttgagtgttc

SEQ ID NO: 4518105 - DNA, 14 bp, Homo sapiens
cttttgatagttct

SEQ ID NO: 4518106 - DNA, 23 bp, Homo sapiens
cttttgatatgcatatttgttta

SEQ ID NO: 4518107 - DNA, 14 bp, Homo sapiens
cttttgatgtctcc

SEQ ID NO: 4518108 - DNA, 21 bp, Homo sapiens
cttttgcaggaaaaggctaag

SEQ ID NO: 4518109 - DNA, 14 bp, Homo sapiens
cttttgctctctgt

SEQ ID NO: 4518110 - DNA, 17 bp, Homo sapiens
cttttgctgtttatact

SEQ ID NO: 4518111 - DNA, 20 bp, Homo sapiens
cttttgcttgccaaagtaca

SEQ ID NO: 4518112 - DNA, 14 bp, Homo sapiens
cttttgctttattc

SEQ ID NO: 4518113 - DNA, 17 bp, Homo sapiens
cttttggcctgggggag

SEQ ID NO: 4518114 - DNA, 23 bp, Homo sapiens
cttttggcctgggggaggtcaga

SEQ ID NO: 4518115 - DNA, 21 bp, Homo sapiens
cttttggtaaagactggcttt

SEQ ID NO: 4518116 - DNA, 21 bp, Homo sapiens
cttttggttaatatgtctttt

SEQ ID NO: 4518117 - DNA, 12 bp, Homo sapiens
cttttgtactga

SEQ ID NO: 4518118 - DNA, 12 bp, Homo sapiens
cttttgtattaa

SEQ ID NO: 4518119 - DNA, 19 bp, Homo sapiens
cttttgtattgtttctaca

SEQ ID NO: 4518120 - DNA, 24 bp, Homo sapiens
cttttgtccacttgtaagaatgtc

SEQ ID NO: 4518121 - DNA, 13 bp, Homo sapiens
cttttgtcctgca

SEQ ID NO: 4518122 - DNA, 13 bp, Homo sapiens
cttttgtgaatta

SEQ ID NO: 4518123 - DNA, 23 bp, Homo sapiens
cttttgtgatgaacatattcatg

SEQ ID NO: 4518124 - DNA, 15 bp, Homo sapiens
cttttgtggagggga

SEQ ID NO: 4518125 - DNA, 21 bp, Homo sapiens
cttttgtggaggggagggatg

SEQ ID NO: 4518126 - DNA, 20 bp, Homo sapiens
cttttgttaacagtatttct

SEQ ID NO: 4518127 - DNA, 12 bp, Homo sapiens
cttttgttaatg

SEQ ID NO: 4518128 - DNA, 23 bp, Homo sapiens
cttttgttaatgcattgttgtaa

SEQ ID NO: 4518129 - DNA, 19 bp, Homo sapiens
cttttgttgtactttatat

SEQ ID NO: 4518130 - DNA, 15 bp, Homo sapiens
cttttgtttcctttt

SEQ ID NO: 4518131 - DNA, 16 bp, Homo sapiens
cttttgtttccttttt

SEQ ID NO: 4518132 - DNA, 19 bp, Homo sapiens
cttttgtttccttttttcc

SEQ ID NO: 4518133 - DNA, 12 bp, Homo sapiens
ctttttaaaata

SEQ ID NO: 4518134 - DNA, 23 bp, Homo sapiens
ctttttaaagagatagcttctct

SEQ ID NO: 4518135 - DNA, 14 bp, Homo sapiens
ctttttaaagctta

SEQ ID NO: 4518136 - DNA, 22 bp, Homo sapiens
ctttttaaatagggaatatgat

SEQ ID NO: 4518137 - DNA, 20 bp, Homo sapiens
ctttttaaggtctttcagta

SEQ ID NO: 4518138 - DNA, 16 bp, Homo sapiens
ctttttagatgtattt

SEQ ID NO: 4518139 - DNA, 11 bp, Homo sapiens
ctttttataaa

SEQ ID NO: 4518140 - DNA, 15 bp, Homo sapiens
ctttttatgctattt

SEQ ID NO: 4518141 - DNA, 15 bp, Homo sapiens
ctttttattgccttc

SEQ ID NO: 4518142 - DNA, 16 bp, Homo sapiens
ctttttattgccttct

SEQ ID NO: 4518143 - DNA, 13 bp, Homo sapiens
ctttttatttgca

SEQ ID NO: 4518144 - DNA, 14 bp, Homo sapiens
ctttttatttgcat

SEQ ID NO: 4518145 - DNA, 13 bp, Homo sapiens
ctttttcataatt

SEQ ID NO: 4518146 - DNA, 12 bp, Homo sapiens
ctttttcattta

SEQ ID NO: 4518147 - DNA, 13 bp, Homo sapiens
ctttttcatttat

SEQ ID NO: 4518148 - DNA, 15 bp, Homo sapiens
ctttttcatttatct

SEQ ID NO: 4518149 - DNA, 18 bp, Homo sapiens
ctttttccaatgttttat

SEQ ID NO: 4518150 - DNA, 20 bp, Homo sapiens
ctttttcctgcgtcccagcc

SEQ ID NO: 4518151 - DNA, 20 bp, Homo sapiens
ctttttctaatgaggagaga

SEQ ID NO: 4518152 - DNA, 22 bp, Homo sapiens
ctttttctaatgaggagagaaa

SEQ ID NO: 4518153 - DNA, 13 bp, Homo sapiens
ctttttgacactg

SEQ ID NO: 4518154 - DNA, 15 bp, Homo sapiens
ctttttgacactgaa

SEQ ID NO: 4518155 - DNA, 14 bp, Homo sapiens
ctttttgcagcaat

SEQ ID NO: 4518156 - DNA, 18 bp, Homo sapiens
ctttttggaatctttgta

SEQ ID NO: 4518157 - DNA, 22 bp, Homo sapiens
ctttttggaattcagcagtttt

SEQ ID NO: 4518158 - DNA, 15 bp, Homo sapiens
ctttttggtggatgt

SEQ ID NO: 4518159 - DNA, 16 bp, Homo sapiens
ctttttggtggatgta

SEQ ID NO: 4518160 - DNA, 15 bp, Homo sapiens
ctttttgttcagaat

SEQ ID NO: 4518161 - DNA, 17 bp, Homo sapiens
ctttttgttgtaaaaca

SEQ ID NO: 4518162 - DNA, 21 bp, Homo sapiens
ctttttgttgtaaaacaaaat

SEQ ID NO: 4518163 - DNA, 14 bp, Homo sapiens
cttttttaaaataa

SEQ ID NO: 4518164 - DNA, 15 bp, Homo sapiens
cttttttaaaataaa

SEQ ID NO: 4518165 - DNA, 12 bp, Homo sapiens
cttttttaagtt

SEQ ID NO: 4518166 - DNA, 22 bp, Homo sapiens
cttttttcccataagacaatga

SEQ ID NO: 4518167 - DNA, 14 bp, Homo sapiens
cttttttctgcctc

SEQ ID NO: 4518168 - DNA, 15 bp, Homo sapiens
cttttttctgcctcc

SEQ ID NO: 4518169 - DNA, 19 bp, Homo sapiens
cttttttctgcctccttta

SEQ ID NO: 4518170 - DNA, 15 bp, Homo sapiens
cttttttgtttgaat

SEQ ID NO: 4518171 - DNA, 15 bp, Homo sapiens
cttttttgtttgttt

SEQ ID NO: 4518172 - DNA, 19 bp, Homo sapiens
ctttttttattactagtgt

SEQ ID NO: 4518173 - DNA, 20 bp, Homo sapiens
ctttttttattactagtgtt

SEQ ID NO: 4518174 - DNA, 11 bp, Homo sapiens
ctttttttcct

SEQ ID NO: 4518175 - DNA, 16 bp, Homo sapiens
ctttttttgtatgtgt

SEQ ID NO: 4518176 - DNA, 13 bp, Homo sapiens
ctttttttgtgtg

SEQ ID NO: 4518177 - DNA, 16 bp, Homo sapiens
cttttttttctgattc

SEQ ID NO: 4518178 - DNA, 15 bp, Homo sapiens
cttttttttgttttg

SEQ ID NO: 4518179 - DNA, 14 bp, Homo sapiens
ctttttttttaagt

SEQ ID NO: 4518180 - DNA, 18 bp, Homo sapiens
ctttttttttaagttctt

SEQ ID NO: 4518181 - DNA, 20 bp, Homo sapiens
ctttttttttcttcattgta

SEQ ID NO: 4518182 - DNA, 23 bp, Homo sapiens
cttttttttttcgtcttccctgc

SEQ ID NO: 4518183 - DNA, 23 bp, Homo sapiens
ctttttttttttgtttgatgcag

SEQ ID NO: 4518184 - DNA, 21 bp, Homo sapiens
gaaatatcagttactcagccc

SEQ ID NO: 4518185 - DNA, 23 bp, Homo sapiens
gaaatatcagttactcagccctg

SEQ ID NO: 4518186 - DNA, 14 bp, Homo sapiens
gaaatatcatgtta

SEQ ID NO: 4518187 - DNA, 16 bp, Homo sapiens
gaaatatgaagagcaa

SEQ ID NO: 4518188 - DNA, 20 bp, Homo sapiens
gaaatattaagaacatttta

SEQ ID NO: 4518189 - DNA, 23 bp, Homo sapiens
gaaatattaagagctattttaga

SEQ ID NO: 4518190 - DNA, 16 bp, Homo sapiens
gaaatcaaatatgcaa

SEQ ID NO: 4518191 - DNA, 20 bp, Homo sapiens
gaaatcaaatatgcaaagca

SEQ ID NO: 4518192 - DNA, 11 bp, Homo sapiens
gaaatccagga

SEQ ID NO: 4518193 - DNA, 18 bp, Homo sapiens
gaaatccccccttcagaa

SEQ ID NO: 4518194 - DNA, 12 bp, Homo sapiens
gaaatcctcagc

SEQ ID NO: 4518195 - DNA, 16 bp, Homo sapiens
gaaatcctgccctgga

SEQ ID NO: 4518196 - DNA, 12 bp, Homo sapiens
gaaatctgtatt

SEQ ID NO: 4518197 - DNA, 18 bp, Homo sapiens
gaaatcttttacattttt

SEQ ID NO: 4518198 - DNA, 13 bp, Homo sapiens
gaaatgaaaggga

SEQ ID NO: 4518199 - DNA, 13 bp, Homo sapiens
gaaatgaacattc

SEQ ID NO: 4518200 - DNA, 14 bp, Homo sapiens
gaaatgaacattcc

SEQ ID NO: 4518201 - DNA, 15 bp, Homo sapiens
gaaatgaatgattct

SEQ ID NO: 4518202 - DNA, 15 bp, Homo sapiens
gaaatgaattaaagt

SEQ ID NO: 4518203 - DNA, 15 bp, Homo sapiens
gaaatgagaaggcag

SEQ ID NO: 4518204 - DNA, 22 bp, Homo sapiens
gaaatgaggtctgtttaaagtg

SEQ ID NO: 4518205 - DNA, 13 bp, Homo sapiens
gaaatgaggtttt

SEQ ID NO: 4518206 - DNA, 15 bp, Homo sapiens
gaaatgataaagact

SEQ ID NO: 4518207 - DNA, 16 bp, Homo sapiens
gaaatgataaagactt

SEQ ID NO: 4518208 - DNA, 22 bp, Homo sapiens
gaaatgattcaaattgctgctt

SEQ ID NO: 4518209 - DNA, 22 bp, Homo sapiens
gaaatgcataccagtaattggc

SEQ ID NO: 4518210 - DNA, 23 bp, Homo sapiens
gaaatgcatccattcctcaggga

SEQ ID NO: 4518211 - DNA, 12 bp, Homo sapiens
gaaatgccaaag

SEQ ID NO: 4518212 - DNA, 23 bp, Homo sapiens
gaaatgctggtttttcagttttc

SEQ ID NO: 4518213 - DNA, 16 bp, Homo sapiens
gaaatgcttttatatt

SEQ ID NO: 4518214 - DNA, 19 bp, Homo sapiens
gaaatgcttttatattcta

SEQ ID NO: 4518215 - DNA, 20 bp, Homo sapiens
gaaatggactggtttgagat

SEQ ID NO: 4518216 - DNA, 17 bp, Homo sapiens
gaaatggctatgaacag

SEQ ID NO: 4518217 - DNA, 15 bp, Homo sapiens
gaaatggtggaactg

SEQ ID NO: 4518218 - DNA, 20 bp, Homo sapiens
gaaatggtttcacttgctct

SEQ ID NO: 4518219 - DNA, 23 bp, Homo sapiens
gaaatggtttcacttgctctttg

SEQ ID NO: 4518220 - DNA, 22 bp, Homo sapiens
gaaatgtaagggaaactgccag

SEQ ID NO: 4518221 - DNA, 12 bp, Homo sapiens
gaaatgtacact

SEQ ID NO: 4518222 - DNA, 17 bp, Homo sapiens
gaaatgtacacttttta

SEQ ID NO: 4518223 - DNA, 16 bp, Homo sapiens
gaaatgtacgtcattt

SEQ ID NO: 4518224 - DNA, 18 bp, Homo sapiens
gaaattaaatccaataaa

SEQ ID NO: 4518225 - DNA, 12 bp, Homo sapiens
gaaattaacaca

SEQ ID NO: 4518226 - DNA, 23 bp, Homo sapiens
gaaattaagactttatgtagttt

SEQ ID NO: 4518227 - DNA, 17 bp, Homo sapiens
gaaattacctgtggata

SEQ ID NO: 4518228 - DNA, 19 bp, Homo sapiens
gaaattacctgtggatatt

SEQ ID NO: 4518229 - DNA, 20 bp, Homo sapiens
gaaattactaattttacttc

SEQ ID NO: 4518230 - DNA, 15 bp, Homo sapiens
gaaattctgaatttg

SEQ ID NO: 4518231 - DNA, 16 bp, Homo sapiens
gaaattctgaatttgc

SEQ ID NO: 4518232 - DNA, 18 bp, Homo sapiens
gaaattcttgttatggta

SEQ ID NO: 4518233 - DNA, 22 bp, Homo sapiens
gaaattcttgttatggtagaaa

SEQ ID NO: 4518234 - DNA, 22 bp, Homo sapiens
gaaattgactgatgattttcct

SEQ ID NO: 4518235 - DNA, 12 bp, Homo sapiens
gaaattgtttat

SEQ ID NO: 4518236 - DNA, 13 bp, Homo sapiens
gaaatttaaacta

SEQ ID NO: 4518237 - DNA, 16 bp, Homo sapiens
gaaatttactgtgaga

SEQ ID NO: 4518238 - DNA, 20 bp, Homo sapiens
gaaatttcctaatttattct

SEQ ID NO: 4518239 - DNA, 22 bp, Homo sapiens
gaaattttaacctatgatattt

SEQ ID NO: 4518240 - DNA, 21 bp, Homo sapiens
gaaattttatatgtaaatgtg

SEQ ID NO: 4518241 - DNA, 22 bp, Homo sapiens
gaaattttatatgtaaatgtgt

SEQ ID NO: 4518242 - DNA, 16 bp, Homo sapiens
gaaattttcttgattt

SEQ ID NO: 4518243 - DNA, 13 bp, Homo sapiens
gaaattttgctat

SEQ ID NO: 4518244 - DNA, 12 bp, Homo sapiens
gaaattttgtaa

SEQ ID NO: 4518245 - DNA, 19 bp, Homo sapiens
gaacaaaaatgtttccact

SEQ ID NO: 4518246 - DNA, 13 bp, Homo sapiens
gaacaaaagggtc

SEQ ID NO: 4518247 - DNA, 14 bp, Homo sapiens
gaacaaaagggtca

SEQ ID NO: 4518248 - DNA, 14 bp, Homo sapiens
gaacaaagacattt

SEQ ID NO: 4518249 - DNA, 17 bp, Homo sapiens
gaacaaagtgaaggaca

SEQ ID NO: 4518250 - DNA, 14 bp, Homo sapiens
gaacaaattatttt

SEQ ID NO: 4518251 - DNA, 14 bp, Homo sapiens
gaacaacttgtagc

SEQ ID NO: 4518252 - DNA, 12 bp, Homo sapiens
gaacaaggaagg

SEQ ID NO: 4518253 - DNA, 19 bp, Homo sapiens
gaacaatgtatacaatgca

SEQ ID NO: 4518254 - DNA, 16 bp, Homo sapiens
gaacacaaccagaggt

SEQ ID NO: 4518255 - DNA, 12 bp, Homo sapiens
gaacacaggggc

SEQ ID NO: 4518256 - DNA, 15 bp, Homo sapiens
gaacacattttaaat

SEQ ID NO: 4518257 - DNA, 21 bp, Homo sapiens
gaacaccagagacctcaaatt

SEQ ID NO: 4518258 - DNA, 23 bp, Homo sapiens
gaacaccttggggtccctccacc

SEQ ID NO: 4518259 - DNA, 13 bp, Homo sapiens
gaacactattttc

SEQ ID NO: 4518260 - DNA, 16 bp, Homo sapiens
gaacactcttttgctt

SEQ ID NO: 4518261 - DNA, 16 bp, Homo sapiens
gaacagacaggagaaa

SEQ ID NO: 4518262 - DNA, 21 bp, Homo sapiens
gaacagagagacccttgtggg

SEQ ID NO: 4518263 - DNA, 11 bp, Homo sapiens
gaacagccccg

SEQ ID NO: 4518264 - DNA, 12 bp, Homo sapiens
gaacagccccgg

SEQ ID NO: 4518265 - DNA, 17 bp, Homo sapiens
gaacagctttgtatgtt

SEQ ID NO: 4518266 - DNA, 21 bp, Homo sapiens
gaacaggtcccacgccaggcc

SEQ ID NO: 4518267 - DNA, 18 bp, Homo sapiens
gaacagtattgggcagga

SEQ ID NO: 4518268 - DNA, 21 bp, Homo sapiens
gaacagtattgggcaggagga

SEQ ID NO: 4518269 - DNA, 16 bp, Homo sapiens
gaacagtgattaccag

SEQ ID NO: 4518270 - DNA, 21 bp, Homo sapiens
gaacatacatgatacattttt

SEQ ID NO: 4518271 - DNA, 22 bp, Homo sapiens
gaacataccccttacaaatgaa

SEQ ID NO: 4518272 - DNA, 18 bp, Homo sapiens
gaacatattgttgaaagg

SEQ ID NO: 4518273 - DNA, 13 bp, Homo sapiens
gaacatctcacct

SEQ ID NO: 4518274 - DNA, 12 bp, Homo sapiens
gaacatgcagtt

SEQ ID NO: 4518275 - DNA, 13 bp, Homo sapiens
gaacattaaaata

SEQ ID NO: 4518276 - DNA, 22 bp, Homo sapiens
gaacattaaaatatagagacag

SEQ ID NO: 4518277 - DNA, 18 bp, Homo sapiens
gaacattattcatctctc

SEQ ID NO: 4518278 - DNA, 17 bp, Homo sapiens
gaacattcacttttgtt

SEQ ID NO: 4518279 - DNA, 23 bp, Homo sapiens
gaaccaaaaatcccaccttccca

SEQ ID NO: 4518280 - DNA, 19 bp, Homo sapiens
gaaccaacaagtaaatatt

SEQ ID NO: 4518281 - DNA, 13 bp, Homo sapiens
gaaccacagcaga

SEQ ID NO: 4518282 - DNA, 14 bp, Homo sapiens
gaaccacagcagac

SEQ ID NO: 4518283 - DNA, 17 bp, Homo sapiens
gaaccacagcagacacc

SEQ ID NO: 4518284 - DNA, 19 bp, Homo sapiens
gaaccacagcagacaccat

SEQ ID NO: 4518285 - DNA, 20 bp, Homo sapiens
gaaccagccgtattttacat

SEQ ID NO: 4518286 - DNA, 23 bp, Homo sapiens
gaaccaggccagagcaaacagaa

SEQ ID NO: 4518287 - DNA, 14 bp, Homo sapiens
gaaccattatactt

SEQ ID NO: 4518288 - DNA, 16 bp, Homo sapiens
gaaccattatacttta

SEQ ID NO: 4518289 - DNA, 15 bp, Homo sapiens
gaaccatttcaccca

SEQ ID NO: 4518290 - DNA, 15 bp, Homo sapiens
gaaccccagaggcag

SEQ ID NO: 4518291 - DNA, 17 bp, Homo sapiens
gaacccccaaatttaat

SEQ ID NO: 4518292 - DNA, 19 bp, Homo sapiens
gaacccgggaggcagaggt

SEQ ID NO: 4518293 - DNA, 17 bp, Homo sapiens
gaacccgggggacagag

SEQ ID NO: 4518294 - DNA, 15 bp, Homo sapiens
gaaccgaggcaggga

SEQ ID NO: 4518295 - DNA, 21 bp, Homo sapiens
gaaccgagggggctgctccca

SEQ ID NO: 4518296 - DNA, 22 bp, Homo sapiens
gaaccgagggggctgctcccac

SEQ ID NO: 4518297 - DNA, 15 bp, Homo sapiens
gaacctaatgcactc

SEQ ID NO: 4518298 - DNA, 18 bp, Homo sapiens
gaacctacagttttaact

SEQ ID NO: 4518299 - DNA, 22 bp, Homo sapiens
gaacctacctgccttggagagg

SEQ ID NO: 4518300 - DNA, 20 bp, Homo sapiens
gaacctcgagtactgtgggc

SEQ ID NO: 4518301 - DNA, 22 bp, Homo sapiens
gaacctcgagtactgtgggcaa

SEQ ID NO: 4518302 - DNA, 22 bp, Homo sapiens
gaacctgagttcccgggagctg

SEQ ID NO: 4518303 - DNA, 16 bp, Homo sapiens
gaacctgcaaaaaata

SEQ ID NO: 4518304 - DNA, 15 bp, Homo sapiens
gaacctggagggcta

SEQ ID NO: 4518305 - DNA, 21 bp, Homo sapiens
gaaacagattcaggccagccc

SEQ ID NO: 4518306 - DNA, 22 bp, Homo sapiens
gaaacagattcaggccagccca

SEQ ID NO: 4518307 - DNA, 14 bp, Homo sapiens
gaaacagctgcctt

SEQ ID NO: 4518308 - DNA, 20 bp, Homo sapiens
gaaacagctgccttagcttc

SEQ ID NO: 4518309 - DNA, 22 bp, Homo sapiens
gaaacagctgccttagcttcag

SEQ ID NO: 4518310 - DNA, 15 bp, Homo sapiens
gaaacagttggcact

SEQ ID NO: 4518311 - DNA, 21 bp, Homo sapiens
gaaacagttggcactgtaagg

SEQ ID NO: 4518312 - DNA, 18 bp, Homo sapiens
gaaacagttggtaacttt

SEQ ID NO: 4518313 - DNA, 21 bp, Homo sapiens
gaaacagttggtaacttttgt

SEQ ID NO: 4518314 - DNA, 19 bp, Homo sapiens
gaaacatgcagctcttcaa

SEQ ID NO: 4518315 - DNA, 19 bp, Homo sapiens
gaaacattttgatttcctc

SEQ ID NO: 4518316 - DNA, 20 bp, Homo sapiens
gaaacattttttcttctgaa

SEQ ID NO: 4518317 - DNA, 22 bp, Homo sapiens
gaaaccaccgtgaaccagaggg

SEQ ID NO: 4518318 - DNA, 16 bp, Homo sapiens
gaaaccactaaagtag

SEQ ID NO: 4518319 - DNA, 16 bp, Homo sapiens
gaaaccagaaaagcaa

SEQ ID NO: 4518320 - DNA, 14 bp, Homo sapiens
gaaaccctgtctct

SEQ ID NO: 4518321 - DNA, 17 bp, Homo sapiens
gaaaccgtcctcttttt

SEQ ID NO: 4518322 - DNA, 21 bp, Homo sapiens
gaaacctacagacaaggagga

SEQ ID NO: 4518323 - DNA, 15 bp, Homo sapiens
gaaacctcagggctg

SEQ ID NO: 4518324 - DNA, 19 bp, Homo sapiens
gaaacctcagggctgtccc

SEQ ID NO: 4518325 - DNA, 20 bp, Homo sapiens
gaaacctcagggctgtccca

SEQ ID NO: 4518326 - DNA, 21 bp, Homo sapiens
gaaacctcagggctgtcccag

SEQ ID NO: 4518327 - DNA, 19 bp, Homo sapiens
gaaacctgctctgtaggag

SEQ ID NO: 4518328 - DNA, 14 bp, Homo sapiens
gaaaccttccaccc

SEQ ID NO: 4518329 - DNA, 15 bp, Homo sapiens
gaaaccttccaccca

SEQ ID NO: 4518330 - DNA, 15 bp, Homo sapiens
gaaaccttgctctcc

SEQ ID NO: 4518331 - DNA, 19 bp, Homo sapiens
gaaaccttgctctcctcat

SEQ ID NO: 4518332 - DNA, 20 bp, Homo sapiens
gaaaccttttcttgtatctg

SEQ ID NO: 4518333 - DNA, 17 bp, Homo sapiens
gaaactaaacagaaaac

SEQ ID NO: 4518334 - DNA, 18 bp, Homo sapiens
gaaactaaacagaaaact

SEQ ID NO: 4518335 - DNA, 21 bp, Homo sapiens
gaaactaaggttagaaacatt

SEQ ID NO: 4518336 - DNA, 20 bp, Homo sapiens
gaaactaattgactttagaa

SEQ ID NO: 4518337 - DNA, 20 bp, Homo sapiens
gaaactactgcctttagaaa

SEQ ID NO: 4518338 - DNA, 19 bp, Homo sapiens
gaaactatgtgtttttctc

SEQ ID NO: 4518339 - DNA, 17 bp, Homo sapiens
gaaactccacatctgcc

SEQ ID NO: 4518340 - DNA, 20 bp, Homo sapiens
gaaactccgaagaaaagaat

SEQ ID NO: 4518341 - DNA, 18 bp, Homo sapiens
gaaactccgtcttagaag

SEQ ID NO: 4518342 - DNA, 16 bp, Homo sapiens
gaaactcgggcttgag

SEQ ID NO: 4518343 - DNA, 23 bp, Homo sapiens
gaaactgagcgaaatccaagatg

SEQ ID NO: 4518344 - DNA, 18 bp, Homo sapiens
gaaactgagtcactcaca

SEQ ID NO: 4518345 - DNA, 15 bp, Homo sapiens
gaaactgccagcaac

SEQ ID NO: 4518346 - DNA, 14 bp, Homo sapiens
gaaactgctgcaga

SEQ ID NO: 4518347 - DNA, 11 bp, Homo sapiens
gaaactggctg

SEQ ID NO: 4518348 - DNA, 21 bp, Homo sapiens
gaaacttaaatgttattatct

SEQ ID NO: 4518349 - DNA, 14 bp, Homo sapiens
gaaagaaaaaattt

SEQ ID NO: 4518350 - DNA, 15 bp, Homo sapiens
gaaagaatagaaaga

SEQ ID NO: 4518351 - DNA, 19 bp, Homo sapiens
gaaagaatagaaagaaagt

SEQ ID NO: 4518352 - DNA, 17 bp, Homo sapiens
gaaagactgaagaaagt

SEQ ID NO: 4518353 - DNA, 19 bp, Homo sapiens
gaaagactgaagaaagtgt

SEQ ID NO: 4518354 - DNA, 18 bp, Homo sapiens
gaaagagaaacagttggt

SEQ ID NO: 4518355 - DNA, 20 bp, Homo sapiens
gaaagagagcaccacgtgat

SEQ ID NO: 4518356 - DNA, 21 bp, Homo sapiens
gaaagaggaatgaagtactca

SEQ ID NO: 4518357 - DNA, 20 bp, Homo sapiens
gaaagaggcaccaggaagcc

SEQ ID NO: 4518358 - DNA, 21 bp, Homo sapiens
gaaagaggcaccaggaagccg

SEQ ID NO: 4518359 - DNA, 20 bp, Homo sapiens
gaaagaggcagcttgaaact

SEQ ID NO: 4518360 - DNA, 13 bp, Homo sapiens
gaaagagggacaa

SEQ ID NO: 4518361 - DNA, 23 bp, Homo sapiens
gaaagatttgtgaactggaagaa

SEQ ID NO: 4518362 - DNA, 14 bp, Homo sapiens
gaaagcaataaatg

SEQ ID NO: 4518363 - DNA, 14 bp, Homo sapiens
gaaagcagaacagt

SEQ ID NO: 4518364 - DNA, 18 bp, Homo sapiens
gaaagcataaagctcaaa

SEQ ID NO: 4518365 - DNA, 17 bp, Homo sapiens
gaaagccaccttgttac

SEQ ID NO: 4518366 - DNA, 16 bp, Homo sapiens
gaaagccacgccctcc

SEQ ID NO: 4518367 - DNA, 18 bp, Homo sapiens
gaaagccacgccctccct

SEQ ID NO: 4518368 - DNA, 20 bp, Homo sapiens
gaaagccacgccctccctgc

SEQ ID NO: 4518369 - DNA, 21 bp, Homo sapiens
gaaagccacgccctccctgct

SEQ ID NO: 4518370 - DNA, 22 bp, Homo sapiens
gaaagccacgccctccctgcta

SEQ ID NO: 4518371 - DNA, 14 bp, Homo sapiens
gaaagccagaacct

SEQ ID NO: 4518372 - DNA, 19 bp, Homo sapiens
gaaagcccaaggtgctgat

SEQ ID NO: 4518373 - DNA, 16 bp, Homo sapiens
gaaagcctcctgcccc

SEQ ID NO: 4518374 - DNA, 19 bp, Homo sapiens
gaaagcctcctgccccctg

SEQ ID NO: 4518375 - DNA, 22 bp, Homo sapiens
gaaagcctcctgccccctgcca

SEQ ID NO: 4518376 - DNA, 18 bp, Homo sapiens
gaaagcgggcagccccgt

SEQ ID NO: 4518377 - DNA, 16 bp, Homo sapiens
gaaagcgtgtgagtga

SEQ ID NO: 4518378 - DNA, 21 bp, Homo sapiens
gaaagcgtgtgagtgagggag

SEQ ID NO: 4518379 - DNA, 16 bp, Homo sapiens
gaaagctagagatatg

SEQ ID NO: 4518380 - DNA, 20 bp, Homo sapiens
gaaagctgtgtttatatgga

SEQ ID NO: 4518381 - DNA, 14 bp, Homo sapiens
gaaagctttggaaa

SEQ ID NO: 4518382 - DNA, 21 bp, Homo sapiens
gaaagctttggaaaaatcttt

SEQ ID NO: 4518383 - DNA, 20 bp, Homo sapiens
gaaagcttttattcctttga

SEQ ID NO: 4518384 - DNA, 12 bp, Homo sapiens
gaaaggacagag

SEQ ID NO: 4518385 - DNA, 16 bp, Homo sapiens
gaaaggacagagccag

SEQ ID NO: 4518386 - DNA, 15 bp, Homo sapiens
gaaaggactcagtgt

SEQ ID NO: 4518387 - DNA, 21 bp, Homo sapiens
gaaaggatggagtgttttagt

SEQ ID NO: 4518388 - DNA, 13 bp, Homo sapiens
gaaaggattttac

SEQ ID NO: 4518389 - DNA, 17 bp, Homo sapiens
gaaaggattttaccaaa

SEQ ID NO: 4518390 - DNA, 24 bp, Homo sapiens
gaaaggattttaccaaagcatcaa

SEQ ID NO: 4518391 - DNA, 20 bp, Homo sapiens
gaaaggccccaatcttgccc

SEQ ID NO: 4518392 - DNA, 22 bp, Homo sapiens
gaaaggctgttaaatacaggaa

SEQ ID NO: 4518393 - DNA, 10 bp, Homo sapiens
gaaagggaaa

SEQ ID NO: 4518394 - DNA, 21 bp, Homo sapiens
gaaaggggagagcctgctggc

SEQ ID NO: 4518395 - DNA, 23 bp, Homo sapiens
gaaagggggtgacctcttgcctc

SEQ ID NO: 4518396 - DNA, 14 bp, Homo sapiens
gaaaggggtgcttt

SEQ ID NO: 4518397 - DNA, 23 bp, Homo sapiens
gaaaggtgagtttgagctgcctt

SEQ ID NO: 4518398 - DNA, 23 bp, Homo sapiens
gaaaggtgccatggaagaggcta

SEQ ID NO: 4518399 - DNA, 13 bp, Homo sapiens
gaaaggttctgcc

SEQ ID NO: 4518400 - DNA, 14 bp, Homo sapiens
gaaaggttctgccc

SEQ ID NO: 4518401 - DNA, 14 bp, Homo sapiens
gaaagtacccagca

SEQ ID NO: 4518402 - DNA, 17 bp, Homo sapiens
gaaagtatttacttttt

SEQ ID NO: 4518403 - DNA, 14 bp, Homo sapiens
gaaagtgatgacat

SEQ ID NO: 4518404 - DNA, 15 bp, Homo sapiens
gaaagtgatgacata

SEQ ID NO: 4518405 - DNA, 11 bp, Homo sapiens
gaaagtgtatt

SEQ ID NO: 4518406 - DNA, 18 bp, Homo sapiens
gaaagtgtgagctcttcc

SEQ ID NO: 4518407 - DNA, 14 bp, Homo sapiens
gaaagttgtacatg

SEQ ID NO: 4518408 - DNA, 17 bp, Homo sapiens
gaaagttttgtaaaaga

SEQ ID NO: 4518409 - DNA, 14 bp, Homo sapiens
gaaataaaaaagtc

SEQ ID NO: 4518410 - DNA, 18 bp, Homo sapiens
gaaataaaaaagtctcta

SEQ ID NO: 4518411 - DNA, 20 bp, Homo sapiens
gaaataaaaaagtctctatt

SEQ ID NO: 4518412 - DNA, 15 bp, Homo sapiens
gaaataaagggacca

SEQ ID NO: 4518413 - DNA, 17 bp, Homo sapiens
gaaataaagttgaatat

SEQ ID NO: 4518414 - DNA, 16 bp, Homo sapiens
gaaataagtaaatgta

SEQ ID NO: 4518415 - DNA, 17 bp, Homo sapiens
gaaatacagttctgctc

SEQ ID NO: 4518416 - DNA, 19 bp, Homo sapiens
gaaatacttaacacgtgaa

SEQ ID NO: 4518417 - DNA, 18 bp, Homo sapiens
gaaatagaaagaagccat

SEQ ID NO: 4518418 - DNA, 21 bp, Homo sapiens
gaaatagacaaaaagtatatt

SEQ ID NO: 4518419 - DNA, 18 bp, Homo sapiens
gaaatagatatcctctcc

SEQ ID NO: 4518420 - DNA, 20 bp, Homo sapiens
gaaataggagggaaaccttt

SEQ ID NO: 4518421 - DNA, 17 bp, Homo sapiens
gaaatagtcctgaagtt

SEQ ID NO: 4518422 - DNA, 16 bp, Homo sapiens
gaaatatacagtttga

SEQ ID NO: 4518423 - DNA, 18 bp, Homo sapiens
gaaatatatattgtaaag

SEQ ID NO: 4518424 - DNA, 20 bp, Homo sapiens
cttttttttttttttacagt

SEQ ID NO: 4518425 - DNA, 21 bp, Homo sapiens
ctttttttttttttttgtgta

SEQ ID NO: 4518426 - DNA, 19 bp, Homo sapiens
gaaaaaaaagtttttaatt

SEQ ID NO: 4518427 - DNA, 20 bp, Homo sapiens
gaaaaaaagcacaaagttct

SEQ ID NO: 4518428 - DNA, 19 bp, Homo sapiens
gaaaaaaagggcactctga

SEQ ID NO: 4518429 - DNA, 18 bp, Homo sapiens
gaaaaaaagtttgccaga

SEQ ID NO: 4518430 - DNA, 20 bp, Homo sapiens
gaaaaaaagtttgccagaag

SEQ ID NO: 4518431 - DNA, 13 bp, Homo sapiens
gaaaaaaatcatc

SEQ ID NO: 4518432 - DNA, 13 bp, Homo sapiens
gaaaaaaatgttg

SEQ ID NO: 4518433 - DNA, 13 bp, Homo sapiens
gaaaaaaattgaa

SEQ ID NO: 4518434 - DNA, 11 bp, Homo sapiens
gaaaaaatcat

SEQ ID NO: 4518435 - DNA, 15 bp, Homo sapiens
gaaaaacaattttct

SEQ ID NO: 4518436 - DNA, 17 bp, Homo sapiens
gaaaaacacaagcaaaa

SEQ ID NO: 4518437 - DNA, 23 bp, Homo sapiens
gaaaaacacatggggaaaaaaat

SEQ ID NO: 4518438 - DNA, 18 bp, Homo sapiens
gaaaaacatctgaaagcc

SEQ ID NO: 4518439 - DNA, 19 bp, Homo sapiens
gaaaaagaacatgcagttt

SEQ ID NO: 4518440 - DNA, 21 bp, Homo sapiens
gaaaaagaacatgcagtttga

SEQ ID NO: 4518441 - DNA, 23 bp, Homo sapiens
gaaaaagaacatgcagtttgaaa

SEQ ID NO: 4518442 - DNA, 14 bp, Homo sapiens
gaaaaagaagaatc

SEQ ID NO: 4518443 - DNA, 17 bp, Homo sapiens
gaaaaagctgcttctta

SEQ ID NO: 4518444 - DNA, 19 bp, Homo sapiens
gaaaaagttaaacattgaa

SEQ ID NO: 4518445 - DNA, 16 bp, Homo sapiens
gaaaaatatcttggcc

SEQ ID NO: 4518446 - DNA, 18 bp, Homo sapiens
gaaaaatatttattcatt

SEQ ID NO: 4518447 - DNA, 17 bp, Homo sapiens
gaaaaatctcaattgaa

SEQ ID NO: 4518448 - DNA, 21 bp, Homo sapiens
gaaaaatctcattatttcaaa

SEQ ID NO: 4518449 - DNA, 20 bp, Homo sapiens
gaaaaatgcccatttttgct

SEQ ID NO: 4518450 - DNA, 16 bp, Homo sapiens
gaaaaatgctccccac

SEQ ID NO: 4518451 - DNA, 15 bp, Homo sapiens
gaaaaatgtataaaa

SEQ ID NO: 4518452 - DNA, 13 bp, Homo sapiens
gaaaaatgtcact

SEQ ID NO: 4518453 - DNA, 12 bp, Homo sapiens
gaaaaattatta

SEQ ID NO: 4518454 - DNA, 18 bp, Homo sapiens
gaaaaattgaactacagc

SEQ ID NO: 4518455 - DNA, 16 bp, Homo sapiens
gaaaaattggggagga

SEQ ID NO: 4518456 - DNA, 16 bp, Homo sapiens
gaaaaatttataagcc

SEQ ID NO: 4518457 - DNA, 17 bp, Homo sapiens
gaaaacaaaagttttaa

SEQ ID NO: 4518458 - DNA, 12 bp, Homo sapiens
gaaaacaaggaa

SEQ ID NO: 4518459 - DNA, 14 bp, Homo sapiens
gaaaacaaggaagt

SEQ ID NO: 4518460 - DNA, 18 bp, Homo sapiens
gaaaacaaggtttccata

SEQ ID NO: 4518461 - DNA, 9 bp, Homo sapiens
gaaaacaga

SEQ ID NO: 4518462 - DNA, 12 bp, Homo sapiens
gaaaacagaaaa

SEQ ID NO: 4518463 - DNA, 17 bp, Homo sapiens
gaaaacagtacagaagg

SEQ ID NO: 4518464 - DNA, 17 bp, Homo sapiens
gaaaacataatatagct

SEQ ID NO: 4518465 - DNA, 19 bp, Homo sapiens
gaaaacatgtactacagct

SEQ ID NO: 4518466 - DNA, 18 bp, Homo sapiens
gaaaacccaagtttttaa

SEQ ID NO: 4518467 - DNA, 17 bp, Homo sapiens
gaaaacctctcctgacc

SEQ ID NO: 4518468 - DNA, 16 bp, Homo sapiens
gaaaacgccagtgtgt

SEQ ID NO: 4518469 - DNA, 16 bp, Homo sapiens
gaaaactaaggatttt

SEQ ID NO: 4518470 - DNA, 18 bp, Homo sapiens
gaaaactcccaatacaaa

SEQ ID NO: 4518471 - DNA, 16 bp, Homo sapiens
gaaaactctttgctgc

SEQ ID NO: 4518472 - DNA, 19 bp, Homo sapiens
gaaaactgtgcaacttttt

SEQ ID NO: 4518473 - DNA, 12 bp, Homo sapiens
gaaaactgtgtt

SEQ ID NO: 4518474 - DNA, 22 bp, Homo sapiens
gaaaacttgtgtgaaattttct

SEQ ID NO: 4518475 - DNA, 21 bp, Homo sapiens
gaaaagaaaatttttgtagta

SEQ ID NO: 4518476 - DNA, 15 bp, Homo sapiens
gaaaagaaagaagtt

SEQ ID NO: 4518477 - DNA, 14 bp, Homo sapiens
gaaaagaatttttt

SEQ ID NO: 4518478 - DNA, 16 bp, Homo sapiens
gaaaagacaagaaaat

SEQ ID NO: 4518479 - DNA, 21 bp, Homo sapiens
gaaaagacagggtgggaggga

SEQ ID NO: 4518480 - DNA, 17 bp, Homo sapiens
gaaaagactccaaagaa

SEQ ID NO: 4518481 - DNA, 11 bp, Homo sapiens
gaaaagagaga

SEQ ID NO: 4518482 - DNA, 13 bp, Homo sapiens
gaaaagagagaaa

SEQ ID NO: 4518483 - DNA, 20 bp, Homo sapiens
gaaaagaggacagaaaaatt

SEQ ID NO: 4518484 - DNA, 12 bp, Homo sapiens
gaaaagcacaga

SEQ ID NO: 4518485 - DNA, 14 bp, Homo sapiens
gaaaagcacctgcc

SEQ ID NO: 4518486 - DNA, 15 bp, Homo sapiens
gaaaagcgcgttgtg

SEQ ID NO: 4518487 - DNA, 13 bp, Homo sapiens
gaaaagctggtct

SEQ ID NO: 4518488 - DNA, 22 bp, Homo sapiens
gaaaaggaagtttccagaaaag

SEQ ID NO: 4518489 - DNA, 18 bp, Homo sapiens
gaaaaggctaagaaaaag

SEQ ID NO: 4518490 - DNA, 19 bp, Homo sapiens
gaaaagggaaatgtgactg

SEQ ID NO: 4518491 - DNA, 19 bp, Homo sapiens
gaaaaggttgaataatata

SEQ ID NO: 4518492 - DNA, 17 bp, Homo sapiens
gaaaagtgatgtatttt

SEQ ID NO: 4518493 - DNA, 14 bp, Homo sapiens
gaaaagtgcaatgc

SEQ ID NO: 4518494 - DNA, 14 bp, Homo sapiens
gaaaataaaacaca

SEQ ID NO: 4518495 - DNA, 13 bp, Homo sapiens
gaaaataactgaa

SEQ ID NO: 4518496 - DNA, 18 bp, Homo sapiens
gaaaataagaatagaaat

SEQ ID NO: 4518497 - DNA, 17 bp, Homo sapiens
gaaaatagctatttttt

SEQ ID NO: 4518498 - DNA, 21 bp, Homo sapiens
gaaaatagctatttttttcct

SEQ ID NO: 4518499 - DNA, 13 bp, Homo sapiens
gaaaataggcttt

SEQ ID NO: 4518500 - DNA, 22 bp, Homo sapiens
gaaaatatagacattctcacat

SEQ ID NO: 4518501 - DNA, 20 bp, Homo sapiens
gaaaatatatattatataca

SEQ ID NO: 4518502 - DNA, 17 bp, Homo sapiens
gaaaatatatgtatttt

SEQ ID NO: 4518503 - DNA, 22 bp, Homo sapiens
gaaaatatatgtatttttatat

SEQ ID NO: 4518504 - DNA, 22 bp, Homo sapiens
gaaaatatctgctcaaaacttt

SEQ ID NO: 4518505 - DNA, 22 bp, Homo sapiens
gaaaatattgttttacaatagt

SEQ ID NO: 4518506 - DNA, 18 bp, Homo sapiens
gaaaatatttgtatcaca

SEQ ID NO: 4518507 - DNA, 13 bp, Homo sapiens
gaaaatcctctgg

SEQ ID NO: 4518508 - DNA, 22 bp, Homo sapiens
gaaaatctacactccagtgaga

SEQ ID NO: 4518509 - DNA, 14 bp, Homo sapiens
gaaaatgaagggat

SEQ ID NO: 4518510 - DNA, 16 bp, Homo sapiens
gaaaatgacttatttc

SEQ ID NO: 4518511 - DNA, 17 bp, Homo sapiens
gaaaatgagaaaggaca

SEQ ID NO: 4518512 - DNA, 20 bp, Homo sapiens
gaaaatgagaaaggacagag

SEQ ID NO: 4518513 - DNA, 22 bp, Homo sapiens
gaaaatgagaaaggacagagcc

SEQ ID NO: 4518514 - DNA, 21 bp, Homo sapiens
gaaaatgccatgaaaattgct

SEQ ID NO: 4518515 - DNA, 23 bp, Homo sapiens
gaaaatggctttctcagccaggc

SEQ ID NO: 4518516 - DNA, 19 bp, Homo sapiens
gaaaatgtattcctttaaa

SEQ ID NO: 4518517 - DNA, 15 bp, Homo sapiens
gaaaatgtccaggaa

SEQ ID NO: 4518518 - DNA, 11 bp, Homo sapiens
gaaaatgtctt

SEQ ID NO: 4518519 - DNA, 17 bp, Homo sapiens
gaaaatgttgagaatcc

SEQ ID NO: 4518520 - DNA, 20 bp, Homo sapiens
gaaaatgttgagaatcccaa

SEQ ID NO: 4518521 - DNA, 17 bp, Homo sapiens
gaaaattacatgttttt

SEQ ID NO: 4518522 - DNA, 18 bp, Homo sapiens
gaaaattagactgtgatt

SEQ ID NO: 4518523 - DNA, 13 bp, Homo sapiens
gaaaattatttaa

SEQ ID NO: 4518524 - DNA, 20 bp, Homo sapiens
gaaaattctgtgccttgttt

SEQ ID NO: 4518525 - DNA, 15 bp, Homo sapiens
gaaaattgatatttt

SEQ ID NO: 4518526 - DNA, 12 bp, Homo sapiens
gaaaattgcccc

SEQ ID NO: 4518527 - DNA, 12 bp, Homo sapiens
gaaaattgtatt

SEQ ID NO: 4518528 - DNA, 22 bp, Homo sapiens
gaaaatttacaaaatttattct

SEQ ID NO: 4518529 - DNA, 13 bp, Homo sapiens
gaaaattttatgt

SEQ ID NO: 4518530 - DNA, 16 bp, Homo sapiens
gaaaatttttgtagta

SEQ ID NO: 4518531 - DNA, 13 bp, Homo sapiens
gaaacaaaataca

SEQ ID NO: 4518532 - DNA, 15 bp, Homo sapiens
gaaacaaaatcctca

SEQ ID NO: 4518533 - DNA, 12 bp, Homo sapiens
gaaacaaaatgt

SEQ ID NO: 4518534 - DNA, 21 bp, Homo sapiens
gaaacaaaccttgccttgaaa

SEQ ID NO: 4518535 - DNA, 12 bp, Homo sapiens
gaaacaacaaaa

SEQ ID NO: 4518536 - DNA, 18 bp, Homo sapiens
gaaacaacatttatatgt

SEQ ID NO: 4518537 - DNA, 16 bp, Homo sapiens
gaaacaaccatgtcat

SEQ ID NO: 4518538 - DNA, 17 bp, Homo sapiens
gaaacaatgaaaacaaa

SEQ ID NO: 4518539 - DNA, 13 bp, Homo sapiens
gaaacacagaaac

SEQ ID NO: 4518540 - DNA, 13 bp, Homo sapiens
gaaacaccattca

SEQ ID NO: 4518541 - DNA, 19 bp, Homo sapiens
gaaacactgcaaattttaa

SEQ ID NO: 4518542 - DNA, 18 bp, Homo sapiens
gaaacactttgcctcctg

SEQ ID NO: 4518543 - DNA, 19 bp, Homo sapiens
gaaacactttgcctcctgt

SEQ ID NO: 4518544 - DNA, 19 bp, Homo sapiens
gaaacagattcaggccagc

SEQ ID NO: 4518545 - DNA, 16 bp, Homo sapiens
gacagaccacttgcca

SEQ ID NO: 4518546 - DNA, 19 bp, Homo sapiens
gacagaccacttgccacgc

SEQ ID NO: 4518547 - DNA, 14 bp, Homo sapiens
gacagacgagacaa

SEQ ID NO: 4518548 - DNA, 23 bp, Homo sapiens
gacagacgagacaacagcacaca

SEQ ID NO: 4518549 - DNA, 21 bp, Homo sapiens
gacagacggaaatgaaattgt

SEQ ID NO: 4518550 - DNA, 16 bp, Homo sapiens
gacagagactcagatg

SEQ ID NO: 4518551 - DNA, 18 bp, Homo sapiens
gacagagcaggggctcca

SEQ ID NO: 4518552 - DNA, 21 bp, Homo sapiens
gacagaggaaagggctggctc

SEQ ID NO: 4518553 - DNA, 23 bp, Homo sapiens
gacagaggaaagggctggctccc

SEQ ID NO: 4518554 - DNA, 15 bp, Homo sapiens
gacagaggcctgccc

SEQ ID NO: 4518555 - DNA, 13 bp, Homo sapiens
gacagaggctgca

SEQ ID NO: 4518556 - DNA, 15 bp, Homo sapiens
gacagagggaagcca

SEQ ID NO: 4518557 - DNA, 19 bp, Homo sapiens
gacagagggaagccagtca

SEQ ID NO: 4518558 - DNA, 18 bp, Homo sapiens
gacagagggagacagggc

SEQ ID NO: 4518559 - DNA, 12 bp, Homo sapiens
gacagagggcac

SEQ ID NO: 4518560 - DNA, 21 bp, Homo sapiens
gacagagggcacatgaacagc

SEQ ID NO: 4518561 - DNA, 21 bp, Homo sapiens
gacagaggttgtagtgagcca

SEQ ID NO: 4518562 - DNA, 16 bp, Homo sapiens
gacagatgagcaggag

SEQ ID NO: 4518563 - DNA, 18 bp, Homo sapiens
gacagatgagcaggagct

SEQ ID NO: 4518564 - DNA, 16 bp, Homo sapiens
gacagatgcctggtga

SEQ ID NO: 4518565 - DNA, 14 bp, Homo sapiens
gacagatgctggtg

SEQ ID NO: 4518566 - DNA, 16 bp, Homo sapiens
gacagcaaagcagcag

SEQ ID NO: 4518567 - DNA, 13 bp, Homo sapiens
gacagcagcagcc

SEQ ID NO: 4518568 - DNA, 15 bp, Homo sapiens
gacagcagcagcctg

SEQ ID NO: 4518569 - DNA, 16 bp, Homo sapiens
gacagcagcagcctgc

SEQ ID NO: 4518570 - DNA, 19 bp, Homo sapiens
gacagcagcagcctgcacc

SEQ ID NO: 4518571 - DNA, 18 bp, Homo sapiens
gacagccaggtggcacct

SEQ ID NO: 4518572 - DNA, 11 bp, Homo sapiens
gacagcctgta

SEQ ID NO: 4518573 - DNA, 20 bp, Homo sapiens
gacagcctgtggcggtgcct

SEQ ID NO: 4518574 - DNA, 22 bp, Homo sapiens
gacagcctgtggcggtgcctgg

SEQ ID NO: 4518575 - DNA, 14 bp, Homo sapiens
gacagcctgtttct

SEQ ID NO: 4518576 - DNA, 20 bp, Homo sapiens
gacagcctgtttctatcctg

SEQ ID NO: 4518577 - DNA, 18 bp, Homo sapiens
gacagcgatataatttta

SEQ ID NO: 4518578 - DNA, 16 bp, Homo sapiens
gacagctcctggacca

SEQ ID NO: 4518579 - DNA, 21 bp, Homo sapiens
gacagctcctggaccaggccc

SEQ ID NO: 4518580 - DNA, 16 bp, Homo sapiens
gacagctgtccctgtc

SEQ ID NO: 4518581 - DNA, 17 bp, Homo sapiens
gacagctgtccctgtca

SEQ ID NO: 4518582 - DNA, 19 bp, Homo sapiens
gacagctgtccctgtcacc

SEQ ID NO: 4518583 - DNA, 19 bp, Homo sapiens
gacaggaaaatcctctggc

SEQ ID NO: 4518584 - DNA, 20 bp, Homo sapiens
gacaggaaagccctccccct

SEQ ID NO: 4518585 - DNA, 22 bp, Homo sapiens
gacaggagagattatttacaag

SEQ ID NO: 4518586 - DNA, 14 bp, Homo sapiens
gacaggagcctagc

SEQ ID NO: 4518587 - DNA, 17 bp, Homo sapiens
gacaggatgaggacaga

SEQ ID NO: 4518588 - DNA, 19 bp, Homo sapiens
gacaggatgaggacagagg

SEQ ID NO: 4518589 - DNA, 20 bp, Homo sapiens
gacaggatttggccacactg

SEQ ID NO: 4518590 - DNA, 14 bp, Homo sapiens
gacaggcagcccag

SEQ ID NO: 4518591 - DNA, 16 bp, Homo sapiens
gacaggcagcccagca

SEQ ID NO: 4518592 - DNA, 18 bp, Homo sapiens
gacaggcagcccagcagt

SEQ ID NO: 4518593 - DNA, 17 bp, Homo sapiens
gacaggccctccctgtc

SEQ ID NO: 4518594 - DNA, 15 bp, Homo sapiens
gacaggcctgaagat

SEQ ID NO: 4518595 - DNA, 16 bp, Homo sapiens
gacaggcgggctcgga

SEQ ID NO: 4518596 - DNA, 14 bp, Homo sapiens
gacaggctctcctg

SEQ ID NO: 4518597 - DNA, 14 bp, Homo sapiens
gacagggctggccc

SEQ ID NO: 4518598 - DNA, 18 bp, Homo sapiens
gacagggctggcccagcc

SEQ ID NO: 4518599 - DNA, 20 bp, Homo sapiens
gacagggctggcccagccct

SEQ ID NO: 4518600 - DNA, 22 bp, Homo sapiens
gacagggctggcccagccctgc

SEQ ID NO: 4518601 - DNA, 18 bp, Homo sapiens
gacaggggagttgtcaac

SEQ ID NO: 4518602 - DNA, 20 bp, Homo sapiens
gacagggtcttgctctgtcc

SEQ ID NO: 4518603 - DNA, 16 bp, Homo sapiens
gacagggtgggaggga

SEQ ID NO: 4518604 - DNA, 22 bp, Homo sapiens
gacagggtgggcttcctgccct

SEQ ID NO: 4518605 - DNA, 17 bp, Homo sapiens
gacagggtttcaccatg

SEQ ID NO: 4518606 - DNA, 15 bp, Homo sapiens
gacaggtcttttcaa

SEQ ID NO: 4518607 - DNA, 20 bp, Homo sapiens
gacaggtgacagtggctgct

SEQ ID NO: 4518608 - DNA, 22 bp, Homo sapiens
gacaggtgacagtggctgctct

SEQ ID NO: 4518609 - DNA, 23 bp, Homo sapiens
gacaggtgacagtggctgctctg

SEQ ID NO: 4518610 - DNA, 23 bp, Homo sapiens
gacagtaaacactccacattctt

SEQ ID NO: 4518611 - DNA, 15 bp, Homo sapiens
gacagtcaaaaccaa

SEQ ID NO: 4518612 - DNA, 19 bp, Homo sapiens
gacagtcactgcatttgcc

SEQ ID NO: 4518613 - DNA, 23 bp, Homo sapiens
gacagtcactgcatttgcctgct

SEQ ID NO: 4518614 - DNA, 13 bp, Homo sapiens
gacagtccacagg

SEQ ID NO: 4518615 - DNA, 14 bp, Homo sapiens
gacagtccctgctg

SEQ ID NO: 4518616 - DNA, 17 bp, Homo sapiens
gacagtccctgctgggg

SEQ ID NO: 4518617 - DNA, 13 bp, Homo sapiens
gacagtctcactc

SEQ ID NO: 4518618 - DNA, 10 bp, Homo sapiens
gacagtctga

SEQ ID NO: 4518619 - DNA, 15 bp, Homo sapiens
gacagtgaagcagca

SEQ ID NO: 4518620 - DNA, 14 bp, Homo sapiens
gacagtgccctgag

SEQ ID NO: 4518621 - DNA, 22 bp, Homo sapiens
gacagtgctgcagctccctggc

SEQ ID NO: 4518622 - DNA, 15 bp, Homo sapiens
gacagtggctgctct

SEQ ID NO: 4518623 - DNA, 17 bp, Homo sapiens
gacagtggctgctctgg

SEQ ID NO: 4518624 - DNA, 21 bp, Homo sapiens
gacagtgttccccgataccat

SEQ ID NO: 4518625 - DNA, 23 bp, Homo sapiens
gacagttacacttgacagacaaa

SEQ ID NO: 4518626 - DNA, 17 bp, Homo sapiens
gacagtttatcatgaag

SEQ ID NO: 4518627 - DNA, 20 bp, Homo sapiens
gacagtttatcatgaagcct

SEQ ID NO: 4518628 - DNA, 19 bp, Homo sapiens
gacataaagttgataaaga

SEQ ID NO: 4518629 - DNA, 22 bp, Homo sapiens
gacataaagttgataaagattt

SEQ ID NO: 4518630 - DNA, 20 bp, Homo sapiens
gacataagcaatcattttat

SEQ ID NO: 4518631 - DNA, 21 bp, Homo sapiens
gacatacgcttttaatgaaaa

SEQ ID NO: 4518632 - DNA, 22 bp, Homo sapiens
gacatactccttccatcaaata

SEQ ID NO: 4518633 - DNA, 15 bp, Homo sapiens
gacatagaggtatat

SEQ ID NO: 4518634 - DNA, 11 bp, Homo sapiens
gacatatttaa

SEQ ID NO: 4518635 - DNA, 15 bp, Homo sapiens
gacatatttaactgg

SEQ ID NO: 4518636 - DNA, 17 bp, Homo sapiens
gacatatttaatgtttt

SEQ ID NO: 4518637 - DNA, 18 bp, Homo sapiens
gacatatttaatgtttta

SEQ ID NO: 4518638 - DNA, 21 bp, Homo sapiens
gacatatttaatgttttaaat

SEQ ID NO: 4518639 - DNA, 13 bp, Homo sapiens
gacatatttcagt

SEQ ID NO: 4518640 - DNA, 16 bp, Homo sapiens
gacatcattgtcagcc

SEQ ID NO: 4518641 - DNA, 22 bp, Homo sapiens
gacatccagcagatttccagcc

SEQ ID NO: 4518642 - DNA, 15 bp, Homo sapiens
gacatcggaaaaata

SEQ ID NO: 4518643 - DNA, 16 bp, Homo sapiens
gacatctctgactttc

SEQ ID NO: 4518644 - DNA, 13 bp, Homo sapiens
gacatctgcctgt

SEQ ID NO: 4518645 - DNA, 20 bp, Homo sapiens
gacatctgcctgtaattaaa

SEQ ID NO: 4518646 - DNA, 14 bp, Homo sapiens
gacatgatttcctt

SEQ ID NO: 4518647 - DNA, 13 bp, Homo sapiens
gacatgcatgaca

SEQ ID NO: 4518648 - DNA, 17 bp, Homo sapiens
gacatgcccaaaactta

SEQ ID NO: 4518649 - DNA, 17 bp, Homo sapiens
gacatggagtgttactg

SEQ ID NO: 4518650 - DNA, 17 bp, Homo sapiens
gacatggtgcctgagag

SEQ ID NO: 4518651 - DNA, 16 bp, Homo sapiens
gacatggttgggggaa

SEQ ID NO: 4518652 - DNA, 22 bp, Homo sapiens
gacatggttgggggaatgcacc

SEQ ID NO: 4518653 - DNA, 19 bp, Homo sapiens
gacattaacaaataaaaaa

SEQ ID NO: 4518654 - DNA, 22 bp, Homo sapiens
gacattagaaaaaaatgaaaca

SEQ ID NO: 4518655 - DNA, 12 bp, Homo sapiens
gacattcacctg

SEQ ID NO: 4518656 - DNA, 13 bp, Homo sapiens
gacattcactgag

SEQ ID NO: 4518657 - DNA, 21 bp, Homo sapiens
gacattccttctcccatctct

SEQ ID NO: 4518658 - DNA, 13 bp, Homo sapiens
gacattctcacat

SEQ ID NO: 4518659 - DNA, 19 bp, Homo sapiens
gacattgttacaaggacat

SEQ ID NO: 4518660 - DNA, 22 bp, Homo sapiens
gacatttctatcttgaatttca

SEQ ID NO: 4518661 - DNA, 14 bp, Homo sapiens
gacattttgttttt

SEQ ID NO: 4518662 - DNA, 16 bp, Homo sapiens
gacatttttcattcat

SEQ ID NO: 4518663 - DNA, 19 bp, Homo sapiens
gacatttttcattcatgaa

SEQ ID NO: 4518664 - DNA, 15 bp, Homo sapiens
gaccaacatccagtc

SEQ ID NO: 4518665 - DNA, 18 bp, Homo sapiens
gaacctggatccagcact

SEQ ID NO: 4518666 - DNA, 13 bp, Homo sapiens
gaacctgggcact

SEQ ID NO: 4518667 - DNA, 18 bp, Homo sapiens
gaacctggtgtgtttctt

SEQ ID NO: 4518668 - DNA, 15 bp, Homo sapiens
gaacctgtagagcta

SEQ ID NO: 4518669 - DNA, 20 bp, Homo sapiens
gaaccttaatgacaacactt

SEQ ID NO: 4518670 - DNA, 20 bp, Homo sapiens
gaacgcaccccactgggaga

SEQ ID NO: 4518671 - DNA, 17 bp, Homo sapiens
gaacgcagccctagagc

SEQ ID NO: 4518672 - DNA, 20 bp, Homo sapiens
gaacgcagccctagagcctg

SEQ ID NO: 4518673 - DNA, 18 bp, Homo sapiens
gaacgccctcatgctcag

SEQ ID NO: 4518674 - DNA, 16 bp, Homo sapiens
gaacgggcagcctggg

SEQ ID NO: 4518675 - DNA, 22 bp, Homo sapiens
gaacgtgactgccccaactcct

SEQ ID NO: 4518676 - DNA, 19 bp, Homo sapiens
gaacgttttaataattttt

SEQ ID NO: 4518677 - DNA, 12 bp, Homo sapiens
gaacgtttttcc

SEQ ID NO: 4518678 - DNA, 19 bp, Homo sapiens
gaacgttttttcctcagtg

SEQ ID NO: 4518679 - DNA, 13 bp, Homo sapiens
gaactaaactagt

SEQ ID NO: 4518680 - DNA, 22 bp, Homo sapiens
gaactaaactagtttttcctat

SEQ ID NO: 4518681 - DNA, 21 bp, Homo sapiens
gaactaaagtgctgcactcaa

SEQ ID NO: 4518682 - DNA, 18 bp, Homo sapiens
gaactaaatttttcatag

SEQ ID NO: 4518683 - DNA, 19 bp, Homo sapiens
gaactaaatttttcataga

SEQ ID NO: 4518684 - DNA, 22 bp, Homo sapiens
gaactacaaacaaaatttctat

SEQ ID NO: 4518685 - DNA, 20 bp, Homo sapiens
gaactagggcaagtcttaaa

SEQ ID NO: 4518686 - DNA, 18 bp, Homo sapiens
gaactatgaggagcctct

SEQ ID NO: 4518687 - DNA, 19 bp, Homo sapiens
gaactcaagggttttccag

SEQ ID NO: 4518688 - DNA, 19 bp, Homo sapiens
gaactcagcacattcggga

SEQ ID NO: 4518689 - DNA, 17 bp, Homo sapiens
gaactccatacagcctc

SEQ ID NO: 4518690 - DNA, 11 bp, Homo sapiens
gaactccattt

SEQ ID NO: 4518691 - DNA, 20 bp, Homo sapiens
gaactcctggaaatatcagt

SEQ ID NO: 4518692 - DNA, 23 bp, Homo sapiens
gaactcgcagggaatgcagcagg

SEQ ID NO: 4518693 - DNA, 17 bp, Homo sapiens
gaactcggcccctcctc

SEQ ID NO: 4518694 - DNA, 14 bp, Homo sapiens
gaactctggtggca

SEQ ID NO: 4518695 - DNA, 13 bp, Homo sapiens
gaactctgttccc

SEQ ID NO: 4518696 - DNA, 16 bp, Homo sapiens
gaactctgttccccca

SEQ ID NO: 4518697 - DNA, 21 bp, Homo sapiens
gaactgaacaccattgaaggc

SEQ ID NO: 4518698 - DNA, 22 bp, Homo sapiens
gaactgaacaccattgaaggct

SEQ ID NO: 4518699 - DNA, 12 bp, Homo sapiens
gaactgaactca

SEQ ID NO: 4518700 - DNA, 18 bp, Homo sapiens
gaactgaattttgggact

SEQ ID NO: 4518701 - DNA, 14 bp, Homo sapiens
gaactgagccccag

SEQ ID NO: 4518702 - DNA, 19 bp, Homo sapiens
gaactgagccccagcgggc

SEQ ID NO: 4518703 - DNA, 20 bp, Homo sapiens
gaactgagccccagcgggct

SEQ ID NO: 4518704 - DNA, 19 bp, Homo sapiens
gaactgagggctctgtttg

SEQ ID NO: 4518705 - DNA, 16 bp, Homo sapiens
gaactgcccttgctgc

SEQ ID NO: 4518706 - DNA, 20 bp, Homo sapiens
gaactgcccttgctgcccgc

SEQ ID NO: 4518707 - DNA, 19 bp, Homo sapiens
gaactgcgttatgaagagc

SEQ ID NO: 4518708 - DNA, 13 bp, Homo sapiens
gaactggaagaaa

SEQ ID NO: 4518709 - DNA, 14 bp, Homo sapiens
gaactggaagaaag

SEQ ID NO: 4518710 - DNA, 15 bp, Homo sapiens
gaactggacacaata

SEQ ID NO: 4518711 - DNA, 21 bp, Homo sapiens
gaactgggctggcgcttggat

SEQ ID NO: 4518712 - DNA, 15 bp, Homo sapiens
gaactgggctgggcc

SEQ ID NO: 4518713 - DNA, 16 bp, Homo sapiens
gaactgggctgggcct

SEQ ID NO: 4518714 - DNA, 15 bp, Homo sapiens
gaactgtacattgtg

SEQ ID NO: 4518715 - DNA, 19 bp, Homo sapiens
gaactgtacattgtgagct

SEQ ID NO: 4518716 - DNA, 14 bp, Homo sapiens
gaactgtcccagct

SEQ ID NO: 4518717 - DNA, 17 bp, Homo sapiens
gaactgtcccagctacc

SEQ ID NO: 4518718 - DNA, 18 bp, Homo sapiens
gaactgtcccagctacca

SEQ ID NO: 4518719 - DNA, 16 bp, Homo sapiens
gaactgtgtatttatt

SEQ ID NO: 4518720 - DNA, 23 bp, Homo sapiens
gaactgtgtatttatttaaaact

SEQ ID NO: 4518721 - DNA, 12 bp, Homo sapiens
gaactgtgtgtg

SEQ ID NO: 4518722 - DNA, 21 bp, Homo sapiens
gaactgtgtttcaaatggact

SEQ ID NO: 4518723 - DNA, 20 bp, Homo sapiens
gacaaacccggaagatcaga

SEQ ID NO: 4518724 - DNA, 21 bp, Homo sapiens
gacaaagaattccaaagcaaa

SEQ ID NO: 4518725 - DNA, 14 bp, Homo sapiens
gacaaagatttctt

SEQ ID NO: 4518726 - DNA, 16 bp, Homo sapiens
gacaaagatttcttct

SEQ ID NO: 4518727 - DNA, 16 bp, Homo sapiens
gacaaaggaggaattt

SEQ ID NO: 4518728 - DNA, 13 bp, Homo sapiens
gacaaaggcaagc

SEQ ID NO: 4518729 - DNA, 20 bp, Homo sapiens
gacaaaggccacaggcagtc

SEQ ID NO: 4518730 - DNA, 14 bp, Homo sapiens
gacaaaggccttaa

SEQ ID NO: 4518731 - DNA, 14 bp, Homo sapiens
gacaaataaaacat

SEQ ID NO: 4518732 - DNA, 13 bp, Homo sapiens
gacaaatattctg

SEQ ID NO: 4518733 - DNA, 19 bp, Homo sapiens
gacaaatctaaaatgcaaa

SEQ ID NO: 4518734 - DNA, 21 bp, Homo sapiens
gacaacacttaatagcaacag

SEQ ID NO: 4518735 - DNA, 16 bp, Homo sapiens
gacaacagcacacagg

SEQ ID NO: 4518736 - DNA, 20 bp, Homo sapiens
gacaacagcacacaggcagc

SEQ ID NO: 4518737 - DNA, 12 bp, Homo sapiens
gacaacagttct

SEQ ID NO: 4518738 - DNA, 22 bp, Homo sapiens
gacaacagttctgagctgtaat

SEQ ID NO: 4518739 - DNA, 23 bp, Homo sapiens
gacaacatcgcaatagtttttta

SEQ ID NO: 4518740 - DNA, 14 bp, Homo sapiens
gacaacatgtttaa

SEQ ID NO: 4518741 - DNA, 22 bp, Homo sapiens
gacaacatttctatagccaaaa

SEQ ID NO: 4518742 - DNA, 19 bp, Homo sapiens
gacaaccatgcaaattgtg

SEQ ID NO: 4518743 - DNA, 18 bp, Homo sapiens
gacaactaaacaaggcat

SEQ ID NO: 4518744 - DNA, 16 bp, Homo sapiens
gacaagacccccagca

SEQ ID NO: 4518745 - DNA, 16 bp, Homo sapiens
gacaagagatctacac

SEQ ID NO: 4518746 - DNA, 20 bp, Homo sapiens
gacaagagatgggaatgagg

SEQ ID NO: 4518747 - DNA, 17 bp, Homo sapiens
gacaagatgggacagca

SEQ ID NO: 4518748 - DNA, 22 bp, Homo sapiens
gacaagcagagtaacaggatca

SEQ ID NO: 4518749 - DNA, 15 bp, Homo sapiens
gacaagtaatttcag

SEQ ID NO: 4518750 - DNA, 15 bp, Homo sapiens
gacaataacttctta

SEQ ID NO: 4518751 - DNA, 23 bp, Homo sapiens
gacaataattctacatgttgtct

SEQ ID NO: 4518752 - DNA, 15 bp, Homo sapiens
gacaatgaagggaaa

SEQ ID NO: 4518753 - DNA, 14 bp, Homo sapiens
gacaatgttgcatt

SEQ ID NO: 4518754 - DNA, 16 bp, Homo sapiens
gacaattagaaaaaag

SEQ ID NO: 4518755 - DNA, 17 bp, Homo sapiens
gacaattcctccagaga

SEQ ID NO: 4518756 - DNA, 13 bp, Homo sapiens
gacaattctgttt

SEQ ID NO: 4518757 - DNA, 16 bp, Homo sapiens
gacaattttttttcaa

SEQ ID NO: 4518758 - DNA, 21 bp, Homo sapiens
gacaattttttttcaaatgtg

SEQ ID NO: 4518759 - DNA, 22 bp, Homo sapiens
gacacaaggtgatttcagactg

SEQ ID NO: 4518760 - DNA, 17 bp, Homo sapiens
gacacacattctgcctt

SEQ ID NO: 4518761 - DNA, 16 bp, Homo sapiens
gacacagaaaatgttg

SEQ ID NO: 4518762 - DNA, 18 bp, Homo sapiens
gacacagaaaatgttgag

SEQ ID NO: 4518763 - DNA, 15 bp, Homo sapiens
gacacagacccagga

SEQ ID NO: 4518764 - DNA, 16 bp, Homo sapiens
gacacagacccaggac

SEQ ID NO: 4518765 - DNA, 16 bp, Homo sapiens
gacacagcatcagctc

SEQ ID NO: 4518766 - DNA, 16 bp, Homo sapiens
gacacagttcctggga

SEQ ID NO: 4518767 - DNA, 15 bp, Homo sapiens
gacacagttttgtct

SEQ ID NO: 4518768 - DNA, 21 bp, Homo sapiens
gacacattgactcctttccaa

SEQ ID NO: 4518769 - DNA, 22 bp, Homo sapiens
gacacattgccttctggagctg

SEQ ID NO: 4518770 - DNA, 14 bp, Homo sapiens
gacacatttaagga

SEQ ID NO: 4518771 - DNA, 19 bp, Homo sapiens
gacaccagccaggctctgt

SEQ ID NO: 4518772 - DNA, 23 bp, Homo sapiens
gacacccaggcccgagcgcctgc

SEQ ID NO: 4518773 - DNA, 17 bp, Homo sapiens
gacacccatgccagaga

SEQ ID NO: 4518774 - DNA, 20 bp, Homo sapiens
gacacccatgccagagaggt

SEQ ID NO: 4518775 - DNA, 21 bp, Homo sapiens
gacaccctggcctgaactgag

SEQ ID NO: 4518776 - DNA, 17 bp, Homo sapiens
gacacctaaccccaggg

SEQ ID NO: 4518777 - DNA, 18 bp, Homo sapiens
gacacctaaccccagggc

SEQ ID NO: 4518778 - DNA, 15 bp, Homo sapiens
gacacctcccccttt

SEQ ID NO: 4518779 - DNA, 19 bp, Homo sapiens
gacacgagccacaagctgc

SEQ ID NO: 4518780 - DNA, 14 bp, Homo sapiens
gacacgcttctgag

SEQ ID NO: 4518781 - DNA, 16 bp, Homo sapiens
gacacgcttctgagca

SEQ ID NO: 4518782 - DNA, 17 bp, Homo sapiens
gacactcaataaacagt

SEQ ID NO: 4518783 - DNA, 18 bp, Homo sapiens
gacactcaataaacagtc

SEQ ID NO: 4518784 - DNA, 15 bp, Homo sapiens
gacactcccttgggc

SEQ ID NO: 4518785 - DNA, 21 bp, Homo sapiens
gacactcccttgggctccctg

SEQ ID NO: 4518786 - DNA, 14 bp, Homo sapiens
gacactcctagaga

SEQ ID NO: 4518787 - DNA, 20 bp, Homo sapiens
gacactctataagattccaa

SEQ ID NO: 4518788 - DNA, 19 bp, Homo sapiens
gacactctatatgtagtgc

SEQ ID NO: 4518789 - DNA, 14 bp, Homo sapiens
gacactgagccagt

SEQ ID NO: 4518790 - DNA, 17 bp, Homo sapiens
gacactgagccagtctt

SEQ ID NO: 4518791 - DNA, 21 bp, Homo sapiens
gacactgctctaacagccctc

SEQ ID NO: 4518792 - DNA, 12 bp, Homo sapiens
gacactggcatg

SEQ ID NO: 4518793 - DNA, 16 bp, Homo sapiens
gacactgttaatagta

SEQ ID NO: 4518794 - DNA, 23 bp, Homo sapiens
gacactttaattaccaacctgtt

SEQ ID NO: 4518795 - DNA, 20 bp, Homo sapiens
gacactttgccaaggctctc

SEQ ID NO: 4518796 - DNA, 21 bp, Homo sapiens
gacactttgccaaggctctcc

SEQ ID NO: 4518797 - DNA, 12 bp, Homo sapiens
gacagaaagcag

SEQ ID NO: 4518798 - DNA, 16 bp, Homo sapiens
gacagaatgtgttctt

SEQ ID NO: 4518799 - DNA, 16 bp, Homo sapiens
gaccaacctgctctgt

SEQ ID NO: 4518800 - DNA, 18 bp, Homo sapiens
gaccaaggttccagctca

SEQ ID NO: 4518801 - DNA, 17 bp, Homo sapiens
gaccaagtataaacttt

SEQ ID NO: 4518802 - DNA, 12 bp, Homo sapiens
gaccaatatata

SEQ ID NO: 4518803 - DNA, 18 bp, Homo sapiens
gaccaatattgtacagtt

SEQ ID NO: 4518804 - DNA, 21 bp, Homo sapiens
gaccaatattgtacagttttt

SEQ ID NO: 4518805 - DNA, 22 bp, Homo sapiens
gaccaattactgcactcttaaa

SEQ ID NO: 4518806 - DNA, 18 bp, Homo sapiens
gaccaatttatgggagaa

SEQ ID NO: 4518807 - DNA, 19 bp, Homo sapiens
gaccaatttatgggagaat

SEQ ID NO: 4518808 - DNA, 20 bp, Homo sapiens
gaccacacattttatgagag

SEQ ID NO: 4518809 - DNA, 17 bp, Homo sapiens
gaccacataagaaggca

SEQ ID NO: 4518810 - DNA, 18 bp, Homo sapiens
gaccacccaacctcaccc

SEQ ID NO: 4518811 - DNA, 21 bp, Homo sapiens
gaccacccaacctcaccctcc

SEQ ID NO: 4518812 - DNA, 16 bp, Homo sapiens
gaccacccatatcatg

SEQ ID NO: 4518813 - DNA, 14 bp, Homo sapiens
gaccacggagggag

SEQ ID NO: 4518814 - DNA, 22 bp, Homo sapiens
gaccactgagccaggcttttct

SEQ ID NO: 4518815 - DNA, 16 bp, Homo sapiens
gaccagaaacagggac

SEQ ID NO: 4518816 - DNA, 12 bp, Homo sapiens
gaccagaagcct

SEQ ID NO: 4518817 - DNA, 11 bp, Homo sapiens
gaccagcacat

SEQ ID NO: 4518818 - DNA, 17 bp, Homo sapiens
gaccagcaggctggcct

SEQ ID NO: 4518819 - DNA, 15 bp, Homo sapiens
gaccagcccattggc

SEQ ID NO: 4518820 - DNA, 19 bp, Homo sapiens
gaccagcccattggccgag

SEQ ID NO: 4518821 - DNA, 21 bp, Homo sapiens
gaccagcccattggccgagct

SEQ ID NO: 4518822 - DNA, 14 bp, Homo sapiens
gaccaggactccct

SEQ ID NO: 4518823 - DNA, 21 bp, Homo sapiens
gaccaggactccctcctcacc

SEQ ID NO: 4518824 - DNA, 18 bp, Homo sapiens
gaccaggaggattgcctt

SEQ ID NO: 4518825 - DNA, 14 bp, Homo sapiens
gaccaggctgggca

SEQ ID NO: 4518826 - DNA, 15 bp, Homo sapiens
gaccagggatgctgg

SEQ ID NO: 4518827 - DNA, 17 bp, Homo sapiens
gaccagggatgctgggc

SEQ ID NO: 4518828 - DNA, 21 bp, Homo sapiens
gaccagggatgctgggctggg

SEQ ID NO: 4518829 - DNA, 17 bp, Homo sapiens
gaccagggtggccacac

SEQ ID NO: 4518830 - DNA, 19 bp, Homo sapiens
gaccagggtggccacacag

SEQ ID NO: 4518831 - DNA, 23 bp, Homo sapiens
gaccagggtggccacacaggcag

SEQ ID NO: 4518832 - DNA, 18 bp, Homo sapiens
gaccatcaagaacctaca

SEQ ID NO: 4518833 - DNA, 13 bp, Homo sapiens
gaccatcctggct

SEQ ID NO: 4518834 - DNA, 21 bp, Homo sapiens
gaccatgccagattctgcctc

SEQ ID NO: 4518835 - DNA, 14 bp, Homo sapiens
gaccatgggaaatg

SEQ ID NO: 4518836 - DNA, 16 bp, Homo sapiens
gaccattggctgcgct

SEQ ID NO: 4518837 - DNA, 19 bp, Homo sapiens
gaccattggggctcccagc

SEQ ID NO: 4518838 - DNA, 21 bp, Homo sapiens
gaccattggggctcccagcca

SEQ ID NO: 4518839 - DNA, 18 bp, Homo sapiens
gacccaaaaggcagaagc

SEQ ID NO: 4518840 - DNA, 15 bp, Homo sapiens
gacccacaagaaatg

SEQ ID NO: 4518841 - DNA, 16 bp, Homo sapiens
gacccacccccagcct

SEQ ID NO: 4518842 - DNA, 19 bp, Homo sapiens
gacccacccccagccttgc

SEQ ID NO: 4518843 - DNA, 18 bp, Homo sapiens
gacccacgggctcatgca

SEQ ID NO: 4518844 - DNA, 21 bp, Homo sapiens
gacccactttgtaatttttgc

SEQ ID NO: 4518845 - DNA, 24 bp, Homo sapiens
gacccagaggtccaggtcccagcc

SEQ ID NO: 4518846 - DNA, 18 bp, Homo sapiens
gacccagagtggagtctg

SEQ ID NO: 4518847 - DNA, 16 bp, Homo sapiens
gacccagccctcatcc

SEQ ID NO: 4518848 - DNA, 18 bp, Homo sapiens
gacccaggacccccgagg

SEQ ID NO: 4518849 - DNA, 21 bp, Homo sapiens
gacccaggagtccagcccctc

SEQ ID NO: 4518850 - DNA, 12 bp, Homo sapiens
gacccagggcct

SEQ ID NO: 4518851 - DNA, 16 bp, Homo sapiens
gacccagggcctgact

SEQ ID NO: 4518852 - DNA, 13 bp, Homo sapiens
gacccagggggag

SEQ ID NO: 4518853 - DNA, 17 bp, Homo sapiens
gacccaggggtccaggc

SEQ ID NO: 4518854 - DNA, 18 bp, Homo sapiens
gacccaggggtccaggcc

SEQ ID NO: 4518855 - DNA, 19 bp, Homo sapiens
gacccaggggtccaggccc

SEQ ID NO: 4518856 - DNA, 23 bp, Homo sapiens
gacccaggggtccaggcccccaa

SEQ ID NO: 4518857 - DNA, 15 bp, Homo sapiens
gacccagtggtcagc

SEQ ID NO: 4518858 - DNA, 20 bp, Homo sapiens
gacccattctacacagagca

SEQ ID NO: 4518859 - DNA, 15 bp, Homo sapiens
gaccccactccggcc

SEQ ID NO: 4518860 - DNA, 17 bp, Homo sapiens
gaccccactccggccct

SEQ ID NO: 4518861 - DNA, 19 bp, Homo sapiens
gaccccagcggctgagtca

SEQ ID NO: 4518862 - DNA, 12 bp, Homo sapiens
gaccccagctgg

SEQ ID NO: 4518863 - DNA, 22 bp, Homo sapiens
gaccccagtcgtgatgtggagg

SEQ ID NO: 4518864 - DNA, 14 bp, Homo sapiens
gacccccacaacaa

SEQ ID NO: 4518865 - DNA, 22 bp, Homo sapiens
gacccccaggcctgtccaccct

SEQ ID NO: 4518866 - DNA, 13 bp, Homo sapiens
gacccccatgtaa

SEQ ID NO: 4518867 - DNA, 14 bp, Homo sapiens
gacccccatgtaaa

SEQ ID NO: 4518868 - DNA, 21 bp, Homo sapiens
gacccccccccaactccagga

SEQ ID NO: 4518869 - DNA, 21 bp, Homo sapiens
gacccccccccaatcggactg

SEQ ID NO: 4518870 - DNA, 18 bp, Homo sapiens
gacccctcagccccagcc

SEQ ID NO: 4518871 - DNA, 20 bp, Homo sapiens
gacccctcagccccagccca

SEQ ID NO: 4518872 - DNA, 14 bp, Homo sapiens
gacccctcgcccca

SEQ ID NO: 4518873 - DNA, 14 bp, Homo sapiens
gacccctggcctcc

SEQ ID NO: 4518874 - DNA, 16 bp, Homo sapiens
gacccctggcctccgg

SEQ ID NO: 4518875 - DNA, 21 bp, Homo sapiens
gacccctttgagagacgccac

SEQ ID NO: 4518876 - DNA, 15 bp, Homo sapiens
gacccgtctccagct

SEQ ID NO: 4518877 - DNA, 16 bp, Homo sapiens
gaccctaaatcttgac

SEQ ID NO: 4518878 - DNA, 14 bp, Homo sapiens
gaccctaccccacc

SEQ ID NO: 4518879 - DNA, 20 bp, Homo sapiens
gaccctatgggtctaggaca

SEQ ID NO: 4518880 - DNA, 20 bp, Homo sapiens
gaccctcatctttcttccaa

SEQ ID NO: 4518881 - DNA, 16 bp, Homo sapiens
gaccctcgggccccat

SEQ ID NO: 4518882 - DNA, 13 bp, Homo sapiens
gaccctcttgccc

SEQ ID NO: 4518883 - DNA, 16 bp, Homo sapiens
gaccctgacctccgcc

SEQ ID NO: 4518884 - DNA, 18 bp, Homo sapiens
gaccctgaggccctgggc

SEQ ID NO: 4518885 - DNA, 21 bp, Homo sapiens
gaccctgaggccctgggctgg

SEQ ID NO: 4518886 - DNA, 19 bp, Homo sapiens
gaccctgagtccgggaggc

SEQ ID NO: 4518887 - DNA, 21 bp, Homo sapiens
gaccctgcaagaccacggagg

SEQ ID NO: 4518888 - DNA, 19 bp, Homo sapiens
gaccctgccacagccagag

SEQ ID NO: 4518889 - DNA, 21 bp, Homo sapiens
gaccctgccacagccagagga

SEQ ID NO: 4518890 - DNA, 19 bp, Homo sapiens
gaccctgcccagagctgag

SEQ ID NO: 4518891 - DNA, 15 bp, Homo sapiens
gaccctgcccccact

SEQ ID NO: 4518892 - DNA, 14 bp, Homo sapiens
gaccctgcttagga

SEQ ID NO: 4518893 - DNA, 20 bp, Homo sapiens
gaccctggactcgccactgg

SEQ ID NO: 4518894 - DNA, 17 bp, Homo sapiens
gaccctgggtgggctct

SEQ ID NO: 4518895 - DNA, 19 bp, Homo sapiens
gaccctgggtgggctctgt

SEQ ID NO: 4518896 - DNA, 22 bp, Homo sapiens
gaccctgggtgggctctgtgca

SEQ ID NO: 4518897 - DNA, 21 bp, Homo sapiens
gaccctgtccggcccagtgcc

SEQ ID NO: 4518898 - DNA, 14 bp, Homo sapiens
gaccctttccttcc

SEQ ID NO: 4518899 - DNA, 23 bp, Homo sapiens
gaccgaaatctgtattctgtttg

SEQ ID NO: 4518900 - DNA, 15 bp, Homo sapiens
gaccgactttcccca

SEQ ID NO: 4518901 - DNA, 22 bp, Homo sapiens
gaccgaggctacagctccacac

SEQ ID NO: 4518902 - DNA, 16 bp, Homo sapiens
gaccgcaggagggcag

SEQ ID NO: 4518903 - DNA, 22 bp, Homo sapiens
gaccgggcccctctctagggac

SEQ ID NO: 4518904 - DNA, 15 bp, Homo sapiens
gaccggtgctgcagg

SEQ ID NO: 4518905 - DNA, 17 bp, Homo sapiens
gaccggtgctgcaggag

SEQ ID NO: 4518906 - DNA, 21 bp, Homo sapiens
gaccgtttgtccacttcattt

SEQ ID NO: 4518907 - DNA, 17 bp, Homo sapiens
gacctaaagcaagcctg

SEQ ID NO: 4518908 - DNA, 13 bp, Homo sapiens
gacctactctcat

SEQ ID NO: 4518909 - DNA, 13 bp, Homo sapiens
gacctagcaggct

SEQ ID NO: 4518910 - DNA, 15 bp, Homo sapiens
gacctccccacccgc

SEQ ID NO: 4518911 - DNA, 19 bp, Homo sapiens
gacctccttagccctgtct

SEQ ID NO: 4518912 - DNA, 20 bp, Homo sapiens
gacctccttagccctgtctg

SEQ ID NO: 4518913 - DNA, 19 bp, Homo sapiens
gacctcgtcctccccctgc

SEQ ID NO: 4518914 - DNA, 13 bp, Homo sapiens
gacctgctcaggc

SEQ ID NO: 4518915 - DNA, 17 bp, Homo sapiens
gacctgctgctcagtaa

SEQ ID NO: 4518916 - DNA, 17 bp, Homo sapiens
gacctggcactgggagg

SEQ ID NO: 4518917 - DNA, 22 bp, Homo sapiens
gacctggtgctgcctctacctg

SEQ ID NO: 4518918 - DNA, 16 bp, Homo sapiens
gacctggttcccactg

SEQ ID NO: 4518919 - DNA, 17 bp, Homo sapiens
gacctgtaacttttgta

SEQ ID NO: 4518920 - DNA, 13 bp, Homo sapiens
gacctgtatttaa

SEQ ID NO: 4518921 - DNA, 15 bp, Homo sapiens
gacctgtcagaataa

SEQ ID NO: 4518922 - DNA, 15 bp, Homo sapiens
gacctgtcctcctgg

SEQ ID NO: 4518923 - DNA, 20 bp, Homo sapiens
gaccttagcgttctggactc

SEQ ID NO: 4518924 - DNA, 21 bp, Homo sapiens
gaccttcatgcccttctgatt

SEQ ID NO: 4518925 - DNA, 15 bp, Homo sapiens
gaccttccagagccc

SEQ ID NO: 4518926 - DNA, 23 bp, Homo sapiens
gaccttccctccgccttctccca

SEQ ID NO: 4518927 - DNA, 19 bp, Homo sapiens
gaccttctgatcttggaaa

SEQ ID NO: 4518928 - DNA, 15 bp, Homo sapiens
gaccttggcctctcc

SEQ ID NO: 4518929 - DNA, 18 bp, Homo sapiens
gaccttggggtacaattg

SEQ ID NO: 4518930 - DNA, 15 bp, Homo sapiens
gacctttatttatta

SEQ ID NO: 4518931 - DNA, 19 bp, Homo sapiens
gacctttatttattaaact

SEQ ID NO: 4518932 - DNA, 22 bp, Homo sapiens
gacctttatttattaaacttca

SEQ ID NO: 4518933 - DNA, 17 bp, Homo sapiens
gaccttttgggggaggg

SEQ ID NO: 4518934 - DNA, 19 bp, Homo sapiens
gacgagacaacagcacaca

SEQ ID NO: 4518935 - DNA, 21 bp, Homo sapiens
gacgagacaacagcacacagg

SEQ ID NO: 4518936 - DNA, 22 bp, Homo sapiens
gacgaggccctcgggcccagcc

SEQ ID NO: 4518937 - DNA, 15 bp, Homo sapiens
gacgcaaggtgtgct

SEQ ID NO: 4518938 - DNA, 16 bp, Homo sapiens
gacgcacacagctgag

SEQ ID NO: 4518939 - DNA, 19 bp, Homo sapiens
gacgcacacagctgagcac

SEQ ID NO: 4518940 - DNA, 14 bp, Homo sapiens
gacgccactcattt

SEQ ID NO: 4518941 - DNA, 18 bp, Homo sapiens
gacgccactcatttcatc

SEQ ID NO: 4518942 - DNA, 17 bp, Homo sapiens
gacgccactccctggga

SEQ ID NO: 4518943 - DNA, 18 bp, Homo sapiens
gacgccactccctgggac

SEQ ID NO: 4518944 - DNA, 22 bp, Homo sapiens
gacgccggggacagaggcctgc

SEQ ID NO: 4518945 - DNA, 13 bp, Homo sapiens
gacgcctgaggaa

SEQ ID NO: 4518946 - DNA, 24 bp, Homo sapiens
gacgccttcatctgggacaaaact

SEQ ID NO: 4518947 - DNA, 21 bp, Homo sapiens
gacgctcagccccaggccagc

SEQ ID NO: 4518948 - DNA, 21 bp, Homo sapiens
gacgctgccgctgccgctgca

SEQ ID NO: 4518949 - DNA, 19 bp, Homo sapiens
gacgcttaacctttccgct

SEQ ID NO: 4518950 - DNA, 13 bp, Homo sapiens
gacgcttgctctg

SEQ ID NO: 4518951 - DNA, 18 bp, Homo sapiens
gacggatgcccattcctg

SEQ ID NO: 4518952 - DNA, 22 bp, Homo sapiens
gacggcaacctgcggaaggagg

SEQ ID NO: 4518953 - DNA, 20 bp, Homo sapiens
gacggcctgatgctccctcc

SEQ ID NO: 4518954 - DNA, 17 bp, Homo sapiens
gacggcgtttcaccatg

SEQ ID NO: 4518955 - DNA, 23 bp, Homo sapiens
gacgggactcaggcgggacagtg

SEQ ID NO: 4518956 - DNA, 13 bp, Homo sapiens
gacgggatgctct

SEQ ID NO: 4518957 - DNA, 17 bp, Homo sapiens
gacggggggccccagtc

SEQ ID NO: 4518958 - DNA, 22 bp, Homo sapiens
gacgggtgcccgtaatcccagc

SEQ ID NO: 4518959 - DNA, 23 bp, Homo sapiens
gacgggtgcccgtaatcccagct

SEQ ID NO: 4518960 - DNA, 17 bp, Homo sapiens
gacggtccccacccctc

SEQ ID NO: 4518961 - DNA, 14 bp, Homo sapiens
gacggttttgcttt

SEQ ID NO: 4518962 - DNA, 19 bp, Homo sapiens
gacgtcaccctccattctg

SEQ ID NO: 4518963 - DNA, 14 bp, Homo sapiens
gacgtcaggccctg

SEQ ID NO: 4518964 - DNA, 20 bp, Homo sapiens
gacgtcaggccctgactcct

SEQ ID NO: 4518965 - DNA, 23 bp, Homo sapiens
gacgtcaggccctgactcctctg

SEQ ID NO: 4518966 - DNA, 22 bp, Homo sapiens
gacgtcatcggaggctgggccc

SEQ ID NO: 4518967 - DNA, 19 bp, Homo sapiens
gacgtctggggtgtgggga

SEQ ID NO: 4518968 - DNA, 20 bp, Homo sapiens
gacgtctggggtgtggggat

SEQ ID NO: 4518969 - DNA, 15 bp, Homo sapiens
gacgtggtaaaatgt

SEQ ID NO: 4518970 - DNA, 15 bp, Homo sapiens
gacgtggtgggactc

SEQ ID NO: 4518971 - DNA, 22 bp, Homo sapiens
gacgttccagccggcatggctg

SEQ ID NO: 4518972 - DNA, 13 bp, Homo sapiens
gacgttgcctgag

SEQ ID NO: 4518973 - DNA, 19 bp, Homo sapiens
gacgttgctgagccagctg

SEQ ID NO: 4518974 - DNA, 20 bp, Homo sapiens
gacgtttttgtgctgtgggc

SEQ ID NO: 4518975 - DNA, 15 bp, Homo sapiens
gactaaactacatta

SEQ ID NO: 4518976 - DNA, 22 bp, Homo sapiens
gactaaactttttttctgtacc

SEQ ID NO: 4518977 - DNA, 18 bp, Homo sapiens
gactaattttacatgttt

SEQ ID NO: 4518978 - DNA, 22 bp, Homo sapiens
gactacaaaataaaacttggtt

SEQ ID NO: 4518979 - DNA, 16 bp, Homo sapiens
gactacacaatacagt

SEQ ID NO: 4518980 - DNA, 17 bp, Homo sapiens
gactacacaatacagta

SEQ ID NO: 4518981 - DNA, 19 bp, Homo sapiens
gactacacaatacagtatt

SEQ ID NO: 4518982 - DNA, 13 bp, Homo sapiens
gactacagggctt

SEQ ID NO: 4518983 - DNA, 19 bp, Homo sapiens
gactagaagattagaaact

SEQ ID NO: 4518984 - DNA, 22 bp, Homo sapiens
gactagagaaaccgtcctcttt

SEQ ID NO: 4518985 - DNA, 16 bp, Homo sapiens
gactagatgatggatg

SEQ ID NO: 4518986 - DNA, 19 bp, Homo sapiens
gactagggattcaggctgc

SEQ ID NO: 4518987 - DNA, 17 bp, Homo sapiens
gactatagctgttctaa

SEQ ID NO: 4518988 - DNA, 16 bp, Homo sapiens
gactatataatttatt

SEQ ID NO: 4518989 - DNA, 16 bp, Homo sapiens
gactatctttgctgca

SEQ ID NO: 4518990 - DNA, 15 bp, Homo sapiens
gactatgaaaagcta

SEQ ID NO: 4518991 - DNA, 21 bp, Homo sapiens
gactatttgacccccacaaca

SEQ ID NO: 4518992 - DNA, 14 bp, Homo sapiens
gactatttgctaat

SEQ ID NO: 4518993 - DNA, 19 bp, Homo sapiens
gactatttgctaatgtata

SEQ ID NO: 4518994 - DNA, 14 bp, Homo sapiens
gactcaagagaatt

SEQ ID NO: 4518995 - DNA, 12 bp, Homo sapiens
gactcacctctg

SEQ ID NO: 4518996 - DNA, 18 bp, Homo sapiens
gactcacctctgcctcaa

SEQ ID NO: 4518997 - DNA, 20 bp, Homo sapiens
gactcacttcaatgtgtcat

SEQ ID NO: 4518998 - DNA, 17 bp, Homo sapiens
gactcagaaagccaaca

SEQ ID NO: 4518999 - DNA, 17 bp, Homo sapiens
gactcagaggtccaggc

SEQ ID NO: 4519000 - DNA, 16 bp, Homo sapiens
gactcagccctgaggt

SEQ ID NO: 4519001 - DNA, 14 bp, Homo sapiens
gactcagcctctgc

SEQ ID NO: 4519002 - DNA, 15 bp, Homo sapiens
gactcagcctctgct

SEQ ID NO: 4519003 - DNA, 16 bp, Homo sapiens
gactcagcctctgctg

SEQ ID NO: 4519004 - DNA, 20 bp, Homo sapiens
gactcagcctctgctggaga

SEQ ID NO: 4519005 - DNA, 24 bp, Homo sapiens
gactcagggaccggtgctgcagga

SEQ ID NO: 4519006 - DNA, 13 bp, Homo sapiens
gactcagggctcc

SEQ ID NO: 4519007 - DNA, 19 bp, Homo sapiens
gactcagttgttctgagca

SEQ ID NO: 4519008 - DNA, 13 bp, Homo sapiens
gactccagccagc

SEQ ID NO: 4519009 - DNA, 14 bp, Homo sapiens
gactccagccagcg

SEQ ID NO: 4519010 - DNA, 21 bp, Homo sapiens
gactccagccagcgcctccct

SEQ ID NO: 4519011 - DNA, 14 bp, Homo sapiens
gactccaggcccaa

SEQ ID NO: 4519012 - DNA, 16 bp, Homo sapiens
gactcccatgaagcct

SEQ ID NO: 4519013 - DNA, 18 bp, Homo sapiens
gactcccatgaagccttt

SEQ ID NO: 4519014 - DNA, 14 bp, Homo sapiens
gactccctcctcac

SEQ ID NO: 4519015 - DNA, 16 bp, Homo sapiens
gactccctcctcacct

SEQ ID NO: 4519016 - DNA, 19 bp, Homo sapiens
gactccctcctcacctctg

SEQ ID NO: 4519017 - DNA, 20 bp, Homo sapiens
gactccctcctcacctctgg

SEQ ID NO: 4519018 - DNA, 23 bp, Homo sapiens
gactccctcctcacctctggact

SEQ ID NO: 4519019 - DNA, 24 bp, Homo sapiens
gactccctcctcacctctggactg

SEQ ID NO: 4519020 - DNA, 14 bp, Homo sapiens
gactccggaggact

SEQ ID NO: 4519021 - DNA, 21 bp, Homo sapiens
gactccggaggactgagcccc

SEQ ID NO: 4519022 - DNA, 23 bp, Homo sapiens
gactccggaggactgagccccca

SEQ ID NO: 4519023 - DNA, 15 bp, Homo sapiens
gactccggctgtgct

SEQ ID NO: 4519024 - DNA, 17 bp, Homo sapiens
gactccggctgtgctgg

SEQ ID NO: 4519025 - DNA, 18 bp, Homo sapiens
gactccggctgtgctggg

SEQ ID NO: 4519026 - DNA, 21 bp, Homo sapiens
gactccggctgtgctgggaga

SEQ ID NO: 4519027 - DNA, 11 bp, Homo sapiens
gactcctgctc

SEQ ID NO: 4519028 - DNA, 21 bp, Homo sapiens
gactcctggactccggaggac

SEQ ID NO: 4519029 - DNA, 16 bp, Homo sapiens
gactcgagaactttca

SEQ ID NO: 4519030 - DNA, 13 bp, Homo sapiens
gactcggagacta

SEQ ID NO: 4519031 - DNA, 20 bp, Homo sapiens
gactcggagactatggcctc

SEQ ID NO: 4519032 - DNA, 14 bp, Homo sapiens
gactctagcaaggc

SEQ ID NO: 4519033 - DNA, 19 bp, Homo sapiens
gactctcagcccagaagaa

SEQ ID NO: 4519034 - DNA, 18 bp, Homo sapiens
gactctcagtctctgagc

SEQ ID NO: 4519035 - DNA, 24 bp, Homo sapiens
gactctccaggggtcctaggcctc

SEQ ID NO: 4519036 - DNA, 15 bp, Homo sapiens
gactctcctcctccc

SEQ ID NO: 4519037 - DNA, 17 bp, Homo sapiens
gactctcctcctcccct

SEQ ID NO: 4519038 - DNA, 18 bp, Homo sapiens
gactctcctcctcccctc

SEQ ID NO: 4519039 - DNA, 19 bp, Homo sapiens
gactctgaagcctctggga

SEQ ID NO: 4519040 - DNA, 15 bp, Homo sapiens
gactctgcacccgcc

SEQ ID NO: 4519041 - DNA, 10 bp, Homo sapiens
gactctgccc

SEQ ID NO: 4519042 - DNA, 12 bp, Homo sapiens
gactctgcccca

SEQ ID NO: 4519043 - DNA, 13 bp, Homo sapiens
gactctgccccct

SEQ ID NO: 4519044 - DNA, 16 bp, Homo sapiens
gactctgccccctgct

SEQ ID NO: 4519045 - DNA, 21 bp, Homo sapiens
gactctgccccctgctggctc

SEQ ID NO: 4519046 - DNA, 13 bp, Homo sapiens
gactctgctgctc

SEQ ID NO: 4519047 - DNA, 22 bp, Homo sapiens
gactctggggtgcagcttcacc

SEQ ID NO: 4519048 - DNA, 12 bp, Homo sapiens
gactctgtgtgg

SEQ ID NO: 4519049 - DNA, 21 bp, Homo sapiens
gactctgtgtggctgtgcaat

SEQ ID NO: 4519050 - DNA, 14 bp, Homo sapiens
gactcttcacagat

SEQ ID NO: 4519051 - DNA, 23 bp, Homo sapiens
gactctttattgtctgtaaatct

SEQ ID NO: 4519052 - DNA, 20 bp, Homo sapiens
gactctttctgaaggaagag

SEQ ID NO: 4519053 - DNA, 17 bp, Homo sapiens
gactcttttccttccct

SEQ ID NO: 4519054 - DNA, 15 bp, Homo sapiens
gactgaaaatattgt

SEQ ID NO: 4519055 - DNA, 20 bp, Homo sapiens
gactgaaagaagaaaacagt

SEQ ID NO: 4519056 - DNA, 21 bp, Homo sapiens
gactgaaagaagaaaacagta

SEQ ID NO: 4519057 - DNA, 18 bp, Homo sapiens
gactgaagatgcagctca

SEQ ID NO: 4519058 - DNA, 15 bp, Homo sapiens
gactgaatgtgccta

SEQ ID NO: 4519059 - DNA, 18 bp, Homo sapiens
gactgaattgtccccagt

SEQ ID NO: 4519060 - DNA, 13 bp, Homo sapiens
gactgagcagaac

SEQ ID NO: 4519061 - DNA, 16 bp, Homo sapiens
gactgagcagccgcca

SEQ ID NO: 4519062 - DNA, 21 bp, Homo sapiens
gactgagcagccgccagctgg

SEQ ID NO: 4519063 - DNA, 21 bp, Homo sapiens
gactgagccaaggaggcctgg

SEQ ID NO: 4519064 - DNA, 13 bp, Homo sapiens
gactgagccccca

SEQ ID NO: 4519065 - DNA, 21 bp, Homo sapiens
gactgaggcctgagcgctcct

SEQ ID NO: 4519066 - DNA, 18 bp, Homo sapiens
gactgagggggcctggat

SEQ ID NO: 4519067 - DNA, 16 bp, Homo sapiens
gactgagtgggaagcc

SEQ ID NO: 4519068 - DNA, 17 bp, Homo sapiens
gactgagtgggaagccc

SEQ ID NO: 4519069 - DNA, 22 bp, Homo sapiens
gactgatgagcacatctctctg

SEQ ID NO: 4519070 - DNA, 21 bp, Homo sapiens
gactgatgttgagggaacaga

SEQ ID NO: 4519071 - DNA, 14 bp, Homo sapiens
gactgatttcagag

SEQ ID NO: 4519072 - DNA, 13 bp, Homo sapiens
gactgattttaat

SEQ ID NO: 4519073 - DNA, 22 bp, Homo sapiens
gactgcaagagatggaaaaaaa

SEQ ID NO: 4519074 - DNA, 16 bp, Homo sapiens
gactgcagaggggaaa

SEQ ID NO: 4519075 - DNA, 22 bp, Homo sapiens
gactgccaggataaagcttccg

SEQ ID NO: 4519076 - DNA, 20 bp, Homo sapiens
gactgcccagaaagtggggg

SEQ ID NO: 4519077 - DNA, 15 bp, Homo sapiens
gactgcccctgctgt

SEQ ID NO: 4519078 - DNA, 14 bp, Homo sapiens
gactgcctgtctgc

SEQ ID NO: 4519079 - DNA, 12 bp, Homo sapiens
gactgcgggagc

SEQ ID NO: 4519080 - DNA, 18 bp, Homo sapiens
gactgcgggagccagact

SEQ ID NO: 4519081 - DNA, 19 bp, Homo sapiens
gactgcgggagccagactg

SEQ ID NO: 4519082 - DNA, 23 bp, Homo sapiens
gactgcgggagccagactgtcca

SEQ ID NO: 4519083 - DNA, 18 bp, Homo sapiens
gactgctaaataaaattt

SEQ ID NO: 4519084 - DNA, 17 bp, Homo sapiens
gactgctacctctgaga

SEQ ID NO: 4519085 - DNA, 20 bp, Homo sapiens
gactgctacctctgagaaga

SEQ ID NO: 4519086 - DNA, 17 bp, Homo sapiens
gactgctgctctcccaa

SEQ ID NO: 4519087 - DNA, 19 bp, Homo sapiens
gactgctgctctcccaagg

SEQ ID NO: 4519088 - DNA, 15 bp, Homo sapiens
gactgcttggggtgg

SEQ ID NO: 4519089 - DNA, 15 bp, Homo sapiens
gactggactgcttgg

SEQ ID NO: 4519090 - DNA, 13 bp, Homo sapiens
gactggaggaggc

SEQ ID NO: 4519091 - DNA, 14 bp, Homo sapiens
gactggcacagttt

SEQ ID NO: 4519092 - DNA, 12 bp, Homo sapiens
gactggccaggg

SEQ ID NO: 4519093 - DNA, 17 bp, Homo sapiens
gactggcgttcacctcc

SEQ ID NO: 4519094 - DNA, 20 bp, Homo sapiens
gactggcgttcacctccctg

SEQ ID NO: 4519095 - DNA, 13 bp, Homo sapiens
gactggctcctga

SEQ ID NO: 4519096 - DNA, 17 bp, Homo sapiens
gactgggagccacttct

SEQ ID NO: 4519097 - DNA, 17 bp, Homo sapiens
gactgggcactggggcc

SEQ ID NO: 4519098 - DNA, 18 bp, Homo sapiens
gactgggcactggggcct

SEQ ID NO: 4519099 - DNA, 14 bp, Homo sapiens
gactgggctgaggg

SEQ ID NO: 4519100 - DNA, 15 bp, Homo sapiens
gactgggctgaggga

SEQ ID NO: 4519101 - DNA, 16 bp, Homo sapiens
gactgggctgagggag

SEQ ID NO: 4519102 - DNA, 18 bp, Homo sapiens
gactgggttagaggagtc

SEQ ID NO: 4519103 - DNA, 17 bp, Homo sapiens
gactggtgaatataaat

SEQ ID NO: 4519104 - DNA, 19 bp, Homo sapiens
gactggtggcaggggcttc

SEQ ID NO: 4519105 - DNA, 16 bp, Homo sapiens
gactgtacacacttta

SEQ ID NO: 4519106 - DNA, 23 bp, Homo sapiens
gactgtacacactttatttactt

SEQ ID NO: 4519107 - DNA, 11 bp, Homo sapiens
gactgtagaaa

SEQ ID NO: 4519108 - DNA, 14 bp, Homo sapiens
gactgtatattgct

SEQ ID NO: 4519109 - DNA, 22 bp, Homo sapiens
gactgtatctaggcatttcatt

SEQ ID NO: 4519110 - DNA, 21 bp, Homo sapiens
gactgtcacggggttccctcc

SEQ ID NO: 4519111 - DNA, 14 bp, Homo sapiens
gactgtcagtgggg

SEQ ID NO: 4519112 - DNA, 14 bp, Homo sapiens
gactgtccagggaa

SEQ ID NO: 4519113 - DNA, 19 bp, Homo sapiens
gactgtcccaccgggagcc

SEQ ID NO: 4519114 - DNA, 18 bp, Homo sapiens
gactgtctccatggccct

SEQ ID NO: 4519115 - DNA, 17 bp, Homo sapiens
gactgtgattagatcac

SEQ ID NO: 4519116 - DNA, 15 bp, Homo sapiens
gactgtgattcagaa

SEQ ID NO: 4519117 - DNA, 14 bp, Homo sapiens
gactgtgcctggct

SEQ ID NO: 4519118 - DNA, 19 bp, Homo sapiens
gactgtgcctggctccctg

SEQ ID NO: 4519119 - DNA, 22 bp, Homo sapiens
gactgtgcttgggagcctgtgg

SEQ ID NO: 4519120 - DNA, 23 bp, Homo sapiens
gactgtggccatatatgctgtat

SEQ ID NO: 4519121 - DNA, 21 bp, Homo sapiens
gactgtggtgacttctgctgc

SEQ ID NO: 4519122 - DNA, 23 bp, Homo sapiens
gactgtggtgacttctgctgctg

SEQ ID NO: 4519123 - DNA, 18 bp, Homo sapiens
gactgtggtgtggaggga

SEQ ID NO: 4519124 - DNA, 16 bp, Homo sapiens
gactgttccaggccct

SEQ ID NO: 4519125 - DNA, 19 bp, Homo sapiens
gacttaaaattagtctttt

SEQ ID NO: 4519126 - DNA, 16 bp, Homo sapiens
gacttatttatataaa

SEQ ID NO: 4519127 - DNA, 15 bp, Homo sapiens
gacttatttctgctc

SEQ ID NO: 4519128 - DNA, 19 bp, Homo sapiens
gacttcaaaatattgagca

SEQ ID NO: 4519129 - DNA, 16 bp, Homo sapiens
gacttcaactgcccag

SEQ ID NO: 4519130 - DNA, 11 bp, Homo sapiens
gacttcactgt

SEQ ID NO: 4519131 - DNA, 12 bp, Homo sapiens
gacttcactgta

SEQ ID NO: 4519132 - DNA, 16 bp, Homo sapiens
gacttcactgtatata

SEQ ID NO: 4519133 - DNA, 12 bp, Homo sapiens
gacttcagattg

SEQ ID NO: 4519134 - DNA, 13 bp, Homo sapiens
gacttcaggtgga

SEQ ID NO: 4519135 - DNA, 12 bp, Homo sapiens
gacttccacaaa

SEQ ID NO: 4519136 - DNA, 17 bp, Homo sapiens
gacttccacaaacctgg

SEQ ID NO: 4519137 - DNA, 17 bp, Homo sapiens
gacttcccactgttctg

SEQ ID NO: 4519138 - DNA, 13 bp, Homo sapiens
gacttcccagcta

SEQ ID NO: 4519139 - DNA, 14 bp, Homo sapiens
gacttccccatccc

SEQ ID NO: 4519140 - DNA, 17 bp, Homo sapiens
gacttccccatcccgaa

SEQ ID NO: 4519141 - DNA, 18 bp, Homo sapiens
gacttctaagtaaaacca

SEQ ID NO: 4519142 - DNA, 15 bp, Homo sapiens
gacttctcaccagca

SEQ ID NO: 4519143 - DNA, 12 bp, Homo sapiens
gacttgagccac

SEQ ID NO: 4519144 - DNA, 13 bp, Homo sapiens
gacttgagccact

SEQ ID NO: 4519145 - DNA, 16 bp, Homo sapiens
gacttgagccactcct

SEQ ID NO: 4519146 - DNA, 20 bp, Homo sapiens
gacttgagccactccttcct

SEQ ID NO: 4519147 - DNA, 19 bp, Homo sapiens
gacttgcaatccaggctgt

SEQ ID NO: 4519148 - DNA, 20 bp, Homo sapiens
gacttgcaatccaggctgtt

SEQ ID NO: 4519149 - DNA, 11 bp, Homo sapiens
gacttgcttta

SEQ ID NO: 4519150 - DNA, 20 bp, Homo sapiens
gacttggatcccaaagcaag

SEQ ID NO: 4519151 - DNA, 19 bp, Homo sapiens
gacttgtacaaacagtatt

SEQ ID NO: 4519152 - DNA, 12 bp, Homo sapiens
gacttgtgtctg

SEQ ID NO: 4519153 - DNA, 17 bp, Homo sapiens
gacttgtgtgcatggaa

SEQ ID NO: 4519154 - DNA, 11 bp, Homo sapiens
gactttataaa

SEQ ID NO: 4519155 - DNA, 13 bp, Homo sapiens
gactttatttatt

SEQ ID NO: 4519156 - DNA, 15 bp, Homo sapiens
gactttatttatttc

SEQ ID NO: 4519157 - DNA, 17 bp, Homo sapiens
gactttatttatttcta

SEQ ID NO: 4519158 - DNA, 21 bp, Homo sapiens
gactttatttatttctagttc

SEQ ID NO: 4519159 - DNA, 21 bp, Homo sapiens
gactttgctgttactgcttct

SEQ ID NO: 4519160 - DNA, 16 bp, Homo sapiens
gactttgtatacttta

SEQ ID NO: 4519161 - DNA, 14 bp, Homo sapiens
gacttttaaaattt

SEQ ID NO: 4519162 - DNA, 14 bp, Homo sapiens
gacttttacagatt

SEQ ID NO: 4519163 - DNA, 15 bp, Homo sapiens
gacttttatgtgaga

SEQ ID NO: 4519164 - DNA, 17 bp, Homo sapiens
gacttttatgtgagatt

SEQ ID NO: 4519165 - DNA, 20 bp, Homo sapiens
gacttttatgtgagatttcc

SEQ ID NO: 4519166 - DNA, 13 bp, Homo sapiens
gacttttctgtaa

SEQ ID NO: 4519167 - DNA, 18 bp, Homo sapiens
gacttttctgtaattcag

SEQ ID NO: 4519168 - DNA, 16 bp, Homo sapiens
gacttttgttaaattc

SEQ ID NO: 4519169 - DNA, 22 bp, Homo sapiens
gacttttgttaaattcagtaat

SEQ ID NO: 4519170 - DNA, 18 bp, Homo sapiens
gactttttggaattcagc

SEQ ID NO: 4519171 - DNA, 20 bp, Homo sapiens
gactttttggaattcagcag

SEQ ID NO: 4519172 - DNA, 21 bp, Homo sapiens
gactttttggtggatgtaaat

SEQ ID NO: 4519173 - DNA, 14 bp, Homo sapiens
gacttttttataca

SEQ ID NO: 4519174 - DNA, 15 bp, Homo sapiens
gacttttttctaaac

SEQ ID NO: 4519175 - DNA, 13 bp, Homo sapiens
gactttttttgta

SEQ ID NO: 4519176 - DNA, 22 bp, Homo sapiens
gagaaaaagacagcgataagct

SEQ ID NO: 4519177 - DNA, 18 bp, Homo sapiens
gagaaaaatgctccccac

SEQ ID NO: 4519178 - DNA, 21 bp, Homo sapiens
gagaaaagacagggtgggagg

SEQ ID NO: 4519179 - DNA, 23 bp, Homo sapiens
gagaaaagacagggtgggaggga

SEQ ID NO: 4519180 - DNA, 14 bp, Homo sapiens
gagaaaagagagaa

SEQ ID NO: 4519181 - DNA, 11 bp, Homo sapiens
gagaaaatata

SEQ ID NO: 4519182 - DNA, 16 bp, Homo sapiens
gagaaaatatatgtat

SEQ ID NO: 4519183 - DNA, 17 bp, Homo sapiens
gagaaaatatatgtatt

SEQ ID NO: 4519184 - DNA, 17 bp, Homo sapiens
gagaaacagttggtaac

SEQ ID NO: 4519185 - DNA, 12 bp, Homo sapiens
gagaaaccctgt

SEQ ID NO: 4519186 - DNA, 11 bp, Homo sapiens
gagaaactgag

SEQ ID NO: 4519187 - DNA, 15 bp, Homo sapiens
gagaaactgctgcag

SEQ ID NO: 4519188 - DNA, 17 bp, Homo sapiens
gagaaactgctgcagat

SEQ ID NO: 4519189 - DNA, 18 bp, Homo sapiens
gagaaactgctgcagatt

SEQ ID NO: 4519190 - DNA, 18 bp, Homo sapiens
gagaaagactattcaaac

SEQ ID NO: 4519191 - DNA, 12 bp, Homo sapiens
gagaaagagaac

SEQ ID NO: 4519192 - DNA, 14 bp, Homo sapiens
gagaaaggacagag

SEQ ID NO: 4519193 - DNA, 21 bp, Homo sapiens
gagaaaggacagagccagcgg

SEQ ID NO: 4519194 - DNA, 14 bp, Homo sapiens
gagaaatcaacagg

SEQ ID NO: 4519195 - DNA, 20 bp, Homo sapiens
gagaaatgaatgctgagacc

SEQ ID NO: 4519196 - DNA, 19 bp, Homo sapiens
gagaaattcgtgtgttttt

SEQ ID NO: 4519197 - DNA, 14 bp, Homo sapiens
gagaaattcttgtt

SEQ ID NO: 4519198 - DNA, 17 bp, Homo sapiens
gagaacaaacagatcga

SEQ ID NO: 4519199 - DNA, 19 bp, Homo sapiens
gagaacagtattgggcagg

SEQ ID NO: 4519200 - DNA, 14 bp, Homo sapiens
gagaaccaaagcaa

SEQ ID NO: 4519201 - DNA, 22 bp, Homo sapiens
gagaaccagtctcctcactctg

SEQ ID NO: 4519202 - DNA, 18 bp, Homo sapiens
gagaacctaatgcactct

SEQ ID NO: 4519203 - DNA, 20 bp, Homo sapiens
gagaacctgagttcccggga

SEQ ID NO: 4519204 - DNA, 15 bp, Homo sapiens
gagaaccttttcaaa

SEQ ID NO: 4519205 - DNA, 13 bp, Homo sapiens
gagaacgcagccc

SEQ ID NO: 4519206 - DNA, 16 bp, Homo sapiens
gagaacgcagccctag

SEQ ID NO: 4519207 - DNA, 22 bp, Homo sapiens
gagaactaaactagtttttcct

SEQ ID NO: 4519208 - DNA, 19 bp, Homo sapiens
gagaactagaacctggagg

SEQ ID NO: 4519209 - DNA, 15 bp, Homo sapiens
gagaactccatcaga

SEQ ID NO: 4519210 - DNA, 21 bp, Homo sapiens
gagaactcgttcacctccaag

SEQ ID NO: 4519211 - DNA, 12 bp, Homo sapiens
gagaactttctt

SEQ ID NO: 4519212 - DNA, 20 bp, Homo sapiens
gagaagaaaggtgagtttga

SEQ ID NO: 4519213 - DNA, 14 bp, Homo sapiens
gagaagaatagcct

SEQ ID NO: 4519214 - DNA, 20 bp, Homo sapiens
gagaagaattttcagacccc

SEQ ID NO: 4519215 - DNA, 18 bp, Homo sapiens
gagaagagggcccagccc

SEQ ID NO: 4519216 - DNA, 21 bp, Homo sapiens
gagaagagggcccagcccaga

SEQ ID NO: 4519217 - DNA, 20 bp, Homo sapiens
gagaagatgcctgttaattt

SEQ ID NO: 4519218 - DNA, 19 bp, Homo sapiens
gagaagctaaaacctgagc

SEQ ID NO: 4519219 - DNA, 13 bp, Homo sapiens
gagaagctctgaa

SEQ ID NO: 4519220 - DNA, 11 bp, Homo sapiens
gagaaggagcc

SEQ ID NO: 4519221 - DNA, 17 bp, Homo sapiens
gagaaggttggaggtgg

SEQ ID NO: 4519222 - DNA, 23 bp, Homo sapiens
gagaaggttggaggtggggaagg

SEQ ID NO: 4519223 - DNA, 22 bp, Homo sapiens
gagaagtagctagtagcaatgt

SEQ ID NO: 4519224 - DNA, 21 bp, Homo sapiens
gagaagttgctgcttgtgatc

SEQ ID NO: 4519225 - DNA, 23 bp, Homo sapiens
gagaataccttggtctcacctat

SEQ ID NO: 4519226 - DNA, 11 bp, Homo sapiens
gagaatagaaa

SEQ ID NO: 4519227 - DNA, 20 bp, Homo sapiens
gagaatcacctgaaccccag

SEQ ID NO: 4519228 - DNA, 22 bp, Homo sapiens
gagaatcactgctccaggcctg

SEQ ID NO: 4519229 - DNA, 22 bp, Homo sapiens
gagaatcacttaagcctggaag

SEQ ID NO: 4519230 - DNA, 15 bp, Homo sapiens
gagaatcacttgaac

SEQ ID NO: 4519231 - DNA, 21 bp, Homo sapiens
gagaatctacccccagatcca

SEQ ID NO: 4519232 - DNA, 23 bp, Homo sapiens
gagaatgatagtaataggataca

SEQ ID NO: 4519233 - DNA, 17 bp, Homo sapiens
gagaatgcacagatata

SEQ ID NO: 4519234 - DNA, 23 bp, Homo sapiens
gagaatgtgtgtgtgtggcaggg

SEQ ID NO: 4519235 - DNA, 17 bp, Homo sapiens
gagaattcaaatcctct

SEQ ID NO: 4519236 - DNA, 21 bp, Homo sapiens
gagaattgctgaagggcattc

SEQ ID NO: 4519237 - DNA, 17 bp, Homo sapiens
gagaatttctaaagtaa

SEQ ID NO: 4519238 - DNA, 14 bp, Homo sapiens
gagacaagcagagt

SEQ ID NO: 4519239 - DNA, 15 bp, Homo sapiens
gagacaaggtgctaa

SEQ ID NO: 4519240 - DNA, 13 bp, Homo sapiens
gagacacctgcac

SEQ ID NO: 4519241 - DNA, 15 bp, Homo sapiens
gagacacctgcacct

SEQ ID NO: 4519242 - DNA, 17 bp, Homo sapiens
gagacacctgcacctcc

SEQ ID NO: 4519243 - DNA, 14 bp, Homo sapiens
gagacactgagcca

SEQ ID NO: 4519244 - DNA, 15 bp, Homo sapiens
gagacagaggatgtg

SEQ ID NO: 4519245 - DNA, 17 bp, Homo sapiens
gagacagccaggtggca

SEQ ID NO: 4519246 - DNA, 22 bp, Homo sapiens
gagacagccaggtggcacctgc

SEQ ID NO: 4519247 - DNA, 20 bp, Homo sapiens
gagacagctctgcatactca

SEQ ID NO: 4519248 - DNA, 15 bp, Homo sapiens
gagacagcttctctg

SEQ ID NO: 4519249 - DNA, 19 bp, Homo sapiens
gagacaggaaaatcctctg

SEQ ID NO: 4519250 - DNA, 18 bp, Homo sapiens
gagacaggacagaatgtg

SEQ ID NO: 4519251 - DNA, 16 bp, Homo sapiens
gagacaggcagcccag

SEQ ID NO: 4519252 - DNA, 17 bp, Homo sapiens
gagacagggctgctccc

SEQ ID NO: 4519253 - DNA, 18 bp, Homo sapiens
gagacagggtcttgctct

SEQ ID NO: 4519254 - DNA, 16 bp, Homo sapiens
gagacagtgaatttgg

SEQ ID NO: 4519255 - DNA, 11 bp, Homo sapiens
gagacatccag

SEQ ID NO: 4519256 - DNA, 18 bp, Homo sapiens
gagacatgtaccttgacc

SEQ ID NO: 4519257 - DNA, 13 bp, Homo sapiens
gagacattgctct

SEQ ID NO: 4519258 - DNA, 23 bp, Homo sapiens
gagaccagggtggccacacaggc

SEQ ID NO: 4519259 - DNA, 12 bp, Homo sapiens
gagaccatcctg

SEQ ID NO: 4519260 - DNA, 14 bp, Homo sapiens
gagaccatcctggc

SEQ ID NO: 4519261 - DNA, 22 bp, Homo sapiens
gagaccatttgtattaccatta

SEQ ID NO: 4519262 - DNA, 12 bp, Homo sapiens
gagacccccaca

SEQ ID NO: 4519263 - DNA, 14 bp, Homo sapiens
gagacccccacacc

SEQ ID NO: 4519264 - DNA, 15 bp, Homo sapiens
gagacccccacacct

SEQ ID NO: 4519265 - DNA, 13 bp, Homo sapiens
gagacccccaggc

SEQ ID NO: 4519266 - DNA, 16 bp, Homo sapiens
gagacccccaggcaga

SEQ ID NO: 4519267 - DNA, 14 bp, Homo sapiens
gagacccccaggcc

SEQ ID NO: 4519268 - DNA, 16 bp, Homo sapiens
gagacccccaggcctg

SEQ ID NO: 4519269 - DNA, 15 bp, Homo sapiens
gagacccctggcctc

SEQ ID NO: 4519270 - DNA, 17 bp, Homo sapiens
gagaccctgaactcaga

SEQ ID NO: 4519271 - DNA, 21 bp, Homo sapiens
gagaccctgccacagccagag

SEQ ID NO: 4519272 - DNA, 23 bp, Homo sapiens
gagaccctgccacagccagagga

SEQ ID NO: 4519273 - DNA, 14 bp, Homo sapiens
gagacctcagccat

SEQ ID NO: 4519274 - DNA, 20 bp, Homo sapiens
gagacctcatcctgctcttt

SEQ ID NO: 4519275 - DNA, 21 bp, Homo sapiens
gagacctgaccagtcagatgg

SEQ ID NO: 4519276 - DNA, 13 bp, Homo sapiens
gagacctgctcag

SEQ ID NO: 4519277 - DNA, 17 bp, Homo sapiens
gagacctgctcaggcgt

SEQ ID NO: 4519278 - DNA, 13 bp, Homo sapiens
gagaccttacccc

SEQ ID NO: 4519279 - DNA, 20 bp, Homo sapiens
gagacgccactccctgggac

SEQ ID NO: 4519280 - DNA, 21 bp, Homo sapiens
gagacgccctatttctatgtc

SEQ ID NO: 4519281 - DNA, 16 bp, Homo sapiens
gagacgggccctggtg

SEQ ID NO: 4519282 - DNA, 19 bp, Homo sapiens
gagacgtggtgggactcca

SEQ ID NO: 4519283 - DNA, 15 bp, Homo sapiens
gagactatggcctcg

SEQ ID NO: 4519284 - DNA, 15 bp, Homo sapiens
gagactcacctctgc

SEQ ID NO: 4519285 - DNA, 19 bp, Homo sapiens
gagactcacctctgcctca

SEQ ID NO: 4519286 - DNA, 20 bp, Homo sapiens
gagactcacctctgcctcaa

SEQ ID NO: 4519287 - DNA, 13 bp, Homo sapiens
gagactcagatga

SEQ ID NO: 4519288 - DNA, 14 bp, Homo sapiens
gagactcagcctct

SEQ ID NO: 4519289 - DNA, 18 bp, Homo sapiens
gagactcagcctctgctg

SEQ ID NO: 4519290 - DNA, 19 bp, Homo sapiens
gagactcagcctctgctgg

SEQ ID NO: 4519291 - DNA, 20 bp, Homo sapiens
gagactcagcctctgctgga

SEQ ID NO: 4519292 - DNA, 23 bp, Homo sapiens
gagactcagcctctgctggagaa

SEQ ID NO: 4519293 - DNA, 14 bp, Homo sapiens
gagactccatcttg

SEQ ID NO: 4519294 - DNA, 16 bp, Homo sapiens
gagactcccatgaagc

SEQ ID NO: 4519295 - DNA, 18 bp, Homo sapiens
gagactcccatgaagcct

SEQ ID NO: 4519296 - DNA, 20 bp, Homo sapiens
gagactcccatgaagccttt

SEQ ID NO: 4519297 - DNA, 15 bp, Homo sapiens
gagactcctggtctg

SEQ ID NO: 4519298 - DNA, 14 bp, Homo sapiens
gagactgggaaggc

SEQ ID NO: 4519299 - DNA, 17 bp, Homo sapiens
gagactgggaaggcttg

SEQ ID NO: 4519300 - DNA, 13 bp, Homo sapiens
gagactgggctga

SEQ ID NO: 4519301 - DNA, 14 bp, Homo sapiens
gagactgggctgag

SEQ ID NO: 4519302 - DNA, 20 bp, Homo sapiens
gagactgggctgagggagcc

SEQ ID NO: 4519303 - DNA, 21 bp, Homo sapiens
gagactgggctgagggagcct

SEQ ID NO: 4519304 - DNA, 13 bp, Homo sapiens
gagactgtacata

SEQ ID NO: 4519305 - DNA, 16 bp, Homo sapiens
gagactgtacataatt

SEQ ID NO: 4519306 - DNA, 21 bp, Homo sapiens
gagacttgtgctcaaggaatc

SEQ ID NO: 4519307 - DNA, 20 bp, Homo sapiens
gagactttctttctgtaggt

SEQ ID NO: 4519308 - DNA, 17 bp, Homo sapiens
gagactttgctgttact

SEQ ID NO: 4519309 - DNA, 20 bp, Homo sapiens
gagactttgctgttactgct

SEQ ID NO: 4519310 - DNA, 19 bp, Homo sapiens
gagactttttggtggatgt

SEQ ID NO: 4519311 - DNA, 13 bp, Homo sapiens
gagagaagctgat

SEQ ID NO: 4519312 - DNA, 15 bp, Homo sapiens
gagagaatgagcaga

SEQ ID NO: 4519313 - DNA, 21 bp, Homo sapiens
gagagacaggcagcccagcag

SEQ ID NO: 4519314 - DNA, 16 bp, Homo sapiens
gagagaccacacattt

SEQ ID NO: 4519315 - DNA, 14 bp, Homo sapiens
gagagacccaagga

SEQ ID NO: 4519316 - DNA, 15 bp, Homo sapiens
gagagacccaaggag

SEQ ID NO: 4519317 - DNA, 19 bp, Homo sapiens
gagagacccaaggaggaaa

SEQ ID NO: 4519318 - DNA, 15 bp, Homo sapiens
gagagacctgctcag

SEQ ID NO: 4519319 - DNA, 17 bp, Homo sapiens
gagagacctgctcaggc

SEQ ID NO: 4519320 - DNA, 19 bp, Homo sapiens
gagagactcccatgaagcc

SEQ ID NO: 4519321 - DNA, 15 bp, Homo sapiens
gagagactgagcagc

SEQ ID NO: 4519322 - DNA, 17 bp, Homo sapiens
gagagactgagcagccg

SEQ ID NO: 4519323 - DNA, 11 bp, Homo sapiens
gagagagaaag

SEQ ID NO: 4519324 - DNA, 13 bp, Homo sapiens
gagagagagagga

SEQ ID NO: 4519325 - DNA, 15 bp, Homo sapiens
gagagatcaaagatg

SEQ ID NO: 4519326 - DNA, 22 bp, Homo sapiens
gagagatgagaaagcttttatt

SEQ ID NO: 4519327 - DNA, 20 bp, Homo sapiens
gagagcaaaggagaaatctg

SEQ ID NO: 4519328 - DNA, 15 bp, Homo sapiens
gagagcaagaaggaa

SEQ ID NO: 4519329 - DNA, 22 bp, Homo sapiens
gagagcactagaagtggtttcc

SEQ ID NO: 4519330 - DNA, 14 bp, Homo sapiens
gagagcagcagcac

SEQ ID NO: 4519331 - DNA, 17 bp, Homo sapiens
gagagcagcagcaccaa

SEQ ID NO: 4519332 - DNA, 21 bp, Homo sapiens
gagagcagctccctttctcag

SEQ ID NO: 4519333 - DNA, 22 bp, Homo sapiens
gagagcagctccctttctcagg

SEQ ID NO: 4519334 - DNA, 12 bp, Homo sapiens
gagagccagccc

SEQ ID NO: 4519335 - DNA, 19 bp, Homo sapiens
gagagccctgaggcctaga

SEQ ID NO: 4519336 - DNA, 16 bp, Homo sapiens
gagagccctgctgtgg

SEQ ID NO: 4519337 - DNA, 19 bp, Homo sapiens
gagagcccttcccagggca

SEQ ID NO: 4519338 - DNA, 19 bp, Homo sapiens
gagagccggccgtggaagg

SEQ ID NO: 4519339 - DNA, 23 bp, Homo sapiens
gagagcctgctcccccaccccct

SEQ ID NO: 4519340 - DNA, 17 bp, Homo sapiens
gagagctagaacctaga

SEQ ID NO: 4519341 - DNA, 13 bp, Homo sapiens
gagagctggtgcc

SEQ ID NO: 4519342 - DNA, 22 bp, Homo sapiens
gagaggaacgggcagcctgggc

SEQ ID NO: 4519343 - DNA, 18 bp, Homo sapiens
gagaggacagcttgagcc

SEQ ID NO: 4519344 - DNA, 18 bp, Homo sapiens
gagaggaccaacatccag

SEQ ID NO: 4519345 - DNA, 16 bp, Homo sapiens
gagaggatacatttaa

SEQ ID NO: 4519346 - DNA, 20 bp, Homo sapiens
gagaggatacatttaataaa

SEQ ID NO: 4519347 - DNA, 21 bp, Homo sapiens
gagaggatacatttaataaaa

SEQ ID NO: 4519348 - DNA, 18 bp, Homo sapiens
gagaggcactcagtgagc

SEQ ID NO: 4519349 - DNA, 22 bp, Homo sapiens
gagaggcactcagtgagcctcc

SEQ ID NO: 4519350 - DNA, 13 bp, Homo sapiens
gagaggcggcctc

SEQ ID NO: 4519351 - DNA, 15 bp, Homo sapiens
gagaggcggcctcgt

SEQ ID NO: 4519352 - DNA, 13 bp, Homo sapiens
gagagggtctgga

SEQ ID NO: 4519353 - DNA, 18 bp, Homo sapiens
gagagggtctggagaagc

SEQ ID NO: 4519354 - DNA, 21 bp, Homo sapiens
gagagtagccgagagcctgct

SEQ ID NO: 4519355 - DNA, 15 bp, Homo sapiens
gagagtgaacaaatt

SEQ ID NO: 4519356 - DNA, 18 bp, Homo sapiens
gagagtgcacatgcccct

SEQ ID NO: 4519357 - DNA, 13 bp, Homo sapiens
gagagtgcactgc

SEQ ID NO: 4519358 - DNA, 21 bp, Homo sapiens
gagagttaataggagtatttt

SEQ ID NO: 4519359 - DNA, 17 bp, Homo sapiens
gagagtttttaatagaa

SEQ ID NO: 4519360 - DNA, 15 bp, Homo sapiens
gagatagttttcatt

SEQ ID NO: 4519361 - DNA, 21 bp, Homo sapiens
gagatattattttaaatttct

SEQ ID NO: 4519362 - DNA, 17 bp, Homo sapiens
gagatattttgtaaaat

SEQ ID NO: 4519363 - DNA, 20 bp, Homo sapiens
gagatcaaagatgaaaagta

SEQ ID NO: 4519364 - DNA, 22 bp, Homo sapiens
gagatcacgccattgtactcca

SEQ ID NO: 4519365 - DNA, 18 bp, Homo sapiens
gagatcccaacactgcca

SEQ ID NO: 4519366 - DNA, 20 bp, Homo sapiens
gagatccctgcagaacccac

SEQ ID NO: 4519367 - DNA, 13 bp, Homo sapiens
gagatcctggact

SEQ ID NO: 4519368 - DNA, 19 bp, Homo sapiens
gagatcgagaccatcctgg

SEQ ID NO: 4519369 - DNA, 21 bp, Homo sapiens
gagatcgagaccatcctggct

SEQ ID NO: 4519370 - DNA, 21 bp, Homo sapiens
gagatcgtgctactgcactcc

SEQ ID NO: 4519371 - DNA, 16 bp, Homo sapiens
gagatctacacatgtt

SEQ ID NO: 4519372 - DNA, 17 bp, Homo sapiens
gagatctacacatgttg

SEQ ID NO: 4519373 - DNA, 23 bp, Homo sapiens
gagatctcccttctcatctcccc

SEQ ID NO: 4519374 - DNA, 18 bp, Homo sapiens
gagatctgctgtcctgtt

SEQ ID NO: 4519375 - DNA, 15 bp, Homo sapiens
gagatcttcctgctg

SEQ ID NO: 4519376 - DNA, 17 bp, Homo sapiens
gagatctttctttccaa

SEQ ID NO: 4519377 - DNA, 22 bp, Homo sapiens
gagatctttctttccaaaacat

SEQ ID NO: 4519378 - DNA, 14 bp, Homo sapiens
gagatgagaaatga

SEQ ID NO: 4519379 - DNA, 18 bp, Homo sapiens
gagatgagaaatgatgaa

SEQ ID NO: 4519380 - DNA, 22 bp, Homo sapiens
gagatgagaaatgatgaaaagg

SEQ ID NO: 4519381 - DNA, 19 bp, Homo sapiens
gagatgaggagtaaaattc

SEQ ID NO: 4519382 - DNA, 16 bp, Homo sapiens
gagatgagtgggcttc

SEQ ID NO: 4519383 - DNA, 20 bp, Homo sapiens
gagatgcagctactggaatg

SEQ ID NO: 4519384 - DNA, 15 bp, Homo sapiens
gagatgcctccaccg

SEQ ID NO: 4519385 - DNA, 20 bp, Homo sapiens
gagatgcttctctccttgcc

SEQ ID NO: 4519386 - DNA, 21 bp, Homo sapiens
gagatgcttggagcaatcaga

SEQ ID NO: 4519387 - DNA, 21 bp, Homo sapiens
gagatgggaatgaggtgggag

SEQ ID NO: 4519388 - DNA, 17 bp, Homo sapiens
gagatgtgtatcagtgt

SEQ ID NO: 4519389 - DNA, 14 bp, Homo sapiens
gagattcaatattg

SEQ ID NO: 4519390 - DNA, 22 bp, Homo sapiens
gagattgaatttcactgtcttt

SEQ ID NO: 4519391 - DNA, 13 bp, Homo sapiens
gagattgcactgc

SEQ ID NO: 4519392 - DNA, 22 bp, Homo sapiens
gagatttaacccctccactgct

SEQ ID NO: 4519393 - DNA, 15 bp, Homo sapiens
gagatttactgctct

SEQ ID NO: 4519394 - DNA, 19 bp, Homo sapiens
gagatttcatctgctctcc

SEQ ID NO: 4519395 - DNA, 14 bp, Homo sapiens
gagatttcttattt

SEQ ID NO: 4519396 - DNA, 17 bp, Homo sapiens
gagattttttttccgtg

SEQ ID NO: 4519397 - DNA, 20 bp, Homo sapiens
gagattttttttccgtgtgt

SEQ ID NO: 4519398 - DNA, 20 bp, Homo sapiens
gagcaaaactccgtctcaaa

SEQ ID NO: 4519399 - DNA, 17 bp, Homo sapiens
gagcaaaataatgcaac

SEQ ID NO: 4519400 - DNA, 13 bp, Homo sapiens
gagcaaaatcaac

SEQ ID NO: 4519401 - DNA, 20 bp, Homo sapiens
gagcaaaatcaacatgactg

SEQ ID NO: 4519402 - DNA, 21 bp, Homo sapiens
gagcaaacctaacaggagaaa

SEQ ID NO: 4519403 - DNA, 14 bp, Homo sapiens
gagcaagaaggaaa

SEQ ID NO: 4519404 - DNA, 12 bp, Homo sapiens
gagcaagcctag

SEQ ID NO: 4519405 - DNA, 18 bp, Homo sapiens
gagcaatcagaacttcag

SEQ ID NO: 4519406 - DNA, 23 bp, Homo sapiens
gagcaatcagaacttcaggtgtg

SEQ ID NO: 4519407 - DNA, 16 bp, Homo sapiens
gagcacaaaattcaaa

SEQ ID NO: 4519408 - DNA, 21 bp, Homo sapiens
gagcacaaaattcaaagcatg

SEQ ID NO: 4519409 - DNA, 18 bp, Homo sapiens
gagcacatctctctgccc

SEQ ID NO: 4519410 - DNA, 15 bp, Homo sapiens
gagcaccaggcacga

SEQ ID NO: 4519411 - DNA, 14 bp, Homo sapiens
gagcacccagagca

SEQ ID NO: 4519412 - DNA, 17 bp, Homo sapiens
gagcaccccctgctcca

SEQ ID NO: 4519413 - DNA, 23 bp, Homo sapiens
gagcaccgtgtcgggcaggtcag

SEQ ID NO: 4519414 - DNA, 13 bp, Homo sapiens
gagcacggactct

SEQ ID NO: 4519415 - DNA, 21 bp, Homo sapiens
gagcacggtcccccaggaggc

SEQ ID NO: 4519416 - DNA, 22 bp, Homo sapiens
gagcacgtggagatagtgccag

SEQ ID NO: 4519417 - DNA, 19 bp, Homo sapiens
gagcactcctggtgcaggt

SEQ ID NO: 4519418 - DNA, 23 bp, Homo sapiens
gagcactggtgtgaactcaccct

SEQ ID NO: 4519419 - DNA, 23 bp, Homo sapiens
gagcagaaggaaggatgccactt

SEQ ID NO: 4519420 - DNA, 24 bp, Homo sapiens
gagcagagacatgactcagcctgt

SEQ ID NO: 4519421 - DNA, 14 bp, Homo sapiens
gagcagaggtctcc

SEQ ID NO: 4519422 - DNA, 14 bp, Homo sapiens
gagcagcagcacca

SEQ ID NO: 4519423 - DNA, 17 bp, Homo sapiens
gagcagcagcttgggga

SEQ ID NO: 4519424 - DNA, 15 bp, Homo sapiens
gagcagccctggccc

SEQ ID NO: 4519425 - DNA, 21 bp, Homo sapiens
gagcagccgccagctgggagc

SEQ ID NO: 4519426 - DNA, 11 bp, Homo sapiens
gagcagcctgt

SEQ ID NO: 4519427 - DNA, 14 bp, Homo sapiens
gagcagcctgtggc

SEQ ID NO: 4519428 - DNA, 18 bp, Homo sapiens
gagcagcctgtggcatct

SEQ ID NO: 4519429 - DNA, 12 bp, Homo sapiens
gagcagctccct

SEQ ID NO: 4519430 - DNA, 15 bp, Homo sapiens
gagcaggactccagg

SEQ ID NO: 4519431 - DNA, 14 bp, Homo sapiens
gagcaggggaagca

SEQ ID NO: 4519432 - DNA, 20 bp, Homo sapiens
gagcaggggaagcaggaccc

SEQ ID NO: 4519433 - DNA, 18 bp, Homo sapiens
gagcaggggtctgagcca

SEQ ID NO: 4519434 - DNA, 12 bp, Homo sapiens
gagcagggtcct

SEQ ID NO: 4519435 - DNA, 16 bp, Homo sapiens
gagcagtccatgcatg

SEQ ID NO: 4519436 - DNA, 19 bp, Homo sapiens
gagcagtcgcctgcctgca

SEQ ID NO: 4519437 - DNA, 16 bp, Homo sapiens
gagcataaaacctaaa

SEQ ID NO: 4519438 - DNA, 15 bp, Homo sapiens
gagcatcaatcttgt

SEQ ID NO: 4519439 - DNA, 17 bp, Homo sapiens
gagcatccagacctgag

SEQ ID NO: 4519440 - DNA, 18 bp, Homo sapiens
gagcatctgccccaggta

SEQ ID NO: 4519441 - DNA, 15 bp, Homo sapiens
gagcatgcacactga

SEQ ID NO: 4519442 - DNA, 16 bp, Homo sapiens
gagcatgcacatgctg

SEQ ID NO: 4519443 - DNA, 12 bp, Homo sapiens
gagcatggatgc

SEQ ID NO: 4519444 - DNA, 18 bp, Homo sapiens
gagcatggatgcatttca

SEQ ID NO: 4519445 - DNA, 20 bp, Homo sapiens
gagcatggatgcatttcaaa

SEQ ID NO: 4519446 - DNA, 21 bp, Homo sapiens
gagcatggatgcatttcaaat

SEQ ID NO: 4519447 - DNA, 13 bp, Homo sapiens
gagcatggggcca

SEQ ID NO: 4519448 - DNA, 18 bp, Homo sapiens
gagcattaactaaatgct

SEQ ID NO: 4519449 - DNA, 20 bp, Homo sapiens
gagcattagaatggaggaaa

SEQ ID NO: 4519450 - DNA, 20 bp, Homo sapiens
gagcattcaggcagcactga

SEQ ID NO: 4519451 - DNA, 22 bp, Homo sapiens
gagcatttaatggcagctagtg

SEQ ID NO: 4519452 - DNA, 12 bp, Homo sapiens
gagccaaggagg

SEQ ID NO: 4519453 - DNA, 15 bp, Homo sapiens
gagccacaagctgca

SEQ ID NO: 4519454 - DNA, 17 bp, Homo sapiens
gagccacaagctgcact

SEQ ID NO: 4519455 - DNA, 18 bp, Homo sapiens
gagccacaagctgcactg

SEQ ID NO: 4519456 - DNA, 14 bp, Homo sapiens
gagccacagcagca

SEQ ID NO: 4519457 - DNA, 21 bp, Homo sapiens
gagccaccgtgcctggccaga

SEQ ID NO: 4519458 - DNA, 13 bp, Homo sapiens
gagccacctgcaa

SEQ ID NO: 4519459 - DNA, 14 bp, Homo sapiens
gagccacctgcaag

SEQ ID NO: 4519460 - DNA, 20 bp, Homo sapiens
gagccacctgcaagatggac

SEQ ID NO: 4519461 - DNA, 13 bp, Homo sapiens
gagccacctgccc

SEQ ID NO: 4519462 - DNA, 14 bp, Homo sapiens
gagccactcctctg

SEQ ID NO: 4519463 - DNA, 16 bp, Homo sapiens
gagccagaacctggag

SEQ ID NO: 4519464 - DNA, 14 bp, Homo sapiens
gagccagcagggca

SEQ ID NO: 4519465 - DNA, 13 bp, Homo sapiens
gagccagccctcc

SEQ ID NO: 4519466 - DNA, 14 bp, Homo sapiens
gagccagccctccc

SEQ ID NO: 4519467 - DNA, 20 bp, Homo sapiens
gagccagccctccctgtcct

SEQ ID NO: 4519468 - DNA, 11 bp, Homo sapiens
gagccagcctg

SEQ ID NO: 4519469 - DNA, 13 bp, Homo sapiens
gagccagcctggc

SEQ ID NO: 4519470 - DNA, 12 bp, Homo sapiens
gagccaggcaca

SEQ ID NO: 4519471 - DNA, 11 bp, Homo sapiens
gagccagggca

SEQ ID NO: 4519472 - DNA, 11 bp, Homo sapiens
gagccataatg

SEQ ID NO: 4519473 - DNA, 20 bp, Homo sapiens
gagccatgatttcccactgc

SEQ ID NO: 4519474 - DNA, 17 bp, Homo sapiens
gagccatttgtcccaag

SEQ ID NO: 4519475 - DNA, 14 bp, Homo sapiens
gagcccagaggagg

SEQ ID NO: 4519476 - DNA, 16 bp, Homo sapiens
gagcccagcccaggag

SEQ ID NO: 4519477 - DNA, 13 bp, Homo sapiens
gagcccagcctgg

SEQ ID NO: 4519478 - DNA, 17 bp, Homo sapiens
gagcccagcctgggagc

SEQ ID NO: 4519479 - DNA, 21 bp, Homo sapiens
gagcccagctctgaaaccagt

SEQ ID NO: 4519480 - DNA, 13 bp, Homo sapiens
gagccccaagcag

SEQ ID NO: 4519481 - DNA, 13 bp, Homo sapiens
gagccccagggtc

SEQ ID NO: 4519482 - DNA, 18 bp, Homo sapiens
gagccccattcctgggaa

SEQ ID NO: 4519483 - DNA, 15 bp, Homo sapiens
gagcccccagcagag

SEQ ID NO: 4519484 - DNA, 23 bp, Homo sapiens
gagcccccagcagaggcaggctg

SEQ ID NO: 4519485 - DNA, 23 bp, Homo sapiens
gagcccccctagcaatacaggga

SEQ ID NO: 4519486 - DNA, 14 bp, Homo sapiens
gagccccctctgcc

SEQ ID NO: 4519487 - DNA, 13 bp, Homo sapiens
gagcccctcccca

SEQ ID NO: 4519488 - DNA, 18 bp, Homo sapiens
gagcccctccccagccag

SEQ ID NO: 4519489 - DNA, 17 bp, Homo sapiens
gagccctcctgagggcc

SEQ ID NO: 4519490 - DNA, 18 bp, Homo sapiens
gagccctgactcctggac

SEQ ID NO: 4519491 - DNA, 15 bp, Homo sapiens
gagccctgctgtggg

SEQ ID NO: 4519492 - DNA, 16 bp, Homo sapiens
gagccctgctgtggga

SEQ ID NO: 4519493 - DNA, 20 bp, Homo sapiens
gagccctgggttccggttgt

SEQ ID NO: 4519494 - DNA, 21 bp, Homo sapiens
gagcccttctatacccaccca

SEQ ID NO: 4519495 - DNA, 23 bp, Homo sapiens
gagcccttctatacccacccaga

SEQ ID NO: 4519496 - DNA, 17 bp, Homo sapiens
gagcccttgcctcccca

SEQ ID NO: 4519497 - DNA, 14 bp, Homo sapiens
gagccgcagagcct

SEQ ID NO: 4519498 - DNA, 21 bp, Homo sapiens
gagccgcatcttctccatctg

SEQ ID NO: 4519499 - DNA, 22 bp, Homo sapiens
gagccgcatcttctccatctgg

SEQ ID NO: 4519500 - DNA, 16 bp, Homo sapiens
gagccggccccaggct

SEQ ID NO: 4519501 - DNA, 23 bp, Homo sapiens
gagccggccccaggctcgtggac

SEQ ID NO: 4519502 - DNA, 15 bp, Homo sapiens
gagccggccgtggaa

SEQ ID NO: 4519503 - DNA, 22 bp, Homo sapiens
gagccgggtctgcctcttctgg

SEQ ID NO: 4519504 - DNA, 16 bp, Homo sapiens
gagccggtggtgcccg

SEQ ID NO: 4519505 - DNA, 13 bp, Homo sapiens
gagccgtggtcct

SEQ ID NO: 4519506 - DNA, 21 bp, Homo sapiens
gagcctagcggagcccagcct

SEQ ID NO: 4519507 - DNA, 15 bp, Homo sapiens
gagcctagctcctgc

SEQ ID NO: 4519508 - DNA, 19 bp, Homo sapiens
gagcctcatccagcctcag

SEQ ID NO: 4519509 - DNA, 22 bp, Homo sapiens
gagcctcccaaggagaacaaat

SEQ ID NO: 4519510 - DNA, 21 bp, Homo sapiens
gagcctcccaccagagccggg

SEQ ID NO: 4519511 - DNA, 15 bp, Homo sapiens
gagcctccccctcag

SEQ ID NO: 4519512 - DNA, 17 bp, Homo sapiens
gagcctccccctcagat

SEQ ID NO: 4519513 - DNA, 14 bp, Homo sapiens
gagcctctggcccc

SEQ ID NO: 4519514 - DNA, 17 bp, Homo sapiens
gagcctgaactgagccc

SEQ ID NO: 4519515 - DNA, 19 bp, Homo sapiens
gagcctgaactgagcccca

SEQ ID NO: 4519516 - DNA, 21 bp, Homo sapiens
gagcctgaccctcatctttct

SEQ ID NO: 4519517 - DNA, 10 bp, Homo sapiens
gagcctgagg

SEQ ID NO: 4519518 - DNA, 15 bp, Homo sapiens
gagcctgagggatct

SEQ ID NO: 4519519 - DNA, 13 bp, Homo sapiens
gagcctgcctgga

SEQ ID NO: 4519520 - DNA, 16 bp, Homo sapiens
gagcctgcctggagcg

SEQ ID NO: 4519521 - DNA, 17 bp, Homo sapiens
gagcctgctcccccacc

SEQ ID NO: 4519522 - DNA, 18 bp, Homo sapiens
gagcctgctctccgcgcc

SEQ ID NO: 4519523 - DNA, 23 bp, Homo sapiens
gagcctgctggtcacagcctcct

SEQ ID NO: 4519524 - DNA, 20 bp, Homo sapiens
gagcctgtggccagcagccc

SEQ ID NO: 4519525 - DNA, 23 bp, Homo sapiens
gagcctgtggccagcagccccca

SEQ ID NO: 4519526 - DNA, 14 bp, Homo sapiens
gagccttcaagtgc

SEQ ID NO: 4519527 - DNA, 22 bp, Homo sapiens
gagccttcagaatgctcctgag

SEQ ID NO: 4519528 - DNA, 17 bp, Homo sapiens
gagccttctcagaagca

SEQ ID NO: 4519529 - DNA, 13 bp, Homo sapiens
gagccttctgcca

SEQ ID NO: 4519530 - DNA, 12 bp, Homo sapiens
gagccttttgct

SEQ ID NO: 4519531 - DNA, 18 bp, Homo sapiens
gagccttttgctctctgt

SEQ ID NO: 4519532 - DNA, 21 bp, Homo sapiens
gagcgaagggggtcaaaggaa

SEQ ID NO: 4519533 - DNA, 15 bp, Homo sapiens
gagcgacagtgagac

SEQ ID NO: 4519534 - DNA, 19 bp, Homo sapiens
gagcgagagatcaaagatg

SEQ ID NO: 4519535 - DNA, 23 bp, Homo sapiens
gagcgagagggaggcaggtggac

SEQ ID NO: 4519536 - DNA, 18 bp, Homo sapiens
gagcgagcaagccggcaa

SEQ ID NO: 4519537 - DNA, 21 bp, Homo sapiens
gagcgaggagatgctccttgg

SEQ ID NO: 4519538 - DNA, 21 bp, Homo sapiens
gagcgcccccgagccctgact

SEQ ID NO: 4519539 - DNA, 22 bp, Homo sapiens
gagcgctcctgccgcagagctg

SEQ ID NO: 4519540 - DNA, 12 bp, Homo sapiens
gagcgtccttgg

SEQ ID NO: 4519541 - DNA, 14 bp, Homo sapiens
gagctagaacctgg

SEQ ID NO: 4519542 - DNA, 17 bp, Homo sapiens
gagctagaacctggagg

SEQ ID NO: 4519543 - DNA, 13 bp, Homo sapiens
gagctagagaaat

SEQ ID NO: 4519544 - DNA, 18 bp, Homo sapiens
gagctagcgctgccgcac

SEQ ID NO: 4519545 - DNA, 19 bp, Homo sapiens
gagctagcgctgccgcacc

SEQ ID NO: 4519546 - DNA, 22 bp, Homo sapiens
gagctattaaaactcagcctgg

SEQ ID NO: 4519547 - DNA, 13 bp, Homo sapiens
gagctattgctgt

SEQ ID NO: 4519548 - DNA, 17 bp, Homo sapiens
gagctattttagaaagc

SEQ ID NO: 4519549 - DNA, 19 bp, Homo sapiens
gagctattttagaaagcta

SEQ ID NO: 4519550 - DNA, 19 bp, Homo sapiens
gagctcacatgggactggg

SEQ ID NO: 4519551 - DNA, 20 bp, Homo sapiens
gagctcagacccccactctc

SEQ ID NO: 4519552 - DNA, 20 bp, Homo sapiens
gagctcccccgtggtgcctg

SEQ ID NO: 4519553 - DNA, 21 bp, Homo sapiens
gagctcccccgtggtgcctgc

SEQ ID NO: 4519554 - DNA, 15 bp, Homo sapiens
gagctcctccctcca

SEQ ID NO: 4519555 - DNA, 20 bp, Homo sapiens
gagctcctccctccagctgc

SEQ ID NO: 4519556 - DNA, 18 bp, Homo sapiens
gagctcctctcctggagg

SEQ ID NO: 4519557 - DNA, 21 bp, Homo sapiens
gagctcctgggacccttggct

SEQ ID NO: 4519558 - DNA, 17 bp, Homo sapiens
gagctcctggggagctc

SEQ ID NO: 4519559 - DNA, 22 bp, Homo sapiens
gagctcctggggagctcctggg

SEQ ID NO: 4519560 - DNA, 15 bp, Homo sapiens
gagctcggggacagg

SEQ ID NO: 4519561 - DNA, 17 bp, Homo sapiens
gagctcggggacaggtg

SEQ ID NO: 4519562 - DNA, 14 bp, Homo sapiens
gagctctcaggccg

SEQ ID NO: 4519563 - DNA, 20 bp, Homo sapiens
gagctctcaggccgagagcc

SEQ ID NO: 4519564 - DNA, 17 bp, Homo sapiens
gagctctgtatggtcag

SEQ ID NO: 4519565 - DNA, 17 bp, Homo sapiens
gagctcttcaggcctcc

SEQ ID NO: 4519566 - DNA, 19 bp, Homo sapiens
gagctcttcaggcctccct

SEQ ID NO: 4519567 - DNA, 13 bp, Homo sapiens
gagctcttccctt

SEQ ID NO: 4519568 - DNA, 12 bp, Homo sapiens
gagctcttggcc

SEQ ID NO: 4519569 - DNA, 22 bp, Homo sapiens
gagctcttggcccggcagggcc

SEQ ID NO: 4519570 - DNA, 21 bp, Homo sapiens
gagctcttgggtcagagaaaa

SEQ ID NO: 4519571 - DNA, 16 bp, Homo sapiens
gagctgactggtttct

SEQ ID NO: 4519572 - DNA, 16 bp, Homo sapiens
gagctgaggcagcagt

SEQ ID NO: 4519573 - DNA, 16 bp, Homo sapiens
gagctgatcgcttctc

SEQ ID NO: 4519574 - DNA, 21 bp, Homo sapiens
gagctgatcgcttctccccca

SEQ ID NO: 4519575 - DNA, 13 bp, Homo sapiens
gagctgcagcccc

SEQ ID NO: 4519576 - DNA, 19 bp, Homo sapiens
gagctgcagccccccagag

SEQ ID NO: 4519577 - DNA, 13 bp, Homo sapiens
gagctgccttccc

SEQ ID NO: 4519578 - DNA, 14 bp, Homo sapiens
gagctgccttccct

SEQ ID NO: 4519579 - DNA, 19 bp, Homo sapiens
gagctgccttccctagctt

SEQ ID NO: 4519580 - DNA, 14 bp, Homo sapiens
gagctggagccccc

SEQ ID NO: 4519581 - DNA, 19 bp, Homo sapiens
gagctggagcccccagcag

SEQ ID NO: 4519582 - DNA, 23 bp, Homo sapiens
gagctggccgcgccaaataatgt

SEQ ID NO: 4519583 - DNA, 16 bp, Homo sapiens
gagctggcgctcagca

SEQ ID NO: 4519584 - DNA, 19 bp, Homo sapiens
gagctgggcccctgcacag

SEQ ID NO: 4519585 - DNA, 20 bp, Homo sapiens
gagctgggccctgcctgcag

SEQ ID NO: 4519586 - DNA, 18 bp, Homo sapiens
gagctggggactcaggga

SEQ ID NO: 4519587 - DNA, 17 bp, Homo sapiens
gagctggtagaggggag

SEQ ID NO: 4519588 - DNA, 16 bp, Homo sapiens
gagctggtgcccggag

SEQ ID NO: 4519589 - DNA, 21 bp, Homo sapiens
gagctggtgcccggagattgg

SEQ ID NO: 4519590 - DNA, 23 bp, Homo sapiens
gagctgtaatttcgccttaaact

SEQ ID NO: 4519591 - DNA, 18 bp, Homo sapiens
gagctgtattaagccact

SEQ ID NO: 4519592 - DNA, 14 bp, Homo sapiens
gagctgtcatcact

SEQ ID NO: 4519593 - DNA, 18 bp, Homo sapiens
gagctgtccggctggtgg

SEQ ID NO: 4519594 - DNA, 18 bp, Homo sapiens
gagctgtgcaggtgggga

SEQ ID NO: 4519595 - DNA, 17 bp, Homo sapiens
gagctgtgcgctgctct

SEQ ID NO: 4519596 - DNA, 19 bp, Homo sapiens
gagctgtgttcacagacct

SEQ ID NO: 4519597 - DNA, 17 bp, Homo sapiens
gagctgttcacagccag

SEQ ID NO: 4519598 - DNA, 17 bp, Homo sapiens
gagctgtttactaggga

SEQ ID NO: 4519599 - DNA, 18 bp, Homo sapiens
gagctgtttatggcctca

SEQ ID NO: 4519600 - DNA, 15 bp, Homo sapiens
gagctgtttatgttt

SEQ ID NO: 4519601 - DNA, 22 bp, Homo sapiens
gagcttaatctttgaaaggtta

SEQ ID NO: 4519602 - DNA, 20 bp, Homo sapiens
gagcttcaatataagaagca

SEQ ID NO: 4519603 - DNA, 22 bp, Homo sapiens
gagcttcccttcctaaaggtaa

SEQ ID NO: 4519604 - DNA, 17 bp, Homo sapiens
gagcttgggcagtgccc

SEQ ID NO: 4519605 - DNA, 20 bp, Homo sapiens
gagcttgggcagtgccccag

SEQ ID NO: 4519606 - DNA, 18 bp, Homo sapiens
gagcttgggtctctctcg

SEQ ID NO: 4519607 - DNA, 17 bp, Homo sapiens
gagctttgtcacttgcc

SEQ ID NO: 4519608 - DNA, 13 bp, Homo sapiens
gagcttttgatgc

SEQ ID NO: 4519609 - DNA, 19 bp, Homo sapiens
gagctttttaatagcacta

SEQ ID NO: 4519610 - DNA, 22 bp, Homo sapiens
gaggaaaacactatttccaaaa

SEQ ID NO: 4519611 - DNA, 23 bp, Homo sapiens
gaggaaaaggcccctgcaatgtg

SEQ ID NO: 4519612 - DNA, 14 bp, Homo sapiens
gaggaaaggatttt

SEQ ID NO: 4519613 - DNA, 14 bp, Homo sapiens
gaggaaagggctgg

SEQ ID NO: 4519614 - DNA, 22 bp, Homo sapiens
gaggaaatccggtcagccaagt

SEQ ID NO: 4519615 - DNA, 16 bp, Homo sapiens
gaggaactgtacagaa

SEQ ID NO: 4519616 - DNA, 19 bp, Homo sapiens
gaggaagaacggggctctt

SEQ ID NO: 4519617 - DNA, 23 bp, Homo sapiens
gaggaagagccacctgcaagatg

SEQ ID NO: 4519618 - DNA, 15 bp, Homo sapiens
gaggaagcaagacgt

SEQ ID NO: 4519619 - DNA, 17 bp, Homo sapiens
gaggaagttcagatctt

SEQ ID NO: 4519620 - DNA, 19 bp, Homo sapiens
gaggaatctgtgggtctgg

SEQ ID NO: 4519621 - DNA, 21 bp, Homo sapiens
gaggaatctgtgggtctggga

SEQ ID NO: 4519622 - DNA, 15 bp, Homo sapiens
gaggaatctgtttct

SEQ ID NO: 4519623 - DNA, 19 bp, Homo sapiens
gaggaatctgtttctctgc

SEQ ID NO: 4519624 - DNA, 21 bp, Homo sapiens
gaggacaaccatgcaaattgt

SEQ ID NO: 4519625 - DNA, 16 bp, Homo sapiens
gaggacagagggcaca

SEQ ID NO: 4519626 - DNA, 16 bp, Homo sapiens
gaggacaggcaggcca

SEQ ID NO: 4519627 - DNA, 19 bp, Homo sapiens
gaggaccaacatccagtcc

SEQ ID NO: 4519628 - DNA, 12 bp, Homo sapiens
gaggaccagagg

SEQ ID NO: 4519629 - DNA, 13 bp, Homo sapiens
gaggaccagagga

SEQ ID NO: 4519630 - DNA, 18 bp, Homo sapiens
gaggaccagaggagcaga

SEQ ID NO: 4519631 - DNA, 11 bp, Homo sapiens
gaggacccagg

SEQ ID NO: 4519632 - DNA, 20 bp, Homo sapiens
gaggaccctggaaatggact

SEQ ID NO: 4519633 - DNA, 20 bp, Homo sapiens
gaggaccgaggctacagctc

SEQ ID NO: 4519634 - DNA, 18 bp, Homo sapiens
gaggactagaacctggag

SEQ ID NO: 4519635 - DNA, 21 bp, Homo sapiens
gaggactctttccgactgccc

SEQ ID NO: 4519636 - DNA, 22 bp, Homo sapiens
gaggactctttccgactgccca

SEQ ID NO: 4519637 - DNA, 12 bp, Homo sapiens
gaggagaaactg

SEQ ID NO: 4519638 - DNA, 16 bp, Homo sapiens
gaggagaaactgagaa

SEQ ID NO: 4519639 - DNA, 15 bp, Homo sapiens
gaggagaaatgcaat

SEQ ID NO: 4519640 - DNA, 19 bp, Homo sapiens
gaggagaaatgcaataact

SEQ ID NO: 4519641 - DNA, 21 bp, Homo sapiens
gaggagaaatgcaataactct

SEQ ID NO: 4519642 - DNA, 22 bp, Homo sapiens
gagtccctccatgcaaaagtgg

SEQ ID NO: 4519643 - DNA, 16 bp, Homo sapiens
gagtccctgcctggac

SEQ ID NO: 4519644 - DNA, 13 bp, Homo sapiens
gagtcctgtctct

SEQ ID NO: 4519645 - DNA, 17 bp, Homo sapiens
gagtcctgtctctgcct

SEQ ID NO: 4519646 - DNA, 22 bp, Homo sapiens
gagtctcggcatagtccccaga

SEQ ID NO: 4519647 - DNA, 18 bp, Homo sapiens
gagtctctgatacacagt

SEQ ID NO: 4519648 - DNA, 18 bp, Homo sapiens
gagtctgagtctgagtcc

SEQ ID NO: 4519649 - DNA, 21 bp, Homo sapiens
gagtcttaactgtatttcagt

SEQ ID NO: 4519650 - DNA, 14 bp, Homo sapiens
gagtcttgtgaaag

SEQ ID NO: 4519651 - DNA, 19 bp, Homo sapiens
gagtgaacaaatttacaga

SEQ ID NO: 4519652 - DNA, 23 bp, Homo sapiens
gagtgaacaaatttacagagaca

SEQ ID NO: 4519653 - DNA, 18 bp, Homo sapiens
gagtgagaccctgtctca

SEQ ID NO: 4519654 - DNA, 19 bp, Homo sapiens
gagtgagatgtagaaagtt

SEQ ID NO: 4519655 - DNA, 18 bp, Homo sapiens
gagtgaggatgtctgggc

SEQ ID NO: 4519656 - DNA, 22 bp, Homo sapiens
gagtgatacaacttcaagtgca

SEQ ID NO: 4519657 - DNA, 13 bp, Homo sapiens
gagtgcacatgcc

SEQ ID NO: 4519658 - DNA, 15 bp, Homo sapiens
gagtgcagacaccta

SEQ ID NO: 4519659 - DNA, 16 bp, Homo sapiens
gagtgcagccttctcc

SEQ ID NO: 4519660 - DNA, 14 bp, Homo sapiens
gagtgcagtcctga

SEQ ID NO: 4519661 - DNA, 22 bp, Homo sapiens
gagtgcagtcctgatcagagcc

SEQ ID NO: 4519662 - DNA, 13 bp, Homo sapiens
gagtgctggactg

SEQ ID NO: 4519663 - DNA, 19 bp, Homo sapiens
gagtgctggactgttccag

SEQ ID NO: 4519664 - DNA, 18 bp, Homo sapiens
gagtgcttgttagagaga

SEQ ID NO: 4519665 - DNA, 20 bp, Homo sapiens
gagtgcttgttagagagaaa

SEQ ID NO: 4519666 - DNA, 17 bp, Homo sapiens
gagtggaggaggcctgg

SEQ ID NO: 4519667 - DNA, 23 bp, Homo sapiens
gagtggagtctgagtctgagtcc

SEQ ID NO: 4519668 - DNA, 10 bp, Homo sapiens
gagtggcctg

SEQ ID NO: 4519669 - DNA, 14 bp, Homo sapiens
gagtggcctggcca

SEQ ID NO: 4519670 - DNA, 15 bp, Homo sapiens
gagtggcctggccag

SEQ ID NO: 4519671 - DNA, 20 bp, Homo sapiens
gagtggcctggccaggagct

SEQ ID NO: 4519672 - DNA, 13 bp, Homo sapiens
gagtggctttcta

SEQ ID NO: 4519673 - DNA, 12 bp, Homo sapiens
gagtgggaagcc

SEQ ID NO: 4519674 - DNA, 13 bp, Homo sapiens
gagtgggaagccc

SEQ ID NO: 4519675 - DNA, 21 bp, Homo sapiens
gagtgggaggcgtgcccccct

SEQ ID NO: 4519676 - DNA, 18 bp, Homo sapiens
gagtggggcctttgccag

SEQ ID NO: 4519677 - DNA, 22 bp, Homo sapiens
gagtggggcctttgccagcaga

SEQ ID NO: 4519678 - DNA, 13 bp, Homo sapiens
gagtggttaggca

SEQ ID NO: 4519679 - DNA, 19 bp, Homo sapiens
gagtggttaggcagcaagc

SEQ ID NO: 4519680 - DNA, 13 bp, Homo sapiens
gagtgtaactttc

SEQ ID NO: 4519681 - DNA, 13 bp, Homo sapiens
gagtgtacaagta

SEQ ID NO: 4519682 - DNA, 18 bp, Homo sapiens
gagtgtcctgcccatgcc

SEQ ID NO: 4519683 - DNA, 19 bp, Homo sapiens
gagtgtctttccacggagc

SEQ ID NO: 4519684 - DNA, 21 bp, Homo sapiens
gagtgtctttccacggagcca

SEQ ID NO: 4519685 - DNA, 18 bp, Homo sapiens
gagtgtgaatataaatgt

SEQ ID NO: 4519686 - DNA, 20 bp, Homo sapiens
gagtgtgaatataaatgtgt

SEQ ID NO: 4519687 - DNA, 12 bp, Homo sapiens
gagtgtgggaag

SEQ ID NO: 4519688 - DNA, 22 bp, Homo sapiens
gagtgtgtaatttaaaattgtg

SEQ ID NO: 4519689 - DNA, 17 bp, Homo sapiens
gagtgtgtgataaatca

SEQ ID NO: 4519690 - DNA, 14 bp, Homo sapiens
gagtgttatgtatt

SEQ ID NO: 4519691 - DNA, 15 bp, Homo sapiens
gagtgttcccgtgcc

SEQ ID NO: 4519692 - DNA, 17 bp, Homo sapiens
gagtgttcccgtgcctg

SEQ ID NO: 4519693 - DNA, 18 bp, Homo sapiens
gagtgttcccgtgcctgg

SEQ ID NO: 4519694 - DNA, 13 bp, Homo sapiens
gagttaaaatgca

SEQ ID NO: 4519695 - DNA, 16 bp, Homo sapiens
gagttacagttctgtg

SEQ ID NO: 4519696 - DNA, 18 bp, Homo sapiens
gagttacttagaatgcca

SEQ ID NO: 4519697 - DNA, 20 bp, Homo sapiens
gagttagaaccacagcagac

SEQ ID NO: 4519698 - DNA, 22 bp, Homo sapiens
gagttagcactgaactgctttt

SEQ ID NO: 4519699 - DNA, 19 bp, Homo sapiens
gagttatcatgaattttaa

SEQ ID NO: 4519700 - DNA, 18 bp, Homo sapiens
gagttatcttctttatta

SEQ ID NO: 4519701 - DNA, 20 bp, Homo sapiens
gagttatcttctttattatt

SEQ ID NO: 4519702 - DNA, 22 bp, Homo sapiens
gagttatcttctttattattcc

SEQ ID NO: 4519703 - DNA, 16 bp, Homo sapiens
gagttattcaaatgaa

SEQ ID NO: 4519704 - DNA, 14 bp, Homo sapiens
gagttcaaatactt

SEQ ID NO: 4519705 - DNA, 18 bp, Homo sapiens
gagttcaagaccagcctg

SEQ ID NO: 4519706 - DNA, 22 bp, Homo sapiens
gagttcaagactagcctggcca

SEQ ID NO: 4519707 - DNA, 15 bp, Homo sapiens
gagttccagaaagta

SEQ ID NO: 4519708 - DNA, 22 bp, Homo sapiens
gagttccctcagtactattcct

SEQ ID NO: 4519709 - DNA, 14 bp, Homo sapiens
gagttcctctgggt

SEQ ID NO: 4519710 - DNA, 20 bp, Homo sapiens
gagttctatggagactttgc

SEQ ID NO: 4519711 - DNA, 21 bp, Homo sapiens
gagttctgtgtattttcagtc

SEQ ID NO: 4519712 - DNA, 21 bp, Homo sapiens
gagttcttcctgtaatcttgt

SEQ ID NO: 4519713 - DNA, 19 bp, Homo sapiens
gagttctttgctgcccctg

SEQ ID NO: 4519714 - DNA, 15 bp, Homo sapiens
gagttgaggaactgt

SEQ ID NO: 4519715 - DNA, 16 bp, Homo sapiens
gagttgaggaactgta

SEQ ID NO: 4519716 - DNA, 23 bp, Homo sapiens
gagttggacttcagtcttgccta

SEQ ID NO: 4519717 - DNA, 13 bp, Homo sapiens
gagttggctggga

SEQ ID NO: 4519718 - DNA, 13 bp, Homo sapiens
gagtttaaaaatc

SEQ ID NO: 4519719 - DNA, 21 bp, Homo sapiens
gagtttaaaaatggtatcaaa

SEQ ID NO: 4519720 - DNA, 14 bp, Homo sapiens
gagtttaaaatcat

SEQ ID NO: 4519721 - DNA, 18 bp, Homo sapiens
gagtttaatacaggaaat

SEQ ID NO: 4519722 - DNA, 17 bp, Homo sapiens
gagtttattacaatgta

SEQ ID NO: 4519723 - DNA, 12 bp, Homo sapiens
gagtttctctgt

SEQ ID NO: 4519724 - DNA, 17 bp, Homo sapiens
gagtttgagctgccttc

SEQ ID NO: 4519725 - DNA, 16 bp, Homo sapiens
gagtttgggctggagc

SEQ ID NO: 4519726 - DNA, 11 bp, Homo sapiens
gagtttgtagg

SEQ ID NO: 4519727 - DNA, 19 bp, Homo sapiens
gagtttgtattattacaaa

SEQ ID NO: 4519728 - DNA, 16 bp, Homo sapiens
gagttttaacaatcca

SEQ ID NO: 4519729 - DNA, 20 bp, Homo sapiens
gagtttttcctcccagtgag

SEQ ID NO: 4519730 - DNA, 22 bp, Homo sapiens
gataaaagcaattctgactgtc

SEQ ID NO: 4519731 - DNA, 17 bp, Homo sapiens
gataaaataaaatttta

SEQ ID NO: 4519732 - DNA, 11 bp, Homo sapiens
gataaactgac

SEQ ID NO: 4519733 - DNA, 18 bp, Homo sapiens
gataaagaccagaaattc

SEQ ID NO: 4519734 - DNA, 13 bp, Homo sapiens
gataaagatttct

SEQ ID NO: 4519735 - DNA, 17 bp, Homo sapiens
gataaagattttttaat

SEQ ID NO: 4519736 - DNA, 17 bp, Homo sapiens
gataaagcttaggtcaa

SEQ ID NO: 4519737 - DNA, 18 bp, Homo sapiens
gataaataatcggcccac

SEQ ID NO: 4519738 - DNA, 17 bp, Homo sapiens
gataaatcataaagtca

SEQ ID NO: 4519739 - DNA, 20 bp, Homo sapiens
gataaccagtaaggaaatat

SEQ ID NO: 4519740 - DNA, 20 bp, Homo sapiens
gataaccttgtttattagca

SEQ ID NO: 4519741 - DNA, 20 bp, Homo sapiens
gataactgaaaattatttaa

SEQ ID NO: 4519742 - DNA, 12 bp, Homo sapiens
gataactgattt

SEQ ID NO: 4519743 - DNA, 16 bp, Homo sapiens
gataacttcttgaaaa

SEQ ID NO: 4519744 - DNA, 22 bp, Homo sapiens
gataagagtagaaactgcaggg

SEQ ID NO: 4519745 - DNA, 17 bp, Homo sapiens
gataaggaattatagac

SEQ ID NO: 4519746 - DNA, 15 bp, Homo sapiens
gataaggcctgtggg

SEQ ID NO: 4519747 - DNA, 19 bp, Homo sapiens
gataagtggctgtttcatc

SEQ ID NO: 4519748 - DNA, 22 bp, Homo sapiens
gataagtttctattctgtcagt

SEQ ID NO: 4519749 - DNA, 16 bp, Homo sapiens
gataatatattgtgtt

SEQ ID NO: 4519750 - DNA, 14 bp, Homo sapiens
gataatatgtttag

SEQ ID NO: 4519751 - DNA, 21 bp, Homo sapiens
gataatattttacatacactg

SEQ ID NO: 4519752 - DNA, 20 bp, Homo sapiens
gataatctcagtgctttcct

SEQ ID NO: 4519753 - DNA, 15 bp, Homo sapiens
gataatgataaaaca

SEQ ID NO: 4519754 - DNA, 15 bp, Homo sapiens
gataatgctgttgcc

SEQ ID NO: 4519755 - DNA, 16 bp, Homo sapiens
gataatgttcattttg

SEQ ID NO: 4519756 - DNA, 14 bp, Homo sapiens
gatacaataaaaca

SEQ ID NO: 4519757 - DNA, 20 bp, Homo sapiens
gatacacaaagctttctttt

SEQ ID NO: 4519758 - DNA, 12 bp, Homo sapiens
gatacagctgag

SEQ ID NO: 4519759 - DNA, 16 bp, Homo sapiens
gatacatttaataaaa

SEQ ID NO: 4519760 - DNA, 11 bp, Homo sapiens
gatacattttt

SEQ ID NO: 4519761 - DNA, 16 bp, Homo sapiens
gataccagaggaagtt

SEQ ID NO: 4519762 - DNA, 16 bp, Homo sapiens
gataccagcagcaact

SEQ ID NO: 4519763 - DNA, 16 bp, Homo sapiens
gaggagagaaaatata

SEQ ID NO: 4519764 - DNA, 17 bp, Homo sapiens
gaggagatgctccttgg

SEQ ID NO: 4519765 - DNA, 16 bp, Homo sapiens
gaggagcagaccagca

SEQ ID NO: 4519766 - DNA, 19 bp, Homo sapiens
gaggagcagaccagcactt

SEQ ID NO: 4519767 - DNA, 22 bp, Homo sapiens
gaggagctgcctcttctcttga

SEQ ID NO: 4519768 - DNA, 16 bp, Homo sapiens
gaggagctggcctgcg

SEQ ID NO: 4519769 - DNA, 13 bp, Homo sapiens
gaggaggctggtg

SEQ ID NO: 4519770 - DNA, 14 bp, Homo sapiens
gaggagggcaggca

SEQ ID NO: 4519771 - DNA, 20 bp, Homo sapiens
gaggagggcgtgactcaccc

SEQ ID NO: 4519772 - DNA, 13 bp, Homo sapiens
gaggaggggtgag

SEQ ID NO: 4519773 - DNA, 23 bp, Homo sapiens
gaggaggggtgagagacctgctc

SEQ ID NO: 4519774 - DNA, 17 bp, Homo sapiens
gaggagggtgggggagg

SEQ ID NO: 4519775 - DNA, 21 bp, Homo sapiens
gaggagtaaataattggaaaa

SEQ ID NO: 4519776 - DNA, 14 bp, Homo sapiens
gaggagtgcagcct

SEQ ID NO: 4519777 - DNA, 21 bp, Homo sapiens
gaggatacatttaataaaact

SEQ ID NO: 4519778 - DNA, 23 bp, Homo sapiens
gaggatataatgtgtgctttatt

SEQ ID NO: 4519779 - DNA, 18 bp, Homo sapiens
gaggatcacagtgctgag

SEQ ID NO: 4519780 - DNA, 19 bp, Homo sapiens
gaggatcacagtgctgaga

SEQ ID NO: 4519781 - DNA, 20 bp, Homo sapiens
gaggatctattactgaccgt

SEQ ID NO: 4519782 - DNA, 21 bp, Homo sapiens
gaggatgatttcagaaggaga

SEQ ID NO: 4519783 - DNA, 15 bp, Homo sapiens
gaggatgtctgggcc

SEQ ID NO: 4519784 - DNA, 20 bp, Homo sapiens
gaggatgttagacttgctcc

SEQ ID NO: 4519785 - DNA, 13 bp, Homo sapiens
gaggattctttcc

SEQ ID NO: 4519786 - DNA, 11 bp, Homo sapiens
gaggcaataag

SEQ ID NO: 4519787 - DNA, 21 bp, Homo sapiens
gaggcaatcctaccttgcttt

SEQ ID NO: 4519788 - DNA, 14 bp, Homo sapiens
gaggcaccagtcca

SEQ ID NO: 4519789 - DNA, 16 bp, Homo sapiens
gaggcaccagtccagc

SEQ ID NO: 4519790 - DNA, 20 bp, Homo sapiens
gaggcactcagtgagcctcc

SEQ ID NO: 4519791 - DNA, 23 bp, Homo sapiens
gaggcagaagaattgaacccagg

SEQ ID NO: 4519792 - DNA, 19 bp, Homo sapiens
gaggcagagacctccaata

SEQ ID NO: 4519793 - DNA, 19 bp, Homo sapiens
gaggcagaggttgcagtga

SEQ ID NO: 4519794 - DNA, 13 bp, Homo sapiens
gaggcaggctggg

SEQ ID NO: 4519795 - DNA, 14 bp, Homo sapiens
gaggcagggcagcc

SEQ ID NO: 4519796 - DNA, 15 bp, Homo sapiens
gaggcagggccttgc

SEQ ID NO: 4519797 - DNA, 17 bp, Homo sapiens
gaggcagggccttgccc

SEQ ID NO: 4519798 - DNA, 20 bp, Homo sapiens
gaggcagggccttgcccaga

SEQ ID NO: 4519799 - DNA, 21 bp, Homo sapiens
gaggcagggccttgcccagag

SEQ ID NO: 4519800 - DNA, 23 bp, Homo sapiens
gaggcagggccttgcccagagat

SEQ ID NO: 4519801 - DNA, 15 bp, Homo sapiens
gaggcagggctctcc

SEQ ID NO: 4519802 - DNA, 16 bp, Homo sapiens
gaggcatgggtgagca

SEQ ID NO: 4519803 - DNA, 23 bp, Homo sapiens
gaggccaccccaaaccccagccc

SEQ ID NO: 4519804 - DNA, 19 bp, Homo sapiens
gaggccagggcagagtgag

SEQ ID NO: 4519805 - DNA, 13 bp, Homo sapiens
gaggcccaaatga

SEQ ID NO: 4519806 - DNA, 23 bp, Homo sapiens
gaggcccaggctgggaactcatc

SEQ ID NO: 4519807 - DNA, 13 bp, Homo sapiens
gaggcccctgcct

SEQ ID NO: 4519808 - DNA, 18 bp, Homo sapiens
gaggccctcaatccacct

SEQ ID NO: 4519809 - DNA, 21 bp, Homo sapiens
gaggccctcaatccaccttca

SEQ ID NO: 4519810 - DNA, 17 bp, Homo sapiens
gaggccctcgggcccag

SEQ ID NO: 4519811 - DNA, 19 bp, Homo sapiens
gaggccctcgggcccagcc

SEQ ID NO: 4519812 - DNA, 18 bp, Homo sapiens
gaggccctgcccaatgag

SEQ ID NO: 4519813 - DNA, 16 bp, Homo sapiens
gaggccctgcccccac

SEQ ID NO: 4519814 - DNA, 21 bp, Homo sapiens
gaggccctgcccccacccctt

SEQ ID NO: 4519815 - DNA, 23 bp, Homo sapiens
gaggccctgcccccaccccttcc

SEQ ID NO: 4519816 - DNA, 18 bp, Homo sapiens
gaggccctggagggaagg

SEQ ID NO: 4519817 - DNA, 13 bp, Homo sapiens
gaggccctgggct

SEQ ID NO: 4519818 - DNA, 15 bp, Homo sapiens
gaggcctagactctg

SEQ ID NO: 4519819 - DNA, 18 bp, Homo sapiens
gaggcctccactccttcc

SEQ ID NO: 4519820 - DNA, 19 bp, Homo sapiens
gaggcctccactccttcca

SEQ ID NO: 4519821 - DNA, 20 bp, Homo sapiens
gaggcctgcaaaccttcctg

SEQ ID NO: 4519822 - DNA, 22 bp, Homo sapiens
gaggcctgcaaaccttcctggg

SEQ ID NO: 4519823 - DNA, 12 bp, Homo sapiens
gaggcctgcccg

SEQ ID NO: 4519824 - DNA, 14 bp, Homo sapiens
gaggcctgtcccaa

SEQ ID NO: 4519825 - DNA, 14 bp, Homo sapiens
gaggcgaataaatg

SEQ ID NO: 4519826 - DNA, 16 bp, Homo sapiens
gaggcgaataaatgtt

SEQ ID NO: 4519827 - DNA, 17 bp, Homo sapiens
gaggcgaataaatgttc

SEQ ID NO: 4519828 - DNA, 18 bp, Homo sapiens
gaggcggacgttccagcc

SEQ ID NO: 4519829 - DNA, 18 bp, Homo sapiens
gaggcggaggctgtgctc

SEQ ID NO: 4519830 - DNA, 21 bp, Homo sapiens
gaggcgtgcccccctcctcca

SEQ ID NO: 4519831 - DNA, 20 bp, Homo sapiens
gaggctacagctccacacgc

SEQ ID NO: 4519832 - DNA, 23 bp, Homo sapiens
gaggctacccgctgtggccggtg

SEQ ID NO: 4519833 - DNA, 23 bp, Homo sapiens
gaggctatgaggaaactgagtca

SEQ ID NO: 4519834 - DNA, 17 bp, Homo sapiens
gaggctccagagggcac

SEQ ID NO: 4519835 - DNA, 21 bp, Homo sapiens
gaggctccagctctggcacag

SEQ ID NO: 4519836 - DNA, 21 bp, Homo sapiens
gaggctccccgcctccactct

SEQ ID NO: 4519837 - DNA, 19 bp, Homo sapiens
gaggctcccggggcctgga

SEQ ID NO: 4519838 - DNA, 21 bp, Homo sapiens
gaggctcccggggcctggaca

SEQ ID NO: 4519839 - DNA, 14 bp, Homo sapiens
gaggctgagacagg

SEQ ID NO: 4519840 - DNA, 18 bp, Homo sapiens
gaggctgagacaggagaa

SEQ ID NO: 4519841 - DNA, 18 bp, Homo sapiens
gaggctgagatgggagaa

SEQ ID NO: 4519842 - DNA, 14 bp, Homo sapiens
gaggctgaggcagg

SEQ ID NO: 4519843 - DNA, 21 bp, Homo sapiens
gaggctgcacccctgggccag

SEQ ID NO: 4519844 - DNA, 16 bp, Homo sapiens
gaggctgcagagctga

SEQ ID NO: 4519845 - DNA, 14 bp, Homo sapiens
gaggctgcagtcag

SEQ ID NO: 4519846 - DNA, 9 bp, Homo sapiens
gaggctgcc

SEQ ID NO: 4519847 - DNA, 23 bp, Homo sapiens
gaggctgcccccggccccctggt

SEQ ID NO: 4519848 - DNA, 15 bp, Homo sapiens
gaggctgcccctctc

SEQ ID NO: 4519849 - DNA, 15 bp, Homo sapiens
gaggctggaggcagg

SEQ ID NO: 4519850 - DNA, 16 bp, Homo sapiens
gaggctggaggcaggg

SEQ ID NO: 4519851 - DNA, 18 bp, Homo sapiens
gaggctggaggcagggcc

SEQ ID NO: 4519852 - DNA, 19 bp, Homo sapiens
gaggctggaggcagggcct

SEQ ID NO: 4519853 - DNA, 19 bp, Homo sapiens
gaggctgggcccctgggat

SEQ ID NO: 4519854 - DNA, 18 bp, Homo sapiens
gaggctggggccccatct

SEQ ID NO: 4519855 - DNA, 22 bp, Homo sapiens
gaggctggggccccatcttgat

SEQ ID NO: 4519856 - DNA, 15 bp, Homo sapiens
gaggcttctccgcca

SEQ ID NO: 4519857 - DNA, 19 bp, Homo sapiens
gaggcttctccgccagcct

SEQ ID NO: 4519858 - DNA, 23 bp, Homo sapiens
gaggcttctcctgttttatatat

SEQ ID NO: 4519859 - DNA, 20 bp, Homo sapiens
gaggctttggatttgacatt

SEQ ID NO: 4519860 - DNA, 23 bp, Homo sapiens
gaggctttggtaaaacagtttca

SEQ ID NO: 4519861 - DNA, 14 bp, Homo sapiens
gagggaaaacagaa

SEQ ID NO: 4519862 - DNA, 20 bp, Homo sapiens
gagggaaattgtaaatcctg

SEQ ID NO: 4519863 - DNA, 22 bp, Homo sapiens
gagggaaattgtaaatcctgtg

SEQ ID NO: 4519864 - DNA, 15 bp, Homo sapiens
gagggaacagacagg

SEQ ID NO: 4519865 - DNA, 21 bp, Homo sapiens
gagggaaggggaatggaagag

SEQ ID NO: 4519866 - DNA, 14 bp, Homo sapiens
gagggaataaatca

SEQ ID NO: 4519867 - DNA, 16 bp, Homo sapiens
gagggaatgaacctgg

SEQ ID NO: 4519868 - DNA, 18 bp, Homo sapiens
gagggaccaaattgcttc

SEQ ID NO: 4519869 - DNA, 14 bp, Homo sapiens
gagggactctgaag

SEQ ID NO: 4519870 - DNA, 16 bp, Homo sapiens
gagggagaacaagacc

SEQ ID NO: 4519871 - DNA, 15 bp, Homo sapiens
gagggagagagagag

SEQ ID NO: 4519872 - DNA, 16 bp, Homo sapiens
gagggagagagagaga

SEQ ID NO: 4519873 - DNA, 22 bp, Homo sapiens
gagggagcgacacttgaatgta

SEQ ID NO: 4519874 - DNA, 15 bp, Homo sapiens
gagggaggagggagt

SEQ ID NO: 4519875 - DNA, 16 bp, Homo sapiens
gagggaggagggagtg

SEQ ID NO: 4519876 - DNA, 21 bp, Homo sapiens
gagggaggggaagcttctgtc

SEQ ID NO: 4519877 - DNA, 18 bp, Homo sapiens
gagggataattggttatt

SEQ ID NO: 4519878 - DNA, 15 bp, Homo sapiens
gagggatcagccccg

SEQ ID NO: 4519879 - DNA, 16 bp, Homo sapiens
gagggattgaggggcc

SEQ ID NO: 4519880 - DNA, 17 bp, Homo sapiens
gagggcacatgaacagc

SEQ ID NO: 4519881 - DNA, 19 bp, Homo sapiens
gagggcagcagaagggggt

SEQ ID NO: 4519882 - DNA, 19 bp, Homo sapiens
gagggcagcagggctaccc

SEQ ID NO: 4519883 - DNA, 17 bp, Homo sapiens
gagggcccaaagaattg

SEQ ID NO: 4519884 - DNA, 12 bp, Homo sapiens
gagggcccagcc

SEQ ID NO: 4519885 - DNA, 13 bp, Homo sapiens
gagggcccagccc

SEQ ID NO: 4519886 - DNA, 15 bp, Homo sapiens
gagggcccagcccag

SEQ ID NO: 4519887 - DNA, 18 bp, Homo sapiens
gagggcccagcccagagc

SEQ ID NO: 4519888 - DNA, 13 bp, Homo sapiens
gagggcccctgcg

SEQ ID NO: 4519889 - DNA, 15 bp, Homo sapiens
gagggccctacctga

SEQ ID NO: 4519890 - DNA, 20 bp, Homo sapiens
gagggcgtgactcacccaag

SEQ ID NO: 4519891 - DNA, 18 bp, Homo sapiens
gagggctagaacctggag

SEQ ID NO: 4519892 - DNA, 21 bp, Homo sapiens
gagggctagaacctggagagc

SEQ ID NO: 4519893 - DNA, 20 bp, Homo sapiens
gagggctagaacctggcagg

SEQ ID NO: 4519894 - DNA, 20 bp, Homo sapiens
gagggctagaatctggagag

SEQ ID NO: 4519895 - DNA, 15 bp, Homo sapiens
gagggctggaatctg

SEQ ID NO: 4519896 - DNA, 19 bp, Homo sapiens
gagggctggaatctggaga

SEQ ID NO: 4519897 - DNA, 21 bp, Homo sapiens
gagggctggaatctggagagc

SEQ ID NO: 4519898 - DNA, 23 bp, Homo sapiens
gagggctggccgggactgctgct

SEQ ID NO: 4519899 - DNA, 18 bp, Homo sapiens
gagggctggctggcctca

SEQ ID NO: 4519900 - DNA, 21 bp, Homo sapiens
gagggcttcctctagaagcca

SEQ ID NO: 4519901 - DNA, 16 bp, Homo sapiens
gagggcttggggctgc

SEQ ID NO: 4519902 - DNA, 17 bp, Homo sapiens
gaggggaaaaaaatgtt

SEQ ID NO: 4519903 - DNA, 16 bp, Homo sapiens
gaggggaaacaatgaa

SEQ ID NO: 4519904 - DNA, 16 bp, Homo sapiens
gaggggaagcttctgt

SEQ ID NO: 4519905 - DNA, 21 bp, Homo sapiens
gaggggagacattagaaaaaa

SEQ ID NO: 4519906 - DNA, 19 bp, Homo sapiens
gaggggagcgtctgggaac

SEQ ID NO: 4519907 - DNA, 13 bp, Homo sapiens
gaggggaggcaga

SEQ ID NO: 4519908 - DNA, 22 bp, Homo sapiens
gaggggcatctgcccctccccc

SEQ ID NO: 4519909 - DNA, 18 bp, Homo sapiens
gaggggccctggccagga

SEQ ID NO: 4519910 - DNA, 19 bp, Homo sapiens
gaggggccctggccaggac

SEQ ID NO: 4519911 - DNA, 19 bp, Homo sapiens
gaggggcgcaccccacagc

SEQ ID NO: 4519912 - DNA, 22 bp, Homo sapiens
gaggggcgcaccccacagctgg

SEQ ID NO: 4519913 - DNA, 15 bp, Homo sapiens
gaggggcgggctcag

SEQ ID NO: 4519914 - DNA, 16 bp, Homo sapiens
gaggggcgggctcaga

SEQ ID NO: 4519915 - DNA, 14 bp, Homo sapiens
gagggggagagggc

SEQ ID NO: 4519916 - DNA, 14 bp, Homo sapiens
gagggggccgggcg

SEQ ID NO: 4519917 - DNA, 21 bp, Homo sapiens
gagggggctatagctacagga

SEQ ID NO: 4519918 - DNA, 12 bp, Homo sapiens
gagggggctggg

SEQ ID NO: 4519919 - DNA, 14 bp, Homo sapiens
gagggggctggggt

SEQ ID NO: 4519920 - DNA, 17 bp, Homo sapiens
gagggggcttgaagcca

SEQ ID NO: 4519921 - DNA, 13 bp, Homo sapiens
gagggggtggagg

SEQ ID NO: 4519922 - DNA, 18 bp, Homo sapiens
gagggggtgtctgcacct

SEQ ID NO: 4519923 - DNA, 23 bp, Homo sapiens
gaggggtgagagacctgctcagg

SEQ ID NO: 4519924 - DNA, 17 bp, Homo sapiens
gaggggtggcccagagc

SEQ ID NO: 4519925 - DNA, 17 bp, Homo sapiens
gaggggtgtggcagtgg

SEQ ID NO: 4519926 - DNA, 18 bp, Homo sapiens
gaggggtgtggcagtggt

SEQ ID NO: 4519927 - DNA, 20 bp, Homo sapiens
gagggtcccaagctgggccc

SEQ ID NO: 4519928 - DNA, 23 bp, Homo sapiens
gagggtcccaagctgggccccag

SEQ ID NO: 4519929 - DNA, 15 bp, Homo sapiens
gagggtctggagaag

SEQ ID NO: 4519930 - DNA, 20 bp, Homo sapiens
gagggtggttcaacaaagaa

SEQ ID NO: 4519931 - DNA, 15 bp, Homo sapiens
gagggtgtttcctct

SEQ ID NO: 4519932 - DNA, 17 bp, Homo sapiens
gagggtgtttcctctaa

SEQ ID NO: 4519933 - DNA, 15 bp, Homo sapiens
gagggttctaagtgg

SEQ ID NO: 4519934 - DNA, 18 bp, Homo sapiens
gagggtttctgatctgta

SEQ ID NO: 4519935 - DNA, 15 bp, Homo sapiens
gaggtaaagatatgg

SEQ ID NO: 4519936 - DNA, 14 bp, Homo sapiens
gaggtatattggaa

SEQ ID NO: 4519937 - DNA, 15 bp, Homo sapiens
gaggtcactggaaag

SEQ ID NO: 4519938 - DNA, 17 bp, Homo sapiens
gaggtcactggaaaggg

SEQ ID NO: 4519939 - DNA, 20 bp, Homo sapiens
gaggtcactggaaaggggag

SEQ ID NO: 4519940 - DNA, 23 bp, Homo sapiens
gaggtccaggtcccagcccctcc

SEQ ID NO: 4519941 - DNA, 21 bp, Homo sapiens
gaggtccttaggcctctgaga

SEQ ID NO: 4519942 - DNA, 12 bp, Homo sapiens
gaggtctgagcc

SEQ ID NO: 4519943 - DNA, 15 bp, Homo sapiens
gaggtctgagccctg

SEQ ID NO: 4519944 - DNA, 16 bp, Homo sapiens
gaggtctgagccctgg

SEQ ID NO: 4519945 - DNA, 19 bp, Homo sapiens
gaggtctgagccctggtgt

SEQ ID NO: 4519946 - DNA, 14 bp, Homo sapiens
gaggtctgttcctt

SEQ ID NO: 4519947 - DNA, 16 bp, Homo sapiens
gaggtctgttcctttt

SEQ ID NO: 4519948 - DNA, 13 bp, Homo sapiens
gaggtctgtttaa

SEQ ID NO: 4519949 - DNA, 16 bp, Homo sapiens
gaggtgaacaaggtaa

SEQ ID NO: 4519950 - DNA, 23 bp, Homo sapiens
gaggtgccacccagtagcccaga

SEQ ID NO: 4519951 - DNA, 15 bp, Homo sapiens
gaggtgctaaattgt

SEQ ID NO: 4519952 - DNA, 17 bp, Homo sapiens
gaggtggaagaagggag

SEQ ID NO: 4519953 - DNA, 18 bp, Homo sapiens
gaggtggaagaagggaga

SEQ ID NO: 4519954 - DNA, 22 bp, Homo sapiens
gaggtggaagcagaggccctgc

SEQ ID NO: 4519955 - DNA, 18 bp, Homo sapiens
gaggtggagggagggaag

SEQ ID NO: 4519956 - DNA, 19 bp, Homo sapiens
gaggtggaggttgcagtga

SEQ ID NO: 4519957 - DNA, 14 bp, Homo sapiens
gaggttcccagggc

SEQ ID NO: 4519958 - DNA, 17 bp, Homo sapiens
gaggttcctctgcctgc

SEQ ID NO: 4519959 - DNA, 13 bp, Homo sapiens
gaggttgtagtga

SEQ ID NO: 4519960 - DNA, 17 bp, Homo sapiens
gagtaaaaagacatttt

SEQ ID NO: 4519961 - DNA, 16 bp, Homo sapiens
gagtaaacggcccagg

SEQ ID NO: 4519962 - DNA, 22 bp, Homo sapiens
gagtaataagcatggtgtcagt

SEQ ID NO: 4519963 - DNA, 13 bp, Homo sapiens
gagtaatgatgta

SEQ ID NO: 4519964 - DNA, 23 bp, Homo sapiens
gagtacactcagccactgtcaca

SEQ ID NO: 4519965 - DNA, 15 bp, Homo sapiens
gagtactctttctct

SEQ ID NO: 4519966 - DNA, 13 bp, Homo sapiens
gagtactgtgggc

SEQ ID NO: 4519967 - DNA, 14 bp, Homo sapiens
gagtactgtgggca

SEQ ID NO: 4519968 - DNA, 15 bp, Homo sapiens
gagtactgtgggcaa

SEQ ID NO: 4519969 - DNA, 22 bp, Homo sapiens
gagtactgtgggcaatttagaa

SEQ ID NO: 4519970 - DNA, 14 bp, Homo sapiens
gagtagaattgcat

SEQ ID NO: 4519971 - DNA, 17 bp, Homo sapiens
gagtagaattgcattga

SEQ ID NO: 4519972 - DNA, 13 bp, Homo sapiens
gagtagccaagct

SEQ ID NO: 4519973 - DNA, 17 bp, Homo sapiens
gagtagccgagagcctg

SEQ ID NO: 4519974 - DNA, 18 bp, Homo sapiens
gagtagccgagagcctgc

SEQ ID NO: 4519975 - DNA, 21 bp, Homo sapiens
gagtagccgagagcctgctcc

SEQ ID NO: 4519976 - DNA, 13 bp, Homo sapiens
gagtagtggccac

SEQ ID NO: 4519977 - DNA, 17 bp, Homo sapiens
gagtataccatgagatg

SEQ ID NO: 4519978 - DNA, 14 bp, Homo sapiens
gagtcaaaaagaac

SEQ ID NO: 4519979 - DNA, 15 bp, Homo sapiens
gagtcaactggctgg

SEQ ID NO: 4519980 - DNA, 13 bp, Homo sapiens
gagtcaatacata

SEQ ID NO: 4519981 - DNA, 19 bp, Homo sapiens
gagtcaatcccctcattca

SEQ ID NO: 4519982 - DNA, 17 bp, Homo sapiens
gagtcacagatgaggcc

SEQ ID NO: 4519983 - DNA, 14 bp, Homo sapiens
gagtcaccaggaat

SEQ ID NO: 4519984 - DNA, 20 bp, Homo sapiens
gagtcagaatgtgaaaaagg

SEQ ID NO: 4519985 - DNA, 21 bp, Homo sapiens
gagtcataacggttaagaaag

SEQ ID NO: 4519986 - DNA, 16 bp, Homo sapiens
gagtcatgatctccct

SEQ ID NO: 4519987 - DNA, 20 bp, Homo sapiens
gagtcatgatctccctgccg

SEQ ID NO: 4519988 - DNA, 14 bp, Homo sapiens
gagtcatggctaat

SEQ ID NO: 4519989 - DNA, 18 bp, Homo sapiens
gagtcattcaggtgacct

SEQ ID NO: 4519990 - DNA, 18 bp, Homo sapiens
gagtcatttgtttaaaca

SEQ ID NO: 4519991 - DNA, 12 bp, Homo sapiens
gagtccaaggcc

SEQ ID NO: 4519992 - DNA, 13 bp, Homo sapiens
gagtccaaggcca

SEQ ID NO: 4519993 - DNA, 17 bp, Homo sapiens
gagtccaaggccagtcc

SEQ ID NO: 4519994 - DNA, 13 bp, Homo sapiens
gagtccacgccca

SEQ ID NO: 4519995 - DNA, 23 bp, Homo sapiens
gagtccacgcccaccagccttgc

SEQ ID NO: 4519996 - DNA, 19 bp, Homo sapiens
gagtccagcccctcctccc

SEQ ID NO: 4519997 - DNA, 22 bp, Homo sapiens
gagtccagcccctcctccctca

SEQ ID NO: 4519998 - DNA, 13 bp, Homo sapiens
gagtccagctccc

SEQ ID NO: 4519999 - DNA, 16 bp, Homo sapiens
gagtccagctcccccc

SEQ ID NO: 4520000 - DNA, 18 bp, Homo sapiens
gagtccaggcccccagcc

SEQ ID NO: 4520001 - DNA, 18 bp, Homo sapiens
gagtccagtgctctgcct

SEQ ID NO: 4520002 - DNA, 20 bp, Homo sapiens
gagtcccaggggcagccaca

SEQ ID NO: 4520003 - DNA, 17 bp, Homo sapiens
gagtccctacctgcttc

SEQ ID NO: 4520004 - DNA, 18 bp, Homo sapiens
gatacccaacagtttatt

SEQ ID NO: 4520005 - DNA, 13 bp, Homo sapiens
gatacctggagca

SEQ ID NO: 4520006 - DNA, 15 bp, Homo sapiens
gatacgtgtcaatgt

SEQ ID NO: 4520007 - DNA, 12 bp, Homo sapiens
gatactctcttc

SEQ ID NO: 4520008 - DNA, 16 bp, Homo sapiens
gatactggcacagagg

SEQ ID NO: 4520009 - DNA, 16 bp, Homo sapiens
gatacttatttttctg

SEQ ID NO: 4520010 - DNA, 13 bp, Homo sapiens
gatacttggattt

SEQ ID NO: 4520011 - DNA, 22 bp, Homo sapiens
gatactttagtacaatttcaac

SEQ ID NO: 4520012 - DNA, 16 bp, Homo sapiens
gatagaaagaataaaa

SEQ ID NO: 4520013 - DNA, 14 bp, Homo sapiens
gatagactgctaca

SEQ ID NO: 4520014 - DNA, 22 bp, Homo sapiens
gatagatgtgtggacacattgg

SEQ ID NO: 4520015 - DNA, 22 bp, Homo sapiens
gatagcactggtttgtttctca

SEQ ID NO: 4520016 - DNA, 13 bp, Homo sapiens
gatagcagggcat

SEQ ID NO: 4520017 - DNA, 17 bp, Homo sapiens
gatagcgggaaaaggag

SEQ ID NO: 4520018 - DNA, 16 bp, Homo sapiens
gatagctaactgtaaa

SEQ ID NO: 4520019 - DNA, 20 bp, Homo sapiens
gatagctaactgtaaatcat

SEQ ID NO: 4520020 - DNA, 18 bp, Homo sapiens
gatagctactaaatatat

SEQ ID NO: 4520021 - DNA, 15 bp, Homo sapiens
gatagcttctcttct

SEQ ID NO: 4520022 - DNA, 18 bp, Homo sapiens
gataggaatgtgaaagca

SEQ ID NO: 4520023 - DNA, 14 bp, Homo sapiens
gataggaggaacca

SEQ ID NO: 4520024 - DNA, 16 bp, Homo sapiens
gatagggagttttaaa

SEQ ID NO: 4520025 - DNA, 21 bp, Homo sapiens
gatagggctgggcaaggaaaa

SEQ ID NO: 4520026 - DNA, 22 bp, Homo sapiens
gatagggctgggcaaggaaaaa

SEQ ID NO: 4520027 - DNA, 15 bp, Homo sapiens
gataggtaaattttt

SEQ ID NO: 4520028 - DNA, 22 bp, Homo sapiens
gatagtcctgacctcatgatct

SEQ ID NO: 4520029 - DNA, 22 bp, Homo sapiens
gatagtcctttttccaatgttt

SEQ ID NO: 4520030 - DNA, 19 bp, Homo sapiens
gatagtgccaggtggctca

SEQ ID NO: 4520031 - DNA, 19 bp, Homo sapiens
gatagttctataagaataa

SEQ ID NO: 4520032 - DNA, 13 bp, Homo sapiens
gatagttttcatt

SEQ ID NO: 4520033 - DNA, 16 bp, Homo sapiens
gatataatctttcaaa

SEQ ID NO: 4520034 - DNA, 18 bp, Homo sapiens
gatataatgaacaaaatt

SEQ ID NO: 4520035 - DNA, 18 bp, Homo sapiens
gatataattgtactgtgt

SEQ ID NO: 4520036 - DNA, 23 bp, Homo sapiens
gatataattgtactgtgttttta

SEQ ID NO: 4520037 - DNA, 19 bp, Homo sapiens
gatatagttttacttttaa

SEQ ID NO: 4520038 - DNA, 21 bp, Homo sapiens
gatatagttttacttttaaac

SEQ ID NO: 4520039 - DNA, 24 bp, Homo sapiens
gatatagttttacttttaaactgt

SEQ ID NO: 4520040 - DNA, 18 bp, Homo sapiens
gatatatggaggattctt

SEQ ID NO: 4520041 - DNA, 20 bp, Homo sapiens
gatatatttgaaatagtata

SEQ ID NO: 4520042 - DNA, 13 bp, Homo sapiens
gatatcagaattt

SEQ ID NO: 4520043 - DNA, 16 bp, Homo sapiens
gatatcagggcacagt

SEQ ID NO: 4520044 - DNA, 23 bp, Homo sapiens
gatatcctctccccctcctccag

SEQ ID NO: 4520045 - DNA, 16 bp, Homo sapiens
gatatcgtgaaatcct

SEQ ID NO: 4520046 - DNA, 13 bp, Homo sapiens
gatatctcaatgt

SEQ ID NO: 4520047 - DNA, 16 bp, Homo sapiens
gatatcttcagaaaac

SEQ ID NO: 4520048 - DNA, 20 bp, Homo sapiens
gatatcttggacaaatcaca

SEQ ID NO: 4520049 - DNA, 14 bp, Homo sapiens
gatatgaatatatg

SEQ ID NO: 4520050 - DNA, 21 bp, Homo sapiens
gatatgagttgttttcagact

SEQ ID NO: 4520051 - DNA, 17 bp, Homo sapiens
gatatgcatatttgttt

SEQ ID NO: 4520052 - DNA, 21 bp, Homo sapiens
gatatgcatgtagcatataaa

SEQ ID NO: 4520053 - DNA, 22 bp, Homo sapiens
gatatgcatgtagcatataaat

SEQ ID NO: 4520054 - DNA, 18 bp, Homo sapiens
gatatggctgcccaggag

SEQ ID NO: 4520055 - DNA, 18 bp, Homo sapiens
gatatgggtcctctgggg

SEQ ID NO: 4520056 - DNA, 16 bp, Homo sapiens
gatatgtaaaacattt

SEQ ID NO: 4520057 - DNA, 19 bp, Homo sapiens
gatatgtaaaacatttatt

SEQ ID NO: 4520058 - DNA, 18 bp, Homo sapiens
gatattaagaatcttaga

SEQ ID NO: 4520059 - DNA, 19 bp, Homo sapiens
gatattaagaatcttagat

SEQ ID NO: 4520060 - DNA, 16 bp, Homo sapiens
gatattatattaaaca

SEQ ID NO: 4520061 - DNA, 20 bp, Homo sapiens
gatattatattaaacataca

SEQ ID NO: 4520062 - DNA, 14 bp, Homo sapiens
gatattattttaaa

SEQ ID NO: 4520063 - DNA, 16 bp, Homo sapiens
gatattctcctcggac

SEQ ID NO: 4520064 - DNA, 20 bp, Homo sapiens
gatattgaaggagaaaatag

SEQ ID NO: 4520065 - DNA, 22 bp, Homo sapiens
gatattgccttatttgtctgta

SEQ ID NO: 4520066 - DNA, 17 bp, Homo sapiens
gatattgctgaagaatc

SEQ ID NO: 4520067 - DNA, 24 bp, Homo sapiens
gatattgctgaagaatctacttaa

SEQ ID NO: 4520068 - DNA, 18 bp, Homo sapiens
gatattgtttgctgttgg

SEQ ID NO: 4520069 - DNA, 20 bp, Homo sapiens
gatattgtttgctgttgggt

SEQ ID NO: 4520070 - DNA, 17 bp, Homo sapiens
gatatttcgaccctggg

SEQ ID NO: 4520071 - DNA, 14 bp, Homo sapiens
gatatttcttgctt

SEQ ID NO: 4520072 - DNA, 16 bp, Homo sapiens
gatatttcttgctttc

SEQ ID NO: 4520073 - DNA, 14 bp, Homo sapiens
gatatttgaaatag

SEQ ID NO: 4520074 - DNA, 20 bp, Homo sapiens
gatatttgcagtttttcatt

SEQ ID NO: 4520075 - DNA, 17 bp, Homo sapiens
gatattttgtaaaatgt

SEQ ID NO: 4520076 - DNA, 18 bp, Homo sapiens
gatattttgtaaaatgta

SEQ ID NO: 4520077 - DNA, 20 bp, Homo sapiens
gatattttgtaaaatgtatt

SEQ ID NO: 4520078 - DNA, 22 bp, Homo sapiens
gatatttttgtacgttatatat

SEQ ID NO: 4520079 - DNA, 15 bp, Homo sapiens
gatcaaagatgaaaa

SEQ ID NO: 4520080 - DNA, 14 bp, Homo sapiens
gatcaacatctttt

SEQ ID NO: 4520081 - DNA, 22 bp, Homo sapiens
gatcaagttgttgactgtgatt

SEQ ID NO: 4520082 - DNA, 22 bp, Homo sapiens
gatcaatcctttattattattt

SEQ ID NO: 4520083 - DNA, 15 bp, Homo sapiens
gatcacagaccacag

SEQ ID NO: 4520084 - DNA, 19 bp, Homo sapiens
gatcacagaccacaggaag

SEQ ID NO: 4520085 - DNA, 17 bp, Homo sapiens
gatcacatctaaagctt

SEQ ID NO: 4520086 - DNA, 23 bp, Homo sapiens
gatcacatcttaaattcatttct

SEQ ID NO: 4520087 - DNA, 13 bp, Homo sapiens
gatcacctgaggt

SEQ ID NO: 4520088 - DNA, 22 bp, Homo sapiens
gatcactttctcagttttcata

SEQ ID NO: 4520089 - DNA, 16 bp, Homo sapiens
gatcagatgctgaatt

SEQ ID NO: 4520090 - DNA, 21 bp, Homo sapiens
gatcaggctagccctgccctc

SEQ ID NO: 4520091 - DNA, 23 bp, Homo sapiens
gatcagtgggcctccaaggaggg

SEQ ID NO: 4520092 - DNA, 20 bp, Homo sapiens
gatcagtgtaccatttgcct

SEQ ID NO: 4520093 - DNA, 14 bp, Homo sapiens
gatcagttaactat

SEQ ID NO: 4520094 - DNA, 14 bp, Homo sapiens
gatcatctggggac

SEQ ID NO: 4520095 - DNA, 19 bp, Homo sapiens
gatcatgtactttttagta

SEQ ID NO: 4520096 - DNA, 18 bp, Homo sapiens
gatcatttataatactgt

SEQ ID NO: 4520097 - DNA, 14 bp, Homo sapiens
gatcattttccccc

SEQ ID NO: 4520098 - DNA, 15 bp, Homo sapiens
gatcattttcccccc

SEQ ID NO: 4520099 - DNA, 20 bp, Homo sapiens
gatccaaattgtgcttctcc

SEQ ID NO: 4520100 - DNA, 16 bp, Homo sapiens
gatccacgctgggcct

SEQ ID NO: 4520101 - DNA, 16 bp, Homo sapiens
gatccagagagcagct

SEQ ID NO: 4520102 - DNA, 13 bp, Homo sapiens
gatccagcactgg

SEQ ID NO: 4520103 - DNA, 14 bp, Homo sapiens
gatccagcactggt

SEQ ID NO: 4520104 - DNA, 17 bp, Homo sapiens
gatccagtataagacta

SEQ ID NO: 4520105 - DNA, 19 bp, Homo sapiens
gatccatcttgagccacag

SEQ ID NO: 4520106 - DNA, 19 bp, Homo sapiens
gatccattaatttaaatga

SEQ ID NO: 4520107 - DNA, 15 bp, Homo sapiens
gatcccaaagcaagg

SEQ ID NO: 4520108 - DNA, 17 bp, Homo sapiens
gatcccaacactgccag

SEQ ID NO: 4520109 - DNA, 21 bp, Homo sapiens
gatcccaccccctcctccccc

SEQ ID NO: 4520110 - DNA, 19 bp, Homo sapiens
gatcccaggcccctggagg

SEQ ID NO: 4520111 - DNA, 24 bp, Homo sapiens
gatccccagcccctcctccctcag

SEQ ID NO: 4520112 - DNA, 14 bp, Homo sapiens
gatccccagctgtt

SEQ ID NO: 4520113 - DNA, 21 bp, Homo sapiens
gatcccggtggtgggatccac

SEQ ID NO: 4520114 - DNA, 16 bp, Homo sapiens
gatccctaatgtgttt

SEQ ID NO: 4520115 - DNA, 18 bp, Homo sapiens
gatccctaatgtgtttct

SEQ ID NO: 4520116 - DNA, 14 bp, Homo sapiens
gatccctcatctgt

SEQ ID NO: 4520117 - DNA, 15 bp, Homo sapiens
gatcctaagaatttt

SEQ ID NO: 4520118 - DNA, 13 bp, Homo sapiens
gatcctccacaga

SEQ ID NO: 4520119 - DNA, 17 bp, Homo sapiens
gatcctctcctttgaaa

SEQ ID NO: 4520120 - DNA, 15 bp, Homo sapiens
gatcctgcaccccag

SEQ ID NO: 4520121 - DNA, 17 bp, Homo sapiens
gatcctggattcactca

SEQ ID NO: 4520122 - DNA, 19 bp, Homo sapiens
gatcctggattcactcact

SEQ ID NO: 4520123 - DNA, 22 bp, Homo sapiens
gatcctgggtactgaaagcctt

SEQ ID NO: 4520124 - DNA, 23 bp, Homo sapiens
gatcctgttacttgcttcagtgg

SEQ ID NO: 4520125 - DNA, 17 bp, Homo sapiens
gatcgaaccgttttgaa

SEQ ID NO: 4520126 - DNA, 19 bp, Homo sapiens
gatcgagaccatcctggct

SEQ ID NO: 4520127 - DNA, 13 bp, Homo sapiens
gatcgatgtgctc

SEQ ID NO: 4520128 - DNA, 14 bp, Homo sapiens
gatcgatgtgctca

SEQ ID NO: 4520129 - DNA, 23 bp, Homo sapiens
gatcgcaccactgcactccagcc

SEQ ID NO: 4520130 - DNA, 20 bp, Homo sapiens
gatcgctgcacatggcctga

SEQ ID NO: 4520131 - DNA, 21 bp, Homo sapiens
gatcgctgcacatggcctgag

SEQ ID NO: 4520132 - DNA, 15 bp, Homo sapiens
gatcggactctgccc

SEQ ID NO: 4520133 - DNA, 19 bp, Homo sapiens
gatcggactctgcccctgg

SEQ ID NO: 4520134 - DNA, 18 bp, Homo sapiens
gatctaaacagttatttc

SEQ ID NO: 4520135 - DNA, 15 bp, Homo sapiens
gatctatctacaaag

SEQ ID NO: 4520136 - DNA, 17 bp, Homo sapiens
gatctattgatttgaaa

SEQ ID NO: 4520137 - DNA, 18 bp, Homo sapiens
gatctattgatttgaaaa

SEQ ID NO: 4520138 - DNA, 21 bp, Homo sapiens
gatctcattggacccttccat

SEQ ID NO: 4520139 - DNA, 12 bp, Homo sapiens
gatctccctgcc

SEQ ID NO: 4520140 - DNA, 14 bp, Homo sapiens
gatctccctgccgc

SEQ ID NO: 4520141 - DNA, 18 bp, Homo sapiens
gatctccctgccgcctca

SEQ ID NO: 4520142 - DNA, 19 bp, Homo sapiens
gatctcccttctcatctcc

SEQ ID NO: 4520143 - DNA, 20 bp, Homo sapiens
gatctcggtttgccaaaatt

SEQ ID NO: 4520144 - DNA, 16 bp, Homo sapiens
gatctctcctggccta

SEQ ID NO: 4520145 - DNA, 21 bp, Homo sapiens
gatctctcttgtcctcttctg

SEQ ID NO: 4520146 - DNA, 23 bp, Homo sapiens
gatctctcttgtcctcttctgct

SEQ ID NO: 4520147 - DNA, 17 bp, Homo sapiens
gatctctgctccctgca

SEQ ID NO: 4520148 - DNA, 12 bp, Homo sapiens
gatctctgctgg

SEQ ID NO: 4520149 - DNA, 12 bp, Homo sapiens
gatctcttaaga

SEQ ID NO: 4520150 - DNA, 13 bp, Homo sapiens
gatctgagggaga

SEQ ID NO: 4520151 - DNA, 18 bp, Homo sapiens
gatctgctgggctctgcc

SEQ ID NO: 4520152 - DNA, 17 bp, Homo sapiens
gatctgggaccctttcc

SEQ ID NO: 4520153 - DNA, 23 bp, Homo sapiens
gatctgggaccctttccttcctt

SEQ ID NO: 4520154 - DNA, 18 bp, Homo sapiens
gatctgggcattttcctc

SEQ ID NO: 4520155 - DNA, 20 bp, Homo sapiens
gatctgggcattttcctcct

SEQ ID NO: 4520156 - DNA, 16 bp, Homo sapiens
gatctggggtgggagt

SEQ ID NO: 4520157 - DNA, 15 bp, Homo sapiens
gatctgtactttgtg

SEQ ID NO: 4520158 - DNA, 16 bp, Homo sapiens
gatctgtactttgtgt

SEQ ID NO: 4520159 - DNA, 17 bp, Homo sapiens
gatctgtcacaccagcc

SEQ ID NO: 4520160 - DNA, 18 bp, Homo sapiens
gatctgtgccccatgcct

SEQ ID NO: 4520161 - DNA, 20 bp, Homo sapiens
gatctgtgctttccagctca

SEQ ID NO: 4520162 - DNA, 13 bp, Homo sapiens
gatctgttttgaa

SEQ ID NO: 4520163 - DNA, 17 bp, Homo sapiens
gatctgttttgaaggca

SEQ ID NO: 4520164 - DNA, 15 bp, Homo sapiens
gatcttaatataaat

SEQ ID NO: 4520165 - DNA, 19 bp, Homo sapiens
gatcttacagaaaatacca

SEQ ID NO: 4520166 - DNA, 14 bp, Homo sapiens
gatcttcactgtat

SEQ ID NO: 4520167 - DNA, 19 bp, Homo sapiens
gatcttcactgtatatgta

SEQ ID NO: 4520168 - DNA, 15 bp, Homo sapiens
gatcttcccacagga

SEQ ID NO: 4520169 - DNA, 17 bp, Homo sapiens
gatcttcccacaggagg

SEQ ID NO: 4520170 - DNA, 15 bp, Homo sapiens
gatcttgcagaagtt

SEQ ID NO: 4520171 - DNA, 18 bp, Homo sapiens
gatctttctttccaaaac

SEQ ID NO: 4520172 - DNA, 13 bp, Homo sapiens
gatctttgactga

SEQ ID NO: 4520173 - DNA, 22 bp, Homo sapiens
gatctttgagcccattcttctg

SEQ ID NO: 4520174 - DNA, 18 bp, Homo sapiens
gatctttgtttaaatgcc

SEQ ID NO: 4520175 - DNA, 20 bp, Homo sapiens
gatgaaaaaaagggaaaaca

SEQ ID NO: 4520176 - DNA, 22 bp, Homo sapiens
gatgaaaaaaagggaaaacaaa

SEQ ID NO: 4520177 - DNA, 21 bp, Homo sapiens
gatgaaaatatcagcttttct

SEQ ID NO: 4520178 - DNA, 13 bp, Homo sapiens
gatgaaataaaat

SEQ ID NO: 4520179 - DNA, 14 bp, Homo sapiens
gatgaaataaaata

SEQ ID NO: 4520180 - DNA, 13 bp, Homo sapiens
gatgaacaatgta

SEQ ID NO: 4520181 - DNA, 20 bp, Homo sapiens
gatgaagtcacccctttctg

SEQ ID NO: 4520182 - DNA, 15 bp, Homo sapiens
gatgaatgcagatta

SEQ ID NO: 4520183 - DNA, 22 bp, Homo sapiens
gatgaatgtcagttgttattta

SEQ ID NO: 4520184 - DNA, 17 bp, Homo sapiens
gatgacaccctggcctg

SEQ ID NO: 4520185 - DNA, 17 bp, Homo sapiens
gatgacaggctctcctg

SEQ ID NO: 4520186 - DNA, 20 bp, Homo sapiens
gatgacaggctctcctggct

SEQ ID NO: 4520187 - DNA, 17 bp, Homo sapiens
gatgaccatactcagac

SEQ ID NO: 4520188 - DNA, 14 bp, Homo sapiens
gatgagaacaagct

SEQ ID NO: 4520189 - DNA, 15 bp, Homo sapiens
gatgagaacaagcta

SEQ ID NO: 4520190 - DNA, 21 bp, Homo sapiens
gatgagacagacattcacctg

SEQ ID NO: 4520191 - DNA, 20 bp, Homo sapiens
gatgagcacatctctctgcc

SEQ ID NO: 4520192 - DNA, 13 bp, Homo sapiens
gatgagcaggagc

SEQ ID NO: 4520193 - DNA, 14 bp, Homo sapiens
gatgagcaggagct

SEQ ID NO: 4520194 - DNA, 18 bp, Homo sapiens
gatgagctgtgcgctgct

SEQ ID NO: 4520195 - DNA, 16 bp, Homo sapiens
gatgaggacagagggc

SEQ ID NO: 4520196 - DNA, 22 bp, Homo sapiens
gatgaggagtaaaattcagttt

SEQ ID NO: 4520197 - DNA, 16 bp, Homo sapiens
gatgaggtattttttc

SEQ ID NO: 4520198 - DNA, 19 bp, Homo sapiens
gatgagtaaactgaggccc

SEQ ID NO: 4520199 - DNA, 21 bp, Homo sapiens
gatgagtgggaggcgtgcccc

SEQ ID NO: 4520200 - DNA, 22 bp, Homo sapiens
gatgagtgggaggcgtgccccc

SEQ ID NO: 4520201 - DNA, 18 bp, Homo sapiens
gatgagttaactgtgaaa

SEQ ID NO: 4520202 - DNA, 14 bp, Homo sapiens
gatgatatacacag

SEQ ID NO: 4520203 - DNA, 18 bp, Homo sapiens
gatgatcaatcctttatt

SEQ ID NO: 4520204 - DNA, 22 bp, Homo sapiens
gatgatctctccacggtagcac

SEQ ID NO: 4520205 - DNA, 22 bp, Homo sapiens
gatgatgacaggtcagcagtat

SEQ ID NO: 4520206 - DNA, 17 bp, Homo sapiens
gatgatgatgatgatga

SEQ ID NO: 4520207 - DNA, 12 bp, Homo sapiens
gatgattaaatt

SEQ ID NO: 4520208 - DNA, 13 bp, Homo sapiens
gatgattcaagcc

SEQ ID NO: 4520209 - DNA, 13 bp, Homo sapiens
gatgattgcttga

SEQ ID NO: 4520210 - DNA, 17 bp, Homo sapiens
gatgatttaagtataca

SEQ ID NO: 4520211 - DNA, 14 bp, Homo sapiens
gatgattttaatat

SEQ ID NO: 4520212 - DNA, 18 bp, Homo sapiens
gatgattttttgaaagtt

SEQ ID NO: 4520213 - DNA, 18 bp, Homo sapiens
gatgcagctactggaatg

SEQ ID NO: 4520214 - DNA, 22 bp, Homo sapiens
gatgcaggcacttattgtaaat

SEQ ID NO: 4520215 - DNA, 21 bp, Homo sapiens
gatgcagtctcctctttaaaa

SEQ ID NO: 4520216 - DNA, 19 bp, Homo sapiens
gatgcatcacactcaagga

SEQ ID NO: 4520217 - DNA, 19 bp, Homo sapiens
gatgcatcgggaaagaaga

SEQ ID NO: 4520218 - DNA, 17 bp, Homo sapiens
gatgcatgtcttttaaa

SEQ ID NO: 4520219 - DNA, 22 bp, Homo sapiens
gatgcatgtcttttaaaatgca

SEQ ID NO: 4520220 - DNA, 18 bp, Homo sapiens
gatgcatttcaaatgtta

SEQ ID NO: 4520221 - DNA, 13 bp, Homo sapiens
gatgcatttccat

SEQ ID NO: 4520222 - DNA, 19 bp, Homo sapiens
gatgccaaaaaaaaataca

SEQ ID NO: 4520223 - DNA, 18 bp, Homo sapiens
gatgccacttctcactca

SEQ ID NO: 4520224 - DNA, 13 bp, Homo sapiens
gatgccaggtgca

SEQ ID NO: 4520225 - DNA, 22 bp, Homo sapiens
gatgccatgagccgcccaaggc

SEQ ID NO: 4520226 - DNA, 17 bp, Homo sapiens
gatgcccattcctgcct

SEQ ID NO: 4520227 - DNA, 19 bp, Homo sapiens
gatgcccattcctgcctgg

SEQ ID NO: 4520228 - DNA, 22 bp, Homo sapiens
gatgcccattcctgcctggtcc

SEQ ID NO: 4520229 - DNA, 12 bp, Homo sapiens
gatgccccagag

SEQ ID NO: 4520230 - DNA, 16 bp, Homo sapiens
gatgccccagagctgt

SEQ ID NO: 4520231 - DNA, 16 bp, Homo sapiens
gatgcctggtgagcag

SEQ ID NO: 4520232 - DNA, 20 bp, Homo sapiens
gatgcctgttaatttataat

SEQ ID NO: 4520233 - DNA, 13 bp, Homo sapiens
gatgctctttaaa

SEQ ID NO: 4520234 - DNA, 14 bp, Homo sapiens
gatgctgggctggg

SEQ ID NO: 4520235 - DNA, 20 bp, Homo sapiens
gatgctgggctgggccctct

SEQ ID NO: 4520236 - DNA, 15 bp, Homo sapiens
gatgctggtggagga

SEQ ID NO: 4520237 - DNA, 20 bp, Homo sapiens
gatgctggtggaggaagggc

SEQ ID NO: 4520238 - DNA, 22 bp, Homo sapiens
gatgctggtggaggaagggctg

SEQ ID NO: 4520239 - DNA, 16 bp, Homo sapiens
gatgctgtgctatgaa

SEQ ID NO: 4520240 - DNA, 20 bp, Homo sapiens
gatgcttggagcaatcagaa

SEQ ID NO: 4520241 - DNA, 14 bp, Homo sapiens
gatggaaactgcca

SEQ ID NO: 4520242 - DNA, 17 bp, Homo sapiens
gatggaattaaatgtgg

SEQ ID NO: 4520243 - DNA, 19 bp, Homo sapiens
gatggacacgagccacaag

SEQ ID NO: 4520244 - DNA, 14 bp, Homo sapiens
gatggagaggacag

SEQ ID NO: 4520245 - DNA, 15 bp, Homo sapiens
gatggagaggcggcc

SEQ ID NO: 4520246 - DNA, 21 bp, Homo sapiens
gatggagaggcggcctcgtgc

SEQ ID NO: 4520247 - DNA, 16 bp, Homo sapiens
gatggagtgttttagt

SEQ ID NO: 4520248 - DNA, 22 bp, Homo sapiens
gatggagtttctctagaagctc

SEQ ID NO: 4520249 - DNA, 22 bp, Homo sapiens
gatggccatgctcaacccccct

SEQ ID NO: 4520250 - DNA, 21 bp, Homo sapiens
gatggccgcagggctgtgcac

SEQ ID NO: 4520251 - DNA, 20 bp, Homo sapiens
gatggcctttccttccctct

SEQ ID NO: 4520252 - DNA, 16 bp, Homo sapiens
gatggcctttggaccc

SEQ ID NO: 4520253 - DNA, 22 bp, Homo sapiens
gatggcctttggacccagggcc

SEQ ID NO: 4520254 - DNA, 14 bp, Homo sapiens
gatggcttatgtca

SEQ ID NO: 4520255 - DNA, 17 bp, Homo sapiens
gatgggaacaaggaagg

SEQ ID NO: 4520256 - DNA, 20 bp, Homo sapiens
gatgggaacaaggaaggaaa

SEQ ID NO: 4520257 - DNA, 16 bp, Homo sapiens
gatgggaataaaagta

SEQ ID NO: 4520258 - DNA, 14 bp, Homo sapiens
gatgggcagcccaa

SEQ ID NO: 4520259 - DNA, 23 bp, Homo sapiens
gatgggcagcccaacagcacttt

SEQ ID NO: 4520260 - DNA, 18 bp, Homo sapiens
gatgggccaccgccttgc

SEQ ID NO: 4520261 - DNA, 11 bp, Homo sapiens
gatggggaggg

SEQ ID NO: 4520262 - DNA, 13 bp, Homo sapiens
gatgggttcttag

SEQ ID NO: 4520263 - DNA, 14 bp, Homo sapiens
gatggtaagagaaa

SEQ ID NO: 4520264 - DNA, 15 bp, Homo sapiens
gatggtaagagaaaa

SEQ ID NO: 4520265 - DNA, 18 bp, Homo sapiens
gatggtcggatctcacag

SEQ ID NO: 4520266 - DNA, 16 bp, Homo sapiens
gatggtcttacagcag

SEQ ID NO: 4520267 - DNA, 16 bp, Homo sapiens
gatggtgctgcccagg

SEQ ID NO: 4520268 - DNA, 14 bp, Homo sapiens
gatggtgtcctgag

SEQ ID NO: 4520269 - DNA, 23 bp, Homo sapiens
gatggtgtcctgaggcctccaag

SEQ ID NO: 4520270 - DNA, 17 bp, Homo sapiens
gatggtgtgccttccag

SEQ ID NO: 4520271 - DNA, 16 bp, Homo sapiens
gatggttttaaacttt

SEQ ID NO: 4520272 - DNA, 17 bp, Homo sapiens
gatggttttaaactttc

SEQ ID NO: 4520273 - DNA, 13 bp, Homo sapiens
gatgtaatgtttt

SEQ ID NO: 4520274 - DNA, 19 bp, Homo sapiens
gatgtacagtctgtcatga

SEQ ID NO: 4520275 - DNA, 22 bp, Homo sapiens
gatgtacataactcctgtccct

SEQ ID NO: 4520276 - DNA, 22 bp, Homo sapiens
gatgtacatagttatttttctc

SEQ ID NO: 4520277 - DNA, 22 bp, Homo sapiens
gatgtacatttaataatatcaa

SEQ ID NO: 4520278 - DNA, 19 bp, Homo sapiens
gatgtagggtaaggtgcct

SEQ ID NO: 4520279 - DNA, 16 bp, Homo sapiens
gatgtatttttgatgt

SEQ ID NO: 4520280 - DNA, 19 bp, Homo sapiens
gatgtatttttgatgtata

SEQ ID NO: 4520281 - DNA, 22 bp, Homo sapiens
gatgtatttttgatgtatatat

SEQ ID NO: 4520282 - DNA, 13 bp, Homo sapiens
gatgtctgtagca

SEQ ID NO: 4520283 - DNA, 16 bp, Homo sapiens
gatgtcttatttttag

SEQ ID NO: 4520284 - DNA, 12 bp, Homo sapiens
gatgtcttccct

SEQ ID NO: 4520285 - DNA, 14 bp, Homo sapiens
gatgtcttctgcct

SEQ ID NO: 4520286 - DNA, 20 bp, Homo sapiens
gatgtcttctgcctgttata

SEQ ID NO: 4520287 - DNA, 18 bp, Homo sapiens
gatgtcttttatagtgga

SEQ ID NO: 4520288 - DNA, 14 bp, Homo sapiens
gatgtgaacacatc

SEQ ID NO: 4520289 - DNA, 16 bp, Homo sapiens
gatgtgaacacatcag

SEQ ID NO: 4520290 - DNA, 14 bp, Homo sapiens
gatgtgcacccatg

SEQ ID NO: 4520291 - DNA, 15 bp, Homo sapiens
gatgtgctcagccaa

SEQ ID NO: 4520292 - DNA, 21 bp, Homo sapiens
gatgtgctggaggggtggccc

SEQ ID NO: 4520293 - DNA, 21 bp, Homo sapiens
gatgtggaggaagagccacct

SEQ ID NO: 4520294 - DNA, 20 bp, Homo sapiens
gatgtggccctggcctgctg

SEQ ID NO: 4520295 - DNA, 12 bp, Homo sapiens
gatgtgtaaaca

SEQ ID NO: 4520296 - DNA, 17 bp, Homo sapiens
gatgtgttttgttttgg

SEQ ID NO: 4520297 - DNA, 21 bp, Homo sapiens
gatgtgttttgttttggactc

SEQ ID NO: 4520298 - DNA, 15 bp, Homo sapiens
gatgttagacttgct

SEQ ID NO: 4520299 - DNA, 17 bp, Homo sapiens
gatgttccacctgccac

SEQ ID NO: 4520300 - DNA, 12 bp, Homo sapiens
gatgttcctttt

SEQ ID NO: 4520301 - DNA, 22 bp, Homo sapiens
gatgttctattttttgttttgt

SEQ ID NO: 4520302 - DNA, 15 bp, Homo sapiens
gatgttctttccatg

SEQ ID NO: 4520303 - DNA, 13 bp, Homo sapiens
gatgttgaacttt

SEQ ID NO: 4520304 - DNA, 14 bp, Homo sapiens
gatgttgaactttt

SEQ ID NO: 4520305 - DNA, 22 bp, Homo sapiens
gatgtttcttgccttttgttaa

SEQ ID NO: 4520306 - DNA, 16 bp, Homo sapiens
gatgtttgagcagtgg

SEQ ID NO: 4520307 - DNA, 14 bp, Homo sapiens
gatgtttgtggcct

SEQ ID NO: 4520308 - DNA, 18 bp, Homo sapiens
gatgtttgtggcctcaga

SEQ ID NO: 4520309 - DNA, 22 bp, Homo sapiens
gatgtttgttttcaaaatactt

SEQ ID NO: 4520310 - DNA, 22 bp, Homo sapiens
gattaaaaggtatactttagta

SEQ ID NO: 4520311 - DNA, 15 bp, Homo sapiens
gattaaaccttttta

SEQ ID NO: 4520312 - DNA, 20 bp, Homo sapiens
gattaaatgtgtcattggaa

SEQ ID NO: 4520313 - DNA, 19 bp, Homo sapiens
gattaaattacagctttta

SEQ ID NO: 4520314 - DNA, 20 bp, Homo sapiens
gattaaattttagtacattt

SEQ ID NO: 4520315 - DNA, 17 bp, Homo sapiens
gattaacataaagaaaa

SEQ ID NO: 4520316 - DNA, 21 bp, Homo sapiens
gattaactttcaaaagcaaac

SEQ ID NO: 4520317 - DNA, 13 bp, Homo sapiens
gattaagaaacct

SEQ ID NO: 4520318 - DNA, 15 bp, Homo sapiens
gattaagaaaggaag

SEQ ID NO: 4520319 - DNA, 16 bp, Homo sapiens
gattaagaaaggaagt

SEQ ID NO: 4520320 - DNA, 23 bp, Homo sapiens
gattaagcttttcattttaatat

SEQ ID NO: 4520321 - DNA, 20 bp, Homo sapiens
gattaaggcgtgagccactg

SEQ ID NO: 4520322 - DNA, 15 bp, Homo sapiens
gattaagggacattt

SEQ ID NO: 4520323 - DNA, 13 bp, Homo sapiens
gattaataaaata

SEQ ID NO: 4520324 - DNA, 20 bp, Homo sapiens
gattaataaaatatctattt

SEQ ID NO: 4520325 - DNA, 20 bp, Homo sapiens
gattacaaatcagaagtcat

SEQ ID NO: 4520326 - DNA, 20 bp, Homo sapiens
gattacaggaatgaagaact

SEQ ID NO: 4520327 - DNA, 14 bp, Homo sapiens
gattacctcctgag

SEQ ID NO: 4520328 - DNA, 20 bp, Homo sapiens
gattacctcctgtgtggaag

SEQ ID NO: 4520329 - DNA, 14 bp, Homo sapiens
gattacctgccaat

SEQ ID NO: 4520330 - DNA, 17 bp, Homo sapiens
gattactgaattgtatc

SEQ ID NO: 4520331 - DNA, 15 bp, Homo sapiens
gattactgatgtgat

SEQ ID NO: 4520332 - DNA, 20 bp, Homo sapiens
gattacttctctataaaaaa

SEQ ID NO: 4520333 - DNA, 19 bp, Homo sapiens
gattagcaagttacagtga

SEQ ID NO: 4520334 - DNA, 14 bp, Homo sapiens
gattataatcagaa

SEQ ID NO: 4520335 - DNA, 15 bp, Homo sapiens
gattatattcacaga

SEQ ID NO: 4520336 - DNA, 22 bp, Homo sapiens
gattatctctttgatctacttg

SEQ ID NO: 4520337 - DNA, 13 bp, Homo sapiens
gattatgaaatgt

SEQ ID NO: 4520338 - DNA, 15 bp, Homo sapiens
gattatggttttgtg

SEQ ID NO: 4520339 - DNA, 12 bp, Homo sapiens
gattatgtgact

SEQ ID NO: 4520340 - DNA, 19 bp, Homo sapiens
gattattaacgatgtccaa

SEQ ID NO: 4520341 - DNA, 20 bp, Homo sapiens
gattattagccaggtaatgt

SEQ ID NO: 4520342 - DNA, 13 bp, Homo sapiens
gattattataaac

SEQ ID NO: 4520343 - DNA, 16 bp, Homo sapiens
gattattataaactat

SEQ ID NO: 4520344 - DNA, 17 bp, Homo sapiens
gattattataaactata

SEQ ID NO: 4520345 - DNA, 22 bp, Homo sapiens
gattattataaactataaactt

SEQ ID NO: 4520346 - DNA, 13 bp, Homo sapiens
gattattcagtgt

SEQ ID NO: 4520347 - DNA, 18 bp, Homo sapiens
gattatttacaagaagaa

SEQ ID NO: 4520348 - DNA, 18 bp, Homo sapiens
gattatttgggagggaaa

SEQ ID NO: 4520349 - DNA, 16 bp, Homo sapiens
gattattttagctaaa

SEQ ID NO: 4520350 - DNA, 15 bp, Homo sapiens
gattcaaaatattta

SEQ ID NO: 4520351 - DNA, 18 bp, Homo sapiens
gattcaaaatatttaaaa

SEQ ID NO: 4520352 - DNA, 23 bp, Homo sapiens
gattcaaaatatttaaaaatgtc

SEQ ID NO: 4520353 - DNA, 16 bp, Homo sapiens
gattcaaacccaggct

SEQ ID NO: 4520354 - DNA, 18 bp, Homo sapiens
gattcaaatgttttaaag

SEQ ID NO: 4520355 - DNA, 10 bp, Homo sapiens
gattcaaatt

SEQ ID NO: 4520356 - DNA, 14 bp, Homo sapiens
gattcaaatttatt

SEQ ID NO: 4520357 - DNA, 15 bp, Homo sapiens
gattcaacagggaag

SEQ ID NO: 4520358 - DNA, 19 bp, Homo sapiens
gattcaaccaaccaaggac

SEQ ID NO: 4520359 - DNA, 21 bp, Homo sapiens
gattcaatattgaatttttcc

SEQ ID NO: 4520360 - DNA, 18 bp, Homo sapiens
gattcaatctgtaaactg

SEQ ID NO: 4520361 - DNA, 13 bp, Homo sapiens
gattcacctgtaa

SEQ ID NO: 4520362 - DNA, 14 bp, Homo sapiens
gattcacctgtaaa

SEQ ID NO: 4520363 - DNA, 15 bp, Homo sapiens
gattcacctgtaaaa

SEQ ID NO: 4520364 - DNA, 16 bp, Homo sapiens
gattcacctgtaaaac

SEQ ID NO: 4520365 - DNA, 17 bp, Homo sapiens
gcacccgtatctgccct

SEQ ID NO: 4520366 - DNA, 19 bp, Homo sapiens
gcaccctggagagtgcaca

SEQ ID NO: 4520367 - DNA, 15 bp, Homo sapiens
gcaccctgtcctgca

SEQ ID NO: 4520368 - DNA, 21 bp, Homo sapiens
gcaccctgtcctgcacaccct

SEQ ID NO: 4520369 - DNA, 16 bp, Homo sapiens
gcacccttccacagct

SEQ ID NO: 4520370 - DNA, 19 bp, Homo sapiens
gcacccttccacagctggc

SEQ ID NO: 4520371 - DNA, 15 bp, Homo sapiens
gcaccgcctgaaggc

SEQ ID NO: 4520372 - DNA, 16 bp, Homo sapiens
gcaccggggcctgggc

SEQ ID NO: 4520373 - DNA, 19 bp, Homo sapiens
gcaccggggcctgggcagg

SEQ ID NO: 4520374 - DNA, 22 bp, Homo sapiens
gcaccgtgatggagaggacaga

SEQ ID NO: 4520375 - DNA, 17 bp, Homo sapiens
gcacctaaagaaaaaca

SEQ ID NO: 4520376 - DNA, 18 bp, Homo sapiens
gcacctatctcagccata

SEQ ID NO: 4520377 - DNA, 14 bp, Homo sapiens
gcacctatttcttt

SEQ ID NO: 4520378 - DNA, 18 bp, Homo sapiens
gcacctccacatcctcca

SEQ ID NO: 4520379 - DNA, 14 bp, Homo sapiens
gcacctccccaaag

SEQ ID NO: 4520380 - DNA, 18 bp, Homo sapiens
gcacctcctaccctccca

SEQ ID NO: 4520381 - DNA, 21 bp, Homo sapiens
gcacctcggggacaccagagc

SEQ ID NO: 4520382 - DNA, 11 bp, Homo sapiens
gcacctgcccc

SEQ ID NO: 4520383 - DNA, 15 bp, Homo sapiens
gcacctgcttccacc

SEQ ID NO: 4520384 - DNA, 16 bp, Homo sapiens
gcaccttcagggctga

SEQ ID NO: 4520385 - DNA, 16 bp, Homo sapiens
gcaccttctttctgga

SEQ ID NO: 4520386 - DNA, 18 bp, Homo sapiens
gcaccttctttctggact

SEQ ID NO: 4520387 - DNA, 19 bp, Homo sapiens
gcaccttctttctggactg

SEQ ID NO: 4520388 - DNA, 22 bp, Homo sapiens
gcaccttttcatggtctctgca

SEQ ID NO: 4520389 - DNA, 16 bp, Homo sapiens
gcacgactgcgggagc

SEQ ID NO: 4520390 - DNA, 21 bp, Homo sapiens
gcacgcacccgtatctgccct

SEQ ID NO: 4520391 - DNA, 20 bp, Homo sapiens
gcacgcggagtgagtttttt

SEQ ID NO: 4520392 - DNA, 19 bp, Homo sapiens
gcacggtcccccaggaggc

SEQ ID NO: 4520393 - DNA, 14 bp, Homo sapiens
gcacgtattgctgt

SEQ ID NO: 4520394 - DNA, 15 bp, Homo sapiens
gcacgtattgctgtg

SEQ ID NO: 4520395 - DNA, 15 bp, Homo sapiens
gcacgtggagagctg

SEQ ID NO: 4520396 - DNA, 16 bp, Homo sapiens
gcacgtggagagctgg

SEQ ID NO: 4520397 - DNA, 20 bp, Homo sapiens
gcacgtggagagctggtgcc

SEQ ID NO: 4520398 - DNA, 18 bp, Homo sapiens
gcacgtggagatagtgcc

SEQ ID NO: 4520399 - DNA, 20 bp, Homo sapiens
gcacgtggagatagtgccag

SEQ ID NO: 4520400 - DNA, 17 bp, Homo sapiens
gcacgtttaaagttctg

SEQ ID NO: 4520401 - DNA, 19 bp, Homo sapiens
gcacgtttaaagttctgtg

SEQ ID NO: 4520402 - DNA, 14 bp, Homo sapiens
gcactaaatatgaa

SEQ ID NO: 4520403 - DNA, 15 bp, Homo sapiens
gcactaaatatgaac

SEQ ID NO: 4520404 - DNA, 19 bp, Homo sapiens
gcactaaccaatgcctttt

SEQ ID NO: 4520405 - DNA, 12 bp, Homo sapiens
gcactacattca

SEQ ID NO: 4520406 - DNA, 17 bp, Homo sapiens
gcactactctaccatgg

SEQ ID NO: 4520407 - DNA, 22 bp, Homo sapiens
gcactactctaccatggttctg

SEQ ID NO: 4520408 - DNA, 14 bp, Homo sapiens
gcactactgggtgt

SEQ ID NO: 4520409 - DNA, 17 bp, Homo sapiens
gcactactgggtgtcat

SEQ ID NO: 4520410 - DNA, 20 bp, Homo sapiens
gcactactgtactccagcca

SEQ ID NO: 4520411 - DNA, 18 bp, Homo sapiens
gcactagaaattgggcag

SEQ ID NO: 4520412 - DNA, 18 bp, Homo sapiens
gcactagagaatgcacag

SEQ ID NO: 4520413 - DNA, 18 bp, Homo sapiens
gcactatatacatcacgt

SEQ ID NO: 4520414 - DNA, 13 bp, Homo sapiens
gcactcagaaaat

SEQ ID NO: 4520415 - DNA, 23 bp, Homo sapiens
gcactcagaagttgtgctaaacc

SEQ ID NO: 4520416 - DNA, 16 bp, Homo sapiens
gcactcagtgagcctc

SEQ ID NO: 4520417 - DNA, 13 bp, Homo sapiens
gcactccagcctg

SEQ ID NO: 4520418 - DNA, 15 bp, Homo sapiens
gcactccagcctgag

SEQ ID NO: 4520419 - DNA, 14 bp, Homo sapiens
gcactccagcctgg

SEQ ID NO: 4520420 - DNA, 15 bp, Homo sapiens
gcactccagcctggg

SEQ ID NO: 4520421 - DNA, 17 bp, Homo sapiens
gcactccagcctggggg

SEQ ID NO: 4520422 - DNA, 16 bp, Homo sapiens
gcactccagcctgggt

SEQ ID NO: 4520423 - DNA, 17 bp, Homo sapiens
gcactcggggtccctgg

SEQ ID NO: 4520424 - DNA, 19 bp, Homo sapiens
gcactcggggtccctggag

SEQ ID NO: 4520425 - DNA, 14 bp, Homo sapiens
gcactctgccccca

SEQ ID NO: 4520426 - DNA, 18 bp, Homo sapiens
gcactctgggtctggcca

SEQ ID NO: 4520427 - DNA, 19 bp, Homo sapiens
gcactctgggtctggccag

SEQ ID NO: 4520428 - DNA, 20 bp, Homo sapiens
gcactctgtagcaaatttgt

SEQ ID NO: 4520429 - DNA, 14 bp, Homo sapiens
gcactgaactgctt

SEQ ID NO: 4520430 - DNA, 15 bp, Homo sapiens
gcactgaagagctct

SEQ ID NO: 4520431 - DNA, 16 bp, Homo sapiens
gcactgaagagctctt

SEQ ID NO: 4520432 - DNA, 18 bp, Homo sapiens
gcactgaagagctcttgg

SEQ ID NO: 4520433 - DNA, 19 bp, Homo sapiens
gcactgacggactcatgat

SEQ ID NO: 4520434 - DNA, 19 bp, Homo sapiens
gcactgagctcacatggga

SEQ ID NO: 4520435 - DNA, 23 bp, Homo sapiens
gcactgagctcacatgggactgg

SEQ ID NO: 4520436 - DNA, 19 bp, Homo sapiens
gcactgatggaaaatacca

SEQ ID NO: 4520437 - DNA, 20 bp, Homo sapiens
gcactgatgttgtgttttta

SEQ ID NO: 4520438 - DNA, 15 bp, Homo sapiens
gcactgcatgggaaa

SEQ ID NO: 4520439 - DNA, 16 bp, Homo sapiens
gcactgcatgggaaat

SEQ ID NO: 4520440 - DNA, 18 bp, Homo sapiens
gcactgcatgtcagagca

SEQ ID NO: 4520441 - DNA, 17 bp, Homo sapiens
gcactgcattcctgtgc

SEQ ID NO: 4520442 - DNA, 22 bp, Homo sapiens
gcactgcattcctgtgccctag

SEQ ID NO: 4520443 - DNA, 14 bp, Homo sapiens
gcactgccagccca

SEQ ID NO: 4520444 - DNA, 17 bp, Homo sapiens
gcactgcttgaggaaaa

SEQ ID NO: 4520445 - DNA, 17 bp, Homo sapiens
gcactggcaaacagggc

SEQ ID NO: 4520446 - DNA, 20 bp, Homo sapiens
gcactggcaaacagggcctc

SEQ ID NO: 4520447 - DNA, 23 bp, Homo sapiens
gcactggcaaacagggcctctgc

SEQ ID NO: 4520448 - DNA, 16 bp, Homo sapiens
gcactggccttctgat

SEQ ID NO: 4520449 - DNA, 15 bp, Homo sapiens
gcactggcgaggaga

SEQ ID NO: 4520450 - DNA, 18 bp, Homo sapiens
gcactggggcaggggccg

SEQ ID NO: 4520451 - DNA, 23 bp, Homo sapiens
gcactggtgaactgagctgggca

SEQ ID NO: 4520452 - DNA, 15 bp, Homo sapiens
gcactggtttgtttc

SEQ ID NO: 4520453 - DNA, 17 bp, Homo sapiens
gcactgtaaatatccct

SEQ ID NO: 4520454 - DNA, 18 bp, Homo sapiens
gcactgtaaggtgcttgc

SEQ ID NO: 4520455 - DNA, 22 bp, Homo sapiens
gcactgtaaggtgcttgctccc

SEQ ID NO: 4520456 - DNA, 22 bp, Homo sapiens
gcactgtgaacctgggcactcc

SEQ ID NO: 4520457 - DNA, 17 bp, Homo sapiens
gcactgtgatacagttt

SEQ ID NO: 4520458 - DNA, 23 bp, Homo sapiens
gcactgtggtcgtcaactttcct

SEQ ID NO: 4520459 - DNA, 21 bp, Homo sapiens
gcactgttacaagaggccatt

SEQ ID NO: 4520460 - DNA, 19 bp, Homo sapiens
gcacttagacctgccagcc

SEQ ID NO: 4520461 - DNA, 21 bp, Homo sapiens
gcacttagcccaagaggtctg

SEQ ID NO: 4520462 - DNA, 18 bp, Homo sapiens
gcacttcaaattcaaata

SEQ ID NO: 4520463 - DNA, 14 bp, Homo sapiens
gcacttcccaggat

SEQ ID NO: 4520464 - DNA, 17 bp, Homo sapiens
gcacttctatttagcca

SEQ ID NO: 4520465 - DNA, 23 bp, Homo sapiens
gcacttgagaaccagtctcctca

SEQ ID NO: 4520466 - DNA, 23 bp, Homo sapiens
gcacttgtctcattttaatgtaa

SEQ ID NO: 4520467 - DNA, 15 bp, Homo sapiens
gcactttgagaggct

SEQ ID NO: 4520468 - DNA, 16 bp, Homo sapiens
gcactttgggaggcag

SEQ ID NO: 4520469 - DNA, 17 bp, Homo sapiens
gcactttgggaggcagg

SEQ ID NO: 4520470 - DNA, 13 bp, Homo sapiens
gcactttgtaaat

SEQ ID NO: 4520471 - DNA, 15 bp, Homo sapiens
gcactttgtaaattc

SEQ ID NO: 4520472 - DNA, 16 bp, Homo sapiens
gcactttgtttagaaa

SEQ ID NO: 4520473 - DNA, 17 bp, Homo sapiens
gcactttgtttagaaaa

SEQ ID NO: 4520474 - DNA, 19 bp, Homo sapiens
gcacttttattttcattgt

SEQ ID NO: 4520475 - DNA, 18 bp, Homo sapiens
gcacttttttgtttgaat

SEQ ID NO: 4520476 - DNA, 21 bp, Homo sapiens
gcacttttttgtttgaatgtt

SEQ ID NO: 4520477 - DNA, 16 bp, Homo sapiens
gcagaaaagcacctgc

SEQ ID NO: 4520478 - DNA, 21 bp, Homo sapiens
gcagaaaagcacctgccgacc

SEQ ID NO: 4520479 - DNA, 14 bp, Homo sapiens
gcagaaaatattta

SEQ ID NO: 4520480 - DNA, 19 bp, Homo sapiens
gcagaaagcatccctcacc

SEQ ID NO: 4520481 - DNA, 12 bp, Homo sapiens
gcagaaatgatt

SEQ ID NO: 4520482 - DNA, 13 bp, Homo sapiens
gcagaacactaac

SEQ ID NO: 4520483 - DNA, 20 bp, Homo sapiens
gcagaacactgcagtcagat

SEQ ID NO: 4520484 - DNA, 21 bp, Homo sapiens
gcagaacgtattggtccagct

SEQ ID NO: 4520485 - DNA, 19 bp, Homo sapiens
gcaatacattaaaataact

SEQ ID NO: 4520486 - DNA, 18 bp, Homo sapiens
gcaatagattactgatgt

SEQ ID NO: 4520487 - DNA, 19 bp, Homo sapiens
gcaatagattactgatgtg

SEQ ID NO: 4520488 - DNA, 20 bp, Homo sapiens
gcaatagattactgatgtga

SEQ ID NO: 4520489 - DNA, 18 bp, Homo sapiens
gcaatagcagttataaca

SEQ ID NO: 4520490 - DNA, 19 bp, Homo sapiens
gcaatatcttcgttagtaa

SEQ ID NO: 4520491 - DNA, 13 bp, Homo sapiens
gcaatcattttat

SEQ ID NO: 4520492 - DNA, 21 bp, Homo sapiens
gcaatccaggctgttctcagc

SEQ ID NO: 4520493 - DNA, 21 bp, Homo sapiens
gcaatcctcctgcctcagcct

SEQ ID NO: 4520494 - DNA, 16 bp, Homo sapiens
gcaatcgttctgctgg

SEQ ID NO: 4520495 - DNA, 22 bp, Homo sapiens
gcaatcgttctgctggccaaga

SEQ ID NO: 4520496 - DNA, 14 bp, Homo sapiens
gcaatcttctactt

SEQ ID NO: 4520497 - DNA, 13 bp, Homo sapiens
gcaatctttgaaa

SEQ ID NO: 4520498 - DNA, 20 bp, Homo sapiens
gcaatgaaaattttaagaag

SEQ ID NO: 4520499 - DNA, 23 bp, Homo sapiens
gcaatgacataaccaatttgtaa

SEQ ID NO: 4520500 - DNA, 17 bp, Homo sapiens
gcaatgataatgagcag

SEQ ID NO: 4520501 - DNA, 18 bp, Homo sapiens
gcaatgccatcatctcct

SEQ ID NO: 4520502 - DNA, 19 bp, Homo sapiens
gcaatgccatcatctcctg

SEQ ID NO: 4520503 - DNA, 16 bp, Homo sapiens
gcaatggccagagcct

SEQ ID NO: 4520504 - DNA, 16 bp, Homo sapiens
gcaatgggtaagggag

SEQ ID NO: 4520505 - DNA, 17 bp, Homo sapiens
gcaatgtaagcatactt

SEQ ID NO: 4520506 - DNA, 16 bp, Homo sapiens
gcaatgtggcaaactg

SEQ ID NO: 4520507 - DNA, 22 bp, Homo sapiens
gcaatgtggtgacacctccccc

SEQ ID NO: 4520508 - DNA, 17 bp, Homo sapiens
gcaattagtctgaaact

SEQ ID NO: 4520509 - DNA, 23 bp, Homo sapiens
gcaattctcctgcctcagcctcc

SEQ ID NO: 4520510 - DNA, 13 bp, Homo sapiens
gcaattctgactg

SEQ ID NO: 4520511 - DNA, 18 bp, Homo sapiens
gcaattgaattaaattag

SEQ ID NO: 4520512 - DNA, 18 bp, Homo sapiens
gcaattggaacaaagtga

SEQ ID NO: 4520513 - DNA, 22 bp, Homo sapiens
gcaatttctgtacatttgcaat

SEQ ID NO: 4520514 - DNA, 13 bp, Homo sapiens
gcaattttagtgt

SEQ ID NO: 4520515 - DNA, 15 bp, Homo sapiens
gcaattttagtgtat

SEQ ID NO: 4520516 - DNA, 20 bp, Homo sapiens
gcaattttagtgtattaatc

SEQ ID NO: 4520517 - DNA, 23 bp, Homo sapiens
gcacaaaatgaatgaggtctggg

SEQ ID NO: 4520518 - DNA, 21 bp, Homo sapiens
gcacaaacttgtgagcatcag

SEQ ID NO: 4520519 - DNA, 15 bp, Homo sapiens
gcacaaagttctcag

SEQ ID NO: 4520520 - DNA, 22 bp, Homo sapiens
gcacaagctcaggtcctgctgc

SEQ ID NO: 4520521 - DNA, 18 bp, Homo sapiens
gcacaaggattgaaaatt

SEQ ID NO: 4520522 - DNA, 13 bp, Homo sapiens
gcacaatatttct

SEQ ID NO: 4520523 - DNA, 19 bp, Homo sapiens
gcacaatatttcttttgtt

SEQ ID NO: 4520524 - DNA, 18 bp, Homo sapiens
gcacacaattagatttct

SEQ ID NO: 4520525 - DNA, 19 bp, Homo sapiens
gcacacactgtgctttcta

SEQ ID NO: 4520526 - DNA, 13 bp, Homo sapiens
gcacacagcagcc

SEQ ID NO: 4520527 - DNA, 15 bp, Homo sapiens
gcacacagcagcccc

SEQ ID NO: 4520528 - DNA, 19 bp, Homo sapiens
gcacacagcagccccccag

SEQ ID NO: 4520529 - DNA, 20 bp, Homo sapiens
gcacacagcagccccccagc

SEQ ID NO: 4520530 - DNA, 13 bp, Homo sapiens
gcacacagctact

SEQ ID NO: 4520531 - DNA, 16 bp, Homo sapiens
gcacacagctgagcac

SEQ ID NO: 4520532 - DNA, 13 bp, Homo sapiens
gcacacaggcagc

SEQ ID NO: 4520533 - DNA, 16 bp, Homo sapiens
gcacacaggcagccag

SEQ ID NO: 4520534 - DNA, 22 bp, Homo sapiens
gcacacaggcagccagccgtgg

SEQ ID NO: 4520535 - DNA, 14 bp, Homo sapiens
gcacacagggcccg

SEQ ID NO: 4520536 - DNA, 20 bp, Homo sapiens
gcacacagggcccggccaca

SEQ ID NO: 4520537 - DNA, 13 bp, Homo sapiens
gcacacattattt

SEQ ID NO: 4520538 - DNA, 13 bp, Homo sapiens
gcacaccaaagct

SEQ ID NO: 4520539 - DNA, 14 bp, Homo sapiens
gcacactggaatat

SEQ ID NO: 4520540 - DNA, 19 bp, Homo sapiens
gcacactggctcacccagt

SEQ ID NO: 4520541 - DNA, 14 bp, Homo sapiens
gcacactttgccat

SEQ ID NO: 4520542 - DNA, 17 bp, Homo sapiens
gcacagatatactttgt

SEQ ID NO: 4520543 - DNA, 14 bp, Homo sapiens
gcacagcaagaaaa

SEQ ID NO: 4520544 - DNA, 12 bp, Homo sapiens
gcacagcaggct

SEQ ID NO: 4520545 - DNA, 17 bp, Homo sapiens
gcacagcaggctgccag

SEQ ID NO: 4520546 - DNA, 23 bp, Homo sapiens
gcacagcaggctgccagtgcctg

SEQ ID NO: 4520547 - DNA, 13 bp, Homo sapiens
gcacagcccctgg

SEQ ID NO: 4520548 - DNA, 14 bp, Homo sapiens
gcacagcccctgga

SEQ ID NO: 4520549 - DNA, 15 bp, Homo sapiens
gcacagcccctggag

SEQ ID NO: 4520550 - DNA, 16 bp, Homo sapiens
gcacagcccctggagc

SEQ ID NO: 4520551 - DNA, 11 bp, Homo sapiens
gcacagccctt

SEQ ID NO: 4520552 - DNA, 19 bp, Homo sapiens
gcacagcctggctgtggcc

SEQ ID NO: 4520553 - DNA, 15 bp, Homo sapiens
gcacagctaattcta

SEQ ID NO: 4520554 - DNA, 15 bp, Homo sapiens
gcacagcttagattt

SEQ ID NO: 4520555 - DNA, 15 bp, Homo sapiens
gcacagggcagctgg

SEQ ID NO: 4520556 - DNA, 17 bp, Homo sapiens
gcacagtggctcacgcc

SEQ ID NO: 4520557 - DNA, 18 bp, Homo sapiens
gcacagtgtaatccaggg

SEQ ID NO: 4520558 - DNA, 22 bp, Homo sapiens
gcacagtgtaatccaggggtgt

SEQ ID NO: 4520559 - DNA, 21 bp, Homo sapiens
gcacagtttagaacagaggga

SEQ ID NO: 4520560 - DNA, 17 bp, Homo sapiens
gcacagttttctgagaa

SEQ ID NO: 4520561 - DNA, 20 bp, Homo sapiens
gcacagttttctgagaaaga

SEQ ID NO: 4520562 - DNA, 16 bp, Homo sapiens
gcacatctacatgcca

SEQ ID NO: 4520563 - DNA, 13 bp, Homo sapiens
gcacatctctctg

SEQ ID NO: 4520564 - DNA, 19 bp, Homo sapiens
gcacatctctctgccctct

SEQ ID NO: 4520565 - DNA, 17 bp, Homo sapiens
gcacatgccacctggca

SEQ ID NO: 4520566 - DNA, 14 bp, Homo sapiens
gcacatgcctctgt

SEQ ID NO: 4520567 - DNA, 16 bp, Homo sapiens
gcacatggcctgagca

SEQ ID NO: 4520568 - DNA, 13 bp, Homo sapiens
gcacatgtgccac

SEQ ID NO: 4520569 - DNA, 22 bp, Homo sapiens
gcacattgggtggggctcctgg

SEQ ID NO: 4520570 - DNA, 14 bp, Homo sapiens
gcaccaaaagaagt

SEQ ID NO: 4520571 - DNA, 15 bp, Homo sapiens
gcaccaaccacagca

SEQ ID NO: 4520572 - DNA, 15 bp, Homo sapiens
gcaccaagcaggaaa

SEQ ID NO: 4520573 - DNA, 19 bp, Homo sapiens
gcaccaatcagcactctgt

SEQ ID NO: 4520574 - DNA, 18 bp, Homo sapiens
gcaccaatcttgtttata

SEQ ID NO: 4520575 - DNA, 16 bp, Homo sapiens
gcaccaattatcatct

SEQ ID NO: 4520576 - DNA, 14 bp, Homo sapiens
gcaccacaaaatat

SEQ ID NO: 4520577 - DNA, 15 bp, Homo sapiens
gcaccacaaaatata

SEQ ID NO: 4520578 - DNA, 19 bp, Homo sapiens
gcaccaccagggctccagg

SEQ ID NO: 4520579 - DNA, 20 bp, Homo sapiens
gcaccaccagggctccagga

SEQ ID NO: 4520580 - DNA, 16 bp, Homo sapiens
gcaccactgcactcca

SEQ ID NO: 4520581 - DNA, 20 bp, Homo sapiens
gcaccactgcactccagcct

SEQ ID NO: 4520582 - DNA, 22 bp, Homo sapiens
gcaccactgcactccagcctgg

SEQ ID NO: 4520583 - DNA, 14 bp, Homo sapiens
gcaccactgttctg

SEQ ID NO: 4520584 - DNA, 17 bp, Homo sapiens
gcaccagatgcaacctc

SEQ ID NO: 4520585 - DNA, 23 bp, Homo sapiens
gcaccaggcacgaacccacctgc

SEQ ID NO: 4520586 - DNA, 23 bp, Homo sapiens
gcaccagggttgaccccagagga

SEQ ID NO: 4520587 - DNA, 12 bp, Homo sapiens
gcaccagtccag

SEQ ID NO: 4520588 - DNA, 14 bp, Homo sapiens
gcaccatctgcttg

SEQ ID NO: 4520589 - DNA, 15 bp, Homo sapiens
gcaccatctgcttgg

SEQ ID NO: 4520590 - DNA, 17 bp, Homo sapiens
gcacccaaaactcaagc

SEQ ID NO: 4520591 - DNA, 19 bp, Homo sapiens
gcacccaccgtggaggagg

SEQ ID NO: 4520592 - DNA, 11 bp, Homo sapiens
gcacccagaac

SEQ ID NO: 4520593 - DNA, 12 bp, Homo sapiens
gcacccagccct

SEQ ID NO: 4520594 - DNA, 14 bp, Homo sapiens
gcaccccacagctg

SEQ ID NO: 4520595 - DNA, 15 bp, Homo sapiens
gcaccccacagctgg

SEQ ID NO: 4520596 - DNA, 16 bp, Homo sapiens
gcaccccacagctggg

SEQ ID NO: 4520597 - DNA, 18 bp, Homo sapiens
gcaccccacagctggggc

SEQ ID NO: 4520598 - DNA, 14 bp, Homo sapiens
gcaccccagcattc

SEQ ID NO: 4520599 - DNA, 22 bp, Homo sapiens
gcaccccagcattccagctctg

SEQ ID NO: 4520600 - DNA, 17 bp, Homo sapiens
gcacccccatgctgcct

SEQ ID NO: 4520601 - DNA, 19 bp, Homo sapiens
gcaccccctgctccaccag

SEQ ID NO: 4520602 - DNA, 21 bp, Homo sapiens
gcacccctccgtgtggagcac

SEQ ID NO: 4520603 - DNA, 22 bp, Homo sapiens
gcacccctccgtgtggagcacg

SEQ ID NO: 4520604 - DNA, 17 bp, Homo sapiens
gcaccccttctctcctc

SEQ ID NO: 4520605 - DNA, 15 bp, Homo sapiens
gcacccgtatctgcc

SEQ ID NO: 4520606 - DNA, 18 bp, Homo sapiens
gattcacctgtaaaactt

SEQ ID NO: 4520607 - DNA, 19 bp, Homo sapiens
gattcacctgtaaaacttt

SEQ ID NO: 4520608 - DNA, 21 bp, Homo sapiens
gattcagaaaatgttctgttt

SEQ ID NO: 4520609 - DNA, 21 bp, Homo sapiens
gattcagaggtcacttcattt

SEQ ID NO: 4520610 - DNA, 13 bp, Homo sapiens
gattcaggccagc

SEQ ID NO: 4520611 - DNA, 17 bp, Homo sapiens
gattcaggccagcccag

SEQ ID NO: 4520612 - DNA, 13 bp, Homo sapiens
gattcaggctgct

SEQ ID NO: 4520613 - DNA, 19 bp, Homo sapiens
gattcagggagaatgttgt

SEQ ID NO: 4520614 - DNA, 15 bp, Homo sapiens
gattcattctcataa

SEQ ID NO: 4520615 - DNA, 20 bp, Homo sapiens
gattccactacacctggctg

SEQ ID NO: 4520616 - DNA, 14 bp, Homo sapiens
gattccatgctaag

SEQ ID NO: 4520617 - DNA, 15 bp, Homo sapiens
gattccatgctaagc

SEQ ID NO: 4520618 - DNA, 20 bp, Homo sapiens
gattccatgctaagcaagct

SEQ ID NO: 4520619 - DNA, 13 bp, Homo sapiens
gattcccagagac

SEQ ID NO: 4520620 - DNA, 14 bp, Homo sapiens
gattcccagagaca

SEQ ID NO: 4520621 - DNA, 15 bp, Homo sapiens
gattccttggcagcc

SEQ ID NO: 4520622 - DNA, 17 bp, Homo sapiens
gattccttggcagccgg

SEQ ID NO: 4520623 - DNA, 17 bp, Homo sapiens
gattctatgttaatatt

SEQ ID NO: 4520624 - DNA, 16 bp, Homo sapiens
gattctcgccccttcc

SEQ ID NO: 4520625 - DNA, 16 bp, Homo sapiens
gattctgagcaaaggc

SEQ ID NO: 4520626 - DNA, 15 bp, Homo sapiens
gattctgcagtaaat

SEQ ID NO: 4520627 - DNA, 15 bp, Homo sapiens
gattctggaagcaaa

SEQ ID NO: 4520628 - DNA, 16 bp, Homo sapiens
gattctgtgttttcag

SEQ ID NO: 4520629 - DNA, 19 bp, Homo sapiens
gattctgttctgcaactcc

SEQ ID NO: 4520630 - DNA, 17 bp, Homo sapiens
gattcttgtaaatcttt

SEQ ID NO: 4520631 - DNA, 15 bp, Homo sapiens
gattctttccccaga

SEQ ID NO: 4520632 - DNA, 15 bp, Homo sapiens
gattcttttttcagt

SEQ ID NO: 4520633 - DNA, 23 bp, Homo sapiens
gattctttttttctgtcagtaaa

SEQ ID NO: 4520634 - DNA, 16 bp, Homo sapiens
gattgaagggtcctgc

SEQ ID NO: 4520635 - DNA, 20 bp, Homo sapiens
gattgaatttttaagcaaat

SEQ ID NO: 4520636 - DNA, 12 bp, Homo sapiens
gattgcactgct

SEQ ID NO: 4520637 - DNA, 21 bp, Homo sapiens
gattgcccctggctttgcctc

SEQ ID NO: 4520638 - DNA, 17 bp, Homo sapiens
gattgcctttaatattt

SEQ ID NO: 4520639 - DNA, 21 bp, Homo sapiens
gattgctgccccatcagtgct

SEQ ID NO: 4520640 - DNA, 15 bp, Homo sapiens
gattgcttaaaagca

SEQ ID NO: 4520641 - DNA, 18 bp, Homo sapiens
gattgcttgagctcagga

SEQ ID NO: 4520642 - DNA, 22 bp, Homo sapiens
gattggatattctcctcggact

SEQ ID NO: 4520643 - DNA, 15 bp, Homo sapiens
gattggatttgctgt

SEQ ID NO: 4520644 - DNA, 18 bp, Homo sapiens
gattggatttgctgtgac

SEQ ID NO: 4520645 - DNA, 18 bp, Homo sapiens
gattggctcacactgaga

SEQ ID NO: 4520646 - DNA, 19 bp, Homo sapiens
gattgggagaagtggaaat

SEQ ID NO: 4520647 - DNA, 22 bp, Homo sapiens
gattggtgttcgtttccatcat

SEQ ID NO: 4520648 - DNA, 20 bp, Homo sapiens
gattggttaaaatgtgattt

SEQ ID NO: 4520649 - DNA, 10 bp, Homo sapiens
gattgtattg

SEQ ID NO: 4520650 - DNA, 13 bp, Homo sapiens
gattgtattgctg

SEQ ID NO: 4520651 - DNA, 15 bp, Homo sapiens
gattgttaatttcag

SEQ ID NO: 4520652 - DNA, 16 bp, Homo sapiens
gattgttattaaatgt

SEQ ID NO: 4520653 - DNA, 19 bp, Homo sapiens
gatttaaaggcagacagtt

SEQ ID NO: 4520654 - DNA, 14 bp, Homo sapiens
gatttaaatttaag

SEQ ID NO: 4520655 - DNA, 16 bp, Homo sapiens
gatttaacttgtattt

SEQ ID NO: 4520656 - DNA, 20 bp, Homo sapiens
gatttaagggcccaggtcag

SEQ ID NO: 4520657 - DNA, 22 bp, Homo sapiens
gatttaagtgaatacattaacg

SEQ ID NO: 4520658 - DNA, 22 bp, Homo sapiens
gatttagtgaaagctagagata

SEQ ID NO: 4520659 - DNA, 13 bp, Homo sapiens
gatttagtttcag

SEQ ID NO: 4520660 - DNA, 14 bp, Homo sapiens
gatttagtttcagt

SEQ ID NO: 4520661 - DNA, 15 bp, Homo sapiens
gatttagtttcagta

SEQ ID NO: 4520662 - DNA, 16 bp, Homo sapiens
gatttagtttcagtag

SEQ ID NO: 4520663 - DNA, 14 bp, Homo sapiens
gatttattatgaac

SEQ ID NO: 4520664 - DNA, 18 bp, Homo sapiens
gatttatttaaaatagca

SEQ ID NO: 4520665 - DNA, 16 bp, Homo sapiens
gatttatttgcttctt

SEQ ID NO: 4520666 - DNA, 18 bp, Homo sapiens
gatttcagctatgcagaa

SEQ ID NO: 4520667 - DNA, 11 bp, Homo sapiens
gatttcataat

SEQ ID NO: 4520668 - DNA, 15 bp, Homo sapiens
gatttcatactgtaa

SEQ ID NO: 4520669 - DNA, 23 bp, Homo sapiens
gatttcatattgatctttttatc

SEQ ID NO: 4520670 - DNA, 15 bp, Homo sapiens
gatttcatctgctct

SEQ ID NO: 4520671 - DNA, 21 bp, Homo sapiens
gatttcatctgctctccttcc

SEQ ID NO: 4520672 - DNA, 11 bp, Homo sapiens
gatttccctgc

SEQ ID NO: 4520673 - DNA, 15 bp, Homo sapiens
gatttccctgcagac

SEQ ID NO: 4520674 - DNA, 21 bp, Homo sapiens
gatttctcacactctaactgt

SEQ ID NO: 4520675 - DNA, 12 bp, Homo sapiens
gatttctgggat

SEQ ID NO: 4520676 - DNA, 15 bp, Homo sapiens
gatttctgtgaagtt

SEQ ID NO: 4520677 - DNA, 20 bp, Homo sapiens
gatttctgtgaagttgaata

SEQ ID NO: 4520678 - DNA, 15 bp, Homo sapiens
gatttgaaaaacttt

SEQ ID NO: 4520679 - DNA, 16 bp, Homo sapiens
gatttgaaaaactttt

SEQ ID NO: 4520680 - DNA, 12 bp, Homo sapiens
gatttgaaaatt

SEQ ID NO: 4520681 - DNA, 16 bp, Homo sapiens
gatttgaaaattgtat

SEQ ID NO: 4520682 - DNA, 21 bp, Homo sapiens
gatttgaacaaattttctggt

SEQ ID NO: 4520683 - DNA, 18 bp, Homo sapiens
gatttgaaccatgaagtc

SEQ ID NO: 4520684 - DNA, 13 bp, Homo sapiens
gatttgaactcag

SEQ ID NO: 4520685 - DNA, 18 bp, Homo sapiens
gatttgaagaacatgtga

SEQ ID NO: 4520686 - DNA, 15 bp, Homo sapiens
gatttgatctttgtt

SEQ ID NO: 4520687 - DNA, 18 bp, Homo sapiens
gatttgcgtggaaatctc

SEQ ID NO: 4520688 - DNA, 19 bp, Homo sapiens
gatttggccacactggggc

SEQ ID NO: 4520689 - DNA, 21 bp, Homo sapiens
gatttggccacactggggctg

SEQ ID NO: 4520690 - DNA, 22 bp, Homo sapiens
gatttggccacactggggctga

SEQ ID NO: 4520691 - DNA, 16 bp, Homo sapiens
gatttgtaatgagcac

SEQ ID NO: 4520692 - DNA, 16 bp, Homo sapiens
gatttgtgaactggaa

SEQ ID NO: 4520693 - DNA, 15 bp, Homo sapiens
gattttaaatttttt

SEQ ID NO: 4520694 - DNA, 18 bp, Homo sapiens
gattttaatttcaggaaa

SEQ ID NO: 4520695 - DNA, 19 bp, Homo sapiens
gattttaatttcaggaaaa

SEQ ID NO: 4520696 - DNA, 14 bp, Homo sapiens
gattttacaagtat

SEQ ID NO: 4520697 - DNA, 19 bp, Homo sapiens
gattttaccaaagcatcaa

SEQ ID NO: 4520698 - DNA, 13 bp, Homo sapiens
gattttcacacat

SEQ ID NO: 4520699 - DNA, 19 bp, Homo sapiens
gattttcacattcttggct

SEQ ID NO: 4520700 - DNA, 12 bp, Homo sapiens
gattttcagtta

SEQ ID NO: 4520701 - DNA, 16 bp, Homo sapiens
gattttcataacttat

SEQ ID NO: 4520702 - DNA, 23 bp, Homo sapiens
gattttcataacttattgctgat

SEQ ID NO: 4520703 - DNA, 23 bp, Homo sapiens
gattttctattatggaaaactgt

SEQ ID NO: 4520704 - DNA, 12 bp, Homo sapiens
gattttgaatct

SEQ ID NO: 4520705 - DNA, 13 bp, Homo sapiens
gattttgataact

SEQ ID NO: 4520706 - DNA, 20 bp, Homo sapiens
gattttggaaactcaaggaa

SEQ ID NO: 4520707 - DNA, 19 bp, Homo sapiens
gattttggttttgttcccc

SEQ ID NO: 4520708 - DNA, 22 bp, Homo sapiens
gattttggttttgttcccctcc

SEQ ID NO: 4520709 - DNA, 15 bp, Homo sapiens
gattttgtaaatgtt

SEQ ID NO: 4520710 - DNA, 14 bp, Homo sapiens
gattttgttatgtt

SEQ ID NO: 4520711 - DNA, 17 bp, Homo sapiens
gatttttaaaaaatatt

SEQ ID NO: 4520712 - DNA, 13 bp, Homo sapiens
gatttttaaaatg

SEQ ID NO: 4520713 - DNA, 15 bp, Homo sapiens
gatttttagaattaa

SEQ ID NO: 4520714 - DNA, 20 bp, Homo sapiens
gatttttatattagttgctt

SEQ ID NO: 4520715 - DNA, 15 bp, Homo sapiens
gatttttctttaact

SEQ ID NO: 4520716 - DNA, 15 bp, Homo sapiens
gatttttgtcttgtg

SEQ ID NO: 4520717 - DNA, 21 bp, Homo sapiens
gatttttgttttccactgtgc

SEQ ID NO: 4520718 - DNA, 16 bp, Homo sapiens
gattttttaataattt

SEQ ID NO: 4520719 - DNA, 19 bp, Homo sapiens
gattttttaataatttaga

SEQ ID NO: 4520720 - DNA, 13 bp, Homo sapiens
gatttttttcctg

SEQ ID NO: 4520721 - DNA, 13 bp, Homo sapiens
gatttttttgtaa

SEQ ID NO: 4520722 - DNA, 15 bp, Homo sapiens
gatttttttttcata

SEQ ID NO: 4520723 - DNA, 17 bp, Homo sapiens
gattttttttttaagtg

SEQ ID NO: 4520724 - DNA, 20 bp, Homo sapiens
gatttttttttttttttcct

SEQ ID NO: 4520725 - DNA, 18 bp, Homo sapiens
gcaaaaaaaaaaaaaagc

SEQ ID NO: 4520726 - DNA, 19 bp, Homo sapiens
gcaaaaaaaaatttagcta

SEQ ID NO: 4520727 - DNA, 21 bp, Homo sapiens
gcaaaaaaattaaaatggatg

SEQ ID NO: 4520728 - DNA, 14 bp, Homo sapiens
gcaaaaaagaaaac

SEQ ID NO: 4520729 - DNA, 17 bp, Homo sapiens
gcaaaaaagaaaacctt

SEQ ID NO: 4520730 - DNA, 18 bp, Homo sapiens
gcaaaaaagaaaaccttt

SEQ ID NO: 4520731 - DNA, 21 bp, Homo sapiens
gcaaaaaagtccaattttaat

SEQ ID NO: 4520732 - DNA, 11 bp, Homo sapiens
gcaaaaaatac

SEQ ID NO: 4520733 - DNA, 21 bp, Homo sapiens
gcaaaaacaaaaagaaaagaa

SEQ ID NO: 4520734 - DNA, 23 bp, Homo sapiens
gcaaaaatagtttggatatgtaa

SEQ ID NO: 4520735 - DNA, 18 bp, Homo sapiens
gcaaaactccaggcagga

SEQ ID NO: 4520736 - DNA, 17 bp, Homo sapiens
gcaaaaggcctcttgta

SEQ ID NO: 4520737 - DNA, 23 bp, Homo sapiens
gcaaaaggcctcttgtaaagact

SEQ ID NO: 4520738 - DNA, 22 bp, Homo sapiens
gcaaaagtggggctaaatgaag

SEQ ID NO: 4520739 - DNA, 10 bp, Homo sapiens
gcaaaatatg

SEQ ID NO: 4520740 - DNA, 13 bp, Homo sapiens
gcaaaatatgttt

SEQ ID NO: 4520741 - DNA, 16 bp, Homo sapiens
gcaaaatcaacatgac

SEQ ID NO: 4520742 - DNA, 12 bp, Homo sapiens
gcaaaattaaat

SEQ ID NO: 4520743 - DNA, 13 bp, Homo sapiens
gcaaacagaaaaa

SEQ ID NO: 4520744 - DNA, 18 bp, Homo sapiens
gcaaacagggcctctgcg

SEQ ID NO: 4520745 - DNA, 18 bp, Homo sapiens
gcaaacatggagaaatct

SEQ ID NO: 4520746 - DNA, 17 bp, Homo sapiens
gcaaaccctggtgcttt

SEQ ID NO: 4520747 - DNA, 19 bp, Homo sapiens
gcaaacctgcagtttttaa

SEQ ID NO: 4520748 - DNA, 16 bp, Homo sapiens
gcaaaccttcctggga

SEQ ID NO: 4520749 - DNA, 13 bp, Homo sapiens
gcaaacctttccc

SEQ ID NO: 4520750 - DNA, 14 bp, Homo sapiens
gcaaactgctttat

SEQ ID NO: 4520751 - DNA, 15 bp, Homo sapiens
gcaaagaagcttcat

SEQ ID NO: 4520752 - DNA, 14 bp, Homo sapiens
gcaaagagacattt

SEQ ID NO: 4520753 - DNA, 16 bp, Homo sapiens
gcaaagagacatttca

SEQ ID NO: 4520754 - DNA, 18 bp, Homo sapiens
gcaaagataatttatttc

SEQ ID NO: 4520755 - DNA, 15 bp, Homo sapiens
gcaaagatggcttcc

SEQ ID NO: 4520756 - DNA, 23 bp, Homo sapiens
gcaaagcactgacttctaagtaa

SEQ ID NO: 4520757 - DNA, 17 bp, Homo sapiens
gcaaaggagaaatctgg

SEQ ID NO: 4520758 - DNA, 12 bp, Homo sapiens
gcaaaggccctg

SEQ ID NO: 4520759 - DNA, 15 bp, Homo sapiens
gcaaaggccctgggt

SEQ ID NO: 4520760 - DNA, 12 bp, Homo sapiens
gcaaagtacaat

SEQ ID NO: 4520761 - DNA, 12 bp, Homo sapiens
gcaaagtactgt

SEQ ID NO: 4520762 - DNA, 16 bp, Homo sapiens
gcaaagtattgtaaat

SEQ ID NO: 4520763 - DNA, 18 bp, Homo sapiens
gcaaagtattgtaaatta

SEQ ID NO: 4520764 - DNA, 21 bp, Homo sapiens
gcaaagtattgtaaattatat

SEQ ID NO: 4520765 - DNA, 14 bp, Homo sapiens
gcaaagtgttttgt

SEQ ID NO: 4520766 - DNA, 14 bp, Homo sapiens
gcaaagtttacaga

SEQ ID NO: 4520767 - DNA, 17 bp, Homo sapiens
gcaaagtttacagatgt

SEQ ID NO: 4520768 - DNA, 20 bp, Homo sapiens
gcaaataatgatcgaaaaaa

SEQ ID NO: 4520769 - DNA, 19 bp, Homo sapiens
gcaaatatactttactttt

SEQ ID NO: 4520770 - DNA, 18 bp, Homo sapiens
gcaaatattagcaaagaa

SEQ ID NO: 4520771 - DNA, 20 bp, Homo sapiens
gcaaatcagaaacttgtgaa

SEQ ID NO: 4520772 - DNA, 21 bp, Homo sapiens
gcaaatcagtatattttctgt

SEQ ID NO: 4520773 - DNA, 23 bp, Homo sapiens
gcaaatcagtatattttctgtat

SEQ ID NO: 4520774 - DNA, 15 bp, Homo sapiens
gcaaattagaaacac

SEQ ID NO: 4520775 - DNA, 12 bp, Homo sapiens
gcaaattctttt

SEQ ID NO: 4520776 - DNA, 19 bp, Homo sapiens
gcaaatttagtttgttaaa

SEQ ID NO: 4520777 - DNA, 18 bp, Homo sapiens
gcaaatttctataaattt

SEQ ID NO: 4520778 - DNA, 20 bp, Homo sapiens
gcaacaaagacttgctttaa

SEQ ID NO: 4520779 - DNA, 19 bp, Homo sapiens
gcaacaaatgtggccaagc

SEQ ID NO: 4520780 - DNA, 22 bp, Homo sapiens
gcaacaacaattggtaaaactc

SEQ ID NO: 4520781 - DNA, 20 bp, Homo sapiens
gcaacaaccttaaaggccgt

SEQ ID NO: 4520782 - DNA, 19 bp, Homo sapiens
gcaacactggtctgctgtt

SEQ ID NO: 4520783 - DNA, 16 bp, Homo sapiens
gcaacagatcagtaaa

SEQ ID NO: 4520784 - DNA, 19 bp, Homo sapiens
gcaacagcaaatcacgacc

SEQ ID NO: 4520785 - DNA, 17 bp, Homo sapiens
gcaacataattcttcct

SEQ ID NO: 4520786 - DNA, 17 bp, Homo sapiens
gcaacatccaaaatagt

SEQ ID NO: 4520787 - DNA, 15 bp, Homo sapiens
gcaacattggacaga

SEQ ID NO: 4520788 - DNA, 17 bp, Homo sapiens
gcaacattggacagaaa

SEQ ID NO: 4520789 - DNA, 20 bp, Homo sapiens
gcaacatttgacaaaactaa

SEQ ID NO: 4520790 - DNA, 16 bp, Homo sapiens
gcaaccaactgcccca

SEQ ID NO: 4520791 - DNA, 18 bp, Homo sapiens
gcaaccaactgccccagg

SEQ ID NO: 4520792 - DNA, 22 bp, Homo sapiens
gcaaccacatttagaaatgttt

SEQ ID NO: 4520793 - DNA, 17 bp, Homo sapiens
gcaaccaggaacagcaa

SEQ ID NO: 4520794 - DNA, 16 bp, Homo sapiens
gcaacccaaggactga

SEQ ID NO: 4520795 - DNA, 17 bp, Homo sapiens
gcaaccctacagtatat

SEQ ID NO: 4520796 - DNA, 17 bp, Homo sapiens
gcaacctcaccttcctg

SEQ ID NO: 4520797 - DNA, 18 bp, Homo sapiens
gcaacctcaccttcctgt

SEQ ID NO: 4520798 - DNA, 22 bp, Homo sapiens
gcaacctcaccttcctgtgggt

SEQ ID NO: 4520799 - DNA, 13 bp, Homo sapiens
gcaacctctgcct

SEQ ID NO: 4520800 - DNA, 19 bp, Homo sapiens
gcaacctgcggaaggaggt

SEQ ID NO: 4520801 - DNA, 15 bp, Homo sapiens
gcaacctttcccttc

SEQ ID NO: 4520802 - DNA, 13 bp, Homo sapiens
gcaacgcaggagg

SEQ ID NO: 4520803 - DNA, 17 bp, Homo sapiens
gcaacgtagcctgggct

SEQ ID NO: 4520804 - DNA, 15 bp, Homo sapiens
gcaactacaacttct

SEQ ID NO: 4520805 - DNA, 18 bp, Homo sapiens
gcaactacaacttctcct

SEQ ID NO: 4520806 - DNA, 12 bp, Homo sapiens
gcaactgaaaat

SEQ ID NO: 4520807 - DNA, 17 bp, Homo sapiens
gcaacttccgctgaggg

SEQ ID NO: 4520808 - DNA, 14 bp, Homo sapiens
gcaacttgcttcta

SEQ ID NO: 4520809 - DNA, 11 bp, Homo sapiens
gcaacttttta

SEQ ID NO: 4520810 - DNA, 15 bp, Homo sapiens
gcaactttttaaagt

SEQ ID NO: 4520811 - DNA, 16 bp, Homo sapiens
gcaagaaggcaaaaat

SEQ ID NO: 4520812 - DNA, 20 bp, Homo sapiens
gcaagaaggcaaaaatagtt

SEQ ID NO: 4520813 - DNA, 23 bp, Homo sapiens
gcaagaccacggagggagcgaca

SEQ ID NO: 4520814 - DNA, 15 bp, Homo sapiens
gcaagacctcatctc

SEQ ID NO: 4520815 - DNA, 14 bp, Homo sapiens
gcaagacgccctct

SEQ ID NO: 4520816 - DNA, 19 bp, Homo sapiens
gcaagacgtaaagaatttt

SEQ ID NO: 4520817 - DNA, 20 bp, Homo sapiens
gcaagagatggaaaaaaagt

SEQ ID NO: 4520818 - DNA, 19 bp, Homo sapiens
gcaagaggcaagctgaaat

SEQ ID NO: 4520819 - DNA, 20 bp, Homo sapiens
gcaagagggggtggaggggt

SEQ ID NO: 4520820 - DNA, 14 bp, Homo sapiens
gcaagatgagctgt

SEQ ID NO: 4520821 - DNA, 16 bp, Homo sapiens
gcaagatgagctgtgc

SEQ ID NO: 4520822 - DNA, 13 bp, Homo sapiens
gcaagatgtgaat

SEQ ID NO: 4520823 - DNA, 13 bp, Homo sapiens
gcaagatgtttct

SEQ ID NO: 4520824 - DNA, 22 bp, Homo sapiens
gcaagcatgtaacttatattaa

SEQ ID NO: 4520825 - DNA, 22 bp, Homo sapiens
gcaagccagacctagcaggctg

SEQ ID NO: 4520826 - DNA, 23 bp, Homo sapiens
gcaagccagacctagcaggctgt

SEQ ID NO: 4520827 - DNA, 12 bp, Homo sapiens
gcaagccctgcc

SEQ ID NO: 4520828 - DNA, 14 bp, Homo sapiens
gcaagccctgccca

SEQ ID NO: 4520829 - DNA, 19 bp, Homo sapiens
gcaagcctgtaatcccagc

SEQ ID NO: 4520830 - DNA, 23 bp, Homo sapiens
gcaagctaaccttatcctgcatt

SEQ ID NO: 4520831 - DNA, 18 bp, Homo sapiens
gcaagctccgcctcccgg

SEQ ID NO: 4520832 - DNA, 19 bp, Homo sapiens
gcaagctcttttatatgct

SEQ ID NO: 4520833 - DNA, 19 bp, Homo sapiens
gcaagctgcccagccctgg

SEQ ID NO: 4520834 - DNA, 23 bp, Homo sapiens
gcaagcttaatggctgataattt

SEQ ID NO: 4520835 - DNA, 16 bp, Homo sapiens
gcaaggaaaaacaggt

SEQ ID NO: 4520836 - DNA, 21 bp, Homo sapiens
gcaaggaccaggactccctcc

SEQ ID NO: 4520837 - DNA, 20 bp, Homo sapiens
gcaaggatatcagagctggg

SEQ ID NO: 4520838 - DNA, 11 bp, Homo sapiens
gcaagggaaga

SEQ ID NO: 4520839 - DNA, 15 bp, Homo sapiens
gcaaggtcatagaca

SEQ ID NO: 4520840 - DNA, 23 bp, Homo sapiens
gcaaggtcatgaaggaggggacc

SEQ ID NO: 4520841 - DNA, 20 bp, Homo sapiens
gcaagtacagcggctcccct

SEQ ID NO: 4520842 - DNA, 17 bp, Homo sapiens
gcaagtctggatctggg

SEQ ID NO: 4520843 - DNA, 14 bp, Homo sapiens
gcaataacaagcat

SEQ ID NO: 4520844 - DNA, 15 bp, Homo sapiens
gcaataactctggga

SEQ ID NO: 4520845 - DNA, 13 bp, Homo sapiens
gcaataactgaaa

SEQ ID NO: 4520846 - DNA, 13 bp, Homo sapiens
gcaataatgcagt

SEQ ID NO: 4520847 - DNA, 18 bp, Homo sapiens
gcaatacagggaggctcc

SEQ ID NO: 4520848 - DNA, 12 bp, Homo sapiens
gcatcagagggc

SEQ ID NO: 4520849 - DNA, 15 bp, Homo sapiens
gcatcagttctacgg

SEQ ID NO: 4520850 - DNA, 19 bp, Homo sapiens
gcatcatcttgaacattaa

SEQ ID NO: 4520851 - DNA, 13 bp, Homo sapiens
gcatcatttaaac

SEQ ID NO: 4520852 - DNA, 13 bp, Homo sapiens
gcatccagacagt

SEQ ID NO: 4520853 - DNA, 16 bp, Homo sapiens
gcatccattcctcagg

SEQ ID NO: 4520854 - DNA, 23 bp, Homo sapiens
gcatcccacgttctgttaattta

SEQ ID NO: 4520855 - DNA, 15 bp, Homo sapiens
gcatcccccctgctc

SEQ ID NO: 4520856 - DNA, 16 bp, Homo sapiens
gcatcccccctgctca

SEQ ID NO: 4520857 - DNA, 21 bp, Homo sapiens
gcatccctggagcaggagccc

SEQ ID NO: 4520858 - DNA, 20 bp, Homo sapiens
gcatcccttcccacatgcct

SEQ ID NO: 4520859 - DNA, 15 bp, Homo sapiens
gcatccttgtaatac

SEQ ID NO: 4520860 - DNA, 23 bp, Homo sapiens
gcatcgctgttctgggcatggca

SEQ ID NO: 4520861 - DNA, 22 bp, Homo sapiens
gcatcggacaagacccccagca

SEQ ID NO: 4520862 - DNA, 20 bp, Homo sapiens
gcatcgggaaagaagaaact

SEQ ID NO: 4520863 - DNA, 19 bp, Homo sapiens
gcatcgggagcacccagag

SEQ ID NO: 4520864 - DNA, 15 bp, Homo sapiens
gcatcggggtggccc

SEQ ID NO: 4520865 - DNA, 15 bp, Homo sapiens
gcatcgtgtattcca

SEQ ID NO: 4520866 - DNA, 19 bp, Homo sapiens
gcatcgtgtattccatatg

SEQ ID NO: 4520867 - DNA, 20 bp, Homo sapiens
gcatctatctggtgatttct

SEQ ID NO: 4520868 - DNA, 12 bp, Homo sapiens
gcatctcccaga

SEQ ID NO: 4520869 - DNA, 19 bp, Homo sapiens
gcatctcctcccgcccttc

SEQ ID NO: 4520870 - DNA, 23 bp, Homo sapiens
gcatctcctcccgcccttccatg

SEQ ID NO: 4520871 - DNA, 19 bp, Homo sapiens
gcatctctccccatatata

SEQ ID NO: 4520872 - DNA, 22 bp, Homo sapiens
gcatctctccccatatataaat

SEQ ID NO: 4520873 - DNA, 18 bp, Homo sapiens
gcatctcttccccagaga

SEQ ID NO: 4520874 - DNA, 23 bp, Homo sapiens
gcatctcttcttccctgtcagcc

SEQ ID NO: 4520875 - DNA, 12 bp, Homo sapiens
gcatctgcccca

SEQ ID NO: 4520876 - DNA, 13 bp, Homo sapiens
gcatctgccccag

SEQ ID NO: 4520877 - DNA, 14 bp, Homo sapiens
gcatctgccccagg

SEQ ID NO: 4520878 - DNA, 12 bp, Homo sapiens
gcatctgcccct

SEQ ID NO: 4520879 - DNA, 14 bp, Homo sapiens
gcatcttctccatc

SEQ ID NO: 4520880 - DNA, 15 bp, Homo sapiens
gcatctttgccttgg

SEQ ID NO: 4520881 - DNA, 23 bp, Homo sapiens
gcatcttttctagagacacattg

SEQ ID NO: 4520882 - DNA, 23 bp, Homo sapiens
gcatcttttgtattaagaaagga

SEQ ID NO: 4520883 - DNA, 21 bp, Homo sapiens
gcatgaacgccaaggaatgta

SEQ ID NO: 4520884 - DNA, 18 bp, Homo sapiens
gcatgaataacatttaaa

SEQ ID NO: 4520885 - DNA, 21 bp, Homo sapiens
gcatgaataacatttaaattc

SEQ ID NO: 4520886 - DNA, 14 bp, Homo sapiens
gcatgacagcctct

SEQ ID NO: 4520887 - DNA, 15 bp, Homo sapiens
gcatgagattttgga

SEQ ID NO: 4520888 - DNA, 20 bp, Homo sapiens
gcatgatcatagctcactgc

SEQ ID NO: 4520889 - DNA, 20 bp, Homo sapiens
gcatgatggtgcatgcctgt

SEQ ID NO: 4520890 - DNA, 13 bp, Homo sapiens
gcatgcaatttga

SEQ ID NO: 4520891 - DNA, 15 bp, Homo sapiens
gcatgcacactgaga

SEQ ID NO: 4520892 - DNA, 19 bp, Homo sapiens
gcatgcacatgctgtctgg

SEQ ID NO: 4520893 - DNA, 16 bp, Homo sapiens
gcatgcactgttcccc

SEQ ID NO: 4520894 - DNA, 22 bp, Homo sapiens
gcatgcattgaaaaatttctaa

SEQ ID NO: 4520895 - DNA, 21 bp, Homo sapiens
gcatgcctgtaatcccagaac

SEQ ID NO: 4520896 - DNA, 18 bp, Homo sapiens
gcatgcctgtagtctcag

SEQ ID NO: 4520897 - DNA, 19 bp, Homo sapiens
gcatgcctgtagtctcagc

SEQ ID NO: 4520898 - DNA, 13 bp, Homo sapiens
gcatgcggcccag

SEQ ID NO: 4520899 - DNA, 15 bp, Homo sapiens
gcatgcggcccagcc

SEQ ID NO: 4520900 - DNA, 14 bp, Homo sapiens
gcatgcttaaattt

SEQ ID NO: 4520901 - DNA, 22 bp, Homo sapiens
gcatggacatttagaagaaaga

SEQ ID NO: 4520902 - DNA, 18 bp, Homo sapiens
gcatggaccgcaggaggg

SEQ ID NO: 4520903 - DNA, 20 bp, Homo sapiens
gcatggatatagttttactt

SEQ ID NO: 4520904 - DNA, 19 bp, Homo sapiens
gcatggatgcatttcaaat

SEQ ID NO: 4520905 - DNA, 15 bp, Homo sapiens
gcatggctcctgtct

SEQ ID NO: 4520906 - DNA, 17 bp, Homo sapiens
gcatggctcctgtctgg

SEQ ID NO: 4520907 - DNA, 20 bp, Homo sapiens
gcatgggaaatagcggccct

SEQ ID NO: 4520908 - DNA, 22 bp, Homo sapiens
gcatgggaaatagcggccctgg

SEQ ID NO: 4520909 - DNA, 23 bp, Homo sapiens
gcatgggaaatagcggccctgga

SEQ ID NO: 4520910 - DNA, 16 bp, Homo sapiens
gcatgggagggggaga

SEQ ID NO: 4520911 - DNA, 22 bp, Homo sapiens
gcatgggctcgccgtgtctcag

SEQ ID NO: 4520912 - DNA, 14 bp, Homo sapiens
gcatggggccagga

SEQ ID NO: 4520913 - DNA, 17 bp, Homo sapiens
gcatgggtgagacctga

SEQ ID NO: 4520914 - DNA, 15 bp, Homo sapiens
gcatgggtgtgccct

SEQ ID NO: 4520915 - DNA, 18 bp, Homo sapiens
gcatggtggctcatgcct

SEQ ID NO: 4520916 - DNA, 22 bp, Homo sapiens
gcatgtagtaacactaatatat

SEQ ID NO: 4520917 - DNA, 18 bp, Homo sapiens
gcatgtatagttgctttt

SEQ ID NO: 4520918 - DNA, 19 bp, Homo sapiens
gcatgtatagttgcttttg

SEQ ID NO: 4520919 - DNA, 14 bp, Homo sapiens
gcatgtcagagcac

SEQ ID NO: 4520920 - DNA, 17 bp, Homo sapiens
gcatgtcatttgcacac

SEQ ID NO: 4520921 - DNA, 15 bp, Homo sapiens
gcatgtcccacccac

SEQ ID NO: 4520922 - DNA, 17 bp, Homo sapiens
gcatgtctgcctatgca

SEQ ID NO: 4520923 - DNA, 14 bp, Homo sapiens
gcatgtgcatgcat

SEQ ID NO: 4520924 - DNA, 16 bp, Homo sapiens
gcatgtgcatgcatac

SEQ ID NO: 4520925 - DNA, 11 bp, Homo sapiens
gcatgtggaga

SEQ ID NO: 4520926 - DNA, 16 bp, Homo sapiens
gcatgtgtgactttca

SEQ ID NO: 4520927 - DNA, 16 bp, Homo sapiens
gcatgttccactaacc

SEQ ID NO: 4520928 - DNA, 14 bp, Homo sapiens
gcatgttcctcctt

SEQ ID NO: 4520929 - DNA, 23 bp, Homo sapiens
gcatgttcctccttttcttcacc

SEQ ID NO: 4520930 - DNA, 15 bp, Homo sapiens
gcatgttctcctcta

SEQ ID NO: 4520931 - DNA, 14 bp, Homo sapiens
gcatgtttgaaatg

SEQ ID NO: 4520932 - DNA, 14 bp, Homo sapiens
gcatgtttttgaaa

SEQ ID NO: 4520933 - DNA, 18 bp, Homo sapiens
gcattaaattcacaaact

SEQ ID NO: 4520934 - DNA, 16 bp, Homo sapiens
gcattaactaaatgct

SEQ ID NO: 4520935 - DNA, 17 bp, Homo sapiens
gcattatctctttctct

SEQ ID NO: 4520936 - DNA, 16 bp, Homo sapiens
gcattcagaagaaaaa

SEQ ID NO: 4520937 - DNA, 18 bp, Homo sapiens
gcattcagaagaaaaaga

SEQ ID NO: 4520938 - DNA, 21 bp, Homo sapiens
gcattcatgtaataaacaggt

SEQ ID NO: 4520939 - DNA, 18 bp, Homo sapiens
gcattcatttttatagca

SEQ ID NO: 4520940 - DNA, 19 bp, Homo sapiens
gcattcatttttatagcaa

SEQ ID NO: 4520941 - DNA, 14 bp, Homo sapiens
gcattcccagggac

SEQ ID NO: 4520942 - DNA, 18 bp, Homo sapiens
gcattcctgtgccctaga

SEQ ID NO: 4520943 - DNA, 23 bp, Homo sapiens
gcattctgaatcagaatctcgca

SEQ ID NO: 4520944 - DNA, 21 bp, Homo sapiens
gcattctggcataatttttac

SEQ ID NO: 4520945 - DNA, 13 bp, Homo sapiens
gcattcttctctg

SEQ ID NO: 4520946 - DNA, 12 bp, Homo sapiens
gcattctttccc

SEQ ID NO: 4520947 - DNA, 13 bp, Homo sapiens
gcattctttccca

SEQ ID NO: 4520948 - DNA, 12 bp, Homo sapiens
gcattgaacaca

SEQ ID NO: 4520949 - DNA, 22 bp, Homo sapiens
gcattgaacacaaactgtaaat

SEQ ID NO: 4520950 - DNA, 19 bp, Homo sapiens
gcattgaatggctatgttt

SEQ ID NO: 4520951 - DNA, 15 bp, Homo sapiens
gcattgagcatattt

SEQ ID NO: 4520952 - DNA, 16 bp, Homo sapiens
gcattgagcttgcatg

SEQ ID NO: 4520953 - DNA, 14 bp, Homo sapiens
gcattgccaagggc

SEQ ID NO: 4520954 - DNA, 16 bp, Homo sapiens
gcattgccaagtgcca

SEQ ID NO: 4520955 - DNA, 18 bp, Homo sapiens
gcattggatattttttac

SEQ ID NO: 4520956 - DNA, 23 bp, Homo sapiens
gcattggggttcctctgtacagc

SEQ ID NO: 4520957 - DNA, 14 bp, Homo sapiens
gcattggtgactca

SEQ ID NO: 4520958 - DNA, 16 bp, Homo sapiens
gcattggttttccatg

SEQ ID NO: 4520959 - DNA, 14 bp, Homo sapiens
gcattgttgtaaag

SEQ ID NO: 4520960 - DNA, 17 bp, Homo sapiens
gcattgttgtaaagtat

SEQ ID NO: 4520961 - DNA, 22 bp, Homo sapiens
gcattgttgtaaagtatttgat

SEQ ID NO: 4520962 - DNA, 23 bp, Homo sapiens
gcatttaagaattgccagtcttt

SEQ ID NO: 4520963 - DNA, 18 bp, Homo sapiens
gcatttaatggcagctag

SEQ ID NO: 4520964 - DNA, 15 bp, Homo sapiens
gcatttatttctctg

SEQ ID NO: 4520965 - DNA, 19 bp, Homo sapiens
gcatttcattatgctttga

SEQ ID NO: 4520966 - DNA, 20 bp, Homo sapiens
gcatttcattatgctttgaa

SEQ ID NO: 4520967 - DNA, 21 bp, Homo sapiens
gcatttgatctgttgcaagcc

SEQ ID NO: 4520968 - DNA, 18 bp, Homo sapiens
gcagggcctggctccagt

SEQ ID NO: 4520969 - DNA, 18 bp, Homo sapiens
gcagggccttgcccagag

SEQ ID NO: 4520970 - DNA, 13 bp, Homo sapiens
gcagggcgagctg

SEQ ID NO: 4520971 - DNA, 23 bp, Homo sapiens
gcagggcgccaagtctggcacca

SEQ ID NO: 4520972 - DNA, 22 bp, Homo sapiens
gcagggcgggcagagggctgga

SEQ ID NO: 4520973 - DNA, 20 bp, Homo sapiens
gcagggcgtgaggaactctc

SEQ ID NO: 4520974 - DNA, 22 bp, Homo sapiens
gcagggctaccctgagctgagg

SEQ ID NO: 4520975 - DNA, 23 bp, Homo sapiens
gcagggctaccctgagctgaggc

SEQ ID NO: 4520976 - DNA, 14 bp, Homo sapiens
gcagggctggtctt

SEQ ID NO: 4520977 - DNA, 14 bp, Homo sapiens
gcagggcttctcct

SEQ ID NO: 4520978 - DNA, 17 bp, Homo sapiens
gcaggggaagcaggacc

SEQ ID NO: 4520979 - DNA, 21 bp, Homo sapiens
gcaggggaagcaggacccagt

SEQ ID NO: 4520980 - DNA, 19 bp, Homo sapiens
gcaggggagacaggagcct

SEQ ID NO: 4520981 - DNA, 22 bp, Homo sapiens
gcaggggagacaggagcctagc

SEQ ID NO: 4520982 - DNA, 19 bp, Homo sapiens
gcaggggccgggggcagtc

SEQ ID NO: 4520983 - DNA, 20 bp, Homo sapiens
gcaggggccgggggcagtct

SEQ ID NO: 4520984 - DNA, 13 bp, Homo sapiens
gcaggggctccag

SEQ ID NO: 4520985 - DNA, 20 bp, Homo sapiens
gcagggggccccgccagggc

SEQ ID NO: 4520986 - DNA, 13 bp, Homo sapiens
gcagggggccctg

SEQ ID NO: 4520987 - DNA, 19 bp, Homo sapiens
gcaggggtcagtgcagcag

SEQ ID NO: 4520988 - DNA, 17 bp, Homo sapiens
gcaggggtgggggtgga

SEQ ID NO: 4520989 - DNA, 20 bp, Homo sapiens
gcaggggtgggggtggaggc

SEQ ID NO: 4520990 - DNA, 21 bp, Homo sapiens
gcaggggtgggggtggaggct

SEQ ID NO: 4520991 - DNA, 14 bp, Homo sapiens
gcaggtcctgccca

SEQ ID NO: 4520992 - DNA, 21 bp, Homo sapiens
gcaggtcctgcccatgtgtcc

SEQ ID NO: 4520993 - DNA, 17 bp, Homo sapiens
gcaggtctccacctgca

SEQ ID NO: 4520994 - DNA, 18 bp, Homo sapiens
gcaggtctccacctgcac

SEQ ID NO: 4520995 - DNA, 14 bp, Homo sapiens
gcaggtctttaaat

SEQ ID NO: 4520996 - DNA, 23 bp, Homo sapiens
gcaggtggacgctgcagacccca

SEQ ID NO: 4520997 - DNA, 17 bp, Homo sapiens
gcaggtggggagactgg

SEQ ID NO: 4520998 - DNA, 15 bp, Homo sapiens
gcaggtgtcctgagc

SEQ ID NO: 4520999 - DNA, 16 bp, Homo sapiens
gcaggtgtcctgagca

SEQ ID NO: 4521000 - DNA, 14 bp, Homo sapiens
gcaggttcatggat

SEQ ID NO: 4521001 - DNA, 16 bp, Homo sapiens
gcagtacaataaaagt

SEQ ID NO: 4521002 - DNA, 22 bp, Homo sapiens
gcagtaccctccattgggcaca

SEQ ID NO: 4521003 - DNA, 13 bp, Homo sapiens
gcagtagagagca

SEQ ID NO: 4521004 - DNA, 17 bp, Homo sapiens
gcagtatggtacatttt

SEQ ID NO: 4521005 - DNA, 14 bp, Homo sapiens
gcagtcactggagg

SEQ ID NO: 4521006 - DNA, 23 bp, Homo sapiens
gcagtcactggaggttgaagcca

SEQ ID NO: 4521007 - DNA, 17 bp, Homo sapiens
gcagtcagggtgggaag

SEQ ID NO: 4521008 - DNA, 19 bp, Homo sapiens
gcagtcattatccaggtaa

SEQ ID NO: 4521009 - DNA, 18 bp, Homo sapiens
gcagtccaggcctctctc

SEQ ID NO: 4521010 - DNA, 13 bp, Homo sapiens
gcagtccatgcat

SEQ ID NO: 4521011 - DNA, 19 bp, Homo sapiens
gcagtcctgatcagagccg

SEQ ID NO: 4521012 - DNA, 16 bp, Homo sapiens
gcagtcgcctgcctgc

SEQ ID NO: 4521013 - DNA, 19 bp, Homo sapiens
gcagtcgcctgcctgcagc

SEQ ID NO: 4521014 - DNA, 20 bp, Homo sapiens
gcagtcgcctgcctgcagca

SEQ ID NO: 4521015 - DNA, 19 bp, Homo sapiens
gcagtctccccttcctggc

SEQ ID NO: 4521016 - DNA, 21 bp, Homo sapiens
gcagtctcctctttaaaacaa

SEQ ID NO: 4521017 - DNA, 23 bp, Homo sapiens
gcagtctcctctttaaaacaaaa

SEQ ID NO: 4521018 - DNA, 18 bp, Homo sapiens
gcagtctcgggtggctag

SEQ ID NO: 4521019 - DNA, 14 bp, Homo sapiens
gcagtctgctctgc

SEQ ID NO: 4521020 - DNA, 15 bp, Homo sapiens
gcagtctgctctgct

SEQ ID NO: 4521021 - DNA, 10 bp, Homo sapiens
gcagtgagcc

SEQ ID NO: 4521022 - DNA, 14 bp, Homo sapiens
gcagtgccccaggg

SEQ ID NO: 4521023 - DNA, 21 bp, Homo sapiens
gcagtgccccagggagtccag

SEQ ID NO: 4521024 - DNA, 14 bp, Homo sapiens
gcagtggactcaga

SEQ ID NO: 4521025 - DNA, 20 bp, Homo sapiens
gcagtggcctgatctctgct

SEQ ID NO: 4521026 - DNA, 12 bp, Homo sapiens
gcagtggctccc

SEQ ID NO: 4521027 - DNA, 23 bp, Homo sapiens
gcagtggctcccctgcccagcct

SEQ ID NO: 4521028 - DNA, 14 bp, Homo sapiens
gcagtgtagatttt

SEQ ID NO: 4521029 - DNA, 17 bp, Homo sapiens
gcagtgtccagagaccc

SEQ ID NO: 4521030 - DNA, 20 bp, Homo sapiens
gcagtgtgaatagcctggcc

SEQ ID NO: 4521031 - DNA, 22 bp, Homo sapiens
gcagtgtgaatagcctggccac

SEQ ID NO: 4521032 - DNA, 19 bp, Homo sapiens
gcagtgtgaggccagggca

SEQ ID NO: 4521033 - DNA, 18 bp, Homo sapiens
gcagttataacagatgtg

SEQ ID NO: 4521034 - DNA, 20 bp, Homo sapiens
gcagttataacagatgtgaa

SEQ ID NO: 4521035 - DNA, 21 bp, Homo sapiens
gcagttataacagatgtgaaa

SEQ ID NO: 4521036 - DNA, 19 bp, Homo sapiens
gcagttatggtgatgactt

SEQ ID NO: 4521037 - DNA, 22 bp, Homo sapiens
gcagttctcacgaaagtattta

SEQ ID NO: 4521038 - DNA, 21 bp, Homo sapiens
gcagttgaaaagactccaaag

SEQ ID NO: 4521039 - DNA, 22 bp, Homo sapiens
gcagttgaaaagactccaaaga

SEQ ID NO: 4521040 - DNA, 18 bp, Homo sapiens
gcagttgtgtggcccagc

SEQ ID NO: 4521041 - DNA, 19 bp, Homo sapiens
gcagttgtgtggcccagca

SEQ ID NO: 4521042 - DNA, 15 bp, Homo sapiens
gcagtttaacaaaat

SEQ ID NO: 4521043 - DNA, 15 bp, Homo sapiens
gcagtttatatttaa

SEQ ID NO: 4521044 - DNA, 18 bp, Homo sapiens
gcagtttatatttaactc

SEQ ID NO: 4521045 - DNA, 15 bp, Homo sapiens
gcagtttatcattca

SEQ ID NO: 4521046 - DNA, 11 bp, Homo sapiens
gcagtttgaaa

SEQ ID NO: 4521047 - DNA, 17 bp, Homo sapiens
gcagtttgaaattctga

SEQ ID NO: 4521048 - DNA, 21 bp, Homo sapiens
gcagtttgaaattctgaattt

SEQ ID NO: 4521049 - DNA, 13 bp, Homo sapiens
gcagtttttaatt

SEQ ID NO: 4521050 - DNA, 14 bp, Homo sapiens
gcagtttttaattt

SEQ ID NO: 4521051 - DNA, 18 bp, Homo sapiens
gcagttttttgaaaatgg

SEQ ID NO: 4521052 - DNA, 15 bp, Homo sapiens
gcataaaagatgaaa

SEQ ID NO: 4521053 - DNA, 13 bp, Homo sapiens
gcataaactaaaa

SEQ ID NO: 4521054 - DNA, 21 bp, Homo sapiens
gcataaagctcaaatgaaatg

SEQ ID NO: 4521055 - DNA, 16 bp, Homo sapiens
gcataacaattcctct

SEQ ID NO: 4521056 - DNA, 16 bp, Homo sapiens
gcataatctgaaaaca

SEQ ID NO: 4521057 - DNA, 20 bp, Homo sapiens
gcataatgctttggaaaaat

SEQ ID NO: 4521058 - DNA, 20 bp, Homo sapiens
gcatacaagtttcattctcc

SEQ ID NO: 4521059 - DNA, 17 bp, Homo sapiens
gcatacaggggaggggc

SEQ ID NO: 4521060 - DNA, 20 bp, Homo sapiens
gcataccacaagacatttct

SEQ ID NO: 4521061 - DNA, 20 bp, Homo sapiens
gcatacgagagcagaggtct

SEQ ID NO: 4521062 - DNA, 22 bp, Homo sapiens
gcatagcacccgtggtgcatgg

SEQ ID NO: 4521063 - DNA, 18 bp, Homo sapiens
gcatagctacaatttgtt

SEQ ID NO: 4521064 - DNA, 15 bp, Homo sapiens
gcatagctctggggt

SEQ ID NO: 4521065 - DNA, 21 bp, Homo sapiens
gcatagtccccagagctcccc

SEQ ID NO: 4521066 - DNA, 20 bp, Homo sapiens
gcatagtgtgctcggacaca

SEQ ID NO: 4521067 - DNA, 21 bp, Homo sapiens
gcatagttgtagacaaagtac

SEQ ID NO: 4521068 - DNA, 16 bp, Homo sapiens
gcatataataaagaag

SEQ ID NO: 4521069 - DNA, 18 bp, Homo sapiens
gcatatgaccctgtttac

SEQ ID NO: 4521070 - DNA, 19 bp, Homo sapiens
gcatatgaggaattaaaga

SEQ ID NO: 4521071 - DNA, 19 bp, Homo sapiens
gcatatgagtaagggcact

SEQ ID NO: 4521072 - DNA, 23 bp, Homo sapiens
gcatatgagtaagggcactgacg

SEQ ID NO: 4521073 - DNA, 12 bp, Homo sapiens
gcatatgttgaa

SEQ ID NO: 4521074 - DNA, 20 bp, Homo sapiens
gcatatgttgaatacttttt

SEQ ID NO: 4521075 - DNA, 20 bp, Homo sapiens
gcatattccctgcacacaca

SEQ ID NO: 4521076 - DNA, 14 bp, Homo sapiens
gcatattgactttt

SEQ ID NO: 4521077 - DNA, 20 bp, Homo sapiens
gcatatttgttactttactt

SEQ ID NO: 4521078 - DNA, 20 bp, Homo sapiens
gcatattttcttacttttat

SEQ ID NO: 4521079 - DNA, 23 bp, Homo sapiens
gcatattttcttacttttattat

SEQ ID NO: 4521080 - DNA, 18 bp, Homo sapiens
gcatattttgagaaactg

SEQ ID NO: 4521081 - DNA, 21 bp, Homo sapiens
gcatattttgagaaactgctg

SEQ ID NO: 4521082 - DNA, 14 bp, Homo sapiens
gcatcaatcttgtt

SEQ ID NO: 4521083 - DNA, 16 bp, Homo sapiens
gcatcacactcaagga

SEQ ID NO: 4521084 - DNA, 20 bp, Homo sapiens
gcatcacacttatattttat

SEQ ID NO: 4521085 - DNA, 13 bp, Homo sapiens
gcatcactgatgg

SEQ ID NO: 4521086 - DNA, 15 bp, Homo sapiens
gcatcactgatggga

SEQ ID NO: 4521087 - DNA, 21 bp, Homo sapiens
gcagaagaattgaacccagga

SEQ ID NO: 4521088 - DNA, 23 bp, Homo sapiens
gcagaagaattgaacccaggagg

SEQ ID NO: 4521089 - DNA, 18 bp, Homo sapiens
gcagaagccccacagcct

SEQ ID NO: 4521090 - DNA, 19 bp, Homo sapiens
gcagaagccccacagcctg

SEQ ID NO: 4521091 - DNA, 21 bp, Homo sapiens
gcagaaggaaggatgccactt

SEQ ID NO: 4521092 - DNA, 15 bp, Homo sapiens
gcagaaggagagtga

SEQ ID NO: 4521093 - DNA, 14 bp, Homo sapiens
gcagaagggggtgg

SEQ ID NO: 4521094 - DNA, 15 bp, Homo sapiens
gcagaagggggtggt

SEQ ID NO: 4521095 - DNA, 15 bp, Homo sapiens
gcagaagtaagcctc

SEQ ID NO: 4521096 - DNA, 15 bp, Homo sapiens
gcagaatgaagggcc

SEQ ID NO: 4521097 - DNA, 19 bp, Homo sapiens
gcagaatgaagggccaggc

SEQ ID NO: 4521098 - DNA, 21 bp, Homo sapiens
gcagaattcattcatacttaa

SEQ ID NO: 4521099 - DNA, 18 bp, Homo sapiens
gcagacaacaccttcctc

SEQ ID NO: 4521100 - DNA, 22 bp, Homo sapiens
gcagacaacaccttcctcctgc

SEQ ID NO: 4521101 - DNA, 19 bp, Homo sapiens
gcagacaccattcattcca

SEQ ID NO: 4521102 - DNA, 16 bp, Homo sapiens
gcagacagccctggca

SEQ ID NO: 4521103 - DNA, 22 bp, Homo sapiens
gcagaccattggggctcccagc

SEQ ID NO: 4521104 - DNA, 23 bp, Homo sapiens
gcagaccattggggctcccagcc

SEQ ID NO: 4521105 - DNA, 15 bp, Homo sapiens
gcagaccccaggttc

SEQ ID NO: 4521106 - DNA, 12 bp, Homo sapiens
gcagacctcaag

SEQ ID NO: 4521107 - DNA, 16 bp, Homo sapiens
gcagacctgtcctcct

SEQ ID NO: 4521108 - DNA, 19 bp, Homo sapiens
gcagacctgtcctcctggt

SEQ ID NO: 4521109 - DNA, 17 bp, Homo sapiens
gcagaccttttttagga

SEQ ID NO: 4521110 - DNA, 13 bp, Homo sapiens
gcagacggtctgt

SEQ ID NO: 4521111 - DNA, 16 bp, Homo sapiens
gcagacgtctgccttg

SEQ ID NO: 4521112 - DNA, 22 bp, Homo sapiens
gcagacgtctgccttggcatcc

SEQ ID NO: 4521113 - DNA, 22 bp, Homo sapiens
gcagactgtgaacttgactggg

SEQ ID NO: 4521114 - DNA, 13 bp, Homo sapiens
gcagagacctcca

SEQ ID NO: 4521115 - DNA, 16 bp, Homo sapiens
gcagagccagggcagg

SEQ ID NO: 4521116 - DNA, 18 bp, Homo sapiens
gcagagccagggcagggc

SEQ ID NO: 4521117 - DNA, 20 bp, Homo sapiens
gcagagcctcccaaggagaa

SEQ ID NO: 4521118 - DNA, 21 bp, Homo sapiens
gcagagccttttacccctgca

SEQ ID NO: 4521119 - DNA, 15 bp, Homo sapiens
gcagagcttttcaga

SEQ ID NO: 4521120 - DNA, 16 bp, Homo sapiens
gcagaggaagcccagc

SEQ ID NO: 4521121 - DNA, 19 bp, Homo sapiens
gcagaggacagtctggaga

SEQ ID NO: 4521122 - DNA, 17 bp, Homo sapiens
gcagaggaggtaagagg

SEQ ID NO: 4521123 - DNA, 14 bp, Homo sapiens
gcagaggcaggctg

SEQ ID NO: 4521124 - DNA, 17 bp, Homo sapiens
gcagaggcaggctggga

SEQ ID NO: 4521125 - DNA, 21 bp, Homo sapiens
gcagaggcaggctgggacgga

SEQ ID NO: 4521126 - DNA, 22 bp, Homo sapiens
gcagaggccctgcccccacccc

SEQ ID NO: 4521127 - DNA, 23 bp, Homo sapiens
gcagaggccctgcccccacccct

SEQ ID NO: 4521128 - DNA, 14 bp, Homo sapiens
gcagaggctttggg

SEQ ID NO: 4521129 - DNA, 16 bp, Homo sapiens
gcagagggagaatcca

SEQ ID NO: 4521130 - DNA, 18 bp, Homo sapiens
gcagagggcagaggctgg

SEQ ID NO: 4521131 - DNA, 13 bp, Homo sapiens
gcagagggctgga

SEQ ID NO: 4521132 - DNA, 14 bp, Homo sapiens
gcagagggctggag

SEQ ID NO: 4521133 - DNA, 18 bp, Homo sapiens
gcagagggctggaggccc

SEQ ID NO: 4521134 - DNA, 20 bp, Homo sapiens
gcagagggctggaggcccag

SEQ ID NO: 4521135 - DNA, 18 bp, Homo sapiens
gcagagttacagttctgt

SEQ ID NO: 4521136 - DNA, 21 bp, Homo sapiens
gcagagttacagttctgtggt

SEQ ID NO: 4521137 - DNA, 14 bp, Homo sapiens
gcagatcatctggg

SEQ ID NO: 4521138 - DNA, 14 bp, Homo sapiens
gcagatctgtgccc

SEQ ID NO: 4521139 - DNA, 22 bp, Homo sapiens
gcagatctgtgccccatgcctg

SEQ ID NO: 4521140 - DNA, 23 bp, Homo sapiens
gcagatcttccgtggtcagagtg

SEQ ID NO: 4521141 - DNA, 17 bp, Homo sapiens
gcagatgagagtttctg

SEQ ID NO: 4521142 - DNA, 16 bp, Homo sapiens
gcagatgtcttccctg

SEQ ID NO: 4521143 - DNA, 19 bp, Homo sapiens
gcagatgtcttccctgggc

SEQ ID NO: 4521144 - DNA, 15 bp, Homo sapiens
gcagatgtgagccac

SEQ ID NO: 4521145 - DNA, 15 bp, Homo sapiens
gcagattctgagcaa

SEQ ID NO: 4521146 - DNA, 18 bp, Homo sapiens
gcagcaaaaccaaactgg

SEQ ID NO: 4521147 - DNA, 21 bp, Homo sapiens
gcagcaaaaccaaactgggtc

SEQ ID NO: 4521148 - DNA, 14 bp, Homo sapiens
gcagcaactgaaaa

SEQ ID NO: 4521149 - DNA, 17 bp, Homo sapiens
gcagcaactgaaaatga

SEQ ID NO: 4521150 - DNA, 19 bp, Homo sapiens
gcagcaactgaaaatgaat

SEQ ID NO: 4521151 - DNA, 16 bp, Homo sapiens
gcagcaatattttgta

SEQ ID NO: 4521152 - DNA, 15 bp, Homo sapiens
gcagcaatcacaaag

SEQ ID NO: 4521153 - DNA, 12 bp, Homo sapiens
gcagcaatttaa

SEQ ID NO: 4521154 - DNA, 14 bp, Homo sapiens
gcagcaccaaccac

SEQ ID NO: 4521155 - DNA, 19 bp, Homo sapiens
gcagcaccctcccccgcag

SEQ ID NO: 4521156 - DNA, 22 bp, Homo sapiens
gcagcacttagacctgccagcc

SEQ ID NO: 4521157 - DNA, 12 bp, Homo sapiens
gcagcagaaggg

SEQ ID NO: 4521158 - DNA, 12 bp, Homo sapiens
gcagcagagagc

SEQ ID NO: 4521159 - DNA, 15 bp, Homo sapiens
gcagcagataacttt

SEQ ID NO: 4521160 - DNA, 13 bp, Homo sapiens
gcagcagcaccaa

SEQ ID NO: 4521161 - DNA, 21 bp, Homo sapiens
gcagcagcacttagacctgcc

SEQ ID NO: 4521162 - DNA, 22 bp, Homo sapiens
gcagcagcacttagacctgcca

SEQ ID NO: 4521163 - DNA, 13 bp, Homo sapiens
gcagcagcctgca

SEQ ID NO: 4521164 - DNA, 15 bp, Homo sapiens
gcagcagcctgcacc

SEQ ID NO: 4521165 - DNA, 17 bp, Homo sapiens
gcagcagcctgcacctg

SEQ ID NO: 4521166 - DNA, 17 bp, Homo sapiens
gcagcagctctgagcca

SEQ ID NO: 4521167 - DNA, 18 bp, Homo sapiens
gcagcagctctgagccag

SEQ ID NO: 4521168 - DNA, 13 bp, Homo sapiens
gcagcaggctcag

SEQ ID NO: 4521169 - DNA, 15 bp, Homo sapiens
gcagcaggctcaggc

SEQ ID NO: 4521170 - DNA, 16 bp, Homo sapiens
gcagcagggaaggccc

SEQ ID NO: 4521171 - DNA, 19 bp, Homo sapiens
gcagcagggctaccctgag

SEQ ID NO: 4521172 - DNA, 20 bp, Homo sapiens
gcagcagggctaccctgagc

SEQ ID NO: 4521173 - DNA, 17 bp, Homo sapiens
gcagcagtcgcccaagc

SEQ ID NO: 4521174 - DNA, 19 bp, Homo sapiens
gcagcagtcgcccaagcag

SEQ ID NO: 4521175 - DNA, 20 bp, Homo sapiens
gcagcagtgtccagagaccc

SEQ ID NO: 4521176 - DNA, 22 bp, Homo sapiens
gcagcagtgtgaggccagggca

SEQ ID NO: 4521177 - DNA, 22 bp, Homo sapiens
gcagcatcggggtggcccactg

SEQ ID NO: 4521178 - DNA, 12 bp, Homo sapiens
gcagcatcttct

SEQ ID NO: 4521179 - DNA, 16 bp, Homo sapiens
gcagcatggcatagcc

SEQ ID NO: 4521180 - DNA, 19 bp, Homo sapiens
gcagcattccatgaccaga

SEQ ID NO: 4521181 - DNA, 11 bp, Homo sapiens
gcagcatttga

SEQ ID NO: 4521182 - DNA, 15 bp, Homo sapiens
gcagcatttgataat

SEQ ID NO: 4521183 - DNA, 18 bp, Homo sapiens
gcagcatttgataatgat

SEQ ID NO: 4521184 - DNA, 17 bp, Homo sapiens
gcagccaagtagcctct

SEQ ID NO: 4521185 - DNA, 19 bp, Homo sapiens
gcagccacccaagcctgct

SEQ ID NO: 4521186 - DNA, 15 bp, Homo sapiens
gcagccagcagaggg

SEQ ID NO: 4521187 - DNA, 16 bp, Homo sapiens
gcagccagcccagccc

SEQ ID NO: 4521188 - DNA, 17 bp, Homo sapiens
gcagccaggagtgcccc

SEQ ID NO: 4521189 - DNA, 21 bp, Homo sapiens
gcagccaggagtgcccccggg

SEQ ID NO: 4521190 - DNA, 12 bp, Homo sapiens
gcagccaggctg

SEQ ID NO: 4521191 - DNA, 14 bp, Homo sapiens
gcagccaggctgcc

SEQ ID NO: 4521192 - DNA, 16 bp, Homo sapiens
gcagcccaacagcact

SEQ ID NO: 4521193 - DNA, 18 bp, Homo sapiens
gcagcccaacagcacttt

SEQ ID NO: 4521194 - DNA, 15 bp, Homo sapiens
gcagcccaccagacg

SEQ ID NO: 4521195 - DNA, 13 bp, Homo sapiens
gcagcccagcagt

SEQ ID NO: 4521196 - DNA, 18 bp, Homo sapiens
gcagcccagcagtgtgga

SEQ ID NO: 4521197 - DNA, 22 bp, Homo sapiens
gcagcccatgcccacctgccca

SEQ ID NO: 4521198 - DNA, 19 bp, Homo sapiens
gcagccccacttcaccccc

SEQ ID NO: 4521199 - DNA, 16 bp, Homo sapiens
gcagcccccactgcac

SEQ ID NO: 4521200 - DNA, 14 bp, Homo sapiens
gcagccccccagca

SEQ ID NO: 4521201 - DNA, 20 bp, Homo sapiens
gcagccccgtggggttcctc

SEQ ID NO: 4521202 - DNA, 15 bp, Homo sapiens
gcagcccctgagagc

SEQ ID NO: 4521203 - DNA, 20 bp, Homo sapiens
gcagcccctgagagcctgtg

SEQ ID NO: 4521204 - DNA, 15 bp, Homo sapiens
gcagcccgcctgccg

SEQ ID NO: 4521205 - DNA, 16 bp, Homo sapiens
gcagcccgcctgccgt

SEQ ID NO: 4521206 - DNA, 17 bp, Homo sapiens
gcagccctagagcctgc

SEQ ID NO: 4521207 - DNA, 19 bp, Homo sapiens
gcagccctagagcctgcct

SEQ ID NO: 4521208 - DNA, 22 bp, Homo sapiens
gcagccctagagcctgcctgga

SEQ ID NO: 4521209 - DNA, 16 bp, Homo sapiens
gcagccctagcggctg

SEQ ID NO: 4521210 - DNA, 15 bp, Homo sapiens
gcagccctcctcacc

SEQ ID NO: 4521211 - DNA, 13 bp, Homo sapiens
gcagccctggatg

SEQ ID NO: 4521212 - DNA, 13 bp, Homo sapiens
gcagccgccagct

SEQ ID NO: 4521213 - DNA, 15 bp, Homo sapiens
gcagccgccagctgg

SEQ ID NO: 4521214 - DNA, 17 bp, Homo sapiens
gcagccgccagctggga

SEQ ID NO: 4521215 - DNA, 16 bp, Homo sapiens
gcagccgtccatagca

SEQ ID NO: 4521216 - DNA, 22 bp, Homo sapiens
gcagcctcatactcctgggctc

SEQ ID NO: 4521217 - DNA, 16 bp, Homo sapiens
gcagcctccagggccc

SEQ ID NO: 4521218 - DNA, 21 bp, Homo sapiens
gcagcctccgggcgtgtgaag

SEQ ID NO: 4521219 - DNA, 20 bp, Homo sapiens
gcagcctctccgactctgca

SEQ ID NO: 4521220 - DNA, 15 bp, Homo sapiens
gcagcctctggacag

SEQ ID NO: 4521221 - DNA, 21 bp, Homo sapiens
gcagcctctggacagccagtg

SEQ ID NO: 4521222 - DNA, 15 bp, Homo sapiens
gcagcctgcacctgc

SEQ ID NO: 4521223 - DNA, 20 bp, Homo sapiens
gcagcctgcacctgccccgt

SEQ ID NO: 4521224 - DNA, 22 bp, Homo sapiens
gcagcctgctataaagttaaag

SEQ ID NO: 4521225 - DNA, 15 bp, Homo sapiens
gcagccttcccctcc

SEQ ID NO: 4521226 - DNA, 16 bp, Homo sapiens
gcagccttcccctccc

SEQ ID NO: 4521227 - DNA, 18 bp, Homo sapiens
gcagccttcccctccctg

SEQ ID NO: 4521228 - DNA, 21 bp, Homo sapiens
gcagccttcccctccctgtat

SEQ ID NO: 4521229 - DNA, 13 bp, Homo sapiens
gcagcgaccaccc

SEQ ID NO: 4521230 - DNA, 14 bp, Homo sapiens
gcagcgaccacccc

SEQ ID NO: 4521231 - DNA, 16 bp, Homo sapiens
gcagcgaccacccctg

SEQ ID NO: 4521232 - DNA, 20 bp, Homo sapiens
gcagcgaccacccctgcctc

SEQ ID NO: 4521233 - DNA, 22 bp, Homo sapiens
gcagcggctgccctctggggcc

SEQ ID NO: 4521234 - DNA, 16 bp, Homo sapiens
gcagcgtgtgtgccac

SEQ ID NO: 4521235 - DNA, 13 bp, Homo sapiens
gcagctaggcgcg

SEQ ID NO: 4521236 - DNA, 13 bp, Homo sapiens
gcagctagtgcct

SEQ ID NO: 4521237 - DNA, 19 bp, Homo sapiens
gcagctatgcgcaatgtgg

SEQ ID NO: 4521238 - DNA, 21 bp, Homo sapiens
gcagctatgcgcaatgtggca

SEQ ID NO: 4521239 - DNA, 17 bp, Homo sapiens
gcagctccctggcttct

SEQ ID NO: 4521240 - DNA, 21 bp, Homo sapiens
gcagctccctggcttctgtgg

SEQ ID NO: 4521241 - DNA, 16 bp, Homo sapiens
gcagctccctttctca

SEQ ID NO: 4521242 - DNA, 19 bp, Homo sapiens
gcagctctgagccagatta

SEQ ID NO: 4521243 - DNA, 21 bp, Homo sapiens
gcagctctgagccagattaca

SEQ ID NO: 4521244 - DNA, 14 bp, Homo sapiens
gcagctctggctct

SEQ ID NO: 4521245 - DNA, 18 bp, Homo sapiens
gcagctctggctctgcct

SEQ ID NO: 4521246 - DNA, 16 bp, Homo sapiens
gcagctgcctctgctc

SEQ ID NO: 4521247 - DNA, 19 bp, Homo sapiens
gcagctgcctctgctccct

SEQ ID NO: 4521248 - DNA, 21 bp, Homo sapiens
gcagctgcctctgctccctct

SEQ ID NO: 4521249 - DNA, 11 bp, Homo sapiens
gcagctgctgt

SEQ ID NO: 4521250 - DNA, 12 bp, Homo sapiens
gcagctgctgtg

SEQ ID NO: 4521251 - DNA, 22 bp, Homo sapiens
gcagctgctgtgggtggggccc

SEQ ID NO: 4521252 - DNA, 21 bp, Homo sapiens
gcagctggaatgtgccacaga

SEQ ID NO: 4521253 - DNA, 24 bp, Homo sapiens
gcagctggaatgtgccacagaggc

SEQ ID NO: 4521254 - DNA, 14 bp, Homo sapiens
gcagctgggcccaa

SEQ ID NO: 4521255 - DNA, 21 bp, Homo sapiens
gcagctgggcccaaccctgtc

SEQ ID NO: 4521256 - DNA, 22 bp, Homo sapiens
gcagctgggcccaaccctgtct

SEQ ID NO: 4521257 - DNA, 17 bp, Homo sapiens
gcagctgtcctgtgatg

SEQ ID NO: 4521258 - DNA, 21 bp, Homo sapiens
gcagcttcaacttttctcttt

SEQ ID NO: 4521259 - DNA, 21 bp, Homo sapiens
gcagcttcacccaccaggcca

SEQ ID NO: 4521260 - DNA, 21 bp, Homo sapiens
gcagcttcgaggacaggaaag

SEQ ID NO: 4521261 - DNA, 18 bp, Homo sapiens
gcagcttctactcctgcc

SEQ ID NO: 4521262 - DNA, 15 bp, Homo sapiens
gcagcttctagacag

SEQ ID NO: 4521263 - DNA, 22 bp, Homo sapiens
gcagctttaacctgctgggaat

SEQ ID NO: 4521264 - DNA, 15 bp, Homo sapiens
gcaggaaaaaaggaa

SEQ ID NO: 4521265 - DNA, 22 bp, Homo sapiens
gcaggaaaaggctaagaaaaag

SEQ ID NO: 4521266 - DNA, 21 bp, Homo sapiens
gcaggaaatgaaaatgtcttg

SEQ ID NO: 4521267 - DNA, 23 bp, Homo sapiens
gcaggaaatgaaaatgtcttgtg

SEQ ID NO: 4521268 - DNA, 18 bp, Homo sapiens
gcaggaacaaacagggct

SEQ ID NO: 4521269 - DNA, 18 bp, Homo sapiens
gcaggaaggaacaaagac

SEQ ID NO: 4521270 - DNA, 17 bp, Homo sapiens
gcaggaaggagagcctg

SEQ ID NO: 4521271 - DNA, 17 bp, Homo sapiens
gcaggaatcacccctct

SEQ ID NO: 4521272 - DNA, 20 bp, Homo sapiens
gcaggaatcacccctctgcc

SEQ ID NO: 4521273 - DNA, 24 bp, Homo sapiens
gcaggaatcacccctctgcccctg

SEQ ID NO: 4521274 - DNA, 14 bp, Homo sapiens
gcaggactccaggc

SEQ ID NO: 4521275 - DNA, 18 bp, Homo sapiens
gcaggactccaggcccaa

SEQ ID NO: 4521276 - DNA, 22 bp, Homo sapiens
gcaggagaagaacaagaaatgg

SEQ ID NO: 4521277 - DNA, 14 bp, Homo sapiens
gcaggagcccccct

SEQ ID NO: 4521278 - DNA, 18 bp, Homo sapiens
gcaggagccccgccacag

SEQ ID NO: 4521279 - DNA, 20 bp, Homo sapiens
gcaggagctagttctcagct

SEQ ID NO: 4521280 - DNA, 13 bp, Homo sapiens
gcaggagcttggg

SEQ ID NO: 4521281 - DNA, 19 bp, Homo sapiens
gcaggaggaaaaggcttgg

SEQ ID NO: 4521282 - DNA, 15 bp, Homo sapiens
gcaggaggagctgcc

SEQ ID NO: 4521283 - DNA, 15 bp, Homo sapiens
gcaggagggaggtgc

SEQ ID NO: 4521284 - DNA, 18 bp, Homo sapiens
gcaggagggccctacctg

SEQ ID NO: 4521285 - DNA, 22 bp, Homo sapiens
gcaggagggccctacctgattg

SEQ ID NO: 4521286 - DNA, 16 bp, Homo sapiens
gcaggatctgtctgtg

SEQ ID NO: 4521287 - DNA, 17 bp, Homo sapiens
gcaggatggcctttcct

SEQ ID NO: 4521288 - DNA, 21 bp, Homo sapiens
gcaggatggcctttccttccc

SEQ ID NO: 4521289 - DNA, 23 bp, Homo sapiens
gcaggatggcctttccttccctc

SEQ ID NO: 4521290 - DNA, 23 bp, Homo sapiens
gcaggcaagagaattgaaatgag

SEQ ID NO: 4521291 - DNA, 17 bp, Homo sapiens
gcaggcacacagcagcc

SEQ ID NO: 4521292 - DNA, 14 bp, Homo sapiens
gcaggcaccgccac

SEQ ID NO: 4521293 - DNA, 16 bp, Homo sapiens
gcaggcaccgccacgt

SEQ ID NO: 4521294 - DNA, 22 bp, Homo sapiens
gcaggcaccgccacgtcccagc

SEQ ID NO: 4521295 - DNA, 18 bp, Homo sapiens
gcaggcaggaacaaacag

SEQ ID NO: 4521296 - DNA, 20 bp, Homo sapiens
gcaggcaggtgtttattaaa

SEQ ID NO: 4521297 - DNA, 17 bp, Homo sapiens
gcaggcatagaggcttc

SEQ ID NO: 4521298 - DNA, 22 bp, Homo sapiens
gcaggcatcggggagccgggag

SEQ ID NO: 4521299 - DNA, 21 bp, Homo sapiens
gcaggcatttgctaaggcagc

SEQ ID NO: 4521300 - DNA, 15 bp, Homo sapiens
gcaggccaaggtctg

SEQ ID NO: 4521301 - DNA, 16 bp, Homo sapiens
gcaggccaaggtctga

SEQ ID NO: 4521302 - DNA, 19 bp, Homo sapiens
gcaggccagatggcccctc

SEQ ID NO: 4521303 - DNA, 16 bp, Homo sapiens
gcaggcccactcccca

SEQ ID NO: 4521304 - DNA, 17 bp, Homo sapiens
gcaggcccactccccag

SEQ ID NO: 4521305 - DNA, 18 bp, Homo sapiens
gcaggcccactccccagc

SEQ ID NO: 4521306 - DNA, 15 bp, Homo sapiens
gcaggctactgtcag

SEQ ID NO: 4521307 - DNA, 19 bp, Homo sapiens
gcaggctcactgccaggcc

SEQ ID NO: 4521308 - DNA, 22 bp, Homo sapiens
gcaggctcactgccaggccagc

SEQ ID NO: 4521309 - DNA, 11 bp, Homo sapiens
gcaggctgggc

SEQ ID NO: 4521310 - DNA, 12 bp, Homo sapiens
gcaggctgggcc

SEQ ID NO: 4521311 - DNA, 13 bp, Homo sapiens
gcaggctggggag

SEQ ID NO: 4521312 - DNA, 19 bp, Homo sapiens
gcaggctggggaggtgctg

SEQ ID NO: 4521313 - DNA, 15 bp, Homo sapiens
gcagggaaggcctga

SEQ ID NO: 4521314 - DNA, 16 bp, Homo sapiens
gcagggaaggcctgac

SEQ ID NO: 4521315 - DNA, 22 bp, Homo sapiens
gcagggaatgcagcaggaagga

SEQ ID NO: 4521316 - DNA, 19 bp, Homo sapiens
gcagggacttgaacccata

SEQ ID NO: 4521317 - DNA, 19 bp, Homo sapiens
gcagggagacatctgcacc

SEQ ID NO: 4521318 - DNA, 18 bp, Homo sapiens
gcagggagttagcactga

SEQ ID NO: 4521319 - DNA, 15 bp, Homo sapiens
gcagggccaggcctc

SEQ ID NO: 4521320 - DNA, 17 bp, Homo sapiens
gcagggccaggcctctg

SEQ ID NO: 4521321 - DNA, 21 bp, Homo sapiens
gcagggccccaggcattgcca

SEQ ID NO: 4521322 - DNA, 17 bp, Homo sapiens
gcagggcccccaataaa

SEQ ID NO: 4521323 - DNA, 18 bp, Homo sapiens
gcagggcccccaataaac

SEQ ID NO: 4521324 - DNA, 19 bp, Homo sapiens
gcagggcccccaataaacc

SEQ ID NO: 4521325 - DNA, 20 bp, Homo sapiens
gcagggcccccaataaacca

SEQ ID NO: 4521326 - DNA, 14 bp, Homo sapiens
gcagggcctggctc

SEQ ID NO: 4521327 - DNA, 18 bp, Homo sapiens
gccacctgcaagatggac

SEQ ID NO: 4521328 - DNA, 11 bp, Homo sapiens
gccacctgccc

SEQ ID NO: 4521329 - DNA, 23 bp, Homo sapiens
gccacctttcaccctcatgaaaa

SEQ ID NO: 4521330 - DNA, 12 bp, Homo sapiens
gccacctttgtg

SEQ ID NO: 4521331 - DNA, 17 bp, Homo sapiens
gccacctttgtgcagct

SEQ ID NO: 4521332 - DNA, 15 bp, Homo sapiens
gccacgccctccctg

SEQ ID NO: 4521333 - DNA, 17 bp, Homo sapiens
gccacgccctccctgct

SEQ ID NO: 4521334 - DNA, 15 bp, Homo sapiens
gccacgctccagctg

SEQ ID NO: 4521335 - DNA, 16 bp, Homo sapiens
gccacgctccagctgc

SEQ ID NO: 4521336 - DNA, 15 bp, Homo sapiens
gccacgctgtcctct

SEQ ID NO: 4521337 - DNA, 21 bp, Homo sapiens
gccacgctgtcctctcgagcc

SEQ ID NO: 4521338 - DNA, 19 bp, Homo sapiens
gccacggagcgggaggcag

SEQ ID NO: 4521339 - DNA, 14 bp, Homo sapiens
gccacgtgccaggc

SEQ ID NO: 4521340 - DNA, 23 bp, Homo sapiens
gccacgtgtttgtgctgtggtgt

SEQ ID NO: 4521341 - DNA, 21 bp, Homo sapiens
gccacgttccttactgcagaa

SEQ ID NO: 4521342 - DNA, 15 bp, Homo sapiens
gccactcagcttcct

SEQ ID NO: 4521343 - DNA, 15 bp, Homo sapiens
gccactcatttcatc

SEQ ID NO: 4521344 - DNA, 15 bp, Homo sapiens
gccactccctgggac

SEQ ID NO: 4521345 - DNA, 17 bp, Homo sapiens
gccactcctctgactca

SEQ ID NO: 4521346 - DNA, 20 bp, Homo sapiens
gccactccttccttcaggac

SEQ ID NO: 4521347 - DNA, 22 bp, Homo sapiens
gccactccttccttcaggactc

SEQ ID NO: 4521348 - DNA, 14 bp, Homo sapiens
gccactcgccttct

SEQ ID NO: 4521349 - DNA, 19 bp, Homo sapiens
gccactcgccttcttagag

SEQ ID NO: 4521350 - DNA, 15 bp, Homo sapiens
gccactctctgggac

SEQ ID NO: 4521351 - DNA, 23 bp, Homo sapiens
gccactgccccccgaggctgcta

SEQ ID NO: 4521352 - DNA, 23 bp, Homo sapiens
gccactgcttttccctttgtgag

SEQ ID NO: 4521353 - DNA, 23 bp, Homo sapiens
gccactggaaggaacatggagct

SEQ ID NO: 4521354 - DNA, 18 bp, Homo sapiens
gccactggatcctgctgc

SEQ ID NO: 4521355 - DNA, 18 bp, Homo sapiens
gccactggggactttatt

SEQ ID NO: 4521356 - DNA, 16 bp, Homo sapiens
gccactgtcacaggca

SEQ ID NO: 4521357 - DNA, 18 bp, Homo sapiens
gccacttaaaatgttcac

SEQ ID NO: 4521358 - DNA, 13 bp, Homo sapiens
gccacttaatgta

SEQ ID NO: 4521359 - DNA, 23 bp, Homo sapiens
gccacttctcactcaccactacc

SEQ ID NO: 4521360 - DNA, 15 bp, Homo sapiens
gccacttgggaatga

SEQ ID NO: 4521361 - DNA, 23 bp, Homo sapiens
gccacttttgactagggattcag

SEQ ID NO: 4521362 - DNA, 22 bp, Homo sapiens
gccagacatcaacagataaata

SEQ ID NO: 4521363 - DNA, 21 bp, Homo sapiens
gccagaccaaggcgagtttcc

SEQ ID NO: 4521364 - DNA, 19 bp, Homo sapiens
gccagaccgcagagaggct

SEQ ID NO: 4521365 - DNA, 15 bp, Homo sapiens
gccagactggcacag

SEQ ID NO: 4521366 - DNA, 19 bp, Homo sapiens
gccagactggcacagtttt

SEQ ID NO: 4521367 - DNA, 17 bp, Homo sapiens
gccagactgtccaggga

SEQ ID NO: 4521368 - DNA, 21 bp, Homo sapiens
gccagacttcccacggctcct

SEQ ID NO: 4521369 - DNA, 16 bp, Homo sapiens
gccagagcaaacagaa

SEQ ID NO: 4521370 - DNA, 17 bp, Homo sapiens
gccagagcaaacagaaa

SEQ ID NO: 4521371 - DNA, 16 bp, Homo sapiens
gccagagccccaagca

SEQ ID NO: 4521372 - DNA, 17 bp, Homo sapiens
gccagagccccaagcag

SEQ ID NO: 4521373 - DNA, 18 bp, Homo sapiens
gccagagccccaagcagg

SEQ ID NO: 4521374 - DNA, 12 bp, Homo sapiens
gccagagcctct

SEQ ID NO: 4521375 - DNA, 13 bp, Homo sapiens
gccagagcctctg

SEQ ID NO: 4521376 - DNA, 15 bp, Homo sapiens
gccagagcctctggc

SEQ ID NO: 4521377 - DNA, 18 bp, Homo sapiens
gccagagcctctggcccc

SEQ ID NO: 4521378 - DNA, 16 bp, Homo sapiens
gccagagcctggggtg

SEQ ID NO: 4521379 - DNA, 11 bp, Homo sapiens
gccagaggccc

SEQ ID NO: 4521380 - DNA, 14 bp, Homo sapiens
gccagaggccctgg

SEQ ID NO: 4521381 - DNA, 16 bp, Homo sapiens
gccagaggccctggag

SEQ ID NO: 4521382 - DNA, 19 bp, Homo sapiens
gccagaggccctggaggga

SEQ ID NO: 4521383 - DNA, 13 bp, Homo sapiens
gccagaggctggg

SEQ ID NO: 4521384 - DNA, 16 bp, Homo sapiens
gccagaggctgggagt

SEQ ID NO: 4521385 - DNA, 14 bp, Homo sapiens
gccagagtggcctg

SEQ ID NO: 4521386 - DNA, 15 bp, Homo sapiens
gccagagtggcctgg

SEQ ID NO: 4521387 - DNA, 22 bp, Homo sapiens
gccagagtggcctggccaggag

SEQ ID NO: 4521388 - DNA, 23 bp, Homo sapiens
gccagagtggcctggccaggagc

SEQ ID NO: 4521389 - DNA, 21 bp, Homo sapiens
gccagatggcccctccactgg

SEQ ID NO: 4521390 - DNA, 14 bp, Homo sapiens
gccagattctgcct

SEQ ID NO: 4521391 - DNA, 16 bp, Homo sapiens
gccagattctgcctct

SEQ ID NO: 4521392 - DNA, 17 bp, Homo sapiens
gccagattctgcctctc

SEQ ID NO: 4521393 - DNA, 16 bp, Homo sapiens
gccagatttgtctttt

SEQ ID NO: 4521394 - DNA, 16 bp, Homo sapiens
gccagcaccctctcct

SEQ ID NO: 4521395 - DNA, 17 bp, Homo sapiens
gccagcaccctctcctg

SEQ ID NO: 4521396 - DNA, 19 bp, Homo sapiens
gccagcagagccagggcag

SEQ ID NO: 4521397 - DNA, 18 bp, Homo sapiens
gccagcagcagcaacctg

SEQ ID NO: 4521398 - DNA, 22 bp, Homo sapiens
gccagcagcttaagtccagctc

SEQ ID NO: 4521399 - DNA, 20 bp, Homo sapiens
gccagcaggcgggctccttt

SEQ ID NO: 4521400 - DNA, 14 bp, Homo sapiens
gccagcattccaga

SEQ ID NO: 4521401 - DNA, 22 bp, Homo sapiens
gccagcattccagacttcaaaa

SEQ ID NO: 4521402 - DNA, 15 bp, Homo sapiens
gccagcccagccagg

SEQ ID NO: 4521403 - DNA, 14 bp, Homo sapiens
gccagcccagccca

SEQ ID NO: 4521404 - DNA, 20 bp, Homo sapiens
gccagcccatggcccccaat

SEQ ID NO: 4521405 - DNA, 21 bp, Homo sapiens
gccagcccatggcccccaata

SEQ ID NO: 4521406 - DNA, 15 bp, Homo sapiens
gccagccctccctgt

SEQ ID NO: 4521407 - DNA, 23 bp, Homo sapiens
gccagccctccctgtcctcctcg

SEQ ID NO: 4521408 - DNA, 21 bp, Homo sapiens
gccagcccttccctggccccg

SEQ ID NO: 4521409 - DNA, 15 bp, Homo sapiens
gccagccgccctggg

SEQ ID NO: 4521410 - DNA, 18 bp, Homo sapiens
gccagccgccctgggctg

SEQ ID NO: 4521411 - DNA, 19 bp, Homo sapiens
gccagcctcagaaggcccc

SEQ ID NO: 4521412 - DNA, 20 bp, Homo sapiens
gccagcctcagaaggcccca

SEQ ID NO: 4521413 - DNA, 21 bp, Homo sapiens
gccagcctccgagagggagag

SEQ ID NO: 4521414 - DNA, 17 bp, Homo sapiens
gccagcgcctccctcca

SEQ ID NO: 4521415 - DNA, 18 bp, Homo sapiens
gccagcgcctccctccac

SEQ ID NO: 4521416 - DNA, 18 bp, Homo sapiens
gccagcggggctgctcac

SEQ ID NO: 4521417 - DNA, 19 bp, Homo sapiens
gccagcgtcctcctctgtg

SEQ ID NO: 4521418 - DNA, 16 bp, Homo sapiens
gccagcgtttattgta

SEQ ID NO: 4521419 - DNA, 12 bp, Homo sapiens
gccagctcagga

SEQ ID NO: 4521420 - DNA, 23 bp, Homo sapiens
gccagctctgtatcaggacccag

SEQ ID NO: 4521421 - DNA, 19 bp, Homo sapiens
gccagctgcccttgcaggg

SEQ ID NO: 4521422 - DNA, 20 bp, Homo sapiens
gccagctgcggccaggcctg

SEQ ID NO: 4521423 - DNA, 13 bp, Homo sapiens
gccagcttaaacc

SEQ ID NO: 4521424 - DNA, 20 bp, Homo sapiens
gccagcttaaacccatacaa

SEQ ID NO: 4521425 - DNA, 22 bp, Homo sapiens
gccagcttaaacccatacaatg

SEQ ID NO: 4521426 - DNA, 15 bp, Homo sapiens
gccaggaacctgtcc

SEQ ID NO: 4521427 - DNA, 22 bp, Homo sapiens
gccaggaacctgtcctaaggaa

SEQ ID NO: 4521428 - DNA, 17 bp, Homo sapiens
gccaggaagccagagcc

SEQ ID NO: 4521429 - DNA, 13 bp, Homo sapiens
gccaggaatattg

SEQ ID NO: 4521430 - DNA, 15 bp, Homo sapiens
gccaggagcagccct

SEQ ID NO: 4521431 - DNA, 17 bp, Homo sapiens
gccaggagcagccctgg

SEQ ID NO: 4521432 - DNA, 17 bp, Homo sapiens
gccaggataaagcttcc

SEQ ID NO: 4521433 - DNA, 17 bp, Homo sapiens
gccaggcacacactgtg

SEQ ID NO: 4521434 - DNA, 22 bp, Homo sapiens
gccaggcacacactgtgctttc

SEQ ID NO: 4521435 - DNA, 23 bp, Homo sapiens
gccaggcacacactgtgctttct

SEQ ID NO: 4521436 - DNA, 16 bp, Homo sapiens
gccaggcaggggtggg

SEQ ID NO: 4521437 - DNA, 23 bp, Homo sapiens
gccaggcagtaaggtagaaatag

SEQ ID NO: 4521438 - DNA, 19 bp, Homo sapiens
gccaggcattggctcagcc

SEQ ID NO: 4521439 - DNA, 12 bp, Homo sapiens
gccaggccagca

SEQ ID NO: 4521440 - DNA, 18 bp, Homo sapiens
gccaggcccggggctggc

SEQ ID NO: 4521441 - DNA, 18 bp, Homo sapiens
gccaggcctctgctggct

SEQ ID NO: 4521442 - DNA, 21 bp, Homo sapiens
gccaggcctcttggcagtcac

SEQ ID NO: 4521443 - DNA, 14 bp, Homo sapiens
gccaggcctgcggg

SEQ ID NO: 4521444 - DNA, 22 bp, Homo sapiens
gccaggcctgcgggcccctggt

SEQ ID NO: 4521445 - DNA, 13 bp, Homo sapiens
gccaggcctggct

SEQ ID NO: 4521446 - DNA, 15 bp, Homo sapiens
gccaggctaattttt

SEQ ID NO: 4521447 - DNA, 13 bp, Homo sapiens
gcatttgcctgct

SEQ ID NO: 4521448 - DNA, 21 bp, Homo sapiens
gcatttggtgagagtcaaagc

SEQ ID NO: 4521449 - DNA, 13 bp, Homo sapiens
gcatttgtcaatg

SEQ ID NO: 4521450 - DNA, 12 bp, Homo sapiens
gcatttgtctat

SEQ ID NO: 4521451 - DNA, 17 bp, Homo sapiens
gcattttcctcctctgc

SEQ ID NO: 4521452 - DNA, 18 bp, Homo sapiens
gcattttcctcctctgcc

SEQ ID NO: 4521453 - DNA, 20 bp, Homo sapiens
gcattttctaagtgggacat

SEQ ID NO: 4521454 - DNA, 16 bp, Homo sapiens
gcattttggtttttcc

SEQ ID NO: 4521455 - DNA, 18 bp, Homo sapiens
gcattttggtttttcctc

SEQ ID NO: 4521456 - DNA, 18 bp, Homo sapiens
gcatttttaaacttgaaa

SEQ ID NO: 4521457 - DNA, 20 bp, Homo sapiens
gcatttttcaatatattgaa

SEQ ID NO: 4521458 - DNA, 16 bp, Homo sapiens
gcatttttccatctgt

SEQ ID NO: 4521459 - DNA, 20 bp, Homo sapiens
gcatttttgttttgaaagtt

SEQ ID NO: 4521460 - DNA, 17 bp, Homo sapiens
gccaaaacaagccaaag

SEQ ID NO: 4521461 - DNA, 18 bp, Homo sapiens
gccaaaaccaaacccagg

SEQ ID NO: 4521462 - DNA, 19 bp, Homo sapiens
gccaaaaggaaaaagctcc

SEQ ID NO: 4521463 - DNA, 23 bp, Homo sapiens
gccaaaaggaaaaagctccatgt

SEQ ID NO: 4521464 - DNA, 18 bp, Homo sapiens
gccaaaagtccctccctg

SEQ ID NO: 4521465 - DNA, 17 bp, Homo sapiens
gccaaaatataatcaga

SEQ ID NO: 4521466 - DNA, 17 bp, Homo sapiens
gccaaaccaagcaaatt

SEQ ID NO: 4521467 - DNA, 19 bp, Homo sapiens
gccaaacccttgctttcct

SEQ ID NO: 4521468 - DNA, 22 bp, Homo sapiens
gccaaacctcctgtcagtgagg

SEQ ID NO: 4521469 - DNA, 13 bp, Homo sapiens
gccaaagcatgcc

SEQ ID NO: 4521470 - DNA, 16 bp, Homo sapiens
gccaaagctagggtgg

SEQ ID NO: 4521471 - DNA, 23 bp, Homo sapiens
gccaaaggttcagaaaattaaac

SEQ ID NO: 4521472 - DNA, 15 bp, Homo sapiens
gccaaagtacagaat

SEQ ID NO: 4521473 - DNA, 22 bp, Homo sapiens
gccaaatccttggagtcccagg

SEQ ID NO: 4521474 - DNA, 19 bp, Homo sapiens
gccaaatttcctgtttgaa

SEQ ID NO: 4521475 - DNA, 15 bp, Homo sapiens
gccaacctaaaactc

SEQ ID NO: 4521476 - DNA, 21 bp, Homo sapiens
gccaacctcaggctcctaaag

SEQ ID NO: 4521477 - DNA, 23 bp, Homo sapiens
gccaacgagacacattgccttct

SEQ ID NO: 4521478 - DNA, 16 bp, Homo sapiens
gccaactagcccctgg

SEQ ID NO: 4521479 - DNA, 23 bp, Homo sapiens
gccaactgccaggctgcctcctg

SEQ ID NO: 4521480 - DNA, 15 bp, Homo sapiens
gccaagaaacgtctt

SEQ ID NO: 4521481 - DNA, 21 bp, Homo sapiens
gccaagaaacgtcttctaaac

SEQ ID NO: 4521482 - DNA, 22 bp, Homo sapiens
gccaagaaacgtcttctaaact

SEQ ID NO: 4521483 - DNA, 13 bp, Homo sapiens
gccaagaatactt

SEQ ID NO: 4521484 - DNA, 16 bp, Homo sapiens
gccaagaatacttgaa

SEQ ID NO: 4521485 - DNA, 19 bp, Homo sapiens
gccaagacgggatgattgc

SEQ ID NO: 4521486 - DNA, 14 bp, Homo sapiens
gccaagactcctca

SEQ ID NO: 4521487 - DNA, 15 bp, Homo sapiens
gccaagactcctcag

SEQ ID NO: 4521488 - DNA, 16 bp, Homo sapiens
gccaagattgtccttt

SEQ ID NO: 4521489 - DNA, 23 bp, Homo sapiens
gccaagattttcctcttgtgatt

SEQ ID NO: 4521490 - DNA, 13 bp, Homo sapiens
gccaagcaggctg

SEQ ID NO: 4521491 - DNA, 13 bp, Homo sapiens
gccaagccctggc

SEQ ID NO: 4521492 - DNA, 15 bp, Homo sapiens
gccaagccctggccc

SEQ ID NO: 4521493 - DNA, 17 bp, Homo sapiens
gccaagctaatctgcct

SEQ ID NO: 4521494 - DNA, 15 bp, Homo sapiens
gccaagctttaaatt

SEQ ID NO: 4521495 - DNA, 16 bp, Homo sapiens
gccaaggacccaggcg

SEQ ID NO: 4521496 - DNA, 10 bp, Homo sapiens
gccaaggagg

SEQ ID NO: 4521497 - DNA, 19 bp, Homo sapiens
gccaaggaggcctggggag

SEQ ID NO: 4521498 - DNA, 15 bp, Homo sapiens
gccaaggctctcccc

SEQ ID NO: 4521499 - DNA, 17 bp, Homo sapiens
gccaaggctctcccctc

SEQ ID NO: 4521500 - DNA, 18 bp, Homo sapiens
gccaaggctctcccctct

SEQ ID NO: 4521501 - DNA, 20 bp, Homo sapiens
gccaagggtcctcacccctc

SEQ ID NO: 4521502 - DNA, 22 bp, Homo sapiens
gccaagtaaaatgttttttaaa

SEQ ID NO: 4521503 - DNA, 16 bp, Homo sapiens
gccaagtaaacagggt

SEQ ID NO: 4521504 - DNA, 16 bp, Homo sapiens
gccaagtaagaaagtg

SEQ ID NO: 4521505 - DNA, 17 bp, Homo sapiens
gccaagtctcagaagag

SEQ ID NO: 4521506 - DNA, 13 bp, Homo sapiens
gccaagtggccac

SEQ ID NO: 4521507 - DNA, 13 bp, Homo sapiens
gccaagtgtcttt

SEQ ID NO: 4521508 - DNA, 17 bp, Homo sapiens
gccaataaaatgtatct

SEQ ID NO: 4521509 - DNA, 16 bp, Homo sapiens
gccaatacagacaaag

SEQ ID NO: 4521510 - DNA, 15 bp, Homo sapiens
gccaatcaagggcaa

SEQ ID NO: 4521511 - DNA, 17 bp, Homo sapiens
gccaatcttaaagacaa

SEQ ID NO: 4521512 - DNA, 21 bp, Homo sapiens
gccaatgcacctaaagaaaaa

SEQ ID NO: 4521513 - DNA, 21 bp, Homo sapiens
gccaatgttatgccagctcca

SEQ ID NO: 4521514 - DNA, 13 bp, Homo sapiens
gccaattcagttt

SEQ ID NO: 4521515 - DNA, 20 bp, Homo sapiens
gccaattgctaccgagaagg

SEQ ID NO: 4521516 - DNA, 16 bp, Homo sapiens
gccaatttcaccccat

SEQ ID NO: 4521517 - DNA, 15 bp, Homo sapiens
gccaattttggatga

SEQ ID NO: 4521518 - DNA, 14 bp, Homo sapiens
gccacaaagccccc

SEQ ID NO: 4521519 - DNA, 16 bp, Homo sapiens
gccacaaagcccccca

SEQ ID NO: 4521520 - DNA, 20 bp, Homo sapiens
gccacaaagccccccagctc

SEQ ID NO: 4521521 - DNA, 22 bp, Homo sapiens
gccacaaagccccccagctccc

SEQ ID NO: 4521522 - DNA, 20 bp, Homo sapiens
gccacaaagctaggatggtt

SEQ ID NO: 4521523 - DNA, 19 bp, Homo sapiens
gccacacaaacgtttactt

SEQ ID NO: 4521524 - DNA, 21 bp, Homo sapiens
gccacacaggcagggcctggc

SEQ ID NO: 4521525 - DNA, 13 bp, Homo sapiens
gccacacccctct

SEQ ID NO: 4521526 - DNA, 18 bp, Homo sapiens
gccacacccctctgctgc

SEQ ID NO: 4521527 - DNA, 14 bp, Homo sapiens
gccacagagaacct

SEQ ID NO: 4521528 - DNA, 19 bp, Homo sapiens
gccacagcagcatttttat

SEQ ID NO: 4521529 - DNA, 16 bp, Homo sapiens
gccacagccagaggag

SEQ ID NO: 4521530 - DNA, 13 bp, Homo sapiens
gccacagctgctg

SEQ ID NO: 4521531 - DNA, 18 bp, Homo sapiens
gccacagctgctggagaa

SEQ ID NO: 4521532 - DNA, 21 bp, Homo sapiens
gccacaggaaggaggggagag

SEQ ID NO: 4521533 - DNA, 20 bp, Homo sapiens
gccacaggccaaatccttgg

SEQ ID NO: 4521534 - DNA, 20 bp, Homo sapiens
gccacaggcctgagatttca

SEQ ID NO: 4521535 - DNA, 23 bp, Homo sapiens
gccacagggaagctcacacatcc

SEQ ID NO: 4521536 - DNA, 17 bp, Homo sapiens
gccacagggagctccgt

SEQ ID NO: 4521537 - DNA, 18 bp, Homo sapiens
gccacatcacacagacct

SEQ ID NO: 4521538 - DNA, 15 bp, Homo sapiens
gccacatgccccagg

SEQ ID NO: 4521539 - DNA, 21 bp, Homo sapiens
gccacatggagccccctctgc

SEQ ID NO: 4521540 - DNA, 15 bp, Homo sapiens
gccacatgggaggct

SEQ ID NO: 4521541 - DNA, 17 bp, Homo sapiens
gccacatggtgtctccc

SEQ ID NO: 4521542 - DNA, 14 bp, Homo sapiens
gccacatttggaat

SEQ ID NO: 4521543 - DNA, 22 bp, Homo sapiens
gccaccaagagggacgcctggg

SEQ ID NO: 4521544 - DNA, 16 bp, Homo sapiens
gccaccaagctgctct

SEQ ID NO: 4521545 - DNA, 13 bp, Homo sapiens
gccaccagccccc

SEQ ID NO: 4521546 - DNA, 13 bp, Homo sapiens
gccaccagcccct

SEQ ID NO: 4521547 - DNA, 14 bp, Homo sapiens
gccaccagcccctc

SEQ ID NO: 4521548 - DNA, 10 bp, Homo sapiens
gccaccagcg

SEQ ID NO: 4521549 - DNA, 12 bp, Homo sapiens
gccaccagggat

SEQ ID NO: 4521550 - DNA, 14 bp, Homo sapiens
gccaccagggatca

SEQ ID NO: 4521551 - DNA, 21 bp, Homo sapiens
gccaccagggatcacagacca

SEQ ID NO: 4521552 - DNA, 20 bp, Homo sapiens
gccaccaggtgcctttcaaa

SEQ ID NO: 4521553 - DNA, 19 bp, Homo sapiens
gccaccagttctcatgggt

SEQ ID NO: 4521554 - DNA, 22 bp, Homo sapiens
gccaccatgcctcactaatttt

SEQ ID NO: 4521555 - DNA, 14 bp, Homo sapiens
gccaccatgcttgc

SEQ ID NO: 4521556 - DNA, 16 bp, Homo sapiens
gccacccaagcctgct

SEQ ID NO: 4521557 - DNA, 19 bp, Homo sapiens
gccacccagtagcccagag

SEQ ID NO: 4521558 - DNA, 18 bp, Homo sapiens
gccaccccaaaccccagc

SEQ ID NO: 4521559 - DNA, 21 bp, Homo sapiens
gccaccccaaaccccagcccc

SEQ ID NO: 4521560 - DNA, 13 bp, Homo sapiens
gccaccgccttgc

SEQ ID NO: 4521561 - DNA, 20 bp, Homo sapiens
gccaccggaggtcactccac

SEQ ID NO: 4521562 - DNA, 17 bp, Homo sapiens
gccacctagactctccc

SEQ ID NO: 4521563 - DNA, 20 bp, Homo sapiens
gccacctatgcctgtggtga

SEQ ID NO: 4521564 - DNA, 12 bp, Homo sapiens
gccacctcccct

SEQ ID NO: 4521565 - DNA, 17 bp, Homo sapiens
gccacctcccctatcca

SEQ ID NO: 4521566 - DNA, 22 bp, Homo sapiens
gccacctcccctatccacccag

SEQ ID NO: 4521567 - DNA, 10 bp, Homo sapiens
gccacctgca

SEQ ID NO: 4521568 - DNA, 15 bp, Homo sapiens
gcccaagattattca

SEQ ID NO: 4521569 - DNA, 20 bp, Homo sapiens
gcccaagcagacagccctgg

SEQ ID NO: 4521570 - DNA, 21 bp, Homo sapiens
gcccaaggttgcacagcaaga

SEQ ID NO: 4521571 - DNA, 20 bp, Homo sapiens
gcccaagttcatgcagctgt

SEQ ID NO: 4521572 - DNA, 20 bp, Homo sapiens
gcccaattggaggaaagcaa

SEQ ID NO: 4521573 - DNA, 17 bp, Homo sapiens
gcccacagctcccaccc

SEQ ID NO: 4521574 - DNA, 17 bp, Homo sapiens
gcccacagtatatttta

SEQ ID NO: 4521575 - DNA, 18 bp, Homo sapiens
gcccaccacaactaacaa

SEQ ID NO: 4521576 - DNA, 13 bp, Homo sapiens
gcccacccccacc

SEQ ID NO: 4521577 - DNA, 21 bp, Homo sapiens
gcccaccccctttgactctgg

SEQ ID NO: 4521578 - DNA, 14 bp, Homo sapiens
gcccaccctcctgt

SEQ ID NO: 4521579 - DNA, 22 bp, Homo sapiens
gcccaccctcctgtcttcccag

SEQ ID NO: 4521580 - DNA, 22 bp, Homo sapiens
gcccacggttcggggcttctgc

SEQ ID NO: 4521581 - DNA, 12 bp, Homo sapiens
gcccactcagcc

SEQ ID NO: 4521582 - DNA, 13 bp, Homo sapiens
gcccactgagggg

SEQ ID NO: 4521583 - DNA, 17 bp, Homo sapiens
gcccactgaggggccag

SEQ ID NO: 4521584 - DNA, 19 bp, Homo sapiens
gcccagaaagtgggggtgg

SEQ ID NO: 4521585 - DNA, 18 bp, Homo sapiens
gcccagaagaaaattctc

SEQ ID NO: 4521586 - DNA, 21 bp, Homo sapiens
gcccagaagaaaattctcctg

SEQ ID NO: 4521587 - DNA, 14 bp, Homo sapiens
gcccagactacagg

SEQ ID NO: 4521588 - DNA, 15 bp, Homo sapiens
gcccagactgatgag

SEQ ID NO: 4521589 - DNA, 18 bp, Homo sapiens
gcccagactgatgagcac

SEQ ID NO: 4521590 - DNA, 19 bp, Homo sapiens
gcccagactgatgagcaca

SEQ ID NO: 4521591 - DNA, 16 bp, Homo sapiens
gcccagagatgcctcc

SEQ ID NO: 4521592 - DNA, 12 bp, Homo sapiens
gcccagagccac

SEQ ID NO: 4521593 - DNA, 16 bp, Homo sapiens
gcccagagccacctgg

SEQ ID NO: 4521594 - DNA, 12 bp, Homo sapiens
gcccagagctga

SEQ ID NO: 4521595 - DNA, 21 bp, Homo sapiens
gcccagatgtgtcccccccag

SEQ ID NO: 4521596 - DNA, 18 bp, Homo sapiens
gcccagcaacatggagga

SEQ ID NO: 4521597 - DNA, 13 bp, Homo sapiens
gcccagcacgagc

SEQ ID NO: 4521598 - DNA, 23 bp, Homo sapiens
gcccagcagcccctgagagcctg

SEQ ID NO: 4521599 - DNA, 23 bp, Homo sapiens
gcccagcaggagagactgagcag

SEQ ID NO: 4521600 - DNA, 15 bp, Homo sapiens
gcccagcccaagcac

SEQ ID NO: 4521601 - DNA, 12 bp, Homo sapiens
gcccagcccaga

SEQ ID NO: 4521602 - DNA, 16 bp, Homo sapiens
gcccagcccagagcca

SEQ ID NO: 4521603 - DNA, 20 bp, Homo sapiens
gcccagcccaggagtttgag

SEQ ID NO: 4521604 - DNA, 15 bp, Homo sapiens
gcccagccctgctgg

SEQ ID NO: 4521605 - DNA, 16 bp, Homo sapiens
gcccagccctgctggc

SEQ ID NO: 4521606 - DNA, 17 bp, Homo sapiens
gcccagccctgctggcc

SEQ ID NO: 4521607 - DNA, 15 bp, Homo sapiens
gcccagcctgctctc

SEQ ID NO: 4521608 - DNA, 15 bp, Homo sapiens
gcccagcctgggagc

SEQ ID NO: 4521609 - DNA, 16 bp, Homo sapiens
gcccagcctgggagcc

SEQ ID NO: 4521610 - DNA, 19 bp, Homo sapiens
gcccagcctgggagcccag

SEQ ID NO: 4521611 - DNA, 14 bp, Homo sapiens
gcccagcgccaagt

SEQ ID NO: 4521612 - DNA, 16 bp, Homo sapiens
gcccagcgtcagaagt

SEQ ID NO: 4521613 - DNA, 22 bp, Homo sapiens
gcccagctaatttttgtatttt

SEQ ID NO: 4521614 - DNA, 13 bp, Homo sapiens
gcccagctctgaa

SEQ ID NO: 4521615 - DNA, 17 bp, Homo sapiens
gcccagctggtgggaag

SEQ ID NO: 4521616 - DNA, 20 bp, Homo sapiens
gcccaggagagccagccctc

SEQ ID NO: 4521617 - DNA, 21 bp, Homo sapiens
gcccaggagagccagccctcc

SEQ ID NO: 4521618 - DNA, 22 bp, Homo sapiens
gcccaggagtccaggcccccag

SEQ ID NO: 4521619 - DNA, 17 bp, Homo sapiens
gcccaggatactggcac

SEQ ID NO: 4521620 - DNA, 20 bp, Homo sapiens
gcccaggcagcctccgggcg

SEQ ID NO: 4521621 - DNA, 13 bp, Homo sapiens
gcccaggccacag

SEQ ID NO: 4521622 - DNA, 17 bp, Homo sapiens
gcccaggccacagagaa

SEQ ID NO: 4521623 - DNA, 19 bp, Homo sapiens
gcccaggccaggtgcccag

SEQ ID NO: 4521624 - DNA, 19 bp, Homo sapiens
gcccaggctggagtgcagt

SEQ ID NO: 4521625 - DNA, 20 bp, Homo sapiens
gcccaggctggagtgcagtg

SEQ ID NO: 4521626 - DNA, 16 bp, Homo sapiens
gcccaggctggtttcg

SEQ ID NO: 4521627 - DNA, 19 bp, Homo sapiens
gcccagggaagcctgggtg

SEQ ID NO: 4521628 - DNA, 18 bp, Homo sapiens
gcccagggacaccagcca

SEQ ID NO: 4521629 - DNA, 22 bp, Homo sapiens
gcccagggacaccagccaggct

SEQ ID NO: 4521630 - DNA, 18 bp, Homo sapiens
gcccagggcatctgggag

SEQ ID NO: 4521631 - DNA, 15 bp, Homo sapiens
gcccagggtggccac

SEQ ID NO: 4521632 - DNA, 20 bp, Homo sapiens
gcccagggtggccacacctc

SEQ ID NO: 4521633 - DNA, 20 bp, Homo sapiens
gcccaggtcctgctgcctct

SEQ ID NO: 4521634 - DNA, 22 bp, Homo sapiens
gcccaggtgccccgactgtggg

SEQ ID NO: 4521635 - DNA, 15 bp, Homo sapiens
gcccagtgccactgc

SEQ ID NO: 4521636 - DNA, 14 bp, Homo sapiens
gcccagtgcttctc

SEQ ID NO: 4521637 - DNA, 22 bp, Homo sapiens
gcccagtgtcaagttgtgcttg

SEQ ID NO: 4521638 - DNA, 17 bp, Homo sapiens
gcccatcacagggttgg

SEQ ID NO: 4521639 - DNA, 21 bp, Homo sapiens
gcccatcacagggttgggccc

SEQ ID NO: 4521640 - DNA, 15 bp, Homo sapiens
gcccatcctgaccag

SEQ ID NO: 4521641 - DNA, 16 bp, Homo sapiens
gcccatcctgaccagc

SEQ ID NO: 4521642 - DNA, 15 bp, Homo sapiens
gcccatcctgactga

SEQ ID NO: 4521643 - DNA, 19 bp, Homo sapiens
gcccatgagcaagcctagg

SEQ ID NO: 4521644 - DNA, 16 bp, Homo sapiens
gcccatggcccccaat

SEQ ID NO: 4521645 - DNA, 19 bp, Homo sapiens
gcccatggcccccaataaa

SEQ ID NO: 4521646 - DNA, 14 bp, Homo sapiens
gcccatgtgtcccc

SEQ ID NO: 4521647 - DNA, 22 bp, Homo sapiens
gcccatgttaagtcctccctga

SEQ ID NO: 4521648 - DNA, 23 bp, Homo sapiens
gcccatgttaagtcctccctgac

SEQ ID NO: 4521649 - DNA, 13 bp, Homo sapiens
gcccattcccacc

SEQ ID NO: 4521650 - DNA, 14 bp, Homo sapiens
gcccattcccacca

SEQ ID NO: 4521651 - DNA, 22 bp, Homo sapiens
gcccattcctgcctggtccagt

SEQ ID NO: 4521652 - DNA, 17 bp, Homo sapiens
gcccattctctctcctg

SEQ ID NO: 4521653 - DNA, 19 bp, Homo sapiens
gcccattctctctcctgtc

SEQ ID NO: 4521654 - DNA, 20 bp, Homo sapiens
gcccattctctctcctgtcc

SEQ ID NO: 4521655 - DNA, 17 bp, Homo sapiens
gcccattcttctgggtg

SEQ ID NO: 4521656 - DNA, 19 bp, Homo sapiens
gcccatttcgaagatatac

SEQ ID NO: 4521657 - DNA, 14 bp, Homo sapiens
gcccatttttgcta

SEQ ID NO: 4521658 - DNA, 16 bp, Homo sapiens
gcccatttttgctaat

SEQ ID NO: 4521659 - DNA, 18 bp, Homo sapiens
gccccaactccaggggca

SEQ ID NO: 4521660 - DNA, 21 bp, Homo sapiens
gccccaagaggggcgggctca

SEQ ID NO: 4521661 - DNA, 15 bp, Homo sapiens
gccccaagcaggacg

SEQ ID NO: 4521662 - DNA, 21 bp, Homo sapiens
gccccaatcgggtccagagac

SEQ ID NO: 4521663 - DNA, 14 bp, Homo sapiens
gccccaatcttgcc

SEQ ID NO: 4521664 - DNA, 20 bp, Homo sapiens
gccccaatcttgcccactgg

SEQ ID NO: 4521665 - DNA, 21 bp, Homo sapiens
gccccaatcttgcccactggc

SEQ ID NO: 4521666 - DNA, 22 bp, Homo sapiens
gccccacactggggtgccgcct

SEQ ID NO: 4521667 - DNA, 15 bp, Homo sapiens
gccccacatggctta

SEQ ID NO: 4521668 - DNA, 13 bp, Homo sapiens
gccccaccaccta

SEQ ID NO: 4521669 - DNA, 18 bp, Homo sapiens
gccccaccacctaggcca

SEQ ID NO: 4521670 - DNA, 20 bp, Homo sapiens
gccccaccacctaggccact

SEQ ID NO: 4521671 - DNA, 13 bp, Homo sapiens
gccccaccagtgc

SEQ ID NO: 4521672 - DNA, 14 bp, Homo sapiens
gccccaccagtgcc

SEQ ID NO: 4521673 - DNA, 15 bp, Homo sapiens
gccccaccagtgcct

SEQ ID NO: 4521674 - DNA, 20 bp, Homo sapiens
gccccacccaactccacagg

SEQ ID NO: 4521675 - DNA, 12 bp, Homo sapiens
gccccacccagg

SEQ ID NO: 4521676 - DNA, 15 bp, Homo sapiens
gccccacccaggagg

SEQ ID NO: 4521677 - DNA, 20 bp, Homo sapiens
gccccaccccatccagccag

SEQ ID NO: 4521678 - DNA, 14 bp, Homo sapiens
gccccacctaaccc

SEQ ID NO: 4521679 - DNA, 15 bp, Homo sapiens
gccccacctgaaggg

SEQ ID NO: 4521680 - DNA, 19 bp, Homo sapiens
gccccacttcacccccaac

SEQ ID NO: 4521681 - DNA, 21 bp, Homo sapiens
gccccacttcacccccaactt

SEQ ID NO: 4521682 - DNA, 16 bp, Homo sapiens
gccccagacagggtgg

SEQ ID NO: 4521683 - DNA, 23 bp, Homo sapiens
gccccagagctgtttatggcctc

SEQ ID NO: 4521684 - DNA, 15 bp, Homo sapiens
gccccagagtggccc

SEQ ID NO: 4521685 - DNA, 22 bp, Homo sapiens
gccccagcacacgagttccaga

SEQ ID NO: 4521686 - DNA, 12 bp, Homo sapiens
gccccagcccac

SEQ ID NO: 4521687 - DNA, 13 bp, Homo sapiens
gccccagcccaga

SEQ ID NO: 4521688 - DNA, 20 bp, Homo sapiens
gccaggctccctttctcttc

SEQ ID NO: 4521689 - DNA, 16 bp, Homo sapiens
gccaggctctgtgctg

SEQ ID NO: 4521690 - DNA, 16 bp, Homo sapiens
gccaggctgcctcctg

SEQ ID NO: 4521691 - DNA, 19 bp, Homo sapiens
gccagggatgggcagccca

SEQ ID NO: 4521692 - DNA, 21 bp, Homo sapiens
gccagggcagagtgagaccca

SEQ ID NO: 4521693 - DNA, 19 bp, Homo sapiens
gccagggcagggccccagg

SEQ ID NO: 4521694 - DNA, 14 bp, Homo sapiens
gccagggcagggcg

SEQ ID NO: 4521695 - DNA, 17 bp, Homo sapiens
gccagggcagggcgagc

SEQ ID NO: 4521696 - DNA, 20 bp, Homo sapiens
gccagggccacgctccagct

SEQ ID NO: 4521697 - DNA, 11 bp, Homo sapiens
gccagggctgg

SEQ ID NO: 4521698 - DNA, 13 bp, Homo sapiens
gccagggctgggg

SEQ ID NO: 4521699 - DNA, 14 bp, Homo sapiens
gccagggctgggga

SEQ ID NO: 4521700 - DNA, 19 bp, Homo sapiens
gccagggctggggacagag

SEQ ID NO: 4521701 - DNA, 23 bp, Homo sapiens
gccagggctggggttgccagagg

SEQ ID NO: 4521702 - DNA, 21 bp, Homo sapiens
gccaggtgcaatctactggaa

SEQ ID NO: 4521703 - DNA, 15 bp, Homo sapiens
gccaggtgccttgga

SEQ ID NO: 4521704 - DNA, 15 bp, Homo sapiens
gccaggtggcacctg

SEQ ID NO: 4521705 - DNA, 16 bp, Homo sapiens
gccagtacttgtcata

SEQ ID NO: 4521706 - DNA, 14 bp, Homo sapiens
gccagtcagggccc

SEQ ID NO: 4521707 - DNA, 12 bp, Homo sapiens
gccagtccccat

SEQ ID NO: 4521708 - DNA, 21 bp, Homo sapiens
gccagtccccatttctgcctc

SEQ ID NO: 4521709 - DNA, 15 bp, Homo sapiens
gccagtccccgagga

SEQ ID NO: 4521710 - DNA, 14 bp, Homo sapiens
gccagtcctgcctg

SEQ ID NO: 4521711 - DNA, 18 bp, Homo sapiens
gccagtcctgcctggcca

SEQ ID NO: 4521712 - DNA, 19 bp, Homo sapiens
gccagtcctgcctggccag

SEQ ID NO: 4521713 - DNA, 21 bp, Homo sapiens
gccagtctttgaactgcagca

SEQ ID NO: 4521714 - DNA, 15 bp, Homo sapiens
gccagtgacctttga

SEQ ID NO: 4521715 - DNA, 13 bp, Homo sapiens
gccagtgcagcca

SEQ ID NO: 4521716 - DNA, 18 bp, Homo sapiens
gccagtgcagccactggc

SEQ ID NO: 4521717 - DNA, 14 bp, Homo sapiens
gccagtgcctgggt

SEQ ID NO: 4521718 - DNA, 15 bp, Homo sapiens
gccagtgccttacct

SEQ ID NO: 4521719 - DNA, 17 bp, Homo sapiens
gccagtgccttacctcc

SEQ ID NO: 4521720 - DNA, 22 bp, Homo sapiens
gccagtgccttacctcctgccc

SEQ ID NO: 4521721 - DNA, 16 bp, Homo sapiens
gccagtggaagaaaca

SEQ ID NO: 4521722 - DNA, 23 bp, Homo sapiens
gccagtggctggatctgtgaggg

SEQ ID NO: 4521723 - DNA, 19 bp, Homo sapiens
gccagttttccctggaact

SEQ ID NO: 4521724 - DNA, 19 bp, Homo sapiens
gccataaccatgagcacta

SEQ ID NO: 4521725 - DNA, 21 bp, Homo sapiens
gccataagctacacagaggcc

SEQ ID NO: 4521726 - DNA, 11 bp, Homo sapiens
gccataataaa

SEQ ID NO: 4521727 - DNA, 17 bp, Homo sapiens
gccataatgttgcttct

SEQ ID NO: 4521728 - DNA, 15 bp, Homo sapiens
gccatacctcagata

SEQ ID NO: 4521729 - DNA, 22 bp, Homo sapiens
gccatactgcgtccaccctgag

SEQ ID NO: 4521730 - DNA, 18 bp, Homo sapiens
gccatacttatctctctg

SEQ ID NO: 4521731 - DNA, 21 bp, Homo sapiens
gccatacttatctctctgtgc

SEQ ID NO: 4521732 - DNA, 22 bp, Homo sapiens
gccatacttatctctctgtgct

SEQ ID NO: 4521733 - DNA, 21 bp, Homo sapiens
gccatagaccctgaggccctg

SEQ ID NO: 4521734 - DNA, 13 bp, Homo sapiens
gccatagccccag

SEQ ID NO: 4521735 - DNA, 14 bp, Homo sapiens
gccatatatgctgt

SEQ ID NO: 4521736 - DNA, 16 bp, Homo sapiens
gccatatatgctgtat

SEQ ID NO: 4521737 - DNA, 16 bp, Homo sapiens
gccatcaaaatgcttt

SEQ ID NO: 4521738 - DNA, 15 bp, Homo sapiens
gccatcaagcacttc

SEQ ID NO: 4521739 - DNA, 18 bp, Homo sapiens
gccatcaagcacttccca

SEQ ID NO: 4521740 - DNA, 22 bp, Homo sapiens
gccatcaccacggctcactgca

SEQ ID NO: 4521741 - DNA, 23 bp, Homo sapiens
gccatcatgcggtgggtgctgcc

SEQ ID NO: 4521742 - DNA, 17 bp, Homo sapiens
gccatcatgtttacaga

SEQ ID NO: 4521743 - DNA, 18 bp, Homo sapiens
gccatccccgctcctggt

SEQ ID NO: 4521744 - DNA, 13 bp, Homo sapiens
gccatccctgggc

SEQ ID NO: 4521745 - DNA, 14 bp, Homo sapiens
gccatccctgggcc

SEQ ID NO: 4521746 - DNA, 18 bp, Homo sapiens
gccatccctgggcccctc

SEQ ID NO: 4521747 - DNA, 20 bp, Homo sapiens
gccatccctgggcccctcca

SEQ ID NO: 4521748 - DNA, 12 bp, Homo sapiens
gccatccctgtg

SEQ ID NO: 4521749 - DNA, 14 bp, Homo sapiens
gccatccctgtgag

SEQ ID NO: 4521750 - DNA, 15 bp, Homo sapiens
gccatccctgtgagg

SEQ ID NO: 4521751 - DNA, 24 bp, Homo sapiens
gccatcctcaaacgacagaggagc

SEQ ID NO: 4521752 - DNA, 20 bp, Homo sapiens
gccatcctggcccagggcat

SEQ ID NO: 4521753 - DNA, 23 bp, Homo sapiens
gccatcctggcccagggcatctg

SEQ ID NO: 4521754 - DNA, 15 bp, Homo sapiens
gccatcgtcctggga

SEQ ID NO: 4521755 - DNA, 18 bp, Homo sapiens
gccatctaatgcttgttt

SEQ ID NO: 4521756 - DNA, 19 bp, Homo sapiens
gccatctaatgcttgttta

SEQ ID NO: 4521757 - DNA, 15 bp, Homo sapiens
gccatctcaggagat

SEQ ID NO: 4521758 - DNA, 17 bp, Homo sapiens
gccatctcaggagatgg

SEQ ID NO: 4521759 - DNA, 14 bp, Homo sapiens
gccatctccctccc

SEQ ID NO: 4521760 - DNA, 16 bp, Homo sapiens
gccatctccctcccca

SEQ ID NO: 4521761 - DNA, 16 bp, Homo sapiens
gccatcttggcagggt

SEQ ID NO: 4521762 - DNA, 15 bp, Homo sapiens
gccatgacagaggct

SEQ ID NO: 4521763 - DNA, 18 bp, Homo sapiens
gccatgacagaggctgca

SEQ ID NO: 4521764 - DNA, 20 bp, Homo sapiens
gccatgacagaggctgcacc

SEQ ID NO: 4521765 - DNA, 20 bp, Homo sapiens
gccatgaggagttgctgttt

SEQ ID NO: 4521766 - DNA, 22 bp, Homo sapiens
gccatgatctgtatttaatggt

SEQ ID NO: 4521767 - DNA, 15 bp, Homo sapiens
gccatgccaggaacc

SEQ ID NO: 4521768 - DNA, 19 bp, Homo sapiens
gccatgctcaacccccctc

SEQ ID NO: 4521769 - DNA, 21 bp, Homo sapiens
gccatgctcaacccccctccc

SEQ ID NO: 4521770 - DNA, 22 bp, Homo sapiens
gccatgctcaacccccctccca

SEQ ID NO: 4521771 - DNA, 12 bp, Homo sapiens
gccatgcttttt

SEQ ID NO: 4521772 - DNA, 16 bp, Homo sapiens
gccatgctttttggtg

SEQ ID NO: 4521773 - DNA, 22 bp, Homo sapiens
gccatggaagaggctacagggc

SEQ ID NO: 4521774 - DNA, 19 bp, Homo sapiens
gccatggcaggacagctcc

SEQ ID NO: 4521775 - DNA, 18 bp, Homo sapiens
gccatggggtccatcccc

SEQ ID NO: 4521776 - DNA, 19 bp, Homo sapiens
gccatgtccaaagaggctg

SEQ ID NO: 4521777 - DNA, 22 bp, Homo sapiens
gccatgtccaaagaggctgccc

SEQ ID NO: 4521778 - DNA, 13 bp, Homo sapiens
gccatgtgctgcc

SEQ ID NO: 4521779 - DNA, 14 bp, Homo sapiens
gccatgtgctgccc

SEQ ID NO: 4521780 - DNA, 20 bp, Homo sapiens
gccatgtgctgccctgttgc

SEQ ID NO: 4521781 - DNA, 19 bp, Homo sapiens
gccatgttggccaggctgg

SEQ ID NO: 4521782 - DNA, 15 bp, Homo sapiens
gccattaaatgaata

SEQ ID NO: 4521783 - DNA, 23 bp, Homo sapiens
gccattaaatgaatattttgata

SEQ ID NO: 4521784 - DNA, 14 bp, Homo sapiens
gccattagccaagg

SEQ ID NO: 4521785 - DNA, 22 bp, Homo sapiens
gccattcacttcataatccagt

SEQ ID NO: 4521786 - DNA, 15 bp, Homo sapiens
gccattctccccctc

SEQ ID NO: 4521787 - DNA, 16 bp, Homo sapiens
gccattctcctgcctc

SEQ ID NO: 4521788 - DNA, 19 bp, Homo sapiens
gccattctcctgcctcagc

SEQ ID NO: 4521789 - DNA, 19 bp, Homo sapiens
gccattctgtgcaggctgc

SEQ ID NO: 4521790 - DNA, 12 bp, Homo sapiens
gccattctttcc

SEQ ID NO: 4521791 - DNA, 17 bp, Homo sapiens
gccattgccaccaggag

SEQ ID NO: 4521792 - DNA, 16 bp, Homo sapiens
gccattgtactccagc

SEQ ID NO: 4521793 - DNA, 18 bp, Homo sapiens
gccattgtactccagcct

SEQ ID NO: 4521794 - DNA, 22 bp, Homo sapiens
gccattgtactccagcctgggc

SEQ ID NO: 4521795 - DNA, 15 bp, Homo sapiens
gccattgtctttata

SEQ ID NO: 4521796 - DNA, 12 bp, Homo sapiens
gccattgtgaac

SEQ ID NO: 4521797 - DNA, 13 bp, Homo sapiens
gccatttgtccca

SEQ ID NO: 4521798 - DNA, 20 bp, Homo sapiens
gccatttgtcccaagtgcca

SEQ ID NO: 4521799 - DNA, 16 bp, Homo sapiens
gccattttggtgctta

SEQ ID NO: 4521800 - DNA, 14 bp, Homo sapiens
gcccaaaatttgat

SEQ ID NO: 4521801 - DNA, 19 bp, Homo sapiens
gcccaaagtggtatagaaa

SEQ ID NO: 4521802 - DNA, 14 bp, Homo sapiens
gcccaaatgatgga

SEQ ID NO: 4521803 - DNA, 14 bp, Homo sapiens
gcccaacagcactt

SEQ ID NO: 4521804 - DNA, 20 bp, Homo sapiens
gcccaagaggactgagactg

SEQ ID NO: 4521805 - DNA, 22 bp, Homo sapiens
gcccaagaggactgagactggc

SEQ ID NO: 4521806 - DNA, 14 bp, Homo sapiens
gcccaagaggtctg

SEQ ID NO: 4521807 - DNA, 17 bp, Homo sapiens
gcccaagaggtctgagc

SEQ ID NO: 4521808 - DNA, 21 bp, Homo sapiens
gcccaagaggtctgagccctg

SEQ ID NO: 4521809 - DNA, 13 bp, Homo sapiens
gcccctggctttg

SEQ ID NO: 4521810 - DNA, 16 bp, Homo sapiens
gcccctggctttgcct

SEQ ID NO: 4521811 - DNA, 18 bp, Homo sapiens
gcccctggctttgcctct

SEQ ID NO: 4521812 - DNA, 22 bp, Homo sapiens
gcccctggctttgcctcttctt

SEQ ID NO: 4521813 - DNA, 11 bp, Homo sapiens
gcccctgggct

SEQ ID NO: 4521814 - DNA, 21 bp, Homo sapiens
gcccctgggcttggcctgctg

SEQ ID NO: 4521815 - DNA, 23 bp, Homo sapiens
gcccctgggcttggcctgctgtg

SEQ ID NO: 4521816 - DNA, 18 bp, Homo sapiens
gcccctggggcccagccc

SEQ ID NO: 4521817 - DNA, 15 bp, Homo sapiens
gcccctggggtggcc

SEQ ID NO: 4521818 - DNA, 17 bp, Homo sapiens
gcccctggtaagcagag

SEQ ID NO: 4521819 - DNA, 16 bp, Homo sapiens
gcccctgtctggaaga

SEQ ID NO: 4521820 - DNA, 17 bp, Homo sapiens
gcccctgtctgttccca

SEQ ID NO: 4521821 - DNA, 18 bp, Homo sapiens
gccccttctacactctcc

SEQ ID NO: 4521822 - DNA, 19 bp, Homo sapiens
gccccttctacactctcct

SEQ ID NO: 4521823 - DNA, 22 bp, Homo sapiens
gccccttctacactctcctggg

SEQ ID NO: 4521824 - DNA, 23 bp, Homo sapiens
gccccttcttatttatgtgaaca

SEQ ID NO: 4521825 - DNA, 15 bp, Homo sapiens
gccccttggtcctgg

SEQ ID NO: 4521826 - DNA, 17 bp, Homo sapiens
gcccgaaactaagccag

SEQ ID NO: 4521827 - DNA, 22 bp, Homo sapiens
gcccgaaactaagccaggcctg

SEQ ID NO: 4521828 - DNA, 18 bp, Homo sapiens
gcccgagctgtttatgtt

SEQ ID NO: 4521829 - DNA, 22 bp, Homo sapiens
gcccgagctgtttatgttttta

SEQ ID NO: 4521830 - DNA, 23 bp, Homo sapiens
gcccgaggcagacgtctgtcagg

SEQ ID NO: 4521831 - DNA, 23 bp, Homo sapiens
gcccgagggaggggaagcttctg

SEQ ID NO: 4521832 - DNA, 16 bp, Homo sapiens
gcccgatattctccct

SEQ ID NO: 4521833 - DNA, 12 bp, Homo sapiens
gcccgcatgtgt

SEQ ID NO: 4521834 - DNA, 17 bp, Homo sapiens
gcccgcatgtgtgcctg

SEQ ID NO: 4521835 - DNA, 14 bp, Homo sapiens
gcccgcctgccagt

SEQ ID NO: 4521836 - DNA, 15 bp, Homo sapiens
gcccgcctgccagtc

SEQ ID NO: 4521837 - DNA, 18 bp, Homo sapiens
gcccgcctgccagtccta

SEQ ID NO: 4521838 - DNA, 19 bp, Homo sapiens
gcccgcctgccgtgcatgg

SEQ ID NO: 4521839 - DNA, 23 bp, Homo sapiens
gcccgcgggagacagcttctctg

SEQ ID NO: 4521840 - DNA, 19 bp, Homo sapiens
gcccgcttgctcgcttgct

SEQ ID NO: 4521841 - DNA, 19 bp, Homo sapiens
gcccggagattggacggcc

SEQ ID NO: 4521842 - DNA, 17 bp, Homo sapiens
gcccggcagggcgggca

SEQ ID NO: 4521843 - DNA, 14 bp, Homo sapiens
gcccggccacaccc

SEQ ID NO: 4521844 - DNA, 20 bp, Homo sapiens
gcccggcgctgattcctcgt

SEQ ID NO: 4521845 - DNA, 16 bp, Homo sapiens
gcccggctacatcagc

SEQ ID NO: 4521846 - DNA, 20 bp, Homo sapiens
gcccggctacatcagccttc

SEQ ID NO: 4521847 - DNA, 17 bp, Homo sapiens
gcccgggagctcaggaa

SEQ ID NO: 4521848 - DNA, 16 bp, Homo sapiens
gcccggtccacaggtc

SEQ ID NO: 4521849 - DNA, 22 bp, Homo sapiens
gcccggtccacaggtccaagga

SEQ ID NO: 4521850 - DNA, 19 bp, Homo sapiens
gcccgtaatcccagctact

SEQ ID NO: 4521851 - DNA, 22 bp, Homo sapiens
gcccgtaatcccagctactcag

SEQ ID NO: 4521852 - DNA, 20 bp, Homo sapiens
gcccgtctctttctcacctt

SEQ ID NO: 4521853 - DNA, 21 bp, Homo sapiens
gcccgtgcccccgcctgccac

SEQ ID NO: 4521854 - DNA, 23 bp, Homo sapiens
gcccgtgcccccgcctgccaccg

SEQ ID NO: 4521855 - DNA, 17 bp, Homo sapiens
gcccgtggggtctgcgc

SEQ ID NO: 4521856 - DNA, 14 bp, Homo sapiens
gccctaagggagtg

SEQ ID NO: 4521857 - DNA, 17 bp, Homo sapiens
gccctaagtggctgcct

SEQ ID NO: 4521858 - DNA, 18 bp, Homo sapiens
gccctaagtggctgcctt

SEQ ID NO: 4521859 - DNA, 16 bp, Homo sapiens
gccctacttccaggat

SEQ ID NO: 4521860 - DNA, 18 bp, Homo sapiens
gccctagagcctgcctgg

SEQ ID NO: 4521861 - DNA, 19 bp, Homo sapiens
gccctagagcctgcctgga

SEQ ID NO: 4521862 - DNA, 20 bp, Homo sapiens
gccctagagcctgcctggag

SEQ ID NO: 4521863 - DNA, 15 bp, Homo sapiens
gccctagcggctgct

SEQ ID NO: 4521864 - DNA, 21 bp, Homo sapiens
gccctatttagatgataaaga

SEQ ID NO: 4521865 - DNA, 13 bp, Homo sapiens
gccctcaagggtg

SEQ ID NO: 4521866 - DNA, 17 bp, Homo sapiens
gccctcaatccaccttc

SEQ ID NO: 4521867 - DNA, 18 bp, Homo sapiens
gccctcacccctggttct

SEQ ID NO: 4521868 - DNA, 18 bp, Homo sapiens
gccctcaggggcctctct

SEQ ID NO: 4521869 - DNA, 19 bp, Homo sapiens
gccctcatgggtcctagcc

SEQ ID NO: 4521870 - DNA, 14 bp, Homo sapiens
gccctccagagccc

SEQ ID NO: 4521871 - DNA, 18 bp, Homo sapiens
gccctccagagccccaca

SEQ ID NO: 4521872 - DNA, 22 bp, Homo sapiens
gccctccagagccccacagccc

SEQ ID NO: 4521873 - DNA, 17 bp, Homo sapiens
gccctccagtgggctga

SEQ ID NO: 4521874 - DNA, 21 bp, Homo sapiens
gccctccagtgggctgatgct

SEQ ID NO: 4521875 - DNA, 23 bp, Homo sapiens
gccctcccccttccccttctgtg

SEQ ID NO: 4521876 - DNA, 19 bp, Homo sapiens
gccctccctgactccctgt

SEQ ID NO: 4521877 - DNA, 20 bp, Homo sapiens
gccctccctgactccctgtg

SEQ ID NO: 4521878 - DNA, 21 bp, Homo sapiens
gccctccctgactccctgtgg

SEQ ID NO: 4521879 - DNA, 21 bp, Homo sapiens
gccctccctgctagcacagag

SEQ ID NO: 4521880 - DNA, 18 bp, Homo sapiens
gccctccctgtcctcctc

SEQ ID NO: 4521881 - DNA, 21 bp, Homo sapiens
gccctccctgtcctcctcgga

SEQ ID NO: 4521882 - DNA, 18 bp, Homo sapiens
gccctcctccccagagct

SEQ ID NO: 4521883 - DNA, 12 bp, Homo sapiens
gccctcctgagg

SEQ ID NO: 4521884 - DNA, 12 bp, Homo sapiens
gccctcctgggc

SEQ ID NO: 4521885 - DNA, 19 bp, Homo sapiens
gccctcctgggccctgggc

SEQ ID NO: 4521886 - DNA, 20 bp, Homo sapiens
gccctcctgggccctgggct

SEQ ID NO: 4521887 - DNA, 21 bp, Homo sapiens
gccctcctgggccctgggctg

SEQ ID NO: 4521888 - DNA, 14 bp, Homo sapiens
gccctcgctgccag

SEQ ID NO: 4521889 - DNA, 15 bp, Homo sapiens
gccctcgctgccagc

SEQ ID NO: 4521890 - DNA, 14 bp, Homo sapiens
gccctcggcctccg

SEQ ID NO: 4521891 - DNA, 16 bp, Homo sapiens
gccctcgggcccagcc

SEQ ID NO: 4521892 - DNA, 17 bp, Homo sapiens
gccctcgggcccagccc

SEQ ID NO: 4521893 - DNA, 20 bp, Homo sapiens
gccctcgggcccagccccca

SEQ ID NO: 4521894 - DNA, 19 bp, Homo sapiens
gccctctccctgtgttctg

SEQ ID NO: 4521895 - DNA, 23 bp, Homo sapiens
gccctctccctgtgttctgggct

SEQ ID NO: 4521896 - DNA, 17 bp, Homo sapiens
gccctctcccttaccct

SEQ ID NO: 4521897 - DNA, 21 bp, Homo sapiens
gccctctcccttaccctggga

SEQ ID NO: 4521898 - DNA, 13 bp, Homo sapiens
gccctctctctgg

SEQ ID NO: 4521899 - DNA, 15 bp, Homo sapiens
gccctgactcctgga

SEQ ID NO: 4521900 - DNA, 19 bp, Homo sapiens
gccctgactcctggactcc

SEQ ID NO: 4521901 - DNA, 21 bp, Homo sapiens
gccctgaggtgaaagggagct

SEQ ID NO: 4521902 - DNA, 15 bp, Homo sapiens
gccctgcattttcat

SEQ ID NO: 4521903 - DNA, 14 bp, Homo sapiens
gccctgcccacaga

SEQ ID NO: 4521904 - DNA, 11 bp, Homo sapiens
gccctgcccca

SEQ ID NO: 4521905 - DNA, 14 bp, Homo sapiens
gccctgccccaccc

SEQ ID NO: 4521906 - DNA, 20 bp, Homo sapiens
gccctgcccccaccccttcc

SEQ ID NO: 4521907 - DNA, 21 bp, Homo sapiens
gccctgcccccaccccttcct

SEQ ID NO: 4521908 - DNA, 16 bp, Homo sapiens
gccctgccctcccaag

SEQ ID NO: 4521909 - DNA, 16 bp, Homo sapiens
gccctgcctcagccag

SEQ ID NO: 4521910 - DNA, 14 bp, Homo sapiens
gccctgcctgcagc

SEQ ID NO: 4521911 - DNA, 22 bp, Homo sapiens
gccctgcctgcagccagggctg

SEQ ID NO: 4521912 - DNA, 14 bp, Homo sapiens
gccctgcggagacc

SEQ ID NO: 4521913 - DNA, 18 bp, Homo sapiens
gccctgctccctgcctcc

SEQ ID NO: 4521914 - DNA, 20 bp, Homo sapiens
gccctgctccctgcctcctg

SEQ ID NO: 4521915 - DNA, 18 bp, Homo sapiens
gccctgctggccgcctca

SEQ ID NO: 4521916 - DNA, 23 bp, Homo sapiens
gccctgctggccgcctcaccccc

SEQ ID NO: 4521917 - DNA, 14 bp, Homo sapiens
gccctgctgtggga

SEQ ID NO: 4521918 - DNA, 17 bp, Homo sapiens
gccctgctgtgggagag

SEQ ID NO: 4521919 - DNA, 12 bp, Homo sapiens
gccctggaggat

SEQ ID NO: 4521920 - DNA, 15 bp, Homo sapiens
gccctggagggaagg

SEQ ID NO: 4521921 - DNA, 15 bp, Homo sapiens
gccctggatggtggc

SEQ ID NO: 4521922 - DNA, 15 bp, Homo sapiens
gccctggcatgtcaa

SEQ ID NO: 4521923 - DNA, 14 bp, Homo sapiens
gccctggccaggac

SEQ ID NO: 4521924 - DNA, 16 bp, Homo sapiens
gccctggcccaggtgc

SEQ ID NO: 4521925 - DNA, 20 bp, Homo sapiens
gccctggcccccacagcgct

SEQ ID NO: 4521926 - DNA, 13 bp, Homo sapiens
gccctggcctgct

SEQ ID NO: 4521927 - DNA, 16 bp, Homo sapiens
gccctggcctgctggg

SEQ ID NO: 4521928 - DNA, 23 bp, Homo sapiens
gccctggctcccacctgtttctg

SEQ ID NO: 4521929 - DNA, 11 bp, Homo sapiens
gccctggctgc

SEQ ID NO: 4521930 - DNA, 19 bp, Homo sapiens
gccctggctgctgccccca

SEQ ID NO: 4521931 - DNA, 20 bp, Homo sapiens
gccctgggccccaccaccta

SEQ ID NO: 4521932 - DNA, 22 bp, Homo sapiens
gccctgggccccaccacctagg

SEQ ID NO: 4521933 - DNA, 19 bp, Homo sapiens
gccctgggctcggaggctg

SEQ ID NO: 4521934 - DNA, 12 bp, Homo sapiens
gccctgggctgg

SEQ ID NO: 4521935 - DNA, 18 bp, Homo sapiens
gccctgggctggcacagc

SEQ ID NO: 4521936 - DNA, 20 bp, Homo sapiens
gccctgggctgtctgtcacc

SEQ ID NO: 4521937 - DNA, 20 bp, Homo sapiens
gccctggggatcttcccaca

SEQ ID NO: 4521938 - DNA, 21 bp, Homo sapiens
gccctgggtaagaagggtggg

SEQ ID NO: 4521939 - DNA, 14 bp, Homo sapiens
gccctggtccaggg

SEQ ID NO: 4521940 - DNA, 16 bp, Homo sapiens
gccctggtccagggaa

SEQ ID NO: 4521941 - DNA, 23 bp, Homo sapiens
gccctggtccagggaagctggcc

SEQ ID NO: 4521942 - DNA, 17 bp, Homo sapiens
gccctggtctcagcagc

SEQ ID NO: 4521943 - DNA, 12 bp, Homo sapiens
gccctgtcccag

SEQ ID NO: 4521944 - DNA, 18 bp, Homo sapiens
gccctgtcgcccctcctt

SEQ ID NO: 4521945 - DNA, 17 bp, Homo sapiens
gccctgtggacaggatg

SEQ ID NO: 4521946 - DNA, 18 bp, Homo sapiens
gccctgtgggagccgcag

SEQ ID NO: 4521947 - DNA, 17 bp, Homo sapiens
gccctgttaaaagatga

SEQ ID NO: 4521948 - DNA, 15 bp, Homo sapiens
gcccttcaccccagt

SEQ ID NO: 4521949 - DNA, 18 bp, Homo sapiens
gcccttccatgtgccttt

SEQ ID NO: 4521950 - DNA, 13 bp, Homo sapiens
gcccttccctctg

SEQ ID NO: 4521951 - DNA, 14 bp, Homo sapiens
gcccttccctgagt

SEQ ID NO: 4521952 - DNA, 16 bp, Homo sapiens
gcccttccgagcggcg

SEQ ID NO: 4521953 - DNA, 22 bp, Homo sapiens
gcccttctatacccacccagaa

SEQ ID NO: 4521954 - DNA, 19 bp, Homo sapiens
gcccttgcagttcagcacc

SEQ ID NO: 4521955 - DNA, 20 bp, Homo sapiens
gcccttgcagttcagcacca

SEQ ID NO: 4521956 - DNA, 21 bp, Homo sapiens
gcccttgcagttcagcaccac

SEQ ID NO: 4521957 - DNA, 21 bp, Homo sapiens
gcccttgtcggccccaccagt

SEQ ID NO: 4521958 - DNA, 15 bp, Homo sapiens
gccctttcctcctca

SEQ ID NO: 4521959 - DNA, 19 bp, Homo sapiens
gcccttttttctgcctcct

SEQ ID NO: 4521960 - DNA, 20 bp, Homo sapiens
gcccttttttctgcctcctt

SEQ ID NO: 4521961 - DNA, 22 bp, Homo sapiens
gcccttttttctgcctccttta

SEQ ID NO: 4521962 - DNA, 18 bp, Homo sapiens
gccgaatttggtacacat

SEQ ID NO: 4521963 - DNA, 19 bp, Homo sapiens
gccgacctcgtcctccccc

SEQ ID NO: 4521964 - DNA, 21 bp, Homo sapiens
gccgacctcgtcctccccctg

SEQ ID NO: 4521965 - DNA, 12 bp, Homo sapiens
gccgagagcctg

SEQ ID NO: 4521966 - DNA, 17 bp, Homo sapiens
gccgagagcctgctccc

SEQ ID NO: 4521967 - DNA, 22 bp, Homo sapiens
gccgagagcctgctcccccacc

SEQ ID NO: 4521968 - DNA, 14 bp, Homo sapiens
gccgagctcctggg

SEQ ID NO: 4521969 - DNA, 15 bp, Homo sapiens
gccgagctcctgggg

SEQ ID NO: 4521970 - DNA, 16 bp, Homo sapiens
gccgagctcctgggga

SEQ ID NO: 4521971 - DNA, 16 bp, Homo sapiens
gccgagggctggccgg

SEQ ID NO: 4521972 - DNA, 18 bp, Homo sapiens
gccgagggtcctggctcc

SEQ ID NO: 4521973 - DNA, 13 bp, Homo sapiens
gccgatgccaccg

SEQ ID NO: 4521974 - DNA, 19 bp, Homo sapiens
gccgatgttgaactttttt

SEQ ID NO: 4521975 - DNA, 13 bp, Homo sapiens
gccgcaccccaga

SEQ ID NO: 4521976 - DNA, 15 bp, Homo sapiens
gccgcaccccagagt

SEQ ID NO: 4521977 - DNA, 14 bp, Homo sapiens
gccgcattccctga

SEQ ID NO: 4521978 - DNA, 18 bp, Homo sapiens
gccgcattccctgagtca

SEQ ID NO: 4521979 - DNA, 14 bp, Homo sapiens
gccgcattggtgac

SEQ ID NO: 4521980 - DNA, 21 bp, Homo sapiens
gccgccactaggtgtccccaa

SEQ ID NO: 4521981 - DNA, 15 bp, Homo sapiens
gccgccagctgggag

SEQ ID NO: 4521982 - DNA, 20 bp, Homo sapiens
gccgccagtacttgtcatat

SEQ ID NO: 4521983 - DNA, 18 bp, Homo sapiens
gccgccatagccccagta

SEQ ID NO: 4521984 - DNA, 12 bp, Homo sapiens
gccgccctgggc

SEQ ID NO: 4521985 - DNA, 15 bp, Homo sapiens
gccgccgccgccgcc

SEQ ID NO: 4521986 - DNA, 20 bp, Homo sapiens
gccgcctgagaccctcgcgc

SEQ ID NO: 4521987 - DNA, 23 bp, Homo sapiens
gccgcctgcccgtctctctccca

SEQ ID NO: 4521988 - DNA, 17 bp, Homo sapiens
gccgcgggccaggaggc

SEQ ID NO: 4521989 - DNA, 19 bp, Homo sapiens
gccgcggggaagctggctt

SEQ ID NO: 4521990 - DNA, 19 bp, Homo sapiens
gccgcgtggaatgtgagtg

SEQ ID NO: 4521991 - DNA, 17 bp, Homo sapiens
gccgctgagcgaggaga

SEQ ID NO: 4521992 - DNA, 14 bp, Homo sapiens
gccgctgcaccacg

SEQ ID NO: 4521993 - DNA, 16 bp, Homo sapiens
gccgctgccacccgcc

SEQ ID NO: 4521994 - DNA, 23 bp, Homo sapiens
gccgctgcccttgggtccccccg

SEQ ID NO: 4521995 - DNA, 16 bp, Homo sapiens
gccgctgccgctgcac

SEQ ID NO: 4521996 - DNA, 13 bp, Homo sapiens
gccgctggctggt

SEQ ID NO: 4521997 - DNA, 17 bp, Homo sapiens
gccgctggctggtgggc

SEQ ID NO: 4521998 - DNA, 22 bp, Homo sapiens
gccgctggctggtgggccccca

SEQ ID NO: 4521999 - DNA, 15 bp, Homo sapiens
gccgctgttcaccca

SEQ ID NO: 4522000 - DNA, 17 bp, Homo sapiens
gccggatctgagggaga

SEQ ID NO: 4522001 - DNA, 20 bp, Homo sapiens
gccggccacacccctctgct

SEQ ID NO: 4522002 - DNA, 14 bp, Homo sapiens
gccggccccaggct

SEQ ID NO: 4522003 - DNA, 12 bp, Homo sapiens
gccggcctcctc

SEQ ID NO: 4522004 - DNA, 14 bp, Homo sapiens
gccggcctcctcct

SEQ ID NO: 4522005 - DNA, 19 bp, Homo sapiens
gccggctgtttcctgacag

SEQ ID NO: 4522006 - DNA, 18 bp, Homo sapiens
gccgggaccaccctgagc

SEQ ID NO: 4522007 - DNA, 18 bp, Homo sapiens
gccgggcaggtcctgccc

SEQ ID NO: 4522008 - DNA, 12 bp, Homo sapiens
gccgggcccctg

SEQ ID NO: 4522009 - DNA, 20 bp, Homo sapiens
gccgggcgtggtggtgagtg

SEQ ID NO: 4522010 - DNA, 19 bp, Homo sapiens
gccgggtccggcctctccc

SEQ ID NO: 4522011 - DNA, 21 bp, Homo sapiens
gccgggtccggcctctccctg

SEQ ID NO: 4522012 - DNA, 14 bp, Homo sapiens
gccggtacctggga

SEQ ID NO: 4522013 - DNA, 14 bp, Homo sapiens
gccggtcgggcagc

SEQ ID NO: 4522014 - DNA, 22 bp, Homo sapiens
gccggtcgggcagccagcagag

SEQ ID NO: 4522015 - DNA, 14 bp, Homo sapiens
gccggtgccagctg

SEQ ID NO: 4522016 - DNA, 15 bp, Homo sapiens
gccggtgccagctgc

SEQ ID NO: 4522017 - DNA, 16 bp, Homo sapiens
gccggtgccagctgcc

SEQ ID NO: 4522018 - DNA, 13 bp, Homo sapiens
gccggtgggaccc

SEQ ID NO: 4522019 - DNA, 16 bp, Homo sapiens
gccggtgggaccctgt

SEQ ID NO: 4522020 - DNA, 20 bp, Homo sapiens
gccggttttcctcagctcta

SEQ ID NO: 4522021 - DNA, 13 bp, Homo sapiens
gccgtatagtgga

SEQ ID NO: 4522022 - DNA, 18 bp, Homo sapiens
gccgtcccgcgttcaaga

SEQ ID NO: 4522023 - DNA, 19 bp, Homo sapiens
gccgtcccgcgttcaagac

SEQ ID NO: 4522024 - DNA, 12 bp, Homo sapiens
gccgtggaagga

SEQ ID NO: 4522025 - DNA, 15 bp, Homo sapiens
gccgtgtctcagcct

SEQ ID NO: 4522026 - DNA, 21 bp, Homo sapiens
gccgtgtctcagcctctgcca

SEQ ID NO: 4522027 - DNA, 13 bp, Homo sapiens
gccgtgtttcctc

SEQ ID NO: 4522028 - DNA, 18 bp, Homo sapiens
gccgttactctccaacct

SEQ ID NO: 4522029 - DNA, 18 bp, Homo sapiens
gcctaaagctaaaaatat

SEQ ID NO: 4522030 - DNA, 21 bp, Homo sapiens
gcctaaagtacagcctggacc

SEQ ID NO: 4522031 - DNA, 17 bp, Homo sapiens
gcctaacctgccgagag

SEQ ID NO: 4522032 - DNA, 18 bp, Homo sapiens
gcctaagcattgcctggc

SEQ ID NO: 4522033 - DNA, 22 bp, Homo sapiens
gcctaaggttgtctacgggggc

SEQ ID NO: 4522034 - DNA, 17 bp, Homo sapiens
gcctaagtgcagccccg

SEQ ID NO: 4522035 - DNA, 13 bp, Homo sapiens
gcctacagccagg

SEQ ID NO: 4522036 - DNA, 20 bp, Homo sapiens
gcctaccccagttcctagca

SEQ ID NO: 4522037 - DNA, 12 bp, Homo sapiens
gcctacctctcc

SEQ ID NO: 4522038 - DNA, 13 bp, Homo sapiens
gcctacctgctct

SEQ ID NO: 4522039 - DNA, 12 bp, Homo sapiens
gcctactcacga

SEQ ID NO: 4522040 - DNA, 17 bp, Homo sapiens
gcctactccaaaatgtt

SEQ ID NO: 4522041 - DNA, 12 bp, Homo sapiens
gcctagcctggc

SEQ ID NO: 4522042 - DNA, 20 bp, Homo sapiens
gcctagcgatctctcctggc

SEQ ID NO: 4522043 - DNA, 18 bp, Homo sapiens
gcctagtggggtctccct

SEQ ID NO: 4522044 - DNA, 22 bp, Homo sapiens
gcctagtggggtctccctctcc

SEQ ID NO: 4522045 - DNA, 23 bp, Homo sapiens
gcctagtggggtctccctctcct

SEQ ID NO: 4522046 - DNA, 18 bp, Homo sapiens
gcctataatcccagctac

SEQ ID NO: 4522047 - DNA, 19 bp, Homo sapiens
gcctataatcccagctact

SEQ ID NO: 4522048 - DNA, 20 bp, Homo sapiens
gcctataatcccagctactg

SEQ ID NO: 4522049 - DNA, 20 bp, Homo sapiens
gcctatcaaaggaaatgaga

SEQ ID NO: 4522050 - DNA, 18 bp, Homo sapiens
gcctatccgctgccagcc

SEQ ID NO: 4522051 - DNA, 18 bp, Homo sapiens
gcctatgcactgaagagc

SEQ ID NO: 4522052 - DNA, 15 bp, Homo sapiens
gcctatgtctcctct

SEQ ID NO: 4522053 - DNA, 19 bp, Homo sapiens
gcctatttcagctgctttg

SEQ ID NO: 4522054 - DNA, 15 bp, Homo sapiens
gcctcaactcctccc

SEQ ID NO: 4522055 - DNA, 18 bp, Homo sapiens
gcctcaactcctcccata

SEQ ID NO: 4522056 - DNA, 21 bp, Homo sapiens
gcctcaatgtggttgcaaggc

SEQ ID NO: 4522057 - DNA, 13 bp, Homo sapiens
gcctcacagaaga

SEQ ID NO: 4522058 - DNA, 19 bp, Homo sapiens
gcctcacatttttttctac

SEQ ID NO: 4522059 - DNA, 14 bp, Homo sapiens
gcctcaccagcccc

SEQ ID NO: 4522060 - DNA, 16 bp, Homo sapiens
gcctcaccagcccccc

SEQ ID NO: 4522061 - DNA, 24 bp, Homo sapiens
gcctcaccagccccccgcgcgccc

SEQ ID NO: 4522062 - DNA, 19 bp, Homo sapiens
gcctcacccacccctgcac

SEQ ID NO: 4522063 - DNA, 22 bp, Homo sapiens
gcctcacggggttggctgttcc

SEQ ID NO: 4522064 - DNA, 19 bp, Homo sapiens
gcctcactaatttttgtat

SEQ ID NO: 4522065 - DNA, 17 bp, Homo sapiens
gcctcactggggcagac

SEQ ID NO: 4522066 - DNA, 19 bp, Homo sapiens
gcctcagaagtgcatctgg

SEQ ID NO: 4522067 - DNA, 23 bp, Homo sapiens
gcctcagaattgatcattttccc

SEQ ID NO: 4522068 - DNA, 17 bp, Homo sapiens
gcctcagacgttgcctg

SEQ ID NO: 4522069 - DNA, 20 bp, Homo sapiens
gcctcagacgttgcctgaga

SEQ ID NO: 4522070 - DNA, 18 bp, Homo sapiens
gcctcagagatctccctt

SEQ ID NO: 4522071 - DNA, 17 bp, Homo sapiens
gcctcagatgatttccc

SEQ ID NO: 4522072 - DNA, 13 bp, Homo sapiens
gcctcagccaggc

SEQ ID NO: 4522073 - DNA, 15 bp, Homo sapiens
gcctcagccaggccc

SEQ ID NO: 4522074 - DNA, 12 bp, Homo sapiens
gcctcagccctc

SEQ ID NO: 4522075 - DNA, 15 bp, Homo sapiens
gcctcagccctcagt

SEQ ID NO: 4522076 - DNA, 17 bp, Homo sapiens
gcctcagccctgctccc

SEQ ID NO: 4522077 - DNA, 21 bp, Homo sapiens
gcctcagcctcccatagctgg

SEQ ID NO: 4522078 - DNA, 14 bp, Homo sapiens
gcctcagcctgctt

SEQ ID NO: 4522079 - DNA, 19 bp, Homo sapiens
gcctcagcctgctttcctg

SEQ ID NO: 4522080 - DNA, 22 bp, Homo sapiens
gcctcagccttccaactagctg

SEQ ID NO: 4522081 - DNA, 15 bp, Homo sapiens
gcctcagcgtcctgg

SEQ ID NO: 4522082 - DNA, 14 bp, Homo sapiens
gcctcagctgcctc

SEQ ID NO: 4522083 - DNA, 16 bp, Homo sapiens
gcctcagctgcctcac

SEQ ID NO: 4522084 - DNA, 20 bp, Homo sapiens
gcctcagctgcctcacttcc

SEQ ID NO: 4522085 - DNA, 21 bp, Homo sapiens
gcctcaggccaagggaccagg

SEQ ID NO: 4522086 - DNA, 18 bp, Homo sapiens
gcctcatactcctgggct

SEQ ID NO: 4522087 - DNA, 22 bp, Homo sapiens
gcctcatactcctgggctcaag

SEQ ID NO: 4522088 - DNA, 21 bp, Homo sapiens
gcctcatcatcagagcctttc

SEQ ID NO: 4522089 - DNA, 16 bp, Homo sapiens
gcctcatctcagaccc

SEQ ID NO: 4522090 - DNA, 17 bp, Homo sapiens
gcctcatctcagaccct

SEQ ID NO: 4522091 - DNA, 22 bp, Homo sapiens
gcctcatgtccactggttcttc

SEQ ID NO: 4522092 - DNA, 15 bp, Homo sapiens
gcctccaagcacaga

SEQ ID NO: 4522093 - DNA, 19 bp, Homo sapiens
gcctccaagcacagagcct

SEQ ID NO: 4522094 - DNA, 21 bp, Homo sapiens
gcctccacactgaccaagtgc

SEQ ID NO: 4522095 - DNA, 14 bp, Homo sapiens
gcctccaccctctg

SEQ ID NO: 4522096 - DNA, 22 bp, Homo sapiens
gcctccaccctctgagctttgc

SEQ ID NO: 4522097 - DNA, 16 bp, Homo sapiens
gcctccactccttcca

SEQ ID NO: 4522098 - DNA, 15 bp, Homo sapiens
gcctccagcctctgt

SEQ ID NO: 4522099 - DNA, 21 bp, Homo sapiens
gcctccaggcccccaactccg

SEQ ID NO: 4522100 - DNA, 13 bp, Homo sapiens
gcctccagggccc

SEQ ID NO: 4522101 - DNA, 12 bp, Homo sapiens
gcctccagggct

SEQ ID NO: 4522102 - DNA, 19 bp, Homo sapiens
gcctccagggctggactga

SEQ ID NO: 4522103 - DNA, 23 bp, Homo sapiens
gcctccagggctggactgaggcc

SEQ ID NO: 4522104 - DNA, 12 bp, Homo sapiens
gcctccagtgca

SEQ ID NO: 4522105 - DNA, 14 bp, Homo sapiens
gcctccagtgcagt

SEQ ID NO: 4522106 - DNA, 23 bp, Homo sapiens
gcctccatcctaccccctgtgcc

SEQ ID NO: 4522107 - DNA, 11 bp, Homo sapiens
gcctccatctc

SEQ ID NO: 4522108 - DNA, 12 bp, Homo sapiens
gcctcccaccag

SEQ ID NO: 4522109 - DNA, 13 bp, Homo sapiens
gcctcccaccaga

SEQ ID NO: 4522110 - DNA, 15 bp, Homo sapiens
gcctcccaccagagc

SEQ ID NO: 4522111 - DNA, 20 bp, Homo sapiens
gcctcccaccagagccggga

SEQ ID NO: 4522112 - DNA, 12 bp, Homo sapiens
gcctcccaggtt

SEQ ID NO: 4522113 - DNA, 18 bp, Homo sapiens
gcctcccaggttcaagca

SEQ ID NO: 4522114 - DNA, 21 bp, Homo sapiens
gcctcccataattgctttgcc

SEQ ID NO: 4522115 - DNA, 14 bp, Homo sapiens
gcctcccatagctg

SEQ ID NO: 4522116 - DNA, 16 bp, Homo sapiens
gcctcccattctgcac

SEQ ID NO: 4522117 - DNA, 18 bp, Homo sapiens
gcctcccattctgcacca

SEQ ID NO: 4522118 - DNA, 13 bp, Homo sapiens
gcctccccatttc

SEQ ID NO: 4522119 - DNA, 22 bp, Homo sapiens
gcctccccatttcccatctgca

SEQ ID NO: 4522120 - DNA, 14 bp, Homo sapiens
gcctccccccagac

SEQ ID NO: 4522121 - DNA, 21 bp, Homo sapiens
gcctccccccagaccccgccc

SEQ ID NO: 4522122 - DNA, 14 bp, Homo sapiens
gcctcccctcccct

SEQ ID NO: 4522123 - DNA, 21 bp, Homo sapiens
gcctcccctcccctggggacg

SEQ ID NO: 4522124 - DNA, 15 bp, Homo sapiens
gcctcccctgccagg

SEQ ID NO: 4522125 - DNA, 18 bp, Homo sapiens
gcctcccctgccagggca

SEQ ID NO: 4522126 - DNA, 22 bp, Homo sapiens
gcctccctagttagcatccagg

SEQ ID NO: 4522127 - DNA, 15 bp, Homo sapiens
gcctccctccacccc

SEQ ID NO: 4522128 - DNA, 18 bp, Homo sapiens
gcctccctccaccccagg

SEQ ID NO: 4522129 - DNA, 20 bp, Homo sapiens
gcctccctccaccccaggac

SEQ ID NO: 4522130 - DNA, 21 bp, Homo sapiens
gcctccctctctcttctgctc

SEQ ID NO: 4522131 - DNA, 17 bp, Homo sapiens
gcctccctgctgtgcca

SEQ ID NO: 4522132 - DNA, 13 bp, Homo sapiens
gcctcccttgact

SEQ ID NO: 4522133 - DNA, 18 bp, Homo sapiens
gcctcccttttctcctct

SEQ ID NO: 4522134 - DNA, 18 bp, Homo sapiens
gcctccgagagggagaga

SEQ ID NO: 4522135 - DNA, 17 bp, Homo sapiens
gcctccgaggctccccg

SEQ ID NO: 4522136 - DNA, 18 bp, Homo sapiens
gcctccgaggctccccgc

SEQ ID NO: 4522137 - DNA, 15 bp, Homo sapiens
gcctccgcctgggtc

SEQ ID NO: 4522138 - DNA, 23 bp, Homo sapiens
gcctccgcctgggtcatgggcct

SEQ ID NO: 4522139 - DNA, 17 bp, Homo sapiens
gcctccggcgtcagcct

SEQ ID NO: 4522140 - DNA, 18 bp, Homo sapiens
gcctccggcgtcagcctc

SEQ ID NO: 4522141 - DNA, 18 bp, Homo sapiens
gcctcctcctcacccttc

SEQ ID NO: 4522142 - DNA, 17 bp, Homo sapiens
gcctcctcggagagcag

SEQ ID NO: 4522143 - DNA, 21 bp, Homo sapiens
gcctcctcggagagcagcagc

SEQ ID NO: 4522144 - DNA, 17 bp, Homo sapiens
gcctcctctgtctgccc

SEQ ID NO: 4522145 - DNA, 23 bp, Homo sapiens
gcctcctgagtagctgggactac

SEQ ID NO: 4522146 - DNA, 17 bp, Homo sapiens
gcctcctgccccctgcc

SEQ ID NO: 4522147 - DNA, 21 bp, Homo sapiens
gcctcctggccaagcaggctg

SEQ ID NO: 4522148 - DNA, 13 bp, Homo sapiens
gcctcctgtacct

SEQ ID NO: 4522149 - DNA, 16 bp, Homo sapiens
gcctcctgtacctcag

SEQ ID NO: 4522150 - DNA, 18 bp, Homo sapiens
gcctcctgtacctcagtg

SEQ ID NO: 4522151 - DNA, 19 bp, Homo sapiens
gcctcctgtacctcagtgg

SEQ ID NO: 4522152 - DNA, 14 bp, Homo sapiens
gcctcctgtgcctg

SEQ ID NO: 4522153 - DNA, 16 bp, Homo sapiens
gcctcctgtgcctggc

SEQ ID NO: 4522154 - DNA, 22 bp, Homo sapiens
gcctccttgtgagagtggcttt

SEQ ID NO: 4522155 - DNA, 22 bp, Homo sapiens
gcctcgacagggcctggagccc

SEQ ID NO: 4522156 - DNA, 17 bp, Homo sapiens
gcctcgacctccccacc

SEQ ID NO: 4522157 - DNA, 16 bp, Homo sapiens
gcctcgaggggcccag

SEQ ID NO: 4522158 - DNA, 19 bp, Homo sapiens
gcctcgaggggcccaggga

SEQ ID NO: 4522159 - DNA, 20 bp, Homo sapiens
gcctcgaggggcccagggaa

SEQ ID NO: 4522160 - DNA, 15 bp, Homo sapiens
gcctcgctcaccgct

SEQ ID NO: 4522161 - DNA, 22 bp, Homo sapiens
gcctcgctcaccgctggccctt

SEQ ID NO: 4522162 - DNA, 22 bp, Homo sapiens
gcctcggcctcccaaagtgctg

SEQ ID NO: 4522163 - DNA, 19 bp, Homo sapiens
gcctcgtagagtgacctcg

SEQ ID NO: 4522164 - DNA, 21 bp, Homo sapiens
gcctctaacagcacagggaag

SEQ ID NO: 4522165 - DNA, 19 bp, Homo sapiens
gcctctaaccccaggcccc

SEQ ID NO: 4522166 - DNA, 19 bp, Homo sapiens
gcctctcatcaactgaatg

SEQ ID NO: 4522167 - DNA, 16 bp, Homo sapiens
gcctctccctgcctgt

SEQ ID NO: 4522168 - DNA, 17 bp, Homo sapiens
gcctctccctgcctgtg

SEQ ID NO: 4522169 - DNA, 18 bp, Homo sapiens
gcctctccctgcctgtgg

SEQ ID NO: 4522170 - DNA, 15 bp, Homo sapiens
gccccagcccagaca

SEQ ID NO: 4522171 - DNA, 17 bp, Homo sapiens
gccccagccccctttgg

SEQ ID NO: 4522172 - DNA, 17 bp, Homo sapiens
gccccaggccagctgcg

SEQ ID NO: 4522173 - DNA, 11 bp, Homo sapiens
gccccaggccc

SEQ ID NO: 4522174 - DNA, 14 bp, Homo sapiens
gccccaggccccag

SEQ ID NO: 4522175 - DNA, 20 bp, Homo sapiens
gccccaggccctccctgact

SEQ ID NO: 4522176 - DNA, 11 bp, Homo sapiens
gccccaggctc

SEQ ID NO: 4522177 - DNA, 21 bp, Homo sapiens
gccccagggtcttccctacct

SEQ ID NO: 4522178 - DNA, 23 bp, Homo sapiens
gccccagggtcttccctacctca

SEQ ID NO: 4522179 - DNA, 21 bp, Homo sapiens
gccccaggtacacctccccct

SEQ ID NO: 4522180 - DNA, 13 bp, Homo sapiens
gccccagtcagcc

SEQ ID NO: 4522181 - DNA, 16 bp, Homo sapiens
gccccagtcagcctct

SEQ ID NO: 4522182 - DNA, 22 bp, Homo sapiens
gccccagtcagcctctctccca

SEQ ID NO: 4522183 - DNA, 20 bp, Homo sapiens
gccccatcagaacctgagct

SEQ ID NO: 4522184 - DNA, 14 bp, Homo sapiens
gccccatcagtgct

SEQ ID NO: 4522185 - DNA, 23 bp, Homo sapiens
gccccatccctgcttgcccgctc

SEQ ID NO: 4522186 - DNA, 12 bp, Homo sapiens
gccccatcctca

SEQ ID NO: 4522187 - DNA, 14 bp, Homo sapiens
gccccatcttgatc

SEQ ID NO: 4522188 - DNA, 16 bp, Homo sapiens
gccccatgcctgtcca

SEQ ID NO: 4522189 - DNA, 23 bp, Homo sapiens
gccccatgcctgtccagcctggg

SEQ ID NO: 4522190 - DNA, 18 bp, Homo sapiens
gccccatgtctctcagaa

SEQ ID NO: 4522191 - DNA, 21 bp, Homo sapiens
gcccccaacccctcctccctc

SEQ ID NO: 4522192 - DNA, 23 bp, Homo sapiens
gcccccaacccctcctccctcag

SEQ ID NO: 4522193 - DNA, 19 bp, Homo sapiens
gcccccaacccctccttcc

SEQ ID NO: 4522194 - DNA, 17 bp, Homo sapiens
gcccccaacctcagggc

SEQ ID NO: 4522195 - DNA, 23 bp, Homo sapiens
gcccccaacctcagggctcccag

SEQ ID NO: 4522196 - DNA, 16 bp, Homo sapiens
gcccccaataaaccag

SEQ ID NO: 4522197 - DNA, 22 bp, Homo sapiens
gcccccaataaaccagtgtgaa

SEQ ID NO: 4522198 - DNA, 15 bp, Homo sapiens
gcccccaataaaggc

SEQ ID NO: 4522199 - DNA, 19 bp, Homo sapiens
gcccccaataaaggcagct

SEQ ID NO: 4522200 - DNA, 17 bp, Homo sapiens
gcccccaccccggggac

SEQ ID NO: 4522201 - DNA, 21 bp, Homo sapiens
gcccccaccccggggaccctg

SEQ ID NO: 4522202 - DNA, 11 bp, Homo sapiens
gcccccagaaa

SEQ ID NO: 4522203 - DNA, 18 bp, Homo sapiens
gcccccagaaagcctcct

SEQ ID NO: 4522204 - DNA, 12 bp, Homo sapiens
gcccccagcaga

SEQ ID NO: 4522205 - DNA, 21 bp, Homo sapiens
gcccccagccccggggtgagt

SEQ ID NO: 4522206 - DNA, 19 bp, Homo sapiens
gcccccagcccctcctccc

SEQ ID NO: 4522207 - DNA, 20 bp, Homo sapiens
gcccccagcccctcctccct

SEQ ID NO: 4522208 - DNA, 22 bp, Homo sapiens
gcccccagcccctcctccctca

SEQ ID NO: 4522209 - DNA, 16 bp, Homo sapiens
gcccccaggtgccagt

SEQ ID NO: 4522210 - DNA, 15 bp, Homo sapiens
gcccccagtccccac

SEQ ID NO: 4522211 - DNA, 18 bp, Homo sapiens
gcccccagtccccacccc

SEQ ID NO: 4522212 - DNA, 17 bp, Homo sapiens
gccccccgaggctgcta

SEQ ID NO: 4522213 - DNA, 16 bp, Homo sapiens
gccccccgccctcatg

SEQ ID NO: 4522214 - DNA, 13 bp, Homo sapiens
gccccccgcgcgc

SEQ ID NO: 4522215 - DNA, 18 bp, Homo sapiens
gccccccgcgctcgccca

SEQ ID NO: 4522216 - DNA, 19 bp, Homo sapiens
gccccccgcgctcgcccag

SEQ ID NO: 4522217 - DNA, 11 bp, Homo sapiens
gcccccctcct

SEQ ID NO: 4522218 - DNA, 14 bp, Homo sapiens
gcccccgagccctg

SEQ ID NO: 4522219 - DNA, 15 bp, Homo sapiens
gcccccgccccagag

SEQ ID NO: 4522220 - DNA, 14 bp, Homo sapiens
gcccccgcctgcca

SEQ ID NO: 4522221 - DNA, 15 bp, Homo sapiens
gcccccgcctgccac

SEQ ID NO: 4522222 - DNA, 16 bp, Homo sapiens
gcccccgcctgccacc

SEQ ID NO: 4522223 - DNA, 19 bp, Homo sapiens
gcccccgcgggttctagac

SEQ ID NO: 4522224 - DNA, 14 bp, Homo sapiens
gcccccggccccct

SEQ ID NO: 4522225 - DNA, 20 bp, Homo sapiens
gccccctcccaccgctgcct

SEQ ID NO: 4522226 - DNA, 21 bp, Homo sapiens
gccccctcccaccgctgcctc

SEQ ID NO: 4522227 - DNA, 13 bp, Homo sapiens
gccccctccccca

SEQ ID NO: 4522228 - DNA, 18 bp, Homo sapiens
gccccctcccccatgggc

SEQ ID NO: 4522229 - DNA, 20 bp, Homo sapiens
gccccctcccccatgggctg

SEQ ID NO: 4522230 - DNA, 12 bp, Homo sapiens
gccccctctcgg

SEQ ID NO: 4522231 - DNA, 11 bp, Homo sapiens
gccccctgcca

SEQ ID NO: 4522232 - DNA, 15 bp, Homo sapiens
gccccctgctggctc

SEQ ID NO: 4522233 - DNA, 20 bp, Homo sapiens
gccccctgctggctcttctg

SEQ ID NO: 4522234 - DNA, 14 bp, Homo sapiens
gccccctggtctct

SEQ ID NO: 4522235 - DNA, 12 bp, Homo sapiens
gccccgactcca

SEQ ID NO: 4522236 - DNA, 13 bp, Homo sapiens
gccccgactccag

SEQ ID NO: 4522237 - DNA, 21 bp, Homo sapiens
gccccgactccagccagcgcc

SEQ ID NO: 4522238 - DNA, 19 bp, Homo sapiens
gccccgaggacccagaccc

SEQ ID NO: 4522239 - DNA, 22 bp, Homo sapiens
gccccgaggacccagacccagt

SEQ ID NO: 4522240 - DNA, 21 bp, Homo sapiens
gccccgcacgactgcgggagc

SEQ ID NO: 4522241 - DNA, 15 bp, Homo sapiens
gccccgccagggctg

SEQ ID NO: 4522242 - DNA, 13 bp, Homo sapiens
gccccgcccctcc

SEQ ID NO: 4522243 - DNA, 14 bp, Homo sapiens
gccccgcccctccc

SEQ ID NO: 4522244 - DNA, 16 bp, Homo sapiens
gccccgcccctcccac

SEQ ID NO: 4522245 - DNA, 13 bp, Homo sapiens
gccccgcgtggaa

SEQ ID NO: 4522246 - DNA, 19 bp, Homo sapiens
gccccgcttgtccagcgcc

SEQ ID NO: 4522247 - DNA, 21 bp, Homo sapiens
gccccggggccccctggtcac

SEQ ID NO: 4522248 - DNA, 19 bp, Homo sapiens
gccccggtcccccagagca

SEQ ID NO: 4522249 - DNA, 19 bp, Homo sapiens
gccccgtcggactgccccc

SEQ ID NO: 4522250 - DNA, 22 bp, Homo sapiens
gccccgtgtgtgtggccggcct

SEQ ID NO: 4522251 - DNA, 18 bp, Homo sapiens
gcccctaccctggacttg

SEQ ID NO: 4522252 - DNA, 19 bp, Homo sapiens
gcccctatagcactgagct

SEQ ID NO: 4522253 - DNA, 20 bp, Homo sapiens
gcccctcacccaccatggac

SEQ ID NO: 4522254 - DNA, 17 bp, Homo sapiens
gcccctcacttgaggag

SEQ ID NO: 4522255 - DNA, 14 bp, Homo sapiens
gcccctccagcttg

SEQ ID NO: 4522256 - DNA, 18 bp, Homo sapiens
gcccctccagcttgtgga

SEQ ID NO: 4522257 - DNA, 14 bp, Homo sapiens
gcccctcccaagcg

SEQ ID NO: 4522258 - DNA, 19 bp, Homo sapiens
gcccctcccacgcctcacc

SEQ ID NO: 4522259 - DNA, 16 bp, Homo sapiens
gcccctccccagccag

SEQ ID NO: 4522260 - DNA, 15 bp, Homo sapiens
gcccctcccccaacc

SEQ ID NO: 4522261 - DNA, 15 bp, Homo sapiens
gcccctcccccactt

SEQ ID NO: 4522262 - DNA, 16 bp, Homo sapiens
gcccctcccgcccctt

SEQ ID NO: 4522263 - DNA, 15 bp, Homo sapiens
gcccctccctacctc

SEQ ID NO: 4522264 - DNA, 17 bp, Homo sapiens
gcccctccctacctcaa

SEQ ID NO: 4522265 - DNA, 11 bp, Homo sapiens
gcccctcctcc

SEQ ID NO: 4522266 - DNA, 12 bp, Homo sapiens
gcccctcctccc

SEQ ID NO: 4522267 - DNA, 17 bp, Homo sapiens
gcccctcctccctcaga

SEQ ID NO: 4522268 - DNA, 21 bp, Homo sapiens
gcccctcctccctcagaccca

SEQ ID NO: 4522269 - DNA, 23 bp, Homo sapiens
gcccctcctccctcagacccagg

SEQ ID NO: 4522270 - DNA, 21 bp, Homo sapiens
gcccctcctccctcaggccca

SEQ ID NO: 4522271 - DNA, 13 bp, Homo sapiens
gcccctcctctgc

SEQ ID NO: 4522272 - DNA, 14 bp, Homo sapiens
gcccctcctctgcc

SEQ ID NO: 4522273 - DNA, 16 bp, Homo sapiens
gcccctcctctgccac

SEQ ID NO: 4522274 - DNA, 17 bp, Homo sapiens
gcccctcctctgccacc

SEQ ID NO: 4522275 - DNA, 21 bp, Homo sapiens
gcccctcctctgccacctccc

SEQ ID NO: 4522276 - DNA, 22 bp, Homo sapiens
gcccctcctctgccacctcccc

SEQ ID NO: 4522277 - DNA, 18 bp, Homo sapiens
gcccctccttttggcctg

SEQ ID NO: 4522278 - DNA, 19 bp, Homo sapiens
gcccctccttttggcctgg

SEQ ID NO: 4522279 - DNA, 15 bp, Homo sapiens
gcccctctcaccaaa

SEQ ID NO: 4522280 - DNA, 18 bp, Homo sapiens
gcccctctctagggaccc

SEQ ID NO: 4522281 - DNA, 22 bp, Homo sapiens
gcccctctctagggacccctcg

SEQ ID NO: 4522282 - DNA, 15 bp, Homo sapiens
gcccctctgccttgc

SEQ ID NO: 4522283 - DNA, 22 bp, Homo sapiens
gcccctgatgacgggatgctct

SEQ ID NO: 4522284 - DNA, 15 bp, Homo sapiens
gcccctgcaatgtgg

SEQ ID NO: 4522285 - DNA, 22 bp, Homo sapiens
gcccctgcacagcaggctgcca

SEQ ID NO: 4522286 - DNA, 17 bp, Homo sapiens
gcccctgcacaggcaca

SEQ ID NO: 4522287 - DNA, 14 bp, Homo sapiens
gcccctgcagctgg

SEQ ID NO: 4522288 - DNA, 16 bp, Homo sapiens
gcccctgctgtgctgc

SEQ ID NO: 4522289 - DNA, 20 bp, Homo sapiens
gcccctgctgtgctgctcaa

SEQ ID NO: 4522290 - DNA, 17 bp, Homo sapiens
gcccctggacctgggaa

SEQ ID NO: 4522291 - DNA, 19 bp, Homo sapiens
gcctctccctgctgctcct

SEQ ID NO: 4522292 - DNA, 22 bp, Homo sapiens
gcctctccctgctgctcctagg

SEQ ID NO: 4522293 - DNA, 14 bp, Homo sapiens
gcctctcctttgta

SEQ ID NO: 4522294 - DNA, 15 bp, Homo sapiens
gcctctcctttgtag

SEQ ID NO: 4522295 - DNA, 13 bp, Homo sapiens
gcctctctcccag

SEQ ID NO: 4522296 - DNA, 17 bp, Homo sapiens
gcctctctcccagtcta

SEQ ID NO: 4522297 - DNA, 13 bp, Homo sapiens
gcctctctcctgc

SEQ ID NO: 4522298 - DNA, 17 bp, Homo sapiens
gcctctctttcacacaa

SEQ ID NO: 4522299 - DNA, 18 bp, Homo sapiens
gcctctgacagtccacag

SEQ ID NO: 4522300 - DNA, 19 bp, Homo sapiens
gcctctgacagtccacagg

SEQ ID NO: 4522301 - DNA, 22 bp, Homo sapiens
gcctctgacagtccacaggggc

SEQ ID NO: 4522302 - DNA, 19 bp, Homo sapiens
gcctctgccgctgccatgc

SEQ ID NO: 4522303 - DNA, 19 bp, Homo sapiens
gcctctgcggagcacactg

SEQ ID NO: 4522304 - DNA, 24 bp, Homo sapiens
gcctctgcggagcacactggctca

SEQ ID NO: 4522305 - DNA, 18 bp, Homo sapiens
gcctctgctggctcagga

SEQ ID NO: 4522306 - DNA, 17 bp, Homo sapiens
gcctctggttgcctccc

SEQ ID NO: 4522307 - DNA, 18 bp, Homo sapiens
gcctctggttgcctcccc

SEQ ID NO: 4522308 - DNA, 15 bp, Homo sapiens
gcctctgtccccttc

SEQ ID NO: 4522309 - DNA, 19 bp, Homo sapiens
gcctctgtccccttctctc

SEQ ID NO: 4522310 - DNA, 16 bp, Homo sapiens
gcctcttcaggcctgc

SEQ ID NO: 4522311 - DNA, 20 bp, Homo sapiens
gcctcttcaggcctgctagt

SEQ ID NO: 4522312 - DNA, 14 bp, Homo sapiens
gcctcttcctgttg

SEQ ID NO: 4522313 - DNA, 19 bp, Homo sapiens
gcctcttctcttgacagtc

SEQ ID NO: 4522314 - DNA, 14 bp, Homo sapiens
gcctcttctttgtg

SEQ ID NO: 4522315 - DNA, 17 bp, Homo sapiens
gcctcttctttgtgcct

SEQ ID NO: 4522316 - DNA, 19 bp, Homo sapiens
gcctcttctttgtgccttt

SEQ ID NO: 4522317 - DNA, 13 bp, Homo sapiens
gcctcttgaccag

SEQ ID NO: 4522318 - DNA, 14 bp, Homo sapiens
gcctcttgaccagg

SEQ ID NO: 4522319 - DNA, 20 bp, Homo sapiens
gcctcttggagaccttaccc

SEQ ID NO: 4522320 - DNA, 18 bp, Homo sapiens
gcctcttgtaaagactgg

SEQ ID NO: 4522321 - DNA, 20 bp, Homo sapiens
gcctgaaatgacatttcact

SEQ ID NO: 4522322 - DNA, 16 bp, Homo sapiens
gcctgaacagccctct

SEQ ID NO: 4522323 - DNA, 15 bp, Homo sapiens
gcctgaactccagag

SEQ ID NO: 4522324 - DNA, 14 bp, Homo sapiens
gcctgaactgagga

SEQ ID NO: 4522325 - DNA, 20 bp, Homo sapiens
gcctgaagcttcggccgcgc

SEQ ID NO: 4522326 - DNA, 19 bp, Homo sapiens
gcctgaattgctttctgct

SEQ ID NO: 4522327 - DNA, 23 bp, Homo sapiens
gcctgacgctcagccccaggcca

SEQ ID NO: 4522328 - DNA, 22 bp, Homo sapiens
gcctgactcagctaatgtcaca

SEQ ID NO: 4522329 - DNA, 19 bp, Homo sapiens
gcctgacttctgctggcat

SEQ ID NO: 4522330 - DNA, 21 bp, Homo sapiens
gcctgacttgagccactcctt

SEQ ID NO: 4522331 - DNA, 12 bp, Homo sapiens
gcctgagaccag

SEQ ID NO: 4522332 - DNA, 13 bp, Homo sapiens
gcctgagaccagg

SEQ ID NO: 4522333 - DNA, 14 bp, Homo sapiens
gcctgagaccaggg

SEQ ID NO: 4522334 - DNA, 16 bp, Homo sapiens
gcctgagaccagggtg

SEQ ID NO: 4522335 - DNA, 18 bp, Homo sapiens
gcctgagaccagggtggc

SEQ ID NO: 4522336 - DNA, 16 bp, Homo sapiens
gcctgagaggcaggca

SEQ ID NO: 4522337 - DNA, 18 bp, Homo sapiens
gcctgagatttcatctgc

SEQ ID NO: 4522338 - DNA, 18 bp, Homo sapiens
gcctgagcaactcttgat

SEQ ID NO: 4522339 - DNA, 22 bp, Homo sapiens
gcctgagcatccagacctgagc

SEQ ID NO: 4522340 - DNA, 17 bp, Homo sapiens
gcctgatactttagcca

SEQ ID NO: 4522341 - DNA, 21 bp, Homo sapiens
gcctgatctttgggcatcaga

SEQ ID NO: 4522342 - DNA, 19 bp, Homo sapiens
gcctgatgagatttttaaa

SEQ ID NO: 4522343 - DNA, 14 bp, Homo sapiens
gcctgatgctccct

SEQ ID NO: 4522344 - DNA, 17 bp, Homo sapiens
gcctgatgctccctccc

SEQ ID NO: 4522345 - DNA, 19 bp, Homo sapiens
gcctgatgctccctcccct

SEQ ID NO: 4522346 - DNA, 20 bp, Homo sapiens
gcctgatgctccctcccctg

SEQ ID NO: 4522347 - DNA, 16 bp, Homo sapiens
gcctgcacaataaaaa

SEQ ID NO: 4522348 - DNA, 21 bp, Homo sapiens
gcctgcacacagagtgaggga

SEQ ID NO: 4522349 - DNA, 14 bp, Homo sapiens
gcctgcacccctcc

SEQ ID NO: 4522350 - DNA, 12 bp, Homo sapiens
gcctgcagcagg

SEQ ID NO: 4522351 - DNA, 17 bp, Homo sapiens
gcctgcagccagggctg

SEQ ID NO: 4522352 - DNA, 15 bp, Homo sapiens
gcctgcaggcagagc

SEQ ID NO: 4522353 - DNA, 16 bp, Homo sapiens
gcctgcaggcagagct

SEQ ID NO: 4522354 - DNA, 20 bp, Homo sapiens
gcctgcatggcatcagacta

SEQ ID NO: 4522355 - DNA, 12 bp, Homo sapiens
gcctgcccagac

SEQ ID NO: 4522356 - DNA, 13 bp, Homo sapiens
gcctgcccagact

SEQ ID NO: 4522357 - DNA, 14 bp, Homo sapiens
gcctgcccagactg

SEQ ID NO: 4522358 - DNA, 20 bp, Homo sapiens
gcctgccccgcccccagtcc

SEQ ID NO: 4522359 - DNA, 12 bp, Homo sapiens
gcctgcccctgt

SEQ ID NO: 4522360 - DNA, 16 bp, Homo sapiens
gcctgccgtgcatggc

SEQ ID NO: 4522361 - DNA, 21 bp, Homo sapiens
gcctgccgtgcatggctcctg

SEQ ID NO: 4522362 - DNA, 18 bp, Homo sapiens
gcctgcctccagggctgg

SEQ ID NO: 4522363 - DNA, 12 bp, Homo sapiens
gcctgcctggag

SEQ ID NO: 4522364 - DNA, 15 bp, Homo sapiens
gcctgcctggcaggc

SEQ ID NO: 4522365 - DNA, 20 bp, Homo sapiens
gcctgcgcccaccccgctct

SEQ ID NO: 4522366 - DNA, 22 bp, Homo sapiens
gcctgcgcccaccccgctctgc

SEQ ID NO: 4522367 - DNA, 23 bp, Homo sapiens
gcctgcgcccaccccgctctgca

SEQ ID NO: 4522368 - DNA, 17 bp, Homo sapiens
gcctgcgcctgctgcct

SEQ ID NO: 4522369 - DNA, 19 bp, Homo sapiens
gcctgcggtggagggatca

SEQ ID NO: 4522370 - DNA, 17 bp, Homo sapiens
gcctgctaaggctcctc

SEQ ID NO: 4522371 - DNA, 14 bp, Homo sapiens
gcctgctagtcact

SEQ ID NO: 4522372 - DNA, 11 bp, Homo sapiens
gcctgctcccc

SEQ ID NO: 4522373 - DNA, 15 bp, Homo sapiens
gcctgctcccccacc

SEQ ID NO: 4522374 - DNA, 17 bp, Homo sapiens
gcctgctcccccacccc

SEQ ID NO: 4522375 - DNA, 20 bp, Homo sapiens
gcctgctccttggcaccccc

SEQ ID NO: 4522376 - DNA, 12 bp, Homo sapiens
gcctgctgccag

SEQ ID NO: 4522377 - DNA, 12 bp, Homo sapiens
gcctgctggctg

SEQ ID NO: 4522378 - DNA, 14 bp, Homo sapiens
gcctgctggctgcg

SEQ ID NO: 4522379 - DNA, 21 bp, Homo sapiens
gcctgctggctgcggccccct

SEQ ID NO: 4522380 - DNA, 16 bp, Homo sapiens
gcctgctgggctctcc

SEQ ID NO: 4522381 - DNA, 18 bp, Homo sapiens
gcctgctgggctctccac

SEQ ID NO: 4522382 - DNA, 19 bp, Homo sapiens
gcctgctgggctctccacc

SEQ ID NO: 4522383 - DNA, 22 bp, Homo sapiens
gcctgctgggctctccacctca

SEQ ID NO: 4522384 - DNA, 24 bp, Homo sapiens
gcctgctgggctctccacctcagc

SEQ ID NO: 4522385 - DNA, 18 bp, Homo sapiens
gcctgctggtcacagcct

SEQ ID NO: 4522386 - DNA, 16 bp, Homo sapiens
gcctgcttctttccag

SEQ ID NO: 4522387 - DNA, 15 bp, Homo sapiens
gcctgctttcctgca

SEQ ID NO: 4522388 - DNA, 16 bp, Homo sapiens
gcctgctttttggaaa

SEQ ID NO: 4522389 - DNA, 21 bp, Homo sapiens
gcctgctttttggaaagtcag

SEQ ID NO: 4522390 - DNA, 21 bp, Homo sapiens
gcctggagacaaggtgctaac

SEQ ID NO: 4522391 - DNA, 13 bp, Homo sapiens
gcctggagctaat

SEQ ID NO: 4522392 - DNA, 17 bp, Homo sapiens
gcctggccaccagccat

SEQ ID NO: 4522393 - DNA, 15 bp, Homo sapiens
gcctggccaggagct

SEQ ID NO: 4522394 - DNA, 23 bp, Homo sapiens
gcctggccaggcagatctgtgcc

SEQ ID NO: 4522395 - DNA, 17 bp, Homo sapiens
gcctggccccagcctgg

SEQ ID NO: 4522396 - DNA, 16 bp, Homo sapiens
gcctggccccatggtc

SEQ ID NO: 4522397 - DNA, 13 bp, Homo sapiens
gcctggcccccaa

SEQ ID NO: 4522398 - DNA, 20 bp, Homo sapiens
gcctggcccccaacctcagg

SEQ ID NO: 4522399 - DNA, 17 bp, Homo sapiens
gcctggccctccccaca

SEQ ID NO: 4522400 - DNA, 13 bp, Homo sapiens
gcctggccctgct

SEQ ID NO: 4522401 - DNA, 18 bp, Homo sapiens
gcctggccgcagggcggg

SEQ ID NO: 4522402 - DNA, 13 bp, Homo sapiens
gcctggcctcatc

SEQ ID NO: 4522403 - DNA, 17 bp, Homo sapiens
gcctggcctcatctcag

SEQ ID NO: 4522404 - DNA, 14 bp, Homo sapiens
gcctggctccagtc

SEQ ID NO: 4522405 - DNA, 15 bp, Homo sapiens
gcctggctccctgat

SEQ ID NO: 4522406 - DNA, 21 bp, Homo sapiens
gcctggctccctgatggggga

SEQ ID NO: 4522407 - DNA, 13 bp, Homo sapiens
gcctggctctgcc

SEQ ID NO: 4522408 - DNA, 17 bp, Homo sapiens
gcctggctggaggagca

SEQ ID NO: 4522409 - DNA, 14 bp, Homo sapiens
gcctgggagcccag

SEQ ID NO: 4522410 - DNA, 18 bp, Homo sapiens
gcctgggcagccaggctg

SEQ ID NO: 4522411 - DNA, 23 bp, Homo sapiens
gcctgggcagccaggctgccaag

SEQ ID NO: 4522412 - DNA, 22 bp, Homo sapiens
gcctgggctcactgtgctgggg

SEQ ID NO: 4522413 - DNA, 14 bp, Homo sapiens
gcctggggaggccc

SEQ ID NO: 4522414 - DNA, 15 bp, Homo sapiens
gcctggggaggccct

SEQ ID NO: 4522415 - DNA, 22 bp, Homo sapiens
gcctggggctgaggctgaggca

SEQ ID NO: 4522416 - DNA, 22 bp, Homo sapiens
gcctgggggcagggagaggagt

SEQ ID NO: 4522417 - DNA, 16 bp, Homo sapiens
gcctgggggtgccagg

SEQ ID NO: 4522418 - DNA, 21 bp, Homo sapiens
gcctgggggtgccaggaccag

SEQ ID NO: 4522419 - DNA, 16 bp, Homo sapiens
gcctggggtgcatctc

SEQ ID NO: 4522420 - DNA, 20 bp, Homo sapiens
gcctggggtgcatctcctcc

SEQ ID NO: 4522421 - DNA, 20 bp, Homo sapiens
gcctgggtcacagagtgaga

SEQ ID NO: 4522422 - DNA, 19 bp, Homo sapiens
gcctgggtcatgggcctgt

SEQ ID NO: 4522423 - DNA, 22 bp, Homo sapiens
gcctgggtggggctgctcctcc

SEQ ID NO: 4522424 - DNA, 14 bp, Homo sapiens
gcctgggtgtcaag

SEQ ID NO: 4522425 - DNA, 20 bp, Homo sapiens
gcctgggtgtcaagtgcctg

SEQ ID NO: 4522426 - DNA, 22 bp, Homo sapiens
gcctgggtgtcaagtgcctgca

SEQ ID NO: 4522427 - DNA, 15 bp, Homo sapiens
gcctggtagaaacta

SEQ ID NO: 4522428 - DNA, 19 bp, Homo sapiens
gcctggttaatattaatat

SEQ ID NO: 4522429 - DNA, 16 bp, Homo sapiens
gcctgtaatcccagaa

SEQ ID NO: 4522430 - DNA, 17 bp, Homo sapiens
gcctgtaatcccagcac

SEQ ID NO: 4522431 - DNA, 18 bp, Homo sapiens
gcctgtaatcccagcact

SEQ ID NO: 4522432 - DNA, 17 bp, Homo sapiens
gcctgtactaaggagca

SEQ ID NO: 4522433 - DNA, 20 bp, Homo sapiens
gcctgtagctttcctggtcc

SEQ ID NO: 4522434 - DNA, 22 bp, Homo sapiens
gcctgtatcctccctggcagac

SEQ ID NO: 4522435 - DNA, 23 bp, Homo sapiens
gcctgtatcctccctggcagaca

SEQ ID NO: 4522436 - DNA, 18 bp, Homo sapiens
gcctgtcacaataaagtt

SEQ ID NO: 4522437 - DNA, 12 bp, Homo sapiens
gcctgtccagcc

SEQ ID NO: 4522438 - DNA, 14 bp, Homo sapiens
gcctgtccagcctg

SEQ ID NO: 4522439 - DNA, 15 bp, Homo sapiens
gcctgtccctgggag

SEQ ID NO: 4522440 - DNA, 18 bp, Homo sapiens
gcctgtctcatccccagg

SEQ ID NO: 4522441 - DNA, 19 bp, Homo sapiens
gcctgtctcatccccaggg

SEQ ID NO: 4522442 - DNA, 14 bp, Homo sapiens
gcctgtctgcttgc

SEQ ID NO: 4522443 - DNA, 21 bp, Homo sapiens
gcctgtgagcatggggccagg

SEQ ID NO: 4522444 - DNA, 18 bp, Homo sapiens
gcctgtggaggggcttgg

SEQ ID NO: 4522445 - DNA, 19 bp, Homo sapiens
gcctgtggcagtaaagaga

SEQ ID NO: 4522446 - DNA, 21 bp, Homo sapiens
gcctgtggccagcagccccca

SEQ ID NO: 4522447 - DNA, 14 bp, Homo sapiens
gcctgtggcccctc

SEQ ID NO: 4522448 - DNA, 20 bp, Homo sapiens
gcctgtggcccctcccctgc

SEQ ID NO: 4522449 - DNA, 23 bp, Homo sapiens
gcctgtggcccctcccctgcaga

SEQ ID NO: 4522450 - DNA, 16 bp, Homo sapiens
gcctgtggcggtgcct

SEQ ID NO: 4522451 - DNA, 13 bp, Homo sapiens
gcctgtgggcttc

SEQ ID NO: 4522452 - DNA, 14 bp, Homo sapiens
gcctgtgggtctct

SEQ ID NO: 4522453 - DNA, 18 bp, Homo sapiens
gcctgtgggtctctgaag

SEQ ID NO: 4522454 - DNA, 15 bp, Homo sapiens
gcctgtggtgaagtg

SEQ ID NO: 4522455 - DNA, 18 bp, Homo sapiens
gcctgtggtgaagtgtgg

SEQ ID NO: 4522456 - DNA, 19 bp, Homo sapiens
gcctgtggtgaagtgtggc

SEQ ID NO: 4522457 - DNA, 21 bp, Homo sapiens
gcctgtgtacaactttttaaa

SEQ ID NO: 4522458 - DNA, 22 bp, Homo sapiens
gcctgttaatttataatgtatt

SEQ ID NO: 4522459 - DNA, 16 bp, Homo sapiens
gcctgttggcaggccc

SEQ ID NO: 4522460 - DNA, 22 bp, Homo sapiens
gcctgttggcaggcccactccc

SEQ ID NO: 4522461 - DNA, 17 bp, Homo sapiens
gccttaatttccttttt

SEQ ID NO: 4522462 - DNA, 15 bp, Homo sapiens
gccttacctcctgcc

SEQ ID NO: 4522463 - DNA, 17 bp, Homo sapiens
gccttacctcctgccca

SEQ ID NO: 4522464 - DNA, 14 bp, Homo sapiens
gccttagcttcagg

SEQ ID NO: 4522465 - DNA, 19 bp, Homo sapiens
gccttattacccaggaaga

SEQ ID NO: 4522466 - DNA, 21 bp, Homo sapiens
gccttatttctcattgcctct

SEQ ID NO: 4522467 - DNA, 22 bp, Homo sapiens
gccttatttgtctgtaaaaaat

SEQ ID NO: 4522468 - DNA, 17 bp, Homo sapiens
gccttcaagaatcagaa

SEQ ID NO: 4522469 - DNA, 16 bp, Homo sapiens
gccttcaaggactgtt

SEQ ID NO: 4522470 - DNA, 21 bp, Homo sapiens
gccttcaaggactgtttcagt

SEQ ID NO: 4522471 - DNA, 12 bp, Homo sapiens
gccttcaagtgc

SEQ ID NO: 4522472 - DNA, 15 bp, Homo sapiens
gccttcaagtgccaa

SEQ ID NO: 4522473 - DNA, 17 bp, Homo sapiens
gccttcaagtgccaaac

SEQ ID NO: 4522474 - DNA, 14 bp, Homo sapiens
gccttcacaaatgt

SEQ ID NO: 4522475 - DNA, 15 bp, Homo sapiens
gccttcactgggcca

SEQ ID NO: 4522476 - DNA, 19 bp, Homo sapiens
gccttcagaatgctcctga

SEQ ID NO: 4522477 - DNA, 18 bp, Homo sapiens
gccttcatatcatccaca

SEQ ID NO: 4522478 - DNA, 20 bp, Homo sapiens
gccttcatctgggacaaaac

SEQ ID NO: 4522479 - DNA, 23 bp, Homo sapiens
gccttccaactagctgggactac

SEQ ID NO: 4522480 - DNA, 21 bp, Homo sapiens
gccttccagatcctctctggg

SEQ ID NO: 4522481 - DNA, 22 bp, Homo sapiens
gccttccagatcctctctgggg

SEQ ID NO: 4522482 - DNA, 18 bp, Homo sapiens
gccttccagttttgtgga

SEQ ID NO: 4522483 - DNA, 20 bp, Homo sapiens
gccttccatgtcggcctcta

SEQ ID NO: 4522484 - DNA, 13 bp, Homo sapiens
gccttcctcagct

SEQ ID NO: 4522485 - DNA, 22 bp, Homo sapiens
gccttcctcctgggccctctct

SEQ ID NO: 4522486 - DNA, 16 bp, Homo sapiens
gccttcgaccacagca

SEQ ID NO: 4522487 - DNA, 20 bp, Homo sapiens
gccttcgtgcctgagaccag

SEQ ID NO: 4522488 - DNA, 21 bp, Homo sapiens
gccttcgtgcctgagaccagg

SEQ ID NO: 4522489 - DNA, 15 bp, Homo sapiens
gccttctcaccagct

SEQ ID NO: 4522490 - DNA, 17 bp, Homo sapiens
gccttctcaccagctgc

SEQ ID NO: 4522491 - DNA, 17 bp, Homo sapiens
gccttctcatgatccaa

SEQ ID NO: 4522492 - DNA, 20 bp, Homo sapiens
gccttctcccacatgaggcc

SEQ ID NO: 4522493 - DNA, 14 bp, Homo sapiens
gccttctggagctg

SEQ ID NO: 4522494 - DNA, 12 bp, Homo sapiens
gccttctgggct

SEQ ID NO: 4522495 - DNA, 13 bp, Homo sapiens
gccttctgggctt

SEQ ID NO: 4522496 - DNA, 23 bp, Homo sapiens
gccttctggtttcttccagccac

SEQ ID NO: 4522497 - DNA, 19 bp, Homo sapiens
gccttctgtggggactccg

SEQ ID NO: 4522498 - DNA, 18 bp, Homo sapiens
gccttcttattctcactc

SEQ ID NO: 4522499 - DNA, 23 bp, Homo sapiens
gccttcttcggggaactcctgga

SEQ ID NO: 4522500 - DNA, 18 bp, Homo sapiens
gccttgaaatttacacag

SEQ ID NO: 4522501 - DNA, 17 bp, Homo sapiens
gccttgcagcggctcct

SEQ ID NO: 4522502 - DNA, 13 bp, Homo sapiens
gccttgcccagct

SEQ ID NO: 4522503 - DNA, 15 bp, Homo sapiens
gccttgccctcctgg

SEQ ID NO: 4522504 - DNA, 17 bp, Homo sapiens
gccttgccctcctgggc

SEQ ID NO: 4522505 - DNA, 19 bp, Homo sapiens
gccttgcggtatccgcccc

SEQ ID NO: 4522506 - DNA, 14 bp, Homo sapiens
gccttgctctcttc

SEQ ID NO: 4522507 - DNA, 22 bp, Homo sapiens
gccttgctctcttcaataaacc

SEQ ID NO: 4522508 - DNA, 23 bp, Homo sapiens
gccttggataatgctgttgcctc

SEQ ID NO: 4522509 - DNA, 14 bp, Homo sapiens
gccttgggctgctc

SEQ ID NO: 4522510 - DNA, 16 bp, Homo sapiens
gccttgggctgctcct

SEQ ID NO: 4522511 - DNA, 15 bp, Homo sapiens
gccttgggtgttcca

SEQ ID NO: 4522512 - DNA, 17 bp, Homo sapiens
gccttggtgtccacctg

SEQ ID NO: 4522513 - DNA, 16 bp, Homo sapiens
gccttgttgtattcct

SEQ ID NO: 4522514 - DNA, 18 bp, Homo sapiens
gccttgttgtattcctgc

SEQ ID NO: 4522515 - DNA, 19 bp, Homo sapiens
gcctttaaatctgtgatga

SEQ ID NO: 4522516 - DNA, 14 bp, Homo sapiens
gcctttaagaacct

SEQ ID NO: 4522517 - DNA, 20 bp, Homo sapiens
gcctttaagaaccttaatga

SEQ ID NO: 4522518 - DNA, 22 bp, Homo sapiens
gcctttaatattttgtaatatt

SEQ ID NO: 4522519 - DNA, 15 bp, Homo sapiens
gcctttatacaattg

SEQ ID NO: 4522520 - DNA, 15 bp, Homo sapiens
gcctttcaaatttag

SEQ ID NO: 4522521 - DNA, 16 bp, Homo sapiens
gcctttcctgttcagc

SEQ ID NO: 4522522 - DNA, 18 bp, Homo sapiens
gcctttcctgttcagcat

SEQ ID NO: 4522523 - DNA, 19 bp, Homo sapiens
gcctttccttccctctctg

SEQ ID NO: 4522524 - DNA, 20 bp, Homo sapiens
gcctttccttccctctctga

SEQ ID NO: 4522525 - DNA, 14 bp, Homo sapiens
gcctttcgtgatct

SEQ ID NO: 4522526 - DNA, 22 bp, Homo sapiens
gcctttcgtgatcttattgctt

SEQ ID NO: 4522527 - DNA, 15 bp, Homo sapiens
gcctttctttgcctc

SEQ ID NO: 4522528 - DNA, 17 bp, Homo sapiens
gcctttctttgcctctg

SEQ ID NO: 4522529 - DNA, 20 bp, Homo sapiens
gcctttgaatgttaattttt

SEQ ID NO: 4522530 - DNA, 19 bp, Homo sapiens
gcctttgcaagatgcttgg

SEQ ID NO: 4522531 - DNA, 22 bp, Homo sapiens
gcctttgcagttggactctcag

SEQ ID NO: 4522532 - DNA, 21 bp, Homo sapiens
gcctttgccagcagagccagg

SEQ ID NO: 4522533 - DNA, 14 bp, Homo sapiens
gcctttggacccag

SEQ ID NO: 4522534 - DNA, 17 bp, Homo sapiens
gcctttggacccagggc

SEQ ID NO: 4522535 - DNA, 23 bp, Homo sapiens
gcctttggacccagggcctgact

SEQ ID NO: 4522536 - DNA, 18 bp, Homo sapiens
gcctttggacttgtcccg

SEQ ID NO: 4522537 - DNA, 22 bp, Homo sapiens
gcctttggcctggggtgcatct

SEQ ID NO: 4522538 - DNA, 11 bp, Homo sapiens
gcctttgtaac

SEQ ID NO: 4522539 - DNA, 16 bp, Homo sapiens
gcctttgtgatcctga

SEQ ID NO: 4522540 - DNA, 23 bp, Homo sapiens
gccttttagttttggttcctcca

SEQ ID NO: 4522541 - DNA, 13 bp, Homo sapiens
gccttttgctctc

SEQ ID NO: 4522542 - DNA, 20 bp, Homo sapiens
gccttttgctctctgtgacc

SEQ ID NO: 4522543 - DNA, 21 bp, Homo sapiens
gccttttgttaatgcattgtt

SEQ ID NO: 4522544 - DNA, 18 bp, Homo sapiens
gcctttttcatttatcta

SEQ ID NO: 4522545 - DNA, 19 bp, Homo sapiens
gcctttttcatttatctat

SEQ ID NO: 4522546 - DNA, 17 bp, Homo sapiens
gcctttttgtttcaatg

SEQ ID NO: 4522547 - DNA, 19 bp, Homo sapiens
gcgaagaccctcttgccca

SEQ ID NO: 4522548 - DNA, 12 bp, Homo sapiens
gcgaataaatgt

SEQ ID NO: 4522549 - DNA, 15 bp, Homo sapiens
gcgaataaatgttca

SEQ ID NO: 4522550 - DNA, 17 bp, Homo sapiens
gcgaataaatgttcaaa

SEQ ID NO: 4522551 - DNA, 15 bp, Homo sapiens
gcgaccacccctgcc

SEQ ID NO: 4522552 - DNA, 19 bp, Homo sapiens
gcgaccacccctgcctcca

SEQ ID NO: 4522553 - DNA, 10 bp, Homo sapiens
gcgacctcct

SEQ ID NO: 4522554 - DNA, 23 bp, Homo sapiens
gcgactaatttcaaaatgctttt

SEQ ID NO: 4522555 - DNA, 16 bp, Homo sapiens
gcgagaccctgtctca

SEQ ID NO: 4522556 - DNA, 14 bp, Homo sapiens
gcgagactccatct

SEQ ID NO: 4522557 - DNA, 15 bp, Homo sapiens
gcgagactccatctc

SEQ ID NO: 4522558 - DNA, 13 bp, Homo sapiens
gcgagctgcagga

SEQ ID NO: 4522559 - DNA, 16 bp, Homo sapiens
gcgaggaggctccaga

SEQ ID NO: 4522560 - DNA, 18 bp, Homo sapiens
gcgaggaggctccagagg

SEQ ID NO: 4522561 - DNA, 16 bp, Homo sapiens
gcgaggtcaacagaga

SEQ ID NO: 4522562 - DNA, 14 bp, Homo sapiens
gcgagtctggggac

SEQ ID NO: 4522563 - DNA, 17 bp, Homo sapiens
gcgattctcctgcctca

SEQ ID NO: 4522564 - DNA, 15 bp, Homo sapiens
gcgattttgtctacc

SEQ ID NO: 4522565 - DNA, 21 bp, Homo sapiens
gcgcaagcctgtaatcccagc

SEQ ID NO: 4522566 - DNA, 22 bp, Homo sapiens
gcgcaagcctgtaatcccagct

SEQ ID NO: 4522567 - DNA, 23 bp, Homo sapiens
gcgcaagcctgtaatcccagcta

SEQ ID NO: 4522568 - DNA, 14 bp, Homo sapiens
gcgcaccccacagc

SEQ ID NO: 4522569 - DNA, 17 bp, Homo sapiens
gcgcaccccacagctgg

SEQ ID NO: 4522570 - DNA, 18 bp, Homo sapiens
gcgcaccccacagctggg

SEQ ID NO: 4522571 - DNA, 17 bp, Homo sapiens
gcgcagcctccagggcc

SEQ ID NO: 4522572 - DNA, 18 bp, Homo sapiens
gcgcaggtgggctggact

SEQ ID NO: 4522573 - DNA, 22 bp, Homo sapiens
gcgcatcctgcagggcttctcc

SEQ ID NO: 4522574 - DNA, 18 bp, Homo sapiens
gcgccaaataatgtctct

SEQ ID NO: 4522575 - DNA, 17 bp, Homo sapiens
gcgccaagtctggcacc

SEQ ID NO: 4522576 - DNA, 21 bp, Homo sapiens
gcgccacacactgcacatctt

SEQ ID NO: 4522577 - DNA, 14 bp, Homo sapiens
gcgccaccgtgcct

SEQ ID NO: 4522578 - DNA, 14 bp, Homo sapiens
gcgccaggaagcca

SEQ ID NO: 4522579 - DNA, 17 bp, Homo sapiens
gcgccaggaagccagag

SEQ ID NO: 4522580 - DNA, 19 bp, Homo sapiens
gcgccaggaagccagagcc

SEQ ID NO: 4522581 - DNA, 20 bp, Homo sapiens
gcgccaggaagccagagccc

SEQ ID NO: 4522582 - DNA, 16 bp, Homo sapiens
gcgcccaccccgctct

SEQ ID NO: 4522583 - DNA, 16 bp, Homo sapiens
gcgcccccgagccctg

SEQ ID NO: 4522584 - DNA, 13 bp, Homo sapiens
gcgcccgaggcag

SEQ ID NO: 4522585 - DNA, 14 bp, Homo sapiens
gcgcccgaggcaga

SEQ ID NO: 4522586 - DNA, 14 bp, Homo sapiens
gcgccgatgccacc

SEQ ID NO: 4522587 - DNA, 11 bp, Homo sapiens
gcgcctcagcc

SEQ ID NO: 4522588 - DNA, 16 bp, Homo sapiens
gcgcctcagccctcag

SEQ ID NO: 4522589 - DNA, 19 bp, Homo sapiens
gcgcctccctccaccccag

SEQ ID NO: 4522590 - DNA, 21 bp, Homo sapiens
gcgcctccctccaccccagga

SEQ ID NO: 4522591 - DNA, 14 bp, Homo sapiens
gcgcctgcaggcag

SEQ ID NO: 4522592 - DNA, 15 bp, Homo sapiens
gcgcctgcaggcaga

SEQ ID NO: 4522593 - DNA, 21 bp, Homo sapiens
gcgcctgcaggcagagctgga

SEQ ID NO: 4522594 - DNA, 12 bp, Homo sapiens
gcgcctgctgcc

SEQ ID NO: 4522595 - DNA, 14 bp, Homo sapiens
gcgcctgctgcctg

SEQ ID NO: 4522596 - DNA, 19 bp, Homo sapiens
gcgccttcgtgcctgagac

SEQ ID NO: 4522597 - DNA, 15 bp, Homo sapiens
gcgcggccagccccg

SEQ ID NO: 4522598 - DNA, 16 bp, Homo sapiens
gcgcggccagccccgg

SEQ ID NO: 4522599 - DNA, 18 bp, Homo sapiens
gcgcggctgggaggaggg

SEQ ID NO: 4522600 - DNA, 16 bp, Homo sapiens
gcgcgggcagccaccc

SEQ ID NO: 4522601 - DNA, 15 bp, Homo sapiens
gcgcggtggctcacg

SEQ ID NO: 4522602 - DNA, 13 bp, Homo sapiens
gcgcgttgtgtat

SEQ ID NO: 4522603 - DNA, 18 bp, Homo sapiens
gcgcgttgtgtatattac

SEQ ID NO: 4522604 - DNA, 15 bp, Homo sapiens
gcgctaacccccagc

SEQ ID NO: 4522605 - DNA, 19 bp, Homo sapiens
gcgctaacccccagcccac

SEQ ID NO: 4522606 - DNA, 15 bp, Homo sapiens
gcgctcagcagccct

SEQ ID NO: 4522607 - DNA, 13 bp, Homo sapiens
gcgctcaggggct

SEQ ID NO: 4522608 - DNA, 17 bp, Homo sapiens
gcgctcaggggctccat

SEQ ID NO: 4522609 - DNA, 18 bp, Homo sapiens
gcgctcaggggctccatg

SEQ ID NO: 4522610 - DNA, 19 bp, Homo sapiens
gcgctcctgccgcagagct

SEQ ID NO: 4522611 - DNA, 21 bp, Homo sapiens
gcgcttgaccatgttgcactg

SEQ ID NO: 4522612 - DNA, 16 bp, Homo sapiens
gcggacgttccagccg

SEQ ID NO: 4522613 - DNA, 15 bp, Homo sapiens
gcggcagccccactt

SEQ ID NO: 4522614 - DNA, 14 bp, Homo sapiens
gcggcatagcaccc

SEQ ID NO: 4522615 - DNA, 11 bp, Homo sapiens
gcggccagccc

SEQ ID NO: 4522616 - DNA, 17 bp, Homo sapiens
gcggccagccccggccc

SEQ ID NO: 4522617 - DNA, 18 bp, Homo sapiens
gcggccagccccggccct

SEQ ID NO: 4522618 - DNA, 13 bp, Homo sapiens
gcggcccagcccg

SEQ ID NO: 4522619 - DNA, 13 bp, Homo sapiens
gcggccctggagg

SEQ ID NO: 4522620 - DNA, 15 bp, Homo sapiens
gcggccctggaggat

SEQ ID NO: 4522621 - DNA, 20 bp, Homo sapiens
gcggctcccctctgcttctc

SEQ ID NO: 4522622 - DNA, 23 bp, Homo sapiens
gcggctgagtcatgatctccctg

SEQ ID NO: 4522623 - DNA, 22 bp, Homo sapiens
gcggctgggaggagggcaggca

SEQ ID NO: 4522624 - DNA, 16 bp, Homo sapiens
gcgggacagtgctgca

SEQ ID NO: 4522625 - DNA, 14 bp, Homo sapiens
gcgggagacagctt

SEQ ID NO: 4522626 - DNA, 21 bp, Homo sapiens
gcgggagacagcttctctgca

SEQ ID NO: 4522627 - DNA, 13 bp, Homo sapiens
gcgggagccagac

SEQ ID NO: 4522628 - DNA, 21 bp, Homo sapiens
gcgggagccagactgtccagg

SEQ ID NO: 4522629 - DNA, 22 bp, Homo sapiens
gcgggaggcagcgccccaccac

SEQ ID NO: 4522630 - DNA, 13 bp, Homo sapiens
gcgggaggctggg

SEQ ID NO: 4522631 - DNA, 16 bp, Homo sapiens
gcgggaggctggggcc

SEQ ID NO: 4522632 - DNA, 21 bp, Homo sapiens
gcgggatcctccacagagagg

SEQ ID NO: 4522633 - DNA, 15 bp, Homo sapiens
gcgggcagagggctg

SEQ ID NO: 4522634 - DNA, 16 bp, Homo sapiens
gcgggcagagggctgg

SEQ ID NO: 4522635 - DNA, 12 bp, Homo sapiens
gcgggccaggag

SEQ ID NO: 4522636 - DNA, 17 bp, Homo sapiens
gcgggccaggaggctgc

SEQ ID NO: 4522637 - DNA, 15 bp, Homo sapiens
gcgggcccctggtga

SEQ ID NO: 4522638 - DNA, 11 bp, Homo sapiens
gcgggctcaga

SEQ ID NO: 4522639 - DNA, 15 bp, Homo sapiens
gcgggctcggaggct

SEQ ID NO: 4522640 - DNA, 12 bp, Homo sapiens
gcgggctgagga

SEQ ID NO: 4522641 - DNA, 17 bp, Homo sapiens
gcgggctgaggccagag

SEQ ID NO: 4522642 - DNA, 19 bp, Homo sapiens
gcggggcccaggcagcctc

SEQ ID NO: 4522643 - DNA, 21 bp, Homo sapiens
gcggggggtgtcttccctgcc

SEQ ID NO: 4522644 - DNA, 13 bp, Homo sapiens
gcggggtgcagaa

SEQ ID NO: 4522645 - DNA, 18 bp, Homo sapiens
gcggtccctgtccctcta

SEQ ID NO: 4522646 - DNA, 21 bp, Homo sapiens
gcggtccctgtccctctagtg

SEQ ID NO: 4522647 - DNA, 15 bp, Homo sapiens
gcggtggctcacgcc

SEQ ID NO: 4522648 - DNA, 18 bp, Homo sapiens
gcggtggctcacgcctgt

SEQ ID NO: 4522649 - DNA, 21 bp, Homo sapiens
gcggtggctgccccggcctcc

SEQ ID NO: 4522650 - DNA, 16 bp, Homo sapiens
gcgtagcagagttaaa

SEQ ID NO: 4522651 - DNA, 12 bp, Homo sapiens
gcgtcagcctcc

SEQ ID NO: 4522652 - DNA, 18 bp, Homo sapiens
gcgtcagcctccagcctc

SEQ ID NO: 4522653 - DNA, 20 bp, Homo sapiens
gcgtcagcctccagcctctg

SEQ ID NO: 4522654 - DNA, 19 bp, Homo sapiens
gcgtccaccctgagctcgg

SEQ ID NO: 4522655 - DNA, 20 bp, Homo sapiens
gcgtccaccctgagctcggg

SEQ ID NO: 4522656 - DNA, 12 bp, Homo sapiens
gcgtcccagcct

SEQ ID NO: 4522657 - DNA, 12 bp, Homo sapiens
gcgtcccagctc

SEQ ID NO: 4522658 - DNA, 13 bp, Homo sapiens
gcgtcccagctcc

SEQ ID NO: 4522659 - DNA, 18 bp, Homo sapiens
gcgtcccagctcccctct

SEQ ID NO: 4522660 - DNA, 20 bp, Homo sapiens
gcgtcccctgctactcctgt

SEQ ID NO: 4522661 - DNA, 13 bp, Homo sapiens
gcgtccttggctg

SEQ ID NO: 4522662 - DNA, 13 bp, Homo sapiens
gcgtgactcaccc

SEQ ID NO: 4522663 - DNA, 14 bp, Homo sapiens
gcgtgagccactgc

SEQ ID NO: 4522664 - DNA, 16 bp, Homo sapiens
gcgtgcccccctcctc

SEQ ID NO: 4522665 - DNA, 17 bp, Homo sapiens
gcgtgcccccctcctcc

SEQ ID NO: 4522666 - DNA, 22 bp, Homo sapiens
gcgtgcccccctcctccagtac

SEQ ID NO: 4522667 - DNA, 14 bp, Homo sapiens
gcgttcctggcctt

SEQ ID NO: 4522668 - DNA, 13 bp, Homo sapiens
gcgttcctttctt

SEQ ID NO: 4522669 - DNA, 15 bp, Homo sapiens
gcgttcctttctttt

SEQ ID NO: 4522670 - DNA, 18 bp, Homo sapiens
gcgttctggactctgccc

SEQ ID NO: 4522671 - DNA, 19 bp, Homo sapiens
gcgttgttgcatgtttgaa

SEQ ID NO: 4522672 - DNA, 14 bp, Homo sapiens
gctaaaaagcaaca

SEQ ID NO: 4522673 - DNA, 12 bp, Homo sapiens
gctaaaaatatt

SEQ ID NO: 4522674 - DNA, 14 bp, Homo sapiens
gctaaaacctgagc

SEQ ID NO: 4522675 - DNA, 16 bp, Homo sapiens
gctaaaacctgagcta

SEQ ID NO: 4522676 - DNA, 15 bp, Homo sapiens
gctaaaagaaacttt

SEQ ID NO: 4522677 - DNA, 15 bp, Homo sapiens
gctaaaagacatgca

SEQ ID NO: 4522678 - DNA, 19 bp, Homo sapiens
gctaaagcaatatgcattt

SEQ ID NO: 4522679 - DNA, 12 bp, Homo sapiens
gctaaaggaggc

SEQ ID NO: 4522680 - DNA, 16 bp, Homo sapiens
gctaaaggaggccata

SEQ ID NO: 4522681 - DNA, 19 bp, Homo sapiens
gctaaataaaatttgttgc

SEQ ID NO: 4522682 - DNA, 20 bp, Homo sapiens
gctaaataaaatttgttgca

SEQ ID NO: 4522683 - DNA, 21 bp, Homo sapiens
gctaaataaaatttgttgcat

SEQ ID NO: 4522684 - DNA, 15 bp, Homo sapiens
gctaaatgtttaaag

SEQ ID NO: 4522685 - DNA, 16 bp, Homo sapiens
gctaaatgtttaaaga

SEQ ID NO: 4522686 - DNA, 17 bp, Homo sapiens
gctaacagttgccacat

SEQ ID NO: 4522687 - DNA, 19 bp, Homo sapiens
gctaacccccagcccacag

SEQ ID NO: 4522688 - DNA, 22 bp, Homo sapiens
gctaacccccagcccacagagc

SEQ ID NO: 4522689 - DNA, 22 bp, Homo sapiens
gctaacctccaacacagtgcat

SEQ ID NO: 4522690 - DNA, 12 bp, Homo sapiens
gctaactggaag

SEQ ID NO: 4522691 - DNA, 13 bp, Homo sapiens
gctaactggaagc

SEQ ID NO: 4522692 - DNA, 13 bp, Homo sapiens
gctaagagaagta

SEQ ID NO: 4522693 - DNA, 18 bp, Homo sapiens
gctaagattatctgggga

SEQ ID NO: 4522694 - DNA, 17 bp, Homo sapiens
gctaagattccttttgt

SEQ ID NO: 4522695 - DNA, 19 bp, Homo sapiens
gctaagcaagctaacctta

SEQ ID NO: 4522696 - DNA, 15 bp, Homo sapiens
gctaaggcaggagga

SEQ ID NO: 4522697 - DNA, 18 bp, Homo sapiens
gctaaggcaggaggatca

SEQ ID NO: 4522698 - DNA, 23 bp, Homo sapiens
gctaagggcttgtttttcttcag

SEQ ID NO: 4522699 - DNA, 20 bp, Homo sapiens
gctaagtacacaataagcaa

SEQ ID NO: 4522700 - DNA, 21 bp, Homo sapiens
gctaagtacacaataagcaaa

SEQ ID NO: 4522701 - DNA, 22 bp, Homo sapiens
gctaagtacacaataagcaaaa

SEQ ID NO: 4522702 - DNA, 13 bp, Homo sapiens
gctaataaaaatt

SEQ ID NO: 4522703 - DNA, 22 bp, Homo sapiens
gctaatctgaccgttctattgt

SEQ ID NO: 4522704 - DNA, 15 bp, Homo sapiens
gctaattctgggaag

SEQ ID NO: 4522705 - DNA, 22 bp, Homo sapiens
gctaattctttgacctgttggg

SEQ ID NO: 4522706 - DNA, 13 bp, Homo sapiens
gctaatttgcatt

SEQ ID NO: 4522707 - DNA, 20 bp, Homo sapiens
gctaatttgttttggatata

SEQ ID NO: 4522708 - DNA, 18 bp, Homo sapiens
gctaatttttattaattt

SEQ ID NO: 4522709 - DNA, 21 bp, Homo sapiens
gctaatttttttgtattttag

SEQ ID NO: 4522710 - DNA, 18 bp, Homo sapiens
gctacaaaaacacagcaa

SEQ ID NO: 4522711 - DNA, 17 bp, Homo sapiens
gctacaatcttggagct

SEQ ID NO: 4522712 - DNA, 14 bp, Homo sapiens
gctacaatttgttt

SEQ ID NO: 4522713 - DNA, 18 bp, Homo sapiens
gctacaatttgtttttgc

SEQ ID NO: 4522714 - DNA, 12 bp, Homo sapiens
gctacactgagc

SEQ ID NO: 4522715 - DNA, 15 bp, Homo sapiens
gctacagctccacac

SEQ ID NO: 4522716 - DNA, 14 bp, Homo sapiens
gctacatcagactc

SEQ ID NO: 4522717 - DNA, 13 bp, Homo sapiens
gctaccagtattt

SEQ ID NO: 4522718 - DNA, 19 bp, Homo sapiens
gctaccccattctctagac

SEQ ID NO: 4522719 - DNA, 19 bp, Homo sapiens
gctacccgctgtggccggt

SEQ ID NO: 4522720 - DNA, 14 bp, Homo sapiens
gctaccctgagctg

SEQ ID NO: 4522721 - DNA, 16 bp, Homo sapiens
gctaccctgagctgag

SEQ ID NO: 4522722 - DNA, 15 bp, Homo sapiens
gctacctctgagaag

SEQ ID NO: 4522723 - DNA, 13 bp, Homo sapiens
gctacctttttat

SEQ ID NO: 4522724 - DNA, 16 bp, Homo sapiens
gctactcaggaggctg

SEQ ID NO: 4522725 - DNA, 20 bp, Homo sapiens
gctactcaggaggctgagac

SEQ ID NO: 4522726 - DNA, 14 bp, Homo sapiens
gctactcctgtgct

SEQ ID NO: 4522727 - DNA, 11 bp, Homo sapiens
gctactgccat

SEQ ID NO: 4522728 - DNA, 13 bp, Homo sapiens
gctactgccatcc

SEQ ID NO: 4522729 - DNA, 18 bp, Homo sapiens
gctactgccatcctggcc

SEQ ID NO: 4522730 - DNA, 20 bp, Homo sapiens
gctactggggaggctgaggc

SEQ ID NO: 4522731 - DNA, 23 bp, Homo sapiens
gctactttgctgctatggttttc

SEQ ID NO: 4522732 - DNA, 20 bp, Homo sapiens
gctagaaaaaaaaaacactt

SEQ ID NO: 4522733 - DNA, 11 bp, Homo sapiens
gctagaaatga

SEQ ID NO: 4522734 - DNA, 20 bp, Homo sapiens
gctagaaccaagaagggcta

SEQ ID NO: 4522735 - DNA, 19 bp, Homo sapiens
gctagaacctagaagggct

SEQ ID NO: 4522736 - DNA, 20 bp, Homo sapiens
gctagaacctagaagggcta

SEQ ID NO: 4522737 - DNA, 20 bp, Homo sapiens
gctagaacctggaagggcta

SEQ ID NO: 4522738 - DNA, 14 bp, Homo sapiens
gctagaagctggag

SEQ ID NO: 4522739 - DNA, 15 bp, Homo sapiens
gctagaagctggagg

SEQ ID NO: 4522740 - DNA, 20 bp, Homo sapiens
gctagaagtgggccaggaca

SEQ ID NO: 4522741 - DNA, 21 bp, Homo sapiens
gctagaagtgggccaggacag

SEQ ID NO: 4522742 - DNA, 19 bp, Homo sapiens
gctagaatctggagagcta

SEQ ID NO: 4522743 - DNA, 16 bp, Homo sapiens
gctagacacatgaagg

SEQ ID NO: 4522744 - DNA, 12 bp, Homo sapiens
gctagagaaatc

SEQ ID NO: 4522745 - DNA, 21 bp, Homo sapiens
gctagagaaatcagctgctat

SEQ ID NO: 4522746 - DNA, 17 bp, Homo sapiens
gctagagaaggaccaga

SEQ ID NO: 4522747 - DNA, 21 bp, Homo sapiens
gctagagacagatgctggtgg

SEQ ID NO: 4522748 - DNA, 20 bp, Homo sapiens
gctagagatatggcagcgaa

SEQ ID NO: 4522749 - DNA, 20 bp, Homo sapiens
gctagaggccagccccaccc

SEQ ID NO: 4522750 - DNA, 21 bp, Homo sapiens
gctagaggccagccccaccca

SEQ ID NO: 4522751 - DNA, 14 bp, Homo sapiens
gctagcacagaggc

SEQ ID NO: 4522752 - DNA, 15 bp, Homo sapiens
gctagcacagaggcc

SEQ ID NO: 4522753 - DNA, 19 bp, Homo sapiens
gctagcacagaggcctgac

SEQ ID NO: 4522754 - DNA, 13 bp, Homo sapiens
gctagccagaggg

SEQ ID NO: 4522755 - DNA, 19 bp, Homo sapiens
gctagctattgcaaatgag

SEQ ID NO: 4522756 - DNA, 20 bp, Homo sapiens
gctaggaagagcaggactcc

SEQ ID NO: 4522757 - DNA, 14 bp, Homo sapiens
gctaggatggttct

SEQ ID NO: 4522758 - DNA, 14 bp, Homo sapiens
gctagggtggccct

SEQ ID NO: 4522759 - DNA, 15 bp, Homo sapiens
gctagggtggccctt

SEQ ID NO: 4522760 - DNA, 17 bp, Homo sapiens
gctagggtggggagaga

SEQ ID NO: 4522761 - DNA, 13 bp, Homo sapiens
gctagtgccttta

SEQ ID NO: 4522762 - DNA, 19 bp, Homo sapiens
gctagtgggccctctctct

SEQ ID NO: 4522763 - DNA, 23 bp, Homo sapiens
gctagtgggccctctctctgggc

SEQ ID NO: 4522764 - DNA, 19 bp, Homo sapiens
gctagttggggagctaagg

SEQ ID NO: 4522765 - DNA, 21 bp, Homo sapiens
gctataaagcagtatttttct

SEQ ID NO: 4522766 - DNA, 12 bp, Homo sapiens
gctataagtgct

SEQ ID NO: 4522767 - DNA, 21 bp, Homo sapiens
gctatactgcatactttttaa

SEQ ID NO: 4522768 - DNA, 19 bp, Homo sapiens
gctataggtgctacaaaaa

SEQ ID NO: 4522769 - DNA, 23 bp, Homo sapiens
gctatagttactgtcctgttgat

SEQ ID NO: 4522770 - DNA, 14 bp, Homo sapiens
gctatatataaaac

SEQ ID NO: 4522771 - DNA, 21 bp, Homo sapiens
gctatccacagaacctttgtc

SEQ ID NO: 4522772 - DNA, 15 bp, Homo sapiens
gctatcctgctgaaa

SEQ ID NO: 4522773 - DNA, 23 bp, Homo sapiens
gctatccttggctttcagagcca

SEQ ID NO: 4522774 - DNA, 15 bp, Homo sapiens
gctatcctttcaaac

SEQ ID NO: 4522775 - DNA, 17 bp, Homo sapiens
gctatgagctggggatg

SEQ ID NO: 4522776 - DNA, 17 bp, Homo sapiens
gctatgcatattcaatg

SEQ ID NO: 4522777 - DNA, 19 bp, Homo sapiens
gctatgggagccccagggt

SEQ ID NO: 4522778 - DNA, 19 bp, Homo sapiens
gctatggggatagatgtgt

SEQ ID NO: 4522779 - DNA, 20 bp, Homo sapiens
gctatggggtaggagaaaag

SEQ ID NO: 4522780 - DNA, 14 bp, Homo sapiens
gctatgtgacttgc

SEQ ID NO: 4522781 - DNA, 16 bp, Homo sapiens
gctatgtttttaatgt

SEQ ID NO: 4522782 - DNA, 19 bp, Homo sapiens
gctattaacaattaattgt

SEQ ID NO: 4522783 - DNA, 23 bp, Homo sapiens
gctattaagaatttaagacttgt

SEQ ID NO: 4522784 - DNA, 14 bp, Homo sapiens
gctattgacaataa

SEQ ID NO: 4522785 - DNA, 16 bp, Homo sapiens
gctattgcaaatgagg

SEQ ID NO: 4522786 - DNA, 14 bp, Homo sapiens
gctatttgtcatct

SEQ ID NO: 4522787 - DNA, 15 bp, Homo sapiens
gctattttagaaagc

SEQ ID NO: 4522788 - DNA, 19 bp, Homo sapiens
gctattttagaaagctaaa

SEQ ID NO: 4522789 - DNA, 23 bp, Homo sapiens
gctattttcctctggccgcagag

SEQ ID NO: 4522790 - DNA, 15 bp, Homo sapiens
gctcaaaatctttcc

SEQ ID NO: 4522791 - DNA, 18 bp, Homo sapiens
gctcaaatgatcctccca

SEQ ID NO: 4522792 - DNA, 19 bp, Homo sapiens
gctcaacagacaattagaa

SEQ ID NO: 4522793 - DNA, 15 bp, Homo sapiens
gctcaacccccctcc

SEQ ID NO: 4522794 - DNA, 21 bp, Homo sapiens
gctcaacccccctcccagaca

SEQ ID NO: 4522795 - DNA, 19 bp, Homo sapiens
gctcaactctacccctgct

SEQ ID NO: 4522796 - DNA, 20 bp, Homo sapiens
gctcaactctacccctgctc

SEQ ID NO: 4522797 - DNA, 14 bp, Homo sapiens
gctcaactttctgt

SEQ ID NO: 4522798 - DNA, 19 bp, Homo sapiens
gctcaagcaatcctcctgc

SEQ ID NO: 4522799 - DNA, 20 bp, Homo sapiens
gctcaagcaatcctcctgcc

SEQ ID NO: 4522800 - DNA, 16 bp, Homo sapiens
gctcaatagcttgaag

SEQ ID NO: 4522801 - DNA, 16 bp, Homo sapiens
gctcaatccctgagga

SEQ ID NO: 4522802 - DNA, 14 bp, Homo sapiens
gctcaatttcagca

SEQ ID NO: 4522803 - DNA, 14 bp, Homo sapiens
gctcacactgagaa

SEQ ID NO: 4522804 - DNA, 22 bp, Homo sapiens
gctcacactgagaatgtaagaa

SEQ ID NO: 4522805 - DNA, 16 bp, Homo sapiens
gctcaccccccacact

SEQ ID NO: 4522806 - DNA, 19 bp, Homo sapiens
gctcaccccccacactcac

SEQ ID NO: 4522807 - DNA, 20 bp, Homo sapiens
gctcaccccccacactcact

SEQ ID NO: 4522808 - DNA, 13 bp, Homo sapiens
gctcaccctctct

SEQ ID NO: 4522809 - DNA, 17 bp, Homo sapiens
gctcaccctctcttggt

SEQ ID NO: 4522810 - DNA, 15 bp, Homo sapiens
gctcaccgcccatca

SEQ ID NO: 4522811 - DNA, 16 bp, Homo sapiens
gctcaccgcccatcag

SEQ ID NO: 4522812 - DNA, 17 bp, Homo sapiens
gctcaccgcccatcagg

SEQ ID NO: 4522813 - DNA, 16 bp, Homo sapiens
gctcaccgctggccct

SEQ ID NO: 4522814 - DNA, 12 bp, Homo sapiens
gctcactgcagc

SEQ ID NO: 4522815 - DNA, 17 bp, Homo sapiens
gctcactgcagcctcat

SEQ ID NO: 4522816 - DNA, 14 bp, Homo sapiens
gctcactgccaggc

SEQ ID NO: 4522817 - DNA, 15 bp, Homo sapiens
gctcactgccaggcc

SEQ ID NO: 4522818 - DNA, 23 bp, Homo sapiens
gctcactgccaggccagcctccg

SEQ ID NO: 4522819 - DNA, 19 bp, Homo sapiens
gctcactgtgtataggaat

SEQ ID NO: 4522820 - DNA, 19 bp, Homo sapiens
gctcagacccccactctca

SEQ ID NO: 4522821 - DNA, 16 bp, Homo sapiens
gctcagacccctcagc

SEQ ID NO: 4522822 - DNA, 18 bp, Homo sapiens
gctcagacccctcagccc

SEQ ID NO: 4522823 - DNA, 22 bp, Homo sapiens
gctcagacccctcagccccagc

SEQ ID NO: 4522824 - DNA, 23 bp, Homo sapiens
gctcagacccctcagccccagcc

SEQ ID NO: 4522825 - DNA, 22 bp, Homo sapiens
gctcagactgggcactggggcc

SEQ ID NO: 4522826 - DNA, 11 bp, Homo sapiens
gctcagagctt

SEQ ID NO: 4522827 - DNA, 17 bp, Homo sapiens
gctcagagctttgtcac

SEQ ID NO: 4522828 - DNA, 13 bp, Homo sapiens
gctcagcagccct

SEQ ID NO: 4522829 - DNA, 17 bp, Homo sapiens
gctcagccaaatttcct

SEQ ID NO: 4522830 - DNA, 16 bp, Homo sapiens
gctcagccccaggcca

SEQ ID NO: 4522831 - DNA, 19 bp, Homo sapiens
gctcaggaaccgaggcagg

SEQ ID NO: 4522832 - DNA, 17 bp, Homo sapiens
gctcaggaattccctgg

SEQ ID NO: 4522833 - DNA, 18 bp, Homo sapiens
gctcaggaattccctgga

SEQ ID NO: 4522834 - DNA, 13 bp, Homo sapiens
gctcaggaggcga

SEQ ID NO: 4522835 - DNA, 20 bp, Homo sapiens
gctcaggaggcgaataaatg

SEQ ID NO: 4522836 - DNA, 21 bp, Homo sapiens
gctcaggaggcgaataaatgt

SEQ ID NO: 4522837 - DNA, 22 bp, Homo sapiens
gctcaggaggcgaataaatgtt

SEQ ID NO: 4522838 - DNA, 23 bp, Homo sapiens
gctcaggaggcgaataaatgttc

SEQ ID NO: 4522839 - DNA, 22 bp, Homo sapiens
gctcaggatatggcttaggaat

SEQ ID NO: 4522840 - DNA, 21 bp, Homo sapiens
gctcagggcctcaggcacccg

SEQ ID NO: 4522841 - DNA, 23 bp, Homo sapiens
gctcaggggctccatgctgggtc

SEQ ID NO: 4522842 - DNA, 16 bp, Homo sapiens
gctcagtaacataact

SEQ ID NO: 4522843 - DNA, 14 bp, Homo sapiens
gctcagtctgttca

SEQ ID NO: 4522844 - DNA, 15 bp, Homo sapiens
gctcagtgccaccta

SEQ ID NO: 4522845 - DNA, 18 bp, Homo sapiens
gctcagtgcttgggctcc

SEQ ID NO: 4522846 - DNA, 18 bp, Homo sapiens
gctcatcattctctgtct

SEQ ID NO: 4522847 - DNA, 19 bp, Homo sapiens
gctcatcattctctgtctc

SEQ ID NO: 4522848 - DNA, 20 bp, Homo sapiens
gctcatcctgtagggcaccc

SEQ ID NO: 4522849 - DNA, 19 bp, Homo sapiens
gctcatgcacccctgagcc

SEQ ID NO: 4522850 - DNA, 15 bp, Homo sapiens
gctcatgtatattta

SEQ ID NO: 4522851 - DNA, 15 bp, Homo sapiens
gctcatttaaaacag

SEQ ID NO: 4522852 - DNA, 16 bp, Homo sapiens
gctcatttcagtttct

SEQ ID NO: 4522853 - DNA, 22 bp, Homo sapiens
gctccacccttggcctgtctca

SEQ ID NO: 4522854 - DNA, 23 bp, Homo sapiens
gctccacccttggcctgtctcat

SEQ ID NO: 4522855 - DNA, 19 bp, Homo sapiens
gctccactcttgatctctc

SEQ ID NO: 4522856 - DNA, 20 bp, Homo sapiens
gctccactcttgatctctct

SEQ ID NO: 4522857 - DNA, 21 bp, Homo sapiens
gctccagagggcactcagaag

SEQ ID NO: 4522858 - DNA, 15 bp, Homo sapiens
gctccagcaccttct

SEQ ID NO: 4522859 - DNA, 22 bp, Homo sapiens
gctccagcaccttctttctgga

SEQ ID NO: 4522860 - DNA, 15 bp, Homo sapiens
gctccagcctctgcc

SEQ ID NO: 4522861 - DNA, 18 bp, Homo sapiens
gctccagcgatggtgctg

SEQ ID NO: 4522862 - DNA, 22 bp, Homo sapiens
gctccatctccgcctccacact

SEQ ID NO: 4522863 - DNA, 19 bp, Homo sapiens
gctccatgctgggtctgag

SEQ ID NO: 4522864 - DNA, 14 bp, Homo sapiens
gctcccaatcagct

SEQ ID NO: 4522865 - DNA, 22 bp, Homo sapiens
gctcccacaccgcgtcccagct

SEQ ID NO: 4522866 - DNA, 20 bp, Homo sapiens
gctcccacataagcactagt

SEQ ID NO: 4522867 - DNA, 15 bp, Homo sapiens
gctcccagccaggcc

SEQ ID NO: 4522868 - DNA, 12 bp, Homo sapiens
gctcccagctcc

SEQ ID NO: 4522869 - DNA, 21 bp, Homo sapiens
gctcccaggggtctccctggc

SEQ ID NO: 4522870 - DNA, 22 bp, Homo sapiens
gctcccagggtccctgcccact

SEQ ID NO: 4522871 - DNA, 20 bp, Homo sapiens
gctcccaggttcccccagca

SEQ ID NO: 4522872 - DNA, 22 bp, Homo sapiens
gctcccaggttcccccagcaag

SEQ ID NO: 4522873 - DNA, 16 bp, Homo sapiens
gctcccagtcctgcct

SEQ ID NO: 4522874 - DNA, 17 bp, Homo sapiens
gctcccagtcctgcctg

SEQ ID NO: 4522875 - DNA, 17 bp, Homo sapiens
gctccccaacacctgcc

SEQ ID NO: 4522876 - DNA, 14 bp, Homo sapiens
gctcccccaccccc

SEQ ID NO: 4522877 - DNA, 19 bp, Homo sapiens
gctccccctccccaggctg

SEQ ID NO: 4522878 - DNA, 16 bp, Homo sapiens
gctcccctggctggct

SEQ ID NO: 4522879 - DNA, 17 bp, Homo sapiens
gctcccctggctggctc

SEQ ID NO: 4522880 - DNA, 19 bp, Homo sapiens
gctcccctggctggctcct

SEQ ID NO: 4522881 - DNA, 15 bp, Homo sapiens
gctcccgctcccagg

SEQ ID NO: 4522882 - DNA, 13 bp, Homo sapiens
gctcccggcccgc

SEQ ID NO: 4522883 - DNA, 18 bp, Homo sapiens
gctcccggcccgcctgcc

SEQ ID NO: 4522884 - DNA, 17 bp, Homo sapiens
gctcccggggcctggac

SEQ ID NO: 4522885 - DNA, 18 bp, Homo sapiens
gctcccggggcctggaca

SEQ ID NO: 4522886 - DNA, 19 bp, Homo sapiens
gctcccggggcctggacag

SEQ ID NO: 4522887 - DNA, 20 bp, Homo sapiens
gctcccggggcctggacagg

SEQ ID NO: 4522888 - DNA, 18 bp, Homo sapiens
gctccctaaactttggcc

SEQ ID NO: 4522889 - DNA, 20 bp, Homo sapiens
gctccctaaactttggcctt

SEQ ID NO: 4522890 - DNA, 18 bp, Homo sapiens
gctccctccccctgcccc

SEQ ID NO: 4522891 - DNA, 19 bp, Homo sapiens
gctccctcccctgccctgg

SEQ ID NO: 4522892 - DNA, 22 bp, Homo sapiens
gctccctcctccaggcctgcct

SEQ ID NO: 4522893 - DNA, 21 bp, Homo sapiens
gctccctctccaagacagcag

SEQ ID NO: 4522894 - DNA, 23 bp, Homo sapiens
gctccctctccaagacagcagca

SEQ ID NO: 4522895 - DNA, 18 bp, Homo sapiens
gctccctgactgggagtt

SEQ ID NO: 4522896 - DNA, 16 bp, Homo sapiens
gctccctgcctcctgc

SEQ ID NO: 4522897 - DNA, 19 bp, Homo sapiens
gctccctgcctcctgccta

SEQ ID NO: 4522898 - DNA, 21 bp, Homo sapiens
gctccctggggttctctacag

SEQ ID NO: 4522899 - DNA, 16 bp, Homo sapiens
gctcccttttgtcctt

SEQ ID NO: 4522900 - DNA, 19 bp, Homo sapiens
gctccgggggtacagccct

SEQ ID NO: 4522901 - DNA, 20 bp, Homo sapiens
gctccgggggtacagccctt

SEQ ID NO: 4522902 - DNA, 18 bp, Homo sapiens
gctcctagaagtcttaat

SEQ ID NO: 4522903 - DNA, 19 bp, Homo sapiens
gctcctagcaccctggaga

SEQ ID NO: 4522904 - DNA, 22 bp, Homo sapiens
gctcctaggacccgtctccagc

SEQ ID NO: 4522905 - DNA, 16 bp, Homo sapiens
gctcctcaaagcctca

SEQ ID NO: 4522906 - DNA, 15 bp, Homo sapiens
gctcctcacctgtct

SEQ ID NO: 4522907 - DNA, 16 bp, Homo sapiens
gctcctcacctgtcta

SEQ ID NO: 4522908 - DNA, 11 bp, Homo sapiens
gctcctcagag

SEQ ID NO: 4522909 - DNA, 22 bp, Homo sapiens
gctcctcagagcgccaggaagc

SEQ ID NO: 4522910 - DNA, 19 bp, Homo sapiens
gctcctcatggtgggttca

SEQ ID NO: 4522911 - DNA, 19 bp, Homo sapiens
gctcctccctccagctgcg

SEQ ID NO: 4522912 - DNA, 19 bp, Homo sapiens
gctcctccttgcccagact

SEQ ID NO: 4522913 - DNA, 15 bp, Homo sapiens
gctcctctcctggag

SEQ ID NO: 4522914 - DNA, 16 bp, Homo sapiens
gctcctctcctggagg

SEQ ID NO: 4522915 - DNA, 21 bp, Homo sapiens
gctcctgaggggcatctgccc

SEQ ID NO: 4522916 - DNA, 12 bp, Homo sapiens
gctcctgcccag

SEQ ID NO: 4522917 - DNA, 20 bp, Homo sapiens
gctcctgcccaggccacaga

SEQ ID NO: 4522918 - DNA, 21 bp, Homo sapiens
gctcctgcccaggccacagag

SEQ ID NO: 4522919 - DNA, 15 bp, Homo sapiens
gctcctgccgcagag

SEQ ID NO: 4522920 - DNA, 20 bp, Homo sapiens
gctcctgggacccttggcta

SEQ ID NO: 4522921 - DNA, 15 bp, Homo sapiens
gctcctggggagctc

SEQ ID NO: 4522922 - DNA, 16 bp, Homo sapiens
gctcctggggagctcc

SEQ ID NO: 4522923 - DNA, 19 bp, Homo sapiens
gctcctggggagctcctgg

SEQ ID NO: 4522924 - DNA, 12 bp, Homo sapiens
gctcctgtgctc

SEQ ID NO: 4522925 - DNA, 21 bp, Homo sapiens
gctccttaaggctcttttgta

SEQ ID NO: 4522926 - DNA, 21 bp, Homo sapiens
gctccttcaggcgaagggtgg

SEQ ID NO: 4522927 - DNA, 23 bp, Homo sapiens
gctccttcccaggagtggaggag

SEQ ID NO: 4522928 - DNA, 17 bp, Homo sapiens
gctccttgagaggagaa

SEQ ID NO: 4522929 - DNA, 11 bp, Homo sapiens
gctccttgggc

SEQ ID NO: 4522930 - DNA, 17 bp, Homo sapiens
gctccttgggccctttg

SEQ ID NO: 4522931 - DNA, 21 bp, Homo sapiens
gctcgatccaaattgtgcttc

SEQ ID NO: 4522932 - DNA, 17 bp, Homo sapiens
gctcgcatccagacagt

SEQ ID NO: 4522933 - DNA, 16 bp, Homo sapiens
gctcgcccacaaactg

SEQ ID NO: 4522934 - DNA, 21 bp, Homo sapiens
gctcgctccctgtagctctgc

SEQ ID NO: 4522935 - DNA, 22 bp, Homo sapiens
gctcgctccctgtagctctgcc

SEQ ID NO: 4522936 - DNA, 23 bp, Homo sapiens
gctcgctccctgtagctctgcct

SEQ ID NO: 4522937 - DNA, 17 bp, Homo sapiens
gctcgcttgctggaaca

SEQ ID NO: 4522938 - DNA, 16 bp, Homo sapiens
gctcggaggctgcccc

SEQ ID NO: 4522939 - DNA, 13 bp, Homo sapiens
gctcggtctccac

SEQ ID NO: 4522940 - DNA, 15 bp, Homo sapiens
gctcggtctccaccc

SEQ ID NO: 4522941 - DNA, 21 bp, Homo sapiens
gctcggtctccaccccagggt

SEQ ID NO: 4522942 - DNA, 22 bp, Homo sapiens
gctcgtggactgagtgggaagc

SEQ ID NO: 4522943 - DNA, 20 bp, Homo sapiens
gctctaatgagcatttcctt

SEQ ID NO: 4522944 - DNA, 18 bp, Homo sapiens
gctctaccttcctgtccc

SEQ ID NO: 4522945 - DNA, 21 bp, Homo sapiens
gctctaccttcctgtccctga

SEQ ID NO: 4522946 - DNA, 23 bp, Homo sapiens
gctctaccttcctgtccctgagg

SEQ ID NO: 4522947 - DNA, 22 bp, Homo sapiens
gctctagggactgccaggctgt

SEQ ID NO: 4522948 - DNA, 23 bp, Homo sapiens
gctctagggactgccaggctgtt

SEQ ID NO: 4522949 - DNA, 22 bp, Homo sapiens
gctctagttttcagccttggga

SEQ ID NO: 4522950 - DNA, 13 bp, Homo sapiens
gctctatgtctgc

SEQ ID NO: 4522951 - DNA, 23 bp, Homo sapiens
gctctcaagtcaaggaagctggg

SEQ ID NO: 4522952 - DNA, 12 bp, Homo sapiens
gctctcagttct

SEQ ID NO: 4522953 - DNA, 18 bp, Homo sapiens
gctctccaagtctcagtg

SEQ ID NO: 4522954 - DNA, 22 bp, Homo sapiens
gctctcccctctcgccccatcc

SEQ ID NO: 4522955 - DNA, 15 bp, Homo sapiens
gctctccctctggcc

SEQ ID NO: 4522956 - DNA, 18 bp, Homo sapiens
gctctccctctggccctg

SEQ ID NO: 4522957 - DNA, 20 bp, Homo sapiens
gctctccctctggccctgcc

SEQ ID NO: 4522958 - DNA, 11 bp, Homo sapiens
gctctccttcc

SEQ ID NO: 4522959 - DNA, 12 bp, Homo sapiens
gctctccttcct

SEQ ID NO: 4522960 - DNA, 17 bp, Homo sapiens
gctctctcacctgctcc

SEQ ID NO: 4522961 - DNA, 19 bp, Homo sapiens
gctctctcattgtctgtgt

SEQ ID NO: 4522962 - DNA, 18 bp, Homo sapiens
gctctctctagaatgagc

SEQ ID NO: 4522963 - DNA, 17 bp, Homo sapiens
gctctctgcagccagcc

SEQ ID NO: 4522964 - DNA, 13 bp, Homo sapiens
gctctctgctgta

SEQ ID NO: 4522965 - DNA, 19 bp, Homo sapiens
gctctctgtgggctggcag

SEQ ID NO: 4522966 - DNA, 17 bp, Homo sapiens
gctctcttcaataaacc

SEQ ID NO: 4522967 - DNA, 19 bp, Homo sapiens
gctctcttcaataaaccac

SEQ ID NO: 4522968 - DNA, 11 bp, Homo sapiens
gctctgaaaac

SEQ ID NO: 4522969 - DNA, 16 bp, Homo sapiens
gctctgaaaccagtgt

SEQ ID NO: 4522970 - DNA, 21 bp, Homo sapiens
gctctgaacttccaagctcca

SEQ ID NO: 4522971 - DNA, 16 bp, Homo sapiens
gctctgacctcctctg

SEQ ID NO: 4522972 - DNA, 23 bp, Homo sapiens
gctctgacctcctctgggccctg

SEQ ID NO: 4522973 - DNA, 15 bp, Homo sapiens
gctctgagccacaga

SEQ ID NO: 4522974 - DNA, 16 bp, Homo sapiens
gctctgagccagatta

SEQ ID NO: 4522975 - DNA, 17 bp, Homo sapiens
gctctgagccagattac

SEQ ID NO: 4522976 - DNA, 20 bp, Homo sapiens
gctctgatctgaggctaaga

SEQ ID NO: 4522977 - DNA, 18 bp, Homo sapiens
gctctgcaggctggggag

SEQ ID NO: 4522978 - DNA, 20 bp, Homo sapiens
gctctgcaggctggggaggt

SEQ ID NO: 4522979 - DNA, 18 bp, Homo sapiens
gctctgcatgcggcccag

SEQ ID NO: 4522980 - DNA, 19 bp, Homo sapiens
gctctgcatgcggcccagc

SEQ ID NO: 4522981 - DNA, 23 bp, Homo sapiens
gctctgcccccgcgggttctaga

SEQ ID NO: 4522982 - DNA, 24 bp, Homo sapiens
gctctgcctcagacgttgcctgag

SEQ ID NO: 4522983 - DNA, 22 bp, Homo sapiens
gctctgcgtgtcacctgtgctt

SEQ ID NO: 4522984 - DNA, 20 bp, Homo sapiens
gctctggaataaagttgcag

SEQ ID NO: 4522985 - DNA, 24 bp, Homo sapiens
gctctggaataaagttgcagatga

SEQ ID NO: 4522986 - DNA, 15 bp, Homo sapiens
gctctggatcctgca

SEQ ID NO: 4522987 - DNA, 17 bp, Homo sapiens
gctctggctctgcctca

SEQ ID NO: 4522988 - DNA, 20 bp, Homo sapiens
gctctggggatttctgggat

SEQ ID NO: 4522989 - DNA, 17 bp, Homo sapiens
gctctggggcagaggaa

SEQ ID NO: 4522990 - DNA, 19 bp, Homo sapiens
gctctggggtgggcagttt

SEQ ID NO: 4522991 - DNA, 18 bp, Homo sapiens
gctctgggtgaggtaggc

SEQ ID NO: 4522992 - DNA, 20 bp, Homo sapiens
gctctggttgtttctgttcc

SEQ ID NO: 4522993 - DNA, 18 bp, Homo sapiens
gctctgtatcaggaccca

SEQ ID NO: 4522994 - DNA, 14 bp, Homo sapiens
gctctgtccccaaa

SEQ ID NO: 4522995 - DNA, 18 bp, Homo sapiens
gctctgtcccccaggctg

SEQ ID NO: 4522996 - DNA, 19 bp, Homo sapiens
gctctgtcccccaggctgg

SEQ ID NO: 4522997 - DNA, 14 bp, Homo sapiens
gctctgtccccctg

SEQ ID NO: 4522998 - DNA, 18 bp, Homo sapiens
gctctgtcgcccaggctg

SEQ ID NO: 4522999 - DNA, 19 bp, Homo sapiens
gctctgtcttggtaggttt

SEQ ID NO: 4523000 - DNA, 18 bp, Homo sapiens
gctctgtgctgaccctcc

SEQ ID NO: 4523001 - DNA, 19 bp, Homo sapiens
gctctgtgctgaccctcct

SEQ ID NO: 4523002 - DNA, 16 bp, Homo sapiens
gctctgtgggtgatgg

SEQ ID NO: 4523003 - DNA, 23 bp, Homo sapiens
gctctgtgggtgatggggagggg

SEQ ID NO: 4523004 - DNA, 15 bp, Homo sapiens
gctctgtttgtgggg

SEQ ID NO: 4523005 - DNA, 21 bp, Homo sapiens
gctctgtttgtggggtgacgg

SEQ ID NO: 4523006 - DNA, 18 bp, Homo sapiens
gctcttagtcccaagcta

SEQ ID NO: 4523007 - DNA, 21 bp, Homo sapiens
gctcttatagaagcttcagca

SEQ ID NO: 4523008 - DNA, 22 bp, Homo sapiens
gctcttatagaagcttcagcag

SEQ ID NO: 4523009 - DNA, 12 bp, Homo sapiens
gctcttcaggcc

SEQ ID NO: 4523010 - DNA, 18 bp, Homo sapiens
gctcttcaggcctccctc

SEQ ID NO: 4523011 - DNA, 17 bp, Homo sapiens
gctcttcataataaacc

SEQ ID NO: 4523012 - DNA, 15 bp, Homo sapiens
gctgcctaataaaga

SEQ ID NO: 4523013 - DNA, 13 bp, Homo sapiens
gctgcctcctgcg

SEQ ID NO: 4523014 - DNA, 20 bp, Homo sapiens
gctgcctcttctcttgacag

SEQ ID NO: 4523015 - DNA, 20 bp, Homo sapiens
gctgccttagcttcaggaac

SEQ ID NO: 4523016 - DNA, 16 bp, Homo sapiens
gctgccttcagggaga

SEQ ID NO: 4523017 - DNA, 12 bp, Homo sapiens
gctgccttccct

SEQ ID NO: 4523018 - DNA, 15 bp, Homo sapiens
gctgccttccctagc

SEQ ID NO: 4523019 - DNA, 16 bp, Homo sapiens
gctgccttccctagct

SEQ ID NO: 4523020 - DNA, 16 bp, Homo sapiens
gctgccttctttccat

SEQ ID NO: 4523021 - DNA, 14 bp, Homo sapiens
gctgcgcagcctcc

SEQ ID NO: 4523022 - DNA, 21 bp, Homo sapiens
gctgcgcagcctccagggccc

SEQ ID NO: 4523023 - DNA, 15 bp, Homo sapiens
gctgcgcttgctttt

SEQ ID NO: 4523024 - DNA, 17 bp, Homo sapiens
gctgcggccaggcctgc

SEQ ID NO: 4523025 - DNA, 15 bp, Homo sapiens
gctgctaattcccaa

SEQ ID NO: 4523026 - DNA, 19 bp, Homo sapiens
gctgctccccaacacctgc

SEQ ID NO: 4523027 - DNA, 22 bp, Homo sapiens
gctgctccccacgtcagctggg

SEQ ID NO: 4523028 - DNA, 18 bp, Homo sapiens
gctgctcctccagggcca

SEQ ID NO: 4523029 - DNA, 13 bp, Homo sapiens
gctgctctcagcc

SEQ ID NO: 4523030 - DNA, 14 bp, Homo sapiens
gctgctctcccaag

SEQ ID NO: 4523031 - DNA, 15 bp, Homo sapiens
gctgctctcccaagg

SEQ ID NO: 4523032 - DNA, 21 bp, Homo sapiens
gctgctctgaccttccagagc

SEQ ID NO: 4523033 - DNA, 18 bp, Homo sapiens
gctgctctgcaggctggg

SEQ ID NO: 4523034 - DNA, 22 bp, Homo sapiens
gctgctctgcaggctggggagg

SEQ ID NO: 4523035 - DNA, 15 bp, Homo sapiens
gctgctctgggaagg

SEQ ID NO: 4523036 - DNA, 19 bp, Homo sapiens
gctgctctgggaaggggct

SEQ ID NO: 4523037 - DNA, 18 bp, Homo sapiens
gctgctgagatcctggac

SEQ ID NO: 4523038 - DNA, 20 bp, Homo sapiens
gctgctgagatcctggactg

SEQ ID NO: 4523039 - DNA, 18 bp, Homo sapiens
gctgctgcccatgtttca

SEQ ID NO: 4523040 - DNA, 15 bp, Homo sapiens
gctgctgcccctgca

SEQ ID NO: 4523041 - DNA, 23 bp, Homo sapiens
gctgctgcccctgcacagcaggc

SEQ ID NO: 4523042 - DNA, 14 bp, Homo sapiens
gctgctggagaata

SEQ ID NO: 4523043 - DNA, 22 bp, Homo sapiens
gctgctggccccgcccctgccc

SEQ ID NO: 4523044 - DNA, 14 bp, Homo sapiens
gctgctggcgcctc

SEQ ID NO: 4523045 - DNA, 18 bp, Homo sapiens
gctgctggcgcctctgca

SEQ ID NO: 4523046 - DNA, 23 bp, Homo sapiens
gctgctgtctgagtagtggccac

SEQ ID NO: 4523047 - DNA, 21 bp, Homo sapiens
gctgctgtgtgctttttttgt

SEQ ID NO: 4523048 - DNA, 15 bp, Homo sapiens
gctgctgtgtgtgag

SEQ ID NO: 4523049 - DNA, 21 bp, Homo sapiens
gctgctgttctcaggacagca

SEQ ID NO: 4523050 - DNA, 15 bp, Homo sapiens
gctgcttggacggat

SEQ ID NO: 4523051 - DNA, 14 bp, Homo sapiens
gctggaacacaggg

SEQ ID NO: 4523052 - DNA, 16 bp, Homo sapiens
gctggaacacaggggc

SEQ ID NO: 4523053 - DNA, 18 bp, Homo sapiens
gctggaacacaggggcct

SEQ ID NO: 4523054 - DNA, 17 bp, Homo sapiens
gctggaagaaccactgt

SEQ ID NO: 4523055 - DNA, 18 bp, Homo sapiens
gctggaagatagctgtga

SEQ ID NO: 4523056 - DNA, 16 bp, Homo sapiens
gctggaaggcagcagg

SEQ ID NO: 4523057 - DNA, 14 bp, Homo sapiens
gctggaatgtgcca

SEQ ID NO: 4523058 - DNA, 21 bp, Homo sapiens
gctggaatgtgccacagaggc

SEQ ID NO: 4523059 - DNA, 17 bp, Homo sapiens
gctggactattgtgcca

SEQ ID NO: 4523060 - DNA, 22 bp, Homo sapiens
gctggactctcagtctctgagc

SEQ ID NO: 4523061 - DNA, 19 bp, Homo sapiens
gctggactgaggcctgagc

SEQ ID NO: 4523062 - DNA, 18 bp, Homo sapiens
gctggactgttccaggcc

SEQ ID NO: 4523063 - DNA, 21 bp, Homo sapiens
gctggactgttccaggccctc

SEQ ID NO: 4523064 - DNA, 22 bp, Homo sapiens
gctggactgttccaggccctcc

SEQ ID NO: 4523065 - DNA, 21 bp, Homo sapiens
gctggacttctacctgccctc

SEQ ID NO: 4523066 - DNA, 22 bp, Homo sapiens
gctggacttctacctgccctca

SEQ ID NO: 4523067 - DNA, 18 bp, Homo sapiens
gctggagaaagccacgcc

SEQ ID NO: 4523068 - DNA, 19 bp, Homo sapiens
gctggagaaagccacgccc

SEQ ID NO: 4523069 - DNA, 16 bp, Homo sapiens
gctggagcccccagca

SEQ ID NO: 4523070 - DNA, 14 bp, Homo sapiens
gctggagctcctcc

SEQ ID NO: 4523071 - DNA, 21 bp, Homo sapiens
gctggagctcctccctccagc

SEQ ID NO: 4523072 - DNA, 23 bp, Homo sapiens
gctggagctcctccctccagctg

SEQ ID NO: 4523073 - DNA, 21 bp, Homo sapiens
gctggaggcagggccttgccc

SEQ ID NO: 4523074 - DNA, 12 bp, Homo sapiens
gctggaggccca

SEQ ID NO: 4523075 - DNA, 14 bp, Homo sapiens
gctggaggggtggc

SEQ ID NO: 4523076 - DNA, 18 bp, Homo sapiens
gctggaggggtggcccag

SEQ ID NO: 4523077 - DNA, 20 bp, Homo sapiens
gctggagtgcagtggcgcga

SEQ ID NO: 4523078 - DNA, 16 bp, Homo sapiens
gctggagtttcatgta

SEQ ID NO: 4523079 - DNA, 14 bp, Homo sapiens
gctggatgacttga

SEQ ID NO: 4523080 - DNA, 19 bp, Homo sapiens
gctggcacagcccctggag

SEQ ID NO: 4523081 - DNA, 21 bp, Homo sapiens
gctggcacagcccctggagcc

SEQ ID NO: 4523082 - DNA, 20 bp, Homo sapiens
gctggcacccaccgtggagg

SEQ ID NO: 4523083 - DNA, 23 bp, Homo sapiens
gctggcacccaccgtggaggagg

SEQ ID NO: 4523084 - DNA, 16 bp, Homo sapiens
gctggcagctgagagc

SEQ ID NO: 4523085 - DNA, 12 bp, Homo sapiens
gctggccagcac

SEQ ID NO: 4523086 - DNA, 21 bp, Homo sapiens
gctggccagcaccctctcctg

SEQ ID NO: 4523087 - DNA, 11 bp, Homo sapiens
gctggcccagc

SEQ ID NO: 4523088 - DNA, 12 bp, Homo sapiens
gctggcccagcc

SEQ ID NO: 4523089 - DNA, 16 bp, Homo sapiens
gctggcccagccctgc

SEQ ID NO: 4523090 - DNA, 19 bp, Homo sapiens
gctggccccgcccctgccc

SEQ ID NO: 4523091 - DNA, 21 bp, Homo sapiens
gctggccccgcccctgccccc

SEQ ID NO: 4523092 - DNA, 23 bp, Homo sapiens
gctggccctacttccaggatgga

SEQ ID NO: 4523093 - DNA, 21 bp, Homo sapiens
gctggccgacccactgaccca

SEQ ID NO: 4523094 - DNA, 21 bp, Homo sapiens
gctggcctggtttcctcgaga

SEQ ID NO: 4523095 - DNA, 15 bp, Homo sapiens
gctggcgcctctgca

SEQ ID NO: 4523096 - DNA, 16 bp, Homo sapiens
gctggcgctcagcagc

SEQ ID NO: 4523097 - DNA, 19 bp, Homo sapiens
gctggcgggcctttttcct

SEQ ID NO: 4523098 - DNA, 18 bp, Homo sapiens
gctggctccccctcccca

SEQ ID NO: 4523099 - DNA, 19 bp, Homo sapiens
gctggctccccctccccag

SEQ ID NO: 4523100 - DNA, 19 bp, Homo sapiens
gctggctcctaggggaaga

SEQ ID NO: 4523101 - DNA, 14 bp, Homo sapiens
gctggctcttctgc

SEQ ID NO: 4523102 - DNA, 16 bp, Homo sapiens
gctggctcttctgccc

SEQ ID NO: 4523103 - DNA, 12 bp, Homo sapiens
gctggctgaaga

SEQ ID NO: 4523104 - DNA, 23 bp, Homo sapiens
gctggctgaagaggaccagagga

SEQ ID NO: 4523105 - DNA, 14 bp, Homo sapiens
gctggctgcggccc

SEQ ID NO: 4523106 - DNA, 12 bp, Homo sapiens
gctggctggcct

SEQ ID NO: 4523107 - DNA, 10 bp, Homo sapiens
gctggctggt

SEQ ID NO: 4523108 - DNA, 14 bp, Homo sapiens
gctgggaaagcata

SEQ ID NO: 4523109 - DNA, 23 bp, Homo sapiens
gctgggacaccccgacttttgtt

SEQ ID NO: 4523110 - DNA, 14 bp, Homo sapiens
gctgggagacaaag

SEQ ID NO: 4523111 - DNA, 14 bp, Homo sapiens
gctgggagcactgg

SEQ ID NO: 4523112 - DNA, 17 bp, Homo sapiens
gctgggaggagggagag

SEQ ID NO: 4523113 - DNA, 17 bp, Homo sapiens
gctgggaggagggcagg

SEQ ID NO: 4523114 - DNA, 21 bp, Homo sapiens
gctgggaggagggcaggcatc

SEQ ID NO: 4523115 - DNA, 19 bp, Homo sapiens
gctgggatggtgactcctg

SEQ ID NO: 4523116 - DNA, 20 bp, Homo sapiens
gctgggatggtgactcctga

SEQ ID NO: 4523117 - DNA, 19 bp, Homo sapiens
gctgggcaaggaaaaagaa

SEQ ID NO: 4523118 - DNA, 20 bp, Homo sapiens
gctgggcaaggaaaaagaaa

SEQ ID NO: 4523119 - DNA, 19 bp, Homo sapiens
gctgggccatgtccaaaga

SEQ ID NO: 4523120 - DNA, 20 bp, Homo sapiens
gctgggccatgtccaaagag

SEQ ID NO: 4523121 - DNA, 13 bp, Homo sapiens
gctgggccccagc

SEQ ID NO: 4523122 - DNA, 24 bp, Homo sapiens
gctgggccccagcccaccctcctg

SEQ ID NO: 4523123 - DNA, 12 bp, Homo sapiens
gctgggcccctg

SEQ ID NO: 4523124 - DNA, 13 bp, Homo sapiens
gctgggcccctgc

SEQ ID NO: 4523125 - DNA, 18 bp, Homo sapiens
gctgggcccctgggatgg

SEQ ID NO: 4523126 - DNA, 17 bp, Homo sapiens
gctgggccctctttccc

SEQ ID NO: 4523127 - DNA, 15 bp, Homo sapiens
gctgggccctgcctg

SEQ ID NO: 4523128 - DNA, 16 bp, Homo sapiens
gctgggccctgcctgc

SEQ ID NO: 4523129 - DNA, 17 bp, Homo sapiens
gctgggccctgcctgca

SEQ ID NO: 4523130 - DNA, 20 bp, Homo sapiens
gctgggccctgcctgcagcc

SEQ ID NO: 4523131 - DNA, 12 bp, Homo sapiens
gctgggctgggc

SEQ ID NO: 4523132 - DNA, 14 bp, Homo sapiens
gctcttctcatttc

SEQ ID NO: 4523133 - DNA, 15 bp, Homo sapiens
gctcttctcatttca

SEQ ID NO: 4523134 - DNA, 12 bp, Homo sapiens
gctcttcttaaa

SEQ ID NO: 4523135 - DNA, 19 bp, Homo sapiens
gctcttgaaatattcagaa

SEQ ID NO: 4523136 - DNA, 11 bp, Homo sapiens
gctctttaaat

SEQ ID NO: 4523137 - DNA, 17 bp, Homo sapiens
gctctttacatttcttt

SEQ ID NO: 4523138 - DNA, 22 bp, Homo sapiens
gctctttacatttcttttaaaa

SEQ ID NO: 4523139 - DNA, 19 bp, Homo sapiens
gctctttttagctggcttt

SEQ ID NO: 4523140 - DNA, 20 bp, Homo sapiens
gctcttttttgtttgtttct

SEQ ID NO: 4523141 - DNA, 17 bp, Homo sapiens
gctgaaagtcctgcttt

SEQ ID NO: 4523142 - DNA, 16 bp, Homo sapiens
gctgaaattttagaaa

SEQ ID NO: 4523143 - DNA, 17 bp, Homo sapiens
gctgaaattttagaaat

SEQ ID NO: 4523144 - DNA, 19 bp, Homo sapiens
gctgaaattttagaaatat

SEQ ID NO: 4523145 - DNA, 17 bp, Homo sapiens
gctgaaattttatatgc

SEQ ID NO: 4523146 - DNA, 23 bp, Homo sapiens
gctgaagatggagggggctgggg

SEQ ID NO: 4523147 - DNA, 17 bp, Homo sapiens
gctgaagcaaagtgccc

SEQ ID NO: 4523148 - DNA, 10 bp, Homo sapiens
gctgaatcca

SEQ ID NO: 4523149 - DNA, 18 bp, Homo sapiens
gctgaatgtatgtaaata

SEQ ID NO: 4523150 - DNA, 20 bp, Homo sapiens
gctgaatgttgggactgcta

SEQ ID NO: 4523151 - DNA, 11 bp, Homo sapiens
gctgaattcct

SEQ ID NO: 4523152 - DNA, 14 bp, Homo sapiens
gctgaattgaacat

SEQ ID NO: 4523153 - DNA, 17 bp, Homo sapiens
gctgaatttccctctct

SEQ ID NO: 4523154 - DNA, 24 bp, Homo sapiens
gctgaatttccctctctcataccc

SEQ ID NO: 4523155 - DNA, 20 bp, Homo sapiens
gctgacaatactgctgcctt

SEQ ID NO: 4523156 - DNA, 16 bp, Homo sapiens
gctgacacccaggccc

SEQ ID NO: 4523157 - DNA, 16 bp, Homo sapiens
gctgacagcttgggag

SEQ ID NO: 4523158 - DNA, 17 bp, Homo sapiens
gctgacattcactgagt

SEQ ID NO: 4523159 - DNA, 19 bp, Homo sapiens
gctgacccagtccctgggg

SEQ ID NO: 4523160 - DNA, 20 bp, Homo sapiens
gctgactatttgacccccac

SEQ ID NO: 4523161 - DNA, 19 bp, Homo sapiens
gctgactggtttctcctgg

SEQ ID NO: 4523162 - DNA, 21 bp, Homo sapiens
gctgactggtttctcctggta

SEQ ID NO: 4523163 - DNA, 17 bp, Homo sapiens
gctgactgttcttggta

SEQ ID NO: 4523164 - DNA, 15 bp, Homo sapiens
gctgagagacccaag

SEQ ID NO: 4523165 - DNA, 20 bp, Homo sapiens
gctgagaggcaccagtccag

SEQ ID NO: 4523166 - DNA, 14 bp, Homo sapiens
gctgagatcctgga

SEQ ID NO: 4523167 - DNA, 14 bp, Homo sapiens
gctgagccagctgc

SEQ ID NO: 4523168 - DNA, 16 bp, Homo sapiens
gctgagccagctgcag

SEQ ID NO: 4523169 - DNA, 17 bp, Homo sapiens
gctgagccagctgcaga

SEQ ID NO: 4523170 - DNA, 20 bp, Homo sapiens
gctgagcgcccccgagccct

SEQ ID NO: 4523171 - DNA, 14 bp, Homo sapiens
gctgagctctctgt

SEQ ID NO: 4523172 - DNA, 18 bp, Homo sapiens
gctgaggaggcacctaca

SEQ ID NO: 4523173 - DNA, 16 bp, Homo sapiens
gctgaggaggcctcca

SEQ ID NO: 4523174 - DNA, 13 bp, Homo sapiens
gctgaggcagcag

SEQ ID NO: 4523175 - DNA, 12 bp, Homo sapiens
gctgaggcagga

SEQ ID NO: 4523176 - DNA, 18 bp, Homo sapiens
gctgaggcaggaggatca

SEQ ID NO: 4523177 - DNA, 19 bp, Homo sapiens
gctgaggccagagtcacct

SEQ ID NO: 4523178 - DNA, 14 bp, Homo sapiens
gctgaggcctctca

SEQ ID NO: 4523179 - DNA, 14 bp, Homo sapiens
gctgagggagcctg

SEQ ID NO: 4523180 - DNA, 22 bp, Homo sapiens
gctgagtcatgatctccctgcc

SEQ ID NO: 4523181 - DNA, 17 bp, Homo sapiens
gctgagtgacagctttc

SEQ ID NO: 4523182 - DNA, 22 bp, Homo sapiens
gctgagtggggggtcgtgggcc

SEQ ID NO: 4523183 - DNA, 14 bp, Homo sapiens
gctgagttggcctg

SEQ ID NO: 4523184 - DNA, 23 bp, Homo sapiens
gctgagttggcctggccatttcc

SEQ ID NO: 4523185 - DNA, 23 bp, Homo sapiens
gctgagtttggatgtctgtagca

SEQ ID NO: 4523186 - DNA, 12 bp, Homo sapiens
gctgataatttt

SEQ ID NO: 4523187 - DNA, 17 bp, Homo sapiens
gctgatggagccttccc

SEQ ID NO: 4523188 - DNA, 13 bp, Homo sapiens
gctgattatttat

SEQ ID NO: 4523189 - DNA, 17 bp, Homo sapiens
gctgattcctcgtgtcc

SEQ ID NO: 4523190 - DNA, 17 bp, Homo sapiens
gctgattcttgtaaatc

SEQ ID NO: 4523191 - DNA, 17 bp, Homo sapiens
gctgattttctctggca

SEQ ID NO: 4523192 - DNA, 12 bp, Homo sapiens
gctgcaaagtgt

SEQ ID NO: 4523193 - DNA, 21 bp, Homo sapiens
gctgcaaagtgttttgtacca

SEQ ID NO: 4523194 - DNA, 14 bp, Homo sapiens
gctgcaacaagctc

SEQ ID NO: 4523195 - DNA, 21 bp, Homo sapiens
gctgcaacaagctcatccctg

SEQ ID NO: 4523196 - DNA, 18 bp, Homo sapiens
gctgcaagcacagccctt

SEQ ID NO: 4523197 - DNA, 12 bp, Homo sapiens
gctgcaaggtac

SEQ ID NO: 4523198 - DNA, 20 bp, Homo sapiens
gctgcaaggtactctggtga

SEQ ID NO: 4523199 - DNA, 19 bp, Homo sapiens
gctgcactctgtagcaaat

SEQ ID NO: 4523200 - DNA, 15 bp, Homo sapiens
gctgcactgtgaacc

SEQ ID NO: 4523201 - DNA, 16 bp, Homo sapiens
gctgcagaccccaggt

SEQ ID NO: 4523202 - DNA, 17 bp, Homo sapiens
gctgcagagctgaccca

SEQ ID NO: 4523203 - DNA, 21 bp, Homo sapiens
gctgcagattagttctttttg

SEQ ID NO: 4523204 - DNA, 20 bp, Homo sapiens
gctgcaggaatcacccctct

SEQ ID NO: 4523205 - DNA, 22 bp, Homo sapiens
gctgcaggaatcacccctctgc

SEQ ID NO: 4523206 - DNA, 21 bp, Homo sapiens
gctgcaggagtgtcctgccca

SEQ ID NO: 4523207 - DNA, 20 bp, Homo sapiens
gctgcagggccactggaagg

SEQ ID NO: 4523208 - DNA, 17 bp, Homo sapiens
gctgcagttttgctatc

SEQ ID NO: 4523209 - DNA, 15 bp, Homo sapiens
gctgcatacagggga

SEQ ID NO: 4523210 - DNA, 20 bp, Homo sapiens
gctgcatacaggggaggggc

SEQ ID NO: 4523211 - DNA, 23 bp, Homo sapiens
gctgcatcgctgttctgggcatg

SEQ ID NO: 4523212 - DNA, 13 bp, Homo sapiens
gctgcatgaccta

SEQ ID NO: 4523213 - DNA, 13 bp, Homo sapiens
gctgccaaatgcg

SEQ ID NO: 4523214 - DNA, 15 bp, Homo sapiens
gctgccaaggccaga

SEQ ID NO: 4523215 - DNA, 16 bp, Homo sapiens
gctgccaaggccagag

SEQ ID NO: 4523216 - DNA, 23 bp, Homo sapiens
gctgccaaggccagagtggcctg

SEQ ID NO: 4523217 - DNA, 16 bp, Homo sapiens
gctgccacacctgagc

SEQ ID NO: 4523218 - DNA, 14 bp, Homo sapiens
gctgccaccagccc

SEQ ID NO: 4523219 - DNA, 15 bp, Homo sapiens
gctgccaccagcccc

SEQ ID NO: 4523220 - DNA, 14 bp, Homo sapiens
gctgccacccgccc

SEQ ID NO: 4523221 - DNA, 17 bp, Homo sapiens
gctgccacccgcccacc

SEQ ID NO: 4523222 - DNA, 19 bp, Homo sapiens
gctgccagccttgagccct

SEQ ID NO: 4523223 - DNA, 17 bp, Homo sapiens
gctgccagctctgtatc

SEQ ID NO: 4523224 - DNA, 18 bp, Homo sapiens
gctgccagctctgtatca

SEQ ID NO: 4523225 - DNA, 16 bp, Homo sapiens
gctgccagtgcagcca

SEQ ID NO: 4523226 - DNA, 13 bp, Homo sapiens
gctgccagtgcct

SEQ ID NO: 4523227 - DNA, 17 bp, Homo sapiens
gctgccatgctttgagt

SEQ ID NO: 4523228 - DNA, 19 bp, Homo sapiens
gctgccatgctttgagtcc

SEQ ID NO: 4523229 - DNA, 16 bp, Homo sapiens
gctgcccagccctggc

SEQ ID NO: 4523230 - DNA, 22 bp, Homo sapiens
gctgcccagccctggcccaggt

SEQ ID NO: 4523231 - DNA, 18 bp, Homo sapiens
gctgccccatcagtgctc

SEQ ID NO: 4523232 - DNA, 15 bp, Homo sapiens
gctgcccccaccccg

SEQ ID NO: 4523233 - DNA, 19 bp, Homo sapiens
gctgcccccggccccctgg

SEQ ID NO: 4523234 - DNA, 20 bp, Homo sapiens
gctgcccccggccccctggt

SEQ ID NO: 4523235 - DNA, 23 bp, Homo sapiens
gctgcccccggccccctggtctc

SEQ ID NO: 4523236 - DNA, 15 bp, Homo sapiens
gctgccccggcccct

SEQ ID NO: 4523237 - DNA, 17 bp, Homo sapiens
gctgccccggcctcctc

SEQ ID NO: 4523238 - DNA, 13 bp, Homo sapiens
gctgcccctctca

SEQ ID NO: 4523239 - DNA, 16 bp, Homo sapiens
gctgcccctgcacagc

SEQ ID NO: 4523240 - DNA, 15 bp, Homo sapiens
gctgcccctgtctgg

SEQ ID NO: 4523241 - DNA, 18 bp, Homo sapiens
gctgcccctgtctggaag

SEQ ID NO: 4523242 - DNA, 13 bp, Homo sapiens
gctgccctctggg

SEQ ID NO: 4523243 - DNA, 14 bp, Homo sapiens
gctgcccttgcagg

SEQ ID NO: 4523244 - DNA, 16 bp, Homo sapiens
gctgcccttgcagggt

SEQ ID NO: 4523245 - DNA, 18 bp, Homo sapiens
gctgcccttgcagggtgg

SEQ ID NO: 4523246 - DNA, 22 bp, Homo sapiens
gctgccgacttggagactcctg

SEQ ID NO: 4523247 - DNA, 24 bp, Homo sapiens
gctgccgacttggagactcctggt

SEQ ID NO: 4523248 - DNA, 22 bp, Homo sapiens
gctgccgagggctggccgggac

SEQ ID NO: 4523249 - DNA, 15 bp, Homo sapiens
gctgccgctgcacca

SEQ ID NO: 4523250 - DNA, 16 bp, Homo sapiens
gctgccgctgcaccac

SEQ ID NO: 4523251 - DNA, 18 bp, Homo sapiens
gctgcctaagtggctgct

SEQ ID NO: 4523252 - DNA, 14 bp, Homo sapiens
gctgcctaataaag

SEQ ID NO: 4523253 - DNA, 15 bp, Homo sapiens
gctgggctgggccct

SEQ ID NO: 4523254 - DNA, 17 bp, Homo sapiens
gctggggaagaacagcc

SEQ ID NO: 4523255 - DNA, 21 bp, Homo sapiens
gctggggaagaacagccccgg

SEQ ID NO: 4523256 - DNA, 23 bp, Homo sapiens
gctggggacacacattctgcctt

SEQ ID NO: 4523257 - DNA, 16 bp, Homo sapiens
gctggggacagagggt

SEQ ID NO: 4523258 - DNA, 13 bp, Homo sapiens
gctggggaggtgc

SEQ ID NO: 4523259 - DNA, 14 bp, Homo sapiens
gctggggaggtgct

SEQ ID NO: 4523260 - DNA, 18 bp, Homo sapiens
gctggggaggtgctgggg

SEQ ID NO: 4523261 - DNA, 16 bp, Homo sapiens
gctggggccagaggct

SEQ ID NO: 4523262 - DNA, 19 bp, Homo sapiens
gctggggccagaggctggg

SEQ ID NO: 4523263 - DNA, 20 bp, Homo sapiens
gctggggccccatcttgatc

SEQ ID NO: 4523264 - DNA, 22 bp, Homo sapiens
gctggggccggttttcctcagc

SEQ ID NO: 4523265 - DNA, 13 bp, Homo sapiens
gctgggggcagga

SEQ ID NO: 4523266 - DNA, 20 bp, Homo sapiens
gctgggggctgccgagccac

SEQ ID NO: 4523267 - DNA, 24 bp, Homo sapiens
gctgggggctgccgagccaccatg

SEQ ID NO: 4523268 - DNA, 13 bp, Homo sapiens
gctggggtgtcaa

SEQ ID NO: 4523269 - DNA, 14 bp, Homo sapiens
gctggggtgtcaat

SEQ ID NO: 4523270 - DNA, 18 bp, Homo sapiens
gctggggttgccagaggc

SEQ ID NO: 4523271 - DNA, 21 bp, Homo sapiens
gctggggttgccagaggccct

SEQ ID NO: 4523272 - DNA, 23 bp, Homo sapiens
gctgggtattggaaatggatgca

SEQ ID NO: 4523273 - DNA, 18 bp, Homo sapiens
gctgggtctgaggcccct

SEQ ID NO: 4523274 - DNA, 19 bp, Homo sapiens
gctgggtctgaggcccctg

SEQ ID NO: 4523275 - DNA, 23 bp, Homo sapiens
gctgggtctgaggcccctgcctc

SEQ ID NO: 4523276 - DNA, 15 bp, Homo sapiens
gctggtagagacccc

SEQ ID NO: 4523277 - DNA, 21 bp, Homo sapiens
gctggtagagacccccaggcc

SEQ ID NO: 4523278 - DNA, 13 bp, Homo sapiens
gctggtagcagca

SEQ ID NO: 4523279 - DNA, 20 bp, Homo sapiens
gctggtagcagcaggctcag

SEQ ID NO: 4523280 - DNA, 13 bp, Homo sapiens
gctggtcacagcc

SEQ ID NO: 4523281 - DNA, 14 bp, Homo sapiens
gctggtccttattt

SEQ ID NO: 4523282 - DNA, 16 bp, Homo sapiens
gctggtccttatttat

SEQ ID NO: 4523283 - DNA, 22 bp, Homo sapiens
gctggtctcaaacttgtggcct

SEQ ID NO: 4523284 - DNA, 22 bp, Homo sapiens
gctggtgtccccttcccctgct

SEQ ID NO: 4523285 - DNA, 23 bp, Homo sapiens
gctggtgtccccttcccctgctg

SEQ ID NO: 4523286 - DNA, 20 bp, Homo sapiens
gctggttcggatttggggtg

SEQ ID NO: 4523287 - DNA, 21 bp, Homo sapiens
gctggttcggatttggggtgg

SEQ ID NO: 4523288 - DNA, 17 bp, Homo sapiens
gctggttggagagctag

SEQ ID NO: 4523289 - DNA, 14 bp, Homo sapiens
gctgtaaataaatg

SEQ ID NO: 4523290 - DNA, 21 bp, Homo sapiens
gctgtaactactttataacta

SEQ ID NO: 4523291 - DNA, 15 bp, Homo sapiens
gctgtaatcatttgt

SEQ ID NO: 4523292 - DNA, 22 bp, Homo sapiens
gctgtaatttcgccttaaactc

SEQ ID NO: 4523293 - DNA, 14 bp, Homo sapiens
gctgtacagatatc

SEQ ID NO: 4523294 - DNA, 22 bp, Homo sapiens
gctgtactcttctgactgcccc

SEQ ID NO: 4523295 - DNA, 17 bp, Homo sapiens
gctgtacttcttgaata

SEQ ID NO: 4523296 - DNA, 13 bp, Homo sapiens
gctgtagaaaaaa

SEQ ID NO: 4523297 - DNA, 18 bp, Homo sapiens
gctgtagacatctgtcct

SEQ ID NO: 4523298 - DNA, 17 bp, Homo sapiens
gctgtattaagccactt

SEQ ID NO: 4523299 - DNA, 16 bp, Homo sapiens
gctgtatttctttgta

SEQ ID NO: 4523300 - DNA, 22 bp, Homo sapiens
gctgtatttctttgtagaataa

SEQ ID NO: 4523301 - DNA, 19 bp, Homo sapiens
gctgtattttgatataatt

SEQ ID NO: 4523302 - DNA, 12 bp, Homo sapiens
gctgtcacctct

SEQ ID NO: 4523303 - DNA, 22 bp, Homo sapiens
gctgtcatcactcaacaaaaaa

SEQ ID NO: 4523304 - DNA, 21 bp, Homo sapiens
gctgtcatggtcctttctgga

SEQ ID NO: 4523305 - DNA, 18 bp, Homo sapiens
gctgtccagaaaggtttg

SEQ ID NO: 4523306 - DNA, 15 bp, Homo sapiens
gctgtccagacagcc

SEQ ID NO: 4523307 - DNA, 18 bp, Homo sapiens
gctgtccagacagcctgt

SEQ ID NO: 4523308 - DNA, 22 bp, Homo sapiens
gctgtccagacagcctgtatct

SEQ ID NO: 4523309 - DNA, 16 bp, Homo sapiens
gctgtccccactgccc

SEQ ID NO: 4523310 - DNA, 17 bp, Homo sapiens
gctgtccccactgcccc

SEQ ID NO: 4523311 - DNA, 16 bp, Homo sapiens
gctgtcctggaggggc

SEQ ID NO: 4523312 - DNA, 23 bp, Homo sapiens
gctgtcctggaggggctggggac

SEQ ID NO: 4523313 - DNA, 22 bp, Homo sapiens
gctgtccttaacccacctctcc

SEQ ID NO: 4523314 - DNA, 15 bp, Homo sapiens
gctgtcgccccaggc

SEQ ID NO: 4523315 - DNA, 16 bp, Homo sapiens
gctgtcgccccaggcc

SEQ ID NO: 4523316 - DNA, 13 bp, Homo sapiens
gctgtctcccacg

SEQ ID NO: 4523317 - DNA, 19 bp, Homo sapiens
gctgtctgagtagtggcca

SEQ ID NO: 4523318 - DNA, 18 bp, Homo sapiens
gctgtctgatctgtgctt

SEQ ID NO: 4523319 - DNA, 13 bp, Homo sapiens
gctgtctgtcacc

SEQ ID NO: 4523320 - DNA, 16 bp, Homo sapiens
gctgtctgtcaccagc

SEQ ID NO: 4523321 - DNA, 15 bp, Homo sapiens
gctgtcttttcttga

SEQ ID NO: 4523322 - DNA, 20 bp, Homo sapiens
gctgtgaatgccaaagccat

SEQ ID NO: 4523323 - DNA, 13 bp, Homo sapiens
gctgtgagggagg

SEQ ID NO: 4523324 - DNA, 15 bp, Homo sapiens
gctgtgagggagggg

SEQ ID NO: 4523325 - DNA, 21 bp, Homo sapiens
gctgtgcacccagaagaagat

SEQ ID NO: 4523326 - DNA, 15 bp, Homo sapiens
gctgtgccatgctgg

SEQ ID NO: 4523327 - DNA, 13 bp, Homo sapiens
gctgtgccgaggc

SEQ ID NO: 4523328 - DNA, 15 bp, Homo sapiens
gctgtgctgggagaa

SEQ ID NO: 4523329 - DNA, 15 bp, Homo sapiens
gctgtgctgtatttt

SEQ ID NO: 4523330 - DNA, 17 bp, Homo sapiens
gctgtggccggtgccag

SEQ ID NO: 4523331 - DNA, 18 bp, Homo sapiens
gctgtggccggtgccagc

SEQ ID NO: 4523332 - DNA, 21 bp, Homo sapiens
gctgtggccggtgccagctgc

SEQ ID NO: 4523333 - DNA, 15 bp, Homo sapiens
gctgtggccgtctcc

SEQ ID NO: 4523334 - DNA, 19 bp, Homo sapiens
gctgtggcctaacctgccg

SEQ ID NO: 4523335 - DNA, 13 bp, Homo sapiens
gctgtgggcagca

SEQ ID NO: 4523336 - DNA, 15 bp, Homo sapiens
gctgtgggcagcacc

SEQ ID NO: 4523337 - DNA, 18 bp, Homo sapiens
gctgtgggcagcaccctc

SEQ ID NO: 4523338 - DNA, 17 bp, Homo sapiens
gctgtgggcggctcctg

SEQ ID NO: 4523339 - DNA, 18 bp, Homo sapiens
gctgtgtctcctctcaga

SEQ ID NO: 4523340 - DNA, 21 bp, Homo sapiens
gctgtgtctgcccaatgaata

SEQ ID NO: 4523341 - DNA, 18 bp, Homo sapiens
gctgtgtgaatacctgct

SEQ ID NO: 4523342 - DNA, 20 bp, Homo sapiens
gctgtgtgaatacctgctca

SEQ ID NO: 4523343 - DNA, 13 bp, Homo sapiens
gctgttaaataca

SEQ ID NO: 4523344 - DNA, 16 bp, Homo sapiens
gctgttaaatacagga

SEQ ID NO: 4523345 - DNA, 22 bp, Homo sapiens
gctgttaaatacaggaaacagt

SEQ ID NO: 4523346 - DNA, 17 bp, Homo sapiens
gctgttacgtttgaagt

SEQ ID NO: 4523347 - DNA, 20 bp, Homo sapiens
gctgttactgcttctctttg

SEQ ID NO: 4523348 - DNA, 23 bp, Homo sapiens
gctgttaggacagcaaagcagca

SEQ ID NO: 4523349 - DNA, 20 bp, Homo sapiens
gctgttatttcttccctgct

SEQ ID NO: 4523350 - DNA, 15 bp, Homo sapiens
gctgttcacagccag

SEQ ID NO: 4523351 - DNA, 22 bp, Homo sapiens
gctgttcacccacagggctaag

SEQ ID NO: 4523352 - DNA, 21 bp, Homo sapiens
gctgttcctgttcagtaataa

SEQ ID NO: 4523353 - DNA, 23 bp, Homo sapiens
gctgttctcaggacagcatccct

SEQ ID NO: 4523354 - DNA, 20 bp, Homo sapiens
gctgttctgggcatggcagg

SEQ ID NO: 4523355 - DNA, 23 bp, Homo sapiens
gctgttctgtagcttatctgccc

SEQ ID NO: 4523356 - DNA, 18 bp, Homo sapiens
gctgttgggtttttgctg

SEQ ID NO: 4523357 - DNA, 21 bp, Homo sapiens
gctgtttactcccttctgtag

SEQ ID NO: 4523358 - DNA, 17 bp, Homo sapiens
gctgtttatacttgaga

SEQ ID NO: 4523359 - DNA, 16 bp, Homo sapiens
gctgtttatggcctca

SEQ ID NO: 4523360 - DNA, 23 bp, Homo sapiens
gctgtttatggcctcagctgcct

SEQ ID NO: 4523361 - DNA, 13 bp, Homo sapiens
gctgtttgaaaat

SEQ ID NO: 4523362 - DNA, 18 bp, Homo sapiens
gctgtttgtagtgaaata

SEQ ID NO: 4523363 - DNA, 18 bp, Homo sapiens
gcttaaaactttgaagtt

SEQ ID NO: 4523364 - DNA, 17 bp, Homo sapiens
gcttaaacccatacaat

SEQ ID NO: 4523365 - DNA, 21 bp, Homo sapiens
gcttaaacccatacaatgtat

SEQ ID NO: 4523366 - DNA, 15 bp, Homo sapiens
gcttaaatttcttat

SEQ ID NO: 4523367 - DNA, 16 bp, Homo sapiens
gcttaaatttcttatg

SEQ ID NO: 4523368 - DNA, 17 bp, Homo sapiens
gcttaagtgtaaatgaa

SEQ ID NO: 4523369 - DNA, 22 bp, Homo sapiens
gcttaatccaatattttgcctt

SEQ ID NO: 4523370 - DNA, 15 bp, Homo sapiens
gcttaatctttgaaa

SEQ ID NO: 4523371 - DNA, 20 bp, Homo sapiens
gcttaatggctgataatttt

SEQ ID NO: 4523372 - DNA, 22 bp, Homo sapiens
gcttaattattgatgttttcat

SEQ ID NO: 4523373 - DNA, 17 bp, Homo sapiens
gcttactgatatatttt

SEQ ID NO: 4523374 - DNA, 13 bp, Homo sapiens
gcttagatttcat

SEQ ID NO: 4523375 - DNA, 22 bp, Homo sapiens
gcttataacctagttaaagaaa

SEQ ID NO: 4523376 - DNA, 17 bp, Homo sapiens
gcttatatctggcctct

SEQ ID NO: 4523377 - DNA, 20 bp, Homo sapiens
gcttatatctggcctctgct

SEQ ID NO: 4523378 - DNA, 14 bp, Homo sapiens
gcttatatgtactt

SEQ ID NO: 4523379 - DNA, 16 bp, Homo sapiens
gcttatccataaaaaa

SEQ ID NO: 4523380 - DNA, 16 bp, Homo sapiens
gcttatctgcccctcc

SEQ ID NO: 4523381 - DNA, 19 bp, Homo sapiens
gcttatctgcccctccccc

SEQ ID NO: 4523382 - DNA, 13 bp, Homo sapiens
gcttatttccagt

SEQ ID NO: 4523383 - DNA, 21 bp, Homo sapiens
gcttcaaattggtctgaaagg

SEQ ID NO: 4523384 - DNA, 15 bp, Homo sapiens
gcttcaatataagaa

SEQ ID NO: 4523385 - DNA, 19 bp, Homo sapiens
gcttcaatataagaagcaa

SEQ ID NO: 4523386 - DNA, 13 bp, Homo sapiens
gcttcacaaaatg

SEQ ID NO: 4523387 - DNA, 15 bp, Homo sapiens
gcttcacagccacac

SEQ ID NO: 4523388 - DNA, 21 bp, Homo sapiens
gcttcacccaccaggccagct

SEQ ID NO: 4523389 - DNA, 23 bp, Homo sapiens
gcttcactcatgcaaactgcttt

SEQ ID NO: 4523390 - DNA, 17 bp, Homo sapiens
gcttcagaccatcagtt

SEQ ID NO: 4523391 - DNA, 13 bp, Homo sapiens
gcttcaggaacct

SEQ ID NO: 4523392 - DNA, 14 bp, Homo sapiens
gcttcaggaacctc

SEQ ID NO: 4523393 - DNA, 15 bp, Homo sapiens
gcttcaggttgcatt

SEQ ID NO: 4523394 - DNA, 16 bp, Homo sapiens
gcttcaggttgcattg

SEQ ID NO: 4523395 - DNA, 14 bp, Homo sapiens
gcttcatctggcaa

SEQ ID NO: 4523396 - DNA, 23 bp, Homo sapiens
gcttcatctgtgggatgctgaag

SEQ ID NO: 4523397 - DNA, 17 bp, Homo sapiens
gcttcatggcagaaggc

SEQ ID NO: 4523398 - DNA, 14 bp, Homo sapiens
gcttccacaaaatt

SEQ ID NO: 4523399 - DNA, 19 bp, Homo sapiens
gcttccaggaaactccaca

SEQ ID NO: 4523400 - DNA, 21 bp, Homo sapiens
gcttccaggaaactccacatc

SEQ ID NO: 4523401 - DNA, 18 bp, Homo sapiens
gcttccatagctgctgcc

SEQ ID NO: 4523402 - DNA, 14 bp, Homo sapiens
gcttccatgattct

SEQ ID NO: 4523403 - DNA, 11 bp, Homo sapiens
gcttccatgcc

SEQ ID NO: 4523404 - DNA, 12 bp, Homo sapiens
gcttccatgcct

SEQ ID NO: 4523405 - DNA, 14 bp, Homo sapiens
gcttccctgactca

SEQ ID NO: 4523406 - DNA, 17 bp, Homo sapiens
gcttccctgacttgctt

SEQ ID NO: 4523407 - DNA, 18 bp, Homo sapiens
gcttccctgacttgcttt

SEQ ID NO: 4523408 - DNA, 13 bp, Homo sapiens
gcttccctggcct

SEQ ID NO: 4523409 - DNA, 20 bp, Homo sapiens
gcttccctggcctcccgcca

SEQ ID NO: 4523410 - DNA, 17 bp, Homo sapiens
gcttccgtgagacacaa

SEQ ID NO: 4523411 - DNA, 19 bp, Homo sapiens
gcttcctcaaatacatgca

SEQ ID NO: 4523412 - DNA, 20 bp, Homo sapiens
gcttcctcaaatacatgcac

SEQ ID NO: 4523413 - DNA, 12 bp, Homo sapiens
gcttcctcctca

SEQ ID NO: 4523414 - DNA, 15 bp, Homo sapiens
gcttcctctagaagc

SEQ ID NO: 4523415 - DNA, 13 bp, Homo sapiens
gcttcctgccctt

SEQ ID NO: 4523416 - DNA, 17 bp, Homo sapiens
gcttcctgcccttccct

SEQ ID NO: 4523417 - DNA, 18 bp, Homo sapiens
gcttcctgcccttccctc

SEQ ID NO: 4523418 - DNA, 19 bp, Homo sapiens
gcttcctgcccttccctct

SEQ ID NO: 4523419 - DNA, 24 bp, Homo sapiens
gcttcctgtctgtttatatattga

SEQ ID NO: 4523420 - DNA, 22 bp, Homo sapiens
gcttcctgtgtaacatctgcca

SEQ ID NO: 4523421 - DNA, 17 bp, Homo sapiens
gcttccttagccttgct

SEQ ID NO: 4523422 - DNA, 19 bp, Homo sapiens
gcttcggagggcccctgcg

SEQ ID NO: 4523423 - DNA, 15 bp, Homo sapiens
gcttcggagtgaatg

SEQ ID NO: 4523424 - DNA, 19 bp, Homo sapiens
gcttcggagtgaatgtggc

SEQ ID NO: 4523425 - DNA, 21 bp, Homo sapiens
gcttcggagtgaatgtggcag

SEQ ID NO: 4523426 - DNA, 16 bp, Homo sapiens
gcttcggccacaggca

SEQ ID NO: 4523427 - DNA, 17 bp, Homo sapiens
gcttcggccgcgccacc

SEQ ID NO: 4523428 - DNA, 14 bp, Homo sapiens
gcttcgtttatttt

SEQ ID NO: 4523429 - DNA, 16 bp, Homo sapiens
gcttcgtttattttca

SEQ ID NO: 4523430 - DNA, 17 bp, Homo sapiens
gcttcgtttattttcaa

SEQ ID NO: 4523431 - DNA, 13 bp, Homo sapiens
gcttctactttca

SEQ ID NO: 4523432 - DNA, 16 bp, Homo sapiens
gcttctactttcatct

SEQ ID NO: 4523433 - DNA, 17 bp, Homo sapiens
gcttctagttctgccag

SEQ ID NO: 4523434 - DNA, 21 bp, Homo sapiens
gcttctagttctgccaggaga

SEQ ID NO: 4523435 - DNA, 20 bp, Homo sapiens
gcttctcacgctttgtttac

SEQ ID NO: 4523436 - DNA, 14 bp, Homo sapiens
gcttctccagggaa

SEQ ID NO: 4523437 - DNA, 14 bp, Homo sapiens
gcttctcccaagcc

SEQ ID NO: 4523438 - DNA, 14 bp, Homo sapiens
gcttctccgccagc

SEQ ID NO: 4523439 - DNA, 15 bp, Homo sapiens
gcttctccgccagcc

SEQ ID NO: 4523440 - DNA, 24 bp, Homo sapiens
gcttctccgccagcctcctctgga

SEQ ID NO: 4523441 - DNA, 21 bp, Homo sapiens
gcttctcctgttttatatatt

SEQ ID NO: 4523442 - DNA, 22 bp, Homo sapiens
gcttctcctgttttatatatta

SEQ ID NO: 4523443 - DNA, 21 bp, Homo sapiens
gcttctcgctgcgcagcctcc

SEQ ID NO: 4523444 - DNA, 22 bp, Homo sapiens
gcttctcgctgcgcagcctcca

SEQ ID NO: 4523445 - DNA, 14 bp, Homo sapiens
gcttctctctgtgg

SEQ ID NO: 4523446 - DNA, 14 bp, Homo sapiens
gcttctctttgtgc

SEQ ID NO: 4523447 - DNA, 19 bp, Homo sapiens
gcttctgagcaggggcccc

SEQ ID NO: 4523448 - DNA, 17 bp, Homo sapiens
gcttctgcagcaactcc

SEQ ID NO: 4523449 - DNA, 21 bp, Homo sapiens
gcttctgcttttctgccctgg

SEQ ID NO: 4523450 - DNA, 23 bp, Homo sapiens
gcttctgcttttctgccctggct

SEQ ID NO: 4523451 - DNA, 15 bp, Homo sapiens
gcttctgtttctagt

SEQ ID NO: 4523452 - DNA, 16 bp, Homo sapiens
gcttcttcagatcagt

SEQ ID NO: 4523453 - DNA, 20 bp, Homo sapiens
gcttcttggagctttggaat

SEQ ID NO: 4523454 - DNA, 17 bp, Homo sapiens
gcttcttgtgttttact

SEQ ID NO: 4523455 - DNA, 20 bp, Homo sapiens
gcttctttccagaaaccaaa

SEQ ID NO: 4523456 - DNA, 21 bp, Homo sapiens
gcttctttctagaaagagaaa

SEQ ID NO: 4523457 - DNA, 12 bp, Homo sapiens
gcttgaacacag

SEQ ID NO: 4523458 - DNA, 16 bp, Homo sapiens
gcttgaacacagtatt

SEQ ID NO: 4523459 - DNA, 17 bp, Homo sapiens
gcttgaacacagtattt

SEQ ID NO: 4523460 - DNA, 17 bp, Homo sapiens
gcttgaaggccagcagc

SEQ ID NO: 4523461 - DNA, 14 bp, Homo sapiens
gcttgacataccta

SEQ ID NO: 4523462 - DNA, 15 bp, Homo sapiens
gcttgagccaggagg

SEQ ID NO: 4523463 - DNA, 14 bp, Homo sapiens
gcttgagcccagga

SEQ ID NO: 4523464 - DNA, 22 bp, Homo sapiens
gcttgagtgagaagagcttgca

SEQ ID NO: 4523465 - DNA, 14 bp, Homo sapiens
gcttgatccagaag

SEQ ID NO: 4523466 - DNA, 20 bp, Homo sapiens
gcttgatccagaagagccca

SEQ ID NO: 4523467 - DNA, 11 bp, Homo sapiens
gcttgatctat

SEQ ID NO: 4523468 - DNA, 19 bp, Homo sapiens
gcttgatctatctacaaag

SEQ ID NO: 4523469 - DNA, 18 bp, Homo sapiens
gcttgatttgatctttgt

SEQ ID NO: 4523470 - DNA, 23 bp, Homo sapiens
gcttgatttgatctttgtttaaa

SEQ ID NO: 4523471 - DNA, 20 bp, Homo sapiens
gcttgcaatctaatctgaac

SEQ ID NO: 4523472 - DNA, 14 bp, Homo sapiens
gcttgccaaagtac

SEQ ID NO: 4523473 - DNA, 23 bp, Homo sapiens
gcttgcccagtacatttaaattt

SEQ ID NO: 4523474 - DNA, 17 bp, Homo sapiens
gcttgcccgctcccaca

SEQ ID NO: 4523475 - DNA, 18 bp, Homo sapiens
gcttgcccgctcccacag

SEQ ID NO: 4523476 - DNA, 17 bp, Homo sapiens
gcttgccctccaaatgt

SEQ ID NO: 4523477 - DNA, 18 bp, Homo sapiens
gcttgcggcaaaaggaaa

SEQ ID NO: 4523478 - DNA, 18 bp, Homo sapiens
gcttgctggaacacaggg

SEQ ID NO: 4523479 - DNA, 21 bp, Homo sapiens
gcttgctggaacacaggggcc

SEQ ID NO: 4523480 - DNA, 14 bp, Homo sapiens
gcttggactacaca

SEQ ID NO: 4523481 - DNA, 23 bp, Homo sapiens
gcttggactacacaatacagtat

SEQ ID NO: 4523482 - DNA, 22 bp, Homo sapiens
gcttggatttcgtgtgccgctg

SEQ ID NO: 4523483 - DNA, 15 bp, Homo sapiens
gcttggcccagcgcc

SEQ ID NO: 4523484 - DNA, 16 bp, Homo sapiens
gcttggcctgctgtga

SEQ ID NO: 4523485 - DNA, 14 bp, Homo sapiens
gcttgggatttgct

SEQ ID NO: 4523486 - DNA, 13 bp, Homo sapiens
gcttgggcctgca

SEQ ID NO: 4523487 - DNA, 14 bp, Homo sapiens
gcttgggctccacg

SEQ ID NO: 4523488 - DNA, 14 bp, Homo sapiens
gcttgggctcccac

SEQ ID NO: 4523489 - DNA, 22 bp, Homo sapiens
gcttgggtctctctcggcccct

SEQ ID NO: 4523490 - DNA, 18 bp, Homo sapiens
gcttgtcctgggcctgcc

SEQ ID NO: 4523491 - DNA, 14 bp, Homo sapiens
gcttgtctttgcta

SEQ ID NO: 4523492 - DNA, 19 bp, Homo sapiens
gcttgtgggcactgtgcca

SEQ ID NO: 4523493 - DNA, 18 bp, Homo sapiens
ggaggtggaagcagaggc

SEQ ID NO: 4523494 - DNA, 23 bp, Homo sapiens
ggaggtgggccacacccaggaag

SEQ ID NO: 4523495 - DNA, 15 bp, Homo sapiens
ggaggtgtcaggctg

SEQ ID NO: 4523496 - DNA, 14 bp, Homo sapiens
ggaggttgaagcca

SEQ ID NO: 4523497 - DNA, 17 bp, Homo sapiens
ggaggttgttgcagtga

SEQ ID NO: 4523498 - DNA, 17 bp, Homo sapiens
ggagtaaacggcccagg

SEQ ID NO: 4523499 - DNA, 14 bp, Homo sapiens
ggagtaacagggca

SEQ ID NO: 4523500 - DNA, 19 bp, Homo sapiens
ggagtaacagggcagaaat

SEQ ID NO: 4523501 - DNA, 21 bp, Homo sapiens
ggagtcacacagtgttggagg

SEQ ID NO: 4523502 - DNA, 18 bp, Homo sapiens
ggagtcagggacctgctg

SEQ ID NO: 4523503 - DNA, 13 bp, Homo sapiens
ggagtccagaccc

SEQ ID NO: 4523504 - DNA, 20 bp, Homo sapiens
ggagtccagaccccccagcc

SEQ ID NO: 4523505 - DNA, 16 bp, Homo sapiens
ggagtccagcccctcc

SEQ ID NO: 4523506 - DNA, 20 bp, Homo sapiens
ggagtccagcccctcctccc

SEQ ID NO: 4523507 - DNA, 20 bp, Homo sapiens
ggagtccaggcccccagccc

SEQ ID NO: 4523508 - DNA, 19 bp, Homo sapiens
ggagtccagggtttctctg

SEQ ID NO: 4523509 - DNA, 16 bp, Homo sapiens
ggagtcccaggggcag

SEQ ID NO: 4523510 - DNA, 17 bp, Homo sapiens
ggagtcccaggggcagc

SEQ ID NO: 4523511 - DNA, 16 bp, Homo sapiens
ggagtctgagtctgag

SEQ ID NO: 4523512 - DNA, 19 bp, Homo sapiens
ggagtctgagtctgagtcc

SEQ ID NO: 4523513 - DNA, 21 bp, Homo sapiens
ggagtgaatgtggcagtttaa

SEQ ID NO: 4523514 - DNA, 17 bp, Homo sapiens
ggagtgagacaggctgg

SEQ ID NO: 4523515 - DNA, 15 bp, Homo sapiens
ggagtgagccagcag

SEQ ID NO: 4523516 - DNA, 19 bp, Homo sapiens
ggagtgattcccaactcct

SEQ ID NO: 4523517 - DNA, 16 bp, Homo sapiens
ggagtgcagagaaaga

SEQ ID NO: 4523518 - DNA, 17 bp, Homo sapiens
ggagtgcagccttctcc

SEQ ID NO: 4523519 - DNA, 17 bp, Homo sapiens
ggagtgcagtggcatga

SEQ ID NO: 4523520 - DNA, 20 bp, Homo sapiens
ggagtggatctatttacata

SEQ ID NO: 4523521 - DNA, 12 bp, Homo sapiens
ggagtggggcct

SEQ ID NO: 4523522 - DNA, 22 bp, Homo sapiens
ggagtggggcctttgccagcag

SEQ ID NO: 4523523 - DNA, 23 bp, Homo sapiens
ggagtggggcctttgccagcaga

SEQ ID NO: 4523524 - DNA, 20 bp, Homo sapiens
ggagtggttaggcagcaagc

SEQ ID NO: 4523525 - DNA, 13 bp, Homo sapiens
ggagtgtcctctt

SEQ ID NO: 4523526 - DNA, 22 bp, Homo sapiens
ggagtgtgtaatttaaaattgt

SEQ ID NO: 4523527 - DNA, 20 bp, Homo sapiens
ggagtgttccccttccactg

SEQ ID NO: 4523528 - DNA, 18 bp, Homo sapiens
ggagtgttcccgtgcctg

SEQ ID NO: 4523529 - DNA, 24 bp, Homo sapiens
ggagttccttatccctctcttccc

SEQ ID NO: 4523530 - DNA, 20 bp, Homo sapiens
ggagttgatcgcctttccca

SEQ ID NO: 4523531 - DNA, 23 bp, Homo sapiens
ggagttgatcgcctttcccaggt

SEQ ID NO: 4523532 - DNA, 22 bp, Homo sapiens
ggagttggtgaatcggttgttc

SEQ ID NO: 4523533 - DNA, 12 bp, Homo sapiens
ggagtttctctg

SEQ ID NO: 4523534 - DNA, 20 bp, Homo sapiens
ggagtttgaggctgcaatga

SEQ ID NO: 4523535 - DNA, 14 bp, Homo sapiens
ggagtttgggctgg

SEQ ID NO: 4523536 - DNA, 15 bp, Homo sapiens
ggagtttgggctgga

SEQ ID NO: 4523537 - DNA, 18 bp, Homo sapiens
ggagtttttatgagaaac

SEQ ID NO: 4523538 - DNA, 18 bp, Homo sapiens
ggataaatcataaagtca

SEQ ID NO: 4523539 - DNA, 23 bp, Homo sapiens
ggataactgatttctatggcttt

SEQ ID NO: 4523540 - DNA, 17 bp, Homo sapiens
ggataagtggctgtttc

SEQ ID NO: 4523541 - DNA, 23 bp, Homo sapiens
ggataagtttctattctgtcagt

SEQ ID NO: 4523542 - DNA, 15 bp, Homo sapiens
ggatactggcacaga

SEQ ID NO: 4523543 - DNA, 17 bp, Homo sapiens
ggatactggcacagagg

SEQ ID NO: 4523544 - DNA, 18 bp, Homo sapiens
ggatactggcacagaggt

SEQ ID NO: 4523545 - DNA, 14 bp, Homo sapiens
ggatagaggggctg

SEQ ID NO: 4523546 - DNA, 14 bp, Homo sapiens
ggatagatgtgtgg

SEQ ID NO: 4523547 - DNA, 14 bp, Homo sapiens
ggatatggctgccc

SEQ ID NO: 4523548 - DNA, 16 bp, Homo sapiens
ggatatgggtcctctg

SEQ ID NO: 4523549 - DNA, 21 bp, Homo sapiens
ggatattaggccagttgaagt

SEQ ID NO: 4523550 - DNA, 16 bp, Homo sapiens
ggatattatagaaaat

SEQ ID NO: 4523551 - DNA, 12 bp, Homo sapiens
ggatattgcctt

SEQ ID NO: 4523552 - DNA, 17 bp, Homo sapiens
ggatattgccttatttg

SEQ ID NO: 4523553 - DNA, 21 bp, Homo sapiens
ggatattgccttatttgtctg

SEQ ID NO: 4523554 - DNA, 18 bp, Homo sapiens
ggatcaagtattactaaa

SEQ ID NO: 4523555 - DNA, 20 bp, Homo sapiens
ggatcacagaccacaggaag

SEQ ID NO: 4523556 - DNA, 21 bp, Homo sapiens
ggatcagatctggggcagcac

SEQ ID NO: 4523557 - DNA, 12 bp, Homo sapiens
ggatcagccccg

SEQ ID NO: 4523558 - DNA, 13 bp, Homo sapiens
ggatcaggaagcc

SEQ ID NO: 4523559 - DNA, 17 bp, Homo sapiens
ggatcagttgcccccca

SEQ ID NO: 4523560 - DNA, 22 bp, Homo sapiens
ggatccacgctgggcctaggat

SEQ ID NO: 4523561 - DNA, 15 bp, Homo sapiens
ggatccatcacagac

SEQ ID NO: 4523562 - DNA, 13 bp, Homo sapiens
ggatcccaaagca

SEQ ID NO: 4523563 - DNA, 17 bp, Homo sapiens
ggatcccaaagcaagga

SEQ ID NO: 4523564 - DNA, 13 bp, Homo sapiens
ggatccctcatct

SEQ ID NO: 4523565 - DNA, 19 bp, Homo sapiens
ggatccgaaacggcagcct

SEQ ID NO: 4523566 - DNA, 14 bp, Homo sapiens
ggatcctccacaga

SEQ ID NO: 4523567 - DNA, 13 bp, Homo sapiens
ggatcctgctgct

SEQ ID NO: 4523568 - DNA, 15 bp, Homo sapiens
ggatcggactctgcc

SEQ ID NO: 4523569 - DNA, 17 bp, Homo sapiens
ggatctcacaggctgag

SEQ ID NO: 4523570 - DNA, 19 bp, Homo sapiens
ggatctgggaccctttcct

SEQ ID NO: 4523571 - DNA, 20 bp, Homo sapiens
ggatcttcagaactgccctt

SEQ ID NO: 4523572 - DNA, 17 bp, Homo sapiens
ggatgacaggctctcct

SEQ ID NO: 4523573 - DNA, 19 bp, Homo sapiens
ggatgacaggctctcctgg

SEQ ID NO: 4523574 - DNA, 23 bp, Homo sapiens
ggatgagaatttgagtgctctga

SEQ ID NO: 4523575 - DNA, 22 bp, Homo sapiens
ggatgagccaaaccagcaggga

SEQ ID NO: 4523576 - DNA, 17 bp, Homo sapiens
ggatgattaaaggcagc

SEQ ID NO: 4523577 - DNA, 14 bp, Homo sapiens
ggatgattaaattt

SEQ ID NO: 4523578 - DNA, 15 bp, Homo sapiens
ggatgattcttttcc

SEQ ID NO: 4523579 - DNA, 22 bp, Homo sapiens
ggatgattgcttgagctcagga

SEQ ID NO: 4523580 - DNA, 18 bp, Homo sapiens
ggatgcatttcaaatgtt

SEQ ID NO: 4523581 - DNA, 22 bp, Homo sapiens
ggatgccaatattaaatctgct

SEQ ID NO: 4523582 - DNA, 20 bp, Homo sapiens
ggatgcccattcctgcctgg

SEQ ID NO: 4523583 - DNA, 14 bp, Homo sapiens
ggatgctgggctgg

SEQ ID NO: 4523584 - DNA, 16 bp, Homo sapiens
ggatgctgggctgggc

SEQ ID NO: 4523585 - DNA, 17 bp, Homo sapiens
ggatggaagcaggacag

SEQ ID NO: 4523586 - DNA, 18 bp, Homo sapiens
ggatggaccaacctgctc

SEQ ID NO: 4523587 - DNA, 14 bp, Homo sapiens
ggatggaggagaag

SEQ ID NO: 4523588 - DNA, 12 bp, Homo sapiens
ggatggcaagat

SEQ ID NO: 4523589 - DNA, 20 bp, Homo sapiens
ggatggccgcagggctgtgc

SEQ ID NO: 4523590 - DNA, 19 bp, Homo sapiens
ggatggcctttccttccct

SEQ ID NO: 4523591 - DNA, 23 bp, Homo sapiens
ggatgggcagcccaacagcactt

SEQ ID NO: 4523592 - DNA, 19 bp, Homo sapiens
ggatggtcttacagcaggc

SEQ ID NO: 4523593 - DNA, 21 bp, Homo sapiens
ggatggtcttacagcaggcag

SEQ ID NO: 4523594 - DNA, 16 bp, Homo sapiens
ggatggtgtcctgagg

SEQ ID NO: 4523595 - DNA, 19 bp, Homo sapiens
ggatggtgtcctgaggcct

SEQ ID NO: 4523596 - DNA, 19 bp, Homo sapiens
ggatgtaaacagtgcctgc

SEQ ID NO: 4523597 - DNA, 20 bp, Homo sapiens
ggatgtaaacagtgcctgct

SEQ ID NO: 4523598 - DNA, 21 bp, Homo sapiens
ggatgtaaacagtgcctgctg

SEQ ID NO: 4523599 - DNA, 17 bp, Homo sapiens
ggatgtagtgattaaat

SEQ ID NO: 4523600 - DNA, 14 bp, Homo sapiens
ggatgtgctggagg

SEQ ID NO: 4523601 - DNA, 15 bp, Homo sapiens
ggatgtgctggaggg

SEQ ID NO: 4523602 - DNA, 18 bp, Homo sapiens
ggatgttagacttgctcc

SEQ ID NO: 4523603 - DNA, 21 bp, Homo sapiens
ggatgttagacttgctccctc

SEQ ID NO: 4523604 - DNA, 23 bp, Homo sapiens
ggatgttggccaccaggtgcctt

SEQ ID NO: 4523605 - DNA, 20 bp, Homo sapiens
ggattaagaaaccttgctct

SEQ ID NO: 4523606 - DNA, 20 bp, Homo sapiens
ggattacgatgtaaattttt

SEQ ID NO: 4523607 - DNA, 18 bp, Homo sapiens
ggattacttctctataaa

SEQ ID NO: 4523608 - DNA, 15 bp, Homo sapiens
ggattataatcagaa

SEQ ID NO: 4523609 - DNA, 11 bp, Homo sapiens
ggattcaaatt

SEQ ID NO: 4523610 - DNA, 15 bp, Homo sapiens
ggattcaggctgctt

SEQ ID NO: 4523611 - DNA, 20 bp, Homo sapiens
ggattcagtttctaaaattg

SEQ ID NO: 4523612 - DNA, 22 bp, Homo sapiens
ggattcattctcataattccta

SEQ ID NO: 4523613 - DNA, 17 bp, Homo sapiens
ggattccttggcagccg

SEQ ID NO: 4523614 - DNA, 17 bp, Homo sapiens
ggattgcccctggcttt

SEQ ID NO: 4523615 - DNA, 23 bp, Homo sapiens
ggattgcccctggctttgcctct

SEQ ID NO: 4523616 - DNA, 16 bp, Homo sapiens
ggatttaaaagcctgc

SEQ ID NO: 4523617 - DNA, 19 bp, Homo sapiens
ggatttaaaagcctgctca

SEQ ID NO: 4523618 - DNA, 13 bp, Homo sapiens
ggatttccctgca

SEQ ID NO: 4523619 - DNA, 15 bp, Homo sapiens
ggatttccctgcaga

SEQ ID NO: 4523620 - DNA, 16 bp, Homo sapiens
ggatttgcatatttat

SEQ ID NO: 4523621 - DNA, 22 bp, Homo sapiens
ggatttggccacactggggctg

SEQ ID NO: 4523622 - DNA, 13 bp, Homo sapiens
ggattttcttttt

SEQ ID NO: 4523623 - DNA, 21 bp, Homo sapiens
ggattttttatgtacaaccct

SEQ ID NO: 4523624 - DNA, 23 bp, Homo sapiens
ggattttttatgtacaaccctga

SEQ ID NO: 4523625 - DNA, 12 bp, Homo sapiens
ggattttttcca

SEQ ID NO: 4523626 - DNA, 22 bp, Homo sapiens
ggcaaaaagaatcccaatgttt

SEQ ID NO: 4523627 - DNA, 12 bp, Homo sapiens
ggcaaaaccagt

SEQ ID NO: 4523628 - DNA, 13 bp, Homo sapiens
ggcaaaattgcaa

SEQ ID NO: 4523629 - DNA, 14 bp, Homo sapiens
ggcaaacagggcct

SEQ ID NO: 4523630 - DNA, 18 bp, Homo sapiens
ggcaaacagggcctctgc

SEQ ID NO: 4523631 - DNA, 13 bp, Homo sapiens
ggcaaacccatca

SEQ ID NO: 4523632 - DNA, 15 bp, Homo sapiens
ggcaaacctttcccc

SEQ ID NO: 4523633 - DNA, 18 bp, Homo sapiens
ggcaaagataatttattt

SEQ ID NO: 4523634 - DNA, 22 bp, Homo sapiens
ggcaaagtttaaatgtatttta

SEQ ID NO: 4523635 - DNA, 23 bp, Homo sapiens
ggcaaagttttacagagaggata

SEQ ID NO: 4523636 - DNA, 18 bp, Homo sapiens
ggcaaatcacaacattct

SEQ ID NO: 4523637 - DNA, 17 bp, Homo sapiens
ggcaaatgcctgactca

SEQ ID NO: 4523638 - DNA, 21 bp, Homo sapiens
ggcaacaagagcaaaactccg

SEQ ID NO: 4523639 - DNA, 18 bp, Homo sapiens
ggcaacagatcagtaaag

SEQ ID NO: 4523640 - DNA, 20 bp, Homo sapiens
ggcaacagatcagtaaagaa

SEQ ID NO: 4523641 - DNA, 14 bp, Homo sapiens
ggcaacatctttat

SEQ ID NO: 4523642 - DNA, 19 bp, Homo sapiens
ggcaaccaactgccccagg

SEQ ID NO: 4523643 - DNA, 20 bp, Homo sapiens
ggcaacctgcggaaggaggt

SEQ ID NO: 4523644 - DNA, 16 bp, Homo sapiens
ggcaacgtagcctggg

SEQ ID NO: 4523645 - DNA, 18 bp, Homo sapiens
ggcaagccacaggaagga

SEQ ID NO: 4523646 - DNA, 15 bp, Homo sapiens
ggcaagccctgccca

SEQ ID NO: 4523647 - DNA, 17 bp, Homo sapiens
ggcaaggaaaaagaaaa

SEQ ID NO: 4523648 - DNA, 19 bp, Homo sapiens
ggcaaggaaaaagaaaata

SEQ ID NO: 4523649 - DNA, 21 bp, Homo sapiens
ggcaagtatttttatttaaat

SEQ ID NO: 4523650 - DNA, 20 bp, Homo sapiens
ggcaatagaccgagactccg

SEQ ID NO: 4523651 - DNA, 15 bp, Homo sapiens
ggcaatcgttctgct

SEQ ID NO: 4523652 - DNA, 16 bp, Homo sapiens
ggcaattggggcggag

SEQ ID NO: 4523653 - DNA, 13 bp, Homo sapiens
ggcaatttagaaa

SEQ ID NO: 4523654 - DNA, 22 bp, Homo sapiens
ggcaatttcatactaaactgat

SEQ ID NO: 4523655 - DNA, 19 bp, Homo sapiens
ggcaattttagtgtattaa

SEQ ID NO: 4523656 - DNA, 20 bp, Homo sapiens
ggcacaacacatcaggaaag

SEQ ID NO: 4523657 - DNA, 13 bp, Homo sapiens
ggcacacacagcc

SEQ ID NO: 4523658 - DNA, 15 bp, Homo sapiens
ggcacacacagcccc

SEQ ID NO: 4523659 - DNA, 15 bp, Homo sapiens
ggcacagatgctcca

SEQ ID NO: 4523660 - DNA, 14 bp, Homo sapiens
ggcacagcccctgg

SEQ ID NO: 4523661 - DNA, 21 bp, Homo sapiens
ggcacagcccctggagcctca

SEQ ID NO: 4523662 - DNA, 22 bp, Homo sapiens
ggcacagcccctggagcctcag

SEQ ID NO: 4523663 - DNA, 23 bp, Homo sapiens
ggcacagccgcgggccaggaggc

SEQ ID NO: 4523664 - DNA, 13 bp, Homo sapiens
ggcacagcctggc

SEQ ID NO: 4523665 - DNA, 13 bp, Homo sapiens
ggcacagtccaga

SEQ ID NO: 4523666 - DNA, 13 bp, Homo sapiens
ggcacagtggctc

SEQ ID NO: 4523667 - DNA, 17 bp, Homo sapiens
ggcacatgaaaaatttt

SEQ ID NO: 4523668 - DNA, 18 bp, Homo sapiens
ggcacatgaaaaatttta

SEQ ID NO: 4523669 - DNA, 18 bp, Homo sapiens
ggcacatgccacctggca

SEQ ID NO: 4523670 - DNA, 14 bp, Homo sapiens
ggcacattgcccct

SEQ ID NO: 4523671 - DNA, 14 bp, Homo sapiens
ggcaccaggaagcc

SEQ ID NO: 4523672 - DNA, 15 bp, Homo sapiens
ggcaccaggaagccg

SEQ ID NO: 4523673 - DNA, 16 bp, Homo sapiens
ggcaccagtccagcaa

SEQ ID NO: 4523674 - DNA, 14 bp, Homo sapiens
ggcacccccatgct

SEQ ID NO: 4523675 - DNA, 12 bp, Homo sapiens
ggcaccctcagg

SEQ ID NO: 4523676 - DNA, 13 bp, Homo sapiens
ggcaccctcaggg

SEQ ID NO: 4523677 - DNA, 22 bp, Homo sapiens
ggcacctcggggacaccagagc

SEQ ID NO: 4523678 - DNA, 18 bp, Homo sapiens
ggcaccttccgacatccc

SEQ ID NO: 4523679 - DNA, 17 bp, Homo sapiens
ggcacgaacccacctgc

SEQ ID NO: 4523680 - DNA, 20 bp, Homo sapiens
ggcacgaacccacctgctga

SEQ ID NO: 4523681 - DNA, 22 bp, Homo sapiens
ggcacgtattgctgtgtctcct

SEQ ID NO: 4523682 - DNA, 17 bp, Homo sapiens
ggcactcagtgagcctc

SEQ ID NO: 4523683 - DNA, 19 bp, Homo sapiens
ggcactcagtgagcctcct

SEQ ID NO: 4523684 - DNA, 22 bp, Homo sapiens
ggcactcagtgagcctcctgtg

SEQ ID NO: 4523685 - DNA, 22 bp, Homo sapiens
ggcactccgcgccgatgccacc

SEQ ID NO: 4523686 - DNA, 23 bp, Homo sapiens
ggcactccgcgccgatgccaccg

SEQ ID NO: 4523687 - DNA, 13 bp, Homo sapiens
ggcactgccagcc

SEQ ID NO: 4523688 - DNA, 15 bp, Homo sapiens
ggcactgccagccca

SEQ ID NO: 4523689 - DNA, 21 bp, Homo sapiens
ggcactgccagcccaccccct

SEQ ID NO: 4523690 - DNA, 17 bp, Homo sapiens
ggcactgggaggcaggg

SEQ ID NO: 4523691 - DNA, 19 bp, Homo sapiens
ggcactgggaggcagggct

SEQ ID NO: 4523692 - DNA, 15 bp, Homo sapiens
ggcactggggcaggg

SEQ ID NO: 4523693 - DNA, 19 bp, Homo sapiens
ggcactgtaaggtgcttgc

SEQ ID NO: 4523694 - DNA, 23 bp, Homo sapiens
ggcactgtaaggtgcttgctccc

SEQ ID NO: 4523695 - DNA, 17 bp, Homo sapiens
ggcacttagcccaagag

SEQ ID NO: 4523696 - DNA, 15 bp, Homo sapiens
ggcacttttgatgaa

SEQ ID NO: 4523697 - DNA, 20 bp, Homo sapiens
ggcagaaaggttctgcccgg

SEQ ID NO: 4523698 - DNA, 20 bp, Homo sapiens
ggcagaacactaacctgacc

SEQ ID NO: 4523699 - DNA, 21 bp, Homo sapiens
ggcagaacactaacctgaccg

SEQ ID NO: 4523700 - DNA, 19 bp, Homo sapiens
ggcagaagagaaaggactc

SEQ ID NO: 4523701 - DNA, 17 bp, Homo sapiens
ggcagaaggcaaaccca

SEQ ID NO: 4523702 - DNA, 14 bp, Homo sapiens
ggcagaagggaatt

SEQ ID NO: 4523703 - DNA, 19 bp, Homo sapiens
ggcagagaggtaaagggtg

SEQ ID NO: 4523704 - DNA, 24 bp, Homo sapiens
ggcagagctggagcccccagcaga

SEQ ID NO: 4523705 - DNA, 19 bp, Homo sapiens
ggcagaggctggaggcagg

SEQ ID NO: 4523706 - DNA, 21 bp, Homo sapiens
ggcagaggctggaggcagggc

SEQ ID NO: 4523707 - DNA, 23 bp, Homo sapiens
ggcagaggctggaggcagggcct

SEQ ID NO: 4523708 - DNA, 19 bp, Homo sapiens
ggcagagggcagaggctgg

SEQ ID NO: 4523709 - DNA, 12 bp, Homo sapiens
ggcagagggctg

SEQ ID NO: 4523710 - DNA, 13 bp, Homo sapiens
ggcagagggctgg

SEQ ID NO: 4523711 - DNA, 18 bp, Homo sapiens
ggcagagttacagttctg

SEQ ID NO: 4523712 - DNA, 16 bp, Homo sapiens
ggcagatctgtgcccc

SEQ ID NO: 4523713 - DNA, 18 bp, Homo sapiens
ggcagattctgaattggc

SEQ ID NO: 4523714 - DNA, 15 bp, Homo sapiens
ggcagcaatttaaat

SEQ ID NO: 4523715 - DNA, 19 bp, Homo sapiens
ggcagcaccctataaatca

SEQ ID NO: 4523716 - DNA, 12 bp, Homo sapiens
ggcagcaccctc

SEQ ID NO: 4523717 - DNA, 16 bp, Homo sapiens
ggcagcaccctccccc

SEQ ID NO: 4523718 - DNA, 18 bp, Homo sapiens
ggcagcacctctggtcag

SEQ ID NO: 4523719 - DNA, 13 bp, Homo sapiens
ggcagcagaaaac

SEQ ID NO: 4523720 - DNA, 21 bp, Homo sapiens
ggcagcagggctaccctgagc

SEQ ID NO: 4523721 - DNA, 19 bp, Homo sapiens
ggcagcagtgtgaggccag

SEQ ID NO: 4523722 - DNA, 22 bp, Homo sapiens
ggcagcagtgtgaggccagggc

SEQ ID NO: 4523723 - DNA, 15 bp, Homo sapiens
ggcagccagaccagc

SEQ ID NO: 4523724 - DNA, 13 bp, Homo sapiens
ggcagccagcaga

SEQ ID NO: 4523725 - DNA, 15 bp, Homo sapiens
ggcagccagccgtgg

SEQ ID NO: 4523726 - DNA, 21 bp, Homo sapiens
ggcagccccacttcaccccca

SEQ ID NO: 4523727 - DNA, 17 bp, Homo sapiens
ggcagcctgggcctggg

SEQ ID NO: 4523728 - DNA, 15 bp, Homo sapiens
ggcagctagtgcctt

SEQ ID NO: 4523729 - DNA, 17 bp, Homo sapiens
ggcagctagtgccttta

SEQ ID NO: 4523730 - DNA, 11 bp, Homo sapiens
ggcagctgcct

SEQ ID NO: 4523731 - DNA, 16 bp, Homo sapiens
ggcagctgcctctgct

SEQ ID NO: 4523732 - DNA, 19 bp, Homo sapiens
ggcagctgcctctgctccc

SEQ ID NO: 4523733 - DNA, 18 bp, Homo sapiens
ggagcagtccatgcatga

SEQ ID NO: 4523734 - DNA, 17 bp, Homo sapiens
ggagcatgattttaaga

SEQ ID NO: 4523735 - DNA, 20 bp, Homo sapiens
ggagcatttaatggcagcta

SEQ ID NO: 4523736 - DNA, 23 bp, Homo sapiens
ggagcatttaatggcagctagtg

SEQ ID NO: 4523737 - DNA, 14 bp, Homo sapiens
ggagccaccagttc

SEQ ID NO: 4523738 - DNA, 19 bp, Homo sapiens
ggagccactcctctgactc

SEQ ID NO: 4523739 - DNA, 15 bp, Homo sapiens
ggagccacttctccc

SEQ ID NO: 4523740 - DNA, 17 bp, Homo sapiens
ggagccagactgtccag

SEQ ID NO: 4523741 - DNA, 13 bp, Homo sapiens
ggagcccagaggg

SEQ ID NO: 4523742 - DNA, 21 bp, Homo sapiens
ggagcccataggccaccccct

SEQ ID NO: 4523743 - DNA, 13 bp, Homo sapiens
ggagccccagggt

SEQ ID NO: 4523744 - DNA, 16 bp, Homo sapiens
ggagccccattcctgg

SEQ ID NO: 4523745 - DNA, 22 bp, Homo sapiens
ggagcccccagcagaggcaggc

SEQ ID NO: 4523746 - DNA, 11 bp, Homo sapiens
ggagccccctc

SEQ ID NO: 4523747 - DNA, 13 bp, Homo sapiens
ggagccccctctg

SEQ ID NO: 4523748 - DNA, 15 bp, Homo sapiens
ggagccccctctgcc

SEQ ID NO: 4523749 - DNA, 17 bp, Homo sapiens
ggagccgggtctgcctc

SEQ ID NO: 4523750 - DNA, 17 bp, Homo sapiens
ggagcctagcggagccc

SEQ ID NO: 4523751 - DNA, 17 bp, Homo sapiens
ggagcctagctcctgcc

SEQ ID NO: 4523752 - DNA, 20 bp, Homo sapiens
ggagcctccccatctgtcca

SEQ ID NO: 4523753 - DNA, 19 bp, Homo sapiens
ggagcctccccctcagatg

SEQ ID NO: 4523754 - DNA, 14 bp, Homo sapiens
ggagcctgctctcc

SEQ ID NO: 4523755 - DNA, 15 bp, Homo sapiens
ggagcctgtggccag

SEQ ID NO: 4523756 - DNA, 19 bp, Homo sapiens
ggagcctgtggccagcagc

SEQ ID NO: 4523757 - DNA, 13 bp, Homo sapiens
ggagccttcccaa

SEQ ID NO: 4523758 - DNA, 13 bp, Homo sapiens
ggagcgtctggga

SEQ ID NO: 4523759 - DNA, 16 bp, Homo sapiens
ggagcgtctgggaact

SEQ ID NO: 4523760 - DNA, 22 bp, Homo sapiens
ggagctatcaggaacagctatg

SEQ ID NO: 4523761 - DNA, 21 bp, Homo sapiens
ggagctcaggaaccgaggcag

SEQ ID NO: 4523762 - DNA, 15 bp, Homo sapiens
ggagctcctccctcc

SEQ ID NO: 4523763 - DNA, 19 bp, Homo sapiens
ggagctcctccctccagct

SEQ ID NO: 4523764 - DNA, 23 bp, Homo sapiens
ggagctcctccctccagctgcga

SEQ ID NO: 4523765 - DNA, 19 bp, Homo sapiens
ggagctcctctcctggagg

SEQ ID NO: 4523766 - DNA, 13 bp, Homo sapiens
ggagctcctggga

SEQ ID NO: 4523767 - DNA, 15 bp, Homo sapiens
ggagctcctgggacc

SEQ ID NO: 4523768 - DNA, 17 bp, Homo sapiens
ggagctcctgggaccct

SEQ ID NO: 4523769 - DNA, 16 bp, Homo sapiens
ggagctctgtatggtc

SEQ ID NO: 4523770 - DNA, 20 bp, Homo sapiens
ggagctgtcacctctcagct

SEQ ID NO: 4523771 - DNA, 22 bp, Homo sapiens
ggaggaaacctgagatctgtgt

SEQ ID NO: 4523772 - DNA, 12 bp, Homo sapiens
ggaggaaagcaa

SEQ ID NO: 4523773 - DNA, 16 bp, Homo sapiens
ggaggaaatccggtca

SEQ ID NO: 4523774 - DNA, 21 bp, Homo sapiens
ggaggaaccacaatgtttctt

SEQ ID NO: 4523775 - DNA, 20 bp, Homo sapiens
ggaggaaccgagggggctgc

SEQ ID NO: 4523776 - DNA, 19 bp, Homo sapiens
ggaggaagagccacctgca

SEQ ID NO: 4523777 - DNA, 20 bp, Homo sapiens
ggaggaagagccacctgcaa

SEQ ID NO: 4523778 - DNA, 13 bp, Homo sapiens
ggaggaaggcaag

SEQ ID NO: 4523779 - DNA, 16 bp, Homo sapiens
ggaggaagggctgggc

SEQ ID NO: 4523780 - DNA, 23 bp, Homo sapiens
ggaggacctggcgtgctcagacc

SEQ ID NO: 4523781 - DNA, 21 bp, Homo sapiens
ggaggactagaacctggaggg

SEQ ID NO: 4523782 - DNA, 21 bp, Homo sapiens
ggaggagctgcctcttctctt

SEQ ID NO: 4523783 - DNA, 16 bp, Homo sapiens
ggaggagctgggccag

SEQ ID NO: 4523784 - DNA, 15 bp, Homo sapiens
ggaggaggaaggcaa

SEQ ID NO: 4523785 - DNA, 20 bp, Homo sapiens
ggaggaggaccctggaaatg

SEQ ID NO: 4523786 - DNA, 22 bp, Homo sapiens
ggaggaggcctgggggcaggga

SEQ ID NO: 4523787 - DNA, 17 bp, Homo sapiens
ggaggaggcctgtccca

SEQ ID NO: 4523788 - DNA, 14 bp, Homo sapiens
ggaggagggcaggc

SEQ ID NO: 4523789 - DNA, 15 bp, Homo sapiens
ggaggagggggccgg

SEQ ID NO: 4523790 - DNA, 18 bp, Homo sapiens
ggaggatggtgtcctgag

SEQ ID NO: 4523791 - DNA, 19 bp, Homo sapiens
ggaggattctttccccaga

SEQ ID NO: 4523792 - DNA, 15 bp, Homo sapiens
ggaggattgccttta

SEQ ID NO: 4523793 - DNA, 14 bp, Homo sapiens
ggaggcagagacct

SEQ ID NO: 4523794 - DNA, 15 bp, Homo sapiens
ggaggcagccacagg

SEQ ID NO: 4523795 - DNA, 13 bp, Homo sapiens
ggaggcagctcag

SEQ ID NO: 4523796 - DNA, 13 bp, Homo sapiens
ggaggccacccca

SEQ ID NO: 4523797 - DNA, 23 bp, Homo sapiens
ggaggccaccccaaaccccagcc

SEQ ID NO: 4523798 - DNA, 16 bp, Homo sapiens
ggaggcccaggctggg

SEQ ID NO: 4523799 - DNA, 20 bp, Homo sapiens
ggaggcccaggctgggaact

SEQ ID NO: 4523800 - DNA, 18 bp, Homo sapiens
ggaggccctaggggagca

SEQ ID NO: 4523801 - DNA, 17 bp, Homo sapiens
ggaggcgaataaatgtt

SEQ ID NO: 4523802 - DNA, 18 bp, Homo sapiens
ggaggcgaataaatgttc

SEQ ID NO: 4523803 - DNA, 18 bp, Homo sapiens
ggaggcgtgcccccctcc

SEQ ID NO: 4523804 - DNA, 22 bp, Homo sapiens
ggaggctacccgctgtggccgg

SEQ ID NO: 4523805 - DNA, 18 bp, Homo sapiens
ggaggctccagagggcac

SEQ ID NO: 4523806 - DNA, 15 bp, Homo sapiens
ggaggctgagatggg

SEQ ID NO: 4523807 - DNA, 14 bp, Homo sapiens
ggaggctgaggcag

SEQ ID NO: 4523808 - DNA, 16 bp, Homo sapiens
ggaggctgaggcagaa

SEQ ID NO: 4523809 - DNA, 13 bp, Homo sapiens
ggaggctgccccc

SEQ ID NO: 4523810 - DNA, 17 bp, Homo sapiens
ggaggctgcccccggcc

SEQ ID NO: 4523811 - DNA, 22 bp, Homo sapiens
ggaggctgcccccggccccctg

SEQ ID NO: 4523812 - DNA, 13 bp, Homo sapiens
ggaggctggcagg

SEQ ID NO: 4523813 - DNA, 23 bp, Homo sapiens
ggaggctgggcccctgggatggg

SEQ ID NO: 4523814 - DNA, 13 bp, Homo sapiens
ggaggctggggcc

SEQ ID NO: 4523815 - DNA, 15 bp, Homo sapiens
ggaggcttcctgcgt

SEQ ID NO: 4523816 - DNA, 18 bp, Homo sapiens
ggagggaaggggaatgga

SEQ ID NO: 4523817 - DNA, 17 bp, Homo sapiens
ggagggaggagggagtg

SEQ ID NO: 4523818 - DNA, 11 bp, Homo sapiens
ggagggatcag

SEQ ID NO: 4523819 - DNA, 15 bp, Homo sapiens
ggagggatcagcccc

SEQ ID NO: 4523820 - DNA, 22 bp, Homo sapiens
ggagggatcagccccgcctgtc

SEQ ID NO: 4523821 - DNA, 21 bp, Homo sapiens
ggagggatcagttgcccccca

SEQ ID NO: 4523822 - DNA, 22 bp, Homo sapiens
ggagggatggagaggcggcctc

SEQ ID NO: 4523823 - DNA, 16 bp, Homo sapiens
ggagggcagcagggct

SEQ ID NO: 4523824 - DNA, 23 bp, Homo sapiens
ggagggccacatgggaggctcac

SEQ ID NO: 4523825 - DNA, 14 bp, Homo sapiens
ggagggcccctgcg

SEQ ID NO: 4523826 - DNA, 16 bp, Homo sapiens
ggagggctagaaccta

SEQ ID NO: 4523827 - DNA, 20 bp, Homo sapiens
ggagggctagaacctagaag

SEQ ID NO: 4523828 - DNA, 21 bp, Homo sapiens
ggagggctagaacctggaagg

SEQ ID NO: 4523829 - DNA, 22 bp, Homo sapiens
ggagggctagaatctggagagc

SEQ ID NO: 4523830 - DNA, 19 bp, Homo sapiens
ggagggctcatgggtggga

SEQ ID NO: 4523831 - DNA, 20 bp, Homo sapiens
ggagggctggaatctggaga

SEQ ID NO: 4523832 - DNA, 22 bp, Homo sapiens
ggagggctttgaatctgggact

SEQ ID NO: 4523833 - DNA, 16 bp, Homo sapiens
ggaggggaaacaatga

SEQ ID NO: 4523834 - DNA, 17 bp, Homo sapiens
ggaggggaaacaatgaa

SEQ ID NO: 4523835 - DNA, 20 bp, Homo sapiens
ggaggggagagacaggcagc

SEQ ID NO: 4523836 - DNA, 20 bp, Homo sapiens
ggaggggagcgtctgggaac

SEQ ID NO: 4523837 - DNA, 22 bp, Homo sapiens
ggaggggcttgggcctgcaccc

SEQ ID NO: 4523838 - DNA, 15 bp, Homo sapiens
ggagggggctggggt

SEQ ID NO: 4523839 - DNA, 19 bp, Homo sapiens
ggagggggctggggtcaca

SEQ ID NO: 4523840 - DNA, 21 bp, Homo sapiens
ggagggggctggggtcacaga

SEQ ID NO: 4523841 - DNA, 22 bp, Homo sapiens
ggagggggctggggtcacagag

SEQ ID NO: 4523842 - DNA, 18 bp, Homo sapiens
ggagggggcttgaagcca

SEQ ID NO: 4523843 - DNA, 21 bp, Homo sapiens
ggagggggcttgaagccaaag

SEQ ID NO: 4523844 - DNA, 13 bp, Homo sapiens
ggaggggtggccc

SEQ ID NO: 4523845 - DNA, 16 bp, Homo sapiens
ggaggggtggcccaga

SEQ ID NO: 4523846 - DNA, 17 bp, Homo sapiens
ggaggggtgtggcagtg

SEQ ID NO: 4523847 - DNA, 14 bp, Homo sapiens
ggagggtcccaagc

SEQ ID NO: 4523848 - DNA, 20 bp, Homo sapiens
ggagggtcccaagctgggcc

SEQ ID NO: 4523849 - DNA, 14 bp, Homo sapiens
ggagggtgggaagg

SEQ ID NO: 4523850 - DNA, 18 bp, Homo sapiens
ggaggtgctgggggagcc

SEQ ID NO: 4523851 - DNA, 16 bp, Homo sapiens
ggaggtgctgtcccca

SEQ ID NO: 4523852 - DNA, 22 bp, Homo sapiens
ggaggtgctgtccccactgccc

SEQ ID NO: 4523853 - DNA, 16 bp, Homo sapiens
gcttgtgttctgctcc

SEQ ID NO: 4523854 - DNA, 18 bp, Homo sapiens
gcttgttccaatgccaca

SEQ ID NO: 4523855 - DNA, 18 bp, Homo sapiens
gctttaaaagtcattatt

SEQ ID NO: 4523856 - DNA, 20 bp, Homo sapiens
gctttaaaagtcattattcc

SEQ ID NO: 4523857 - DNA, 12 bp, Homo sapiens
gctttaaataaa

SEQ ID NO: 4523858 - DNA, 15 bp, Homo sapiens
gctttaaataaatta

SEQ ID NO: 4523859 - DNA, 22 bp, Homo sapiens
gctttaaataaattaagatcct

SEQ ID NO: 4523860 - DNA, 14 bp, Homo sapiens
gctttaaatgacag

SEQ ID NO: 4523861 - DNA, 19 bp, Homo sapiens
gctttaaatgacagtaata

SEQ ID NO: 4523862 - DNA, 22 bp, Homo sapiens
gctttaaatgacagtaatattg

SEQ ID NO: 4523863 - DNA, 22 bp, Homo sapiens
gctttaatatgagcttcaatat

SEQ ID NO: 4523864 - DNA, 13 bp, Homo sapiens
gctttaatcagaa

SEQ ID NO: 4523865 - DNA, 19 bp, Homo sapiens
gctttacatactttatcaa

SEQ ID NO: 4523866 - DNA, 20 bp, Homo sapiens
gctttactcaagcagatctc

SEQ ID NO: 4523867 - DNA, 20 bp, Homo sapiens
gctttagaaacagtgcaaca

SEQ ID NO: 4523868 - DNA, 17 bp, Homo sapiens
gctttatactgagcttt

SEQ ID NO: 4523869 - DNA, 11 bp, Homo sapiens
gctttatgatt

SEQ ID NO: 4523870 - DNA, 18 bp, Homo sapiens
gctttatgattttcataa

SEQ ID NO: 4523871 - DNA, 18 bp, Homo sapiens
gctttattaaagaaataa

SEQ ID NO: 4523872 - DNA, 18 bp, Homo sapiens
gctttattgaattagaaa

SEQ ID NO: 4523873 - DNA, 19 bp, Homo sapiens
gctttattgaattagaaaa

SEQ ID NO: 4523874 - DNA, 19 bp, Homo sapiens
gctttcagagccagcctgg

SEQ ID NO: 4523875 - DNA, 20 bp, Homo sapiens
gctttcagagccagcctggc

SEQ ID NO: 4523876 - DNA, 15 bp, Homo sapiens
gctttcatgtaaact

SEQ ID NO: 4523877 - DNA, 14 bp, Homo sapiens
gctttccagctcac

SEQ ID NO: 4523878 - DNA, 23 bp, Homo sapiens
gctttccaggcaccctcagggag

SEQ ID NO: 4523879 - DNA, 19 bp, Homo sapiens
gctttcccccaactcagga

SEQ ID NO: 4523880 - DNA, 15 bp, Homo sapiens
gctttccctgcctct

SEQ ID NO: 4523881 - DNA, 23 bp, Homo sapiens
gctttcctaaagtctctgctgct

SEQ ID NO: 4523882 - DNA, 18 bp, Homo sapiens
gctttcctatctagcatt

SEQ ID NO: 4523883 - DNA, 20 bp, Homo sapiens
gctttcctcaaaaagcagaa

SEQ ID NO: 4523884 - DNA, 23 bp, Homo sapiens
gctttcctcaaaaagcagaagga

SEQ ID NO: 4523885 - DNA, 12 bp, Homo sapiens
gctttcctgaat

SEQ ID NO: 4523886 - DNA, 14 bp, Homo sapiens
gctttcctgcagca

SEQ ID NO: 4523887 - DNA, 22 bp, Homo sapiens
gctttcctgcagcagtcgccca

SEQ ID NO: 4523888 - DNA, 12 bp, Homo sapiens
gctttcctgggc

SEQ ID NO: 4523889 - DNA, 15 bp, Homo sapiens
gctttcctggtccct

SEQ ID NO: 4523890 - DNA, 15 bp, Homo sapiens
gctttctattgtaca

SEQ ID NO: 4523891 - DNA, 17 bp, Homo sapiens
gctttctattgtacaga

SEQ ID NO: 4523892 - DNA, 16 bp, Homo sapiens
gctttctctctcatgc

SEQ ID NO: 4523893 - DNA, 14 bp, Homo sapiens
gctttctggggcct

SEQ ID NO: 4523894 - DNA, 13 bp, Homo sapiens
gctttctgttcca

SEQ ID NO: 4523895 - DNA, 15 bp, Homo sapiens
gctttcttacctact

SEQ ID NO: 4523896 - DNA, 21 bp, Homo sapiens
gctttcttgtcttttcagaag

SEQ ID NO: 4523897 - DNA, 17 bp, Homo sapiens
gctttgaatctgggact

SEQ ID NO: 4523898 - DNA, 17 bp, Homo sapiens
gctttgagtccacgccc

SEQ ID NO: 4523899 - DNA, 20 bp, Homo sapiens
gctttgattcatagtaactt

SEQ ID NO: 4523900 - DNA, 17 bp, Homo sapiens
gctttgcatgttccact

SEQ ID NO: 4523901 - DNA, 12 bp, Homo sapiens
gctttgccaaaa

SEQ ID NO: 4523902 - DNA, 21 bp, Homo sapiens
gctttgccaaaataccagagc

SEQ ID NO: 4523903 - DNA, 12 bp, Homo sapiens
gctttgcctctt

SEQ ID NO: 4523904 - DNA, 13 bp, Homo sapiens
gctttgcctcttc

SEQ ID NO: 4523905 - DNA, 14 bp, Homo sapiens
gctttggcactctc

SEQ ID NO: 4523906 - DNA, 18 bp, Homo sapiens
gctttggtaaaacagttt

SEQ ID NO: 4523907 - DNA, 20 bp, Homo sapiens
gctttggtaaaacagtttca

SEQ ID NO: 4523908 - DNA, 20 bp, Homo sapiens
gctttggttaagggctccct

SEQ ID NO: 4523909 - DNA, 16 bp, Homo sapiens
gctttgtacttgtgat

SEQ ID NO: 4523910 - DNA, 13 bp, Homo sapiens
gctttgtatgttt

SEQ ID NO: 4523911 - DNA, 18 bp, Homo sapiens
gctttgtatgtttatgaa

SEQ ID NO: 4523912 - DNA, 18 bp, Homo sapiens
gctttgtcacttgccaca

SEQ ID NO: 4523913 - DNA, 19 bp, Homo sapiens
gctttgtcacttgccacat

SEQ ID NO: 4523914 - DNA, 23 bp, Homo sapiens
gctttgttaaaaaaaaaaagatt

SEQ ID NO: 4523915 - DNA, 15 bp, Homo sapiens
gctttgtttactctc

SEQ ID NO: 4523916 - DNA, 16 bp, Homo sapiens
gctttgttttccctgg

SEQ ID NO: 4523917 - DNA, 20 bp, Homo sapiens
gcttttaaaagtgcacatta

SEQ ID NO: 4523918 - DNA, 14 bp, Homo sapiens
gcttttatggatga

SEQ ID NO: 4523919 - DNA, 14 bp, Homo sapiens
gcttttattgcacc

SEQ ID NO: 4523920 - DNA, 22 bp, Homo sapiens
gcttttattgcaccattttcaa

SEQ ID NO: 4523921 - DNA, 16 bp, Homo sapiens
gcttttccctttgtga

SEQ ID NO: 4523922 - DNA, 12 bp, Homo sapiens
gcttttcctctg

SEQ ID NO: 4523923 - DNA, 13 bp, Homo sapiens
gcttttctaatta

SEQ ID NO: 4523924 - DNA, 17 bp, Homo sapiens
gcttttctgccctggct

SEQ ID NO: 4523925 - DNA, 15 bp, Homo sapiens
gcttttctttttctg

SEQ ID NO: 4523926 - DNA, 17 bp, Homo sapiens
gcttttgcctgtaagaa

SEQ ID NO: 4523927 - DNA, 14 bp, Homo sapiens
gcttttgcttgcaa

SEQ ID NO: 4523928 - DNA, 14 bp, Homo sapiens
gcttttggttaata

SEQ ID NO: 4523929 - DNA, 14 bp, Homo sapiens
gcttttgttgttta

SEQ ID NO: 4523930 - DNA, 16 bp, Homo sapiens
gctttttaatagcact

SEQ ID NO: 4523931 - DNA, 12 bp, Homo sapiens
gctttttataaa

SEQ ID NO: 4523932 - DNA, 14 bp, Homo sapiens
gctttttattccct

SEQ ID NO: 4523933 - DNA, 20 bp, Homo sapiens
gctttttattccctgcccaa

SEQ ID NO: 4523934 - DNA, 17 bp, Homo sapiens
gctttttatttctgcat

SEQ ID NO: 4523935 - DNA, 21 bp, Homo sapiens
gctttttatttctgcatatgt

SEQ ID NO: 4523936 - DNA, 15 bp, Homo sapiens
gctttttcacagtca

SEQ ID NO: 4523937 - DNA, 12 bp, Homo sapiens
gctttttggaaa

SEQ ID NO: 4523938 - DNA, 13 bp, Homo sapiens
gctttttggaatc

SEQ ID NO: 4523939 - DNA, 16 bp, Homo sapiens
gctttttgtgtttttt

SEQ ID NO: 4523940 - DNA, 20 bp, Homo sapiens
gcttttttccaaaacaaaaa

SEQ ID NO: 4523941 - DNA, 21 bp, Homo sapiens
gcttttttcctgttggtttca

SEQ ID NO: 4523942 - DNA, 18 bp, Homo sapiens
gcttttttctcaataaaa

SEQ ID NO: 4523943 - DNA, 15 bp, Homo sapiens
gctttttttttctct

SEQ ID NO: 4523944 - DNA, 18 bp, Homo sapiens
ggaaaaaaactgggataa

SEQ ID NO: 4523945 - DNA, 13 bp, Homo sapiens
ggaaaaaaacttt

SEQ ID NO: 4523946 - DNA, 12 bp, Homo sapiens
ggaaaaaaatgt

SEQ ID NO: 4523947 - DNA, 13 bp, Homo sapiens
ggaaaaaaatgtt

SEQ ID NO: 4523948 - DNA, 15 bp, Homo sapiens
ggaaaaaatatttta

SEQ ID NO: 4523949 - DNA, 13 bp, Homo sapiens
ggaaaaagaaaat

SEQ ID NO: 4523950 - DNA, 20 bp, Homo sapiens
ggaaaaagaaaataaagaca

SEQ ID NO: 4523951 - DNA, 23 bp, Homo sapiens
ggaaaaagcaagttcgtctgttg

SEQ ID NO: 4523952 - DNA, 17 bp, Homo sapiens
ggaaaagaaagaagtta

SEQ ID NO: 4523953 - DNA, 12 bp, Homo sapiens
ggaaaaggcccc

SEQ ID NO: 4523954 - DNA, 16 bp, Homo sapiens
ggaaaaggcccctgca

SEQ ID NO: 4523955 - DNA, 12 bp, Homo sapiens
ggaaaagggaag

SEQ ID NO: 4523956 - DNA, 20 bp, Homo sapiens
ggaaaaggttgaataatata

SEQ ID NO: 4523957 - DNA, 17 bp, Homo sapiens
ggaaaagttctttcaac

SEQ ID NO: 4523958 - DNA, 22 bp, Homo sapiens
ggaaaataggaagtgaacccat

SEQ ID NO: 4523959 - DNA, 19 bp, Homo sapiens
ggaaaataggctttttaat

SEQ ID NO: 4523960 - DNA, 19 bp, Homo sapiens
ggaaaatgccatgaattac

SEQ ID NO: 4523961 - DNA, 17 bp, Homo sapiens
ggaaaatgtattgattc

SEQ ID NO: 4523962 - DNA, 12 bp, Homo sapiens
ggaaaattattt

SEQ ID NO: 4523963 - DNA, 15 bp, Homo sapiens
ggaaaattattttga

SEQ ID NO: 4523964 - DNA, 17 bp, Homo sapiens
ggaaaattattttgaca

SEQ ID NO: 4523965 - DNA, 14 bp, Homo sapiens
ggaaaattcatttt

SEQ ID NO: 4523966 - DNA, 14 bp, Homo sapiens
ggaaaattgcccca

SEQ ID NO: 4523967 - DNA, 11 bp, Homo sapiens
ggaaacaatga

SEQ ID NO: 4523968 - DNA, 13 bp, Homo sapiens
ggaaacaatgaaa

SEQ ID NO: 4523969 - DNA, 17 bp, Homo sapiens
ggaaacctgagatctgt

SEQ ID NO: 4523970 - DNA, 19 bp, Homo sapiens
ggaaactatgtgtttttct

SEQ ID NO: 4523971 - DNA, 20 bp, Homo sapiens
ggaaactccacatctgcctt

SEQ ID NO: 4523972 - DNA, 17 bp, Homo sapiens
ggaaactcctgtgacca

SEQ ID NO: 4523973 - DNA, 13 bp, Homo sapiens
ggaaactgagtca

SEQ ID NO: 4523974 - DNA, 20 bp, Homo sapiens
ggaaactgccaaacctcctg

SEQ ID NO: 4523975 - DNA, 13 bp, Homo sapiens
ggaaactggctga

SEQ ID NO: 4523976 - DNA, 22 bp, Homo sapiens
ggaaactgggtttctcattaaa

SEQ ID NO: 4523977 - DNA, 15 bp, Homo sapiens
ggaaagcaataaatg

SEQ ID NO: 4523978 - DNA, 11 bp, Homo sapiens
ggaaagcaggt

SEQ ID NO: 4523979 - DNA, 16 bp, Homo sapiens
ggaaagcttttcagtg

SEQ ID NO: 4523980 - DNA, 21 bp, Homo sapiens
ggaaaggatgatcaaaaataa

SEQ ID NO: 4523981 - DNA, 20 bp, Homo sapiens
ggaaaggctcatttaaaaca

SEQ ID NO: 4523982 - DNA, 14 bp, Homo sapiens
ggaaaggggagagc

SEQ ID NO: 4523983 - DNA, 19 bp, Homo sapiens
ggaaagtacactctgctgt

SEQ ID NO: 4523984 - DNA, 21 bp, Homo sapiens
ggaaagtgccagcattccaga

SEQ ID NO: 4523985 - DNA, 20 bp, Homo sapiens
ggaaagtgtgagctcttccc

SEQ ID NO: 4523986 - DNA, 20 bp, Homo sapiens
ggaaagttttctccactgga

SEQ ID NO: 4523987 - DNA, 15 bp, Homo sapiens
ggaaataaaaaagtc

SEQ ID NO: 4523988 - DNA, 22 bp, Homo sapiens
ggaaataaaaaagtctctattt

SEQ ID NO: 4523989 - DNA, 16 bp, Homo sapiens
ggaaatagcggccctg

SEQ ID NO: 4523990 - DNA, 17 bp, Homo sapiens
ggaaatagcggccctgg

SEQ ID NO: 4523991 - DNA, 20 bp, Homo sapiens
ggaaatagcggccctggagg

SEQ ID NO: 4523992 - DNA, 21 bp, Homo sapiens
ggaaatagcggccctggagga

SEQ ID NO: 4523993 - DNA, 17 bp, Homo sapiens
ggaaatcagtagaaagc

SEQ ID NO: 4523994 - DNA, 15 bp, Homo sapiens
ggaaatgaagcaggg

SEQ ID NO: 4523995 - DNA, 15 bp, Homo sapiens
ggaaatgtacacttt

SEQ ID NO: 4523996 - DNA, 17 bp, Homo sapiens
ggaaatgtagcacttac

SEQ ID NO: 4523997 - DNA, 20 bp, Homo sapiens
ggaaatgtgctcaaattact

SEQ ID NO: 4523998 - DNA, 21 bp, Homo sapiens
ggaaattagataaataaaaat

SEQ ID NO: 4523999 - DNA, 17 bp, Homo sapiens
ggaacaaagacaggcaa

SEQ ID NO: 4524000 - DNA, 19 bp, Homo sapiens
ggaacaagatgctgatcca

SEQ ID NO: 4524001 - DNA, 12 bp, Homo sapiens
ggaacaaggaag

SEQ ID NO: 4524002 - DNA, 13 bp, Homo sapiens
ggaacacaggggc

SEQ ID NO: 4524003 - DNA, 22 bp, Homo sapiens
ggaacacctgatcttacagaaa

SEQ ID NO: 4524004 - DNA, 20 bp, Homo sapiens
ggaacagctatgggagcccc

SEQ ID NO: 4524005 - DNA, 13 bp, Homo sapiens
ggaacagtgcatg

SEQ ID NO: 4524006 - DNA, 15 bp, Homo sapiens
ggaacatgtgcttca

SEQ ID NO: 4524007 - DNA, 19 bp, Homo sapiens
ggaaccacaatgtttcttc

SEQ ID NO: 4524008 - DNA, 15 bp, Homo sapiens
ggaaccgaggcaggg

SEQ ID NO: 4524009 - DNA, 16 bp, Homo sapiens
ggaacctcgagtactg

SEQ ID NO: 4524010 - DNA, 17 bp, Homo sapiens
ggaacctcgagtactgt

SEQ ID NO: 4524011 - DNA, 22 bp, Homo sapiens
ggaacctcgagtactgtgggca

SEQ ID NO: 4524012 - DNA, 22 bp, Homo sapiens
ggaacctgtcctaaggaacctt

SEQ ID NO: 4524013 - DNA, 15 bp, Homo sapiens
ggaaccttccctcca

SEQ ID NO: 4524014 - DNA, 16 bp, Homo sapiens
ggaaccttccttcctg

SEQ ID NO: 4524015 - DNA, 19 bp, Homo sapiens
ggaaccttccttcctgctt

SEQ ID NO: 4524016 - DNA, 20 bp, Homo sapiens
ggaaccttccttcctgcttg

SEQ ID NO: 4524017 - DNA, 18 bp, Homo sapiens
ggaacgggcagcctgggc

SEQ ID NO: 4524018 - DNA, 19 bp, Homo sapiens
ggaactatacccgggacca

SEQ ID NO: 4524019 - DNA, 13 bp, Homo sapiens
ggaactgcagacc

SEQ ID NO: 4524020 - DNA, 20 bp, Homo sapiens
ggaactgctgggcttggcag

SEQ ID NO: 4524021 - DNA, 14 bp, Homo sapiens
ggaactgggctggc

SEQ ID NO: 4524022 - DNA, 15 bp, Homo sapiens
ggaactgtgtattta

SEQ ID NO: 4524023 - DNA, 22 bp, Homo sapiens
ggaacttgcgagtccaaggcca

SEQ ID NO: 4524024 - DNA, 11 bp, Homo sapiens
ggaacttgtct

SEQ ID NO: 4524025 - DNA, 16 bp, Homo sapiens
ggaactttatttacac

SEQ ID NO: 4524026 - DNA, 16 bp, Homo sapiens
ggaagaaaactatcct

SEQ ID NO: 4524027 - DNA, 14 bp, Homo sapiens
ggaagaaagcaaca

SEQ ID NO: 4524028 - DNA, 22 bp, Homo sapiens
ggaagaacagccccggggcccc

SEQ ID NO: 4524029 - DNA, 13 bp, Homo sapiens
ggaagaagggaga

SEQ ID NO: 4524030 - DNA, 18 bp, Homo sapiens
ggaagaagggagaagaaa

SEQ ID NO: 4524031 - DNA, 16 bp, Homo sapiens
ggaagactcaggagtc

SEQ ID NO: 4524032 - DNA, 18 bp, Homo sapiens
ggaagactcaggagtctg

SEQ ID NO: 4524033 - DNA, 20 bp, Homo sapiens
ggaagactcaggagtctgcc

SEQ ID NO: 4524034 - DNA, 17 bp, Homo sapiens
ggaagagacagcccagg

SEQ ID NO: 4524035 - DNA, 13 bp, Homo sapiens
ggaagagagaaag

SEQ ID NO: 4524036 - DNA, 16 bp, Homo sapiens
ggaagagcaggactcc

SEQ ID NO: 4524037 - DNA, 23 bp, Homo sapiens
ggaagagcaggactccaggccca

SEQ ID NO: 4524038 - DNA, 15 bp, Homo sapiens
ggaagagccacctgc

SEQ ID NO: 4524039 - DNA, 19 bp, Homo sapiens
ggaagagccacctgcaaga

SEQ ID NO: 4524040 - DNA, 15 bp, Homo sapiens
ggaagaggttttatt

SEQ ID NO: 4524041 - DNA, 14 bp, Homo sapiens
ggaagatagctgtg

SEQ ID NO: 4524042 - DNA, 17 bp, Homo sapiens
ggaagatttggaagctc

SEQ ID NO: 4524043 - DNA, 18 bp, Homo sapiens
ggaagcaagacgtaaaga

SEQ ID NO: 4524044 - DNA, 15 bp, Homo sapiens
ggaagcagaggccct

SEQ ID NO: 4524045 - DNA, 20 bp, Homo sapiens
ggaagcagaggccctgcccc

SEQ ID NO: 4524046 - DNA, 21 bp, Homo sapiens
ggaagcatgtaggagaatcca

SEQ ID NO: 4524047 - DNA, 13 bp, Homo sapiens
ggaagccagagcc

SEQ ID NO: 4524048 - DNA, 14 bp, Homo sapiens
ggaagccagagccc

SEQ ID NO: 4524049 - DNA, 16 bp, Homo sapiens
ggaagccagctttccc

SEQ ID NO: 4524050 - DNA, 20 bp, Homo sapiens
ggaagccatcccttttttta

SEQ ID NO: 4524051 - DNA, 18 bp, Homo sapiens
ggaagccattttccagtg

SEQ ID NO: 4524052 - DNA, 18 bp, Homo sapiens
ggaagcccagcccaagca

SEQ ID NO: 4524053 - DNA, 19 bp, Homo sapiens
ggaagcccaggagcctcac

SEQ ID NO: 4524054 - DNA, 15 bp, Homo sapiens
ggaagcccctgggcc

SEQ ID NO: 4524055 - DNA, 12 bp, Homo sapiens
ggaagccctcct

SEQ ID NO: 4524056 - DNA, 15 bp, Homo sapiens
ggaagccctggattt

SEQ ID NO: 4524057 - DNA, 13 bp, Homo sapiens
ggaagcctgggtg

SEQ ID NO: 4524058 - DNA, 22 bp, Homo sapiens
ggaagctagacacatgaaggta

SEQ ID NO: 4524059 - DNA, 13 bp, Homo sapiens
ggaagctcttctt

SEQ ID NO: 4524060 - DNA, 13 bp, Homo sapiens
ggaagcttctgtc

SEQ ID NO: 4524061 - DNA, 17 bp, Homo sapiens
ggaaggaaataaacatt

SEQ ID NO: 4524062 - DNA, 15 bp, Homo sapiens
ggaaggaacaaagac

SEQ ID NO: 4524063 - DNA, 18 bp, Homo sapiens
ggaaggaacatggagctg

SEQ ID NO: 4524064 - DNA, 15 bp, Homo sapiens
ggaaggaagaacagt

SEQ ID NO: 4524065 - DNA, 20 bp, Homo sapiens
ggaaggacagtccctgctgg

SEQ ID NO: 4524066 - DNA, 15 bp, Homo sapiens
ggaaggagactcacc

SEQ ID NO: 4524067 - DNA, 20 bp, Homo sapiens
ggaaggagactcacctctgc

SEQ ID NO: 4524068 - DNA, 15 bp, Homo sapiens
ggaaggagacttagg

SEQ ID NO: 4524069 - DNA, 13 bp, Homo sapiens
ggaaggagagcct

SEQ ID NO: 4524070 - DNA, 15 bp, Homo sapiens
ggaaggcagagaaat

SEQ ID NO: 4524071 - DNA, 21 bp, Homo sapiens
ggaaggcccaactggttcagg

SEQ ID NO: 4524072 - DNA, 20 bp, Homo sapiens
ggaaggcctgacttctgctg

SEQ ID NO: 4524073 - DNA, 12 bp, Homo sapiens
ggaagggctggg

SEQ ID NO: 4524074 - DNA, 19 bp, Homo sapiens
ggaaggggttcctcaaatt

SEQ ID NO: 4524075 - DNA, 15 bp, Homo sapiens
ggaagtagctgtcag

SEQ ID NO: 4524076 - DNA, 16 bp, Homo sapiens
ggaagtaggaagtaaa

SEQ ID NO: 4524077 - DNA, 18 bp, Homo sapiens
ggaagtagtccttggcat

SEQ ID NO: 4524078 - DNA, 15 bp, Homo sapiens
ggaagtccaatgtgg

SEQ ID NO: 4524079 - DNA, 16 bp, Homo sapiens
ggaagtccaatgtggc

SEQ ID NO: 4524080 - DNA, 12 bp, Homo sapiens
ggaagtgtgggt

SEQ ID NO: 4524081 - DNA, 21 bp, Homo sapiens
ggaagtgtgggtctgtgtgtg

SEQ ID NO: 4524082 - DNA, 15 bp, Homo sapiens
ggaagtgtgtttgcc

SEQ ID NO: 4524083 - DNA, 13 bp, Homo sapiens
ggaagtttagaga

SEQ ID NO: 4524084 - DNA, 23 bp, Homo sapiens
ggaagttttaactttaatacagc

SEQ ID NO: 4524085 - DNA, 15 bp, Homo sapiens
ggaataaagttgcag

SEQ ID NO: 4524086 - DNA, 18 bp, Homo sapiens
ggaataaggcccagagcg

SEQ ID NO: 4524087 - DNA, 19 bp, Homo sapiens
ggaataaggtacaagaagc

SEQ ID NO: 4524088 - DNA, 14 bp, Homo sapiens
ggaataattgcttt

SEQ ID NO: 4524089 - DNA, 14 bp, Homo sapiens
ggaatacattttat

SEQ ID NO: 4524090 - DNA, 20 bp, Homo sapiens
ggaatatctgttcccagccc

SEQ ID NO: 4524091 - DNA, 15 bp, Homo sapiens
ggaatattaaaaaac

SEQ ID NO: 4524092 - DNA, 15 bp, Homo sapiens
ggaatattttatcct

SEQ ID NO: 4524093 - DNA, 16 bp, Homo sapiens
ggaatattttatcctg

SEQ ID NO: 4524094 - DNA, 20 bp, Homo sapiens
ggaatcacccctctgcccct

SEQ ID NO: 4524095 - DNA, 22 bp, Homo sapiens
ggaatcacccctctgcccctgc

SEQ ID NO: 4524096 - DNA, 14 bp, Homo sapiens
ggactatcaggtaa

SEQ ID NO: 4524097 - DNA, 14 bp, Homo sapiens
ggactatctttgct

SEQ ID NO: 4524098 - DNA, 16 bp, Homo sapiens
ggactattatgtggaa

SEQ ID NO: 4524099 - DNA, 17 bp, Homo sapiens
ggactcagccctgaggt

SEQ ID NO: 4524100 - DNA, 22 bp, Homo sapiens
ggactccaggcccaaggctccc

SEQ ID NO: 4524101 - DNA, 20 bp, Homo sapiens
ggactccctcctcacctctg

SEQ ID NO: 4524102 - DNA, 16 bp, Homo sapiens
ggactccggaggactg

SEQ ID NO: 4524103 - DNA, 21 bp, Homo sapiens
ggactccggaggactgagccc

SEQ ID NO: 4524104 - DNA, 13 bp, Homo sapiens
ggactctcaggga

SEQ ID NO: 4524105 - DNA, 18 bp, Homo sapiens
ggactctcagtctctgag

SEQ ID NO: 4524106 - DNA, 21 bp, Homo sapiens
ggactctcagtctctgagcag

SEQ ID NO: 4524107 - DNA, 13 bp, Homo sapiens
ggactctcctcct

SEQ ID NO: 4524108 - DNA, 18 bp, Homo sapiens
ggactctcctcctcccct

SEQ ID NO: 4524109 - DNA, 12 bp, Homo sapiens
ggactctctgtg

SEQ ID NO: 4524110 - DNA, 20 bp, Homo sapiens
ggactctctgtggtcccttc

SEQ ID NO: 4524111 - DNA, 19 bp, Homo sapiens
ggactctgaagcctctggg

SEQ ID NO: 4524112 - DNA, 14 bp, Homo sapiens
ggactctgccccaa

SEQ ID NO: 4524113 - DNA, 14 bp, Homo sapiens
ggactctgcccctg

SEQ ID NO: 4524114 - DNA, 18 bp, Homo sapiens
ggactctgcccctggacc

SEQ ID NO: 4524115 - DNA, 22 bp, Homo sapiens
ggactctgcgggaggctggggc

SEQ ID NO: 4524116 - DNA, 21 bp, Homo sapiens
ggactctttccgactgcccag

SEQ ID NO: 4524117 - DNA, 15 bp, Homo sapiens
ggactgaccctgcag

SEQ ID NO: 4524118 - DNA, 16 bp, Homo sapiens
ggactgagcccccacc

SEQ ID NO: 4524119 - DNA, 17 bp, Homo sapiens
ggactgagtgggaagcc

SEQ ID NO: 4524120 - DNA, 22 bp, Homo sapiens
ggactgcacagcgtcctgtcca

SEQ ID NO: 4524121 - DNA, 17 bp, Homo sapiens
ggactgccaggctgttt

SEQ ID NO: 4524122 - DNA, 11 bp, Homo sapiens
ggactgccccc

SEQ ID NO: 4524123 - DNA, 15 bp, Homo sapiens
ggactgctgctctcc

SEQ ID NO: 4524124 - DNA, 16 bp, Homo sapiens
ggactgctgctctccc

SEQ ID NO: 4524125 - DNA, 18 bp, Homo sapiens
ggactgctgctctcccaa

SEQ ID NO: 4524126 - DNA, 23 bp, Homo sapiens
ggactggctagagtcctcactcc

SEQ ID NO: 4524127 - DNA, 19 bp, Homo sapiens
ggactgtacacactttatt

SEQ ID NO: 4524128 - DNA, 12 bp, Homo sapiens
ggactgtgcctg

SEQ ID NO: 4524129 - DNA, 13 bp, Homo sapiens
ggactgttccagg

SEQ ID NO: 4524130 - DNA, 17 bp, Homo sapiens
ggactgttccaggccct

SEQ ID NO: 4524131 - DNA, 23 bp, Homo sapiens
ggactgtttcaaggtccatggag

SEQ ID NO: 4524132 - DNA, 20 bp, Homo sapiens
ggacttattcattcctcaca

SEQ ID NO: 4524133 - DNA, 18 bp, Homo sapiens
ggacttctgcagctatgc

SEQ ID NO: 4524134 - DNA, 12 bp, Homo sapiens
ggacttgtgtct

SEQ ID NO: 4524135 - DNA, 14 bp, Homo sapiens
ggactttgcacact

SEQ ID NO: 4524136 - DNA, 23 bp, Homo sapiens
ggactttgcacactttggcccag

SEQ ID NO: 4524137 - DNA, 19 bp, Homo sapiens
ggagaaaaaaattgctctg

SEQ ID NO: 4524138 - DNA, 13 bp, Homo sapiens
ggagaaaacactt

SEQ ID NO: 4524139 - DNA, 12 bp, Homo sapiens
ggagaaaatata

SEQ ID NO: 4524140 - DNA, 16 bp, Homo sapiens
ggagaaacaaaatcct

SEQ ID NO: 4524141 - DNA, 18 bp, Homo sapiens
ggagaaagaaagtaccca

SEQ ID NO: 4524142 - DNA, 17 bp, Homo sapiens
ggagaaagccacgccct

SEQ ID NO: 4524143 - DNA, 19 bp, Homo sapiens
ggagaaagccacgccctcc

SEQ ID NO: 4524144 - DNA, 20 bp, Homo sapiens
ggagaaatgcatccattcct

SEQ ID NO: 4524145 - DNA, 23 bp, Homo sapiens
ggagaaatgcatccattcctcag

SEQ ID NO: 4524146 - DNA, 11 bp, Homo sapiens
ggagaacaaat

SEQ ID NO: 4524147 - DNA, 19 bp, Homo sapiens
ggagaagaacaagaaatgg

SEQ ID NO: 4524148 - DNA, 23 bp, Homo sapiens
ggagaagagctgttcacagccag

SEQ ID NO: 4524149 - DNA, 24 bp, Homo sapiens
ggagaagaggggtcaagagttaaa

SEQ ID NO: 4524150 - DNA, 20 bp, Homo sapiens
ggagaagagttgaggaactg

SEQ ID NO: 4524151 - DNA, 15 bp, Homo sapiens
ggagaagcagtgagc

SEQ ID NO: 4524152 - DNA, 17 bp, Homo sapiens
ggagaaggaaggagact

SEQ ID NO: 4524153 - DNA, 20 bp, Homo sapiens
ggagaagtcttctatttatt

SEQ ID NO: 4524154 - DNA, 22 bp, Homo sapiens
ggagaattgcacacagatgtga

SEQ ID NO: 4524155 - DNA, 20 bp, Homo sapiens
ggagacagaggaaagggctg

SEQ ID NO: 4524156 - DNA, 21 bp, Homo sapiens
ggagacagccaggtggcacct

SEQ ID NO: 4524157 - DNA, 17 bp, Homo sapiens
ggagacaggagcctagc

SEQ ID NO: 4524158 - DNA, 11 bp, Homo sapiens
ggagacatatc

SEQ ID NO: 4524159 - DNA, 21 bp, Homo sapiens
ggagacatatcactgctgctg

SEQ ID NO: 4524160 - DNA, 22 bp, Homo sapiens
ggagacattgctctatgtctgc

SEQ ID NO: 4524161 - DNA, 20 bp, Homo sapiens
ggagacccccaggcagaggg

SEQ ID NO: 4524162 - DNA, 20 bp, Homo sapiens
ggagaccctgccacagccag

SEQ ID NO: 4524163 - DNA, 23 bp, Homo sapiens
ggagaccctgccacagccagagg

SEQ ID NO: 4524164 - DNA, 21 bp, Homo sapiens
ggagacctctccttcctaccc

SEQ ID NO: 4524165 - DNA, 15 bp, Homo sapiens
ggagacgggaccctg

SEQ ID NO: 4524166 - DNA, 9 bp, Homo sapiens
ggagactca

SEQ ID NO: 4524167 - DNA, 23 bp, Homo sapiens
ggagactttgctgttactgcttc

SEQ ID NO: 4524168 - DNA, 16 bp, Homo sapiens
ggagagacaggcagcc

SEQ ID NO: 4524169 - DNA, 20 bp, Homo sapiens
ggagagacaggcagcccagc

SEQ ID NO: 4524170 - DNA, 17 bp, Homo sapiens
ggagagacgggccctgg

SEQ ID NO: 4524171 - DNA, 19 bp, Homo sapiens
ggagagactcccatgaagc

SEQ ID NO: 4524172 - DNA, 17 bp, Homo sapiens
ggagagactgagcagcc

SEQ ID NO: 4524173 - DNA, 19 bp, Homo sapiens
ggagagagagagagagagg

SEQ ID NO: 4524174 - DNA, 19 bp, Homo sapiens
ggagagagcccttcccagg

SEQ ID NO: 4524175 - DNA, 21 bp, Homo sapiens
ggagagagcccttcccagggc

SEQ ID NO: 4524176 - DNA, 23 bp, Homo sapiens
ggagagagcccttcccagggcac

SEQ ID NO: 4524177 - DNA, 17 bp, Homo sapiens
ggagagcaagaaggaaa

SEQ ID NO: 4524178 - DNA, 14 bp, Homo sapiens
ggagagcagcagca

SEQ ID NO: 4524179 - DNA, 19 bp, Homo sapiens
ggagagccagaacctggag

SEQ ID NO: 4524180 - DNA, 11 bp, Homo sapiens
ggagagccagc

SEQ ID NO: 4524181 - DNA, 14 bp, Homo sapiens
ggagagccagccct

SEQ ID NO: 4524182 - DNA, 18 bp, Homo sapiens
ggagagccagccctccct

SEQ ID NO: 4524183 - DNA, 12 bp, Homo sapiens
ggagagcctgct

SEQ ID NO: 4524184 - DNA, 22 bp, Homo sapiens
ggagagctagaacctggagagc

SEQ ID NO: 4524185 - DNA, 22 bp, Homo sapiens
ggagagctagaacctggagggc

SEQ ID NO: 4524186 - DNA, 15 bp, Homo sapiens
ggagagctggtgccc

SEQ ID NO: 4524187 - DNA, 17 bp, Homo sapiens
ggagaggacagagcagg

SEQ ID NO: 4524188 - DNA, 20 bp, Homo sapiens
ggagaggagtgactgagctt

SEQ ID NO: 4524189 - DNA, 21 bp, Homo sapiens
ggagaggcggcctcgtgccat

SEQ ID NO: 4524190 - DNA, 21 bp, Homo sapiens
ggagagggatttccctgcaga

SEQ ID NO: 4524191 - DNA, 12 bp, Homo sapiens
ggagaggggggc

SEQ ID NO: 4524192 - DNA, 17 bp, Homo sapiens
ggagaggggtggaggct

SEQ ID NO: 4524193 - DNA, 21 bp, Homo sapiens
ggagagggtctggagaagcag

SEQ ID NO: 4524194 - DNA, 17 bp, Homo sapiens
ggagagtggacctgtgc

SEQ ID NO: 4524195 - DNA, 19 bp, Homo sapiens
ggagagtggacctgtgctg

SEQ ID NO: 4524196 - DNA, 13 bp, Homo sapiens
ggagatgaccagg

SEQ ID NO: 4524197 - DNA, 18 bp, Homo sapiens
ggagatgcatcgggaaag

SEQ ID NO: 4524198 - DNA, 20 bp, Homo sapiens
ggagatgcatcgggaaagaa

SEQ ID NO: 4524199 - DNA, 15 bp, Homo sapiens
ggagatgcttctctc

SEQ ID NO: 4524200 - DNA, 20 bp, Homo sapiens
ggagatgcttctctccttgc

SEQ ID NO: 4524201 - DNA, 16 bp, Homo sapiens
ggagatggagggcttg

SEQ ID NO: 4524202 - DNA, 14 bp, Homo sapiens
ggagatgggtggga

SEQ ID NO: 4524203 - DNA, 15 bp, Homo sapiens
ggagattaaaaccag

SEQ ID NO: 4524204 - DNA, 21 bp, Homo sapiens
ggagattctgtgtattaacat

SEQ ID NO: 4524205 - DNA, 21 bp, Homo sapiens
ggagattttgaggtaaagata

SEQ ID NO: 4524206 - DNA, 13 bp, Homo sapiens
ggagcaaggttta

SEQ ID NO: 4524207 - DNA, 13 bp, Homo sapiens
ggagcaatcagaa

SEQ ID NO: 4524208 - DNA, 19 bp, Homo sapiens
ggagcacccagagcacccc

SEQ ID NO: 4524209 - DNA, 23 bp, Homo sapiens
ggagcacccagagcaccccctgc

SEQ ID NO: 4524210 - DNA, 13 bp, Homo sapiens
ggagcagaatcag

SEQ ID NO: 4524211 - DNA, 17 bp, Homo sapiens
ggagcagagctctgccg

SEQ ID NO: 4524212 - DNA, 14 bp, Homo sapiens
ggagcagaggaggg

SEQ ID NO: 4524213 - DNA, 12 bp, Homo sapiens
ggagcagccccc

SEQ ID NO: 4524214 - DNA, 12 bp, Homo sapiens
ggagcaggagcc

SEQ ID NO: 4524215 - DNA, 13 bp, Homo sapiens
ggagcagggaagg

SEQ ID NO: 4524216 - DNA, 22 bp, Homo sapiens
ggaatcattaatttcaaaattt

SEQ ID NO: 4524217 - DNA, 22 bp, Homo sapiens
ggaatctaatatccccaaatta

SEQ ID NO: 4524218 - DNA, 13 bp, Homo sapiens
ggaatctggagag

SEQ ID NO: 4524219 - DNA, 17 bp, Homo sapiens
ggaatctgtttctctgc

SEQ ID NO: 4524220 - DNA, 13 bp, Homo sapiens
ggaatcttcacta

SEQ ID NO: 4524221 - DNA, 17 bp, Homo sapiens
ggaatgcacctccccaa

SEQ ID NO: 4524222 - DNA, 13 bp, Homo sapiens
ggaatgcagcagg

SEQ ID NO: 4524223 - DNA, 19 bp, Homo sapiens
ggaatggatttttctttaa

SEQ ID NO: 4524224 - DNA, 21 bp, Homo sapiens
ggaatgggagaggcaataaat

SEQ ID NO: 4524225 - DNA, 16 bp, Homo sapiens
ggaatgtgccacagag

SEQ ID NO: 4524226 - DNA, 19 bp, Homo sapiens
ggaatgtgccacagaggcc

SEQ ID NO: 4524227 - DNA, 22 bp, Homo sapiens
ggaatgtttttccctccccaga

SEQ ID NO: 4524228 - DNA, 18 bp, Homo sapiens
ggaattcaccagtgttcc

SEQ ID NO: 4524229 - DNA, 13 bp, Homo sapiens
ggaattccctccc

SEQ ID NO: 4524230 - DNA, 16 bp, Homo sapiens
ggaattctactggaaa

SEQ ID NO: 4524231 - DNA, 18 bp, Homo sapiens
ggaattcttgctgttaaa

SEQ ID NO: 4524232 - DNA, 14 bp, Homo sapiens
ggaattgaaaaaaa

SEQ ID NO: 4524233 - DNA, 19 bp, Homo sapiens
ggaattgatttgcattgaa

SEQ ID NO: 4524234 - DNA, 16 bp, Homo sapiens
ggaattgcgctcaggg

SEQ ID NO: 4524235 - DNA, 22 bp, Homo sapiens
ggaatttcttaacttcttgctt

SEQ ID NO: 4524236 - DNA, 18 bp, Homo sapiens
ggacaaatcacatatttt

SEQ ID NO: 4524237 - DNA, 22 bp, Homo sapiens
ggacaaatctaaaatgcaaaga

SEQ ID NO: 4524238 - DNA, 23 bp, Homo sapiens
ggacaaccatgcaaattgtgaaa

SEQ ID NO: 4524239 - DNA, 20 bp, Homo sapiens
ggacaaggaggtctgtgcca

SEQ ID NO: 4524240 - DNA, 21 bp, Homo sapiens
ggacacagttcctgggaacat

SEQ ID NO: 4524241 - DNA, 12 bp, Homo sapiens
ggacaccagagc

SEQ ID NO: 4524242 - DNA, 21 bp, Homo sapiens
ggacaccattaccaaaataat

SEQ ID NO: 4524243 - DNA, 21 bp, Homo sapiens
ggacaccctccctccagggtc

SEQ ID NO: 4524244 - DNA, 17 bp, Homo sapiens
ggacacctgtacattct

SEQ ID NO: 4524245 - DNA, 14 bp, Homo sapiens
ggacacgagccaca

SEQ ID NO: 4524246 - DNA, 21 bp, Homo sapiens
ggacacgagccacaagctgca

SEQ ID NO: 4524247 - DNA, 23 bp, Homo sapiens
ggacacgagccacaagctgcact

SEQ ID NO: 4524248 - DNA, 15 bp, Homo sapiens
ggacactcctagaga

SEQ ID NO: 4524249 - DNA, 23 bp, Homo sapiens
ggacactcgtcaccccagccctc

SEQ ID NO: 4524250 - DNA, 22 bp, Homo sapiens
ggacagacagatgttgggagga

SEQ ID NO: 4524251 - DNA, 19 bp, Homo sapiens
ggacagagacacctgcacc

SEQ ID NO: 4524252 - DNA, 20 bp, Homo sapiens
ggacagagacacctgcacct

SEQ ID NO: 4524253 - DNA, 20 bp, Homo sapiens
ggacagagcaggggctccag

SEQ ID NO: 4524254 - DNA, 12 bp, Homo sapiens
ggacagagccag

SEQ ID NO: 4524255 - DNA, 13 bp, Homo sapiens
ggacagagccagc

SEQ ID NO: 4524256 - DNA, 15 bp, Homo sapiens
ggacagaggcctgcc

SEQ ID NO: 4524257 - DNA, 21 bp, Homo sapiens
ggacagagggaagccagtcag

SEQ ID NO: 4524258 - DNA, 15 bp, Homo sapiens
ggacagagggcacat

SEQ ID NO: 4524259 - DNA, 16 bp, Homo sapiens
ggacagagggcacatg

SEQ ID NO: 4524260 - DNA, 17 bp, Homo sapiens
ggacagcaaagcagcag

SEQ ID NO: 4524261 - DNA, 14 bp, Homo sapiens
ggacagcagaagcc

SEQ ID NO: 4524262 - DNA, 17 bp, Homo sapiens
ggacagcagaagcctcc

SEQ ID NO: 4524263 - DNA, 24 bp, Homo sapiens
ggacagcatcccttcccacatgcc

SEQ ID NO: 4524264 - DNA, 17 bp, Homo sapiens
ggacagctgtgccggga

SEQ ID NO: 4524265 - DNA, 23 bp, Homo sapiens
ggacaggaaaggccccaatcttg

SEQ ID NO: 4524266 - DNA, 18 bp, Homo sapiens
ggacagggctggcccagc

SEQ ID NO: 4524267 - DNA, 17 bp, Homo sapiens
ggacagtaaacactcca

SEQ ID NO: 4524268 - DNA, 19 bp, Homo sapiens
ggacagtacctgattgtat

SEQ ID NO: 4524269 - DNA, 12 bp, Homo sapiens
ggacagtccctg

SEQ ID NO: 4524270 - DNA, 15 bp, Homo sapiens
ggacagtccctgctg

SEQ ID NO: 4524271 - DNA, 17 bp, Homo sapiens
ggacagtccctgctggg

SEQ ID NO: 4524272 - DNA, 19 bp, Homo sapiens
ggacagtttatcatgaagc

SEQ ID NO: 4524273 - DNA, 22 bp, Homo sapiens
ggacagtttatcatgaagcctg

SEQ ID NO: 4524274 - DNA, 23 bp, Homo sapiens
ggacatagaggtatattggaaga

SEQ ID NO: 4524275 - DNA, 12 bp, Homo sapiens
ggacatcagcaa

SEQ ID NO: 4524276 - DNA, 15 bp, Homo sapiens
ggacatcagcaaaca

SEQ ID NO: 4524277 - DNA, 23 bp, Homo sapiens
ggacatggtgagtctatttttaa

SEQ ID NO: 4524278 - DNA, 16 bp, Homo sapiens
ggacatttctataaaa

SEQ ID NO: 4524279 - DNA, 15 bp, Homo sapiens
ggacattttatgtct

SEQ ID NO: 4524280 - DNA, 19 bp, Homo sapiens
ggaccaaattgcttctagg

SEQ ID NO: 4524281 - DNA, 20 bp, Homo sapiens
ggaccaaattgcttctagga

SEQ ID NO: 4524282 - DNA, 16 bp, Homo sapiens
ggaccaacctgctctg

SEQ ID NO: 4524283 - DNA, 17 bp, Homo sapiens
ggaccaacctgctctgt

SEQ ID NO: 4524284 - DNA, 20 bp, Homo sapiens
ggaccaacctgctctgtccc

SEQ ID NO: 4524285 - DNA, 16 bp, Homo sapiens
ggaccaattctggaca

SEQ ID NO: 4524286 - DNA, 22 bp, Homo sapiens
ggaccaattctggacagacaga

SEQ ID NO: 4524287 - DNA, 17 bp, Homo sapiens
ggaccaccgttcagtca

SEQ ID NO: 4524288 - DNA, 18 bp, Homo sapiens
ggaccactcgaggcctgc

SEQ ID NO: 4524289 - DNA, 21 bp, Homo sapiens
ggaccactgggtgagagagga

SEQ ID NO: 4524290 - DNA, 20 bp, Homo sapiens
ggaccagcccattggccgag

SEQ ID NO: 4524291 - DNA, 12 bp, Homo sapiens
ggaccagcctct

SEQ ID NO: 4524292 - DNA, 15 bp, Homo sapiens
ggaccaggactccct

SEQ ID NO: 4524293 - DNA, 13 bp, Homo sapiens
ggaccatgccaga

SEQ ID NO: 4524294 - DNA, 23 bp, Homo sapiens
ggaccatgccagattctgcctct

SEQ ID NO: 4524295 - DNA, 11 bp, Homo sapiens
ggacccacccc

SEQ ID NO: 4524296 - DNA, 12 bp, Homo sapiens
ggacccacccca

SEQ ID NO: 4524297 - DNA, 21 bp, Homo sapiens
ggacccacctgtggggcctgg

SEQ ID NO: 4524298 - DNA, 22 bp, Homo sapiens
ggacccacctgtggggcctggg

SEQ ID NO: 4524299 - DNA, 12 bp, Homo sapiens
ggacccagaccc

SEQ ID NO: 4524300 - DNA, 15 bp, Homo sapiens
ggacccagggcctga

SEQ ID NO: 4524301 - DNA, 19 bp, Homo sapiens
ggacccatggtcatctctg

SEQ ID NO: 4524302 - DNA, 23 bp, Homo sapiens
ggaccccactccggccctccaga

SEQ ID NO: 4524303 - DNA, 15 bp, Homo sapiens
ggaccctcagcagct

SEQ ID NO: 4524304 - DNA, 21 bp, Homo sapiens
ggaccctgtccggcccagtgc

SEQ ID NO: 4524305 - DNA, 22 bp, Homo sapiens
ggaccctgtccggcccagtgcc

SEQ ID NO: 4524306 - DNA, 24 bp, Homo sapiens
ggacccttaggatggggctcccag

SEQ ID NO: 4524307 - DNA, 16 bp, Homo sapiens
ggaccctttccttcct

SEQ ID NO: 4524308 - DNA, 21 bp, Homo sapiens
ggaccctttccttccttccct

SEQ ID NO: 4524309 - DNA, 17 bp, Homo sapiens
ggaccggtacagaaagg

SEQ ID NO: 4524310 - DNA, 20 bp, Homo sapiens
ggaccggtgctgcaggagtg

SEQ ID NO: 4524311 - DNA, 16 bp, Homo sapiens
ggacctcagcaagctg

SEQ ID NO: 4524312 - DNA, 19 bp, Homo sapiens
ggacctcagcaagctgccc

SEQ ID NO: 4524313 - DNA, 20 bp, Homo sapiens
ggacctcagcaagctgccca

SEQ ID NO: 4524314 - DNA, 20 bp, Homo sapiens
ggacctgcatatttagctgt

SEQ ID NO: 4524315 - DNA, 17 bp, Homo sapiens
ggacctggtgctgcctc

SEQ ID NO: 4524316 - DNA, 18 bp, Homo sapiens
ggacctgtatttaagcaa

SEQ ID NO: 4524317 - DNA, 20 bp, Homo sapiens
ggacctgtatttaagcaaat

SEQ ID NO: 4524318 - DNA, 22 bp, Homo sapiens
ggacctgtatttaagcaaatac

SEQ ID NO: 4524319 - DNA, 22 bp, Homo sapiens
ggaccttctggtggttctgctg

SEQ ID NO: 4524320 - DNA, 22 bp, Homo sapiens
ggacctttaggtcaaactccct

SEQ ID NO: 4524321 - DNA, 16 bp, Homo sapiens
ggaccttttgttttct

SEQ ID NO: 4524322 - DNA, 23 bp, Homo sapiens
ggacgatagcttggagggatgga

SEQ ID NO: 4524323 - DNA, 17 bp, Homo sapiens
ggacgcctgcaggagag

SEQ ID NO: 4524324 - DNA, 14 bp, Homo sapiens
ggacgcctgggggt

SEQ ID NO: 4524325 - DNA, 15 bp, Homo sapiens
ggacgctgaggaagt

SEQ ID NO: 4524326 - DNA, 15 bp, Homo sapiens
ggacgggagtgagct

SEQ ID NO: 4524327 - DNA, 22 bp, Homo sapiens
ggacgtcatcggaggctgggcc

SEQ ID NO: 4524328 - DNA, 16 bp, Homo sapiens
ggacgtgtcaggtggt

SEQ ID NO: 4524329 - DNA, 13 bp, Homo sapiens
ggacgttccagcc

SEQ ID NO: 4524330 - DNA, 21 bp, Homo sapiens
ggacgttgctgagccagctgc

SEQ ID NO: 4524331 - DNA, 14 bp, Homo sapiens
ggacgttgttttgg

SEQ ID NO: 4524332 - DNA, 19 bp, Homo sapiens
ggactaagcctacctgctc

SEQ ID NO: 4524333 - DNA, 17 bp, Homo sapiens
ggactagaacctggagg

SEQ ID NO: 4524334 - DNA, 18 bp, Homo sapiens
ggactagaagattagaaa

SEQ ID NO: 4524335 - DNA, 14 bp, Homo sapiens
ggccctggcctgct

SEQ ID NO: 4524336 - DNA, 16 bp, Homo sapiens
ggccctggcctgctgg

SEQ ID NO: 4524337 - DNA, 13 bp, Homo sapiens
ggccctgggcctc

SEQ ID NO: 4524338 - DNA, 16 bp, Homo sapiens
ggccctgggcctcagt

SEQ ID NO: 4524339 - DNA, 21 bp, Homo sapiens
ggccctgggctgggtgctggg

SEQ ID NO: 4524340 - DNA, 13 bp, Homo sapiens
ggccgagagcctt

SEQ ID NO: 4524341 - DNA, 12 bp, Homo sapiens
ggccgagctcct

SEQ ID NO: 4524342 - DNA, 20 bp, Homo sapiens
ggccgagctcctggggagct

SEQ ID NO: 4524343 - DNA, 22 bp, Homo sapiens
ggccgagctcctggggagctcc

SEQ ID NO: 4524344 - DNA, 16 bp, Homo sapiens
ggccgagggtcctggc

SEQ ID NO: 4524345 - DNA, 18 bp, Homo sapiens
ggccgcagggcggggctg

SEQ ID NO: 4524346 - DNA, 15 bp, Homo sapiens
ggccgcattccctga

SEQ ID NO: 4524347 - DNA, 16 bp, Homo sapiens
ggccgcattccctgag

SEQ ID NO: 4524348 - DNA, 13 bp, Homo sapiens
ggccgcctcaccc

SEQ ID NO: 4524349 - DNA, 14 bp, Homo sapiens
ggccgcctcacccc

SEQ ID NO: 4524350 - DNA, 15 bp, Homo sapiens
ggccgctgagcgccc

SEQ ID NO: 4524351 - DNA, 22 bp, Homo sapiens
ggccgctgagcgcccccgagcc

SEQ ID NO: 4524352 - DNA, 13 bp, Homo sapiens
ggccggcctcctc

SEQ ID NO: 4524353 - DNA, 17 bp, Homo sapiens
ggccggcctcctcctca

SEQ ID NO: 4524354 - DNA, 16 bp, Homo sapiens
ggccggctgtttcctg

SEQ ID NO: 4524355 - DNA, 12 bp, Homo sapiens
ggccgggcacag

SEQ ID NO: 4524356 - DNA, 15 bp, Homo sapiens
ggccgggcacagtgg

SEQ ID NO: 4524357 - DNA, 19 bp, Homo sapiens
ggccgggcaggtcctgccc

SEQ ID NO: 4524358 - DNA, 13 bp, Homo sapiens
ggccgggccagga

SEQ ID NO: 4524359 - DNA, 15 bp, Homo sapiens
ggccggtgccagctg

SEQ ID NO: 4524360 - DNA, 18 bp, Homo sapiens
ggcctaccccagttccta

SEQ ID NO: 4524361 - DNA, 13 bp, Homo sapiens
ggcctagactctg

SEQ ID NO: 4524362 - DNA, 19 bp, Homo sapiens
ggcctagcgatctctcctg

SEQ ID NO: 4524363 - DNA, 23 bp, Homo sapiens
ggcctagcgatctctcctggcct

SEQ ID NO: 4524364 - DNA, 16 bp, Homo sapiens
ggcctatttcagctgc

SEQ ID NO: 4524365 - DNA, 17 bp, Homo sapiens
ggcctcaactcctccca

SEQ ID NO: 4524366 - DNA, 18 bp, Homo sapiens
ggcctcacccacccctgc

SEQ ID NO: 4524367 - DNA, 15 bp, Homo sapiens
ggcctcagctgcctc

SEQ ID NO: 4524368 - DNA, 22 bp, Homo sapiens
ggcctcagctgcctcacttcct

SEQ ID NO: 4524369 - DNA, 14 bp, Homo sapiens
ggcctcaggctccg

SEQ ID NO: 4524370 - DNA, 19 bp, Homo sapiens
ggcctcatctcagaccctg

SEQ ID NO: 4524371 - DNA, 17 bp, Homo sapiens
ggcctccactccttcca

SEQ ID NO: 4524372 - DNA, 18 bp, Homo sapiens
ggcctcccaaagtgctga

SEQ ID NO: 4524373 - DNA, 16 bp, Homo sapiens
ggcctccctgctgtgc

SEQ ID NO: 4524374 - DNA, 18 bp, Homo sapiens
ggcctccgaggctccccg

SEQ ID NO: 4524375 - DNA, 20 bp, Homo sapiens
ggcctcctcctcacccttcc

SEQ ID NO: 4524376 - DNA, 21 bp, Homo sapiens
ggcctcctcctcacccttccc

SEQ ID NO: 4524377 - DNA, 23 bp, Homo sapiens
ggcctcctcctcacccttcccgg

SEQ ID NO: 4524378 - DNA, 20 bp, Homo sapiens
ggcctcctcggagagcagca

SEQ ID NO: 4524379 - DNA, 19 bp, Homo sapiens
ggcctcgcctccccaccct

SEQ ID NO: 4524380 - DNA, 16 bp, Homo sapiens
ggcctctaaccccagg

SEQ ID NO: 4524381 - DNA, 20 bp, Homo sapiens
ggcctctaaccccaggcccc

SEQ ID NO: 4524382 - DNA, 20 bp, Homo sapiens
ggcctctcattccagaggaa

SEQ ID NO: 4524383 - DNA, 13 bp, Homo sapiens
ggcctctccctgc

SEQ ID NO: 4524384 - DNA, 15 bp, Homo sapiens
ggcctctccctgcct

SEQ ID NO: 4524385 - DNA, 17 bp, Homo sapiens
ggcctctccctgcctgt

SEQ ID NO: 4524386 - DNA, 20 bp, Homo sapiens
ggcctctccttggaaggtct

SEQ ID NO: 4524387 - DNA, 15 bp, Homo sapiens
ggcctctctctgctc

SEQ ID NO: 4524388 - DNA, 17 bp, Homo sapiens
ggcctctctctgctcca

SEQ ID NO: 4524389 - DNA, 19 bp, Homo sapiens
ggcctctgcggagcacact

SEQ ID NO: 4524390 - DNA, 16 bp, Homo sapiens
ggcctctgctggctca

SEQ ID NO: 4524391 - DNA, 22 bp, Homo sapiens
ggcctctgctggctcaggagga

SEQ ID NO: 4524392 - DNA, 16 bp, Homo sapiens
ggcctcttcaggcctg

SEQ ID NO: 4524393 - DNA, 22 bp, Homo sapiens
ggcctcttctcaacttttttcc

SEQ ID NO: 4524394 - DNA, 15 bp, Homo sapiens
ggcctgaaacccgcc

SEQ ID NO: 4524395 - DNA, 21 bp, Homo sapiens
ggcctgaaacccgccctcagg

SEQ ID NO: 4524396 - DNA, 15 bp, Homo sapiens
ggcctgaactgagga

SEQ ID NO: 4524397 - DNA, 15 bp, Homo sapiens
ggcctgacttgagcc

SEQ ID NO: 4524398 - DNA, 16 bp, Homo sapiens
ggcctgacttgagcca

SEQ ID NO: 4524399 - DNA, 18 bp, Homo sapiens
ggcctgagaggggaagcg

SEQ ID NO: 4524400 - DNA, 12 bp, Homo sapiens
ggcctgagcccc

SEQ ID NO: 4524401 - DNA, 15 bp, Homo sapiens
ggcctgatctctgct

SEQ ID NO: 4524402 - DNA, 17 bp, Homo sapiens
ggcctgatgctccctcc

SEQ ID NO: 4524403 - DNA, 22 bp, Homo sapiens
ggcctgatgctccctcccctgc

SEQ ID NO: 4524404 - DNA, 19 bp, Homo sapiens
ggcctgcaaaccttcctgg

SEQ ID NO: 4524405 - DNA, 12 bp, Homo sapiens
ggcctgcaccct

SEQ ID NO: 4524406 - DNA, 21 bp, Homo sapiens
ggcctgcacggtgggccttgc

SEQ ID NO: 4524407 - DNA, 14 bp, Homo sapiens
ggcctgccagtctg

SEQ ID NO: 4524408 - DNA, 18 bp, Homo sapiens
ggcctgcgggcccctggt

SEQ ID NO: 4524409 - DNA, 13 bp, Homo sapiens
ggcctgctgccag

SEQ ID NO: 4524410 - DNA, 19 bp, Homo sapiens
ggcctgctgccagtgcagc

SEQ ID NO: 4524411 - DNA, 21 bp, Homo sapiens
ggcctgctgccagtgcagcca

SEQ ID NO: 4524412 - DNA, 23 bp, Homo sapiens
ggcctgctgccagtgcagccact

SEQ ID NO: 4524413 - DNA, 19 bp, Homo sapiens
ggcctgctgggctctccac

SEQ ID NO: 4524414 - DNA, 20 bp, Homo sapiens
ggcctgctgggctctccacc

SEQ ID NO: 4524415 - DNA, 23 bp, Homo sapiens
ggcctggagccccatcggccaag

SEQ ID NO: 4524416 - DNA, 23 bp, Homo sapiens
ggcctggccaggagctcttcagg

SEQ ID NO: 4524417 - DNA, 12 bp, Homo sapiens
ggcctggccctg

SEQ ID NO: 4524418 - DNA, 14 bp, Homo sapiens
ggcctggccctgct

SEQ ID NO: 4524419 - DNA, 17 bp, Homo sapiens
ggcctggcctcatctca

SEQ ID NO: 4524420 - DNA, 21 bp, Homo sapiens
ggcctggcctcatctcagacc

SEQ ID NO: 4524421 - DNA, 16 bp, Homo sapiens
ggcctggctccagtct

SEQ ID NO: 4524422 - DNA, 20 bp, Homo sapiens
ggcctggggtgcatctcctc

SEQ ID NO: 4524423 - DNA, 18 bp, Homo sapiens
ggcctggtttcctcgaga

SEQ ID NO: 4524424 - DNA, 23 bp, Homo sapiens
ggcctggtttcctcgagaggcac

SEQ ID NO: 4524425 - DNA, 23 bp, Homo sapiens
ggcctgtatcctccctggcagac

SEQ ID NO: 4524426 - DNA, 20 bp, Homo sapiens
ggcctgtgggtctctgaagg

SEQ ID NO: 4524427 - DNA, 21 bp, Homo sapiens
ggcctgtgggtctctgaaggg

SEQ ID NO: 4524428 - DNA, 17 bp, Homo sapiens
ggccttattgcatccca

SEQ ID NO: 4524429 - DNA, 13 bp, Homo sapiens
ggccttgtacttg

SEQ ID NO: 4524430 - DNA, 22 bp, Homo sapiens
ggccttgtcctacgtccaaggt

SEQ ID NO: 4524431 - DNA, 11 bp, Homo sapiens
ggcctttcctt

SEQ ID NO: 4524432 - DNA, 20 bp, Homo sapiens
ggcctttccttccctctctg

SEQ ID NO: 4524433 - DNA, 19 bp, Homo sapiens
ggcctttgccagcagagcc

SEQ ID NO: 4524434 - DNA, 20 bp, Homo sapiens
ggcctttgccagcagagcca

SEQ ID NO: 4524435 - DNA, 19 bp, Homo sapiens
ggcctttggacccagggcc

SEQ ID NO: 4524436 - DNA, 12 bp, Homo sapiens
ggcctttttcct

SEQ ID NO: 4524437 - DNA, 18 bp, Homo sapiens
ggcgaataaatgttcaaa

SEQ ID NO: 4524438 - DNA, 13 bp, Homo sapiens
ggcgaatctcaaa

SEQ ID NO: 4524439 - DNA, 11 bp, Homo sapiens
ggcgacctcct

SEQ ID NO: 4524440 - DNA, 12 bp, Homo sapiens
ggcgagctgcag

SEQ ID NO: 4524441 - DNA, 16 bp, Homo sapiens
ggcgcaccccacagct

SEQ ID NO: 4524442 - DNA, 18 bp, Homo sapiens
ggcgcaccccacagctgg

SEQ ID NO: 4524443 - DNA, 19 bp, Homo sapiens
ggcgcaccccacagctggg

SEQ ID NO: 4524444 - DNA, 22 bp, Homo sapiens
ggcgcaccccacagctggggcc

SEQ ID NO: 4524445 - DNA, 16 bp, Homo sapiens
ggcgccaagtctggca

SEQ ID NO: 4524446 - DNA, 15 bp, Homo sapiens
ggcgcgggcagccac

SEQ ID NO: 4524447 - DNA, 17 bp, Homo sapiens
ggcgctcagcagcccta

SEQ ID NO: 4524448 - DNA, 18 bp, Homo sapiens
ggcgctgcatacagggga

SEQ ID NO: 4524449 - DNA, 16 bp, Homo sapiens
ggcgcttggatctggg

SEQ ID NO: 4524450 - DNA, 22 bp, Homo sapiens
ggcggatcatgaggtcaggagt

SEQ ID NO: 4524451 - DNA, 23 bp, Homo sapiens
ggcggctactcagcagccctcct

SEQ ID NO: 4524452 - DNA, 16 bp, Homo sapiens
ggcggctactctggaa

SEQ ID NO: 4524453 - DNA, 16 bp, Homo sapiens
ggcggctcctggtgct

SEQ ID NO: 4524454 - DNA, 20 bp, Homo sapiens
ggcgggcctttttcctgcgt

SEQ ID NO: 4524455 - DNA, 14 bp, Homo sapiens
ggccagagtggcct

SEQ ID NO: 4524456 - DNA, 18 bp, Homo sapiens
ggccagagtggcctggcc

SEQ ID NO: 4524457 - DNA, 13 bp, Homo sapiens
ggccagcaccctc

SEQ ID NO: 4524458 - DNA, 11 bp, Homo sapiens
ggccagcccag

SEQ ID NO: 4524459 - DNA, 13 bp, Homo sapiens
ggccagcccagcc

SEQ ID NO: 4524460 - DNA, 15 bp, Homo sapiens
ggccagcccagccag

SEQ ID NO: 4524461 - DNA, 20 bp, Homo sapiens
ggccagccccacccaggagg

SEQ ID NO: 4524462 - DNA, 21 bp, Homo sapiens
ggccagccccacccaggaggg

SEQ ID NO: 4524463 - DNA, 20 bp, Homo sapiens
ggccagcccctggggcccag

SEQ ID NO: 4524464 - DNA, 16 bp, Homo sapiens
ggccagcggggctgct

SEQ ID NO: 4524465 - DNA, 19 bp, Homo sapiens
ggccagcggggctgctcac

SEQ ID NO: 4524466 - DNA, 13 bp, Homo sapiens
ggccagctcagga

SEQ ID NO: 4524467 - DNA, 20 bp, Homo sapiens
ggccagctgccccagccaga

SEQ ID NO: 4524468 - DNA, 22 bp, Homo sapiens
ggccagctgcggccaggcctgc

SEQ ID NO: 4524469 - DNA, 16 bp, Homo sapiens
ggccaggacaggcccg

SEQ ID NO: 4524470 - DNA, 13 bp, Homo sapiens
ggccaggagctct

SEQ ID NO: 4524471 - DNA, 18 bp, Homo sapiens
ggccaggcctctgctggc

SEQ ID NO: 4524472 - DNA, 20 bp, Homo sapiens
ggccaggcctctgctggctc

SEQ ID NO: 4524473 - DNA, 21 bp, Homo sapiens
ggccaggggtgctcctgtgct

SEQ ID NO: 4524474 - DNA, 22 bp, Homo sapiens
ggccaggggtgctcctgtgctc

SEQ ID NO: 4524475 - DNA, 15 bp, Homo sapiens
ggccaggtgcccagg

SEQ ID NO: 4524476 - DNA, 22 bp, Homo sapiens
ggccagtcaacggggggctcct

SEQ ID NO: 4524477 - DNA, 21 bp, Homo sapiens
ggccagtccccatttctgcct

SEQ ID NO: 4524478 - DNA, 15 bp, Homo sapiens
ggccagtccccgagg

SEQ ID NO: 4524479 - DNA, 20 bp, Homo sapiens
ggccagtcctgcctggccag

SEQ ID NO: 4524480 - DNA, 15 bp, Homo sapiens
ggccagtgctgccca

SEQ ID NO: 4524481 - DNA, 20 bp, Homo sapiens
ggccatatatgctgtatttc

SEQ ID NO: 4524482 - DNA, 22 bp, Homo sapiens
ggccatatatgctgtatttctt

SEQ ID NO: 4524483 - DNA, 14 bp, Homo sapiens
ggccatccctgggc

SEQ ID NO: 4524484 - DNA, 14 bp, Homo sapiens
ggccatccctgtga

SEQ ID NO: 4524485 - DNA, 15 bp, Homo sapiens
ggccatctcaggaga

SEQ ID NO: 4524486 - DNA, 17 bp, Homo sapiens
ggccatctcaggagatg

SEQ ID NO: 4524487 - DNA, 22 bp, Homo sapiens
ggccatgtccaaagaggctgcc

SEQ ID NO: 4524488 - DNA, 15 bp, Homo sapiens
ggccatgtgctgccc

SEQ ID NO: 4524489 - DNA, 17 bp, Homo sapiens
ggccatgtgctgccctg

SEQ ID NO: 4524490 - DNA, 17 bp, Homo sapiens
ggccattgtgaaccaat

SEQ ID NO: 4524491 - DNA, 21 bp, Homo sapiens
ggccatttccaagaggctgta

SEQ ID NO: 4524492 - DNA, 20 bp, Homo sapiens
ggcccaaccaccagatgaga

SEQ ID NO: 4524493 - DNA, 13 bp, Homo sapiens
ggcccaaccctgt

SEQ ID NO: 4524494 - DNA, 17 bp, Homo sapiens
ggcccaaggcggcccct

SEQ ID NO: 4524495 - DNA, 13 bp, Homo sapiens
ggcccacagctcc

SEQ ID NO: 4524496 - DNA, 15 bp, Homo sapiens
ggcccacagctccca

SEQ ID NO: 4524497 - DNA, 19 bp, Homo sapiens
ggcccacagctcccacccc

SEQ ID NO: 4524498 - DNA, 23 bp, Homo sapiens
ggcccacggttcggggcttctgc

SEQ ID NO: 4524499 - DNA, 13 bp, Homo sapiens
ggcccactcccca

SEQ ID NO: 4524500 - DNA, 17 bp, Homo sapiens
ggcccactccccagccc

SEQ ID NO: 4524501 - DNA, 19 bp, Homo sapiens
ggcccactccccagcccca

SEQ ID NO: 4524502 - DNA, 17 bp, Homo sapiens
ggcccagaagtttccct

SEQ ID NO: 4524503 - DNA, 17 bp, Homo sapiens
ggcccagagccatactg

SEQ ID NO: 4524504 - DNA, 12 bp, Homo sapiens
ggcccagcccag

SEQ ID NO: 4524505 - DNA, 22 bp, Homo sapiens
ggcccagcccagagccacctgg

SEQ ID NO: 4524506 - DNA, 19 bp, Homo sapiens
ggcccagcccccacagtgc

SEQ ID NO: 4524507 - DNA, 16 bp, Homo sapiens
ggcccagcccggctcc

SEQ ID NO: 4524508 - DNA, 12 bp, Homo sapiens
ggcccagccctg

SEQ ID NO: 4524509 - DNA, 15 bp, Homo sapiens
ggcccagctgctccc

SEQ ID NO: 4524510 - DNA, 20 bp, Homo sapiens
ggcccaggccaggtgcccag

SEQ ID NO: 4524511 - DNA, 17 bp, Homo sapiens
ggcccagggacaccagc

SEQ ID NO: 4524512 - DNA, 23 bp, Homo sapiens
ggcccagggacaccagccaggct

SEQ ID NO: 4524513 - DNA, 19 bp, Homo sapiens
ggcccagggtggccacacc

SEQ ID NO: 4524514 - DNA, 20 bp, Homo sapiens
ggcccaggtcagccactgtt

SEQ ID NO: 4524515 - DNA, 12 bp, Homo sapiens
ggcccaggtgcc

SEQ ID NO: 4524516 - DNA, 17 bp, Homo sapiens
ggcccagtatgagccct

SEQ ID NO: 4524517 - DNA, 14 bp, Homo sapiens
ggcccagtgccact

SEQ ID NO: 4524518 - DNA, 17 bp, Homo sapiens
ggcccagtgccactgcc

SEQ ID NO: 4524519 - DNA, 14 bp, Homo sapiens
ggccccaccaccta

SEQ ID NO: 4524520 - DNA, 15 bp, Homo sapiens
ggccccaccagtgcc

SEQ ID NO: 4524521 - DNA, 18 bp, Homo sapiens
ggccccaccagtgcctct

SEQ ID NO: 4524522 - DNA, 23 bp, Homo sapiens
ggccccagcccaccctcctgtct

SEQ ID NO: 4524523 - DNA, 13 bp, Homo sapiens
ggccccagcctcc

SEQ ID NO: 4524524 - DNA, 13 bp, Homo sapiens
ggccccaggcccc

SEQ ID NO: 4524525 - DNA, 19 bp, Homo sapiens
ggccccaggccccagacag

SEQ ID NO: 4524526 - DNA, 23 bp, Homo sapiens
ggccccatccaaccactgtacac

SEQ ID NO: 4524527 - DNA, 20 bp, Homo sapiens
ggcccccaacctcagggctc

SEQ ID NO: 4524528 - DNA, 17 bp, Homo sapiens
ggcccccaataaaccag

SEQ ID NO: 4524529 - DNA, 18 bp, Homo sapiens
ggcccccaataaaccagt

SEQ ID NO: 4524530 - DNA, 19 bp, Homo sapiens
ggcccccaataaaccagtg

SEQ ID NO: 4524531 - DNA, 21 bp, Homo sapiens
ggcccccaataaaggcagctg

SEQ ID NO: 4524532 - DNA, 23 bp, Homo sapiens
ggcccccaataaaggcagctgcc

SEQ ID NO: 4524533 - DNA, 15 bp, Homo sapiens
ggcccccacagcgct

SEQ ID NO: 4524534 - DNA, 20 bp, Homo sapiens
ggcccccagcccctcctccc

SEQ ID NO: 4524535 - DNA, 22 bp, Homo sapiens
ggcccccagcccctcctccctc

SEQ ID NO: 4524536 - DNA, 18 bp, Homo sapiens
ggcccccatcagccctgc

SEQ ID NO: 4524537 - DNA, 20 bp, Homo sapiens
ggcccccggccaaggaccca

SEQ ID NO: 4524538 - DNA, 20 bp, Homo sapiens
ggccccctctcggccaggca

SEQ ID NO: 4524539 - DNA, 17 bp, Homo sapiens
ggccccgaggacccaga

SEQ ID NO: 4524540 - DNA, 16 bp, Homo sapiens
ggccccgccagggctg

SEQ ID NO: 4524541 - DNA, 18 bp, Homo sapiens
ggccccgccagggctggg

SEQ ID NO: 4524542 - DNA, 21 bp, Homo sapiens
ggccccgccagggctggggac

SEQ ID NO: 4524543 - DNA, 18 bp, Homo sapiens
ggccccgtgggtgggcct

SEQ ID NO: 4524544 - DNA, 13 bp, Homo sapiens
ggcccctccacgc

SEQ ID NO: 4524545 - DNA, 17 bp, Homo sapiens
ggcccctccagcttgtg

SEQ ID NO: 4524546 - DNA, 13 bp, Homo sapiens
ggcccctcccctg

SEQ ID NO: 4524547 - DNA, 16 bp, Homo sapiens
ggcccctcccctgcag

SEQ ID NO: 4524548 - DNA, 17 bp, Homo sapiens
ggcccctcccctgcaga

SEQ ID NO: 4524549 - DNA, 12 bp, Homo sapiens
ggcccctggagg

SEQ ID NO: 4524550 - DNA, 21 bp, Homo sapiens
ggcccctgggcttggcctgct

SEQ ID NO: 4524551 - DNA, 13 bp, Homo sapiens
ggcccctgtctgt

SEQ ID NO: 4524552 - DNA, 23 bp, Homo sapiens
ggcccctgtctgttcccagcccc

SEQ ID NO: 4524553 - DNA, 13 bp, Homo sapiens
ggcccggcagggc

SEQ ID NO: 4524554 - DNA, 18 bp, Homo sapiens
ggcccggcagggcgggca

SEQ ID NO: 4524555 - DNA, 15 bp, Homo sapiens
ggcccggccacaccc

SEQ ID NO: 4524556 - DNA, 13 bp, Homo sapiens
ggcccggggctgg

SEQ ID NO: 4524557 - DNA, 15 bp, Homo sapiens
ggcccggtccacagg

SEQ ID NO: 4524558 - DNA, 21 bp, Homo sapiens
ggccctccagagccccacagc

SEQ ID NO: 4524559 - DNA, 13 bp, Homo sapiens
ggccctccctgac

SEQ ID NO: 4524560 - DNA, 22 bp, Homo sapiens
ggccctccgaccacttccaggg

SEQ ID NO: 4524561 - DNA, 15 bp, Homo sapiens
ggccctcgctgccag

SEQ ID NO: 4524562 - DNA, 22 bp, Homo sapiens
ggccctcgctgccagctctgta

SEQ ID NO: 4524563 - DNA, 16 bp, Homo sapiens
ggccctcgggcccagc

SEQ ID NO: 4524564 - DNA, 17 bp, Homo sapiens
ggccctctttccctgcg

SEQ ID NO: 4524565 - DNA, 14 bp, Homo sapiens
ggccctgaggcgga

SEQ ID NO: 4524566 - DNA, 13 bp, Homo sapiens
ggccctgccccac

SEQ ID NO: 4524567 - DNA, 17 bp, Homo sapiens
ggccctgcccccacccc

SEQ ID NO: 4524568 - DNA, 23 bp, Homo sapiens
ggccctgcccccaccccttcctg

SEQ ID NO: 4524569 - DNA, 10 bp, Homo sapiens
ggccctgcct

SEQ ID NO: 4524570 - DNA, 12 bp, Homo sapiens
ggccctgcctgc

SEQ ID NO: 4524571 - DNA, 15 bp, Homo sapiens
ggccctgcctgcagc

SEQ ID NO: 4524572 - DNA, 19 bp, Homo sapiens
ggccctgcctgcagccagg

SEQ ID NO: 4524573 - DNA, 21 bp, Homo sapiens
ggccctgcctgcagccagggc

SEQ ID NO: 4524574 - DNA, 11 bp, Homo sapiens
ggccctggagg

SEQ ID NO: 4524575 - DNA, 15 bp, Homo sapiens
ggccctggccaggac

SEQ ID NO: 4524576 - DNA, 21 bp, Homo sapiens
ggcagctgcctctgctccctc

SEQ ID NO: 4524577 - DNA, 14 bp, Homo sapiens
ggcagctgggccca

SEQ ID NO: 4524578 - DNA, 16 bp, Homo sapiens
ggcaggaaagcatgca

SEQ ID NO: 4524579 - DNA, 15 bp, Homo sapiens
ggcaggaacaaacag

SEQ ID NO: 4524580 - DNA, 15 bp, Homo sapiens
ggcaggaaggagagc

SEQ ID NO: 4524581 - DNA, 16 bp, Homo sapiens
ggcaggaaggagagcc

SEQ ID NO: 4524582 - DNA, 23 bp, Homo sapiens
ggcaggaaggagagcctgctgca

SEQ ID NO: 4524583 - DNA, 23 bp, Homo sapiens
ggcaggagaagaacaagaaatgg

SEQ ID NO: 4524584 - DNA, 19 bp, Homo sapiens
ggcaggaggaaaaggcttg

SEQ ID NO: 4524585 - DNA, 15 bp, Homo sapiens
ggcaggaggatcact

SEQ ID NO: 4524586 - DNA, 18 bp, Homo sapiens
ggcaggcacacagcagcc

SEQ ID NO: 4524587 - DNA, 20 bp, Homo sapiens
ggcaggcacacagcagcccc

SEQ ID NO: 4524588 - DNA, 22 bp, Homo sapiens
ggcaggcacacagcagcccccc

SEQ ID NO: 4524589 - DNA, 23 bp, Homo sapiens
ggcaggcatcggggagccgggag

SEQ ID NO: 4524590 - DNA, 18 bp, Homo sapiens
ggcaggcccactccccag

SEQ ID NO: 4524591 - DNA, 21 bp, Homo sapiens
ggcaggcccactccccagccc

SEQ ID NO: 4524592 - DNA, 19 bp, Homo sapiens
ggcaggctcactgccaggc

SEQ ID NO: 4524593 - DNA, 22 bp, Homo sapiens
ggcaggctcactgccaggccag

SEQ ID NO: 4524594 - DNA, 14 bp, Homo sapiens
ggcaggctgggacg

SEQ ID NO: 4524595 - DNA, 14 bp, Homo sapiens
ggcaggctgggcca

SEQ ID NO: 4524596 - DNA, 16 bp, Homo sapiens
ggcaggctgggccatg

SEQ ID NO: 4524597 - DNA, 22 bp, Homo sapiens
ggcaggctgggccatgtccaaa

SEQ ID NO: 4524598 - DNA, 14 bp, Homo sapiens
ggcagggagggctt

SEQ ID NO: 4524599 - DNA, 24 bp, Homo sapiens
ggcagggccactcaacagagagga

SEQ ID NO: 4524600 - DNA, 15 bp, Homo sapiens
ggcagggcccccaat

SEQ ID NO: 4524601 - DNA, 18 bp, Homo sapiens
ggcagggcccccaataaa

SEQ ID NO: 4524602 - DNA, 20 bp, Homo sapiens
ggcagggcccccaataaacc

SEQ ID NO: 4524603 - DNA, 17 bp, Homo sapiens
ggcagggcctggctcca

SEQ ID NO: 4524604 - DNA, 18 bp, Homo sapiens
ggcagggcctggctccag

SEQ ID NO: 4524605 - DNA, 16 bp, Homo sapiens
ggcagggcgagctgca

SEQ ID NO: 4524606 - DNA, 17 bp, Homo sapiens
ggcagggcgagctgcag

SEQ ID NO: 4524607 - DNA, 19 bp, Homo sapiens
ggcagggcgggcagagggc

SEQ ID NO: 4524608 - DNA, 21 bp, Homo sapiens
ggcagggcgggcagagggctg

SEQ ID NO: 4524609 - DNA, 18 bp, Homo sapiens
ggcaggggagacaggagc

SEQ ID NO: 4524610 - DNA, 23 bp, Homo sapiens
ggcaggggagacaggagcctagc

SEQ ID NO: 4524611 - DNA, 12 bp, Homo sapiens
ggcaggggcgga

SEQ ID NO: 4524612 - DNA, 13 bp, Homo sapiens
ggcagggggccct

SEQ ID NO: 4524613 - DNA, 18 bp, Homo sapiens
ggcaggggtcagagcact

SEQ ID NO: 4524614 - DNA, 20 bp, Homo sapiens
ggcaggggtgcttcctcctc

SEQ ID NO: 4524615 - DNA, 13 bp, Homo sapiens
ggcaggggtgggg

SEQ ID NO: 4524616 - DNA, 17 bp, Homo sapiens
ggcaggtcacagaaagg

SEQ ID NO: 4524617 - DNA, 15 bp, Homo sapiens
ggcaggtcctgccca

SEQ ID NO: 4524618 - DNA, 21 bp, Homo sapiens
ggcaggtggacgctgcagacc

SEQ ID NO: 4524619 - DNA, 22 bp, Homo sapiens
ggcaggtgtttattaaaattct

SEQ ID NO: 4524620 - DNA, 14 bp, Homo sapiens
ggcagtaataaaaa

SEQ ID NO: 4524621 - DNA, 20 bp, Homo sapiens
ggcagtagcctcctcctggg

SEQ ID NO: 4524622 - DNA, 22 bp, Homo sapiens
ggcagtagcctcctcctgggct

SEQ ID NO: 4524623 - DNA, 23 bp, Homo sapiens
ggcagtcattcagcaccagagca

SEQ ID NO: 4524624 - DNA, 20 bp, Homo sapiens
ggcagtccaggcctctctct

SEQ ID NO: 4524625 - DNA, 16 bp, Homo sapiens
ggcagtctccccttcc

SEQ ID NO: 4524626 - DNA, 20 bp, Homo sapiens
ggcagtctccccttcctggc

SEQ ID NO: 4524627 - DNA, 22 bp, Homo sapiens
ggcagtctccccttcctggcac

SEQ ID NO: 4524628 - DNA, 14 bp, Homo sapiens
ggcagtctctctct

SEQ ID NO: 4524629 - DNA, 13 bp, Homo sapiens
ggcagtgccatgg

SEQ ID NO: 4524630 - DNA, 13 bp, Homo sapiens
ggcagtgccccag

SEQ ID NO: 4524631 - DNA, 16 bp, Homo sapiens
ggcagtgccccaggga

SEQ ID NO: 4524632 - DNA, 10 bp, Homo sapiens
ggcagttttt

SEQ ID NO: 4524633 - DNA, 17 bp, Homo sapiens
ggcatacacacagcagt

SEQ ID NO: 4524634 - DNA, 22 bp, Homo sapiens
ggcatagaggcttctccgccag

SEQ ID NO: 4524635 - DNA, 22 bp, Homo sapiens
ggcatccagagtccctgcctgg

SEQ ID NO: 4524636 - DNA, 16 bp, Homo sapiens
ggcatctccatgtaga

SEQ ID NO: 4524637 - DNA, 14 bp, Homo sapiens
ggcatctcttcccc

SEQ ID NO: 4524638 - DNA, 18 bp, Homo sapiens
ggcatctcttccccagag

SEQ ID NO: 4524639 - DNA, 21 bp, Homo sapiens
ggcatctcttccccagagagg

SEQ ID NO: 4524640 - DNA, 15 bp, Homo sapiens
ggcatcttggaaaag

SEQ ID NO: 4524641 - DNA, 16 bp, Homo sapiens
ggcatcttttgtatta

SEQ ID NO: 4524642 - DNA, 20 bp, Homo sapiens
ggcatgatcatagctcactg

SEQ ID NO: 4524643 - DNA, 19 bp, Homo sapiens
ggcatggcagggccaggcc

SEQ ID NO: 4524644 - DNA, 17 bp, Homo sapiens
ggcatggtgcagggaga

SEQ ID NO: 4524645 - DNA, 21 bp, Homo sapiens
ggcatggtggctcatgcctgt

SEQ ID NO: 4524646 - DNA, 11 bp, Homo sapiens
ggcatttccta

SEQ ID NO: 4524647 - DNA, 20 bp, Homo sapiens
ggcatttgcagggtcctctt

SEQ ID NO: 4524648 - DNA, 21 bp, Homo sapiens
ggcatttgcagggtcctcttc

SEQ ID NO: 4524649 - DNA, 21 bp, Homo sapiens
ggcatttggtgagagtcaaag

SEQ ID NO: 4524650 - DNA, 14 bp, Homo sapiens
ggcattttaagtaa

SEQ ID NO: 4524651 - DNA, 19 bp, Homo sapiens
ggcattttacaagaagtac

SEQ ID NO: 4524652 - DNA, 14 bp, Homo sapiens
ggcattttcctcct

SEQ ID NO: 4524653 - DNA, 17 bp, Homo sapiens
ggcattttcctcctctg

SEQ ID NO: 4524654 - DNA, 19 bp, Homo sapiens
ggcattttcctcctctgcc

SEQ ID NO: 4524655 - DNA, 20 bp, Homo sapiens
ggcattttcctcctctgcct

SEQ ID NO: 4524656 - DNA, 15 bp, Homo sapiens
ggccaaaaggaaaaa

SEQ ID NO: 4524657 - DNA, 19 bp, Homo sapiens
ggccaaaaggaaaaagctc

SEQ ID NO: 4524658 - DNA, 20 bp, Homo sapiens
ggccaaacccttgctttcct

SEQ ID NO: 4524659 - DNA, 16 bp, Homo sapiens
ggccaaagagtctcca

SEQ ID NO: 4524660 - DNA, 15 bp, Homo sapiens
ggccaagaagcagtg

SEQ ID NO: 4524661 - DNA, 18 bp, Homo sapiens
ggccaagaatacttgaag

SEQ ID NO: 4524662 - DNA, 13 bp, Homo sapiens
ggccaagacggga

SEQ ID NO: 4524663 - DNA, 13 bp, Homo sapiens
ggccaagcaggct

SEQ ID NO: 4524664 - DNA, 22 bp, Homo sapiens
ggccaagcaggctggtttgcaa

SEQ ID NO: 4524665 - DNA, 16 bp, Homo sapiens
ggccaaggacccaggc

SEQ ID NO: 4524666 - DNA, 17 bp, Homo sapiens
ggccaaggacccaggcg

SEQ ID NO: 4524667 - DNA, 23 bp, Homo sapiens
ggccaagtccgcagaagccctga

SEQ ID NO: 4524668 - DNA, 14 bp, Homo sapiens
ggccacacaggcag

SEQ ID NO: 4524669 - DNA, 21 bp, Homo sapiens
ggccacacaggcagggcctgg

SEQ ID NO: 4524670 - DNA, 15 bp, Homo sapiens
ggccacagagaacct

SEQ ID NO: 4524671 - DNA, 21 bp, Homo sapiens
ggccacagcaagtacagcggc

SEQ ID NO: 4524672 - DNA, 18 bp, Homo sapiens
ggccacaggcagtccagg

SEQ ID NO: 4524673 - DNA, 18 bp, Homo sapiens
ggccacatgggaggctca

SEQ ID NO: 4524674 - DNA, 21 bp, Homo sapiens
ggccaccagccatcctccctc

SEQ ID NO: 4524675 - DNA, 14 bp, Homo sapiens
ggccaccagggatc

SEQ ID NO: 4524676 - DNA, 19 bp, Homo sapiens
ggccaccccaaaccccagc

SEQ ID NO: 4524677 - DNA, 20 bp, Homo sapiens
ggccaccccaaaccccagcc

SEQ ID NO: 4524678 - DNA, 23 bp, Homo sapiens
ggccaccccaaaccccagcccca

SEQ ID NO: 4524679 - DNA, 19 bp, Homo sapiens
ggccaccccctatcctctg

SEQ ID NO: 4524680 - DNA, 15 bp, Homo sapiens
ggccacccctcccca

SEQ ID NO: 4524681 - DNA, 18 bp, Homo sapiens
ggccaccgccttgcccag

SEQ ID NO: 4524682 - DNA, 18 bp, Homo sapiens
ggccacctttgtgcagct

SEQ ID NO: 4524683 - DNA, 19 bp, Homo sapiens
ggccacgccggccacaccc

SEQ ID NO: 4524684 - DNA, 18 bp, Homo sapiens
ggccacgctccagctgcc

SEQ ID NO: 4524685 - DNA, 12 bp, Homo sapiens
ggccacgtgcca

SEQ ID NO: 4524686 - DNA, 16 bp, Homo sapiens
ggccacgtgccaggcc

SEQ ID NO: 4524687 - DNA, 15 bp, Homo sapiens
ggccactggatcctg

SEQ ID NO: 4524688 - DNA, 19 bp, Homo sapiens
ggccactggatcctgctgc

SEQ ID NO: 4524689 - DNA, 13 bp, Homo sapiens
ggccactggggac

SEQ ID NO: 4524690 - DNA, 15 bp, Homo sapiens
ggccacttctgggtg

SEQ ID NO: 4524691 - DNA, 21 bp, Homo sapiens
ggccagacatggtgtctcaca

SEQ ID NO: 4524692 - DNA, 14 bp, Homo sapiens
ggccagagcctctg

SEQ ID NO: 4524693 - DNA, 17 bp, Homo sapiens
ggccagagcctctggcc

SEQ ID NO: 4524694 - DNA, 11 bp, Homo sapiens
ggccagaggct

SEQ ID NO: 4524695 - DNA, 23 bp, Homo sapiens
ggccagaggctcgaggggctcag

SEQ ID NO: 4524696 - DNA, 12 bp, Homo sapiens
ggctgctcctcc

SEQ ID NO: 4524697 - DNA, 13 bp, Homo sapiens
ggctgctcctcca

SEQ ID NO: 4524698 - DNA, 13 bp, Homo sapiens
ggctgctctggga

SEQ ID NO: 4524699 - DNA, 17 bp, Homo sapiens
ggctgctctgggaaggg

SEQ ID NO: 4524700 - DNA, 10 bp, Homo sapiens
ggctgctgcc

SEQ ID NO: 4524701 - DNA, 18 bp, Homo sapiens
ggctgctgcccccacccc

SEQ ID NO: 4524702 - DNA, 18 bp, Homo sapiens
ggctgctggcgcctctgc

SEQ ID NO: 4524703 - DNA, 14 bp, Homo sapiens
ggctggaatctgga

SEQ ID NO: 4524704 - DNA, 19 bp, Homo sapiens
ggctggaatctggagagct

SEQ ID NO: 4524705 - DNA, 14 bp, Homo sapiens
ggctggactgaggc

SEQ ID NO: 4524706 - DNA, 17 bp, Homo sapiens
ggctggactgaggcctg

SEQ ID NO: 4524707 - DNA, 15 bp, Homo sapiens
ggctggactgcagtg

SEQ ID NO: 4524708 - DNA, 19 bp, Homo sapiens
ggctggactgcagtggcct

SEQ ID NO: 4524709 - DNA, 21 bp, Homo sapiens
ggctggacttctacctgccct

SEQ ID NO: 4524710 - DNA, 13 bp, Homo sapiens
ggctggagacccc

SEQ ID NO: 4524711 - DNA, 19 bp, Homo sapiens
ggctggagctcctccctcc

SEQ ID NO: 4524712 - DNA, 15 bp, Homo sapiens
ggctggaggcagggc

SEQ ID NO: 4524713 - DNA, 15 bp, Homo sapiens
ggctggaggcccagg

SEQ ID NO: 4524714 - DNA, 19 bp, Homo sapiens
ggctggagtgcagtggcgt

SEQ ID NO: 4524715 - DNA, 19 bp, Homo sapiens
ggctggcacagcccctgga

SEQ ID NO: 4524716 - DNA, 17 bp, Homo sapiens
ggctggcagctgagagc

SEQ ID NO: 4524717 - DNA, 16 bp, Homo sapiens
ggctggcccagccctg

SEQ ID NO: 4524718 - DNA, 23 bp, Homo sapiens
ggctggccgggactgctgctctc

SEQ ID NO: 4524719 - DNA, 18 bp, Homo sapiens
ggctggcgcttggatctg

SEQ ID NO: 4524720 - DNA, 20 bp, Homo sapiens
ggctggcggctactcagcag

SEQ ID NO: 4524721 - DNA, 13 bp, Homo sapiens
ggctggcgggcct

SEQ ID NO: 4524722 - DNA, 11 bp, Homo sapiens
ggctggctccc

SEQ ID NO: 4524723 - DNA, 14 bp, Homo sapiens
ggctggctccccct

SEQ ID NO: 4524724 - DNA, 21 bp, Homo sapiens
ggctggctccccctccccagg

SEQ ID NO: 4524725 - DNA, 11 bp, Homo sapiens
ggctggctcct

SEQ ID NO: 4524726 - DNA, 23 bp, Homo sapiens
ggctgggaactgcagacctgtcc

SEQ ID NO: 4524727 - DNA, 14 bp, Homo sapiens
ggctgggagtccct

SEQ ID NO: 4524728 - DNA, 15 bp, Homo sapiens
ggctgggagtcccta

SEQ ID NO: 4524729 - DNA, 19 bp, Homo sapiens
ggctgggatggtgactcct

SEQ ID NO: 4524730 - DNA, 20 bp, Homo sapiens
ggctgggccatgtccaaaga

SEQ ID NO: 4524731 - DNA, 17 bp, Homo sapiens
ggctgggcccctccagg

SEQ ID NO: 4524732 - DNA, 21 bp, Homo sapiens
ggctgggcccctgggatggga

SEQ ID NO: 4524733 - DNA, 19 bp, Homo sapiens
ggctggggactgctacctc

SEQ ID NO: 4524734 - DNA, 14 bp, Homo sapiens
ggctgggggctgcc

SEQ ID NO: 4524735 - DNA, 10 bp, Homo sapiens
ggctggggtc

SEQ ID NO: 4524736 - DNA, 17 bp, Homo sapiens
ggctggggtcacagagg

SEQ ID NO: 4524737 - DNA, 18 bp, Homo sapiens
ggctggggtcacagaggc

SEQ ID NO: 4524738 - DNA, 23 bp, Homo sapiens
ggctggggttgccagaggccctg

SEQ ID NO: 4524739 - DNA, 15 bp, Homo sapiens
ggctgggtcctgcca

SEQ ID NO: 4524740 - DNA, 19 bp, Homo sapiens
ggctgggtcctgccagctg

SEQ ID NO: 4524741 - DNA, 13 bp, Homo sapiens
ggctgggtgctgg

SEQ ID NO: 4524742 - DNA, 20 bp, Homo sapiens
ggctgggtgtttcagtttga

SEQ ID NO: 4524743 - DNA, 16 bp, Homo sapiens
ggctggtagcagcagg

SEQ ID NO: 4524744 - DNA, 17 bp, Homo sapiens
ggctggtagcagcaggc

SEQ ID NO: 4524745 - DNA, 22 bp, Homo sapiens
ggctggtagcagcaggctcagg

SEQ ID NO: 4524746 - DNA, 13 bp, Homo sapiens
ggctggtgtcccc

SEQ ID NO: 4524747 - DNA, 22 bp, Homo sapiens
ggctggtgtccccttcccctgc

SEQ ID NO: 4524748 - DNA, 23 bp, Homo sapiens
ggctggttcggatttggggtgga

SEQ ID NO: 4524749 - DNA, 14 bp, Homo sapiens
ggctgtaaaactta

SEQ ID NO: 4524750 - DNA, 21 bp, Homo sapiens
ggctgtcctaccatcagctct

SEQ ID NO: 4524751 - DNA, 18 bp, Homo sapiens
ggctgtcttaaaagatat

SEQ ID NO: 4524752 - DNA, 14 bp, Homo sapiens
ggctgtgggcaagc

SEQ ID NO: 4524753 - DNA, 19 bp, Homo sapiens
ggctgtgtcctaaggccca

SEQ ID NO: 4524754 - DNA, 20 bp, Homo sapiens
ggctgttaggacagcaaagc

SEQ ID NO: 4524755 - DNA, 22 bp, Homo sapiens
ggctgttccagactcaggttcc

SEQ ID NO: 4524756 - DNA, 15 bp, Homo sapiens
ggctgttcctcccct

SEQ ID NO: 4524757 - DNA, 13 bp, Homo sapiens
ggctgttctcagc

SEQ ID NO: 4524758 - DNA, 21 bp, Homo sapiens
ggctgttctgtggttcctctg

SEQ ID NO: 4524759 - DNA, 14 bp, Homo sapiens
ggctgtttcatcag

SEQ ID NO: 4524760 - DNA, 18 bp, Homo sapiens
ggctgtttttggctgttt

SEQ ID NO: 4524761 - DNA, 14 bp, Homo sapiens
ggcttaatcatttt

SEQ ID NO: 4524762 - DNA, 13 bp, Homo sapiens
ggcttagtgccac

SEQ ID NO: 4524763 - DNA, 19 bp, Homo sapiens
ggcttagtgccacccacct

SEQ ID NO: 4524764 - DNA, 15 bp, Homo sapiens
ggcttccccactccc

SEQ ID NO: 4524765 - DNA, 20 bp, Homo sapiens
ggcttccctgacttgcttta

SEQ ID NO: 4524766 - DNA, 17 bp, Homo sapiens
ggcttccgtgagacaca

SEQ ID NO: 4524767 - DNA, 13 bp, Homo sapiens
ggcttcctgccct

SEQ ID NO: 4524768 - DNA, 18 bp, Homo sapiens
ggcttcctgcccttccct

SEQ ID NO: 4524769 - DNA, 19 bp, Homo sapiens
ggcttcctgcccttccctc

SEQ ID NO: 4524770 - DNA, 19 bp, Homo sapiens
ggcttcctgcgtcctcctc

SEQ ID NO: 4524771 - DNA, 17 bp, Homo sapiens
ggcttcggacaaaatat

SEQ ID NO: 4524772 - DNA, 22 bp, Homo sapiens
ggcttctcacgctttgtttact

SEQ ID NO: 4524773 - DNA, 23 bp, Homo sapiens
ggcttctccagggaattcttaca

SEQ ID NO: 4524774 - DNA, 18 bp, Homo sapiens
ggcttctccgccagcctc

SEQ ID NO: 4524775 - DNA, 14 bp, Homo sapiens
ggcttctcctcctc

SEQ ID NO: 4524776 - DNA, 14 bp, Homo sapiens
ggcttctcctgttt

SEQ ID NO: 4524777 - DNA, 20 bp, Homo sapiens
ggcttctcctgttttatata

SEQ ID NO: 4524778 - DNA, 22 bp, Homo sapiens
ggcttctcctgttttatatatt

SEQ ID NO: 4524779 - DNA, 13 bp, Homo sapiens
ggcttctgtgggg

SEQ ID NO: 4524780 - DNA, 20 bp, Homo sapiens
ggcttctgtttctagttgag

SEQ ID NO: 4524781 - DNA, 11 bp, Homo sapiens
ggcttgctgtt

SEQ ID NO: 4524782 - DNA, 24 bp, Homo sapiens
ggcttggatttcgtgtgccgctgc

SEQ ID NO: 4524783 - DNA, 13 bp, Homo sapiens
ggcttggcccagc

SEQ ID NO: 4524784 - DNA, 12 bp, Homo sapiens
ggcttggcctgc

SEQ ID NO: 4524785 - DNA, 15 bp, Homo sapiens
ggcttggcctgctgt

SEQ ID NO: 4524786 - DNA, 12 bp, Homo sapiens
ggcttgggattt

SEQ ID NO: 4524787 - DNA, 15 bp, Homo sapiens
ggcttgtaactccac

SEQ ID NO: 4524788 - DNA, 18 bp, Homo sapiens
ggcttgtaactccaccaa

SEQ ID NO: 4524789 - DNA, 16 bp, Homo sapiens
ggcttgtttttcttca

SEQ ID NO: 4524790 - DNA, 19 bp, Homo sapiens
ggctttcaaagctaaaata

SEQ ID NO: 4524791 - DNA, 12 bp, Homo sapiens
ggctttcccagg

SEQ ID NO: 4524792 - DNA, 14 bp, Homo sapiens
ggctttcccaggag

SEQ ID NO: 4524793 - DNA, 19 bp, Homo sapiens
ggctttcccccaactcagg

SEQ ID NO: 4524794 - DNA, 14 bp, Homo sapiens
ggctttctggggcc

SEQ ID NO: 4524795 - DNA, 22 bp, Homo sapiens
ggctttgaaacctcagggctgt

SEQ ID NO: 4524796 - DNA, 14 bp, Homo sapiens
ggctttgcagctgc

SEQ ID NO: 4524797 - DNA, 15 bp, Homo sapiens
ggctttgcagctgct

SEQ ID NO: 4524798 - DNA, 17 bp, Homo sapiens
ggctttgcagctgctgt

SEQ ID NO: 4524799 - DNA, 12 bp, Homo sapiens
ggctttgcctct

SEQ ID NO: 4524800 - DNA, 15 bp, Homo sapiens
ggctttgcctcttct

SEQ ID NO: 4524801 - DNA, 17 bp, Homo sapiens
ggctttgcctcttcttt

SEQ ID NO: 4524802 - DNA, 19 bp, Homo sapiens
ggctttgcctcttctttgt

SEQ ID NO: 4524803 - DNA, 20 bp, Homo sapiens
ggcttttattaatgcacttt

SEQ ID NO: 4524804 - DNA, 20 bp, Homo sapiens
ggcttttcgcttgcttctgc

SEQ ID NO: 4524805 - DNA, 21 bp, Homo sapiens
ggcttttcgcttgcttctgca

SEQ ID NO: 4524806 - DNA, 22 bp, Homo sapiens
ggcttttcgcttgcttctgcag

SEQ ID NO: 4524807 - DNA, 15 bp, Homo sapiens
gggaaaaaaatgttg

SEQ ID NO: 4524808 - DNA, 20 bp, Homo sapiens
gggaaaaaacttaaaaatta

SEQ ID NO: 4524809 - DNA, 15 bp, Homo sapiens
gggaaaacagaaaac

SEQ ID NO: 4524810 - DNA, 17 bp, Homo sapiens
gggaaaattatttgcat

SEQ ID NO: 4524811 - DNA, 15 bp, Homo sapiens
gggaaacagcctctc

SEQ ID NO: 4524812 - DNA, 16 bp, Homo sapiens
gggaaacagcctctct

SEQ ID NO: 4524813 - DNA, 17 bp, Homo sapiens
gggaaacagcctctctc

SEQ ID NO: 4524814 - DNA, 19 bp, Homo sapiens
gggaaacaggttgggatgg

SEQ ID NO: 4524815 - DNA, 12 bp, Homo sapiens
gggaaactggct

SEQ ID NO: 4524816 - DNA, 16 bp, Homo sapiens
gggaaactgggaaact

SEQ ID NO: 4524817 - DNA, 20 bp, Homo sapiens
ggcgggctcagagctttgtc

SEQ ID NO: 4524818 - DNA, 20 bp, Homo sapiens
ggcgggtggatcatgaggtc

SEQ ID NO: 4524819 - DNA, 19 bp, Homo sapiens
ggcggtcggatctacagaa

SEQ ID NO: 4524820 - DNA, 22 bp, Homo sapiens
ggcgtgcccccctcctccagta

SEQ ID NO: 4524821 - DNA, 14 bp, Homo sapiens
ggcgtgctcagacc

SEQ ID NO: 4524822 - DNA, 22 bp, Homo sapiens
ggctaaaaaagctgaatcagac

SEQ ID NO: 4524823 - DNA, 16 bp, Homo sapiens
ggctaaaaggcttcca

SEQ ID NO: 4524824 - DNA, 20 bp, Homo sapiens
ggctaaaaggcttccaggct

SEQ ID NO: 4524825 - DNA, 13 bp, Homo sapiens
ggctaagaaaaag

SEQ ID NO: 4524826 - DNA, 19 bp, Homo sapiens
ggctaagagctagcgctgc

SEQ ID NO: 4524827 - DNA, 12 bp, Homo sapiens
ggctaatttaac

SEQ ID NO: 4524828 - DNA, 13 bp, Homo sapiens
ggctacagctcca

SEQ ID NO: 4524829 - DNA, 12 bp, Homo sapiens
ggctacatcagc

SEQ ID NO: 4524830 - DNA, 16 bp, Homo sapiens
ggctacatcagccttc

SEQ ID NO: 4524831 - DNA, 17 bp, Homo sapiens
ggctacccgctgtggcc

SEQ ID NO: 4524832 - DNA, 19 bp, Homo sapiens
ggctacccgctgtggccgg

SEQ ID NO: 4524833 - DNA, 16 bp, Homo sapiens
ggctagaacctggaga

SEQ ID NO: 4524834 - DNA, 18 bp, Homo sapiens
ggctagaacctggagggc

SEQ ID NO: 4524835 - DNA, 15 bp, Homo sapiens
ggctagaactggaga

SEQ ID NO: 4524836 - DNA, 13 bp, Homo sapiens
ggctagaatctgg

SEQ ID NO: 4524837 - DNA, 16 bp, Homo sapiens
ggctagaatctggaga

SEQ ID NO: 4524838 - DNA, 22 bp, Homo sapiens
ggctagaatctggagagctaga

SEQ ID NO: 4524839 - DNA, 18 bp, Homo sapiens
ggctagaggccagcccca

SEQ ID NO: 4524840 - DNA, 14 bp, Homo sapiens
ggctagagtcctca

SEQ ID NO: 4524841 - DNA, 20 bp, Homo sapiens
ggctaggtagaaaaagggtc

SEQ ID NO: 4524842 - DNA, 13 bp, Homo sapiens
ggctagtcagaga

SEQ ID NO: 4524843 - DNA, 15 bp, Homo sapiens
ggctagtcagagaga

SEQ ID NO: 4524844 - DNA, 23 bp, Homo sapiens
ggctataggtgctacaaaaacac

SEQ ID NO: 4524845 - DNA, 21 bp, Homo sapiens
ggctatgaaaatgagccctgg

SEQ ID NO: 4524846 - DNA, 19 bp, Homo sapiens
ggctcaaatgatcctccca

SEQ ID NO: 4524847 - DNA, 22 bp, Homo sapiens
ggctcaaccttccaacttcctg

SEQ ID NO: 4524848 - DNA, 19 bp, Homo sapiens
ggctcaagcaatcctcctg

SEQ ID NO: 4524849 - DNA, 20 bp, Homo sapiens
ggctcaagcaatcctcctgc

SEQ ID NO: 4524850 - DNA, 22 bp, Homo sapiens
ggctcaagcaatcctcctgcct

SEQ ID NO: 4524851 - DNA, 19 bp, Homo sapiens
ggctcaagcgattctcctg

SEQ ID NO: 4524852 - DNA, 13 bp, Homo sapiens
ggctcaagttttt

SEQ ID NO: 4524853 - DNA, 12 bp, Homo sapiens
ggctcacactga

SEQ ID NO: 4524854 - DNA, 14 bp, Homo sapiens
ggctcacactgaga

SEQ ID NO: 4524855 - DNA, 16 bp, Homo sapiens
ggctcacccagtcctg

SEQ ID NO: 4524856 - DNA, 17 bp, Homo sapiens
ggctcacgcctgtaatc

SEQ ID NO: 4524857 - DNA, 23 bp, Homo sapiens
ggctcacgcctgtaatcccagca

SEQ ID NO: 4524858 - DNA, 19 bp, Homo sapiens
ggctcactgccaggccagc

SEQ ID NO: 4524859 - DNA, 13 bp, Homo sapiens
ggctcactgtgct

SEQ ID NO: 4524860 - DNA, 16 bp, Homo sapiens
ggctcagaagaattta

SEQ ID NO: 4524861 - DNA, 21 bp, Homo sapiens
ggctcagacccctcagcccca

SEQ ID NO: 4524862 - DNA, 14 bp, Homo sapiens
ggctcagagtgggg

SEQ ID NO: 4524863 - DNA, 14 bp, Homo sapiens
ggctcagcccgctg

SEQ ID NO: 4524864 - DNA, 15 bp, Homo sapiens
ggctcatgcacccct

SEQ ID NO: 4524865 - DNA, 13 bp, Homo sapiens
ggctccaactcct

SEQ ID NO: 4524866 - DNA, 23 bp, Homo sapiens
ggctccaactcctttcagccaca

SEQ ID NO: 4524867 - DNA, 22 bp, Homo sapiens
ggctccactcttgatctctctt

SEQ ID NO: 4524868 - DNA, 13 bp, Homo sapiens
ggctccagagggc

SEQ ID NO: 4524869 - DNA, 16 bp, Homo sapiens
ggctccagagggcact

SEQ ID NO: 4524870 - DNA, 22 bp, Homo sapiens
ggctccagagggcactctgctt

SEQ ID NO: 4524871 - DNA, 15 bp, Homo sapiens
ggctccagctctggc

SEQ ID NO: 4524872 - DNA, 12 bp, Homo sapiens
ggctccagtctc

SEQ ID NO: 4524873 - DNA, 19 bp, Homo sapiens
ggctccagtctcatcctcc

SEQ ID NO: 4524874 - DNA, 22 bp, Homo sapiens
ggctcccagctcctttctcctg

SEQ ID NO: 4524875 - DNA, 12 bp, Homo sapiens
ggctcccagggg

SEQ ID NO: 4524876 - DNA, 21 bp, Homo sapiens
ggctcccagggtccctgccca

SEQ ID NO: 4524877 - DNA, 19 bp, Homo sapiens
ggctcccatgaccatactg

SEQ ID NO: 4524878 - DNA, 22 bp, Homo sapiens
ggctccccctccccaggctgga

SEQ ID NO: 4524879 - DNA, 23 bp, Homo sapiens
ggctccccctccccaggctggag

SEQ ID NO: 4524880 - DNA, 13 bp, Homo sapiens
ggctccccgcctc

SEQ ID NO: 4524881 - DNA, 13 bp, Homo sapiens
ggctcccctctgc

SEQ ID NO: 4524882 - DNA, 14 bp, Homo sapiens
ggctcccctctgct

SEQ ID NO: 4524883 - DNA, 21 bp, Homo sapiens
ggctcccctgcccagcctgct

SEQ ID NO: 4524884 - DNA, 15 bp, Homo sapiens
ggctcccggaattcc

SEQ ID NO: 4524885 - DNA, 20 bp, Homo sapiens
ggctcccggggcctggacag

SEQ ID NO: 4524886 - DNA, 17 bp, Homo sapiens
ggctccctgactgggag

SEQ ID NO: 4524887 - DNA, 19 bp, Homo sapiens
ggctccgggcaccaggggc

SEQ ID NO: 4524888 - DNA, 14 bp, Homo sapiens
ggctcctcagagcg

SEQ ID NO: 4524889 - DNA, 17 bp, Homo sapiens
ggctcctcagagcgcca

SEQ ID NO: 4524890 - DNA, 20 bp, Homo sapiens
ggctcctcgagatcccaaca

SEQ ID NO: 4524891 - DNA, 12 bp, Homo sapiens
ggctcctgaggg

SEQ ID NO: 4524892 - DNA, 13 bp, Homo sapiens
ggctcctggtgct

SEQ ID NO: 4524893 - DNA, 13 bp, Homo sapiens
ggctcctgtctgg

SEQ ID NO: 4524894 - DNA, 21 bp, Homo sapiens
ggctcgaggggctcagggcct

SEQ ID NO: 4524895 - DNA, 21 bp, Homo sapiens
ggctcggaggctacccgctgt

SEQ ID NO: 4524896 - DNA, 16 bp, Homo sapiens
ggctcggaggctgccc

SEQ ID NO: 4524897 - DNA, 15 bp, Homo sapiens
ggctctaccttcctg

SEQ ID NO: 4524898 - DNA, 17 bp, Homo sapiens
ggctctccacctcagcc

SEQ ID NO: 4524899 - DNA, 21 bp, Homo sapiens
ggctctccacctcagccttgg

SEQ ID NO: 4524900 - DNA, 22 bp, Homo sapiens
ggctctcccctctcgccccatc

SEQ ID NO: 4524901 - DNA, 20 bp, Homo sapiens
ggctctctattccctcagcc

SEQ ID NO: 4524902 - DNA, 21 bp, Homo sapiens
ggctctctattccctcagcct

SEQ ID NO: 4524903 - DNA, 23 bp, Homo sapiens
ggctctctattccctcagcctaa

SEQ ID NO: 4524904 - DNA, 14 bp, Homo sapiens
ggctctgccctgga

SEQ ID NO: 4524905 - DNA, 15 bp, Homo sapiens
ggctctgggaatggg

SEQ ID NO: 4524906 - DNA, 12 bp, Homo sapiens
ggctctgtgctg

SEQ ID NO: 4524907 - DNA, 19 bp, Homo sapiens
ggctctgtgctgaccctcc

SEQ ID NO: 4524908 - DNA, 22 bp, Homo sapiens
ggctcttatagaagcttcagca

SEQ ID NO: 4524909 - DNA, 19 bp, Homo sapiens
ggctgaagaggaccagagg

SEQ ID NO: 4524910 - DNA, 19 bp, Homo sapiens
ggctgaatgtatgtaaata

SEQ ID NO: 4524911 - DNA, 17 bp, Homo sapiens
ggctgacattcactgag

SEQ ID NO: 4524912 - DNA, 18 bp, Homo sapiens
ggctgacattcactgagt

SEQ ID NO: 4524913 - DNA, 19 bp, Homo sapiens
ggctgacccagtccctggg

SEQ ID NO: 4524914 - DNA, 15 bp, Homo sapiens
ggctgagaggaagca

SEQ ID NO: 4524915 - DNA, 15 bp, Homo sapiens
ggctgagccctcctg

SEQ ID NO: 4524916 - DNA, 20 bp, Homo sapiens
ggctgaggaggcctccatct

SEQ ID NO: 4524917 - DNA, 17 bp, Homo sapiens
ggctgaggcagaagaat

SEQ ID NO: 4524918 - DNA, 12 bp, Homo sapiens
ggctgaggcagg

SEQ ID NO: 4524919 - DNA, 16 bp, Homo sapiens
ggctgaggggatacca

SEQ ID NO: 4524920 - DNA, 14 bp, Homo sapiens
ggctgaggttcctc

SEQ ID NO: 4524921 - DNA, 18 bp, Homo sapiens
ggctgaggttcctctgcc

SEQ ID NO: 4524922 - DNA, 21 bp, Homo sapiens
ggctgaggttcctctgcctgc

SEQ ID NO: 4524923 - DNA, 16 bp, Homo sapiens
ggctgagtctccaggg

SEQ ID NO: 4524924 - DNA, 21 bp, Homo sapiens
ggctgatggattccaaaccag

SEQ ID NO: 4524925 - DNA, 17 bp, Homo sapiens
ggctgcacccctgggcc

SEQ ID NO: 4524926 - DNA, 18 bp, Homo sapiens
ggctgcagagctgaccca

SEQ ID NO: 4524927 - DNA, 21 bp, Homo sapiens
ggctgcagtggctcccctgcc

SEQ ID NO: 4524928 - DNA, 17 bp, Homo sapiens
ggctgccaaggccagag

SEQ ID NO: 4524929 - DNA, 17 bp, Homo sapiens
ggctgccaccagccccc

SEQ ID NO: 4524930 - DNA, 17 bp, Homo sapiens
ggctgccagtgcctggg

SEQ ID NO: 4524931 - DNA, 14 bp, Homo sapiens
ggctgcccaggaga

SEQ ID NO: 4524932 - DNA, 20 bp, Homo sapiens
ggctgcccccggccccctgg

SEQ ID NO: 4524933 - DNA, 12 bp, Homo sapiens
ggctgcctccca

SEQ ID NO: 4524934 - DNA, 20 bp, Homo sapiens
ggctgcctcccttgtggcag

SEQ ID NO: 4524935 - DNA, 12 bp, Homo sapiens
ggctgctcccac

SEQ ID NO: 4524936 - DNA, 21 bp, Homo sapiens
ggctgctcccacctggctctg

SEQ ID NO: 4524937 - DNA, 12 bp, Homo sapiens
gggaaagaagaa

SEQ ID NO: 4524938 - DNA, 16 bp, Homo sapiens
gggaaagcgggcagcc

SEQ ID NO: 4524939 - DNA, 19 bp, Homo sapiens
gggaaaggatggagtgttt

SEQ ID NO: 4524940 - DNA, 22 bp, Homo sapiens
gggaaagtgtgagctcttccct

SEQ ID NO: 4524941 - DNA, 19 bp, Homo sapiens
gggaaatagcggccctgga

SEQ ID NO: 4524942 - DNA, 14 bp, Homo sapiens
gggaacaaggaagg

SEQ ID NO: 4524943 - DNA, 16 bp, Homo sapiens
gggaacagacaggaga

SEQ ID NO: 4524944 - DNA, 20 bp, Homo sapiens
gggaacccaagtccaagcat

SEQ ID NO: 4524945 - DNA, 14 bp, Homo sapiens
gggaacgtgactgc

SEQ ID NO: 4524946 - DNA, 17 bp, Homo sapiens
gggaacgtgactgcccc

SEQ ID NO: 4524947 - DNA, 16 bp, Homo sapiens
gggaagaaagagaagg

SEQ ID NO: 4524948 - DNA, 17 bp, Homo sapiens
gggaagacaaagcacac

SEQ ID NO: 4524949 - DNA, 14 bp, Homo sapiens
gggaagagaagaca

SEQ ID NO: 4524950 - DNA, 20 bp, Homo sapiens
gggaagagaagagggcccag

SEQ ID NO: 4524951 - DNA, 20 bp, Homo sapiens
gggaagagggaaatgtacac

SEQ ID NO: 4524952 - DNA, 23 bp, Homo sapiens
gggaagccattttccagtgactt

SEQ ID NO: 4524953 - DNA, 18 bp, Homo sapiens
gggaagcccatcctgacc

SEQ ID NO: 4524954 - DNA, 12 bp, Homo sapiens
gggaagcctggg

SEQ ID NO: 4524955 - DNA, 20 bp, Homo sapiens
gggaagcctgggtgtcaagt

SEQ ID NO: 4524956 - DNA, 19 bp, Homo sapiens
gggaaggacagtccctgct

SEQ ID NO: 4524957 - DNA, 16 bp, Homo sapiens
gggaagggagagcggg

SEQ ID NO: 4524958 - DNA, 16 bp, Homo sapiens
gggaagggcctgccca

SEQ ID NO: 4524959 - DNA, 14 bp, Homo sapiens
gggaaggggaatgg

SEQ ID NO: 4524960 - DNA, 19 bp, Homo sapiens
gggaagggtcccttttgca

SEQ ID NO: 4524961 - DNA, 16 bp, Homo sapiens
gggaagtcgaggctgc

SEQ ID NO: 4524962 - DNA, 13 bp, Homo sapiens
gggaagtgcagag

SEQ ID NO: 4524963 - DNA, 16 bp, Homo sapiens
gggaatgaacctggag

SEQ ID NO: 4524964 - DNA, 18 bp, Homo sapiens
gggaatgcacctccccaa

SEQ ID NO: 4524965 - DNA, 15 bp, Homo sapiens
gggaatgcagcagga

SEQ ID NO: 4524966 - DNA, 13 bp, Homo sapiens
gggaattcttaca

SEQ ID NO: 4524967 - DNA, 20 bp, Homo sapiens
gggaattttccccgtgacat

SEQ ID NO: 4524968 - DNA, 18 bp, Homo sapiens
gggacaccagccaggctc

SEQ ID NO: 4524969 - DNA, 20 bp, Homo sapiens
gggacaccagccaggctctg

SEQ ID NO: 4524970 - DNA, 18 bp, Homo sapiens
gggacagagacacctgca

SEQ ID NO: 4524971 - DNA, 15 bp, Homo sapiens
gggacagaggcctgc

SEQ ID NO: 4524972 - DNA, 12 bp, Homo sapiens
gggacagggctg

SEQ ID NO: 4524973 - DNA, 13 bp, Homo sapiens
gggacagggctgg

SEQ ID NO: 4524974 - DNA, 21 bp, Homo sapiens
gggacagggctggcccagccc

SEQ ID NO: 4524975 - DNA, 20 bp, Homo sapiens
gggacagtttatcatgaagc

SEQ ID NO: 4524976 - DNA, 22 bp, Homo sapiens
gggacagtttatcatgaagcct

SEQ ID NO: 4524977 - DNA, 20 bp, Homo sapiens
gggaccaaactcacggacca

SEQ ID NO: 4524978 - DNA, 16 bp, Homo sapiens
gggaccaactgggccc

SEQ ID NO: 4524979 - DNA, 22 bp, Homo sapiens
gggaccaattctggacagacag

SEQ ID NO: 4524980 - DNA, 16 bp, Homo sapiens
gggaccctcagcagct

SEQ ID NO: 4524981 - DNA, 17 bp, Homo sapiens
gggaccctcagcagctc

SEQ ID NO: 4524982 - DNA, 19 bp, Homo sapiens
gggaccctcagcagctctg

SEQ ID NO: 4524983 - DNA, 18 bp, Homo sapiens
gggaccctgcccagagct

SEQ ID NO: 4524984 - DNA, 21 bp, Homo sapiens
gggaccctgcccagagctgag

SEQ ID NO: 4524985 - DNA, 18 bp, Homo sapiens
gggaccggtacagaaagg

SEQ ID NO: 4524986 - DNA, 19 bp, Homo sapiens
gggaccggtgctgcaggag

SEQ ID NO: 4524987 - DNA, 18 bp, Homo sapiens
gggacctgccaggcaggg

SEQ ID NO: 4524988 - DNA, 14 bp, Homo sapiens
gggacctttaactt

SEQ ID NO: 4524989 - DNA, 22 bp, Homo sapiens
gggacgcctgggggtgccagga

SEQ ID NO: 4524990 - DNA, 13 bp, Homo sapiens
gggacgctgagga

SEQ ID NO: 4524991 - DNA, 17 bp, Homo sapiens
gggacggaccagcatct

SEQ ID NO: 4524992 - DNA, 18 bp, Homo sapiens
gggactaggacctgagcc

SEQ ID NO: 4524993 - DNA, 16 bp, Homo sapiens
gggactcagccctgag

SEQ ID NO: 4524994 - DNA, 17 bp, Homo sapiens
gggactcagccctgagg

SEQ ID NO: 4524995 - DNA, 21 bp, Homo sapiens
gggactgaggggaggggagca

SEQ ID NO: 4524996 - DNA, 12 bp, Homo sapiens
gggactgctgct

SEQ ID NO: 4524997 - DNA, 17 bp, Homo sapiens
gggactgctgctctccc

SEQ ID NO: 4524998 - DNA, 20 bp, Homo sapiens
gggacttcaactgcccagca

SEQ ID NO: 4524999 - DNA, 15 bp, Homo sapiens
gggacttgaacaaag

SEQ ID NO: 4525000 - DNA, 19 bp, Homo sapiens
gggacttgaacaaagacat

SEQ ID NO: 4525001 - DNA, 21 bp, Homo sapiens
gggacttgaacaaagacattt

SEQ ID NO: 4525002 - DNA, 13 bp, Homo sapiens
gggacttgtgtct

SEQ ID NO: 4525003 - DNA, 15 bp, Homo sapiens
gggacttgtgtctgc

SEQ ID NO: 4525004 - DNA, 12 bp, Homo sapiens
gggagaaatact

SEQ ID NO: 4525005 - DNA, 23 bp, Homo sapiens
gggagaaatagtcggtgaagaaa

SEQ ID NO: 4525006 - DNA, 14 bp, Homo sapiens
gggagaaatgccag

SEQ ID NO: 4525007 - DNA, 22 bp, Homo sapiens
gggagaagaaaggtgagtttga

SEQ ID NO: 4525008 - DNA, 23 bp, Homo sapiens
gggagaatcacttaagcctggaa

SEQ ID NO: 4525009 - DNA, 18 bp, Homo sapiens
gggagacaggagcctagc

SEQ ID NO: 4525010 - DNA, 15 bp, Homo sapiens
gggagacagggctgc

SEQ ID NO: 4525011 - DNA, 19 bp, Homo sapiens
gggagacagggctgctccc

SEQ ID NO: 4525012 - DNA, 20 bp, Homo sapiens
gggagaccctgaactcagaa

SEQ ID NO: 4525013 - DNA, 20 bp, Homo sapiens
gggagagacaggcagcccag

SEQ ID NO: 4525014 - DNA, 13 bp, Homo sapiens
gggagagaccctt

SEQ ID NO: 4525015 - DNA, 23 bp, Homo sapiens
gggagagagagagagagaggaca

SEQ ID NO: 4525016 - DNA, 21 bp, Homo sapiens
gggagagatccctgcagaacc

SEQ ID NO: 4525017 - DNA, 15 bp, Homo sapiens
gggagagggtctgga

SEQ ID NO: 4525018 - DNA, 14 bp, Homo sapiens
gggagcactgcgtt

SEQ ID NO: 4525019 - DNA, 23 bp, Homo sapiens
gggagcagagaggtggatcctgt

SEQ ID NO: 4525020 - DNA, 15 bp, Homo sapiens
gggagcagggaaggc

SEQ ID NO: 4525021 - DNA, 21 bp, Homo sapiens
gggagcatttaatggcagcta

SEQ ID NO: 4525022 - DNA, 11 bp, Homo sapiens
gggagccagac

SEQ ID NO: 4525023 - DNA, 17 bp, Homo sapiens
gggagccagactgtcca

SEQ ID NO: 4525024 - DNA, 19 bp, Homo sapiens
gggagcccactgaggggcc

SEQ ID NO: 4525025 - DNA, 13 bp, Homo sapiens
gggagccccaggg

SEQ ID NO: 4525026 - DNA, 17 bp, Homo sapiens
gggagcctagctcctgc

SEQ ID NO: 4525027 - DNA, 14 bp, Homo sapiens
gggagcctccccat

SEQ ID NO: 4525028 - DNA, 20 bp, Homo sapiens
gggagcctccccctcagatg

SEQ ID NO: 4525029 - DNA, 21 bp, Homo sapiens
gggagctcctctcctggagga

SEQ ID NO: 4525030 - DNA, 22 bp, Homo sapiens
gggagctcctctcctggaggat

SEQ ID NO: 4525031 - DNA, 13 bp, Homo sapiens
gggagctctgtat

SEQ ID NO: 4525032 - DNA, 13 bp, Homo sapiens
gggagctgagcag

SEQ ID NO: 4525033 - DNA, 18 bp, Homo sapiens
gggagctgagcagcctct

SEQ ID NO: 4525034 - DNA, 20 bp, Homo sapiens
gggagctgggccctgcctgc

SEQ ID NO: 4525035 - DNA, 21 bp, Homo sapiens
gggagctgggccctgcctgca

SEQ ID NO: 4525036 - DNA, 23 bp, Homo sapiens
gggagctgggccctgcctgcagc

SEQ ID NO: 4525037 - DNA, 12 bp, Homo sapiens
gggaggagggca

SEQ ID NO: 4525038 - DNA, 15 bp, Homo sapiens
gggaggatacagagg

SEQ ID NO: 4525039 - DNA, 18 bp, Homo sapiens
gggaggcaagtgtggggg

SEQ ID NO: 4525040 - DNA, 18 bp, Homo sapiens
gggaggcgtgcccccctc

SEQ ID NO: 4525041 - DNA, 18 bp, Homo sapiens
gggaggctcccggggcct

SEQ ID NO: 4525042 - DNA, 21 bp, Homo sapiens
gggaggctcccggggcctgga

SEQ ID NO: 4525043 - DNA, 18 bp, Homo sapiens
gggaggctgaggcagaag

SEQ ID NO: 4525044 - DNA, 16 bp, Homo sapiens
gggaggctgaggcagg

SEQ ID NO: 4525045 - DNA, 17 bp, Homo sapiens
gggaggctgaggcagga

SEQ ID NO: 4525046 - DNA, 13 bp, Homo sapiens
gggagggaaaagg

SEQ ID NO: 4525047 - DNA, 20 bp, Homo sapiens
gggagggaaaagggaagtag

SEQ ID NO: 4525048 - DNA, 12 bp, Homo sapiens
gggagggatcag

SEQ ID NO: 4525049 - DNA, 16 bp, Homo sapiens
gggagggcaggatggc

SEQ ID NO: 4525050 - DNA, 19 bp, Homo sapiens
gggagggcaggatggcctt

SEQ ID NO: 4525051 - DNA, 13 bp, Homo sapiens
gggagggctgcga

SEQ ID NO: 4525052 - DNA, 17 bp, Homo sapiens
gggaggggaagcttctg

SEQ ID NO: 4525053 - DNA, 17 bp, Homo sapiens
gggaggggcgcacccca

SEQ ID NO: 4525054 - DNA, 15 bp, Homo sapiens
gggaggtcactggaa

SEQ ID NO: 4525055 - DNA, 23 bp, Homo sapiens
gggaggtgcttctagttctgcca

SEQ ID NO: 4525056 - DNA, 23 bp, Homo sapiens
gggaggttgtggggcctcaggct

SEQ ID NO: 4525057 - DNA, 20 bp, Homo sapiens
gggagtaataggaccagagc

SEQ ID NO: 4525058 - DNA, 19 bp, Homo sapiens
gggagtcacatttgcatca

SEQ ID NO: 4525059 - DNA, 23 bp, Homo sapiens
gggagtcagggacctgctgctca

SEQ ID NO: 4525060 - DNA, 17 bp, Homo sapiens
gggagtccctacctgct

SEQ ID NO: 4525061 - DNA, 20 bp, Homo sapiens
gggagtccctacctgcttca

SEQ ID NO: 4525062 - DNA, 15 bp, Homo sapiens
gggagtgctgtgttt

SEQ ID NO: 4525063 - DNA, 21 bp, Homo sapiens
gggagttagcactgaactgct

SEQ ID NO: 4525064 - DNA, 23 bp, Homo sapiens
gggagttcgagaccaacctgacc

SEQ ID NO: 4525065 - DNA, 16 bp, Homo sapiens
gggataactgatttct

SEQ ID NO: 4525066 - DNA, 14 bp, Homo sapiens
gggatacagctgag

SEQ ID NO: 4525067 - DNA, 20 bp, Homo sapiens
gggatattgccttatttgtc

SEQ ID NO: 4525068 - DNA, 22 bp, Homo sapiens
gggatcacagaccacaggaaga

SEQ ID NO: 4525069 - DNA, 17 bp, Homo sapiens
gggatccacgctgggcc

SEQ ID NO: 4525070 - DNA, 17 bp, Homo sapiens
gggatcctccacagaga

SEQ ID NO: 4525071 - DNA, 18 bp, Homo sapiens
gggatcctccacagagag

SEQ ID NO: 4525072 - DNA, 13 bp, Homo sapiens
gggatcttcccac

SEQ ID NO: 4525073 - DNA, 16 bp, Homo sapiens
gggatcttcccacagg

SEQ ID NO: 4525074 - DNA, 17 bp, Homo sapiens
gggatgagcatgctgtt

SEQ ID NO: 4525075 - DNA, 14 bp, Homo sapiens
gggatgctgggctg

SEQ ID NO: 4525076 - DNA, 14 bp, Homo sapiens
gggatggaggagaa

SEQ ID NO: 4525077 - DNA, 17 bp, Homo sapiens
gggatggtggagggcca

SEQ ID NO: 4525078 - DNA, 18 bp, Homo sapiens
gggatggtggagggccac

SEQ ID NO: 4525079 - DNA, 18 bp, Homo sapiens
gggattgaagggtcctgc

SEQ ID NO: 4525080 - DNA, 22 bp, Homo sapiens
gggattgcccctggctttgcct

SEQ ID NO: 4525081 - DNA, 17 bp, Homo sapiens
gggattgtaaaatggtg

SEQ ID NO: 4525082 - DNA, 18 bp, Homo sapiens
gggcaaaccctggtgctt

SEQ ID NO: 4525083 - DNA, 22 bp, Homo sapiens
gggcaaaccctggtgctttcct

SEQ ID NO: 4525084 - DNA, 21 bp, Homo sapiens
gggcaagagagcgagaccctg

SEQ ID NO: 4525085 - DNA, 13 bp, Homo sapiens
gggcaagaggaat

SEQ ID NO: 4525086 - DNA, 17 bp, Homo sapiens
gggcaattggaacaaag

SEQ ID NO: 4525087 - DNA, 21 bp, Homo sapiens
gggcacacccctggggctgag

SEQ ID NO: 4525088 - DNA, 14 bp, Homo sapiens
gggcacagcctagg

SEQ ID NO: 4525089 - DNA, 18 bp, Homo sapiens
gggcacagtccagaccca

SEQ ID NO: 4525090 - DNA, 14 bp, Homo sapiens
gggcacgcctgctg

SEQ ID NO: 4525091 - DNA, 23 bp, Homo sapiens
gggcacggcgggatcctccacag

SEQ ID NO: 4525092 - DNA, 18 bp, Homo sapiens
gggcactccgcgccgatg

SEQ ID NO: 4525093 - DNA, 21 bp, Homo sapiens
gggcactccgcgccgatgcca

SEQ ID NO: 4525094 - DNA, 23 bp, Homo sapiens
gggcactccgcgccgatgccacc

SEQ ID NO: 4525095 - DNA, 14 bp, Homo sapiens
gggcactgccagcc

SEQ ID NO: 4525096 - DNA, 15 bp, Homo sapiens
gggcactgccagccc

SEQ ID NO: 4525097 - DNA, 13 bp, Homo sapiens
gggcactggggcc

SEQ ID NO: 4525098 - DNA, 14 bp, Homo sapiens
gggcagaacactaa

SEQ ID NO: 4525099 - DNA, 14 bp, Homo sapiens
gggcagactgtgaa

SEQ ID NO: 4525100 - DNA, 15 bp, Homo sapiens
gggcagaggctggag

SEQ ID NO: 4525101 - DNA, 15 bp, Homo sapiens
gggcagagggcagag

SEQ ID NO: 4525102 - DNA, 16 bp, Homo sapiens
gggcagattttcagca

SEQ ID NO: 4525103 - DNA, 14 bp, Homo sapiens
gggcagcaccctcc

SEQ ID NO: 4525104 - DNA, 20 bp, Homo sapiens
gggcagcagaagggggtggt

SEQ ID NO: 4525105 - DNA, 18 bp, Homo sapiens
gggcagccacaccactgc

SEQ ID NO: 4525106 - DNA, 12 bp, Homo sapiens
gggcagccagca

SEQ ID NO: 4525107 - DNA, 12 bp, Homo sapiens
gggcagccagga

SEQ ID NO: 4525108 - DNA, 13 bp, Homo sapiens
gggcagccaggct

SEQ ID NO: 4525109 - DNA, 16 bp, Homo sapiens
gggcagccaggctgcc

SEQ ID NO: 4525110 - DNA, 20 bp, Homo sapiens
gggcagcccaacagcacttt

SEQ ID NO: 4525111 - DNA, 21 bp, Homo sapiens
gggcagcctctccgactctgc

SEQ ID NO: 4525112 - DNA, 13 bp, Homo sapiens
gggcagctgggcc

SEQ ID NO: 4525113 - DNA, 14 bp, Homo sapiens
gggcagctgggccc

SEQ ID NO: 4525114 - DNA, 17 bp, Homo sapiens
gggcagctgggcccaac

SEQ ID NO: 4525115 - DNA, 21 bp, Homo sapiens
gggcaggaggaaaaggcttgg

SEQ ID NO: 4525116 - DNA, 13 bp, Homo sapiens
gggcaggctgggc

SEQ ID NO: 4525117 - DNA, 18 bp, Homo sapiens
gggcaggtcctgcccatg

SEQ ID NO: 4525118 - DNA, 17 bp, Homo sapiens
gggcagtcattatccag

SEQ ID NO: 4525119 - DNA, 19 bp, Homo sapiens
gggcagtctgagagaggcc

SEQ ID NO: 4525120 - DNA, 15 bp, Homo sapiens
gggcagtctgctctg

SEQ ID NO: 4525121 - DNA, 20 bp, Homo sapiens
gggcagtgctcacccacacc

SEQ ID NO: 4525122 - DNA, 18 bp, Homo sapiens
gggcagtgggtcccagat

SEQ ID NO: 4525123 - DNA, 20 bp, Homo sapiens
gggcatctcttccccagaga

SEQ ID NO: 4525124 - DNA, 21 bp, Homo sapiens
gggcatggtggctcatgcctg

SEQ ID NO: 4525125 - DNA, 17 bp, Homo sapiens
gggcattctgttggcct

SEQ ID NO: 4525126 - DNA, 19 bp, Homo sapiens
gggcattttcctcctctgc

SEQ ID NO: 4525127 - DNA, 20 bp, Homo sapiens
gggcattttcctcctctgcc

SEQ ID NO: 4525128 - DNA, 18 bp, Homo sapiens
gggccaacctcaggctcc

SEQ ID NO: 4525129 - DNA, 20 bp, Homo sapiens
gggccaacctcaggctccta

SEQ ID NO: 4525130 - DNA, 15 bp, Homo sapiens
gggccaaggtcctgc

SEQ ID NO: 4525131 - DNA, 19 bp, Homo sapiens
gggccacatagatgctgat

SEQ ID NO: 4525132 - DNA, 19 bp, Homo sapiens
gggccacatgggaggctca

SEQ ID NO: 4525133 - DNA, 12 bp, Homo sapiens
gggccaccacct

SEQ ID NO: 4525134 - DNA, 19 bp, Homo sapiens
gggccaccgccttgcccag

SEQ ID NO: 4525135 - DNA, 19 bp, Homo sapiens
gggccacgtgccaggcccg

SEQ ID NO: 4525136 - DNA, 11 bp, Homo sapiens
gggccactggg

SEQ ID NO: 4525137 - DNA, 22 bp, Homo sapiens
gggccactggggactttattta

SEQ ID NO: 4525138 - DNA, 15 bp, Homo sapiens
gggccagaggctggg

SEQ ID NO: 4525139 - DNA, 19 bp, Homo sapiens
gggccagaggctgggagtc

SEQ ID NO: 4525140 - DNA, 17 bp, Homo sapiens
gggccaggacaggcccg

SEQ ID NO: 4525141 - DNA, 19 bp, Homo sapiens
gggccaggagaatctccgc

SEQ ID NO: 4525142 - DNA, 21 bp, Homo sapiens
gggccaggcctctgctggctc

SEQ ID NO: 4525143 - DNA, 18 bp, Homo sapiens
gggccagtcctgcctggc

SEQ ID NO: 4525144 - DNA, 23 bp, Homo sapiens
gggccatctcttaggtgagacag

SEQ ID NO: 4525145 - DNA, 14 bp, Homo sapiens
gggccatgtccaaa

SEQ ID NO: 4525146 - DNA, 16 bp, Homo sapiens
gggcccaaccctgtct

SEQ ID NO: 4525147 - DNA, 18 bp, Homo sapiens
gggcccaagacagatgcc

SEQ ID NO: 4525148 - DNA, 23 bp, Homo sapiens
gggcccaagacagatgccccaga

SEQ ID NO: 4525149 - DNA, 19 bp, Homo sapiens
gggcccaaggcggcccctc

SEQ ID NO: 4525150 - DNA, 13 bp, Homo sapiens
gggcccagatctg

SEQ ID NO: 4525151 - DNA, 11 bp, Homo sapiens
gggcccagccc

SEQ ID NO: 4525152 - DNA, 13 bp, Homo sapiens
gggcccagcccct

SEQ ID NO: 4525153 - DNA, 9 bp, Homo sapiens
gggcccagg

SEQ ID NO: 4525154 - DNA, 18 bp, Homo sapiens
gggcccagggacaccagc

SEQ ID NO: 4525155 - DNA, 17 bp, Homo sapiens
gggcccaggggctgtgg

SEQ ID NO: 4525156 - DNA, 14 bp, Homo sapiens
gggccccagcccac

SEQ ID NO: 4525157 - DNA, 16 bp, Homo sapiens
gggccccagcccaccc

SEQ ID NO: 4525158 - DNA, 17 bp, Homo sapiens
gggccccagcccaccct

SEQ ID NO: 4525159 - DNA, 18 bp, Homo sapiens
gggccccagtcagcctct

SEQ ID NO: 4525160 - DNA, 22 bp, Homo sapiens
gggccccatcctcatccctgac

SEQ ID NO: 4525161 - DNA, 23 bp, Homo sapiens
gggccccatcttgatctttgagc

SEQ ID NO: 4525162 - DNA, 18 bp, Homo sapiens
gggcccccaataaaccag

SEQ ID NO: 4525163 - DNA, 12 bp, Homo sapiens
gggccccccaac

SEQ ID NO: 4525164 - DNA, 13 bp, Homo sapiens
gggcccctccagc

SEQ ID NO: 4525165 - DNA, 14 bp, Homo sapiens
gggcccctccagct

SEQ ID NO: 4525166 - DNA, 12 bp, Homo sapiens
gggcccctggga

SEQ ID NO: 4525167 - DNA, 13 bp, Homo sapiens
gggcccctggtga

SEQ ID NO: 4525168 - DNA, 21 bp, Homo sapiens
gggccctccgaccacttccag

SEQ ID NO: 4525169 - DNA, 21 bp, Homo sapiens
gggccctctctctgggcccag

SEQ ID NO: 4525170 - DNA, 13 bp, Homo sapiens
gggccctgcccca

SEQ ID NO: 4525171 - DNA, 19 bp, Homo sapiens
gggccctgccccaccccat

SEQ ID NO: 4525172 - DNA, 15 bp, Homo sapiens
gggccctgcctgcag

SEQ ID NO: 4525173 - DNA, 18 bp, Homo sapiens
gggccctgcctgcagcca

SEQ ID NO: 4525174 - DNA, 19 bp, Homo sapiens
gggccctgcctgcagccag

SEQ ID NO: 4525175 - DNA, 21 bp, Homo sapiens
gggccctggcttccctgccct

SEQ ID NO: 4525176 - DNA, 12 bp, Homo sapiens
gggccctgggcc

SEQ ID NO: 4525177 - DNA, 15 bp, Homo sapiens
gggccctgggcctca

SEQ ID NO: 4525178 - DNA, 18 bp, Homo sapiens
gggccctgggcctcagtt

SEQ ID NO: 4525179 - DNA, 21 bp, Homo sapiens
gggccctggtgtttctagcac

SEQ ID NO: 4525180 - DNA, 17 bp, Homo sapiens
gggccctttgagtgcag

SEQ ID NO: 4525181 - DNA, 13 bp, Homo sapiens
gggccgggcaggt

SEQ ID NO: 4525182 - DNA, 21 bp, Homo sapiens
gggccggttttcctcagctct

SEQ ID NO: 4525183 - DNA, 21 bp, Homo sapiens
gggcctagcgatctctcctgg

SEQ ID NO: 4525184 - DNA, 19 bp, Homo sapiens
gggcctcaggctccgggca

SEQ ID NO: 4525185 - DNA, 15 bp, Homo sapiens
gggcctctccttgga

SEQ ID NO: 4525186 - DNA, 13 bp, Homo sapiens
gggcctctctcct

SEQ ID NO: 4525187 - DNA, 23 bp, Homo sapiens
gggcctctgcggagcacactggc

SEQ ID NO: 4525188 - DNA, 15 bp, Homo sapiens
gggcctgacttgagc

SEQ ID NO: 4525189 - DNA, 22 bp, Homo sapiens
gggcctgacttgagccactcct

SEQ ID NO: 4525190 - DNA, 13 bp, Homo sapiens
gggcctgcccctg

SEQ ID NO: 4525191 - DNA, 13 bp, Homo sapiens
gggcctggacagg

SEQ ID NO: 4525192 - DNA, 19 bp, Homo sapiens
gggcctggacaggcgggct

SEQ ID NO: 4525193 - DNA, 14 bp, Homo sapiens
gggcctggagcccc

SEQ ID NO: 4525194 - DNA, 15 bp, Homo sapiens
gggcctggagcccca

SEQ ID NO: 4525195 - DNA, 15 bp, Homo sapiens
gggcctggccctgct

SEQ ID NO: 4525196 - DNA, 17 bp, Homo sapiens
gggcctggctccagtct

SEQ ID NO: 4525197 - DNA, 12 bp, Homo sapiens
gggcctgggcag

SEQ ID NO: 4525198 - DNA, 13 bp, Homo sapiens
gggcctgggcagg

SEQ ID NO: 4525199 - DNA, 15 bp, Homo sapiens
gggcctgggcaggag

SEQ ID NO: 4525200 - DNA, 16 bp, Homo sapiens
gggcctgggcaggagg

SEQ ID NO: 4525201 - DNA, 13 bp, Homo sapiens
gggcctggggagc

SEQ ID NO: 4525202 - DNA, 16 bp, Homo sapiens
gggcctggggagccca

SEQ ID NO: 4525203 - DNA, 22 bp, Homo sapiens
gggcctgtggggactgaacctg

SEQ ID NO: 4525204 - DNA, 20 bp, Homo sapiens
gggccttcgggaccctgggg

SEQ ID NO: 4525205 - DNA, 12 bp, Homo sapiens
gggccttgccca

SEQ ID NO: 4525206 - DNA, 15 bp, Homo sapiens
gggccttgcccagag

SEQ ID NO: 4525207 - DNA, 22 bp, Homo sapiens
gggccttgcccagagatgcctc

SEQ ID NO: 4525208 - DNA, 15 bp, Homo sapiens
gggcctttgcaagat

SEQ ID NO: 4525209 - DNA, 20 bp, Homo sapiens
gggcctttgccagcagagcc

SEQ ID NO: 4525210 - DNA, 22 bp, Homo sapiens
gggcctttgccagcagagccag

SEQ ID NO: 4525211 - DNA, 23 bp, Homo sapiens
gggccttttaagttgagcgtgcg

SEQ ID NO: 4525212 - DNA, 15 bp, Homo sapiens
gggcgagctgcagga

SEQ ID NO: 4525213 - DNA, 17 bp, Homo sapiens
gggcgcaccccacagct

SEQ ID NO: 4525214 - DNA, 21 bp, Homo sapiens
gggcgcaccccacagctgggg

SEQ ID NO: 4525215 - DNA, 22 bp, Homo sapiens
gggcgcaccccacagctggggc

SEQ ID NO: 4525216 - DNA, 13 bp, Homo sapiens
gggcgcccttgtc

SEQ ID NO: 4525217 - DNA, 17 bp, Homo sapiens
gggcgctcggtctccac

SEQ ID NO: 4525218 - DNA, 18 bp, Homo sapiens
gggcggcctcccaggtcc

SEQ ID NO: 4525219 - DNA, 14 bp, Homo sapiens
gggcgggctcagag

SEQ ID NO: 4525220 - DNA, 14 bp, Homo sapiens
gggcgtgaggaact

SEQ ID NO: 4525221 - DNA, 14 bp, Homo sapiens
gggctagaacctgg

SEQ ID NO: 4525222 - DNA, 15 bp, Homo sapiens
gggctagaacctgga

SEQ ID NO: 4525223 - DNA, 22 bp, Homo sapiens
gggctatcaacttaataagata

SEQ ID NO: 4525224 - DNA, 20 bp, Homo sapiens
gggctcaagcaatcctcctg

SEQ ID NO: 4525225 - DNA, 13 bp, Homo sapiens
gggctcagagctt

SEQ ID NO: 4525226 - DNA, 20 bp, Homo sapiens
gggctcagagctttgtcact

SEQ ID NO: 4525227 - DNA, 23 bp, Homo sapiens
gggctccagcaccttctttctgg

SEQ ID NO: 4525228 - DNA, 18 bp, Homo sapiens
gggctccaggagcctcat

SEQ ID NO: 4525229 - DNA, 22 bp, Homo sapiens
gggctccatgctgggtctgagg

SEQ ID NO: 4525230 - DNA, 17 bp, Homo sapiens
gggctcccagccaggcc

SEQ ID NO: 4525231 - DNA, 13 bp, Homo sapiens
gggctcccagctc

SEQ ID NO: 4525232 - DNA, 14 bp, Homo sapiens
gggctcccaggggt

SEQ ID NO: 4525233 - DNA, 22 bp, Homo sapiens
gggctcccaggggtctccctgg

SEQ ID NO: 4525234 - DNA, 12 bp, Homo sapiens
gggctccctgac

SEQ ID NO: 4525235 - DNA, 14 bp, Homo sapiens
gggctccctgactg

SEQ ID NO: 4525236 - DNA, 12 bp, Homo sapiens
gggctcctgccc

SEQ ID NO: 4525237 - DNA, 23 bp, Homo sapiens
gggctcctgcccaggccacagag

SEQ ID NO: 4525238 - DNA, 23 bp, Homo sapiens
gggctcgccgtgtctcagcctct

SEQ ID NO: 4525239 - DNA, 21 bp, Homo sapiens
gggctcggaggctacccgctg

SEQ ID NO: 4525240 - DNA, 15 bp, Homo sapiens
gggctcggaggctgc

SEQ ID NO: 4525241 - DNA, 18 bp, Homo sapiens
gggctctccacctcagcc

SEQ ID NO: 4525242 - DNA, 19 bp, Homo sapiens
gggctctccacctcagcct

SEQ ID NO: 4525243 - DNA, 22 bp, Homo sapiens
gggctcttctcaggggctctag

SEQ ID NO: 4525244 - DNA, 14 bp, Homo sapiens
gggctgacacccag

SEQ ID NO: 4525245 - DNA, 14 bp, Homo sapiens
gggctgaggccaga

SEQ ID NO: 4525246 - DNA, 18 bp, Homo sapiens
gggctgccaccagccccc

SEQ ID NO: 4525247 - DNA, 16 bp, Homo sapiens
gggctgccgagccacc

SEQ ID NO: 4525248 - DNA, 22 bp, Homo sapiens
gggctgcgacgcttgctctgtt

SEQ ID NO: 4525249 - DNA, 12 bp, Homo sapiens
gggctgctcacc

SEQ ID NO: 4525250 - DNA, 13 bp, Homo sapiens
gggctgctcccac

SEQ ID NO: 4525251 - DNA, 23 bp, Homo sapiens
gggctgctcccacctggctctgt

SEQ ID NO: 4525252 - DNA, 11 bp, Homo sapiens
gggctgctcct

SEQ ID NO: 4525253 - DNA, 18 bp, Homo sapiens
gggctgctcctccagggc

SEQ ID NO: 4525254 - DNA, 18 bp, Homo sapiens
gggctggaatctggagag

SEQ ID NO: 4525255 - DNA, 14 bp, Homo sapiens
gggctggaggccca

SEQ ID NO: 4525256 - DNA, 18 bp, Homo sapiens
gggctggcacagcccctg

SEQ ID NO: 4525257 - DNA, 14 bp, Homo sapiens
gggctggcagggcg

SEQ ID NO: 4525258 - DNA, 13 bp, Homo sapiens
gggctggcccagc

SEQ ID NO: 4525259 - DNA, 19 bp, Homo sapiens
gggctggcgcttggatctg

SEQ ID NO: 4525260 - DNA, 23 bp, Homo sapiens
gggctggcgcttggatctggggt

SEQ ID NO: 4525261 - DNA, 22 bp, Homo sapiens
gggctggcgggcctttttcctg

SEQ ID NO: 4525262 - DNA, 16 bp, Homo sapiens
gggctgggccaccagg

SEQ ID NO: 4525263 - DNA, 12 bp, Homo sapiens
gggctgggcccc

SEQ ID NO: 4525264 - DNA, 21 bp, Homo sapiens
gggctgggcccctccaggagt

SEQ ID NO: 4525265 - DNA, 18 bp, Homo sapiens
gggctggggttgccagag

SEQ ID NO: 4525266 - DNA, 15 bp, Homo sapiens
gggctggttttgctt

SEQ ID NO: 4525267 - DNA, 13 bp, Homo sapiens
gggctgtcccagc

SEQ ID NO: 4525268 - DNA, 15 bp, Homo sapiens
gggctgtcccagccc

SEQ ID NO: 4525269 - DNA, 15 bp, Homo sapiens
gggcttaaagcagaa

SEQ ID NO: 4525270 - DNA, 14 bp, Homo sapiens
gggcttatatctgg

SEQ ID NO: 4525271 - DNA, 21 bp, Homo sapiens
gggcttcacagccacacctgg

SEQ ID NO: 4525272 - DNA, 17 bp, Homo sapiens
gggcttccctggcctcc

SEQ ID NO: 4525273 - DNA, 19 bp, Homo sapiens
gggcttccctggcctcccg

SEQ ID NO: 4525274 - DNA, 15 bp, Homo sapiens
gggcttcctgccctt

SEQ ID NO: 4525275 - DNA, 17 bp, Homo sapiens
gggcttcctgcccttcc

SEQ ID NO: 4525276 - DNA, 22 bp, Homo sapiens
gggcttcctgcccttccctctg

SEQ ID NO: 4525277 - DNA, 15 bp, Homo sapiens
gggcttcctgggtcc

SEQ ID NO: 4525278 - DNA, 21 bp, Homo sapiens
gggcttctcctcctctgtctt

SEQ ID NO: 4525279 - DNA, 13 bp, Homo sapiens
gggcttgaagcca

SEQ ID NO: 4525280 - DNA, 17 bp, Homo sapiens
gggcttgaagccaaaga

SEQ ID NO: 4525281 - DNA, 17 bp, Homo sapiens
gggcttggcctgctgtg

SEQ ID NO: 4525282 - DNA, 13 bp, Homo sapiens
gggcttgggcctg

SEQ ID NO: 4525283 - DNA, 17 bp, Homo sapiens
gggcttgggcctgcacc

SEQ ID NO: 4525284 - DNA, 15 bp, Homo sapiens
gggcttggggctgca

SEQ ID NO: 4525285 - DNA, 14 bp, Homo sapiens
gggcttgtcctaga

SEQ ID NO: 4525286 - DNA, 20 bp, Homo sapiens
gggcttgtttttcttcagca

SEQ ID NO: 4525287 - DNA, 22 bp, Homo sapiens
gggctttgtgaccagaaagctt

SEQ ID NO: 4525288 - DNA, 17 bp, Homo sapiens
ggggaaacaggttggga

SEQ ID NO: 4525289 - DNA, 13 bp, Homo sapiens
ggggaactcctgg

SEQ ID NO: 4525290 - DNA, 22 bp, Homo sapiens
ggggaagaacagccccggggcc

SEQ ID NO: 4525291 - DNA, 14 bp, Homo sapiens
ggggaagccctgga

SEQ ID NO: 4525292 - DNA, 14 bp, Homo sapiens
ggggaagctggctt

SEQ ID NO: 4525293 - DNA, 14 bp, Homo sapiens
ggggacaccagagc

SEQ ID NO: 4525294 - DNA, 18 bp, Homo sapiens
ggggaccaattctggaca

SEQ ID NO: 4525295 - DNA, 18 bp, Homo sapiens
ggggacggggggccccag

SEQ ID NO: 4525296 - DNA, 13 bp, Homo sapiens
ggggactcagccc

SEQ ID NO: 4525297 - DNA, 15 bp, Homo sapiens
ggggactcagccctg

SEQ ID NO: 4525298 - DNA, 22 bp, Homo sapiens
ggggactccggctgtgctggga

SEQ ID NO: 4525299 - DNA, 17 bp, Homo sapiens
ggtggatcacagaggct

SEQ ID NO: 4525300 - DNA, 13 bp, Homo sapiens
ggtggatgtaaat

SEQ ID NO: 4525301 - DNA, 15 bp, Homo sapiens
ggtggatgtgctgga

SEQ ID NO: 4525302 - DNA, 17 bp, Homo sapiens
ggtggatgtgctggagg

SEQ ID NO: 4525303 - DNA, 23 bp, Homo sapiens
ggtggcacaggagtgtcctcttc

SEQ ID NO: 4525304 - DNA, 21 bp, Homo sapiens
ggtggcagatgtcttccctgg

SEQ ID NO: 4525305 - DNA, 22 bp, Homo sapiens
ggtggcaggcacacagcagccc

SEQ ID NO: 4525306 - DNA, 15 bp, Homo sapiens
ggtggccacacaggc

SEQ ID NO: 4525307 - DNA, 17 bp, Homo sapiens
ggtggccacacaggcag

SEQ ID NO: 4525308 - DNA, 20 bp, Homo sapiens
ggtggccacacaggcagggc

SEQ ID NO: 4525309 - DNA, 21 bp, Homo sapiens
ggtggccacacaggcagggcc

SEQ ID NO: 4525310 - DNA, 14 bp, Homo sapiens
ggtggccatccctg

SEQ ID NO: 4525311 - DNA, 16 bp, Homo sapiens
ggtggccatccctggg

SEQ ID NO: 4525312 - DNA, 18 bp, Homo sapiens
ggtggccatccctgggcc

SEQ ID NO: 4525313 - DNA, 21 bp, Homo sapiens
ggtggccatccctgggcccct

SEQ ID NO: 4525314 - DNA, 21 bp, Homo sapiens
ggtggcccaaatagaacaaga

SEQ ID NO: 4525315 - DNA, 15 bp, Homo sapiens
ggtggcccagagcca

SEQ ID NO: 4525316 - DNA, 15 bp, Homo sapiens
ggtggccgggcacag

SEQ ID NO: 4525317 - DNA, 18 bp, Homo sapiens
ggtggcctggaggtgggc

SEQ ID NO: 4525318 - DNA, 20 bp, Homo sapiens
ggtggcgtgagcctgtagtc

SEQ ID NO: 4525319 - DNA, 21 bp, Homo sapiens
ggtggctgacccagtccctgg

SEQ ID NO: 4525320 - DNA, 23 bp, Homo sapiens
ggtggctgacccagtccctgggg

SEQ ID NO: 4525321 - DNA, 16 bp, Homo sapiens
ggtggctgccccggcc

SEQ ID NO: 4525322 - DNA, 20 bp, Homo sapiens
ggtggctgccccggcctcct

SEQ ID NO: 4525323 - DNA, 23 bp, Homo sapiens
ggtggcttttgcggttcaggaaa

SEQ ID NO: 4525324 - DNA, 15 bp, Homo sapiens
ggtgggaagaaagaa

SEQ ID NO: 4525325 - DNA, 14 bp, Homo sapiens
ggtgggaagtgggg

SEQ ID NO: 4525326 - DNA, 20 bp, Homo sapiens
ggtgggagaattgcttgagc

SEQ ID NO: 4525327 - DNA, 12 bp, Homo sapiens
ggtgggagggag

SEQ ID NO: 4525328 - DNA, 15 bp, Homo sapiens
ggtgggattttgcaa

SEQ ID NO: 4525329 - DNA, 15 bp, Homo sapiens
ggtgggccttgctgg

SEQ ID NO: 4525330 - DNA, 22 bp, Homo sapiens
ggtgggcttcctgcccttccct

SEQ ID NO: 4525331 - DNA, 19 bp, Homo sapiens
ggtggggaggcccaaatga

SEQ ID NO: 4525332 - DNA, 12 bp, Homo sapiens
ggtggggctcct

SEQ ID NO: 4525333 - DNA, 14 bp, Homo sapiens
ggtggggctcctgg

SEQ ID NO: 4525334 - DNA, 17 bp, Homo sapiens
ggtggggctgctcctcc

SEQ ID NO: 4525335 - DNA, 22 bp, Homo sapiens
ggtggggctgctcctccagggc

SEQ ID NO: 4525336 - DNA, 14 bp, Homo sapiens
ggtgggggagggag

SEQ ID NO: 4525337 - DNA, 22 bp, Homo sapiens
ggtggggggggggcgcggctgg

SEQ ID NO: 4525338 - DNA, 16 bp, Homo sapiens
ggtgggggtggaggct

SEQ ID NO: 4525339 - DNA, 16 bp, Homo sapiens
ggtgggggtgggtcag

SEQ ID NO: 4525340 - DNA, 10 bp, Homo sapiens
ggtgggtcca

SEQ ID NO: 4525341 - DNA, 16 bp, Homo sapiens
ggtgggttttcttccc

SEQ ID NO: 4525342 - DNA, 17 bp, Homo sapiens
ggtgggttttcttccca

SEQ ID NO: 4525343 - DNA, 15 bp, Homo sapiens
ggtggtggctcggga

SEQ ID NO: 4525344 - DNA, 14 bp, Homo sapiens
ggtgtaatggagca

SEQ ID NO: 4525345 - DNA, 20 bp, Homo sapiens
ggtgtagatttctgacatca

SEQ ID NO: 4525346 - DNA, 23 bp, Homo sapiens
ggtgtagctaacagttgccacat

SEQ ID NO: 4525347 - DNA, 13 bp, Homo sapiens
ggtgtatagtgtt

SEQ ID NO: 4525348 - DNA, 21 bp, Homo sapiens
ggtgtatagtgttcacaaact

SEQ ID NO: 4525349 - DNA, 23 bp, Homo sapiens
ggtgtatagtgttcacaaactgt

SEQ ID NO: 4525350 - DNA, 14 bp, Homo sapiens
ggtgtcatttcatt

SEQ ID NO: 4525351 - DNA, 23 bp, Homo sapiens
ggtgtccccaacgtcccctccgc

SEQ ID NO: 4525352 - DNA, 15 bp, Homo sapiens
ggtgtccccttcccc

SEQ ID NO: 4525353 - DNA, 21 bp, Homo sapiens
ggtgtccccttcccctgctga

SEQ ID NO: 4525354 - DNA, 23 bp, Homo sapiens
ggtgtctccaaccccccagcact

SEQ ID NO: 4525355 - DNA, 19 bp, Homo sapiens
ggtgtctcccaacatggga

SEQ ID NO: 4525356 - DNA, 23 bp, Homo sapiens
ggtgtctgcaccttagaaaaaaa

SEQ ID NO: 4525357 - DNA, 13 bp, Homo sapiens
ggtgtctgcgggg

SEQ ID NO: 4525358 - DNA, 18 bp, Homo sapiens
ggtgtcttccctgcctgt

SEQ ID NO: 4525359 - DNA, 17 bp, Homo sapiens
ggtgtgaacccgggagc

SEQ ID NO: 4525360 - DNA, 18 bp, Homo sapiens
ggtgtgaacctacctgcc

SEQ ID NO: 4525361 - DNA, 15 bp, Homo sapiens
ggtgtgactctagca

SEQ ID NO: 4525362 - DNA, 21 bp, Homo sapiens
ggtgtgactctagcaaggctc

SEQ ID NO: 4525363 - DNA, 18 bp, Homo sapiens
ggtgtgatcgtctgactg

SEQ ID NO: 4525364 - DNA, 17 bp, Homo sapiens
ggtgtgcaccagggttg

SEQ ID NO: 4525365 - DNA, 17 bp, Homo sapiens
ggtgtgccttccagatc

SEQ ID NO: 4525366 - DNA, 18 bp, Homo sapiens
ggtgtgccttccagatcc

SEQ ID NO: 4525367 - DNA, 14 bp, Homo sapiens
ggtgtggcctcagc

SEQ ID NO: 4525368 - DNA, 19 bp, Homo sapiens
ggtgtggctttccaggcac

SEQ ID NO: 4525369 - DNA, 15 bp, Homo sapiens
ggtgtggggtggggt

SEQ ID NO: 4525370 - DNA, 14 bp, Homo sapiens
ggtgtgtttttggg

SEQ ID NO: 4525371 - DNA, 17 bp, Homo sapiens
ggtgttgtatgccttta

SEQ ID NO: 4525372 - DNA, 14 bp, Homo sapiens
ggtgtttcctctaa

SEQ ID NO: 4525373 - DNA, 15 bp, Homo sapiens
ggtgtttcctctaaa

SEQ ID NO: 4525374 - DNA, 18 bp, Homo sapiens
ggtgtttctagcactggc

SEQ ID NO: 4525375 - DNA, 18 bp, Homo sapiens
ggttaaacgtagcatgtg

SEQ ID NO: 4525376 - DNA, 16 bp, Homo sapiens
ggttaaagctaaactg

SEQ ID NO: 4525377 - DNA, 17 bp, Homo sapiens
ggttaagaaagcactta

SEQ ID NO: 4525378 - DNA, 21 bp, Homo sapiens
ggttaagcattaccactcagg

SEQ ID NO: 4525379 - DNA, 16 bp, Homo sapiens
ggttaagccctgaggg

SEQ ID NO: 4525380 - DNA, 15 bp, Homo sapiens
ggttacactgttaga

SEQ ID NO: 4525381 - DNA, 21 bp, Homo sapiens
ggttacactgttagaacacta

SEQ ID NO: 4525382 - DNA, 19 bp, Homo sapiens
ggttacgtggggtgcggga

SEQ ID NO: 4525383 - DNA, 19 bp, Homo sapiens
ggttactcagcagcagaga

SEQ ID NO: 4525384 - DNA, 22 bp, Homo sapiens
ggttatagccctgccctcccaa

SEQ ID NO: 4525385 - DNA, 14 bp, Homo sapiens
ggttattagaaagt

SEQ ID NO: 4525386 - DNA, 23 bp, Homo sapiens
ggttcaacaaagaaacaaagatg

SEQ ID NO: 4525387 - DNA, 19 bp, Homo sapiens
ggttcaagtgattctcttg

SEQ ID NO: 4525388 - DNA, 15 bp, Homo sapiens
ggttcacacagccca

SEQ ID NO: 4525389 - DNA, 15 bp, Homo sapiens
ggttcagaaaattaa

SEQ ID NO: 4525390 - DNA, 19 bp, Homo sapiens
ggttcagaaatagctcctc

SEQ ID NO: 4525391 - DNA, 16 bp, Homo sapiens
ggttcagcccctcctc

SEQ ID NO: 4525392 - DNA, 19 bp, Homo sapiens
ggttcagcccctcctctgc

SEQ ID NO: 4525393 - DNA, 20 bp, Homo sapiens
ggttcagcccctcctctgcc

SEQ ID NO: 4525394 - DNA, 22 bp, Homo sapiens
ggttcagcccctcctctgccac

SEQ ID NO: 4525395 - DNA, 22 bp, Homo sapiens
ggttccagaacagccctcggcc

SEQ ID NO: 4525396 - DNA, 20 bp, Homo sapiens
ggttccagcaattctcctgc

SEQ ID NO: 4525397 - DNA, 19 bp, Homo sapiens
ggttccctcctagctctcc

SEQ ID NO: 4525398 - DNA, 22 bp, Homo sapiens
ggttccgcttggagcagagggg

SEQ ID NO: 4525399 - DNA, 14 bp, Homo sapiens
ggttcctctgcctg

SEQ ID NO: 4525400 - DNA, 18 bp, Homo sapiens
ggttcctctgcctgcccc

SEQ ID NO: 4525401 - DNA, 18 bp, Homo sapiens
ggttcctctgtacagcaa

SEQ ID NO: 4525402 - DNA, 16 bp, Homo sapiens
ggttctaagtgggaga

SEQ ID NO: 4525403 - DNA, 10 bp, Homo sapiens
ggttctagac

SEQ ID NO: 4525404 - DNA, 17 bp, Homo sapiens
ggttctagacgcccctc

SEQ ID NO: 4525405 - DNA, 12 bp, Homo sapiens
ggttctcatctt

SEQ ID NO: 4525406 - DNA, 19 bp, Homo sapiens
ggttctgtgacccatctgt

SEQ ID NO: 4525407 - DNA, 23 bp, Homo sapiens
ggttcttagagccttagcagccc

SEQ ID NO: 4525408 - DNA, 16 bp, Homo sapiens
ggttgaactctggtgg

SEQ ID NO: 4525409 - DNA, 15 bp, Homo sapiens
ggttgaccccagagg

SEQ ID NO: 4525410 - DNA, 19 bp, Homo sapiens
ggttgaggtggaagccctc

SEQ ID NO: 4525411 - DNA, 12 bp, Homo sapiens
ggttgccagagg

SEQ ID NO: 4525412 - DNA, 17 bp, Homo sapiens
ggttgccagaggccctg

SEQ ID NO: 4525413 - DNA, 19 bp, Homo sapiens
ggttgccagaggccctgga

SEQ ID NO: 4525414 - DNA, 13 bp, Homo sapiens
ggttgctccattt

SEQ ID NO: 4525415 - DNA, 15 bp, Homo sapiens
ggttgggatgggata

SEQ ID NO: 4525416 - DNA, 20 bp, Homo sapiens
ggttgtggggcctcaggctc

SEQ ID NO: 4525417 - DNA, 15 bp, Homo sapiens
ggttgtgttgaggtt

SEQ ID NO: 4525418 - DNA, 22 bp, Homo sapiens
ggttgttgatattgtttgctgt

SEQ ID NO: 4525419 - DNA, 18 bp, Homo sapiens
ggtcccggctctgtgggt

SEQ ID NO: 4525420 - DNA, 19 bp, Homo sapiens
ggtcccggctctgtgggtg

SEQ ID NO: 4525421 - DNA, 22 bp, Homo sapiens
ggtcccggttcagacccctgcc

SEQ ID NO: 4525422 - DNA, 24 bp, Homo sapiens
ggtcccggttcagacccctgcctg

SEQ ID NO: 4525423 - DNA, 21 bp, Homo sapiens
ggtccctccaccccacagaac

SEQ ID NO: 4525424 - DNA, 20 bp, Homo sapiens
ggtccctgataacaacctgg

SEQ ID NO: 4525425 - DNA, 19 bp, Homo sapiens
ggtcccttgagacctcagc

SEQ ID NO: 4525426 - DNA, 20 bp, Homo sapiens
ggtcccttgagacctcagcc

SEQ ID NO: 4525427 - DNA, 14 bp, Homo sapiens
ggtccgcaccctgt

SEQ ID NO: 4525428 - DNA, 16 bp, Homo sapiens
ggtccgcaccctgtcc

SEQ ID NO: 4525429 - DNA, 20 bp, Homo sapiens
ggtccggacactcctagaga

SEQ ID NO: 4525430 - DNA, 21 bp, Homo sapiens
ggtccggacactcctagagaa

SEQ ID NO: 4525431 - DNA, 18 bp, Homo sapiens
ggtccggcctctccctgc

SEQ ID NO: 4525432 - DNA, 14 bp, Homo sapiens
ggtcctagacaaac

SEQ ID NO: 4525433 - DNA, 19 bp, Homo sapiens
ggtcctagcccttccctga

SEQ ID NO: 4525434 - DNA, 23 bp, Homo sapiens
ggtcctcacccctcgccaccttt

SEQ ID NO: 4525435 - DNA, 17 bp, Homo sapiens
ggtcctcccctctcttg

SEQ ID NO: 4525436 - DNA, 12 bp, Homo sapiens
ggtcctctcagt

SEQ ID NO: 4525437 - DNA, 21 bp, Homo sapiens
ggtcctctcagttctctccct

SEQ ID NO: 4525438 - DNA, 22 bp, Homo sapiens
ggtcctctcttccacagtggcg

SEQ ID NO: 4525439 - DNA, 15 bp, Homo sapiens
ggtcctggctcctga

SEQ ID NO: 4525440 - DNA, 18 bp, Homo sapiens
ggtccttttgacactgct

SEQ ID NO: 4525441 - DNA, 15 bp, Homo sapiens
ggtcgccccgtgttt

SEQ ID NO: 4525442 - DNA, 14 bp, Homo sapiens
ggtcggatctcaca

SEQ ID NO: 4525443 - DNA, 13 bp, Homo sapiens
ggtcgggacagct

SEQ ID NO: 4525444 - DNA, 14 bp, Homo sapiens
ggtcgggcagccag

SEQ ID NO: 4525445 - DNA, 16 bp, Homo sapiens
ggtctatgttccccag

SEQ ID NO: 4525446 - DNA, 23 bp, Homo sapiens
ggtctcaaactcctgacctcagg

SEQ ID NO: 4525447 - DNA, 20 bp, Homo sapiens
ggtctcagcagcgaccaccc

SEQ ID NO: 4525448 - DNA, 15 bp, Homo sapiens
ggtctcatctcccag

SEQ ID NO: 4525449 - DNA, 16 bp, Homo sapiens
ggtctccaccccaggg

SEQ ID NO: 4525450 - DNA, 17 bp, Homo sapiens
ggtctccaccccagggt

SEQ ID NO: 4525451 - DNA, 18 bp, Homo sapiens
ggtctccaccccagggtc

SEQ ID NO: 4525452 - DNA, 15 bp, Homo sapiens
ggtctccctctcctg

SEQ ID NO: 4525453 - DNA, 19 bp, Homo sapiens
ggtctccctctcctgccta

SEQ ID NO: 4525454 - DNA, 14 bp, Homo sapiens
ggtctccctggctc

SEQ ID NO: 4525455 - DNA, 24 bp, Homo sapiens
ggtctccctggctccctcctccag

SEQ ID NO: 4525456 - DNA, 19 bp, Homo sapiens
ggtctcctcactcccttct

SEQ ID NO: 4525457 - DNA, 15 bp, Homo sapiens
ggtctcgctctgtca

SEQ ID NO: 4525458 - DNA, 19 bp, Homo sapiens
ggtctctctcggcccctgt

SEQ ID NO: 4525459 - DNA, 21 bp, Homo sapiens
ggtctcttctgaataaagcaa

SEQ ID NO: 4525460 - DNA, 22 bp, Homo sapiens
ggtctgagccacagcagcattt

SEQ ID NO: 4525461 - DNA, 15 bp, Homo sapiens
ggtctgaggcccctg

SEQ ID NO: 4525462 - DNA, 15 bp, Homo sapiens
ggtctgcacagattc

SEQ ID NO: 4525463 - DNA, 16 bp, Homo sapiens
ggtctggagttgctga

SEQ ID NO: 4525464 - DNA, 16 bp, Homo sapiens
ggtctggttcctgtgt

SEQ ID NO: 4525465 - DNA, 16 bp, Homo sapiens
ggtctgtgtgctgttt

SEQ ID NO: 4525466 - DNA, 20 bp, Homo sapiens
ggtctgtgtgtgtgtatgtg

SEQ ID NO: 4525467 - DNA, 12 bp, Homo sapiens
ggtcttcagctt

SEQ ID NO: 4525468 - DNA, 13 bp, Homo sapiens
ggtcttcagcttt

SEQ ID NO: 4525469 - DNA, 22 bp, Homo sapiens
ggtcttccctacctcaggcagg

SEQ ID NO: 4525470 - DNA, 18 bp, Homo sapiens
ggtcttccttctacccca

SEQ ID NO: 4525471 - DNA, 23 bp, Homo sapiens
ggtcttgctctgtcccccaggct

SEQ ID NO: 4525472 - DNA, 21 bp, Homo sapiens
ggtcttgggggtcagggggga

SEQ ID NO: 4525473 - DNA, 17 bp, Homo sapiens
ggtctttctctcagtga

SEQ ID NO: 4525474 - DNA, 19 bp, Homo sapiens
ggtcttttataggaaaaaa

SEQ ID NO: 4525475 - DNA, 13 bp, Homo sapiens
ggtgaaagggagc

SEQ ID NO: 4525476 - DNA, 14 bp, Homo sapiens
ggtgaaagggagct

SEQ ID NO: 4525477 - DNA, 20 bp, Homo sapiens
ggtgaagtgtggctggtgtc

SEQ ID NO: 4525478 - DNA, 23 bp, Homo sapiens
ggtgacacgcttctgagcagggg

SEQ ID NO: 4525479 - DNA, 20 bp, Homo sapiens
ggtgacagctccgggatcag

SEQ ID NO: 4525480 - DNA, 18 bp, Homo sapiens
ggtgacagtgccttctct

SEQ ID NO: 4525481 - DNA, 15 bp, Homo sapiens
ggtgacctcttgcct

SEQ ID NO: 4525482 - DNA, 21 bp, Homo sapiens
ggtgacgggactcaggcggga

SEQ ID NO: 4525483 - DNA, 22 bp, Homo sapiens
ggtgactcacttcaatgtgtca

SEQ ID NO: 4525484 - DNA, 12 bp, Homo sapiens
ggtgactgtccc

SEQ ID NO: 4525485 - DNA, 16 bp, Homo sapiens
ggtgactgtcccaccg

SEQ ID NO: 4525486 - DNA, 13 bp, Homo sapiens
ggtgagaaattta

SEQ ID NO: 4525487 - DNA, 18 bp, Homo sapiens
ggtgagacagttgcccga

SEQ ID NO: 4525488 - DNA, 21 bp, Homo sapiens
ggtgagagaccacacatttta

SEQ ID NO: 4525489 - DNA, 12 bp, Homo sapiens
ggtgagagagac

SEQ ID NO: 4525490 - DNA, 23 bp, Homo sapiens
ggtgaggtctgttccttttatat

SEQ ID NO: 4525491 - DNA, 20 bp, Homo sapiens
ggtgagtttgagctgccttc

SEQ ID NO: 4525492 - DNA, 21 bp, Homo sapiens
ggtgagtttgagctgccttcc

SEQ ID NO: 4525493 - DNA, 17 bp, Homo sapiens
ggtgataaaaataaagc

SEQ ID NO: 4525494 - DNA, 15 bp, Homo sapiens
ggtgataagggaaaa

SEQ ID NO: 4525495 - DNA, 17 bp, Homo sapiens
ggtgatggaaactgcca

SEQ ID NO: 4525496 - DNA, 14 bp, Homo sapiens
ggtgatgtcactca

SEQ ID NO: 4525497 - DNA, 15 bp, Homo sapiens
ggtgcactttgtaaa

SEQ ID NO: 4525498 - DNA, 19 bp, Homo sapiens
ggtgcagcttcacccacca

SEQ ID NO: 4525499 - DNA, 22 bp, Homo sapiens
ggtgcagggagacatctgcacc

SEQ ID NO: 4525500 - DNA, 19 bp, Homo sapiens
ggtgcaggtctccacctgc

SEQ ID NO: 4525501 - DNA, 20 bp, Homo sapiens
ggtgcaggtctccacctgca

SEQ ID NO: 4525502 - DNA, 23 bp, Homo sapiens
ggtgccagctgcccttgcagggt

SEQ ID NO: 4525503 - DNA, 16 bp, Homo sapiens
ggtgccatttctgaac

SEQ ID NO: 4525504 - DNA, 22 bp, Homo sapiens
ggtgccatttctgaactgttac

SEQ ID NO: 4525505 - DNA, 15 bp, Homo sapiens
ggtgcctggcacagc

SEQ ID NO: 4525506 - DNA, 23 bp, Homo sapiens
ggtgcctgggtggggctgctcct

SEQ ID NO: 4525507 - DNA, 18 bp, Homo sapiens
ggtgcctgtgaggcaggg

SEQ ID NO: 4525508 - DNA, 21 bp, Homo sapiens
ggtgcctgtgaggcaggggcg

SEQ ID NO: 4525509 - DNA, 20 bp, Homo sapiens
ggtgccttcactgggccagt

SEQ ID NO: 4525510 - DNA, 22 bp, Homo sapiens
ggtgccttcactgggccagtca

SEQ ID NO: 4525511 - DNA, 17 bp, Homo sapiens
ggtgcctttcctgttca

SEQ ID NO: 4525512 - DNA, 22 bp, Homo sapiens
ggtgcctttcctgttcagcatt

SEQ ID NO: 4525513 - DNA, 13 bp, Homo sapiens
ggtgctaaattgt

SEQ ID NO: 4525514 - DNA, 22 bp, Homo sapiens
ggtgctacacccttttccagct

SEQ ID NO: 4525515 - DNA, 23 bp, Homo sapiens
ggtgctagtgggccctctctctg

SEQ ID NO: 4525516 - DNA, 24 bp, Homo sapiens
ggtgctagtgggccctctctctgg

SEQ ID NO: 4525517 - DNA, 15 bp, Homo sapiens
ggtgctgcaggagtg

SEQ ID NO: 4525518 - DNA, 21 bp, Homo sapiens
ggtgctgcaggagtgtcctgc

SEQ ID NO: 4525519 - DNA, 23 bp, Homo sapiens
ggtgctgccatgacagaggctgc

SEQ ID NO: 4525520 - DNA, 21 bp, Homo sapiens
ggtgctgccgagggctggccg

SEQ ID NO: 4525521 - DNA, 15 bp, Homo sapiens
ggtgctgggaggagg

SEQ ID NO: 4525522 - DNA, 13 bp, Homo sapiens
ggtgctgtttaaa

SEQ ID NO: 4525523 - DNA, 17 bp, Homo sapiens
ggtgcttcctcctcagg

SEQ ID NO: 4525524 - DNA, 21 bp, Homo sapiens
ggtgcttctagttctgccagg

SEQ ID NO: 4525525 - DNA, 17 bp, Homo sapiens
ggtgctttccttcatct

SEQ ID NO: 4525526 - DNA, 18 bp, Homo sapiens
ggtgctttccttcatctc

SEQ ID NO: 4525527 - DNA, 21 bp, Homo sapiens
ggtgcttttatagaggctagc

SEQ ID NO: 4525528 - DNA, 18 bp, Homo sapiens
ggtgctttttataaaaag

SEQ ID NO: 4525529 - DNA, 13 bp, Homo sapiens
ggtggaagcagag

SEQ ID NO: 4525530 - DNA, 16 bp, Homo sapiens
ggtggaagcagaggcc

SEQ ID NO: 4525531 - DNA, 21 bp, Homo sapiens
ggtggaagcagaggccctgcc

SEQ ID NO: 4525532 - DNA, 18 bp, Homo sapiens
ggtggaagccctccttcc

SEQ ID NO: 4525533 - DNA, 15 bp, Homo sapiens
ggtggactcgcctgt

SEQ ID NO: 4525534 - DNA, 17 bp, Homo sapiens
ggtggactgcgctggac

SEQ ID NO: 4525535 - DNA, 16 bp, Homo sapiens
ggtggagagcactaga

SEQ ID NO: 4525536 - DNA, 21 bp, Homo sapiens
ggtggaggaccgaggctacag

SEQ ID NO: 4525537 - DNA, 21 bp, Homo sapiens
ggtggaggctgcggtgagccg

SEQ ID NO: 4525538 - DNA, 18 bp, Homo sapiens
ggggactcgggggctggt

SEQ ID NO: 4525539 - DNA, 16 bp, Homo sapiens
ggggagagcctgctgg

SEQ ID NO: 4525540 - DNA, 23 bp, Homo sapiens
ggggagcccactgaggggccagg

SEQ ID NO: 4525541 - DNA, 12 bp, Homo sapiens
ggggagcccagt

SEQ ID NO: 4525542 - DNA, 14 bp, Homo sapiens
ggggagcccagtga

SEQ ID NO: 4525543 - DNA, 18 bp, Homo sapiens
ggggaggaatcctggacc

SEQ ID NO: 4525544 - DNA, 17 bp, Homo sapiens
ggggaggcccaaatgat

SEQ ID NO: 4525545 - DNA, 15 bp, Homo sapiens
ggggagggcaggatg

SEQ ID NO: 4525546 - DNA, 22 bp, Homo sapiens
ggggagtaataggaccagagcg

SEQ ID NO: 4525547 - DNA, 15 bp, Homo sapiens
ggggagtagccaagc

SEQ ID NO: 4525548 - DNA, 20 bp, Homo sapiens
ggggatcttcccacaggagg

SEQ ID NO: 4525549 - DNA, 22 bp, Homo sapiens
ggggatcttcccacaggagggc

SEQ ID NO: 4525550 - DNA, 14 bp, Homo sapiens
ggggatgggccagg

SEQ ID NO: 4525551 - DNA, 14 bp, Homo sapiens
ggggatttctggga

SEQ ID NO: 4525552 - DNA, 15 bp, Homo sapiens
ggggcaactgtatga

SEQ ID NO: 4525553 - DNA, 21 bp, Homo sapiens
ggggcagacaataaaccctca

SEQ ID NO: 4525554 - DNA, 16 bp, Homo sapiens
ggggcaggagggccct

SEQ ID NO: 4525555 - DNA, 14 bp, Homo sapiens
ggggcaggctgggc

SEQ ID NO: 4525556 - DNA, 16 bp, Homo sapiens
ggggcaggctgggcca

SEQ ID NO: 4525557 - DNA, 13 bp, Homo sapiens
ggggcaggggtgc

SEQ ID NO: 4525558 - DNA, 22 bp, Homo sapiens
ggggcatctgagtccagctccc

SEQ ID NO: 4525559 - DNA, 14 bp, Homo sapiens
ggggcatctgcccc

SEQ ID NO: 4525560 - DNA, 20 bp, Homo sapiens
ggggcatctgcccctccccc

SEQ ID NO: 4525561 - DNA, 19 bp, Homo sapiens
ggggccaacctcaggctcc

SEQ ID NO: 4525562 - DNA, 13 bp, Homo sapiens
ggggccagaggct

SEQ ID NO: 4525563 - DNA, 19 bp, Homo sapiens
ggggcccaaggcggcccct

SEQ ID NO: 4525564 - DNA, 22 bp, Homo sapiens
ggggcccaaggcggcccctccc

SEQ ID NO: 4525565 - DNA, 18 bp, Homo sapiens
ggggccccagtcagcctc

SEQ ID NO: 4525566 - DNA, 16 bp, Homo sapiens
ggggccccctggtcac

SEQ ID NO: 4525567 - DNA, 20 bp, Homo sapiens
ggggccccgccagggctggg

SEQ ID NO: 4525568 - DNA, 21 bp, Homo sapiens
ggggccccgccagggctgggg

SEQ ID NO: 4525569 - DNA, 12 bp, Homo sapiens
ggggccctgccc

SEQ ID NO: 4525570 - DNA, 16 bp, Homo sapiens
ggggccctggccagga

SEQ ID NO: 4525571 - DNA, 18 bp, Homo sapiens
ggggccctgggcctcagt

SEQ ID NO: 4525572 - DNA, 16 bp, Homo sapiens
ggggccgggcaggtcc

SEQ ID NO: 4525573 - DNA, 21 bp, Homo sapiens
ggggccgggcgcggtggctca

SEQ ID NO: 4525574 - DNA, 15 bp, Homo sapiens
ggggcctcaggctcc

SEQ ID NO: 4525575 - DNA, 12 bp, Homo sapiens
ggggcctggatg

SEQ ID NO: 4525576 - DNA, 15 bp, Homo sapiens
ggggcctgggcagga

SEQ ID NO: 4525577 - DNA, 21 bp, Homo sapiens
ggggccttgcggtatccgccc

SEQ ID NO: 4525578 - DNA, 17 bp, Homo sapiens
ggggcgcaccccacagc

SEQ ID NO: 4525579 - DNA, 18 bp, Homo sapiens
ggggcgcaccccacagct

SEQ ID NO: 4525580 - DNA, 16 bp, Homo sapiens
ggggcgcggctgggag

SEQ ID NO: 4525581 - DNA, 14 bp, Homo sapiens
ggggcgggctcaga

SEQ ID NO: 4525582 - DNA, 18 bp, Homo sapiens
ggggctccatgctgggtc

SEQ ID NO: 4525583 - DNA, 22 bp, Homo sapiens
ggggctccatgctgggtctgag

SEQ ID NO: 4525584 - DNA, 16 bp, Homo sapiens
ggggctcccagccagg

SEQ ID NO: 4525585 - DNA, 12 bp, Homo sapiens
ggggctcctgcc

SEQ ID NO: 4525586 - DNA, 14 bp, Homo sapiens
ggggctcctgccca

SEQ ID NO: 4525587 - DNA, 16 bp, Homo sapiens
ggggctcctgcccagg

SEQ ID NO: 4525588 - DNA, 18 bp, Homo sapiens
ggggctcctgcccaggcc

SEQ ID NO: 4525589 - DNA, 17 bp, Homo sapiens
ggggctcctgggaggga

SEQ ID NO: 4525590 - DNA, 18 bp, Homo sapiens
ggggctgagccctcctga

SEQ ID NO: 4525591 - DNA, 23 bp, Homo sapiens
ggggctgagccctcctgagggcc

SEQ ID NO: 4525592 - DNA, 23 bp, Homo sapiens
ggggctgcacctcctaccctccc

SEQ ID NO: 4525593 - DNA, 20 bp, Homo sapiens
ggggctgctcacccacctct

SEQ ID NO: 4525594 - DNA, 15 bp, Homo sapiens
ggggctgctcctcca

SEQ ID NO: 4525595 - DNA, 16 bp, Homo sapiens
ggggctgctcctccag

SEQ ID NO: 4525596 - DNA, 19 bp, Homo sapiens
ggggctggcggctactcag

SEQ ID NO: 4525597 - DNA, 20 bp, Homo sapiens
ggggcttataataaaggact

SEQ ID NO: 4525598 - DNA, 15 bp, Homo sapiens
gggggagagggctgc

SEQ ID NO: 4525599 - DNA, 11 bp, Homo sapiens
gggggcagagg

SEQ ID NO: 4525600 - DNA, 12 bp, Homo sapiens
gggggcagaggg

SEQ ID NO: 4525601 - DNA, 14 bp, Homo sapiens
gggggcagtctccc

SEQ ID NO: 4525602 - DNA, 21 bp, Homo sapiens
gggggcagtctccccttcctg

SEQ ID NO: 4525603 - DNA, 22 bp, Homo sapiens
gggggcagtctccccttcctgg

SEQ ID NO: 4525604 - DNA, 21 bp, Homo sapiens
gggggcagtgctcacccacac

SEQ ID NO: 4525605 - DNA, 22 bp, Homo sapiens
gggggcatctgagtccagctcc

SEQ ID NO: 4525606 - DNA, 23 bp, Homo sapiens
gggggcatctgagtccagctccc

SEQ ID NO: 4525607 - DNA, 12 bp, Homo sapiens
gggggccgggca

SEQ ID NO: 4525608 - DNA, 23 bp, Homo sapiens
gggggccgggcaggtcctgccca

SEQ ID NO: 4525609 - DNA, 15 bp, Homo sapiens
gggggcctggatgcc

SEQ ID NO: 4525610 - DNA, 15 bp, Homo sapiens
gggggctcctgccca

SEQ ID NO: 4525611 - DNA, 22 bp, Homo sapiens
gggggctcctgcccaggccaca

SEQ ID NO: 4525612 - DNA, 12 bp, Homo sapiens
gggggctggggt

SEQ ID NO: 4525613 - DNA, 12 bp, Homo sapiens
gggggctttctg

SEQ ID NO: 4525614 - DNA, 14 bp, Homo sapiens
ggggggctcctgcc

SEQ ID NO: 4525615 - DNA, 12 bp, Homo sapiens
gggggtggcagg

SEQ ID NO: 4525616 - DNA, 18 bp, Homo sapiens
ggggtaagccagagcctg

SEQ ID NO: 4525617 - DNA, 19 bp, Homo sapiens
ggggtacatttctctgagc

SEQ ID NO: 4525618 - DNA, 18 bp, Homo sapiens
ggggtcagagcactccct

SEQ ID NO: 4525619 - DNA, 12 bp, Homo sapiens
ggggtccctgca

SEQ ID NO: 4525620 - DNA, 14 bp, Homo sapiens
ggggtcctagccca

SEQ ID NO: 4525621 - DNA, 15 bp, Homo sapiens
ggggtcctagcccag

SEQ ID NO: 4525622 - DNA, 13 bp, Homo sapiens
ggggtctccctgg

SEQ ID NO: 4525623 - DNA, 14 bp, Homo sapiens
ggggtctccctggc

SEQ ID NO: 4525624 - DNA, 23 bp, Homo sapiens
ggggtctcgttttgttgccaaag

SEQ ID NO: 4525625 - DNA, 16 bp, Homo sapiens
ggggtgagagacctgc

SEQ ID NO: 4525626 - DNA, 17 bp, Homo sapiens
ggggtggaggcttcctg

SEQ ID NO: 4525627 - DNA, 23 bp, Homo sapiens
ggggtggcccagagccatactgc

SEQ ID NO: 4525628 - DNA, 11 bp, Homo sapiens
ggggtgggtca

SEQ ID NO: 4525629 - DNA, 22 bp, Homo sapiens
ggggttccctcctagctctccc

SEQ ID NO: 4525630 - DNA, 14 bp, Homo sapiens
ggggttgccagagg

SEQ ID NO: 4525631 - DNA, 17 bp, Homo sapiens
ggggttgccagaggccc

SEQ ID NO: 4525632 - DNA, 21 bp, Homo sapiens
ggggttgccagaggccctgga

SEQ ID NO: 4525633 - DNA, 19 bp, Homo sapiens
gggtaagccagagcctggg

SEQ ID NO: 4525634 - DNA, 16 bp, Homo sapiens
gggtaagggagggaag

SEQ ID NO: 4525635 - DNA, 14 bp, Homo sapiens
gggtagcccgcctg

SEQ ID NO: 4525636 - DNA, 18 bp, Homo sapiens
gggtagcccgcctgccag

SEQ ID NO: 4525637 - DNA, 12 bp, Homo sapiens
gggtattggaaa

SEQ ID NO: 4525638 - DNA, 18 bp, Homo sapiens
gggtcactggcctctccc

SEQ ID NO: 4525639 - DNA, 12 bp, Homo sapiens
gggtcagggggg

SEQ ID NO: 4525640 - DNA, 21 bp, Homo sapiens
gggtcagtctggtgggaggac

SEQ ID NO: 4525641 - DNA, 13 bp, Homo sapiens
gggtcatgggcct

SEQ ID NO: 4525642 - DNA, 13 bp, Homo sapiens
gggtcccaagctg

SEQ ID NO: 4525643 - DNA, 15 bp, Homo sapiens
gggtcccaagctggg

SEQ ID NO: 4525644 - DNA, 17 bp, Homo sapiens
gggtcccaagctgggcc

SEQ ID NO: 4525645 - DNA, 21 bp, Homo sapiens
gggtccggcctctccctgcct

SEQ ID NO: 4525646 - DNA, 22 bp, Homo sapiens
gggtccggcctctccctgcctg

SEQ ID NO: 4525647 - DNA, 23 bp, Homo sapiens
gggtccggcctctccctgcctgt

SEQ ID NO: 4525648 - DNA, 14 bp, Homo sapiens
gggtcctagccctt

SEQ ID NO: 4525649 - DNA, 23 bp, Homo sapiens
gggtcctctcttccacagtggcg

SEQ ID NO: 4525650 - DNA, 13 bp, Homo sapiens
gggtcctcttctg

SEQ ID NO: 4525651 - DNA, 15 bp, Homo sapiens
gggtcctgccagctg

SEQ ID NO: 4525652 - DNA, 15 bp, Homo sapiens
gggtccttctccaca

SEQ ID NO: 4525653 - DNA, 12 bp, Homo sapiens
gggtcggaggtg

SEQ ID NO: 4525654 - DNA, 20 bp, Homo sapiens
gggtctccctctcctgccta

SEQ ID NO: 4525655 - DNA, 15 bp, Homo sapiens
gggtctctctcggcc

SEQ ID NO: 4525656 - DNA, 16 bp, Homo sapiens
gggtctctctcggccc

SEQ ID NO: 4525657 - DNA, 14 bp, Homo sapiens
gggtctctgaaggg

SEQ ID NO: 4525658 - DNA, 20 bp, Homo sapiens
gggtctctgtgtgtgtatga

SEQ ID NO: 4525659 - DNA, 18 bp, Homo sapiens
gggtctgaggcccctgcc

SEQ ID NO: 4525660 - DNA, 19 bp, Homo sapiens
gggtctgaggcccctgcct

SEQ ID NO: 4525661 - DNA, 23 bp, Homo sapiens
gggtctgggcagcacctctggtc

SEQ ID NO: 4525662 - DNA, 11 bp, Homo sapiens
gggtcttcagc

SEQ ID NO: 4525663 - DNA, 21 bp, Homo sapiens
gggtcttgctctgtcccccag

SEQ ID NO: 4525664 - DNA, 17 bp, Homo sapiens
gggtgacagctccggga

SEQ ID NO: 4525665 - DNA, 18 bp, Homo sapiens
gggtgacgggactcaggc

SEQ ID NO: 4525666 - DNA, 14 bp, Homo sapiens
gggtgagagacctg

SEQ ID NO: 4525667 - DNA, 18 bp, Homo sapiens
gggtgagctctcaggccg

SEQ ID NO: 4525668 - DNA, 18 bp, Homo sapiens
gggtgaggtaggcgggaa

SEQ ID NO: 4525669 - DNA, 18 bp, Homo sapiens
gggtgatatggacagcag

SEQ ID NO: 4525670 - DNA, 17 bp, Homo sapiens
gggtgcaagcactcggg

SEQ ID NO: 4525671 - DNA, 12 bp, Homo sapiens
gggtgccgcctg

SEQ ID NO: 4525672 - DNA, 21 bp, Homo sapiens
gggtgcttttatagaggctag

SEQ ID NO: 4525673 - DNA, 17 bp, Homo sapiens
gggtggatcacgaggtc

SEQ ID NO: 4525674 - DNA, 17 bp, Homo sapiens
gggtggccacacaggca

SEQ ID NO: 4525675 - DNA, 13 bp, Homo sapiens
gggtggccatccc

SEQ ID NO: 4525676 - DNA, 15 bp, Homo sapiens
gggtgggaagaaaga

SEQ ID NO: 4525677 - DNA, 15 bp, Homo sapiens
gggtgggagggagga

SEQ ID NO: 4525678 - DNA, 14 bp, Homo sapiens
gggtggggagagac

SEQ ID NO: 4525679 - DNA, 12 bp, Homo sapiens
gggtggggctgc

SEQ ID NO: 4525680 - DNA, 11 bp, Homo sapiens
gggtgggtcag

SEQ ID NO: 4525681 - DNA, 13 bp, Homo sapiens
gggtgtgcccttg

SEQ ID NO: 4525682 - DNA, 12 bp, Homo sapiens
gggtgtggcagt

SEQ ID NO: 4525683 - DNA, 15 bp, Homo sapiens
gggtgtggcctcagc

SEQ ID NO: 4525684 - DNA, 19 bp, Homo sapiens
gggtgtggcctcagccctc

SEQ ID NO: 4525685 - DNA, 23 bp, Homo sapiens
gggtgttccacctggaaactgct

SEQ ID NO: 4525686 - DNA, 17 bp, Homo sapiens
gggttaacttggtcaga

SEQ ID NO: 4525687 - DNA, 21 bp, Homo sapiens
gggttcacgccattctcctgc

SEQ ID NO: 4525688 - DNA, 17 bp, Homo sapiens
gggttcagcccctcctc

SEQ ID NO: 4525689 - DNA, 19 bp, Homo sapiens
gggttcagcccctcctctg

SEQ ID NO: 4525690 - DNA, 14 bp, Homo sapiens
gggttcctctgtac

SEQ ID NO: 4525691 - DNA, 11 bp, Homo sapiens
gggttctagac

SEQ ID NO: 4525692 - DNA, 12 bp, Homo sapiens
gggttctagacg

SEQ ID NO: 4525693 - DNA, 14 bp, Homo sapiens
gggttctctacagg

SEQ ID NO: 4525694 - DNA, 16 bp, Homo sapiens
gggttgccagaggccc

SEQ ID NO: 4525695 - DNA, 22 bp, Homo sapiens
gggttgggcccagatctggtcc

SEQ ID NO: 4525696 - DNA, 23 bp, Homo sapiens
gggtttaacaagctgtctactgg

SEQ ID NO: 4525697 - DNA, 19 bp, Homo sapiens
gggtttacagtgaagaaag

SEQ ID NO: 4525698 - DNA, 15 bp, Homo sapiens
gggtttattcactga

SEQ ID NO: 4525699 - DNA, 20 bp, Homo sapiens
gggtttcaccatgttagcca

SEQ ID NO: 4525700 - DNA, 18 bp, Homo sapiens
gggttttaaacactaatc

SEQ ID NO: 4525701 - DNA, 20 bp, Homo sapiens
gggttttattgtttaaaatc

SEQ ID NO: 4525702 - DNA, 16 bp, Homo sapiens
ggtaaaaaatttataa

SEQ ID NO: 4525703 - DNA, 18 bp, Homo sapiens
ggtaaaacagggccacat

SEQ ID NO: 4525704 - DNA, 17 bp, Homo sapiens
ggtaaaataaaatgcct

SEQ ID NO: 4525705 - DNA, 13 bp, Homo sapiens
ggtaaaatgtatt

SEQ ID NO: 4525706 - DNA, 23 bp, Homo sapiens
ggtaaacattcctccagcctccc

SEQ ID NO: 4525707 - DNA, 23 bp, Homo sapiens
ggtaagaaagccaccttgttaca

SEQ ID NO: 4525708 - DNA, 14 bp, Homo sapiens
ggtaagaagaaagc

SEQ ID NO: 4525709 - DNA, 15 bp, Homo sapiens
ggtaagaagaaagca

SEQ ID NO: 4525710 - DNA, 17 bp, Homo sapiens
ggtaagaagaaagcaaa

SEQ ID NO: 4525711 - DNA, 18 bp, Homo sapiens
ggtaagaagggtgggagt

SEQ ID NO: 4525712 - DNA, 14 bp, Homo sapiens
ggtaagactgctgg

SEQ ID NO: 4525713 - DNA, 20 bp, Homo sapiens
ggtaagccagagcctggggt

SEQ ID NO: 4525714 - DNA, 13 bp, Homo sapiens
ggtaagggaggga

SEQ ID NO: 4525715 - DNA, 14 bp, Homo sapiens
ggtaagggagggaa

SEQ ID NO: 4525716 - DNA, 13 bp, Homo sapiens
ggtaaggtgcctt

SEQ ID NO: 4525717 - DNA, 14 bp, Homo sapiens
ggtaagttgctatt

SEQ ID NO: 4525718 - DNA, 23 bp, Homo sapiens
ggtaatcctcttctaaaatagca

SEQ ID NO: 4525719 - DNA, 12 bp, Homo sapiens
ggtaatctacac

SEQ ID NO: 4525720 - DNA, 13 bp, Homo sapiens
ggtaatctacacc

SEQ ID NO: 4525721 - DNA, 18 bp, Homo sapiens
ggtaatctacaccaatga

SEQ ID NO: 4525722 - DNA, 13 bp, Homo sapiens
ggtacaaaaataa

SEQ ID NO: 4525723 - DNA, 16 bp, Homo sapiens
ggtacaactgtattta

SEQ ID NO: 4525724 - DNA, 18 bp, Homo sapiens
ggtacaactgtatttatt

SEQ ID NO: 4525725 - DNA, 12 bp, Homo sapiens
ggtacagtttgg

SEQ ID NO: 4525726 - DNA, 16 bp, Homo sapiens
ggtacatttttcaact

SEQ ID NO: 4525727 - DNA, 14 bp, Homo sapiens
ggtaccagctgcgc

SEQ ID NO: 4525728 - DNA, 23 bp, Homo sapiens
ggtactataaaagctttctgcca

SEQ ID NO: 4525729 - DNA, 14 bp, Homo sapiens
ggtactgtagcagg

SEQ ID NO: 4525730 - DNA, 16 bp, Homo sapiens
ggtacttcctctgtga

SEQ ID NO: 4525731 - DNA, 11 bp, Homo sapiens
ggtagaaaaac

SEQ ID NO: 4525732 - DNA, 19 bp, Homo sapiens
ggtagatgacaaatattct

SEQ ID NO: 4525733 - DNA, 22 bp, Homo sapiens
ggtagccatcaagcacttccca

SEQ ID NO: 4525734 - DNA, 21 bp, Homo sapiens
ggtagcctgaattgctttctg

SEQ ID NO: 4525735 - DNA, 18 bp, Homo sapiens
ggtagttctgtgcctccc

SEQ ID NO: 4525736 - DNA, 21 bp, Homo sapiens
ggtagttctgtgcctcccccc

SEQ ID NO: 4525737 - DNA, 18 bp, Homo sapiens
ggtatatcctctggaaaa

SEQ ID NO: 4525738 - DNA, 20 bp, Homo sapiens
ggtatatttgaaataaagtt

SEQ ID NO: 4525739 - DNA, 15 bp, Homo sapiens
ggtatgctggccagc

SEQ ID NO: 4525740 - DNA, 16 bp, Homo sapiens
ggtatgctggccagca

SEQ ID NO: 4525741 - DNA, 17 bp, Homo sapiens
ggtatgctggccagcac

SEQ ID NO: 4525742 - DNA, 18 bp, Homo sapiens
ggtatgctggccagcacc

SEQ ID NO: 4525743 - DNA, 21 bp, Homo sapiens
ggtatggaagggtttgtggct

SEQ ID NO: 4525744 - DNA, 18 bp, Homo sapiens
ggtatgtagccagctgtg

SEQ ID NO: 4525745 - DNA, 14 bp, Homo sapiens
ggtcaaaggaagac

SEQ ID NO: 4525746 - DNA, 23 bp, Homo sapiens
ggtcaatgctatttttgttttta

SEQ ID NO: 4525747 - DNA, 23 bp, Homo sapiens
ggtcaccgagactcagcctctgc

SEQ ID NO: 4525748 - DNA, 24 bp, Homo sapiens
ggtcagaacattcgaatctctgcc

SEQ ID NO: 4525749 - DNA, 19 bp, Homo sapiens
ggtcagaagagttgtgcac

SEQ ID NO: 4525750 - DNA, 22 bp, Homo sapiens
ggtcagagaaaatgagaaagga

SEQ ID NO: 4525751 - DNA, 13 bp, Homo sapiens
ggtcagagccact

SEQ ID NO: 4525752 - DNA, 14 bp, Homo sapiens
ggtcagagccactc

SEQ ID NO: 4525753 - DNA, 15 bp, Homo sapiens
ggtcagagccactct

SEQ ID NO: 4525754 - DNA, 20 bp, Homo sapiens
ggtcagaggacctgtattta

SEQ ID NO: 4525755 - DNA, 17 bp, Homo sapiens
ggtcagagtgccactgc

SEQ ID NO: 4525756 - DNA, 18 bp, Homo sapiens
ggtcagattagttggctt

SEQ ID NO: 4525757 - DNA, 21 bp, Homo sapiens
ggtcagcatgtctattcagct

SEQ ID NO: 4525758 - DNA, 19 bp, Homo sapiens
ggtcaggcccgtcagcatc

SEQ ID NO: 4525759 - DNA, 18 bp, Homo sapiens
ggtcaggcggagctgctg

SEQ ID NO: 4525760 - DNA, 13 bp, Homo sapiens
ggtcagtgccttt

SEQ ID NO: 4525761 - DNA, 14 bp, Homo sapiens
ggtcagtggccagg

SEQ ID NO: 4525762 - DNA, 22 bp, Homo sapiens
ggtcatagacaattcctccaga

SEQ ID NO: 4525763 - DNA, 13 bp, Homo sapiens
ggtccacaggtcc

SEQ ID NO: 4525764 - DNA, 14 bp, Homo sapiens
ggtccacaggtcca

SEQ ID NO: 4525765 - DNA, 17 bp, Homo sapiens
ggtccagcttgctcttc

SEQ ID NO: 4525766 - DNA, 18 bp, Homo sapiens
ggtccagcttgctcttca

SEQ ID NO: 4525767 - DNA, 17 bp, Homo sapiens
ggtccaggggcccctcc

SEQ ID NO: 4525768 - DNA, 13 bp, Homo sapiens
ggtccagtgggga

SEQ ID NO: 4525769 - DNA, 23 bp, Homo sapiens
ggtccatccccttcccccatccc

SEQ ID NO: 4525770 - DNA, 16 bp, Homo sapiens
ggtccatggagtacgg

SEQ ID NO: 4525771 - DNA, 16 bp, Homo sapiens
ggtccatgggcagagc

SEQ ID NO: 4525772 - DNA, 16 bp, Homo sapiens
ggtcccaagctgggcc

SEQ ID NO: 4525773 - DNA, 16 bp, Homo sapiens
ggtcccacgccaggcc

SEQ ID NO: 4525774 - DNA, 17 bp, Homo sapiens
ggtcccacgccaggcca

SEQ ID NO: 4525775 - DNA, 14 bp, Homo sapiens
ggtcccagccaccc

SEQ ID NO: 4525776 - DNA, 18 bp, Homo sapiens
ggtcccagcccctcctcc

SEQ ID NO: 4525777 - DNA, 20 bp, Homo sapiens
ggtcccccagagcatctgcc

SEQ ID NO: 4525778 - DNA, 23 bp, Homo sapiens
ggtcccccagagcatctgcccca

SEQ ID NO: 4525779 - DNA, 13 bp, Homo sapiens
ggtcccctccccc

SEQ ID NO: 4525780 - DNA, 15 bp, Homo sapiens
gtatagccatgattt

SEQ ID NO: 4525781 - DNA, 18 bp, Homo sapiens
gtatagctgcttccagtg

SEQ ID NO: 4525782 - DNA, 17 bp, Homo sapiens
gtatagtgttcacaaac

SEQ ID NO: 4525783 - DNA, 21 bp, Homo sapiens
gtatataagtactgaccactg

SEQ ID NO: 4525784 - DNA, 13 bp, Homo sapiens
gtatatatattca

SEQ ID NO: 4525785 - DNA, 14 bp, Homo sapiens
gtatatatattcat

SEQ ID NO: 4525786 - DNA, 16 bp, Homo sapiens
gtatatctcttggaaa

SEQ ID NO: 4525787 - DNA, 22 bp, Homo sapiens
gtatatctcttggaaaataaga

SEQ ID NO: 4525788 - DNA, 12 bp, Homo sapiens
gtatatgtattt

SEQ ID NO: 4525789 - DNA, 19 bp, Homo sapiens
gtatatgtgccacattttc

SEQ ID NO: 4525790 - DNA, 11 bp, Homo sapiens
gtatattaaac

SEQ ID NO: 4525791 - DNA, 13 bp, Homo sapiens
gtatattacaatg

SEQ ID NO: 4525792 - DNA, 14 bp, Homo sapiens
gtatattgataaat

SEQ ID NO: 4525793 - DNA, 22 bp, Homo sapiens
gtatattgtataggggcaactg

SEQ ID NO: 4525794 - DNA, 19 bp, Homo sapiens
gtatattgtgtttgtgtat

SEQ ID NO: 4525795 - DNA, 20 bp, Homo sapiens
gtatattgtgtttgtgtatt

SEQ ID NO: 4525796 - DNA, 15 bp, Homo sapiens
gtatatttgaaataa

SEQ ID NO: 4525797 - DNA, 15 bp, Homo sapiens
gtatatttgtatgat

SEQ ID NO: 4525798 - DNA, 15 bp, Homo sapiens
gtatattttatttca

SEQ ID NO: 4525799 - DNA, 18 bp, Homo sapiens
gtatattttctgtattta

SEQ ID NO: 4525800 - DNA, 18 bp, Homo sapiens
gtatcaataaaattctgt

SEQ ID NO: 4525801 - DNA, 21 bp, Homo sapiens
gtatcactgcagtcacctctt

SEQ ID NO: 4525802 - DNA, 18 bp, Homo sapiens
gtatcaggacccagagga

SEQ ID NO: 4525803 - DNA, 14 bp, Homo sapiens
gtatcagtgtcctt

SEQ ID NO: 4525804 - DNA, 14 bp, Homo sapiens
gtatccatgctctt

SEQ ID NO: 4525805 - DNA, 11 bp, Homo sapiens
gtatcctaaac

SEQ ID NO: 4525806 - DNA, 16 bp, Homo sapiens
gtatcctaaactttag

SEQ ID NO: 4525807 - DNA, 18 bp, Homo sapiens
gtatcctccctggcagac

SEQ ID NO: 4525808 - DNA, 19 bp, Homo sapiens
gtatcctccctggcagaca

SEQ ID NO: 4525809 - DNA, 17 bp, Homo sapiens
gtatctacagtaatgaa

SEQ ID NO: 4525810 - DNA, 19 bp, Homo sapiens
gtatctatttgtacaattt

SEQ ID NO: 4525811 - DNA, 21 bp, Homo sapiens
gtatctcaggaagtccagcca

SEQ ID NO: 4525812 - DNA, 11 bp, Homo sapiens
gtatctgccct

SEQ ID NO: 4525813 - DNA, 23 bp, Homo sapiens
gtatctgggtaagaagaaagcaa

SEQ ID NO: 4525814 - DNA, 17 bp, Homo sapiens
gtatcttactttcctct

SEQ ID NO: 4525815 - DNA, 19 bp, Homo sapiens
gtatcttgacacaggaaat

SEQ ID NO: 4525816 - DNA, 13 bp, Homo sapiens
gtatctttattaa

SEQ ID NO: 4525817 - DNA, 15 bp, Homo sapiens
gtatctttattaaaa

SEQ ID NO: 4525818 - DNA, 17 bp, Homo sapiens
gtatctttattaaaaca

SEQ ID NO: 4525819 - DNA, 19 bp, Homo sapiens
gtatctttattaaaacaaa

SEQ ID NO: 4525820 - DNA, 15 bp, Homo sapiens
gtatctttccaggct

SEQ ID NO: 4525821 - DNA, 21 bp, Homo sapiens
gtatcttttttaaactgtaaa

SEQ ID NO: 4525822 - DNA, 16 bp, Homo sapiens
gtatgaaatatatgtg

SEQ ID NO: 4525823 - DNA, 20 bp, Homo sapiens
gtatgaaatatatgtgaaag

SEQ ID NO: 4525824 - DNA, 13 bp, Homo sapiens
gtatgaagtatct

SEQ ID NO: 4525825 - DNA, 17 bp, Homo sapiens
gtatgaataatgaaaat

SEQ ID NO: 4525826 - DNA, 18 bp, Homo sapiens
gtatgagagagagagtgt

SEQ ID NO: 4525827 - DNA, 14 bp, Homo sapiens
gtatgcattcttta

SEQ ID NO: 4525828 - DNA, 19 bp, Homo sapiens
gtatgcattctttatagtg

SEQ ID NO: 4525829 - DNA, 19 bp, Homo sapiens
gtatgctggccagcaccct

SEQ ID NO: 4525830 - DNA, 20 bp, Homo sapiens
gtatgctggccagcaccctc

SEQ ID NO: 4525831 - DNA, 23 bp, Homo sapiens
gtatgctggccagcaccctctcc

SEQ ID NO: 4525832 - DNA, 20 bp, Homo sapiens
gtatgcttttataggcctgt

SEQ ID NO: 4525833 - DNA, 16 bp, Homo sapiens
gtatgtaatggaactt

SEQ ID NO: 4525834 - DNA, 19 bp, Homo sapiens
gtatgtacaatacaatgta

SEQ ID NO: 4525835 - DNA, 15 bp, Homo sapiens
gtatgtatataatca

SEQ ID NO: 4525836 - DNA, 13 bp, Homo sapiens
gtatgtattattt

SEQ ID NO: 4525837 - DNA, 16 bp, Homo sapiens
gtatgtccttcagctg

SEQ ID NO: 4525838 - DNA, 15 bp, Homo sapiens
gtatgtgtgcttgag

SEQ ID NO: 4525839 - DNA, 13 bp, Homo sapiens
gtatgttatagaa

SEQ ID NO: 4525840 - DNA, 18 bp, Homo sapiens
gtatgttgaggatctatt

SEQ ID NO: 4525841 - DNA, 19 bp, Homo sapiens
gtattaaacctttccattt

SEQ ID NO: 4525842 - DNA, 13 bp, Homo sapiens
gtattaaatggtt

SEQ ID NO: 4525843 - DNA, 15 bp, Homo sapiens
gtattaacatgcaat

SEQ ID NO: 4525844 - DNA, 17 bp, Homo sapiens
gtattaacatgcaataa

SEQ ID NO: 4525845 - DNA, 12 bp, Homo sapiens
gtattaagaaag

SEQ ID NO: 4525846 - DNA, 15 bp, Homo sapiens
gtattaagaaaggaa

SEQ ID NO: 4525847 - DNA, 16 bp, Homo sapiens
gtattaagaaaggaag

SEQ ID NO: 4525848 - DNA, 22 bp, Homo sapiens
gtattaagttgttaataaaagt

SEQ ID NO: 4525849 - DNA, 18 bp, Homo sapiens
gtattaataaaaagacaa

SEQ ID NO: 4525850 - DNA, 20 bp, Homo sapiens
gtattaatctctgtgtgttt

SEQ ID NO: 4525851 - DNA, 16 bp, Homo sapiens
gtattaatcttggata

SEQ ID NO: 4525852 - DNA, 23 bp, Homo sapiens
gtattacacaagaccagtgctta

SEQ ID NO: 4525853 - DNA, 13 bp, Homo sapiens
gtattagatatca

SEQ ID NO: 4525854 - DNA, 13 bp, Homo sapiens
gtattagcaaagc

SEQ ID NO: 4525855 - DNA, 23 bp, Homo sapiens
gtattatagacaaaagaataaga

SEQ ID NO: 4525856 - DNA, 19 bp, Homo sapiens
gtattattacaaatattgt

SEQ ID NO: 4525857 - DNA, 14 bp, Homo sapiens
gtattccaccttaa

SEQ ID NO: 4525858 - DNA, 15 bp, Homo sapiens
gtattcctgcctttg

SEQ ID NO: 4525859 - DNA, 15 bp, Homo sapiens
gtattcttaaaatgc

SEQ ID NO: 4525860 - DNA, 15 bp, Homo sapiens
gtattcttcatgaaa

SEQ ID NO: 4525861 - DNA, 18 bp, Homo sapiens
gtattcttcatgaaatgt

SEQ ID NO: 4525862 - DNA, 16 bp, Homo sapiens
gtattcttctcttcct

SEQ ID NO: 4525863 - DNA, 16 bp, Homo sapiens
gtattcttgtttgaat

SEQ ID NO: 4525864 - DNA, 23 bp, Homo sapiens
gtattgacttctttttggcatta

SEQ ID NO: 4525865 - DNA, 22 bp, Homo sapiens
gtattgcatgcaatttgaagta

SEQ ID NO: 4525866 - DNA, 13 bp, Homo sapiens
gtattgcttcctg

SEQ ID NO: 4525867 - DNA, 12 bp, Homo sapiens
gtattgtaaatt

SEQ ID NO: 4525868 - DNA, 16 bp, Homo sapiens
gtatttaacaaaaagt

SEQ ID NO: 4525869 - DNA, 20 bp, Homo sapiens
gtatttaacaaaaagtgctt

SEQ ID NO: 4525870 - DNA, 15 bp, Homo sapiens
gtatttaattataaa

SEQ ID NO: 4525871 - DNA, 22 bp, Homo sapiens
gtatttaattgtaaactgtact

SEQ ID NO: 4525872 - DNA, 13 bp, Homo sapiens
gtatttacagaca

SEQ ID NO: 4525873 - DNA, 21 bp, Homo sapiens
gtatttataaaaatataaatt

SEQ ID NO: 4525874 - DNA, 17 bp, Homo sapiens
gtatttatataagtctg

SEQ ID NO: 4525875 - DNA, 22 bp, Homo sapiens
gtatttatgggtggatttatcc

SEQ ID NO: 4525876 - DNA, 19 bp, Homo sapiens
gtatttatgtaatgaagta

SEQ ID NO: 4525877 - DNA, 22 bp, Homo sapiens
gtatttatgtaatgaagtaaag

SEQ ID NO: 4525878 - DNA, 14 bp, Homo sapiens
gtatttcagtattt

SEQ ID NO: 4525879 - DNA, 18 bp, Homo sapiens
gtatttctcctttgcaat

SEQ ID NO: 4525880 - DNA, 21 bp, Homo sapiens
gtatttctcctttgcaatagc

SEQ ID NO: 4525881 - DNA, 16 bp, Homo sapiens
gtatttcttaagaatt

SEQ ID NO: 4525882 - DNA, 21 bp, Homo sapiens
gtatttgaaaattacatgttt

SEQ ID NO: 4525883 - DNA, 16 bp, Homo sapiens
gtatttgagagaatct

SEQ ID NO: 4525884 - DNA, 11 bp, Homo sapiens
gtatttgctaa

SEQ ID NO: 4525885 - DNA, 13 bp, Homo sapiens
gtatttgtaatta

SEQ ID NO: 4525886 - DNA, 22 bp, Homo sapiens
gtatttgttaatttagaaaact

SEQ ID NO: 4525887 - DNA, 16 bp, Homo sapiens
gtatttgttatatata

SEQ ID NO: 4525888 - DNA, 22 bp, Homo sapiens
gtatttgttatatataataaat

SEQ ID NO: 4525889 - DNA, 19 bp, Homo sapiens
gtattttcaaatgtaaact

SEQ ID NO: 4525890 - DNA, 12 bp, Homo sapiens
gtattttccagc

SEQ ID NO: 4525891 - DNA, 18 bp, Homo sapiens
gtattttgtattgtttca

SEQ ID NO: 4525892 - DNA, 14 bp, Homo sapiens
gtatttttatataa

SEQ ID NO: 4525893 - DNA, 19 bp, Homo sapiens
gtatttttctgacttttac

SEQ ID NO: 4525894 - DNA, 13 bp, Homo sapiens
gtatttttcttga

SEQ ID NO: 4525895 - DNA, 16 bp, Homo sapiens
gtatttttttttctaa

SEQ ID NO: 4525896 - DNA, 17 bp, Homo sapiens
gtcaaacattcgtgagc

SEQ ID NO: 4525897 - DNA, 20 bp, Homo sapiens
gtcaaactgtagaaatgatg

SEQ ID NO: 4525898 - DNA, 17 bp, Homo sapiens
gtcaaacttggatactt

SEQ ID NO: 4525899 - DNA, 18 bp, Homo sapiens
gtcaaaggacggaagtgg

SEQ ID NO: 4525900 - DNA, 14 bp, Homo sapiens
gtcaaataaacact

SEQ ID NO: 4525901 - DNA, 12 bp, Homo sapiens
gtacttaaatga

SEQ ID NO: 4525902 - DNA, 14 bp, Homo sapiens
gtacttaaatgagt

SEQ ID NO: 4525903 - DNA, 20 bp, Homo sapiens
gtacttaatttacttaagtg

SEQ ID NO: 4525904 - DNA, 17 bp, Homo sapiens
gtacttagagtttctgt

SEQ ID NO: 4525905 - DNA, 19 bp, Homo sapiens
gtacttcctctgtgaactg

SEQ ID NO: 4525906 - DNA, 21 bp, Homo sapiens
gtacttcctctgtgaactgtg

SEQ ID NO: 4525907 - DNA, 13 bp, Homo sapiens
gtacttctaagag

SEQ ID NO: 4525908 - DNA, 21 bp, Homo sapiens
gtacttcttcatccatagaca

SEQ ID NO: 4525909 - DNA, 22 bp, Homo sapiens
gtacttgccttattagagtgtc

SEQ ID NO: 4525910 - DNA, 15 bp, Homo sapiens
gtactttatatcttg

SEQ ID NO: 4525911 - DNA, 20 bp, Homo sapiens
gtactttatcatgaatgctt

SEQ ID NO: 4525912 - DNA, 16 bp, Homo sapiens
gtacttttcattctct

SEQ ID NO: 4525913 - DNA, 18 bp, Homo sapiens
gtacttttcattctcttt

SEQ ID NO: 4525914 - DNA, 22 bp, Homo sapiens
gtacttttcattctcttttaat

SEQ ID NO: 4525915 - DNA, 23 bp, Homo sapiens
gtactttttagtaatttcttttt

SEQ ID NO: 4525916 - DNA, 20 bp, Homo sapiens
gtacttttttaaatattttc

SEQ ID NO: 4525917 - DNA, 19 bp, Homo sapiens
gtagaaaaattattagaac

SEQ ID NO: 4525918 - DNA, 15 bp, Homo sapiens
gtagaaactgcaggg

SEQ ID NO: 4525919 - DNA, 19 bp, Homo sapiens
gtagaaactgcagggaaaa

SEQ ID NO: 4525920 - DNA, 19 bp, Homo sapiens
gtagaaagacatctgcctg

SEQ ID NO: 4525921 - DNA, 22 bp, Homo sapiens
gtagaaagttgtaaaatagaaa

SEQ ID NO: 4525922 - DNA, 16 bp, Homo sapiens
gtagaactgtctgtga

SEQ ID NO: 4525923 - DNA, 12 bp, Homo sapiens
gtagaagatggc

SEQ ID NO: 4525924 - DNA, 15 bp, Homo sapiens
gtagaataaatgaag

SEQ ID NO: 4525925 - DNA, 14 bp, Homo sapiens
gtagaatgttttca

SEQ ID NO: 4525926 - DNA, 21 bp, Homo sapiens
gtagacacactatcatagtta

SEQ ID NO: 4525927 - DNA, 21 bp, Homo sapiens
gtagacggctcagtatagata

SEQ ID NO: 4525928 - DNA, 19 bp, Homo sapiens
gtagactctaagatacact

SEQ ID NO: 4525929 - DNA, 21 bp, Homo sapiens
gtagactgtgccagaggccag

SEQ ID NO: 4525930 - DNA, 17 bp, Homo sapiens
gtagactgtttcacatt

SEQ ID NO: 4525931 - DNA, 23 bp, Homo sapiens
gtagacttggacccaaaaaatca

SEQ ID NO: 4525932 - DNA, 15 bp, Homo sapiens
gtagagacagagttt

SEQ ID NO: 4525933 - DNA, 20 bp, Homo sapiens
gtagagcatggttccagtga

SEQ ID NO: 4525934 - DNA, 22 bp, Homo sapiens
gtagagtgacctcggacagagc

SEQ ID NO: 4525935 - DNA, 21 bp, Homo sapiens
gtagatctatattagatcaaa

SEQ ID NO: 4525936 - DNA, 18 bp, Homo sapiens
gtagatgacaaatattct

SEQ ID NO: 4525937 - DNA, 14 bp, Homo sapiens
gtagattcatgaaa

SEQ ID NO: 4525938 - DNA, 13 bp, Homo sapiens
gtagattgcagaa

SEQ ID NO: 4525939 - DNA, 18 bp, Homo sapiens
gtagatttgaaaattgta

SEQ ID NO: 4525940 - DNA, 20 bp, Homo sapiens
gtagatttgaaaattgtata

SEQ ID NO: 4525941 - DNA, 14 bp, Homo sapiens
gtagcaaatgttta

SEQ ID NO: 4525942 - DNA, 15 bp, Homo sapiens
gtagcaaatgtttac

SEQ ID NO: 4525943 - DNA, 22 bp, Homo sapiens
gtagcaatggccagagcctctg

SEQ ID NO: 4525944 - DNA, 12 bp, Homo sapiens
gtagcaatgtgc

SEQ ID NO: 4525945 - DNA, 15 bp, Homo sapiens
gtagcagagttaaat

SEQ ID NO: 4525946 - DNA, 12 bp, Homo sapiens
gtagcagcaggc

SEQ ID NO: 4525947 - DNA, 15 bp, Homo sapiens
gtagcagcaggctca

SEQ ID NO: 4525948 - DNA, 16 bp, Homo sapiens
gtagcagcaggctcag

SEQ ID NO: 4525949 - DNA, 13 bp, Homo sapiens
gtagcatataaat

SEQ ID NO: 4525950 - DNA, 16 bp, Homo sapiens
gtagcatataaatgtt

SEQ ID NO: 4525951 - DNA, 20 bp, Homo sapiens
gtagcatgaacgccaaggaa

SEQ ID NO: 4525952 - DNA, 13 bp, Homo sapiens
gtagccagctgtg

SEQ ID NO: 4525953 - DNA, 21 bp, Homo sapiens
gtagcctctcctgtatttaac

SEQ ID NO: 4525954 - DNA, 12 bp, Homo sapiens
gtagcctgctgg

SEQ ID NO: 4525955 - DNA, 17 bp, Homo sapiens
gtagcctgggctcactg

SEQ ID NO: 4525956 - DNA, 19 bp, Homo sapiens
gtagcctgggctcactgtg

SEQ ID NO: 4525957 - DNA, 20 bp, Homo sapiens
gtagcctgggctcactgtgc

SEQ ID NO: 4525958 - DNA, 13 bp, Homo sapiens
gtagcgtttttta

SEQ ID NO: 4525959 - DNA, 17 bp, Homo sapiens
gtagcgttttttaaatg

SEQ ID NO: 4525960 - DNA, 19 bp, Homo sapiens
gtagctagtagcaatgtgc

SEQ ID NO: 4525961 - DNA, 20 bp, Homo sapiens
gtagctccagcgatggtgct

SEQ ID NO: 4525962 - DNA, 19 bp, Homo sapiens
gtagctcccctggctggct

SEQ ID NO: 4525963 - DNA, 12 bp, Homo sapiens
gtagctctgcct

SEQ ID NO: 4525964 - DNA, 13 bp, Homo sapiens
gtagctctgcctc

SEQ ID NO: 4525965 - DNA, 18 bp, Homo sapiens
gtagctgggatgacaggc

SEQ ID NO: 4525966 - DNA, 20 bp, Homo sapiens
gtagctgtcagatgtcacat

SEQ ID NO: 4525967 - DNA, 17 bp, Homo sapiens
gtagcttatctgcccct

SEQ ID NO: 4525968 - DNA, 23 bp, Homo sapiens
gtagcttatctgcccctccccca

SEQ ID NO: 4525969 - DNA, 21 bp, Homo sapiens
gtagcttcagtcattaaatta

SEQ ID NO: 4525970 - DNA, 16 bp, Homo sapiens
gtaggaactgctgggc

SEQ ID NO: 4525971 - DNA, 15 bp, Homo sapiens
gtaggaagtaggaag

SEQ ID NO: 4525972 - DNA, 16 bp, Homo sapiens
gtaggagggtgggaag

SEQ ID NO: 4525973 - DNA, 17 bp, Homo sapiens
gtaggagggtgggaagg

SEQ ID NO: 4525974 - DNA, 20 bp, Homo sapiens
gtaggatcacctgaggtcag

SEQ ID NO: 4525975 - DNA, 21 bp, Homo sapiens
gtaggcatcagtatgtcactc

SEQ ID NO: 4525976 - DNA, 14 bp, Homo sapiens
gtaggcatttccta

SEQ ID NO: 4525977 - DNA, 20 bp, Homo sapiens
gtagggtttggacagaccca

SEQ ID NO: 4525978 - DNA, 22 bp, Homo sapiens
gtaggtaaaatgtatttttcta

SEQ ID NO: 4525979 - DNA, 19 bp, Homo sapiens
gtaggttgtgatgatagca

SEQ ID NO: 4525980 - DNA, 17 bp, Homo sapiens
gtagtacttcttctgta

SEQ ID NO: 4525981 - DNA, 14 bp, Homo sapiens
gtagtcaataaaac

SEQ ID NO: 4525982 - DNA, 12 bp, Homo sapiens
gtagtccatcac

SEQ ID NO: 4525983 - DNA, 14 bp, Homo sapiens
gtagtccttggcat

SEQ ID NO: 4525984 - DNA, 21 bp, Homo sapiens
gtagtccttggcatagacatg

SEQ ID NO: 4525985 - DNA, 19 bp, Homo sapiens
gtagtgcatttttaaactt

SEQ ID NO: 4525986 - DNA, 20 bp, Homo sapiens
gtagtgcatttttaaacttg

SEQ ID NO: 4525987 - DNA, 13 bp, Homo sapiens
gtagtggccactg

SEQ ID NO: 4525988 - DNA, 17 bp, Homo sapiens
gtagtggccactggggt

SEQ ID NO: 4525989 - DNA, 21 bp, Homo sapiens
gtagtgttattgccaggaaag

SEQ ID NO: 4525990 - DNA, 17 bp, Homo sapiens
gtagttaatataaatgt

SEQ ID NO: 4525991 - DNA, 20 bp, Homo sapiens
gtagttccctgaaaacccag

SEQ ID NO: 4525992 - DNA, 19 bp, Homo sapiens
gtagttgggtagaaaaatt

SEQ ID NO: 4525993 - DNA, 22 bp, Homo sapiens
gtagttgtcacagtcttgtgaa

SEQ ID NO: 4525994 - DNA, 19 bp, Homo sapiens
gtagtttatggcagaaggg

SEQ ID NO: 4525995 - DNA, 21 bp, Homo sapiens
gtagtttatggcagaagggaa

SEQ ID NO: 4525996 - DNA, 22 bp, Homo sapiens
gtagtttgaaagttgtacatga

SEQ ID NO: 4525997 - DNA, 15 bp, Homo sapiens
gtagtttgaatgttt

SEQ ID NO: 4525998 - DNA, 17 bp, Homo sapiens
gtagtttgctttgcttt

SEQ ID NO: 4525999 - DNA, 20 bp, Homo sapiens
gtagttttattttatgttta

SEQ ID NO: 4526000 - DNA, 20 bp, Homo sapiens
gtagtttttatatgttgtaa

SEQ ID NO: 4526001 - DNA, 20 bp, Homo sapiens
gtataaaaattatcaaaaag

SEQ ID NO: 4526002 - DNA, 15 bp, Homo sapiens
gtataaaacattaat

SEQ ID NO: 4526003 - DNA, 12 bp, Homo sapiens
gtataaactttt

SEQ ID NO: 4526004 - DNA, 20 bp, Homo sapiens
gtataaatgtacatcagttt

SEQ ID NO: 4526005 - DNA, 15 bp, Homo sapiens
gtataagataaaata

SEQ ID NO: 4526006 - DNA, 23 bp, Homo sapiens
gtataagccacttgtcttgaaaa

SEQ ID NO: 4526007 - DNA, 21 bp, Homo sapiens
gtataagttgctgtaaaattt

SEQ ID NO: 4526008 - DNA, 13 bp, Homo sapiens
gtataatactttg

SEQ ID NO: 4526009 - DNA, 17 bp, Homo sapiens
gtataatagagataagt

SEQ ID NO: 4526010 - DNA, 18 bp, Homo sapiens
gtataatcccacccacct

SEQ ID NO: 4526011 - DNA, 14 bp, Homo sapiens
gtataatctattta

SEQ ID NO: 4526012 - DNA, 14 bp, Homo sapiens
gtataatgctttct

SEQ ID NO: 4526013 - DNA, 14 bp, Homo sapiens
gtataatgtgtctg

SEQ ID NO: 4526014 - DNA, 15 bp, Homo sapiens
gtataatgtgtctgt

SEQ ID NO: 4526015 - DNA, 18 bp, Homo sapiens
gtataattggatttccta

SEQ ID NO: 4526016 - DNA, 20 bp, Homo sapiens
gtataattggatttcctaat

SEQ ID NO: 4526017 - DNA, 14 bp, Homo sapiens
gtatacaagtactg

SEQ ID NO: 4526018 - DNA, 23 bp, Homo sapiens
gtatacagagaagaaaacctcaa

SEQ ID NO: 4526019 - DNA, 22 bp, Homo sapiens
gtataccaatgtgttttctgta

SEQ ID NO: 4526020 - DNA, 23 bp, Homo sapiens
gtataccaatgtgttttctgtag

SEQ ID NO: 4526021 - DNA, 19 bp, Homo sapiens
gtaataaagtgttttcaga

SEQ ID NO: 4526022 - DNA, 21 bp, Homo sapiens
gtaataaatctaggatgtgat

SEQ ID NO: 4526023 - DNA, 23 bp, Homo sapiens
gtaataaatctaggatgtgatga

SEQ ID NO: 4526024 - DNA, 17 bp, Homo sapiens
gtaataaatgtgactca

SEQ ID NO: 4526025 - DNA, 15 bp, Homo sapiens
gtaatacctgattga

SEQ ID NO: 4526026 - DNA, 15 bp, Homo sapiens
gtaatactttacaaa

SEQ ID NO: 4526027 - DNA, 19 bp, Homo sapiens
gtaatactttttaaattac

SEQ ID NO: 4526028 - DNA, 15 bp, Homo sapiens
gtaatagtttatctt

SEQ ID NO: 4526029 - DNA, 19 bp, Homo sapiens
gtaatagtttatcttatac

SEQ ID NO: 4526030 - DNA, 14 bp, Homo sapiens
gtaatattctgttt

SEQ ID NO: 4526031 - DNA, 19 bp, Homo sapiens
gtaatattggcatagaaaa

SEQ ID NO: 4526032 - DNA, 19 bp, Homo sapiens
gtaatatttacaatgtatt

SEQ ID NO: 4526033 - DNA, 21 bp, Homo sapiens
gtaatatttacaatgtattaa

SEQ ID NO: 4526034 - DNA, 13 bp, Homo sapiens
gtaatattttcca

SEQ ID NO: 4526035 - DNA, 13 bp, Homo sapiens
gtaatcattttaa

SEQ ID NO: 4526036 - DNA, 14 bp, Homo sapiens
gtaatcattttaaa

SEQ ID NO: 4526037 - DNA, 20 bp, Homo sapiens
gtaatcattttaaattccac

SEQ ID NO: 4526038 - DNA, 16 bp, Homo sapiens
gtaatcccagcacttt

SEQ ID NO: 4526039 - DNA, 14 bp, Homo sapiens
gtaatcccagctac

SEQ ID NO: 4526040 - DNA, 18 bp, Homo sapiens
gtaatcccagctactcag

SEQ ID NO: 4526041 - DNA, 21 bp, Homo sapiens
gtaatcccagctactcaggag

SEQ ID NO: 4526042 - DNA, 18 bp, Homo sapiens
gtaatccctgctttttgt

SEQ ID NO: 4526043 - DNA, 11 bp, Homo sapiens
gtaatctacac

SEQ ID NO: 4526044 - DNA, 22 bp, Homo sapiens
gtaatctacaccaatgaaaaca

SEQ ID NO: 4526045 - DNA, 16 bp, Homo sapiens
gtaatctgtataatac

SEQ ID NO: 4526046 - DNA, 17 bp, Homo sapiens
gtaatctttacctgtat

SEQ ID NO: 4526047 - DNA, 19 bp, Homo sapiens
gtaatctttacctgtatac

SEQ ID NO: 4526048 - DNA, 14 bp, Homo sapiens
gtaatgaaatgttt

SEQ ID NO: 4526049 - DNA, 13 bp, Homo sapiens
gtaatgaagtaaa

SEQ ID NO: 4526050 - DNA, 21 bp, Homo sapiens
gtaatgaatttttatgatatt

SEQ ID NO: 4526051 - DNA, 21 bp, Homo sapiens
gtaatgatactgattatgaaa

SEQ ID NO: 4526052 - DNA, 15 bp, Homo sapiens
gtaatgcagttttta

SEQ ID NO: 4526053 - DNA, 20 bp, Homo sapiens
gtaatgccacacattgtgct

SEQ ID NO: 4526054 - DNA, 20 bp, Homo sapiens
gtaatgtcaccaccttccca

SEQ ID NO: 4526055 - DNA, 22 bp, Homo sapiens
gtaatgtcaccaccttcccagc

SEQ ID NO: 4526056 - DNA, 19 bp, Homo sapiens
gtaatgttttctttgcaaa

SEQ ID NO: 4526057 - DNA, 16 bp, Homo sapiens
gtaattaaactgttaa

SEQ ID NO: 4526058 - DNA, 22 bp, Homo sapiens
gtaattaaactgttaacttatt

SEQ ID NO: 4526059 - DNA, 20 bp, Homo sapiens
gtaattaaggtacatcatta

SEQ ID NO: 4526060 - DNA, 21 bp, Homo sapiens
gtaattaaggtacatcattat

SEQ ID NO: 4526061 - DNA, 22 bp, Homo sapiens
gtaattaaggtacatcattatt

SEQ ID NO: 4526062 - DNA, 16 bp, Homo sapiens
gtaattccaaaatcca

SEQ ID NO: 4526063 - DNA, 18 bp, Homo sapiens
gtaattctaccctgaaag

SEQ ID NO: 4526064 - DNA, 20 bp, Homo sapiens
gtaattcttctgcctcagcc

SEQ ID NO: 4526065 - DNA, 21 bp, Homo sapiens
gtaattgtgtggattctttaa

SEQ ID NO: 4526066 - DNA, 12 bp, Homo sapiens
gtaatttaactt

SEQ ID NO: 4526067 - DNA, 15 bp, Homo sapiens
gtaatttattgtctg

SEQ ID NO: 4526068 - DNA, 18 bp, Homo sapiens
gtaatttcgccttaaact

SEQ ID NO: 4526069 - DNA, 19 bp, Homo sapiens
gtaatttcgccttaaactc

SEQ ID NO: 4526070 - DNA, 20 bp, Homo sapiens
gtaatttctttaaatgtgta

SEQ ID NO: 4526071 - DNA, 21 bp, Homo sapiens
gtaatttctttttttcctttt

SEQ ID NO: 4526072 - DNA, 13 bp, Homo sapiens
gtaatttgaagat

SEQ ID NO: 4526073 - DNA, 22 bp, Homo sapiens
gtaatttgttatatcagcagac

SEQ ID NO: 4526074 - DNA, 15 bp, Homo sapiens
gtaatttttttcacc

SEQ ID NO: 4526075 - DNA, 16 bp, Homo sapiens
gtacaaacagtatttc

SEQ ID NO: 4526076 - DNA, 13 bp, Homo sapiens
gtacaactgtatt

SEQ ID NO: 4526077 - DNA, 17 bp, Homo sapiens
gtacaactgtatttatt

SEQ ID NO: 4526078 - DNA, 15 bp, Homo sapiens
gtacaatacaatgta

SEQ ID NO: 4526079 - DNA, 17 bp, Homo sapiens
gtacaatacaatgtaca

SEQ ID NO: 4526080 - DNA, 17 bp, Homo sapiens
gtacaattatgtctctt

SEQ ID NO: 4526081 - DNA, 18 bp, Homo sapiens
gtacaattttaaagttct

SEQ ID NO: 4526082 - DNA, 14 bp, Homo sapiens
gtacacatttctta

SEQ ID NO: 4526083 - DNA, 17 bp, Homo sapiens
gtacacctccccctgcg

SEQ ID NO: 4526084 - DNA, 13 bp, Homo sapiens
gtacactcagcca

SEQ ID NO: 4526085 - DNA, 14 bp, Homo sapiens
gtacactctgctgt

SEQ ID NO: 4526086 - DNA, 13 bp, Homo sapiens
gtacactttttac

SEQ ID NO: 4526087 - DNA, 18 bp, Homo sapiens
gtacagatccccagcccc

SEQ ID NO: 4526088 - DNA, 14 bp, Homo sapiens
gtacagtcttgtat

SEQ ID NO: 4526089 - DNA, 16 bp, Homo sapiens
gtacagttgagctcag

SEQ ID NO: 4526090 - DNA, 13 bp, Homo sapiens
gtacagtttttat

SEQ ID NO: 4526091 - DNA, 15 bp, Homo sapiens
gtacataaacaatga

SEQ ID NO: 4526092 - DNA, 18 bp, Homo sapiens
gtacataattgcatgaaa

SEQ ID NO: 4526093 - DNA, 21 bp, Homo sapiens
gtacataattgcatgaaaata

SEQ ID NO: 4526094 - DNA, 17 bp, Homo sapiens
gtacataggcttctatt

SEQ ID NO: 4526095 - DNA, 16 bp, Homo sapiens
gtacatcattattgta

SEQ ID NO: 4526096 - DNA, 15 bp, Homo sapiens
gtacatctgcaatat

SEQ ID NO: 4526097 - DNA, 17 bp, Homo sapiens
gtacatgataagacatt

SEQ ID NO: 4526098 - DNA, 18 bp, Homo sapiens
gtacattgcttaaaatat

SEQ ID NO: 4526099 - DNA, 17 bp, Homo sapiens
gtacatttgcaattaga

SEQ ID NO: 4526100 - DNA, 16 bp, Homo sapiens
gtacatttttcaactt

SEQ ID NO: 4526101 - DNA, 19 bp, Homo sapiens
gtacatttttcaactttga

SEQ ID NO: 4526102 - DNA, 22 bp, Homo sapiens
gtacatttttcaactttgaata

SEQ ID NO: 4526103 - DNA, 16 bp, Homo sapiens
gtaccaaaattttaaa

SEQ ID NO: 4526104 - DNA, 20 bp, Homo sapiens
gtaccaaaattttaaaaaag

SEQ ID NO: 4526105 - DNA, 16 bp, Homo sapiens
gtaccagctgcgcttg

SEQ ID NO: 4526106 - DNA, 17 bp, Homo sapiens
gtaccagctgcgcttgc

SEQ ID NO: 4526107 - DNA, 15 bp, Homo sapiens
gtaccagtgaatttt

SEQ ID NO: 4526108 - DNA, 19 bp, Homo sapiens
gtaccagtgaatttttgca

SEQ ID NO: 4526109 - DNA, 17 bp, Homo sapiens
gtaccatagaaaaatgt

SEQ ID NO: 4526110 - DNA, 20 bp, Homo sapiens
gtacccagcaaatgggcatt

SEQ ID NO: 4526111 - DNA, 23 bp, Homo sapiens
gtaccgccttgcacactcagaag

SEQ ID NO: 4526112 - DNA, 14 bp, Homo sapiens
gtacctcactgtcc

SEQ ID NO: 4526113 - DNA, 12 bp, Homo sapiens
gtacctcagtgg

SEQ ID NO: 4526114 - DNA, 20 bp, Homo sapiens
gtacctcagtggatcttcag

SEQ ID NO: 4526115 - DNA, 17 bp, Homo sapiens
gtacctgcccccaatcc

SEQ ID NO: 4526116 - DNA, 11 bp, Homo sapiens
gtacctgtggc

SEQ ID NO: 4526117 - DNA, 12 bp, Homo sapiens
gtacctgtggct

SEQ ID NO: 4526118 - DNA, 15 bp, Homo sapiens
gtacctgtggctgtg

SEQ ID NO: 4526119 - DNA, 23 bp, Homo sapiens
gtaccttttttgttttttcaaaa

SEQ ID NO: 4526120 - DNA, 16 bp, Homo sapiens
gtacgatcaagttgtt

SEQ ID NO: 4526121 - DNA, 17 bp, Homo sapiens
gtacggattttcagtta

SEQ ID NO: 4526122 - DNA, 16 bp, Homo sapiens
gtactaaggagcatga

SEQ ID NO: 4526123 - DNA, 12 bp, Homo sapiens
gtactaccccag

SEQ ID NO: 4526124 - DNA, 13 bp, Homo sapiens
gtactagaaaaat

SEQ ID NO: 4526125 - DNA, 20 bp, Homo sapiens
gtactagccagcacaaaagg

SEQ ID NO: 4526126 - DNA, 22 bp, Homo sapiens
gtactcagggcattctgttggc

SEQ ID NO: 4526127 - DNA, 23 bp, Homo sapiens
gtactgaaagccttagggaagct

SEQ ID NO: 4526128 - DNA, 18 bp, Homo sapiens
gtactgaatttttttgta

SEQ ID NO: 4526129 - DNA, 22 bp, Homo sapiens
gtactgaatttttttgtaataa

SEQ ID NO: 4526130 - DNA, 20 bp, Homo sapiens
gtactgatttcagtaagtct

SEQ ID NO: 4526131 - DNA, 19 bp, Homo sapiens
gtactgccccccatgagga

SEQ ID NO: 4526132 - DNA, 21 bp, Homo sapiens
gtactgccccccatgaggaag

SEQ ID NO: 4526133 - DNA, 23 bp, Homo sapiens
gtactgccccccatgaggaagga

SEQ ID NO: 4526134 - DNA, 19 bp, Homo sapiens
gtactggtaagattgttat

SEQ ID NO: 4526135 - DNA, 17 bp, Homo sapiens
gtactgtgggcaattta

SEQ ID NO: 4526136 - DNA, 13 bp, Homo sapiens
gtactgtgttttt

SEQ ID NO: 4526137 - DNA, 23 bp, Homo sapiens
gtactgtgtttttaaattttgta

SEQ ID NO: 4526138 - DNA, 17 bp, Homo sapiens
gtactgttcggaagggg

SEQ ID NO: 4526139 - DNA, 13 bp, Homo sapiens
gtactgtttacca

SEQ ID NO: 4526140 - DNA, 20 bp, Homo sapiens
gtactgtttaccatttttca

SEQ ID NO: 4526141 - DNA, 22 bp, Homo sapiens
ggttgttgcaccatctgcttgg

SEQ ID NO: 4526142 - DNA, 13 bp, Homo sapiens
ggtttaatgtttt

SEQ ID NO: 4526143 - DNA, 21 bp, Homo sapiens
ggtttattctatctgttttta

SEQ ID NO: 4526144 - DNA, 17 bp, Homo sapiens
ggtttatttttctgtta

SEQ ID NO: 4526145 - DNA, 19 bp, Homo sapiens
ggtttcaccatgttgccca

SEQ ID NO: 4526146 - DNA, 20 bp, Homo sapiens
ggtttcaccatgttggccag

SEQ ID NO: 4526147 - DNA, 21 bp, Homo sapiens
ggtttctaagcataaaagatg

SEQ ID NO: 4526148 - DNA, 18 bp, Homo sapiens
ggtttctcattaaactct

SEQ ID NO: 4526149 - DNA, 15 bp, Homo sapiens
ggtttctcattaaag

SEQ ID NO: 4526150 - DNA, 22 bp, Homo sapiens
ggtttctgatctgtactttgtg

SEQ ID NO: 4526151 - DNA, 10 bp, Homo sapiens
ggtttcttat

SEQ ID NO: 4526152 - DNA, 22 bp, Homo sapiens
ggtttgagattgccccaggtct

SEQ ID NO: 4526153 - DNA, 16 bp, Homo sapiens
ggtttggaatattaaa

SEQ ID NO: 4526154 - DNA, 14 bp, Homo sapiens
ggtttggtgctttt

SEQ ID NO: 4526155 - DNA, 15 bp, Homo sapiens
ggtttgtaaaatgca

SEQ ID NO: 4526156 - DNA, 13 bp, Homo sapiens
ggttttaaacttt

SEQ ID NO: 4526157 - DNA, 23 bp, Homo sapiens
ggttttatggttacttcttctct

SEQ ID NO: 4526158 - DNA, 22 bp, Homo sapiens
ggttttattctgacttcctctg

SEQ ID NO: 4526159 - DNA, 13 bp, Homo sapiens
ggttttcatttgc

SEQ ID NO: 4526160 - DNA, 16 bp, Homo sapiens
ggttttgaaatgtttc

SEQ ID NO: 4526161 - DNA, 18 bp, Homo sapiens
ggttttgtattctctgag

SEQ ID NO: 4526162 - DNA, 22 bp, Homo sapiens
ggttttgttcccctcctccact

SEQ ID NO: 4526163 - DNA, 19 bp, Homo sapiens
ggtttttaaattttgtaat

SEQ ID NO: 4526164 - DNA, 17 bp, Homo sapiens
ggtttttacttaactgt

SEQ ID NO: 4526165 - DNA, 23 bp, Homo sapiens
gtaaaaaaaaaaaaaatgttctt

SEQ ID NO: 4526166 - DNA, 18 bp, Homo sapiens
gtaaaaataaaatacttt

SEQ ID NO: 4526167 - DNA, 20 bp, Homo sapiens
gtaaaaataaaatactttga

SEQ ID NO: 4526168 - DNA, 13 bp, Homo sapiens
gtaaaaatgctgc

SEQ ID NO: 4526169 - DNA, 17 bp, Homo sapiens
gtaaaacagggccacat

SEQ ID NO: 4526170 - DNA, 20 bp, Homo sapiens
gtaaaacagggccacataga

SEQ ID NO: 4526171 - DNA, 14 bp, Homo sapiens
gtaaaacagtcatc

SEQ ID NO: 4526172 - DNA, 20 bp, Homo sapiens
gtaaaacatttattttgaca

SEQ ID NO: 4526173 - DNA, 18 bp, Homo sapiens
gtaaaagcaaaaaagaaa

SEQ ID NO: 4526174 - DNA, 13 bp, Homo sapiens
gtaaaatgagttt

SEQ ID NO: 4526175 - DNA, 20 bp, Homo sapiens
gtaaaatgcaccaatcagca

SEQ ID NO: 4526176 - DNA, 23 bp, Homo sapiens
gtaaaatgcttttcactttctgt

SEQ ID NO: 4526177 - DNA, 17 bp, Homo sapiens
gtaaaatgtatttttct

SEQ ID NO: 4526178 - DNA, 17 bp, Homo sapiens
gtaaaatgtctttccaa

SEQ ID NO: 4526179 - DNA, 20 bp, Homo sapiens
gtaaaattaatgtaataaag

SEQ ID NO: 4526180 - DNA, 19 bp, Homo sapiens
gtaaaatttcccattaaag

SEQ ID NO: 4526181 - DNA, 20 bp, Homo sapiens
gtaaaatttgtgtaaatttg

SEQ ID NO: 4526182 - DNA, 19 bp, Homo sapiens
gtaaacagcctctttttga

SEQ ID NO: 4526183 - DNA, 14 bp, Homo sapiens
gtaaacagggtacc

SEQ ID NO: 4526184 - DNA, 22 bp, Homo sapiens
gtaaacaggtatttttttaaat

SEQ ID NO: 4526185 - DNA, 23 bp, Homo sapiens
gtaaacaggtatttttttaaatc

SEQ ID NO: 4526186 - DNA, 15 bp, Homo sapiens
gtaaacagtgcctgc

SEQ ID NO: 4526187 - DNA, 20 bp, Homo sapiens
gtaaacataaaaactgattt

SEQ ID NO: 4526188 - DNA, 23 bp, Homo sapiens
gtaaacatatttatttttacctg

SEQ ID NO: 4526189 - DNA, 16 bp, Homo sapiens
gtaaaccactgaaaaa

SEQ ID NO: 4526190 - DNA, 20 bp, Homo sapiens
gtaaaccactgaaaaaatat

SEQ ID NO: 4526191 - DNA, 14 bp, Homo sapiens
gtaaaccagatctg

SEQ ID NO: 4526192 - DNA, 14 bp, Homo sapiens
gtaaacggcccagg

SEQ ID NO: 4526193 - DNA, 12 bp, Homo sapiens
gtaaactctctt

SEQ ID NO: 4526194 - DNA, 14 bp, Homo sapiens
gtaaactgaggccc

SEQ ID NO: 4526195 - DNA, 20 bp, Homo sapiens
gtaaactgtgtattccaaga

SEQ ID NO: 4526196 - DNA, 16 bp, Homo sapiens
gtaaactttttgtgct

SEQ ID NO: 4526197 - DNA, 23 bp, Homo sapiens
gtaaagaacgcgacttccacaaa

SEQ ID NO: 4526198 - DNA, 14 bp, Homo sapiens
gtaaagaattttca

SEQ ID NO: 4526199 - DNA, 14 bp, Homo sapiens
gtaaagactggctt

SEQ ID NO: 4526200 - DNA, 14 bp, Homo sapiens
gtaaagagaaactt

SEQ ID NO: 4526201 - DNA, 20 bp, Homo sapiens
gtaaagagtacactcagcca

SEQ ID NO: 4526202 - DNA, 19 bp, Homo sapiens
gtaaagatatttttatctt

SEQ ID NO: 4526203 - DNA, 14 bp, Homo sapiens
gtaaagtgcaatgg

SEQ ID NO: 4526204 - DNA, 17 bp, Homo sapiens
gtaaagttatgtattta

SEQ ID NO: 4526205 - DNA, 19 bp, Homo sapiens
gtaaataaactatttatat

SEQ ID NO: 4526206 - DNA, 23 bp, Homo sapiens
gtaaataaactatttatatcaca

SEQ ID NO: 4526207 - DNA, 20 bp, Homo sapiens
gtaaataaccccattctttg

SEQ ID NO: 4526208 - DNA, 15 bp, Homo sapiens
gtaaataatttattt

SEQ ID NO: 4526209 - DNA, 13 bp, Homo sapiens
gtaaatactgtga

SEQ ID NO: 4526210 - DNA, 13 bp, Homo sapiens
gtaaataggtttc

SEQ ID NO: 4526211 - DNA, 14 bp, Homo sapiens
gtaaatatatatgg

SEQ ID NO: 4526212 - DNA, 11 bp, Homo sapiens
gtaaatatatc

SEQ ID NO: 4526213 - DNA, 20 bp, Homo sapiens
gtaaatattgctaaaagcat

SEQ ID NO: 4526214 - DNA, 13 bp, Homo sapiens
gtaaatctacaca

SEQ ID NO: 4526215 - DNA, 17 bp, Homo sapiens
gtaaatctttttgcttc

SEQ ID NO: 4526216 - DNA, 12 bp, Homo sapiens
gtaaatgcatat

SEQ ID NO: 4526217 - DNA, 16 bp, Homo sapiens
gtaaatgtggattttg

SEQ ID NO: 4526218 - DNA, 16 bp, Homo sapiens
gtaaattacaaatgtg

SEQ ID NO: 4526219 - DNA, 14 bp, Homo sapiens
gtaaattatatttg

SEQ ID NO: 4526220 - DNA, 15 bp, Homo sapiens
gtaaattatatttgt

SEQ ID NO: 4526221 - DNA, 18 bp, Homo sapiens
gtaaattattttaaatta

SEQ ID NO: 4526222 - DNA, 22 bp, Homo sapiens
gtaaattattttaaattataag

SEQ ID NO: 4526223 - DNA, 17 bp, Homo sapiens
gtaacaatacatgagaa

SEQ ID NO: 4526224 - DNA, 15 bp, Homo sapiens
gtaacactaatatat

SEQ ID NO: 4526225 - DNA, 12 bp, Homo sapiens
gtaacactacag

SEQ ID NO: 4526226 - DNA, 20 bp, Homo sapiens
gtaacactgtgatttatctt

SEQ ID NO: 4526227 - DNA, 22 bp, Homo sapiens
gtaacactgtgatttatctttc

SEQ ID NO: 4526228 - DNA, 17 bp, Homo sapiens
gtaacagtgcaagattt

SEQ ID NO: 4526229 - DNA, 18 bp, Homo sapiens
gtaacataactgcttctt

SEQ ID NO: 4526230 - DNA, 23 bp, Homo sapiens
gtaacatgtgttaagtattttca

SEQ ID NO: 4526231 - DNA, 15 bp, Homo sapiens
gtaacatttttcaat

SEQ ID NO: 4526232 - DNA, 12 bp, Homo sapiens
gtaaccagccag

SEQ ID NO: 4526233 - DNA, 20 bp, Homo sapiens
gtaaccaggccccagcctcc

SEQ ID NO: 4526234 - DNA, 17 bp, Homo sapiens
gtaacgagaagtgcttt

SEQ ID NO: 4526235 - DNA, 16 bp, Homo sapiens
gtaactataagataca

SEQ ID NO: 4526236 - DNA, 12 bp, Homo sapiens
gtaactccacca

SEQ ID NO: 4526237 - DNA, 22 bp, Homo sapiens
gtaactgaaggtgttgggtcag

SEQ ID NO: 4526238 - DNA, 14 bp, Homo sapiens
gtaactgagagaaa

SEQ ID NO: 4526239 - DNA, 15 bp, Homo sapiens
gtaactgagagaaag

SEQ ID NO: 4526240 - DNA, 19 bp, Homo sapiens
gtaactgattacctgccaa

SEQ ID NO: 4526241 - DNA, 14 bp, Homo sapiens
gtaactgctttctg

SEQ ID NO: 4526242 - DNA, 19 bp, Homo sapiens
gtaactgctttctgttcca

SEQ ID NO: 4526243 - DNA, 22 bp, Homo sapiens
gtaactgtttagatgaatgtca

SEQ ID NO: 4526244 - DNA, 20 bp, Homo sapiens
gtaacttcttatggaattga

SEQ ID NO: 4526245 - DNA, 18 bp, Homo sapiens
gtaagaactgtacattgt

SEQ ID NO: 4526246 - DNA, 20 bp, Homo sapiens
gtaagaactgtacattgtga

SEQ ID NO: 4526247 - DNA, 15 bp, Homo sapiens
gtaagaagaaagcaa

SEQ ID NO: 4526248 - DNA, 18 bp, Homo sapiens
gtaagaagggtgggagtg

SEQ ID NO: 4526249 - DNA, 14 bp, Homo sapiens
gtaagaatggccaa

SEQ ID NO: 4526250 - DNA, 16 bp, Homo sapiens
gtaagaccaaatgtag

SEQ ID NO: 4526251 - DNA, 14 bp, Homo sapiens
gtaagactgctggt

SEQ ID NO: 4526252 - DNA, 22 bp, Homo sapiens
gtaagccaaagaaatgaacatt

SEQ ID NO: 4526253 - DNA, 14 bp, Homo sapiens
gtaagggagggaag

SEQ ID NO: 4526254 - DNA, 17 bp, Homo sapiens
gtaagttcagcacttgt

SEQ ID NO: 4526255 - DNA, 19 bp, Homo sapiens
gtaagttgagaaaaattta

SEQ ID NO: 4526256 - DNA, 14 bp, Homo sapiens
gtaataaaaagaga

SEQ ID NO: 4526257 - DNA, 18 bp, Homo sapiens
gtaataaaactatttgta

SEQ ID NO: 4526258 - DNA, 19 bp, Homo sapiens
gtaataaaactatttgtat

SEQ ID NO: 4526259 - DNA, 19 bp, Homo sapiens
gtaataaagtgaactttgt

SEQ ID NO: 4526260 - DNA, 18 bp, Homo sapiens
gtaataaagtgttttcag

SEQ ID NO: 4526261 - DNA, 15 bp, Homo sapiens
gtcaaataaacactg

SEQ ID NO: 4526262 - DNA, 16 bp, Homo sapiens
gtcaacaaagtgcttt

SEQ ID NO: 4526263 - DNA, 23 bp, Homo sapiens
gtcaacagagaaggcaggaatgt

SEQ ID NO: 4526264 - DNA, 13 bp, Homo sapiens
gtcaacagtaaac

SEQ ID NO: 4526265 - DNA, 14 bp, Homo sapiens
gtcaacagtaaacc

SEQ ID NO: 4526266 - DNA, 21 bp, Homo sapiens
gtcaacggggggctcctgccc

SEQ ID NO: 4526267 - DNA, 14 bp, Homo sapiens
gtcaagacatttgc

SEQ ID NO: 4526268 - DNA, 16 bp, Homo sapiens
gtcaagagcatgcaca

SEQ ID NO: 4526269 - DNA, 17 bp, Homo sapiens
gtcaagtgcctgcacca

SEQ ID NO: 4526270 - DNA, 16 bp, Homo sapiens
gtcaagtgggatctgt

SEQ ID NO: 4526271 - DNA, 16 bp, Homo sapiens
gtcaagttgtgcttgt

SEQ ID NO: 4526272 - DNA, 17 bp, Homo sapiens
gtcaagttgtgcttgtt

SEQ ID NO: 4526273 - DNA, 19 bp, Homo sapiens
gtcaataacactgtatttt

SEQ ID NO: 4526274 - DNA, 16 bp, Homo sapiens
gtcaatcccctcattc

SEQ ID NO: 4526275 - DNA, 17 bp, Homo sapiens
gtcaatcccctcattca

SEQ ID NO: 4526276 - DNA, 15 bp, Homo sapiens
gtcaatgcagccccc

SEQ ID NO: 4526277 - DNA, 21 bp, Homo sapiens
gtcaattttgttatgtatatt

SEQ ID NO: 4526278 - DNA, 11 bp, Homo sapiens
gtcacaataaa

SEQ ID NO: 4526279 - DNA, 13 bp, Homo sapiens
gtcacaataaagt

SEQ ID NO: 4526280 - DNA, 20 bp, Homo sapiens
gtcacaatgagattgaattt

SEQ ID NO: 4526281 - DNA, 13 bp, Homo sapiens
gtcacacactgat

SEQ ID NO: 4526282 - DNA, 20 bp, Homo sapiens
gtcacagacgtgaaagccag

SEQ ID NO: 4526283 - DNA, 12 bp, Homo sapiens
gtcacagagtga

SEQ ID NO: 4526284 - DNA, 17 bp, Homo sapiens
gtcacagatgaggcccc

SEQ ID NO: 4526285 - DNA, 20 bp, Homo sapiens
gtcacaggaagtagaggagg

SEQ ID NO: 4526286 - DNA, 22 bp, Homo sapiens
gtcacagtaaagagtacactca

SEQ ID NO: 4526287 - DNA, 23 bp, Homo sapiens
gtcacagtaaagagtacactcag

SEQ ID NO: 4526288 - DNA, 17 bp, Homo sapiens
gtcacagtcttgtgaac

SEQ ID NO: 4526289 - DNA, 22 bp, Homo sapiens
gtcacagttcttggtgactgtc

SEQ ID NO: 4526290 - DNA, 20 bp, Homo sapiens
gtcacatcacaatattcagt

SEQ ID NO: 4526291 - DNA, 11 bp, Homo sapiens
gtcaccacctt

SEQ ID NO: 4526292 - DNA, 15 bp, Homo sapiens
gtcaccaccttccca

SEQ ID NO: 4526293 - DNA, 20 bp, Homo sapiens
gtcaccaccttcccagctct

SEQ ID NO: 4526294 - DNA, 19 bp, Homo sapiens
gtcaccacgactggccagg

SEQ ID NO: 4526295 - DNA, 16 bp, Homo sapiens
gtcaccagagacttta

SEQ ID NO: 4526296 - DNA, 18 bp, Homo sapiens
gtcaccaggaatgttaaa

SEQ ID NO: 4526297 - DNA, 23 bp, Homo sapiens
gtcaccaggaatgttaaagtcag

SEQ ID NO: 4526298 - DNA, 20 bp, Homo sapiens
gtcacccctttctgtcccac

SEQ ID NO: 4526299 - DNA, 17 bp, Homo sapiens
gtcaccgagcgggtgca

SEQ ID NO: 4526300 - DNA, 19 bp, Homo sapiens
gtcaccggtcagtgccttt

SEQ ID NO: 4526301 - DNA, 15 bp, Homo sapiens
gtcacctcacaaacc

SEQ ID NO: 4526302 - DNA, 18 bp, Homo sapiens
gtcacctgccgccctgtg

SEQ ID NO: 4526303 - DNA, 13 bp, Homo sapiens
gtcactatatctt

SEQ ID NO: 4526304 - DNA, 20 bp, Homo sapiens
gtcactcattaatgaatcac

SEQ ID NO: 4526305 - DNA, 15 bp, Homo sapiens
gtcactccaccatcc

SEQ ID NO: 4526306 - DNA, 22 bp, Homo sapiens
gtcactgatgtacaattaaaaa

SEQ ID NO: 4526307 - DNA, 17 bp, Homo sapiens
gtcactgcatttgcctg

SEQ ID NO: 4526308 - DNA, 18 bp, Homo sapiens
gtcactgcatttgcctgc

SEQ ID NO: 4526309 - DNA, 20 bp, Homo sapiens
gtcactggaaaggggagagc

SEQ ID NO: 4526310 - DNA, 23 bp, Homo sapiens
gtcactggaggttgaagccaagt

SEQ ID NO: 4526311 - DNA, 22 bp, Homo sapiens
gtcactggcctctccccaggaa

SEQ ID NO: 4526312 - DNA, 15 bp, Homo sapiens
gtcacttgccacatg

SEQ ID NO: 4526313 - DNA, 21 bp, Homo sapiens
gtcagaacaggtttttttgtt

SEQ ID NO: 4526314 - DNA, 15 bp, Homo sapiens
gtcagaaccctgcca

SEQ ID NO: 4526315 - DNA, 18 bp, Homo sapiens
gtcagaataaaaatgtgg

SEQ ID NO: 4526316 - DNA, 20 bp, Homo sapiens
gtcagaatgtgaaaaaggaa

SEQ ID NO: 4526317 - DNA, 16 bp, Homo sapiens
gtcagagaaaatgaga

SEQ ID NO: 4526318 - DNA, 20 bp, Homo sapiens
gtcagagagacctcatcctg

SEQ ID NO: 4526319 - DNA, 21 bp, Homo sapiens
gtcagagagacctcatcctgc

SEQ ID NO: 4526320 - DNA, 13 bp, Homo sapiens
gtcagagccactc

SEQ ID NO: 4526321 - DNA, 17 bp, Homo sapiens
gtcagagcccagcccag

SEQ ID NO: 4526322 - DNA, 17 bp, Homo sapiens
gtcagagtccagtgctc

SEQ ID NO: 4526323 - DNA, 22 bp, Homo sapiens
gtcagagtccagtgctctgcct

SEQ ID NO: 4526324 - DNA, 13 bp, Homo sapiens
gtcagagtgccac

SEQ ID NO: 4526325 - DNA, 17 bp, Homo sapiens
gtcagatcctgttactt

SEQ ID NO: 4526326 - DNA, 21 bp, Homo sapiens
gtcagatgcccgagggagggg

SEQ ID NO: 4526327 - DNA, 12 bp, Homo sapiens
gtcagattcctt

SEQ ID NO: 4526328 - DNA, 13 bp, Homo sapiens
gtcagattccttt

SEQ ID NO: 4526329 - DNA, 13 bp, Homo sapiens
gtcagatttttat

SEQ ID NO: 4526330 - DNA, 18 bp, Homo sapiens
gtcagatttttatttatg

SEQ ID NO: 4526331 - DNA, 23 bp, Homo sapiens
gtcagcacccccaccaaacttta

SEQ ID NO: 4526332 - DNA, 15 bp, Homo sapiens
gtcagcagcagctct

SEQ ID NO: 4526333 - DNA, 12 bp, Homo sapiens
gtcagcagtatt

SEQ ID NO: 4526334 - DNA, 17 bp, Homo sapiens
gtcagcatcactgatgg

SEQ ID NO: 4526335 - DNA, 21 bp, Homo sapiens
gtcagcatcactgatgggaat

SEQ ID NO: 4526336 - DNA, 16 bp, Homo sapiens
gtcagccaagtgcaga

SEQ ID NO: 4526337 - DNA, 12 bp, Homo sapiens
gtcagccagccg

SEQ ID NO: 4526338 - DNA, 22 bp, Homo sapiens
gtcagccctagggtggagagcc

SEQ ID NO: 4526339 - DNA, 14 bp, Homo sapiens
gtcagcctccagcc

SEQ ID NO: 4526340 - DNA, 21 bp, Homo sapiens
gtcagcctctctcccagtcta

SEQ ID NO: 4526341 - DNA, 19 bp, Homo sapiens
gtcagctcccctcggagaa

SEQ ID NO: 4526342 - DNA, 12 bp, Homo sapiens
gtcagcttatcc

SEQ ID NO: 4526343 - DNA, 13 bp, Homo sapiens
gtcagcttctccc

SEQ ID NO: 4526344 - DNA, 14 bp, Homo sapiens
gtcagcttctccca

SEQ ID NO: 4526345 - DNA, 19 bp, Homo sapiens
gtcagcttctcccaagccc

SEQ ID NO: 4526346 - DNA, 21 bp, Homo sapiens
gtcagcttctcccaagcccac

SEQ ID NO: 4526347 - DNA, 17 bp, Homo sapiens
gtcagcttttttcctgt

SEQ ID NO: 4526348 - DNA, 20 bp, Homo sapiens
gtcaggagttttactgcctg

SEQ ID NO: 4526349 - DNA, 21 bp, Homo sapiens
gtcaggagttttactgcctgt

SEQ ID NO: 4526350 - DNA, 16 bp, Homo sapiens
gtcaggcccgtcagca

SEQ ID NO: 4526351 - DNA, 17 bp, Homo sapiens
gtcaggcccgtcagcat

SEQ ID NO: 4526352 - DNA, 18 bp, Homo sapiens
gtcaggcccgtcagcatc

SEQ ID NO: 4526353 - DNA, 16 bp, Homo sapiens
gtcaggctacaaggta

SEQ ID NO: 4526354 - DNA, 14 bp, Homo sapiens
gtcaggctgctggc

SEQ ID NO: 4526355 - DNA, 15 bp, Homo sapiens
gtcaggctgctggcg

SEQ ID NO: 4526356 - DNA, 17 bp, Homo sapiens
gtcaggctgctggcgcc

SEQ ID NO: 4526357 - DNA, 22 bp, Homo sapiens
gtcaggctgctggcgcctctgc

SEQ ID NO: 4526358 - DNA, 14 bp, Homo sapiens
gtcaggggggagaa

SEQ ID NO: 4526359 - DNA, 15 bp, Homo sapiens
gtcagggtgggaaga

SEQ ID NO: 4526360 - DNA, 19 bp, Homo sapiens
gtcaggtggttaccaggca

SEQ ID NO: 4526361 - DNA, 22 bp, Homo sapiens
gtcaggtggttaccaggcactg

SEQ ID NO: 4526362 - DNA, 16 bp, Homo sapiens
gtcagtgcagcagagg

SEQ ID NO: 4526363 - DNA, 19 bp, Homo sapiens
gtcagtgttaaagattttg

SEQ ID NO: 4526364 - DNA, 22 bp, Homo sapiens
gtcataaagtgagaaaactgtg

SEQ ID NO: 4526365 - DNA, 19 bp, Homo sapiens
gtcatacaaatttataaag

SEQ ID NO: 4526366 - DNA, 16 bp, Homo sapiens
gtcataccaatgaaaa

SEQ ID NO: 4526367 - DNA, 13 bp, Homo sapiens
gtcatagaaatat

SEQ ID NO: 4526368 - DNA, 15 bp, Homo sapiens
gtcatatacatattg

SEQ ID NO: 4526369 - DNA, 17 bp, Homo sapiens
gtcatcaaaacctgcgc

SEQ ID NO: 4526370 - DNA, 22 bp, Homo sapiens
gtcatcaaaatctgcacagtca

SEQ ID NO: 4526371 - DNA, 16 bp, Homo sapiens
gtcatccatatttgct

SEQ ID NO: 4526372 - DNA, 19 bp, Homo sapiens
gtcatcctcaaagaaagtg

SEQ ID NO: 4526373 - DNA, 18 bp, Homo sapiens
gtcatcctcacagtgaac

SEQ ID NO: 4526374 - DNA, 14 bp, Homo sapiens
gtcatctctctggg

SEQ ID NO: 4526375 - DNA, 17 bp, Homo sapiens
gtcatctctctggggcc

SEQ ID NO: 4526376 - DNA, 23 bp, Homo sapiens
gtcatctctctggggccctgggc

SEQ ID NO: 4526377 - DNA, 14 bp, Homo sapiens
gtcatctgatgaga

SEQ ID NO: 4526378 - DNA, 22 bp, Homo sapiens
gtcatcttgctaccagtattta

SEQ ID NO: 4526379 - DNA, 16 bp, Homo sapiens
gtcatctttttctaga

SEQ ID NO: 4526380 - DNA, 18 bp, Homo sapiens
gtcatgaacatgttcctg

SEQ ID NO: 4526381 - DNA, 20 bp, Homo sapiens
gtcatgatctccctgccgcc

SEQ ID NO: 4526382 - DNA, 12 bp, Homo sapiens
gtcatgggcctg

SEQ ID NO: 4526383 - DNA, 21 bp, Homo sapiens
gtcatggtagatttttttcat

SEQ ID NO: 4526384 - DNA, 16 bp, Homo sapiens
gtcatggtcacagtaa

SEQ ID NO: 4526385 - DNA, 22 bp, Homo sapiens
gtcattacaaaaaaacacgtgg

SEQ ID NO: 4526386 - DNA, 20 bp, Homo sapiens
gtcattatattctaattaaa

SEQ ID NO: 4526387 - DNA, 23 bp, Homo sapiens
gtcattatattctaattaaaatt

SEQ ID NO: 4526388 - DNA, 17 bp, Homo sapiens
gtcattatttttgttag

SEQ ID NO: 4526389 - DNA, 23 bp, Homo sapiens
gtcattcttttgccacatcccta

SEQ ID NO: 4526390 - DNA, 23 bp, Homo sapiens
gtcattgcacctatctcagccat

SEQ ID NO: 4526391 - DNA, 12 bp, Homo sapiens
gtcatttcattc

SEQ ID NO: 4526392 - DNA, 15 bp, Homo sapiens
gtcatttcattccat

SEQ ID NO: 4526393 - DNA, 16 bp, Homo sapiens
gtcatttcattccatt

SEQ ID NO: 4526394 - DNA, 21 bp, Homo sapiens
gtcatttcattccattgccta

SEQ ID NO: 4526395 - DNA, 17 bp, Homo sapiens
gtcatttgaacctggat

SEQ ID NO: 4526396 - DNA, 19 bp, Homo sapiens
gtcattttattttgtaata

SEQ ID NO: 4526397 - DNA, 18 bp, Homo sapiens
gtcattttggtactttgg

SEQ ID NO: 4526398 - DNA, 11 bp, Homo sapiens
gtcatttttgt

SEQ ID NO: 4526399 - DNA, 12 bp, Homo sapiens
gtcatttttgtt

SEQ ID NO: 4526400 - DNA, 19 bp, Homo sapiens
gtcatttttgtttttggtt

SEQ ID NO: 4526401 - DNA, 13 bp, Homo sapiens
gtcattttttact

SEQ ID NO: 4526402 - DNA, 14 bp, Homo sapiens
gtcattttttactt

SEQ ID NO: 4526403 - DNA, 17 bp, Homo sapiens
gtcattttttacttgaa

SEQ ID NO: 4526404 - DNA, 20 bp, Homo sapiens
gtccaaataaattcaataaa

SEQ ID NO: 4526405 - DNA, 13 bp, Homo sapiens
gtccaacatggtg

SEQ ID NO: 4526406 - DNA, 23 bp, Homo sapiens
gtccaacatggtgaaacccccat

SEQ ID NO: 4526407 - DNA, 23 bp, Homo sapiens
gtccaaggtggcagatgtcttcc

SEQ ID NO: 4526408 - DNA, 17 bp, Homo sapiens
gtccaatgccacctaga

SEQ ID NO: 4526409 - DNA, 15 bp, Homo sapiens
gtccaccatgctctc

SEQ ID NO: 4526410 - DNA, 20 bp, Homo sapiens
gtccacccacctatgtgcca

SEQ ID NO: 4526411 - DNA, 13 bp, Homo sapiens
gtccaccctgagc

SEQ ID NO: 4526412 - DNA, 15 bp, Homo sapiens
gtccaccctgagctc

SEQ ID NO: 4526413 - DNA, 18 bp, Homo sapiens
gtccaccctgagctcggg

SEQ ID NO: 4526414 - DNA, 20 bp, Homo sapiens
gtccaccctgagctcgggga

SEQ ID NO: 4526415 - DNA, 14 bp, Homo sapiens
gtccaccctgccaa

SEQ ID NO: 4526416 - DNA, 21 bp, Homo sapiens
gtccacctggccccatgtctc

SEQ ID NO: 4526417 - DNA, 16 bp, Homo sapiens
gtccacgactgtctcc

SEQ ID NO: 4526418 - DNA, 13 bp, Homo sapiens
gtccacgcccacc

SEQ ID NO: 4526419 - DNA, 17 bp, Homo sapiens
gtccacgcccaccagcc

SEQ ID NO: 4526420 - DNA, 18 bp, Homo sapiens
gtccacgcccaccagcct

SEQ ID NO: 4526421 - DNA, 18 bp, Homo sapiens
gtccacgtacttaattta

SEQ ID NO: 4526422 - DNA, 19 bp, Homo sapiens
gtccactgttctgttctca

SEQ ID NO: 4526423 - DNA, 19 bp, Homo sapiens
gtccagaagcctcctgttg

SEQ ID NO: 4526424 - DNA, 17 bp, Homo sapiens
gtccagaccccccagcc

SEQ ID NO: 4526425 - DNA, 21 bp, Homo sapiens
gtccagaccccccagcccctc

SEQ ID NO: 4526426 - DNA, 19 bp, Homo sapiens
gtccagagaccacaccact

SEQ ID NO: 4526427 - DNA, 21 bp, Homo sapiens
gtccagcaaataaagcagtca

SEQ ID NO: 4526428 - DNA, 18 bp, Homo sapiens
gtccagcattgctggact

SEQ ID NO: 4526429 - DNA, 21 bp, Homo sapiens
gtccagcattgctggactctg

SEQ ID NO: 4526430 - DNA, 17 bp, Homo sapiens
gtccagcccctcctccc

SEQ ID NO: 4526431 - DNA, 13 bp, Homo sapiens
gtccagcctgggc

SEQ ID NO: 4526432 - DNA, 22 bp, Homo sapiens
gtccagctggggccagaggctg

SEQ ID NO: 4526433 - DNA, 17 bp, Homo sapiens
gtccagcttgctcttca

SEQ ID NO: 4526434 - DNA, 15 bp, Homo sapiens
gtccaggcactgaga

SEQ ID NO: 4526435 - DNA, 16 bp, Homo sapiens
gtccaggcccccagcc

SEQ ID NO: 4526436 - DNA, 18 bp, Homo sapiens
gtccaggcctctctctgc

SEQ ID NO: 4526437 - DNA, 20 bp, Homo sapiens
gtccaggcctctctctgctc

SEQ ID NO: 4526438 - DNA, 20 bp, Homo sapiens
gtccagggaaacagcctctc

SEQ ID NO: 4526439 - DNA, 15 bp, Homo sapiens
gtccagggaagctgg

SEQ ID NO: 4526440 - DNA, 20 bp, Homo sapiens
gtccagggaagctggccgag

SEQ ID NO: 4526441 - DNA, 19 bp, Homo sapiens
gtccaggggcccctccagc

SEQ ID NO: 4526442 - DNA, 23 bp, Homo sapiens
gtccaggggcccctccagcttgt

SEQ ID NO: 4526443 - DNA, 16 bp, Homo sapiens
gtccaggggtctgtct

SEQ ID NO: 4526444 - DNA, 18 bp, Homo sapiens
gtccaggggtctgtctgc

SEQ ID NO: 4526445 - DNA, 20 bp, Homo sapiens
gtccagggtttctctgcaga

SEQ ID NO: 4526446 - DNA, 19 bp, Homo sapiens
gtccaggtcccagcccctc

SEQ ID NO: 4526447 - DNA, 23 bp, Homo sapiens
gtccaggtcccagcccctcctcc

SEQ ID NO: 4526448 - DNA, 20 bp, Homo sapiens
gtccaggtccgtagctcccc

SEQ ID NO: 4526449 - DNA, 22 bp, Homo sapiens
gtccaggtccgtagctcccctg

SEQ ID NO: 4526450 - DNA, 16 bp, Homo sapiens
gtccagtctttttaaa

SEQ ID NO: 4526451 - DNA, 18 bp, Homo sapiens
gtccagtgctctgcctca

SEQ ID NO: 4526452 - DNA, 18 bp, Homo sapiens
gtccagtggagggctcat

SEQ ID NO: 4526453 - DNA, 20 bp, Homo sapiens
gtccagttataagcgtattt

SEQ ID NO: 4526454 - DNA, 15 bp, Homo sapiens
gtccatacactttgt

SEQ ID NO: 4526455 - DNA, 16 bp, Homo sapiens
gtccatagagatgagc

SEQ ID NO: 4526456 - DNA, 20 bp, Homo sapiens
gtccatagagatgagcccac

SEQ ID NO: 4526457 - DNA, 14 bp, Homo sapiens
gtccatatcacaca

SEQ ID NO: 4526458 - DNA, 15 bp, Homo sapiens
gtccatcagcctcca

SEQ ID NO: 4526459 - DNA, 22 bp, Homo sapiens
gtccatgaagatgtagaggaga

SEQ ID NO: 4526460 - DNA, 23 bp, Homo sapiens
gtccatgaagatgtagaggagaa

SEQ ID NO: 4526461 - DNA, 22 bp, Homo sapiens
gtccatgcatgacagcctctat

SEQ ID NO: 4526462 - DNA, 18 bp, Homo sapiens
gtccatgctaacaaagac

SEQ ID NO: 4526463 - DNA, 15 bp, Homo sapiens
gtcccaagcctgata

SEQ ID NO: 4526464 - DNA, 13 bp, Homo sapiens
gtcccacccaccc

SEQ ID NO: 4526465 - DNA, 19 bp, Homo sapiens
gtcccaccgggagcctccc

SEQ ID NO: 4526466 - DNA, 14 bp, Homo sapiens
gtcccactgtgcag

SEQ ID NO: 4526467 - DNA, 20 bp, Homo sapiens
gtcccagaatgcctcctgca

SEQ ID NO: 4526468 - DNA, 22 bp, Homo sapiens
gtcccagattggctcacactga

SEQ ID NO: 4526469 - DNA, 14 bp, Homo sapiens
gtcccagcatccct

SEQ ID NO: 4526470 - DNA, 16 bp, Homo sapiens
gtcccagcatccctgg

SEQ ID NO: 4526471 - DNA, 17 bp, Homo sapiens
gtcccagcatccctgga

SEQ ID NO: 4526472 - DNA, 20 bp, Homo sapiens
gtcccagcatccctggagca

SEQ ID NO: 4526473 - DNA, 15 bp, Homo sapiens
gtcccagccaccccg

SEQ ID NO: 4526474 - DNA, 23 bp, Homo sapiens
gtcccagccaccccgggctctct

SEQ ID NO: 4526475 - DNA, 22 bp, Homo sapiens
gtcccagccccggcaagccaca

SEQ ID NO: 4526476 - DNA, 17 bp, Homo sapiens
gtcccagctcccctctt

SEQ ID NO: 4526477 - DNA, 19 bp, Homo sapiens
gtcccaggaatcagtttaa

SEQ ID NO: 4526478 - DNA, 15 bp, Homo sapiens
gtcccaggggcagcc

SEQ ID NO: 4526479 - DNA, 19 bp, Homo sapiens
gtcccaggggcagccacac

SEQ ID NO: 4526480 - DNA, 16 bp, Homo sapiens
gtcccattcagtggca

SEQ ID NO: 4526481 - DNA, 13 bp, Homo sapiens
gtccccacccatg

SEQ ID NO: 4526482 - DNA, 14 bp, Homo sapiens
gtccccacccatgc

SEQ ID NO: 4526483 - DNA, 13 bp, Homo sapiens
gtccccagagctc

SEQ ID NO: 4526484 - DNA, 16 bp, Homo sapiens
gtccccagcctacctc

SEQ ID NO: 4526485 - DNA, 16 bp, Homo sapiens
gtccccatttctgcct

SEQ ID NO: 4526486 - DNA, 18 bp, Homo sapiens
gtccccatttctgcctcg

SEQ ID NO: 4526487 - DNA, 12 bp, Homo sapiens
gtcccccagagc

SEQ ID NO: 4526488 - DNA, 13 bp, Homo sapiens
gtcccccagagca

SEQ ID NO: 4526489 - DNA, 22 bp, Homo sapiens
gtcccccagagcatctgcccca

SEQ ID NO: 4526490 - DNA, 13 bp, Homo sapiens
gtcccccaggagg

SEQ ID NO: 4526491 - DNA, 17 bp, Homo sapiens
gtcccccaggaggcagc

SEQ ID NO: 4526492 - DNA, 15 bp, Homo sapiens
gtcccccaggctgga

SEQ ID NO: 4526493 - DNA, 17 bp, Homo sapiens
gtccccctcctcagcca

SEQ ID NO: 4526494 - DNA, 19 bp, Homo sapiens
gtccccctcctcagccagc

SEQ ID NO: 4526495 - DNA, 19 bp, Homo sapiens
gtccccctctgtccaggca

SEQ ID NO: 4526496 - DNA, 21 bp, Homo sapiens
gtccccctctgtccaggcact

SEQ ID NO: 4526497 - DNA, 14 bp, Homo sapiens
gtccccgaggagct

SEQ ID NO: 4526498 - DNA, 20 bp, Homo sapiens
gtccccgaggagctgggccc

SEQ ID NO: 4526499 - DNA, 23 bp, Homo sapiens
gtccccgaggagctgggcccctg

SEQ ID NO: 4526500 - DNA, 18 bp, Homo sapiens
gtccccgtggccatccct

SEQ ID NO: 4526501 - DNA, 15 bp, Homo sapiens
gtcccctcactctgt

SEQ ID NO: 4526502 - DNA, 23 bp, Homo sapiens
gtcccctcactctgtcagccagc

SEQ ID NO: 4526503 - DNA, 17 bp, Homo sapiens
gtcccctccgccgtgcc

SEQ ID NO: 4526504 - DNA, 19 bp, Homo sapiens
gtcccctccgccgtgccgg

SEQ ID NO: 4526505 - DNA, 12 bp, Homo sapiens
gtcccctgcggg

SEQ ID NO: 4526506 - DNA, 20 bp, Homo sapiens
gtcccctgcgggcgcgggca

SEQ ID NO: 4526507 - DNA, 23 bp, Homo sapiens
gtcccctgctactcctgtgctct

SEQ ID NO: 4526508 - DNA, 13 bp, Homo sapiens
gtccccttcccct

SEQ ID NO: 4526509 - DNA, 18 bp, Homo sapiens
gtccccttcccctgctga

SEQ ID NO: 4526510 - DNA, 11 bp, Homo sapiens
gtccccttctc

SEQ ID NO: 4526511 - DNA, 14 bp, Homo sapiens
gtccccttctctca

SEQ ID NO: 4526512 - DNA, 17 bp, Homo sapiens
gtccccttctctcatct

SEQ ID NO: 4526513 - DNA, 19 bp, Homo sapiens
gtccccttctctcatctct

SEQ ID NO: 4526514 - DNA, 14 bp, Homo sapiens
gtcccgcactctgc

SEQ ID NO: 4526515 - DNA, 14 bp, Homo sapiens
gtcccggctctgtg

SEQ ID NO: 4526516 - DNA, 15 bp, Homo sapiens
gtcccggctctgtgg

SEQ ID NO: 4526517 - DNA, 15 bp, Homo sapiens
gtccctatgcatatc

SEQ ID NO: 4526518 - DNA, 11 bp, Homo sapiens
gtccctccctg

SEQ ID NO: 4526519 - DNA, 16 bp, Homo sapiens
gtccctccctgcctga

SEQ ID NO: 4526520 - DNA, 18 bp, Homo sapiens
gtccctccctgcctgagg

SEQ ID NO: 4526521 - DNA, 23 bp, Homo sapiens
gtccctccgggacctggtgctgc

SEQ ID NO: 4526522 - DNA, 20 bp, Homo sapiens
gtccctgcctggaccagcct

SEQ ID NO: 4526523 - DNA, 13 bp, Homo sapiens
gtccctgctgggg

SEQ ID NO: 4526524 - DNA, 14 bp, Homo sapiens
gtccctggagggca

SEQ ID NO: 4526525 - DNA, 22 bp, Homo sapiens
gtccctggagggcaagccctgc

SEQ ID NO: 4526526 - DNA, 21 bp, Homo sapiens
gtccctgggagtgttcccgtg

SEQ ID NO: 4526527 - DNA, 19 bp, Homo sapiens
gtccctgggggaagccctg

SEQ ID NO: 4526528 - DNA, 22 bp, Homo sapiens
gtccctgggggaagccctggat

SEQ ID NO: 4526529 - DNA, 17 bp, Homo sapiens
gtccctgtcacctcttc

SEQ ID NO: 4526530 - DNA, 18 bp, Homo sapiens
gtcccttccaatgctgtg

SEQ ID NO: 4526531 - DNA, 17 bp, Homo sapiens
gtcccttcccctccctg

SEQ ID NO: 4526532 - DNA, 18 bp, Homo sapiens
gtcccttcccctccctgg

SEQ ID NO: 4526533 - DNA, 20 bp, Homo sapiens
gtcccttcccctccctggct

SEQ ID NO: 4526534 - DNA, 22 bp, Homo sapiens
gtcccttcccctccctggctcc

SEQ ID NO: 4526535 - DNA, 14 bp, Homo sapiens
gtcccttgagacct

SEQ ID NO: 4526536 - DNA, 16 bp, Homo sapiens
gtcccttgagacctca

SEQ ID NO: 4526537 - DNA, 19 bp, Homo sapiens
gtcccttgagacctcagcc

SEQ ID NO: 4526538 - DNA, 20 bp, Homo sapiens
gtcccttgagacctcagcca

SEQ ID NO: 4526539 - DNA, 22 bp, Homo sapiens
gtcccttgagacctcagccatg

SEQ ID NO: 4526540 - DNA, 16 bp, Homo sapiens
gtcccttgcctctgcc

SEQ ID NO: 4526541 - DNA, 22 bp, Homo sapiens
gtcccttgcctctgccctggat

SEQ ID NO: 4526542 - DNA, 16 bp, Homo sapiens
gtccgcaccctgtcct

SEQ ID NO: 4526543 - DNA, 18 bp, Homo sapiens
gtccggacactcctagag

SEQ ID NO: 4526544 - DNA, 16 bp, Homo sapiens
gtccggcccagtgcca

SEQ ID NO: 4526545 - DNA, 17 bp, Homo sapiens
gtccggcctctccctgc

SEQ ID NO: 4526546 - DNA, 13 bp, Homo sapiens
gtccgtagctccc

SEQ ID NO: 4526547 - DNA, 14 bp, Homo sapiens
gtccgtagctcccc

SEQ ID NO: 4526548 - DNA, 18 bp, Homo sapiens
gtccgtagctcccctggc

SEQ ID NO: 4526549 - DNA, 19 bp, Homo sapiens
gtccgttcacatgtgtggt

SEQ ID NO: 4526550 - DNA, 15 bp, Homo sapiens
gtcctaaaagcaaaa

SEQ ID NO: 4526551 - DNA, 22 bp, Homo sapiens
gtcctaacctcgggcctgctgc

SEQ ID NO: 4526552 - DNA, 15 bp, Homo sapiens
gtcctaactttctga

SEQ ID NO: 4526553 - DNA, 14 bp, Homo sapiens
gtcctaaggcccat

SEQ ID NO: 4526554 - DNA, 20 bp, Homo sapiens
gtcctaagtgctaagtgctt

SEQ ID NO: 4526555 - DNA, 16 bp, Homo sapiens
gtcctaccatcagctc

SEQ ID NO: 4526556 - DNA, 24 bp, Homo sapiens
gtcctacgtccaaggtggcagatg

SEQ ID NO: 4526557 - DNA, 20 bp, Homo sapiens
gtcctagcccttccctgagt

SEQ ID NO: 4526558 - DNA, 20 bp, Homo sapiens
gtcctagctgcacagggcag

SEQ ID NO: 4526559 - DNA, 21 bp, Homo sapiens
gtcctattatattcattcttt

SEQ ID NO: 4526560 - DNA, 19 bp, Homo sapiens
gtcctcacctggttgaccc

SEQ ID NO: 4526561 - DNA, 24 bp, Homo sapiens
gtcctcacttctagatctcagcca

SEQ ID NO: 4526562 - DNA, 20 bp, Homo sapiens
gtcctccactcgacccagaa

SEQ ID NO: 4526563 - DNA, 21 bp, Homo sapiens
gtcctccactcgacccagaat

SEQ ID NO: 4526564 - DNA, 21 bp, Homo sapiens
gtcctccagaagcctctggct

SEQ ID NO: 4526565 - DNA, 15 bp, Homo sapiens
gtcctccccctgcca

SEQ ID NO: 4526566 - DNA, 17 bp, Homo sapiens
gtcctccccctgccagt

SEQ ID NO: 4526567 - DNA, 20 bp, Homo sapiens
gtcctccccctgccagtgcc

SEQ ID NO: 4526568 - DNA, 16 bp, Homo sapiens
gtcctcccctatttta

SEQ ID NO: 4526569 - DNA, 12 bp, Homo sapiens
gtcctccctgac

SEQ ID NO: 4526570 - DNA, 20 bp, Homo sapiens
gtcctccctgatcccacccc

SEQ ID NO: 4526571 - DNA, 12 bp, Homo sapiens
gtcctcctctgt

SEQ ID NO: 4526572 - DNA, 23 bp, Homo sapiens
gtcctctcagttctctcccttcc

SEQ ID NO: 4526573 - DNA, 15 bp, Homo sapiens
gtcctctcttccaca

SEQ ID NO: 4526574 - DNA, 16 bp, Homo sapiens
gtcctctcttccacag

SEQ ID NO: 4526575 - DNA, 17 bp, Homo sapiens
gtcctctcttccacagt

SEQ ID NO: 4526576 - DNA, 18 bp, Homo sapiens
gtcctctcttccacagtg

SEQ ID NO: 4526577 - DNA, 20 bp, Homo sapiens
gtcctctcttccacagtggc

SEQ ID NO: 4526578 - DNA, 12 bp, Homo sapiens
gtcctcttctgc

SEQ ID NO: 4526579 - DNA, 15 bp, Homo sapiens
gtcctcttctgctct

SEQ ID NO: 4526580 - DNA, 20 bp, Homo sapiens
gtcctgactccgtcaagctg

SEQ ID NO: 4526581 - DNA, 20 bp, Homo sapiens
gtcctgcacaccctgggcca

SEQ ID NO: 4526582 - DNA, 15 bp, Homo sapiens
gtcctgcaccggggc

SEQ ID NO: 4526583 - DNA, 20 bp, Homo sapiens
gtcctgcaccggggcctggg

SEQ ID NO: 4526584 - DNA, 15 bp, Homo sapiens
gtcctgccagctgga

SEQ ID NO: 4526585 - DNA, 18 bp, Homo sapiens
gtcctgcccatgccccag

SEQ ID NO: 4526586 - DNA, 16 bp, Homo sapiens
gtcctgcccatgtgtc

SEQ ID NO: 4526587 - DNA, 21 bp, Homo sapiens
gtcctgcccatgtgtcccctc

SEQ ID NO: 4526588 - DNA, 23 bp, Homo sapiens
gtcctgcccatgtgtcccctcac

SEQ ID NO: 4526589 - DNA, 11 bp, Homo sapiens
gtcctgcctga

SEQ ID NO: 4526590 - DNA, 21 bp, Homo sapiens
gtcctgcctgaacagccctct

SEQ ID NO: 4526591 - DNA, 20 bp, Homo sapiens
gtcctgcctggccaggcaga

SEQ ID NO: 4526592 - DNA, 20 bp, Homo sapiens
gtcctggaggggctggggac

SEQ ID NO: 4526593 - DNA, 14 bp, Homo sapiens
gtcctggcagggcg

SEQ ID NO: 4526594 - DNA, 22 bp, Homo sapiens
gtcctggcgcctggcagtccgt

SEQ ID NO: 4526595 - DNA, 14 bp, Homo sapiens
gtcctggctcctga

SEQ ID NO: 4526596 - DNA, 15 bp, Homo sapiens
gtcctgggcctgccc

SEQ ID NO: 4526597 - DNA, 16 bp, Homo sapiens
gtcctgggcctgcccc

SEQ ID NO: 4526598 - DNA, 17 bp, Homo sapiens
gtcctgggctcaaatga

SEQ ID NO: 4526599 - DNA, 17 bp, Homo sapiens
gtcctggtgctgccgag

SEQ ID NO: 4526600 - DNA, 17 bp, Homo sapiens
gtcctgtaagaagcggc

SEQ ID NO: 4526601 - DNA, 22 bp, Homo sapiens
gtcctgtagttttattttatgt

SEQ ID NO: 4526602 - DNA, 22 bp, Homo sapiens
gtcctgtccacacccagctcag

SEQ ID NO: 4526603 - DNA, 15 bp, Homo sapiens
gtcctgtctctgcct

SEQ ID NO: 4526604 - DNA, 16 bp, Homo sapiens
gtcctgtgatgtcagc

SEQ ID NO: 4526605 - DNA, 20 bp, Homo sapiens
gtcctgtgtaaattagtgta

SEQ ID NO: 4526606 - DNA, 16 bp, Homo sapiens
gtcctgttaatttata

SEQ ID NO: 4526607 - DNA, 23 bp, Homo sapiens
gtcctgttaatttataggcgttt

SEQ ID NO: 4526608 - DNA, 18 bp, Homo sapiens
gtcctgtttctgtcaagc

SEQ ID NO: 4526609 - DNA, 23 bp, Homo sapiens
gtccttaacccacctctcctgcc

SEQ ID NO: 4526610 - DNA, 19 bp, Homo sapiens
gtccttccctgatggcctt

SEQ ID NO: 4526611 - DNA, 17 bp, Homo sapiens
gtccttcctgtgccctg

SEQ ID NO: 4526612 - DNA, 14 bp, Homo sapiens
gtccttgcacctgc

SEQ ID NO: 4526613 - DNA, 15 bp, Homo sapiens
gtccttgcacctgca

SEQ ID NO: 4526614 - DNA, 16 bp, Homo sapiens
gtccttgcacctgcat

SEQ ID NO: 4526615 - DNA, 15 bp, Homo sapiens
gtccttggctgccgt

SEQ ID NO: 4526616 - DNA, 15 bp, Homo sapiens
gtcctttctggaagt

SEQ ID NO: 4526617 - DNA, 20 bp, Homo sapiens
gtcctttctggaagtttctg

SEQ ID NO: 4526618 - DNA, 15 bp, Homo sapiens
gtccttttcactaca

SEQ ID NO: 4526619 - DNA, 16 bp, Homo sapiens
gtccttttgacactgc

SEQ ID NO: 4526620 - DNA, 19 bp, Homo sapiens
gtccttttgacactgctct

SEQ ID NO: 4526621 - DNA, 14 bp, Homo sapiens
gtgccttctgggct

SEQ ID NO: 4526622 - DNA, 13 bp, Homo sapiens
gtgccttgttttt

SEQ ID NO: 4526623 - DNA, 16 bp, Homo sapiens
gtgcctttatttccac

SEQ ID NO: 4526624 - DNA, 20 bp, Homo sapiens
gtgcctttatttccactgtg

SEQ ID NO: 4526625 - DNA, 13 bp, Homo sapiens
gtgcctttcaaat

SEQ ID NO: 4526626 - DNA, 11 bp, Homo sapiens
gtgcctttcct

SEQ ID NO: 4526627 - DNA, 14 bp, Homo sapiens
gtgcctttcctatc

SEQ ID NO: 4526628 - DNA, 20 bp, Homo sapiens
gtgcctttcctgttcagcat

SEQ ID NO: 4526629 - DNA, 17 bp, Homo sapiens
gtgcctttctttgcctc

SEQ ID NO: 4526630 - DNA, 18 bp, Homo sapiens
gtgcctttctttgcctct

SEQ ID NO: 4526631 - DNA, 19 bp, Homo sapiens
gtgcctttctttgcctctg

SEQ ID NO: 4526632 - DNA, 13 bp, Homo sapiens
gtgcctttggcct

SEQ ID NO: 4526633 - DNA, 14 bp, Homo sapiens
gtgccttttgccat

SEQ ID NO: 4526634 - DNA, 14 bp, Homo sapiens
gtgccttttggaac

SEQ ID NO: 4526635 - DNA, 15 bp, Homo sapiens
gtgcgtaaggatgtg

SEQ ID NO: 4526636 - DNA, 14 bp, Homo sapiens
gtgctaaattgtct

SEQ ID NO: 4526637 - DNA, 20 bp, Homo sapiens
gtgctacaaaaacacagcaa

SEQ ID NO: 4526638 - DNA, 21 bp, Homo sapiens
gtgctagaggattagtaagat

SEQ ID NO: 4526639 - DNA, 13 bp, Homo sapiens
gtgctatagtatt

SEQ ID NO: 4526640 - DNA, 14 bp, Homo sapiens
gtgctatagtattt

SEQ ID NO: 4526641 - DNA, 15 bp, Homo sapiens
gtgctatataaatat

SEQ ID NO: 4526642 - DNA, 23 bp, Homo sapiens
gtgctattgtagagccagaggtc

SEQ ID NO: 4526643 - DNA, 16 bp, Homo sapiens
gtgctatttgtcatct

SEQ ID NO: 4526644 - DNA, 16 bp, Homo sapiens
gtgctcacaatgttct

SEQ ID NO: 4526645 - DNA, 17 bp, Homo sapiens
gtgctcacaatgttctg

SEQ ID NO: 4526646 - DNA, 15 bp, Homo sapiens
gtgctcaccagccct

SEQ ID NO: 4526647 - DNA, 20 bp, Homo sapiens
gtgctcaccagccctgcagc

SEQ ID NO: 4526648 - DNA, 23 bp, Homo sapiens
gtgctcacgttaccttgacacat

SEQ ID NO: 4526649 - DNA, 12 bp, Homo sapiens
gtgctcagccaa

SEQ ID NO: 4526650 - DNA, 15 bp, Homo sapiens
gtgctcagccaaatt

SEQ ID NO: 4526651 - DNA, 18 bp, Homo sapiens
gtgctcgcccacaaactg

SEQ ID NO: 4526652 - DNA, 15 bp, Homo sapiens
gtgctcggacacagt

SEQ ID NO: 4526653 - DNA, 22 bp, Homo sapiens
gtgctcggacacagttttgtct

SEQ ID NO: 4526654 - DNA, 12 bp, Homo sapiens
gtgctctgcctc

SEQ ID NO: 4526655 - DNA, 21 bp, Homo sapiens
gtgctctggggatttctggga

SEQ ID NO: 4526656 - DNA, 19 bp, Homo sapiens
gtgctgaatgttgggactg

SEQ ID NO: 4526657 - DNA, 17 bp, Homo sapiens
gtgctgagtaaacataa

SEQ ID NO: 4526658 - DNA, 17 bp, Homo sapiens
gtgctgcacaaaagcag

SEQ ID NO: 4526659 - DNA, 19 bp, Homo sapiens
gtgctgcacaaaagcagat

SEQ ID NO: 4526660 - DNA, 14 bp, Homo sapiens
gtgctgcagctccc

SEQ ID NO: 4526661 - DNA, 12 bp, Homo sapiens
gtgctgcaggag

SEQ ID NO: 4526662 - DNA, 21 bp, Homo sapiens
gtgctgccgagggctggccgg

SEQ ID NO: 4526663 - DNA, 18 bp, Homo sapiens
gtgctgccgcgcagtgtg

SEQ ID NO: 4526664 - DNA, 15 bp, Homo sapiens
gtgctgctgtgtgct

SEQ ID NO: 4526665 - DNA, 22 bp, Homo sapiens
gtgctggactgttccaggccct

SEQ ID NO: 4526666 - DNA, 20 bp, Homo sapiens
gtgctggaggggtggcccag

SEQ ID NO: 4526667 - DNA, 21 bp, Homo sapiens
gtgctggtcagagagacctca

SEQ ID NO: 4526668 - DNA, 14 bp, Homo sapiens
gtgctggtgcatca

SEQ ID NO: 4526669 - DNA, 16 bp, Homo sapiens
gtgctgtattttgata

SEQ ID NO: 4526670 - DNA, 20 bp, Homo sapiens
gtgctgtccccactgcccca

SEQ ID NO: 4526671 - DNA, 15 bp, Homo sapiens
gtgctgtgagggagg

SEQ ID NO: 4526672 - DNA, 13 bp, Homo sapiens
gtgctgtggaagc

SEQ ID NO: 4526673 - DNA, 12 bp, Homo sapiens
gtgctgtgggca

SEQ ID NO: 4526674 - DNA, 19 bp, Homo sapiens
gtgctgtgggcagcaccct

SEQ ID NO: 4526675 - DNA, 21 bp, Homo sapiens
gtgcttattgatattctaaga

SEQ ID NO: 4526676 - DNA, 18 bp, Homo sapiens
gtgcttcatctgtgggat

SEQ ID NO: 4526677 - DNA, 17 bp, Homo sapiens
gtgcttcctcctcaggc

SEQ ID NO: 4526678 - DNA, 21 bp, Homo sapiens
gtgcttctagttctgccagga

SEQ ID NO: 4526679 - DNA, 18 bp, Homo sapiens
gtgcttgttagagagaaa

SEQ ID NO: 4526680 - DNA, 20 bp, Homo sapiens
gtgcttgttagagagaaaga

SEQ ID NO: 4526681 - DNA, 21 bp, Homo sapiens
gtgcttgttagagagaaagag

SEQ ID NO: 4526682 - DNA, 22 bp, Homo sapiens
gtgcttgttagagagaaagaga

SEQ ID NO: 4526683 - DNA, 10 bp, Homo sapiens
gtgctttata

SEQ ID NO: 4526684 - DNA, 20 bp, Homo sapiens
gtgctttattgaattagaaa

SEQ ID NO: 4526685 - DNA, 17 bp, Homo sapiens
gtgctttctattgtaca

SEQ ID NO: 4526686 - DNA, 19 bp, Homo sapiens
gtgctttctattgtacaga

SEQ ID NO: 4526687 - DNA, 20 bp, Homo sapiens
gtgctttctattgtacagaa

SEQ ID NO: 4526688 - DNA, 18 bp, Homo sapiens
gtgctttttataaaaaga

SEQ ID NO: 4526689 - DNA, 20 bp, Homo sapiens
gtgctttttctcccctcctc

SEQ ID NO: 4526690 - DNA, 16 bp, Homo sapiens
gtggaaaacttatgct

SEQ ID NO: 4526691 - DNA, 20 bp, Homo sapiens
gtggaacataaaaaggacat

SEQ ID NO: 4526692 - DNA, 21 bp, Homo sapiens
gtggaacataaaaaggacatc

SEQ ID NO: 4526693 - DNA, 18 bp, Homo sapiens
gtggaactgcgttatgaa

SEQ ID NO: 4526694 - DNA, 16 bp, Homo sapiens
gtggaagcagaggccc

SEQ ID NO: 4526695 - DNA, 18 bp, Homo sapiens
gtggaagcagaggccctg

SEQ ID NO: 4526696 - DNA, 22 bp, Homo sapiens
gtggaagcagaggccctgcccc

SEQ ID NO: 4526697 - DNA, 24 bp, Homo sapiens
gtggaagcagaggccctgccccca

SEQ ID NO: 4526698 - DNA, 16 bp, Homo sapiens
gtggaagccctccttc

SEQ ID NO: 4526699 - DNA, 18 bp, Homo sapiens
gtggaagccctccttcca

SEQ ID NO: 4526700 - DNA, 17 bp, Homo sapiens
gtggaaggcagagaaat

SEQ ID NO: 4526701 - DNA, 15 bp, Homo sapiens
gtggaagtcagtacg

SEQ ID NO: 4526702 - DNA, 13 bp, Homo sapiens
gtggaataaagat

SEQ ID NO: 4526703 - DNA, 18 bp, Homo sapiens
gtggaatataaggaaagc

SEQ ID NO: 4526704 - DNA, 23 bp, Homo sapiens
gtggaatgtcgcagactcctcca

SEQ ID NO: 4526705 - DNA, 17 bp, Homo sapiens
gtggaatgttggataag

SEQ ID NO: 4526706 - DNA, 19 bp, Homo sapiens
gtggaattttgagaaaaat

SEQ ID NO: 4526707 - DNA, 23 bp, Homo sapiens
gtggacagcagacaagagggcaa

SEQ ID NO: 4526708 - DNA, 22 bp, Homo sapiens
gtggacaggatgaggacagagg

SEQ ID NO: 4526709 - DNA, 13 bp, Homo sapiens
gtggaccaggaca

SEQ ID NO: 4526710 - DNA, 14 bp, Homo sapiens
gtggaccaggacag

SEQ ID NO: 4526711 - DNA, 18 bp, Homo sapiens
gtggaccaggacaggacc

SEQ ID NO: 4526712 - DNA, 22 bp, Homo sapiens
gtggaccaggaggattgccttt

SEQ ID NO: 4526713 - DNA, 20 bp, Homo sapiens
gtggactgagtgggaagccc

SEQ ID NO: 4526714 - DNA, 15 bp, Homo sapiens
gtggactggcccctg

SEQ ID NO: 4526715 - DNA, 18 bp, Homo sapiens
gtggactgtgctggtgca

SEQ ID NO: 4526716 - DNA, 12 bp, Homo sapiens
gtggagagctgg

SEQ ID NO: 4526717 - DNA, 14 bp, Homo sapiens
gtggagagctggtg

SEQ ID NO: 4526718 - DNA, 17 bp, Homo sapiens
gtggagatagtgccagg

SEQ ID NO: 4526719 - DNA, 21 bp, Homo sapiens
gtggagatagtgccaggtggc

SEQ ID NO: 4526720 - DNA, 14 bp, Homo sapiens
gtggagccccacac

SEQ ID NO: 4526721 - DNA, 18 bp, Homo sapiens
gtggaggaagggctgggc

SEQ ID NO: 4526722 - DNA, 20 bp, Homo sapiens
gtggaggaagggctgggcca

SEQ ID NO: 4526723 - DNA, 22 bp, Homo sapiens
gtggaggaccgaggctacagct

SEQ ID NO: 4526724 - DNA, 23 bp, Homo sapiens
gtggaggggtgtggcagtggttt

SEQ ID NO: 4526725 - DNA, 15 bp, Homo sapiens
gtggataagtggctg

SEQ ID NO: 4526726 - DNA, 14 bp, Homo sapiens
gtggatattgttac

SEQ ID NO: 4526727 - DNA, 14 bp, Homo sapiens
gtggatcacagagg

SEQ ID NO: 4526728 - DNA, 16 bp, Homo sapiens
gtggatcctgtaggct

SEQ ID NO: 4526729 - DNA, 21 bp, Homo sapiens
gtggatgccacagcccagctt

SEQ ID NO: 4526730 - DNA, 21 bp, Homo sapiens
gtggattacgatgtaaatttt

SEQ ID NO: 4526731 - DNA, 16 bp, Homo sapiens
gtggattttgtagatg

SEQ ID NO: 4526732 - DNA, 14 bp, Homo sapiens
gtggcaccagatgc

SEQ ID NO: 4526733 - DNA, 22 bp, Homo sapiens
gtggcactcagtctctcttctc

SEQ ID NO: 4526734 - DNA, 19 bp, Homo sapiens
gtggcactggccacccctc

SEQ ID NO: 4526735 - DNA, 18 bp, Homo sapiens
gtggcactggggcagggg

SEQ ID NO: 4526736 - DNA, 19 bp, Homo sapiens
gtggcaggcacacagcagc

SEQ ID NO: 4526737 - DNA, 21 bp, Homo sapiens
gtggcaggcacacagcagccc

SEQ ID NO: 4526738 - DNA, 18 bp, Homo sapiens
gtggcagggagcagtaca

SEQ ID NO: 4526739 - DNA, 14 bp, Homo sapiens
gtggcagtaaagag

SEQ ID NO: 4526740 - DNA, 20 bp, Homo sapiens
gtggcagtaaagagaaactt

SEQ ID NO: 4526741 - DNA, 16 bp, Homo sapiens
gtgattaccagggact

SEQ ID NO: 4526742 - DNA, 14 bp, Homo sapiens
gtgattagatcaca

SEQ ID NO: 4526743 - DNA, 14 bp, Homo sapiens
gtgattcaatctgt

SEQ ID NO: 4526744 - DNA, 23 bp, Homo sapiens
gtgattcaatctgtaaactgtgt

SEQ ID NO: 4526745 - DNA, 22 bp, Homo sapiens
gtgattccactacacctggctg

SEQ ID NO: 4526746 - DNA, 17 bp, Homo sapiens
gtgatttaagggcccag

SEQ ID NO: 4526747 - DNA, 16 bp, Homo sapiens
gtgattttgctgtaga

SEQ ID NO: 4526748 - DNA, 16 bp, Homo sapiens
gtgatttttatgccac

SEQ ID NO: 4526749 - DNA, 21 bp, Homo sapiens
gtgatttttatgccacctgaa

SEQ ID NO: 4526750 - DNA, 23 bp, Homo sapiens
gtgcaaaaactgtaaaagtgtac

SEQ ID NO: 4526751 - DNA, 19 bp, Homo sapiens
gtgcaaaatatttgactat

SEQ ID NO: 4526752 - DNA, 13 bp, Homo sapiens
gtgcaacactggt

SEQ ID NO: 4526753 - DNA, 14 bp, Homo sapiens
gtgcaacccttacc

SEQ ID NO: 4526754 - DNA, 23 bp, Homo sapiens
gtgcaacccttaccccttagcct

SEQ ID NO: 4526755 - DNA, 16 bp, Homo sapiens
gtgcaactttttaaag

SEQ ID NO: 4526756 - DNA, 17 bp, Homo sapiens
gtgcaactttttaaagt

SEQ ID NO: 4526757 - DNA, 20 bp, Homo sapiens
gtgcaattccaagaaaatat

SEQ ID NO: 4526758 - DNA, 13 bp, Homo sapiens
gtgcacaaaatga

SEQ ID NO: 4526759 - DNA, 14 bp, Homo sapiens
gtgcacaaatacaa

SEQ ID NO: 4526760 - DNA, 21 bp, Homo sapiens
gtgcacaaatacaaagtggaa

SEQ ID NO: 4526761 - DNA, 23 bp, Homo sapiens
gtgcacaacccaccacccccttt

SEQ ID NO: 4526762 - DNA, 22 bp, Homo sapiens
gtgcacatatccaggcaccagg

SEQ ID NO: 4526763 - DNA, 21 bp, Homo sapiens
gtgcacatgccccttggtcct

SEQ ID NO: 4526764 - DNA, 14 bp, Homo sapiens
gtgcacatgcctct

SEQ ID NO: 4526765 - DNA, 16 bp, Homo sapiens
gtgcacatgcctctgt

SEQ ID NO: 4526766 - DNA, 15 bp, Homo sapiens
gtgcacccagaagaa

SEQ ID NO: 4526767 - DNA, 19 bp, Homo sapiens
gtgcacccatgggctctga

SEQ ID NO: 4526768 - DNA, 18 bp, Homo sapiens
gtgcacgcagattagcag

SEQ ID NO: 4526769 - DNA, 21 bp, Homo sapiens
gtgcacgtggagagctggtgc

SEQ ID NO: 4526770 - DNA, 13 bp, Homo sapiens
gtgcactttgtaa

SEQ ID NO: 4526771 - DNA, 14 bp, Homo sapiens
gtgcactttgtaaa

SEQ ID NO: 4526772 - DNA, 17 bp, Homo sapiens
gtgcagaaccagcacta

SEQ ID NO: 4526773 - DNA, 21 bp, Homo sapiens
gtgcagacacctaaccccagg

SEQ ID NO: 4526774 - DNA, 18 bp, Homo sapiens
gtgcagccgctgagcgag

SEQ ID NO: 4526775 - DNA, 18 bp, Homo sapiens
gtgcagcttcacccacca

SEQ ID NO: 4526776 - DNA, 20 bp, Homo sapiens
gtgcagcttcacccaccagg

SEQ ID NO: 4526777 - DNA, 20 bp, Homo sapiens
gtgcaggcctgtccctggga

SEQ ID NO: 4526778 - DNA, 21 bp, Homo sapiens
gtgcaggcctgtccctgggag

SEQ ID NO: 4526779 - DNA, 11 bp, Homo sapiens
gtgcaggctgc

SEQ ID NO: 4526780 - DNA, 18 bp, Homo sapiens
gtgcaggctgcagtggct

SEQ ID NO: 4526781 - DNA, 14 bp, Homo sapiens
gtgcaggtctccac

SEQ ID NO: 4526782 - DNA, 15 bp, Homo sapiens
gtgcaggtctccacc

SEQ ID NO: 4526783 - DNA, 19 bp, Homo sapiens
gtgcaggtctccacctgca

SEQ ID NO: 4526784 - DNA, 20 bp, Homo sapiens
gtgcaggtctccacctgcac

SEQ ID NO: 4526785 - DNA, 18 bp, Homo sapiens
gtgcaggtgctattgtta

SEQ ID NO: 4526786 - DNA, 16 bp, Homo sapiens
gtgcagtccatttcct

SEQ ID NO: 4526787 - DNA, 17 bp, Homo sapiens
gtgcagtgtttttcctg

SEQ ID NO: 4526788 - DNA, 17 bp, Homo sapiens
gtgcagttgctgtttac

SEQ ID NO: 4526789 - DNA, 14 bp, Homo sapiens
gtgcagtttctttt

SEQ ID NO: 4526790 - DNA, 14 bp, Homo sapiens
gtgcataatgcttt

SEQ ID NO: 4526791 - DNA, 15 bp, Homo sapiens
gtgcataatgctttg

SEQ ID NO: 4526792 - DNA, 18 bp, Homo sapiens
gtgcatccgcctgaaagt

SEQ ID NO: 4526793 - DNA, 14 bp, Homo sapiens
gtgcatccttgtaa

SEQ ID NO: 4526794 - DNA, 16 bp, Homo sapiens
gtgcatccttgtaata

SEQ ID NO: 4526795 - DNA, 12 bp, Homo sapiens
gtgcatctcctc

SEQ ID NO: 4526796 - DNA, 15 bp, Homo sapiens
gtgcatgaaagagaa

SEQ ID NO: 4526797 - DNA, 16 bp, Homo sapiens
gtgcatggctcctgtc

SEQ ID NO: 4526798 - DNA, 13 bp, Homo sapiens
gtgcatgtgcatg

SEQ ID NO: 4526799 - DNA, 15 bp, Homo sapiens
gtgcatgtgcatgca

SEQ ID NO: 4526800 - DNA, 18 bp, Homo sapiens
gtgcatttgagagaagcc

SEQ ID NO: 4526801 - DNA, 23 bp, Homo sapiens
gtgcatttttaaacttgaaatat

SEQ ID NO: 4526802 - DNA, 20 bp, Homo sapiens
gtgcatttttggatcatttt

SEQ ID NO: 4526803 - DNA, 17 bp, Homo sapiens
gtgccaagagctactcc

SEQ ID NO: 4526804 - DNA, 19 bp, Homo sapiens
gtgccaagatttaaaatta

SEQ ID NO: 4526805 - DNA, 13 bp, Homo sapiens
gtgccaagccctg

SEQ ID NO: 4526806 - DNA, 16 bp, Homo sapiens
gtgccaagccctggcc

SEQ ID NO: 4526807 - DNA, 12 bp, Homo sapiens
gtgccaagtttg

SEQ ID NO: 4526808 - DNA, 13 bp, Homo sapiens
gtgccacagaggc

SEQ ID NO: 4526809 - DNA, 15 bp, Homo sapiens
gtgccacagaggccc

SEQ ID NO: 4526810 - DNA, 19 bp, Homo sapiens
gtgccacagaggccccacc

SEQ ID NO: 4526811 - DNA, 13 bp, Homo sapiens
gtgccacattttc

SEQ ID NO: 4526812 - DNA, 18 bp, Homo sapiens
gtgccacctatgcctgtg

SEQ ID NO: 4526813 - DNA, 15 bp, Homo sapiens
gtgccagaggccaga

SEQ ID NO: 4526814 - DNA, 13 bp, Homo sapiens
gtgccagatataa

SEQ ID NO: 4526815 - DNA, 15 bp, Homo sapiens
gtgccagcattccag

SEQ ID NO: 4526816 - DNA, 15 bp, Homo sapiens
gtgccagctctagtt

SEQ ID NO: 4526817 - DNA, 21 bp, Homo sapiens
gtgccagctgcccttgcaggg

SEQ ID NO: 4526818 - DNA, 13 bp, Homo sapiens
gtgccaggaccag

SEQ ID NO: 4526819 - DNA, 12 bp, Homo sapiens
gtgccaggcccg

SEQ ID NO: 4526820 - DNA, 20 bp, Homo sapiens
gtgccaggcccggggctggc

SEQ ID NO: 4526821 - DNA, 16 bp, Homo sapiens
gtgccagggcagcact

SEQ ID NO: 4526822 - DNA, 22 bp, Homo sapiens
gtgccaggtggctcagtgccac

SEQ ID NO: 4526823 - DNA, 15 bp, Homo sapiens
gtgccataaccatga

SEQ ID NO: 4526824 - DNA, 15 bp, Homo sapiens
gtgccatgctgggcc

SEQ ID NO: 4526825 - DNA, 23 bp, Homo sapiens
gtgccatgctgggccactgggga

SEQ ID NO: 4526826 - DNA, 19 bp, Homo sapiens
gtgccatggatttccactg

SEQ ID NO: 4526827 - DNA, 13 bp, Homo sapiens
gtgccattgtctt

SEQ ID NO: 4526828 - DNA, 23 bp, Homo sapiens
gtgcccaccaacatcccattgcc

SEQ ID NO: 4526829 - DNA, 15 bp, Homo sapiens
gtgcccatcctgcca

SEQ ID NO: 4526830 - DNA, 12 bp, Homo sapiens
gtgccccaggga

SEQ ID NO: 4526831 - DNA, 14 bp, Homo sapiens
gtgcccccctcctc

SEQ ID NO: 4526832 - DNA, 13 bp, Homo sapiens
gtgcccctgctca

SEQ ID NO: 4526833 - DNA, 22 bp, Homo sapiens
gtgcccctgctcactgggcccg

SEQ ID NO: 4526834 - DNA, 23 bp, Homo sapiens
gtgcccgactgactggaggaggc

SEQ ID NO: 4526835 - DNA, 15 bp, Homo sapiens
gtgccctccaaagag

SEQ ID NO: 4526836 - DNA, 18 bp, Homo sapiens
gtgccctggactgtttca

SEQ ID NO: 4526837 - DNA, 15 bp, Homo sapiens
gtgccgacactgagc

SEQ ID NO: 4526838 - DNA, 17 bp, Homo sapiens
gtgccgacactgagctg

SEQ ID NO: 4526839 - DNA, 23 bp, Homo sapiens
gtgccgcctgcccgtctctctcc

SEQ ID NO: 4526840 - DNA, 19 bp, Homo sapiens
gtgccggcggcagccccac

SEQ ID NO: 4526841 - DNA, 14 bp, Homo sapiens
gtgccgggaggcag

SEQ ID NO: 4526842 - DNA, 15 bp, Homo sapiens
gtgccgggaggcagc

SEQ ID NO: 4526843 - DNA, 20 bp, Homo sapiens
gtgccgggaggcagccacag

SEQ ID NO: 4526844 - DNA, 17 bp, Homo sapiens
gtgcctgagaggcaggc

SEQ ID NO: 4526845 - DNA, 18 bp, Homo sapiens
gtgcctgagaggcaggca

SEQ ID NO: 4526846 - DNA, 19 bp, Homo sapiens
gtgcctggccagatttttc

SEQ ID NO: 4526847 - DNA, 16 bp, Homo sapiens
gtgcctggccccagcc

SEQ ID NO: 4526848 - DNA, 22 bp, Homo sapiens
gtgcctggccccagcctgggcc

SEQ ID NO: 4526849 - DNA, 17 bp, Homo sapiens
gtgcctggccgcagggc

SEQ ID NO: 4526850 - DNA, 14 bp, Homo sapiens
gtgcctggctccct

SEQ ID NO: 4526851 - DNA, 15 bp, Homo sapiens
gtgcctggctccctg

SEQ ID NO: 4526852 - DNA, 16 bp, Homo sapiens
gtgcctggctccctga

SEQ ID NO: 4526853 - DNA, 17 bp, Homo sapiens
gtgcctggctccctgat

SEQ ID NO: 4526854 - DNA, 21 bp, Homo sapiens
gtgcctgtagtcccagctact

SEQ ID NO: 4526855 - DNA, 15 bp, Homo sapiens
gtgcctgtgaggcag

SEQ ID NO: 4526856 - DNA, 17 bp, Homo sapiens
gtgcctgtgaggcaggg

SEQ ID NO: 4526857 - DNA, 18 bp, Homo sapiens
gtgccttacctcctgccc

SEQ ID NO: 4526858 - DNA, 12 bp, Homo sapiens
gtgccttcactg

SEQ ID NO: 4526859 - DNA, 18 bp, Homo sapiens
gtgccttcactgggccag

SEQ ID NO: 4526860 - DNA, 22 bp, Homo sapiens
gtgccttccagatcctctctgg

SEQ ID NO: 4526861 - DNA, 20 bp, Homo sapiens
gtgccttccatgtcggcctc

SEQ ID NO: 4526862 - DNA, 23 bp, Homo sapiens
gtgaataccccaagactcccatg

SEQ ID NO: 4526863 - DNA, 16 bp, Homo sapiens
gtgaatataaatgtgt

SEQ ID NO: 4526864 - DNA, 18 bp, Homo sapiens
gtgaatcacgtaaagcta

SEQ ID NO: 4526865 - DNA, 17 bp, Homo sapiens
gtgaatgccaaagccat

SEQ ID NO: 4526866 - DNA, 14 bp, Homo sapiens
gtgaatgcttctca

SEQ ID NO: 4526867 - DNA, 12 bp, Homo sapiens
gtgaatggaggc

SEQ ID NO: 4526868 - DNA, 17 bp, Homo sapiens
gtgaatggaggcagaga

SEQ ID NO: 4526869 - DNA, 13 bp, Homo sapiens
gtgaatgtggcag

SEQ ID NO: 4526870 - DNA, 16 bp, Homo sapiens
gtgaatgtggcagttt

SEQ ID NO: 4526871 - DNA, 18 bp, Homo sapiens
gtgaattaggctgtaact

SEQ ID NO: 4526872 - DNA, 14 bp, Homo sapiens
gtgaattattgaca

SEQ ID NO: 4526873 - DNA, 16 bp, Homo sapiens
gtgaattattgacact

SEQ ID NO: 4526874 - DNA, 18 bp, Homo sapiens
gtgaattattgacactga

SEQ ID NO: 4526875 - DNA, 19 bp, Homo sapiens
gtgaattattgacactgaa

SEQ ID NO: 4526876 - DNA, 18 bp, Homo sapiens
gtgaatttgtttgtgaca

SEQ ID NO: 4526877 - DNA, 14 bp, Homo sapiens
gtgaatttttgcaa

SEQ ID NO: 4526878 - DNA, 21 bp, Homo sapiens
gtgaatttttgcaataatgca

SEQ ID NO: 4526879 - DNA, 13 bp, Homo sapiens
gtgacaaaattca

SEQ ID NO: 4526880 - DNA, 16 bp, Homo sapiens
gtgacaattttgtaca

SEQ ID NO: 4526881 - DNA, 15 bp, Homo sapiens
gtgacaggaaagccc

SEQ ID NO: 4526882 - DNA, 18 bp, Homo sapiens
gtgacaggaaagccctcc

SEQ ID NO: 4526883 - DNA, 17 bp, Homo sapiens
gtgacagtgccttctct

SEQ ID NO: 4526884 - DNA, 20 bp, Homo sapiens
gtgacagtggctgctctggg

SEQ ID NO: 4526885 - DNA, 22 bp, Homo sapiens
gtgacagtggctgctctgggaa

SEQ ID NO: 4526886 - DNA, 15 bp, Homo sapiens
gtgacatggtgcctg

SEQ ID NO: 4526887 - DNA, 16 bp, Homo sapiens
gtgacatggtgcctga

SEQ ID NO: 4526888 - DNA, 19 bp, Homo sapiens
gtgacatggtgcctgagag

SEQ ID NO: 4526889 - DNA, 23 bp, Homo sapiens
gtgacatggtgcctgagaggcag

SEQ ID NO: 4526890 - DNA, 17 bp, Homo sapiens
gtgacattttacattaa

SEQ ID NO: 4526891 - DNA, 14 bp, Homo sapiens
gtgaccagtttctt

SEQ ID NO: 4526892 - DNA, 15 bp, Homo sapiens
gtgacccatctgtag

SEQ ID NO: 4526893 - DNA, 14 bp, Homo sapiens
gtgacgaaaacatt

SEQ ID NO: 4526894 - DNA, 15 bp, Homo sapiens
gtgacgaaaacattg

SEQ ID NO: 4526895 - DNA, 17 bp, Homo sapiens
gtgactaaaagggcttc

SEQ ID NO: 4526896 - DNA, 21 bp, Homo sapiens
gtgactatggagctgagcagg

SEQ ID NO: 4526897 - DNA, 22 bp, Homo sapiens
gtgactcctgaaacctcttcct

SEQ ID NO: 4526898 - DNA, 14 bp, Homo sapiens
gtgactctacctgc

SEQ ID NO: 4526899 - DNA, 15 bp, Homo sapiens
gtgactctagcaagg

SEQ ID NO: 4526900 - DNA, 19 bp, Homo sapiens
gtgactgaaacaaaatgtt

SEQ ID NO: 4526901 - DNA, 16 bp, Homo sapiens
gtgactgccaggataa

SEQ ID NO: 4526902 - DNA, 21 bp, Homo sapiens
gtgactgccccaactcctgga

SEQ ID NO: 4526903 - DNA, 23 bp, Homo sapiens
gtgactgccccaactcctggaag

SEQ ID NO: 4526904 - DNA, 12 bp, Homo sapiens
gtgactgtccca

SEQ ID NO: 4526905 - DNA, 21 bp, Homo sapiens
gtgactgtcccaccgggagcc

SEQ ID NO: 4526906 - DNA, 22 bp, Homo sapiens
gtgactgtcccaccgggagcct

SEQ ID NO: 4526907 - DNA, 23 bp, Homo sapiens
gtgactgtcccaccgggagcctc

SEQ ID NO: 4526908 - DNA, 22 bp, Homo sapiens
gtgactgtgtaactttctctta

SEQ ID NO: 4526909 - DNA, 18 bp, Homo sapiens
gtgacttacaatttgcac

SEQ ID NO: 4526910 - DNA, 16 bp, Homo sapiens
gtgacttctgctgctg

SEQ ID NO: 4526911 - DNA, 18 bp, Homo sapiens
gtgacttctgctgctggc

SEQ ID NO: 4526912 - DNA, 18 bp, Homo sapiens
gtgacttgcaatccaggc

SEQ ID NO: 4526913 - DNA, 20 bp, Homo sapiens
gtgagaatatagacagtgcc

SEQ ID NO: 4526914 - DNA, 18 bp, Homo sapiens
gtgagaattgtgctttca

SEQ ID NO: 4526915 - DNA, 18 bp, Homo sapiens
gtgagacactgtctctac

SEQ ID NO: 4526916 - DNA, 16 bp, Homo sapiens
gtgagacaggctgggt

SEQ ID NO: 4526917 - DNA, 22 bp, Homo sapiens
gtgagacaggctgggtcctgcc

SEQ ID NO: 4526918 - DNA, 14 bp, Homo sapiens
gtgagactgcccca

SEQ ID NO: 4526919 - DNA, 14 bp, Homo sapiens
gtgagactgtacat

SEQ ID NO: 4526920 - DNA, 15 bp, Homo sapiens
gtgagagacctgctc

SEQ ID NO: 4526921 - DNA, 17 bp, Homo sapiens
gtgagagagatgggagc

SEQ ID NO: 4526922 - DNA, 12 bp, Homo sapiens
gtgagagcccat

SEQ ID NO: 4526923 - DNA, 13 bp, Homo sapiens
gtgagagtgagct

SEQ ID NO: 4526924 - DNA, 16 bp, Homo sapiens
gtgagatagttttcat

SEQ ID NO: 4526925 - DNA, 21 bp, Homo sapiens
gtgagcaacatttattattta

SEQ ID NO: 4526926 - DNA, 20 bp, Homo sapiens
gtgagcaaggattatgtttt

SEQ ID NO: 4526927 - DNA, 18 bp, Homo sapiens
gtgagcaccaccagggct

SEQ ID NO: 4526928 - DNA, 18 bp, Homo sapiens
gtgagcagtcgcctgcct

SEQ ID NO: 4526929 - DNA, 15 bp, Homo sapiens
gtgagcatcagaggg

SEQ ID NO: 4526930 - DNA, 13 bp, Homo sapiens
gtgagcatgcaca

SEQ ID NO: 4526931 - DNA, 20 bp, Homo sapiens
gtgagcatgcacactgagaa

SEQ ID NO: 4526932 - DNA, 22 bp, Homo sapiens
gtgagcatgcacactgagaatg

SEQ ID NO: 4526933 - DNA, 18 bp, Homo sapiens
gtgagcatggggccagga

SEQ ID NO: 4526934 - DNA, 19 bp, Homo sapiens
gtgagcatggggccaggaa

SEQ ID NO: 4526935 - DNA, 22 bp, Homo sapiens
gtgagccaccgtgcctggccag

SEQ ID NO: 4526936 - DNA, 17 bp, Homo sapiens
gtgagcccctccccagc

SEQ ID NO: 4526937 - DNA, 18 bp, Homo sapiens
gtgagcccctccccagcc

SEQ ID NO: 4526938 - DNA, 21 bp, Homo sapiens
gtgagccctgctcttctctcc

SEQ ID NO: 4526939 - DNA, 12 bp, Homo sapiens
gtgagccgcatc

SEQ ID NO: 4526940 - DNA, 18 bp, Homo sapiens
gtgagccgcatcttctcc

SEQ ID NO: 4526941 - DNA, 21 bp, Homo sapiens
gtgagccgcatcttctccatc

SEQ ID NO: 4526942 - DNA, 17 bp, Homo sapiens
gtgagcctcctgtgcct

SEQ ID NO: 4526943 - DNA, 20 bp, Homo sapiens
gtgagcctcctgtgcctggc

SEQ ID NO: 4526944 - DNA, 22 bp, Homo sapiens
gtgagccttttgcaggaaaagg

SEQ ID NO: 4526945 - DNA, 23 bp, Homo sapiens
gtgagccttttgcaggaaaaggc

SEQ ID NO: 4526946 - DNA, 16 bp, Homo sapiens
gtgagctctcaggccg

SEQ ID NO: 4526947 - DNA, 23 bp, Homo sapiens
gtgagctctggttatttttctct

SEQ ID NO: 4526948 - DNA, 12 bp, Homo sapiens
gtgagctgggga

SEQ ID NO: 4526949 - DNA, 14 bp, Homo sapiens
gtgagctggggact

SEQ ID NO: 4526950 - DNA, 17 bp, Homo sapiens
gtgaggagctgctggct

SEQ ID NO: 4526951 - DNA, 18 bp, Homo sapiens
gtgaggagctgctggctt

SEQ ID NO: 4526952 - DNA, 23 bp, Homo sapiens
gtgaggcaataagaattactttg

SEQ ID NO: 4526953 - DNA, 12 bp, Homo sapiens
gtgaggcagggg

SEQ ID NO: 4526954 - DNA, 14 bp, Homo sapiens
gtgaggccagggca

SEQ ID NO: 4526955 - DNA, 13 bp, Homo sapiens
gtgagggagggga

SEQ ID NO: 4526956 - DNA, 11 bp, Homo sapiens
gtgaggggaag

SEQ ID NO: 4526957 - DNA, 21 bp, Homo sapiens
gtgaggggggggtgggtgaga

SEQ ID NO: 4526958 - DNA, 20 bp, Homo sapiens
gtgaggtgggttttcttccc

SEQ ID NO: 4526959 - DNA, 17 bp, Homo sapiens
gtgagtcatttaaatgt

SEQ ID NO: 4526960 - DNA, 15 bp, Homo sapiens
gtgagtccattctcc

SEQ ID NO: 4526961 - DNA, 18 bp, Homo sapiens
gtgagtttgagctgcctt

SEQ ID NO: 4526962 - DNA, 19 bp, Homo sapiens
gtgataaccagtaaggaaa

SEQ ID NO: 4526963 - DNA, 19 bp, Homo sapiens
gtgataagggaaaagataa

SEQ ID NO: 4526964 - DNA, 20 bp, Homo sapiens
gtgatacaacttcaagtgca

SEQ ID NO: 4526965 - DNA, 20 bp, Homo sapiens
gtgatcaatatttttatatc

SEQ ID NO: 4526966 - DNA, 21 bp, Homo sapiens
gtgatcctctcacctcagcct

SEQ ID NO: 4526967 - DNA, 22 bp, Homo sapiens
gtgatcggggtcaggcaaagga

SEQ ID NO: 4526968 - DNA, 14 bp, Homo sapiens
gtgatctctgctgg

SEQ ID NO: 4526969 - DNA, 15 bp, Homo sapiens
gtgatctctgctggg

SEQ ID NO: 4526970 - DNA, 14 bp, Homo sapiens
gtgatcttaaaata

SEQ ID NO: 4526971 - DNA, 15 bp, Homo sapiens
gtgatcttaaaataa

SEQ ID NO: 4526972 - DNA, 15 bp, Homo sapiens
gtgatcttattgctt

SEQ ID NO: 4526973 - DNA, 16 bp, Homo sapiens
gtgatcttattgcttg

SEQ ID NO: 4526974 - DNA, 22 bp, Homo sapiens
gtgatcttcactgtatatgtaa

SEQ ID NO: 4526975 - DNA, 14 bp, Homo sapiens
gtgatgaatactgt

SEQ ID NO: 4526976 - DNA, 18 bp, Homo sapiens
gtgatgctttcattatgt

SEQ ID NO: 4526977 - DNA, 20 bp, Homo sapiens
gtgatgggagaattggtata

SEQ ID NO: 4526978 - DNA, 15 bp, Homo sapiens
gtgatgtcagcggtg

SEQ ID NO: 4526979 - DNA, 14 bp, Homo sapiens
gtgatgtcatttga

SEQ ID NO: 4526980 - DNA, 15 bp, Homo sapiens
gtgatgtggaggaag

SEQ ID NO: 4526981 - DNA, 11 bp, Homo sapiens
gtgattaccag

SEQ ID NO: 4526982 - DNA, 15 bp, Homo sapiens
gtctgcatttcatat

SEQ ID NO: 4526983 - DNA, 10 bp, Homo sapiens
gtctgccctt

SEQ ID NO: 4526984 - DNA, 17 bp, Homo sapiens
gtctgcccttcacccca

SEQ ID NO: 4526985 - DNA, 13 bp, Homo sapiens
gtctgcctatgca

SEQ ID NO: 4526986 - DNA, 21 bp, Homo sapiens
gtctgcctggttccctcccca

SEQ ID NO: 4526987 - DNA, 13 bp, Homo sapiens
gtctgccttcaca

SEQ ID NO: 4526988 - DNA, 18 bp, Homo sapiens
gtctgccttcacaaatgt

SEQ ID NO: 4526989 - DNA, 16 bp, Homo sapiens
gtctgctccaatgact

SEQ ID NO: 4526990 - DNA, 12 bp, Homo sapiens
gtctgctctgct

SEQ ID NO: 4526991 - DNA, 13 bp, Homo sapiens
gtctgctctgctg

SEQ ID NO: 4526992 - DNA, 18 bp, Homo sapiens
gtctgctgagttggcctg

SEQ ID NO: 4526993 - DNA, 16 bp, Homo sapiens
gtctgctgttccagtg

SEQ ID NO: 4526994 - DNA, 12 bp, Homo sapiens
gtctggaccccg

SEQ ID NO: 4526995 - DNA, 14 bp, Homo sapiens
gtctggagaagcag

SEQ ID NO: 4526996 - DNA, 14 bp, Homo sapiens
gtctggatcagtaa

SEQ ID NO: 4526997 - DNA, 19 bp, Homo sapiens
gtctggcagtttatattta

SEQ ID NO: 4526998 - DNA, 14 bp, Homo sapiens
gtctggccctgggg

SEQ ID NO: 4526999 - DNA, 22 bp, Homo sapiens
gtctggctttggcactctctgc

SEQ ID NO: 4527000 - DNA, 22 bp, Homo sapiens
gtctgggatatggctgcccagg

SEQ ID NO: 4527001 - DNA, 17 bp, Homo sapiens
gtctgggctaggtagaa

SEQ ID NO: 4527002 - DNA, 13 bp, Homo sapiens
gtctggtgggagg

SEQ ID NO: 4527003 - DNA, 17 bp, Homo sapiens
gtctgtagagggccctg

SEQ ID NO: 4527004 - DNA, 19 bp, Homo sapiens
gtctgtagagggccctggt

SEQ ID NO: 4527005 - DNA, 22 bp, Homo sapiens
gtctgtagagggccctggtgtt

SEQ ID NO: 4527006 - DNA, 19 bp, Homo sapiens
gtctgtatttatgtgtgag

SEQ ID NO: 4527007 - DNA, 13 bp, Homo sapiens
gtctgtctgcttt

SEQ ID NO: 4527008 - DNA, 21 bp, Homo sapiens
gtctgtgaacagagagaccct

SEQ ID NO: 4527009 - DNA, 15 bp, Homo sapiens
gtctgtgcacatgcc

SEQ ID NO: 4527010 - DNA, 22 bp, Homo sapiens
gtctgtgcacatgcctctgtag

SEQ ID NO: 4527011 - DNA, 19 bp, Homo sapiens
gtctgtgccctccaaagag

SEQ ID NO: 4527012 - DNA, 13 bp, Homo sapiens
gtctgtggatttt

SEQ ID NO: 4527013 - DNA, 20 bp, Homo sapiens
gtctgtgtgggactgtacac

SEQ ID NO: 4527014 - DNA, 11 bp, Homo sapiens
gtctgtgtgtg

SEQ ID NO: 4527015 - DNA, 16 bp, Homo sapiens
gtctgttatttattat

SEQ ID NO: 4527016 - DNA, 18 bp, Homo sapiens
gtctgttatttattatta

SEQ ID NO: 4527017 - DNA, 14 bp, Homo sapiens
gtctgttcccagcc

SEQ ID NO: 4527018 - DNA, 16 bp, Homo sapiens
gtctgttcccagcccc

SEQ ID NO: 4527019 - DNA, 16 bp, Homo sapiens
gtctgtttttactctg

SEQ ID NO: 4527020 - DNA, 17 bp, Homo sapiens
gtcttaaactaaatgtg

SEQ ID NO: 4527021 - DNA, 16 bp, Homo sapiens
gtcttaacctcaggga

SEQ ID NO: 4527022 - DNA, 19 bp, Homo sapiens
gtcttaattaaaagaatat

SEQ ID NO: 4527023 - DNA, 22 bp, Homo sapiens
gtcttaattaaaagaatatttt

SEQ ID NO: 4527024 - DNA, 18 bp, Homo sapiens
gtcttaattgtgtttatt

SEQ ID NO: 4527025 - DNA, 19 bp, Homo sapiens
gtcttacgtttttctggtg

SEQ ID NO: 4527026 - DNA, 21 bp, Homo sapiens
gtcttatagtgtttggacagc

SEQ ID NO: 4527027 - DNA, 15 bp, Homo sapiens
gtcttatttttagat

SEQ ID NO: 4527028 - DNA, 19 bp, Homo sapiens
gtcttcattttttaatgtg

SEQ ID NO: 4527029 - DNA, 15 bp, Homo sapiens
gtcttccatttgcaa

SEQ ID NO: 4527030 - DNA, 12 bp, Homo sapiens
gtcttcccaggg

SEQ ID NO: 4527031 - DNA, 18 bp, Homo sapiens
gtcttccctacctcaggc

SEQ ID NO: 4527032 - DNA, 15 bp, Homo sapiens
gtcttccctgcctgt

SEQ ID NO: 4527033 - DNA, 13 bp, Homo sapiens
gtcttcctcccaa

SEQ ID NO: 4527034 - DNA, 14 bp, Homo sapiens
gtcttcctcccaag

SEQ ID NO: 4527035 - DNA, 23 bp, Homo sapiens
gtcttcctcccaagtggtgccta

SEQ ID NO: 4527036 - DNA, 18 bp, Homo sapiens
gtcttccttctaccccaa

SEQ ID NO: 4527037 - DNA, 14 bp, Homo sapiens
gtcttcgtccttga

SEQ ID NO: 4527038 - DNA, 23 bp, Homo sapiens
gtcttctaaacttccccatcttc

SEQ ID NO: 4527039 - DNA, 17 bp, Homo sapiens
gtcttctatttatttat

SEQ ID NO: 4527040 - DNA, 15 bp, Homo sapiens
gtcttctgcctgtta

SEQ ID NO: 4527041 - DNA, 18 bp, Homo sapiens
gtcttgaaatgaaaggga

SEQ ID NO: 4527042 - DNA, 19 bp, Homo sapiens
gtcttgaaatgaaagggaa

SEQ ID NO: 4527043 - DNA, 20 bp, Homo sapiens
gtcttgaaatgaaagggaaa

SEQ ID NO: 4527044 - DNA, 21 bp, Homo sapiens
gtcttgatgttttttctgtaa

SEQ ID NO: 4527045 - DNA, 14 bp, Homo sapiens
gtcttgctctgtcc

SEQ ID NO: 4527046 - DNA, 21 bp, Homo sapiens
gtcttgtcccaattaaaatac

SEQ ID NO: 4527047 - DNA, 12 bp, Homo sapiens
gtcttgtgaaag

SEQ ID NO: 4527048 - DNA, 15 bp, Homo sapiens
gtcttgtgaaagtgt

SEQ ID NO: 4527049 - DNA, 11 bp, Homo sapiens
gtcttgtgaac

SEQ ID NO: 4527050 - DNA, 20 bp, Homo sapiens
gtcttgtgtttctttagttt

SEQ ID NO: 4527051 - DNA, 14 bp, Homo sapiens
gtcttgtttcagtg

SEQ ID NO: 4527052 - DNA, 13 bp, Homo sapiens
gtctttaaatcat

SEQ ID NO: 4527053 - DNA, 16 bp, Homo sapiens
gtctttaatcattggt

SEQ ID NO: 4527054 - DNA, 11 bp, Homo sapiens
gtctttcagta

SEQ ID NO: 4527055 - DNA, 16 bp, Homo sapiens
gtctttcagtactttt

SEQ ID NO: 4527056 - DNA, 22 bp, Homo sapiens
gtctttcagtacttttttaaat

SEQ ID NO: 4527057 - DNA, 18 bp, Homo sapiens
gtctttccacggagccac

SEQ ID NO: 4527058 - DNA, 14 bp, Homo sapiens
gtctttctctcagt

SEQ ID NO: 4527059 - DNA, 12 bp, Homo sapiens
gtctttcttctt

SEQ ID NO: 4527060 - DNA, 15 bp, Homo sapiens
gtctttctttggtgc

SEQ ID NO: 4527061 - DNA, 22 bp, Homo sapiens
gtctttggagaaatgcttagaa

SEQ ID NO: 4527062 - DNA, 21 bp, Homo sapiens
gtctttgtaatgtcaccacct

SEQ ID NO: 4527063 - DNA, 23 bp, Homo sapiens
gtcttttatagtggaaaaacaca

SEQ ID NO: 4527064 - DNA, 22 bp, Homo sapiens
gtcttttcaaataatgcttttc

SEQ ID NO: 4527065 - DNA, 15 bp, Homo sapiens
gtcttttcagaagca

SEQ ID NO: 4527066 - DNA, 16 bp, Homo sapiens
gtctttttttattact

SEQ ID NO: 4527067 - DNA, 17 bp, Homo sapiens
gtgaaaaactaatgtgt

SEQ ID NO: 4527068 - DNA, 13 bp, Homo sapiens
gtgaaaatagtgt

SEQ ID NO: 4527069 - DNA, 16 bp, Homo sapiens
gtgaaaatatacttga

SEQ ID NO: 4527070 - DNA, 20 bp, Homo sapiens
gtgaaaatatacttgactct

SEQ ID NO: 4527071 - DNA, 18 bp, Homo sapiens
gtgaaacctggtctctac

SEQ ID NO: 4527072 - DNA, 11 bp, Homo sapiens
gtgaaagcttt

SEQ ID NO: 4527073 - DNA, 18 bp, Homo sapiens
gtgaaataccacaagcct

SEQ ID NO: 4527074 - DNA, 14 bp, Homo sapiens
gtgaaatcctcagc

SEQ ID NO: 4527075 - DNA, 14 bp, Homo sapiens
gtgaaatcttgttt

SEQ ID NO: 4527076 - DNA, 16 bp, Homo sapiens
gtgaaatggccaggat

SEQ ID NO: 4527077 - DNA, 22 bp, Homo sapiens
gtgaaatttctagcctgcactt

SEQ ID NO: 4527078 - DNA, 22 bp, Homo sapiens
gtgaaattttcttgatttgagt

SEQ ID NO: 4527079 - DNA, 14 bp, Homo sapiens
gtgaacaaggtaaa

SEQ ID NO: 4527080 - DNA, 13 bp, Homo sapiens
gtgaacacatcag

SEQ ID NO: 4527081 - DNA, 15 bp, Homo sapiens
gtgaacacatcagct

SEQ ID NO: 4527082 - DNA, 18 bp, Homo sapiens
gtgaaccaaaaatagaaa

SEQ ID NO: 4527083 - DNA, 20 bp, Homo sapiens
gtgaaccaacccccatctcc

SEQ ID NO: 4527084 - DNA, 21 bp, Homo sapiens
gtgaaccaacccccatctccc

SEQ ID NO: 4527085 - DNA, 14 bp, Homo sapiens
gtgaaccaatgcaa

SEQ ID NO: 4527086 - DNA, 23 bp, Homo sapiens
gtgaactcaccctgggagccagt

SEQ ID NO: 4527087 - DNA, 13 bp, Homo sapiens
gtgaactcctgcc

SEQ ID NO: 4527088 - DNA, 17 bp, Homo sapiens
gtgaacttgactgggtg

SEQ ID NO: 4527089 - DNA, 12 bp, Homo sapiens
gtgaacttttct

SEQ ID NO: 4527090 - DNA, 14 bp, Homo sapiens
gtgaagaatttaga

SEQ ID NO: 4527091 - DNA, 15 bp, Homo sapiens
gtgaagagccggtgg

SEQ ID NO: 4527092 - DNA, 18 bp, Homo sapiens
gtgaagcagcactgtgag

SEQ ID NO: 4527093 - DNA, 15 bp, Homo sapiens
gtgaagcctttatct

SEQ ID NO: 4527094 - DNA, 22 bp, Homo sapiens
gtgaagcctttatctatgggag

SEQ ID NO: 4527095 - DNA, 14 bp, Homo sapiens
gtgaaggagaagtc

SEQ ID NO: 4527096 - DNA, 21 bp, Homo sapiens
gtgaaggattatggaaaaata

SEQ ID NO: 4527097 - DNA, 21 bp, Homo sapiens
gtgaagtccttcagtgagccc

SEQ ID NO: 4527098 - DNA, 18 bp, Homo sapiens
gtgaagtctagaatcata

SEQ ID NO: 4527099 - DNA, 14 bp, Homo sapiens
gtgaagtgtggctg

SEQ ID NO: 4527100 - DNA, 17 bp, Homo sapiens
gtgaagtgtggctggtg

SEQ ID NO: 4527101 - DNA, 20 bp, Homo sapiens
gtgaagtgtggctggtgtcc

SEQ ID NO: 4527102 - DNA, 23 bp, Homo sapiens
gtgaagtgtggctggtgtcccct

SEQ ID NO: 4527103 - DNA, 18 bp, Homo sapiens
gtgaagtgttaatacatc

SEQ ID NO: 4527104 - DNA, 21 bp, Homo sapiens
gtccttttgggaagaatccag

SEQ ID NO: 4527105 - DNA, 14 bp, Homo sapiens
gtcgctatgtgact

SEQ ID NO: 4527106 - DNA, 17 bp, Homo sapiens
gtcgctcagtctgttca

SEQ ID NO: 4527107 - DNA, 14 bp, Homo sapiens
gtcggaggtgctgt

SEQ ID NO: 4527108 - DNA, 19 bp, Homo sapiens
gtcggaggtgctgtcccca

SEQ ID NO: 4527109 - DNA, 14 bp, Homo sapiens
gtcggatctcacag

SEQ ID NO: 4527110 - DNA, 15 bp, Homo sapiens
gtcggccccaccagt

SEQ ID NO: 4527111 - DNA, 20 bp, Homo sapiens
gtcggccgccatagccccag

SEQ ID NO: 4527112 - DNA, 21 bp, Homo sapiens
gtcggcctctaaccccaggcc

SEQ ID NO: 4527113 - DNA, 15 bp, Homo sapiens
gtcgggacagctgtg

SEQ ID NO: 4527114 - DNA, 12 bp, Homo sapiens
gtcgtaaagatt

SEQ ID NO: 4527115 - DNA, 18 bp, Homo sapiens
gtcgtcaactttcctcaa

SEQ ID NO: 4527116 - DNA, 13 bp, Homo sapiens
gtcgttgtgaggg

SEQ ID NO: 4527117 - DNA, 12 bp, Homo sapiens
gtcgttttccaa

SEQ ID NO: 4527118 - DNA, 21 bp, Homo sapiens
gtctaaaccaagattatgtga

SEQ ID NO: 4527119 - DNA, 21 bp, Homo sapiens
gtctaactttggttttcttgt

SEQ ID NO: 4527120 - DNA, 19 bp, Homo sapiens
gtctaatgggggcagtctc

SEQ ID NO: 4527121 - DNA, 21 bp, Homo sapiens
gtctaatgggggcagtctccc

SEQ ID NO: 4527122 - DNA, 23 bp, Homo sapiens
gtctaatgggggcagtctcccct

SEQ ID NO: 4527123 - DNA, 14 bp, Homo sapiens
gtctacattaaaca

SEQ ID NO: 4527124 - DNA, 15 bp, Homo sapiens
gtctacattaaacaa

SEQ ID NO: 4527125 - DNA, 12 bp, Homo sapiens
gtctacatttca

SEQ ID NO: 4527126 - DNA, 17 bp, Homo sapiens
gtctacatttctgcaga

SEQ ID NO: 4527127 - DNA, 20 bp, Homo sapiens
gtctacccagagaagcccct

SEQ ID NO: 4527128 - DNA, 19 bp, Homo sapiens
gtctagacacaatttcatt

SEQ ID NO: 4527129 - DNA, 15 bp, Homo sapiens
gtctagagaacactg

SEQ ID NO: 4527130 - DNA, 20 bp, Homo sapiens
gtctagattaatactctatt

SEQ ID NO: 4527131 - DNA, 17 bp, Homo sapiens
gtctaggagatgctttc

SEQ ID NO: 4527132 - DNA, 19 bp, Homo sapiens
gtctaggagctccttctgg

SEQ ID NO: 4527133 - DNA, 12 bp, Homo sapiens
gtctagggagag

SEQ ID NO: 4527134 - DNA, 16 bp, Homo sapiens
gtctaggtctcctcag

SEQ ID NO: 4527135 - DNA, 16 bp, Homo sapiens
gtctaggttaaagcta

SEQ ID NO: 4527136 - DNA, 17 bp, Homo sapiens
gtctaggttaaagctaa

SEQ ID NO: 4527137 - DNA, 17 bp, Homo sapiens
gtctatatcataactat

SEQ ID NO: 4527138 - DNA, 22 bp, Homo sapiens
gtctatctggtattaaatgcca

SEQ ID NO: 4527139 - DNA, 17 bp, Homo sapiens
gtctatttccaagaacc

SEQ ID NO: 4527140 - DNA, 21 bp, Homo sapiens
gtctcaaacttgtggcctcaa

SEQ ID NO: 4527141 - DNA, 17 bp, Homo sapiens
gtctcaactactcagct

SEQ ID NO: 4527142 - DNA, 14 bp, Homo sapiens
gtctcaatgaaata

SEQ ID NO: 4527143 - DNA, 16 bp, Homo sapiens
gtctcaccacacataa

SEQ ID NO: 4527144 - DNA, 16 bp, Homo sapiens
gtctcactcttctgtc

SEQ ID NO: 4527145 - DNA, 15 bp, Homo sapiens
gtctcactgcttgaa

SEQ ID NO: 4527146 - DNA, 19 bp, Homo sapiens
gtctcactttactttcaag

SEQ ID NO: 4527147 - DNA, 20 bp, Homo sapiens
gtctcactttactttcaagt

SEQ ID NO: 4527148 - DNA, 11 bp, Homo sapiens
gtctcagaaga

SEQ ID NO: 4527149 - DNA, 16 bp, Homo sapiens
gtctcagagagttaat

SEQ ID NO: 4527150 - DNA, 22 bp, Homo sapiens
gtctcagcagcgaccacccctg

SEQ ID NO: 4527151 - DNA, 13 bp, Homo sapiens
gtctcagcctctg

SEQ ID NO: 4527152 - DNA, 17 bp, Homo sapiens
gtctcagcctctgccag

SEQ ID NO: 4527153 - DNA, 18 bp, Homo sapiens
gtctcagcctctgccagc

SEQ ID NO: 4527154 - DNA, 16 bp, Homo sapiens
gtctcaggagtctctg

SEQ ID NO: 4527155 - DNA, 17 bp, Homo sapiens
gtctcaggagtctctgg

SEQ ID NO: 4527156 - DNA, 22 bp, Homo sapiens
gtctcaggtttgttttgtgaat

SEQ ID NO: 4527157 - DNA, 14 bp, Homo sapiens
gtctcatcctccca

SEQ ID NO: 4527158 - DNA, 21 bp, Homo sapiens
gtctcatcctcccattgccca

SEQ ID NO: 4527159 - DNA, 23 bp, Homo sapiens
gtctcatcctcccattgcccagt

SEQ ID NO: 4527160 - DNA, 14 bp, Homo sapiens
gtctcatgtctccc

SEQ ID NO: 4527161 - DNA, 15 bp, Homo sapiens
gtctcattgcttctg

SEQ ID NO: 4527162 - DNA, 16 bp, Homo sapiens
gtctcattgcttctga

SEQ ID NO: 4527163 - DNA, 22 bp, Homo sapiens
gtctcattttaatgtaaagatt

SEQ ID NO: 4527164 - DNA, 22 bp, Homo sapiens
gtctccaaccccccagcactga

SEQ ID NO: 4527165 - DNA, 14 bp, Homo sapiens
gtctccaagacctt

SEQ ID NO: 4527166 - DNA, 12 bp, Homo sapiens
gtctccacctgc

SEQ ID NO: 4527167 - DNA, 18 bp, Homo sapiens
gtctccacctgcacattg

SEQ ID NO: 4527168 - DNA, 19 bp, Homo sapiens
gtctccagggcccccaccg

SEQ ID NO: 4527169 - DNA, 17 bp, Homo sapiens
gtctccagggcccccca

SEQ ID NO: 4527170 - DNA, 22 bp, Homo sapiens
gtctccagggccccccaactgt

SEQ ID NO: 4527171 - DNA, 14 bp, Homo sapiens
gtctccatggccct

SEQ ID NO: 4527172 - DNA, 21 bp, Homo sapiens
gtctccatgtgtgtgccaagc

SEQ ID NO: 4527173 - DNA, 17 bp, Homo sapiens
gtctccccagttccaca

SEQ ID NO: 4527174 - DNA, 18 bp, Homo sapiens
gtctccccagttccacag

SEQ ID NO: 4527175 - DNA, 14 bp, Homo sapiens
gtctccccttcctg

SEQ ID NO: 4527176 - DNA, 17 bp, Homo sapiens
gtctccccttcctggca

SEQ ID NO: 4527177 - DNA, 18 bp, Homo sapiens
gtctccccttcctggcac

SEQ ID NO: 4527178 - DNA, 19 bp, Homo sapiens
gtctccctctcctgcctac

SEQ ID NO: 4527179 - DNA, 17 bp, Homo sapiens
gtctccgccttgctggg

SEQ ID NO: 4527180 - DNA, 17 bp, Homo sapiens
gtctccgggactgccct

SEQ ID NO: 4527181 - DNA, 14 bp, Homo sapiens
gtctcctcactccc

SEQ ID NO: 4527182 - DNA, 14 bp, Homo sapiens
gtctcctcactctg

SEQ ID NO: 4527183 - DNA, 21 bp, Homo sapiens
gtctcctcactctgtccctgt

SEQ ID NO: 4527184 - DNA, 13 bp, Homo sapiens
gtctcctcagggt

SEQ ID NO: 4527185 - DNA, 19 bp, Homo sapiens
gtctcctcagggtgggggg

SEQ ID NO: 4527186 - DNA, 22 bp, Homo sapiens
gtctcggatgacaccctggcct

SEQ ID NO: 4527187 - DNA, 13 bp, Homo sapiens
gtctcgtggtagg

SEQ ID NO: 4527188 - DNA, 19 bp, Homo sapiens
gtctcgtggtaggactgta

SEQ ID NO: 4527189 - DNA, 20 bp, Homo sapiens
gtctcgttttgttgccaaag

SEQ ID NO: 4527190 - DNA, 21 bp, Homo sapiens
gtctctaaaaagaagccacag

SEQ ID NO: 4527191 - DNA, 22 bp, Homo sapiens
gtctctaaaaagaagccacaga

SEQ ID NO: 4527192 - DNA, 18 bp, Homo sapiens
gtctctactaaaaataca

SEQ ID NO: 4527193 - DNA, 11 bp, Homo sapiens
gtctctattta

SEQ ID NO: 4527194 - DNA, 17 bp, Homo sapiens
gtctctatttaaattct

SEQ ID NO: 4527195 - DNA, 23 bp, Homo sapiens
gtctctctcccatggagccccag

SEQ ID NO: 4527196 - DNA, 17 bp, Homo sapiens
gtctctcttggacccac

SEQ ID NO: 4527197 - DNA, 18 bp, Homo sapiens
gtctctcttggacccacc

SEQ ID NO: 4527198 - DNA, 20 bp, Homo sapiens
gtctctcttggacccacctg

SEQ ID NO: 4527199 - DNA, 20 bp, Homo sapiens
gtctctgggccacttggagt

SEQ ID NO: 4527200 - DNA, 17 bp, Homo sapiens
gtctctggtagcctgca

SEQ ID NO: 4527201 - DNA, 21 bp, Homo sapiens
gtctcttctgaataaagcaat

SEQ ID NO: 4527202 - DNA, 20 bp, Homo sapiens
gtctcttgagcatcaatctt

SEQ ID NO: 4527203 - DNA, 24 bp, Homo sapiens
gtctcttgagcatcaatcttgtta

SEQ ID NO: 4527204 - DNA, 13 bp, Homo sapiens
gtctcttgtaatc

SEQ ID NO: 4527205 - DNA, 22 bp, Homo sapiens
gtctgaaactggcttccccact

SEQ ID NO: 4527206 - DNA, 19 bp, Homo sapiens
gtctgaagaaggaaggcct

SEQ ID NO: 4527207 - DNA, 14 bp, Homo sapiens
gtctgaagtacaaa

SEQ ID NO: 4527208 - DNA, 14 bp, Homo sapiens
gtctgaatgatctt

SEQ ID NO: 4527209 - DNA, 24 bp, Homo sapiens
gtctgacatcagaggtatcttact

SEQ ID NO: 4527210 - DNA, 23 bp, Homo sapiens
gtctgagactctcttaggagcag

SEQ ID NO: 4527211 - DNA, 15 bp, Homo sapiens
gtctgagccacagca

SEQ ID NO: 4527212 - DNA, 22 bp, Homo sapiens
gtctgagccacagcagcatttt

SEQ ID NO: 4527213 - DNA, 12 bp, Homo sapiens
gtctgagccctg

SEQ ID NO: 4527214 - DNA, 15 bp, Homo sapiens
gtctgaggcccctgc

SEQ ID NO: 4527215 - DNA, 18 bp, Homo sapiens
gtctgaggcccctgcctc

SEQ ID NO: 4527216 - DNA, 17 bp, Homo sapiens
gtctgagtagtggccac

SEQ ID NO: 4527217 - DNA, 18 bp, Homo sapiens
gtctgagtcctgtctctg

SEQ ID NO: 4527218 - DNA, 23 bp, Homo sapiens
gtctgagtcctgtctctgcctgc

SEQ ID NO: 4527219 - DNA, 21 bp, Homo sapiens
gtctgatctgtgctttccagc

SEQ ID NO: 4527220 - DNA, 20 bp, Homo sapiens
gtctgatggaactgtgtatt

SEQ ID NO: 4527221 - DNA, 18 bp, Homo sapiens
gtctgatgttctttccat

SEQ ID NO: 4527222 - DNA, 20 bp, Homo sapiens
gtctgcacaccttgaatctg

SEQ ID NO: 4527223 - DNA, 16 bp, Homo sapiens
gtctgcaccttagaaa

SEQ ID NO: 4527224 - DNA, 21 bp, Homo sapiens
ctggaacaacttgtagcagct

SEQ ID NO: 4527225 - DNA, 14 bp, Homo sapiens
ctggaacacagggg

SEQ ID NO: 4527226 - DNA, 16 bp, Homo sapiens
ctggaacacaggggcc

SEQ ID NO: 4527227 - DNA, 17 bp, Homo sapiens
ctggaacacaggggcct

SEQ ID NO: 4527228 - DNA, 21 bp, Homo sapiens
ctggaacctgcaaaaaatact

SEQ ID NO: 4527229 - DNA, 17 bp, Homo sapiens
ctggaactcctggcctt

SEQ ID NO: 4527230 - DNA, 20 bp, Homo sapiens
ctggaagaaagcaacaaaga

SEQ ID NO: 4527231 - DNA, 17 bp, Homo sapiens
ctggaagaaccactgtc

SEQ ID NO: 4527232 - DNA, 15 bp, Homo sapiens
ctggaagatagctgt

SEQ ID NO: 4527233 - DNA, 19 bp, Homo sapiens
ctggaagatagctgtgact

SEQ ID NO: 4527234 - DNA, 23 bp, Homo sapiens
ctggaagcatgtaggagaatcca

SEQ ID NO: 4527235 - DNA, 17 bp, Homo sapiens
ctggaagcccctgggcc

SEQ ID NO: 4527236 - DNA, 22 bp, Homo sapiens
ctggaagctaatttgcattaaa

SEQ ID NO: 4527237 - DNA, 20 bp, Homo sapiens
ctggaaggaacatggagctg

SEQ ID NO: 4527238 - DNA, 13 bp, Homo sapiens
ctggaaggcagca

SEQ ID NO: 4527239 - DNA, 22 bp, Homo sapiens
ctggaagggctagaacctgtag

SEQ ID NO: 4527240 - DNA, 23 bp, Homo sapiens
ctggaagtcatctcattccactg

SEQ ID NO: 4527241 - DNA, 23 bp, Homo sapiens
ctggaagtttctggtgccatttc

SEQ ID NO: 4527242 - DNA, 16 bp, Homo sapiens
ctggaataaagttgca

SEQ ID NO: 4527243 - DNA, 14 bp, Homo sapiens
ctggaataagttca

SEQ ID NO: 4527244 - DNA, 15 bp, Homo sapiens
ctggaataatattgg

SEQ ID NO: 4527245 - DNA, 20 bp, Homo sapiens
ctggaatagtaaactaaagt

SEQ ID NO: 4527246 - DNA, 22 bp, Homo sapiens
ctggaatggtgttttgtcagac

SEQ ID NO: 4527247 - DNA, 21 bp, Homo sapiens
ctggaatgtgccacagaggcc

SEQ ID NO: 4527248 - DNA, 23 bp, Homo sapiens
ctggaatgtgccacagaggcccc

SEQ ID NO: 4527249 - DNA, 23 bp, Homo sapiens
ctggacacattggaatgccttgg

SEQ ID NO: 4527250 - DNA, 18 bp, Homo sapiens
ctggacagcatcagaaat

SEQ ID NO: 4527251 - DNA, 15 bp, Homo sapiens
ctggacagccagtga

SEQ ID NO: 4527252 - DNA, 23 bp, Homo sapiens
ctggacaggcgggctcggaggct

SEQ ID NO: 4527253 - DNA, 18 bp, Homo sapiens
ctggacatcaccagtcct

SEQ ID NO: 4527254 - DNA, 12 bp, Homo sapiens
ctggaccagcct

SEQ ID NO: 4527255 - DNA, 20 bp, Homo sapiens
ctggaccccgtttcattttt

SEQ ID NO: 4527256 - DNA, 13 bp, Homo sapiens
ctggacctgggga

SEQ ID NO: 4527257 - DNA, 14 bp, Homo sapiens
ctggacggcaggct

SEQ ID NO: 4527258 - DNA, 21 bp, Homo sapiens
ctggacggcaggctcactgcc

SEQ ID NO: 4527259 - DNA, 22 bp, Homo sapiens
ctggacggcaggctcactgcca

SEQ ID NO: 4527260 - DNA, 16 bp, Homo sapiens
ctggactattgtgcca

SEQ ID NO: 4527261 - DNA, 16 bp, Homo sapiens
ctggactccggaggac

SEQ ID NO: 4527262 - DNA, 18 bp, Homo sapiens
ctggactctcagtctctg

SEQ ID NO: 4527263 - DNA, 13 bp, Homo sapiens
ctggactctgccc

SEQ ID NO: 4527264 - DNA, 17 bp, Homo sapiens
ctggactctgccccaat

SEQ ID NO: 4527265 - DNA, 18 bp, Homo sapiens
ctggactgagccaaggag

SEQ ID NO: 4527266 - DNA, 23 bp, Homo sapiens
ctggactgagccaaggaggcctg

SEQ ID NO: 4527267 - DNA, 13 bp, Homo sapiens
ctggactgaggcc

SEQ ID NO: 4527268 - DNA, 15 bp, Homo sapiens
ctggactgaggcctg

SEQ ID NO: 4527269 - DNA, 20 bp, Homo sapiens
ctggactgagggggcctgga

SEQ ID NO: 4527270 - DNA, 23 bp, Homo sapiens
ctggactgagggggcctggatgc

SEQ ID NO: 4527271 - DNA, 13 bp, Homo sapiens
ctggactgcttgg

SEQ ID NO: 4527272 - DNA, 21 bp, Homo sapiens
ctggactggctagagtcctca

SEQ ID NO: 4527273 - DNA, 19 bp, Homo sapiens
ctggactgtttcaaggtcc

SEQ ID NO: 4527274 - DNA, 23 bp, Homo sapiens
ctggacttaagcatctggctcta

SEQ ID NO: 4527275 - DNA, 15 bp, Homo sapiens
ctggacttctacctg

SEQ ID NO: 4527276 - DNA, 15 bp, Homo sapiens
ctggacttgcctctg

SEQ ID NO: 4527277 - DNA, 13 bp, Homo sapiens
ctggagaactaga

SEQ ID NO: 4527278 - DNA, 19 bp, Homo sapiens
ctggagaactagaacctgg

SEQ ID NO: 4527279 - DNA, 21 bp, Homo sapiens
ctggagaagcagtgagccgca

SEQ ID NO: 4527280 - DNA, 18 bp, Homo sapiens
ctggagacaaggtgctaa

SEQ ID NO: 4527281 - DNA, 22 bp, Homo sapiens
ctggagacccccccccaactcc

SEQ ID NO: 4527282 - DNA, 18 bp, Homo sapiens
ctggagacttcctctggt

SEQ ID NO: 4527283 - DNA, 16 bp, Homo sapiens
ctggagagaacaggtt

SEQ ID NO: 4527284 - DNA, 13 bp, Homo sapiens
ctggagagctaga

SEQ ID NO: 4527285 - DNA, 20 bp, Homo sapiens
ctggagagctagaacctgga

SEQ ID NO: 4527286 - DNA, 22 bp, Homo sapiens
ctggagagctagaacctggaga

SEQ ID NO: 4527287 - DNA, 16 bp, Homo sapiens
ctggagagtgcacatg

SEQ ID NO: 4527288 - DNA, 23 bp, Homo sapiens
ctggagatcatcctaacaatgtg

SEQ ID NO: 4527289 - DNA, 15 bp, Homo sapiens
ctggagatgcagcta

SEQ ID NO: 4527290 - DNA, 13 bp, Homo sapiens
ctggagcaccagg

SEQ ID NO: 4527291 - DNA, 14 bp, Homo sapiens
ctggagcaccaggc

SEQ ID NO: 4527292 - DNA, 15 bp, Homo sapiens
ctggagcaccaggtg

SEQ ID NO: 4527293 - DNA, 14 bp, Homo sapiens
ctggagcaggagcc

SEQ ID NO: 4527294 - DNA, 16 bp, Homo sapiens
ctggagcccagaggag

SEQ ID NO: 4527295 - DNA, 22 bp, Homo sapiens
ctggagcccagcgtcagaagtc

SEQ ID NO: 4527296 - DNA, 16 bp, Homo sapiens
ctggagcccccagcag

SEQ ID NO: 4527297 - DNA, 19 bp, Homo sapiens
ctggagcccccagcagagg

SEQ ID NO: 4527298 - DNA, 23 bp, Homo sapiens
ctggagcccccagcagaggcagg

SEQ ID NO: 4527299 - DNA, 15 bp, Homo sapiens
ctggagcctgcatta

SEQ ID NO: 4527300 - DNA, 15 bp, Homo sapiens
ctggagctcctccct

SEQ ID NO: 4527301 - DNA, 16 bp, Homo sapiens
ctggagctgggagaca

SEQ ID NO: 4527302 - DNA, 19 bp, Homo sapiens
ctggaggactagaacctgg

SEQ ID NO: 4527303 - DNA, 20 bp, Homo sapiens
ctggaggactagaacctgga

SEQ ID NO: 4527304 - DNA, 22 bp, Homo sapiens
ctggaggactagaacctggagg

SEQ ID NO: 4527305 - DNA, 17 bp, Homo sapiens
ctggaggagcagcagct

SEQ ID NO: 4527306 - DNA, 18 bp, Homo sapiens
ctggaggaggcctgtccc

SEQ ID NO: 4527307 - DNA, 19 bp, Homo sapiens
ctggaggaggcctgtccca

SEQ ID NO: 4527308 - DNA, 12 bp, Homo sapiens
ctggaggcaggg

SEQ ID NO: 4527309 - DNA, 15 bp, Homo sapiens
ctggaggcagggcct

SEQ ID NO: 4527310 - DNA, 23 bp, Homo sapiens
ctggaggcagggccttgcccaga

SEQ ID NO: 4527311 - DNA, 15 bp, Homo sapiens
ctggaggcccaggct

SEQ ID NO: 4527312 - DNA, 16 bp, Homo sapiens
ctggaggctgcctccc

SEQ ID NO: 4527313 - DNA, 17 bp, Homo sapiens
ctggagggaaggacagt

SEQ ID NO: 4527314 - DNA, 19 bp, Homo sapiens
ctggagggaatgaacctgg

SEQ ID NO: 4527315 - DNA, 23 bp, Homo sapiens
ctggagggaatgaacctggaggg

SEQ ID NO: 4527316 - DNA, 13 bp, Homo sapiens
ctggagggcaagc

SEQ ID NO: 4527317 - DNA, 16 bp, Homo sapiens
ctggagggcaagccct

SEQ ID NO: 4527318 - DNA, 17 bp, Homo sapiens
ctggagggcaagccctg

SEQ ID NO: 4527319 - DNA, 20 bp, Homo sapiens
ctggagggctagaacctaga

SEQ ID NO: 4527320 - DNA, 19 bp, Homo sapiens
ctggagggctagaatctgg

SEQ ID NO: 4527321 - DNA, 20 bp, Homo sapiens
ctggagggctagaatctgga

SEQ ID NO: 4527322 - DNA, 12 bp, Homo sapiens
ctggaggggtgg

SEQ ID NO: 4527323 - DNA, 15 bp, Homo sapiens
ctggaggggtggccc

SEQ ID NO: 4527324 - DNA, 21 bp, Homo sapiens
ctggaggggtggcccagagcc

SEQ ID NO: 4527325 - DNA, 20 bp, Homo sapiens
ctggagtggatctatttaca

SEQ ID NO: 4527326 - DNA, 19 bp, Homo sapiens
ctggagtgtggctgaggag

SEQ ID NO: 4527327 - DNA, 22 bp, Homo sapiens
ctggagtgtggctgaggaggcc

SEQ ID NO: 4527328 - DNA, 19 bp, Homo sapiens
ctggagttccttatccctc

SEQ ID NO: 4527329 - DNA, 20 bp, Homo sapiens
ctggagttccttatccctct

SEQ ID NO: 4527330 - DNA, 24 bp, Homo sapiens
ctggagttccttatccctctcttc

SEQ ID NO: 4527331 - DNA, 18 bp, Homo sapiens
ctggataggagcctgctg

SEQ ID NO: 4527332 - DNA, 20 bp, Homo sapiens
ctggataggagcctgctggt

SEQ ID NO: 4527333 - DNA, 12 bp, Homo sapiens
ctggatcagtaa

SEQ ID NO: 4527334 - DNA, 14 bp, Homo sapiens
ctggatcctgcact

SEQ ID NO: 4527335 - DNA, 20 bp, Homo sapiens
ctggatctcttaagacagca

SEQ ID NO: 4527336 - DNA, 20 bp, Homo sapiens
ctggatctgggaccctttcc

SEQ ID NO: 4527337 - DNA, 21 bp, Homo sapiens
ctggatctgggaccctttcct

SEQ ID NO: 4527338 - DNA, 17 bp, Homo sapiens
ctggatgccccctgtgg

SEQ ID NO: 4527339 - DNA, 19 bp, Homo sapiens
ctggatgccccctgtggat

SEQ ID NO: 4527340 - DNA, 22 bp, Homo sapiens
ctggatgcctcattatgtcaac

SEQ ID NO: 4527341 - DNA, 19 bp, Homo sapiens
ctggatggtggccagaaat

SEQ ID NO: 4527342 - DNA, 21 bp, Homo sapiens
ctggattttttatgtacaacc

SEQ ID NO: 4527343 - DNA, 15 bp, Homo sapiens
ctgctcatattgtga

SEQ ID NO: 4527344 - DNA, 22 bp, Homo sapiens
ctgctcatcattctctgtctca

SEQ ID NO: 4527345 - DNA, 19 bp, Homo sapiens
ctgctccaatgactgagca

SEQ ID NO: 4527346 - DNA, 15 bp, Homo sapiens
ctgctccaccagcag

SEQ ID NO: 4527347 - DNA, 16 bp, Homo sapiens
ctgctccaccagcagc

SEQ ID NO: 4527348 - DNA, 11 bp, Homo sapiens
ctgctccaccc

SEQ ID NO: 4527349 - DNA, 16 bp, Homo sapiens
ctgctccacccttggc

SEQ ID NO: 4527350 - DNA, 20 bp, Homo sapiens
ctgctccacccttggcctgt

SEQ ID NO: 4527351 - DNA, 18 bp, Homo sapiens
ctgctccagcctctgccg

SEQ ID NO: 4527352 - DNA, 12 bp, Homo sapiens
ctgctccaggcc

SEQ ID NO: 4527353 - DNA, 21 bp, Homo sapiens
ctgctccatccccctgcctcc

SEQ ID NO: 4527354 - DNA, 17 bp, Homo sapiens
ctgctcccacctggctc

SEQ ID NO: 4527355 - DNA, 16 bp, Homo sapiens
ctgctcccagtcctgc

SEQ ID NO: 4527356 - DNA, 14 bp, Homo sapiens
ctgctcccattcct

SEQ ID NO: 4527357 - DNA, 12 bp, Homo sapiens
ctgctcccccac

SEQ ID NO: 4527358 - DNA, 17 bp, Homo sapiens
ctgctcccccaccccct

SEQ ID NO: 4527359 - DNA, 23 bp, Homo sapiens
ctgctcccccaccccctccccag

SEQ ID NO: 4527360 - DNA, 13 bp, Homo sapiens
ctgctcccctgga

SEQ ID NO: 4527361 - DNA, 14 bp, Homo sapiens
ctgctccctgcaag

SEQ ID NO: 4527362 - DNA, 23 bp, Homo sapiens
ctgctccctgcaagctccgcctc

SEQ ID NO: 4527363 - DNA, 13 bp, Homo sapiens
ctgctccctgcct

SEQ ID NO: 4527364 - DNA, 14 bp, Homo sapiens
ctgctccctggggt

SEQ ID NO: 4527365 - DNA, 23 bp, Homo sapiens
ctgctcctagcaccctggagagt

SEQ ID NO: 4527366 - DNA, 12 bp, Homo sapiens
ctgctcctccag

SEQ ID NO: 4527367 - DNA, 14 bp, Homo sapiens
ctgctcctccaggg

SEQ ID NO: 4527368 - DNA, 16 bp, Homo sapiens
ctgctcctccagggcc

SEQ ID NO: 4527369 - DNA, 16 bp, Homo sapiens
ctgctccttcaggcga

SEQ ID NO: 4527370 - DNA, 17 bp, Homo sapiens
ctgctcgtggactgtgc

SEQ ID NO: 4527371 - DNA, 19 bp, Homo sapiens
ctgctcgtggactgtgctg

SEQ ID NO: 4527372 - DNA, 16 bp, Homo sapiens
ctgctctcagcctccc

SEQ ID NO: 4527373 - DNA, 19 bp, Homo sapiens
ctgctctcagcctcccaca

SEQ ID NO: 4527374 - DNA, 16 bp, Homo sapiens
ctgctctccttcctgg

SEQ ID NO: 4527375 - DNA, 16 bp, Homo sapiens
ctgctctgaccttcca

SEQ ID NO: 4527376 - DNA, 20 bp, Homo sapiens
ctgctctgcgtgtcacctgt

SEQ ID NO: 4527377 - DNA, 21 bp, Homo sapiens
ctgctctgcgtgtcacctgtg

SEQ ID NO: 4527378 - DNA, 22 bp, Homo sapiens
ctgctctgcgtgtcacctgtgc

SEQ ID NO: 4527379 - DNA, 11 bp, Homo sapiens
ctgctctggga

SEQ ID NO: 4527380 - DNA, 22 bp, Homo sapiens
ctgctcttctctccccagcccc

SEQ ID NO: 4527381 - DNA, 19 bp, Homo sapiens
ctgctctttacatttcttt

SEQ ID NO: 4527382 - DNA, 19 bp, Homo sapiens
ctgctcttttgtgatgaac

SEQ ID NO: 4527383 - DNA, 22 bp, Homo sapiens
ctgctcttttgtgatgaacata

SEQ ID NO: 4527384 - DNA, 12 bp, Homo sapiens
ctgctgaaactg

SEQ ID NO: 4527385 - DNA, 19 bp, Homo sapiens
ctgctgaaagtcctgcttt

SEQ ID NO: 4527386 - DNA, 15 bp, Homo sapiens
ctgctgagagaccca

SEQ ID NO: 4527387 - DNA, 22 bp, Homo sapiens
ctgctgagagacccaaggagga

SEQ ID NO: 4527388 - DNA, 16 bp, Homo sapiens
ctgctgagatcctgga

SEQ ID NO: 4527389 - DNA, 22 bp, Homo sapiens
ctgctgagatgaggaggggagc

SEQ ID NO: 4527390 - DNA, 20 bp, Homo sapiens
ctgctgagttggcctggcca

SEQ ID NO: 4527391 - DNA, 22 bp, Homo sapiens
ctgctgagttggcctggccatt

SEQ ID NO: 4527392 - DNA, 14 bp, Homo sapiens
ctgctgattcttgt

SEQ ID NO: 4527393 - DNA, 15 bp, Homo sapiens
ctgctgattcttgta

SEQ ID NO: 4527394 - DNA, 21 bp, Homo sapiens
ctgctgattcttgtaaatctt

SEQ ID NO: 4527395 - DNA, 22 bp, Homo sapiens
ctgctgcaacaagctcatccct

SEQ ID NO: 4527396 - DNA, 15 bp, Homo sapiens
ctgctgccatgtctc

SEQ ID NO: 4527397 - DNA, 21 bp, Homo sapiens
ctgctgcccccaccccgggga

SEQ ID NO: 4527398 - DNA, 14 bp, Homo sapiens
ctgctgcccctgca

SEQ ID NO: 4527399 - DNA, 23 bp, Homo sapiens
ctgctgcccctgcacagcaggct

SEQ ID NO: 4527400 - DNA, 17 bp, Homo sapiens
ctgctgcctctctttca

SEQ ID NO: 4527401 - DNA, 15 bp, Homo sapiens
ctgctgcctgctgag

SEQ ID NO: 4527402 - DNA, 16 bp, Homo sapiens
ctgctgcctgctgaga

SEQ ID NO: 4527403 - DNA, 17 bp, Homo sapiens
ctgctgctaggggctgt

SEQ ID NO: 4527404 - DNA, 15 bp, Homo sapiens
ctgctgctcctagga

SEQ ID NO: 4527405 - DNA, 14 bp, Homo sapiens
ctgctgctctccca

SEQ ID NO: 4527406 - DNA, 17 bp, Homo sapiens
ctgctgctctgaccttc

SEQ ID NO: 4527407 - DNA, 17 bp, Homo sapiens
ctgctgctttgggctgg

SEQ ID NO: 4527408 - DNA, 21 bp, Homo sapiens
ctgctggagtttcatgtacaa

SEQ ID NO: 4527409 - DNA, 16 bp, Homo sapiens
ctgctggcacccaccg

SEQ ID NO: 4527410 - DNA, 17 bp, Homo sapiens
ctgctggccaagaagtt

SEQ ID NO: 4527411 - DNA, 17 bp, Homo sapiens
ctgctggcgcctctgca

SEQ ID NO: 4527412 - DNA, 15 bp, Homo sapiens
ctgctggctcaggag

SEQ ID NO: 4527413 - DNA, 12 bp, Homo sapiens
ctgctggctctt

SEQ ID NO: 4527414 - DNA, 15 bp, Homo sapiens
ctgctggctgcggcc

SEQ ID NO: 4527415 - DNA, 16 bp, Homo sapiens
ctgctgggctctccac

SEQ ID NO: 4527416 - DNA, 18 bp, Homo sapiens
ctgctgggctctccacct

SEQ ID NO: 4527417 - DNA, 21 bp, Homo sapiens
ctgctgggctctccacctcag

SEQ ID NO: 4527418 - DNA, 16 bp, Homo sapiens
ctgctggtcacagcct

SEQ ID NO: 4527419 - DNA, 17 bp, Homo sapiens
ctgctgtccagacagcc

SEQ ID NO: 4527420 - DNA, 20 bp, Homo sapiens
ctgctgtccagacagcctgt

SEQ ID NO: 4527421 - DNA, 21 bp, Homo sapiens
ctgctgtccagacagcctgta

SEQ ID NO: 4527422 - DNA, 14 bp, Homo sapiens
ctgctgtctgagta

SEQ ID NO: 4527423 - DNA, 15 bp, Homo sapiens
ctgctgtctgagtag

SEQ ID NO: 4527424 - DNA, 15 bp, Homo sapiens
ctgctgtctgggact

SEQ ID NO: 4527425 - DNA, 17 bp, Homo sapiens
ctgctgtgaatctgaaa

SEQ ID NO: 4527426 - DNA, 21 bp, Homo sapiens
ctgctgtgccatgctgggcca

SEQ ID NO: 4527427 - DNA, 23 bp, Homo sapiens
ctgctgtgccatgctgggccact

SEQ ID NO: 4527428 - DNA, 16 bp, Homo sapiens
ctgctgtgctgctcaa

SEQ ID NO: 4527429 - DNA, 19 bp, Homo sapiens
ctgctgtgggagagcgaag

SEQ ID NO: 4527430 - DNA, 22 bp, Homo sapiens
ctgctgtgtgctttttttgtgt

SEQ ID NO: 4527431 - DNA, 23 bp, Homo sapiens
ctgctgtgtgctttttttgtgtg

SEQ ID NO: 4527432 - DNA, 15 bp, Homo sapiens
ctgctgttccagtgg

SEQ ID NO: 4527433 - DNA, 21 bp, Homo sapiens
ctgctgtttgacacctctttt

SEQ ID NO: 4527434 - DNA, 19 bp, Homo sapiens
ctgcttaaacttgacccag

SEQ ID NO: 4527435 - DNA, 19 bp, Homo sapiens
ctgcttcaatcccagccta

SEQ ID NO: 4527436 - DNA, 15 bp, Homo sapiens
ctgcttctcatccca

SEQ ID NO: 4527437 - DNA, 23 bp, Homo sapiens
ctgcttcttggagctttggaata

SEQ ID NO: 4527438 - DNA, 13 bp, Homo sapiens
ctgcttgaggaaa

SEQ ID NO: 4527439 - DNA, 19 bp, Homo sapiens
ctgcttgcccgctcccaca

SEQ ID NO: 4527440 - DNA, 17 bp, Homo sapiens
ctgcttggacggattcc

SEQ ID NO: 4527441 - DNA, 23 bp, Homo sapiens
ctgcttggcagttgcagtgctgc

SEQ ID NO: 4527442 - DNA, 23 bp, Homo sapiens
ctgcttgtatgcttttataggcc

SEQ ID NO: 4527443 - DNA, 22 bp, Homo sapiens
ctgcttgtcctgggcctgcccc

SEQ ID NO: 4527444 - DNA, 15 bp, Homo sapiens
ctgcttgtgatctca

SEQ ID NO: 4527445 - DNA, 9 bp, Homo sapiens
ctgctttat

SEQ ID NO: 4527446 - DNA, 17 bp, Homo sapiens
ctgctttcctgcagcag

SEQ ID NO: 4527447 - DNA, 17 bp, Homo sapiens
ctgctttctgttccaaa

SEQ ID NO: 4527448 - DNA, 19 bp, Homo sapiens
ctgctttgcatctttgtta

SEQ ID NO: 4527449 - DNA, 12 bp, Homo sapiens
ctgcttttaagt

SEQ ID NO: 4527450 - DNA, 18 bp, Homo sapiens
ctgcttttccctttgtga

SEQ ID NO: 4527451 - DNA, 22 bp, Homo sapiens
ctgcttttccctttgtgagtca

SEQ ID NO: 4527452 - DNA, 15 bp, Homo sapiens
ctgcttttcctctgc

SEQ ID NO: 4527453 - DNA, 17 bp, Homo sapiens
ctgcttttcctctgcct

SEQ ID NO: 4527454 - DNA, 17 bp, Homo sapiens
ctgcttttctgccctgg

SEQ ID NO: 4527455 - DNA, 14 bp, Homo sapiens
ctgctttttggaaa

SEQ ID NO: 4527456 - DNA, 18 bp, Homo sapiens
ctgctttttggaaagtca

SEQ ID NO: 4527457 - DNA, 15 bp, Homo sapiens
ctggaaacaaaacag

SEQ ID NO: 4527458 - DNA, 14 bp, Homo sapiens
ctggaaacatacag

SEQ ID NO: 4527459 - DNA, 17 bp, Homo sapiens
ctggaaactgctcagac

SEQ ID NO: 4527460 - DNA, 17 bp, Homo sapiens
ctggaaaggggagagcc

SEQ ID NO: 4527461 - DNA, 21 bp, Homo sapiens
ctggaaaggggagagcctgct

SEQ ID NO: 4527462 - DNA, 15 bp, Homo sapiens
ctggaacaacttgta

SEQ ID NO: 4527463 - DNA, 15 bp, Homo sapiens
ctgatgattttcctt

SEQ ID NO: 4527464 - DNA, 16 bp, Homo sapiens
ctgatgattttccttt

SEQ ID NO: 4527465 - DNA, 14 bp, Homo sapiens
ctgatgctccctcc

SEQ ID NO: 4527466 - DNA, 20 bp, Homo sapiens
ctgatggaactgtgtattta

SEQ ID NO: 4527467 - DNA, 15 bp, Homo sapiens
ctgatggcctttgga

SEQ ID NO: 4527468 - DNA, 22 bp, Homo sapiens
ctgatgggaaaactgccaatat

SEQ ID NO: 4527469 - DNA, 22 bp, Homo sapiens
ctgatggggaagggacttttat

SEQ ID NO: 4527470 - DNA, 15 bp, Homo sapiens
ctgatgtcccagtgc

SEQ ID NO: 4527471 - DNA, 21 bp, Homo sapiens
ctgatgttcatgatagaaaga

SEQ ID NO: 4527472 - DNA, 13 bp, Homo sapiens
ctgatgttcctag

SEQ ID NO: 4527473 - DNA, 20 bp, Homo sapiens
ctgatgttcctagtgaaaga

SEQ ID NO: 4527474 - DNA, 15 bp, Homo sapiens
ctgatgttctttcca

SEQ ID NO: 4527475 - DNA, 22 bp, Homo sapiens
ctgatgttgagggaacagacag

SEQ ID NO: 4527476 - DNA, 19 bp, Homo sapiens
ctgattataccatgtgtgc

SEQ ID NO: 4527477 - DNA, 20 bp, Homo sapiens
ctgattattgagttccagtt

SEQ ID NO: 4527478 - DNA, 18 bp, Homo sapiens
ctgattatttatgacctg

SEQ ID NO: 4527479 - DNA, 13 bp, Homo sapiens
ctgattattttag

SEQ ID NO: 4527480 - DNA, 13 bp, Homo sapiens
ctgattgatcaca

SEQ ID NO: 4527481 - DNA, 22 bp, Homo sapiens
ctgattggccactggatcctgc

SEQ ID NO: 4527482 - DNA, 20 bp, Homo sapiens
ctgatttctatggctttcaa

SEQ ID NO: 4527483 - DNA, 21 bp, Homo sapiens
ctgatttctatggctttcaaa

SEQ ID NO: 4527484 - DNA, 12 bp, Homo sapiens
ctgatttctcac

SEQ ID NO: 4527485 - DNA, 22 bp, Homo sapiens
ctgattttaatggattgttaat

SEQ ID NO: 4527486 - DNA, 24 bp, Homo sapiens
ctgattttctctggcagcataatt

SEQ ID NO: 4527487 - DNA, 19 bp, Homo sapiens
ctgattttttttcctttta

SEQ ID NO: 4527488 - DNA, 14 bp, Homo sapiens
ctgcaaaaagaaaa

SEQ ID NO: 4527489 - DNA, 17 bp, Homo sapiens
ctgcaaaactccaggca

SEQ ID NO: 4527490 - DNA, 15 bp, Homo sapiens
ctgcaaaatgtagaa

SEQ ID NO: 4527491 - DNA, 13 bp, Homo sapiens
ctgcaaaattaaa

SEQ ID NO: 4527492 - DNA, 15 bp, Homo sapiens
ctgcaaaattaaatc

SEQ ID NO: 4527493 - DNA, 18 bp, Homo sapiens
ctgcaaaccttcctggga

SEQ ID NO: 4527494 - DNA, 20 bp, Homo sapiens
ctgcaaatagaaaacaggaa

SEQ ID NO: 4527495 - DNA, 18 bp, Homo sapiens
ctgcaaatcaggcttttg

SEQ ID NO: 4527496 - DNA, 20 bp, Homo sapiens
ctgcaaatcaggcttttgtt

SEQ ID NO: 4527497 - DNA, 20 bp, Homo sapiens
ctgcaaatttagtttgttaa

SEQ ID NO: 4527498 - DNA, 23 bp, Homo sapiens
ctgcaaatttagtttgttaaagc

SEQ ID NO: 4527499 - DNA, 21 bp, Homo sapiens
ctgcaacaaaatgtagaatat

SEQ ID NO: 4527500 - DNA, 12 bp, Homo sapiens
ctgcaacaggct

SEQ ID NO: 4527501 - DNA, 23 bp, Homo sapiens
ctgcaacctcacctcccgggttc

SEQ ID NO: 4527502 - DNA, 22 bp, Homo sapiens
ctgcaacctccacatcccatgt

SEQ ID NO: 4527503 - DNA, 16 bp, Homo sapiens
ctgcaacctctgcctc

SEQ ID NO: 4527504 - DNA, 17 bp, Homo sapiens
ctgcaacttccgctgag

SEQ ID NO: 4527505 - DNA, 19 bp, Homo sapiens
ctgcaacttccgctgaggg

SEQ ID NO: 4527506 - DNA, 13 bp, Homo sapiens
ctgcaagaccacg

SEQ ID NO: 4527507 - DNA, 22 bp, Homo sapiens
ctgcaagaccacggagggagcg

SEQ ID NO: 4527508 - DNA, 21 bp, Homo sapiens
ctgcaagagatggaaaaaaag

SEQ ID NO: 4527509 - DNA, 21 bp, Homo sapiens
ctgcaagagccttggtgtcca

SEQ ID NO: 4527510 - DNA, 23 bp, Homo sapiens
ctgcaagagccttggtgtccacc

SEQ ID NO: 4527511 - DNA, 21 bp, Homo sapiens
ctgcaagatggacacgagcca

SEQ ID NO: 4527512 - DNA, 20 bp, Homo sapiens
ctgcaagatttcacatcagc

SEQ ID NO: 4527513 - DNA, 17 bp, Homo sapiens
ctgcaagcatttttcca

SEQ ID NO: 4527514 - DNA, 18 bp, Homo sapiens
ctgcaagcatttttccat

SEQ ID NO: 4527515 - DNA, 13 bp, Homo sapiens
ctgcaagctccgc

SEQ ID NO: 4527516 - DNA, 16 bp, Homo sapiens
ctgcaagctccgcctc

SEQ ID NO: 4527517 - DNA, 19 bp, Homo sapiens
ctgcaagctccgcctcccg

SEQ ID NO: 4527518 - DNA, 16 bp, Homo sapiens
ctgcaaggtactctgg

SEQ ID NO: 4527519 - DNA, 18 bp, Homo sapiens
ctgcaaggtactctggtg

SEQ ID NO: 4527520 - DNA, 19 bp, Homo sapiens
ctgcaaggtactctggtga

SEQ ID NO: 4527521 - DNA, 16 bp, Homo sapiens
ctgcaagtctgtggcc

SEQ ID NO: 4527522 - DNA, 19 bp, Homo sapiens
ctgcaagtgaggtgtgtca

SEQ ID NO: 4527523 - DNA, 16 bp, Homo sapiens
ctgcaatacattaaaa

SEQ ID NO: 4527524 - DNA, 14 bp, Homo sapiens
ctgcaatgagccat

SEQ ID NO: 4527525 - DNA, 15 bp, Homo sapiens
ctgcaatgagccatg

SEQ ID NO: 4527526 - DNA, 18 bp, Homo sapiens
ctgcaatgtgatctatgt

SEQ ID NO: 4527527 - DNA, 16 bp, Homo sapiens
ctgcaattttactgtg

SEQ ID NO: 4527528 - DNA, 16 bp, Homo sapiens
ctgcacaaaagcagat

SEQ ID NO: 4527529 - DNA, 15 bp, Homo sapiens
ctgcacaataaaaat

SEQ ID NO: 4527530 - DNA, 22 bp, Homo sapiens
ctgcacaataaaaatgtttaac

SEQ ID NO: 4527531 - DNA, 23 bp, Homo sapiens
ctgcacaccagagacaagcagag

SEQ ID NO: 4527532 - DNA, 18 bp, Homo sapiens
ctgcacaccctccagaga

SEQ ID NO: 4527533 - DNA, 20 bp, Homo sapiens
ctgcacaccctccagagaca

SEQ ID NO: 4527534 - DNA, 13 bp, Homo sapiens
ctgcacaccctgg

SEQ ID NO: 4527535 - DNA, 17 bp, Homo sapiens
ctgcacaccctgggcca

SEQ ID NO: 4527536 - DNA, 15 bp, Homo sapiens
ctgcacagagcaagt

SEQ ID NO: 4527537 - DNA, 21 bp, Homo sapiens
ctgcacagagcaagtcctcac

SEQ ID NO: 4527538 - DNA, 18 bp, Homo sapiens
ctgcacagcaggctgcca

SEQ ID NO: 4527539 - DNA, 22 bp, Homo sapiens
ctgcacagcaggctgccagtgc

SEQ ID NO: 4527540 - DNA, 21 bp, Homo sapiens
ctgcacaggcacacagggccc

SEQ ID NO: 4527541 - DNA, 17 bp, Homo sapiens
ctgcacagggcagctgg

SEQ ID NO: 4527542 - DNA, 21 bp, Homo sapiens
ctgcacagggcagctgggccc

SEQ ID NO: 4527543 - DNA, 17 bp, Homo sapiens
ctgcacagtcagaagga

SEQ ID NO: 4527544 - DNA, 13 bp, Homo sapiens
ctgcacagtgttg

SEQ ID NO: 4527545 - DNA, 21 bp, Homo sapiens
ctgcacagtttagaacagagg

SEQ ID NO: 4527546 - DNA, 15 bp, Homo sapiens
ctgcacatggcctga

SEQ ID NO: 4527547 - DNA, 21 bp, Homo sapiens
ctgcacattaaggagaaatct

SEQ ID NO: 4527548 - DNA, 19 bp, Homo sapiens
ctgcacattgggtggggct

SEQ ID NO: 4527549 - DNA, 23 bp, Homo sapiens
ctgcaccaggggtgcacaataaa

SEQ ID NO: 4527550 - DNA, 18 bp, Homo sapiens
ctgcaccccagcattcca

SEQ ID NO: 4527551 - DNA, 21 bp, Homo sapiens
ctgcaccccagcattccagct

SEQ ID NO: 4527552 - DNA, 22 bp, Homo sapiens
ctgcacccctccggccccgtct

SEQ ID NO: 4527553 - DNA, 11 bp, Homo sapiens
ctgcacccctg

SEQ ID NO: 4527554 - DNA, 22 bp, Homo sapiens
ctgcacccctgcccccaggtga

SEQ ID NO: 4527555 - DNA, 15 bp, Homo sapiens
ctgcacccctgggcc

SEQ ID NO: 4527556 - DNA, 13 bp, Homo sapiens
ctgcacccgcctc

SEQ ID NO: 4527557 - DNA, 14 bp, Homo sapiens
ctgcacccttccac

SEQ ID NO: 4527558 - DNA, 11 bp, Homo sapiens
ctgcacctccc

SEQ ID NO: 4527559 - DNA, 18 bp, Homo sapiens
ctgcacctccccccactg

SEQ ID NO: 4527560 - DNA, 19 bp, Homo sapiens
ctgcacctccccccactgc

SEQ ID NO: 4527561 - DNA, 20 bp, Homo sapiens
ctgcacctccccccactgca

SEQ ID NO: 4527562 - DNA, 11 bp, Homo sapiens
ctgcacctcct

SEQ ID NO: 4527563 - DNA, 12 bp, Homo sapiens
ctgcacctgccc

SEQ ID NO: 4527564 - DNA, 14 bp, Homo sapiens
ctgcaccttagaaa

SEQ ID NO: 4527565 - DNA, 19 bp, Homo sapiens
ctgcacggtgggccttgct

SEQ ID NO: 4527566 - DNA, 19 bp, Homo sapiens
ctgcactactcctctgcag

SEQ ID NO: 4527567 - DNA, 20 bp, Homo sapiens
ctgcactactcctctgcagt

SEQ ID NO: 4527568 - DNA, 23 bp, Homo sapiens
ctgcactactcctctgcagtgcc

SEQ ID NO: 4527569 - DNA, 11 bp, Homo sapiens
ctgcactccag

SEQ ID NO: 4527570 - DNA, 17 bp, Homo sapiens
ctgcactccagcctggg

SEQ ID NO: 4527571 - DNA, 20 bp, Homo sapiens
ctgcactccagtctgggtga

SEQ ID NO: 4527572 - DNA, 22 bp, Homo sapiens
ctgcactcccacctgacacacc

SEQ ID NO: 4527573 - DNA, 14 bp, Homo sapiens
ctgcactcttaaac

SEQ ID NO: 4527574 - DNA, 16 bp, Homo sapiens
ctgcactcttaaacag

SEQ ID NO: 4527575 - DNA, 20 bp, Homo sapiens
ctgcactttccaatgccaca

SEQ ID NO: 4527576 - DNA, 22 bp, Homo sapiens
ctgcactttccaatgccacaga

SEQ ID NO: 4527577 - DNA, 23 bp, Homo sapiens
ctgcactttccaatgccacagac

SEQ ID NO: 4527578 - DNA, 19 bp, Homo sapiens
ctgcactttgatgtcatgt

SEQ ID NO: 4527579 - DNA, 20 bp, Homo sapiens
ctgcactttgatgtcatgtg

SEQ ID NO: 4527580 - DNA, 22 bp, Homo sapiens
ctgcactttgatgtcatgtgtt

SEQ ID NO: 4527581 - DNA, 23 bp, Homo sapiens
ctgcactttgatgtcatgtgttc

SEQ ID NO: 4527582 - DNA, 13 bp, Homo sapiens
ctgccaggctgtt

SEQ ID NO: 4527583 - DNA, 12 bp, Homo sapiens
ctgccagggcag

SEQ ID NO: 4527584 - DNA, 13 bp, Homo sapiens
ctgccagggcagg

SEQ ID NO: 4527585 - DNA, 18 bp, Homo sapiens
ctgccagtcctagctgca

SEQ ID NO: 4527586 - DNA, 17 bp, Homo sapiens
ctgccagtgaagtcctt

SEQ ID NO: 4527587 - DNA, 12 bp, Homo sapiens
ctgccagtgcct

SEQ ID NO: 4527588 - DNA, 13 bp, Homo sapiens
ctgccagtgcctt

SEQ ID NO: 4527589 - DNA, 17 bp, Homo sapiens
ctgccagtgccttacct

SEQ ID NO: 4527590 - DNA, 16 bp, Homo sapiens
ctgccatcctggccca

SEQ ID NO: 4527591 - DNA, 17 bp, Homo sapiens
ctgccatcctggcccag

SEQ ID NO: 4527592 - DNA, 21 bp, Homo sapiens
ctgccatcctggcccagggca

SEQ ID NO: 4527593 - DNA, 23 bp, Homo sapiens
ctgccatgccaggaacctgtcct

SEQ ID NO: 4527594 - DNA, 20 bp, Homo sapiens
ctgccatggaactgtttcct

SEQ ID NO: 4527595 - DNA, 16 bp, Homo sapiens
ctgccattctgtgcag

SEQ ID NO: 4527596 - DNA, 15 bp, Homo sapiens
ctgccattcttctgg

SEQ ID NO: 4527597 - DNA, 14 bp, Homo sapiens
ctgccattgggacc

SEQ ID NO: 4527598 - DNA, 15 bp, Homo sapiens
ctgcccaaaatgtga

SEQ ID NO: 4527599 - DNA, 18 bp, Homo sapiens
ctgcccaaaatgtgaagc

SEQ ID NO: 4527600 - DNA, 21 bp, Homo sapiens
ctgcccaaacagctgtattta

SEQ ID NO: 4527601 - DNA, 22 bp, Homo sapiens
ctgcccaaacagctgtatttat

SEQ ID NO: 4527602 - DNA, 16 bp, Homo sapiens
ctgcccaattggagga

SEQ ID NO: 4527603 - DNA, 22 bp, Homo sapiens
ctgcccacagaaagccaggagc

SEQ ID NO: 4527604 - DNA, 15 bp, Homo sapiens
ctgcccactctgcaa

SEQ ID NO: 4527605 - DNA, 20 bp, Homo sapiens
ctgcccactctgcaagaaga

SEQ ID NO: 4527606 - DNA, 18 bp, Homo sapiens
ctgcccagaaagtggggg

SEQ ID NO: 4527607 - DNA, 21 bp, Homo sapiens
ctgcccagaaagtgggggtgg

SEQ ID NO: 4527608 - DNA, 12 bp, Homo sapiens
ctgcccagagct

SEQ ID NO: 4527609 - DNA, 14 bp, Homo sapiens
ctgcccagagctga

SEQ ID NO: 4527610 - DNA, 18 bp, Homo sapiens
ctgcccagcaacatggag

SEQ ID NO: 4527611 - DNA, 22 bp, Homo sapiens
ctgcccagcagcccctgagagc

SEQ ID NO: 4527612 - DNA, 13 bp, Homo sapiens
ctgcccagcctgc

SEQ ID NO: 4527613 - DNA, 18 bp, Homo sapiens
ctgcccagcctgctctcc

SEQ ID NO: 4527614 - DNA, 21 bp, Homo sapiens
ctgcccaggagacagaccact

SEQ ID NO: 4527615 - DNA, 22 bp, Homo sapiens
ctgcccaggagagccagccctc

SEQ ID NO: 4527616 - DNA, 12 bp, Homo sapiens
ctgcccaggcca

SEQ ID NO: 4527617 - DNA, 20 bp, Homo sapiens
ctgcccaggccacagagaac

SEQ ID NO: 4527618 - DNA, 20 bp, Homo sapiens
ctgcccatgagcaagcctag

SEQ ID NO: 4527619 - DNA, 20 bp, Homo sapiens
ctgcccatgtgtcccctcac

SEQ ID NO: 4527620 - DNA, 18 bp, Homo sapiens
ctgccccaactcctggaa

SEQ ID NO: 4527621 - DNA, 20 bp, Homo sapiens
ctgccccaactcctggaagc

SEQ ID NO: 4527622 - DNA, 19 bp, Homo sapiens
ctgccccaatcgggtccag

SEQ ID NO: 4527623 - DNA, 20 bp, Homo sapiens
ctgccccaatcgggtccaga

SEQ ID NO: 4527624 - DNA, 13 bp, Homo sapiens
ctgccccacatgc

SEQ ID NO: 4527625 - DNA, 21 bp, Homo sapiens
ctgccccacccaactccacag

SEQ ID NO: 4527626 - DNA, 14 bp, Homo sapiens
ctgccccacggaga

SEQ ID NO: 4527627 - DNA, 18 bp, Homo sapiens
ctgccccacggagacaga

SEQ ID NO: 4527628 - DNA, 11 bp, Homo sapiens
ctgccccaggg

SEQ ID NO: 4527629 - DNA, 20 bp, Homo sapiens
ctgccccattgagatcttcc

SEQ ID NO: 4527630 - DNA, 19 bp, Homo sapiens
ctgcccccagaaagcctcc

SEQ ID NO: 4527631 - DNA, 22 bp, Homo sapiens
ctgcccccagaaagcctcctgc

SEQ ID NO: 4527632 - DNA, 16 bp, Homo sapiens
ctgcccccagccccgg

SEQ ID NO: 4527633 - DNA, 16 bp, Homo sapiens
ctgcccccggccccct

SEQ ID NO: 4527634 - DNA, 21 bp, Homo sapiens
ctgccccctcccccatgggct

SEQ ID NO: 4527635 - DNA, 15 bp, Homo sapiens
ctgccccctcctgtg

SEQ ID NO: 4527636 - DNA, 12 bp, Homo sapiens
ctgccccctgcc

SEQ ID NO: 4527637 - DNA, 15 bp, Homo sapiens
ctgccccctgccagt

SEQ ID NO: 4527638 - DNA, 15 bp, Homo sapiens
ctgccccctgctggc

SEQ ID NO: 4527639 - DNA, 17 bp, Homo sapiens
ctgccccctgctggctc

SEQ ID NO: 4527640 - DNA, 23 bp, Homo sapiens
ctgccccgcagacggtctgtgtg

SEQ ID NO: 4527641 - DNA, 17 bp, Homo sapiens
ctgccccgcccccagtc

SEQ ID NO: 4527642 - DNA, 14 bp, Homo sapiens
ctgccccggcctcc

SEQ ID NO: 4527643 - DNA, 22 bp, Homo sapiens
ctgccccgtcggactgccccca

SEQ ID NO: 4527644 - DNA, 12 bp, Homo sapiens
ctgcccctcact

SEQ ID NO: 4527645 - DNA, 22 bp, Homo sapiens
ctgcccctcccccaacccccac

SEQ ID NO: 4527646 - DNA, 19 bp, Homo sapiens
ctgcccctgcacagcaggc

SEQ ID NO: 4527647 - DNA, 13 bp, Homo sapiens
ctgcccctgcagc

SEQ ID NO: 4527648 - DNA, 14 bp, Homo sapiens
ctgcccctgctgtg

SEQ ID NO: 4527649 - DNA, 20 bp, Homo sapiens
ctgcccctgctgtgctgctc

SEQ ID NO: 4527650 - DNA, 14 bp, Homo sapiens
ctgcccctggacct

SEQ ID NO: 4527651 - DNA, 18 bp, Homo sapiens
ctgccccttctacactct

SEQ ID NO: 4527652 - DNA, 21 bp, Homo sapiens
ctgccccttctacactctcct

SEQ ID NO: 4527653 - DNA, 18 bp, Homo sapiens
ctgcccggctacatcagc

SEQ ID NO: 4527654 - DNA, 19 bp, Homo sapiens
ctgcccgggcgcggccagc

SEQ ID NO: 4527655 - DNA, 21 bp, Homo sapiens
ctgcccgggcgcggccagccc

SEQ ID NO: 4527656 - DNA, 24 bp, Homo sapiens
ctgcccgtctctctcccatggagc

SEQ ID NO: 4527657 - DNA, 18 bp, Homo sapiens
ctgccctcccaagtccca

SEQ ID NO: 4527658 - DNA, 20 bp, Homo sapiens
ctgccctccttgtccaccca

SEQ ID NO: 4527659 - DNA, 12 bp, Homo sapiens
ctgccctctaga

SEQ ID NO: 4527660 - DNA, 14 bp, Homo sapiens
ctgccctctagagc

SEQ ID NO: 4527661 - DNA, 20 bp, Homo sapiens
ctgccctgcacgtcatggga

SEQ ID NO: 4527662 - DNA, 12 bp, Homo sapiens
ctgccctggctg

SEQ ID NO: 4527663 - DNA, 18 bp, Homo sapiens
ctgccctggctgctgccc

SEQ ID NO: 4527664 - DNA, 21 bp, Homo sapiens
ctgccctggctgctgccccca

SEQ ID NO: 4527665 - DNA, 20 bp, Homo sapiens
ctgccctggtccagggaagc

SEQ ID NO: 4527666 - DNA, 23 bp, Homo sapiens
ctgccctggtccagggaagctgg

SEQ ID NO: 4527667 - DNA, 17 bp, Homo sapiens
ctgccctgtcaagcttc

SEQ ID NO: 4527668 - DNA, 20 bp, Homo sapiens
ctgccctgtcaagcttctct

SEQ ID NO: 4527669 - DNA, 20 bp, Homo sapiens
ctgccctgtgatatgtctgc

SEQ ID NO: 4527670 - DNA, 14 bp, Homo sapiens
ctgccctgtggaca

SEQ ID NO: 4527671 - DNA, 15 bp, Homo sapiens
ctgcccttaggccac

SEQ ID NO: 4527672 - DNA, 17 bp, Homo sapiens
ctgcccttcaccccagt

SEQ ID NO: 4527673 - DNA, 14 bp, Homo sapiens
ctgcccttccctct

SEQ ID NO: 4527674 - DNA, 17 bp, Homo sapiens
ctgcccttccctctggg

SEQ ID NO: 4527675 - DNA, 15 bp, Homo sapiens
ctgcccttgctgccc

SEQ ID NO: 4527676 - DNA, 23 bp, Homo sapiens
ctgccctttcccaggtaatttaa

SEQ ID NO: 4527677 - DNA, 13 bp, Homo sapiens
ctgccctttctca

SEQ ID NO: 4527678 - DNA, 15 bp, Homo sapiens
ctgccctttctcagg

SEQ ID NO: 4527679 - DNA, 21 bp, Homo sapiens
ctgcccttttttctgcctcct

SEQ ID NO: 4527680 - DNA, 23 bp, Homo sapiens
ctgccgagagtccatcagcctcc

SEQ ID NO: 4527681 - DNA, 17 bp, Homo sapiens
ctgccgattttgtaaat

SEQ ID NO: 4527682 - DNA, 18 bp, Homo sapiens
ctgccgcagagctggccg

SEQ ID NO: 4527683 - DNA, 14 bp, Homo sapiens
ctgccgccctgtgg

SEQ ID NO: 4527684 - DNA, 15 bp, Homo sapiens
ctgccgccctgtggg

SEQ ID NO: 4527685 - DNA, 15 bp, Homo sapiens
ctgccgcgcagtgtg

SEQ ID NO: 4527686 - DNA, 13 bp, Homo sapiens
ctgccgctgcacc

SEQ ID NO: 4527687 - DNA, 13 bp, Homo sapiens
ctgccgctgccat

SEQ ID NO: 4527688 - DNA, 14 bp, Homo sapiens
ctgccgctgccatg

SEQ ID NO: 4527689 - DNA, 14 bp, Homo sapiens
ctgccgctggaggc

SEQ ID NO: 4527690 - DNA, 20 bp, Homo sapiens
ctgccggtcgggcagccagc

SEQ ID NO: 4527691 - DNA, 21 bp, Homo sapiens
ctgccggtgggaccctgtccg

SEQ ID NO: 4527692 - DNA, 20 bp, Homo sapiens
ctgccgtgcatggctcctgt

SEQ ID NO: 4527693 - DNA, 14 bp, Homo sapiens
ctgcctaagtggct

SEQ ID NO: 4527694 - DNA, 14 bp, Homo sapiens
ctgcctaataaaga

SEQ ID NO: 4527695 - DNA, 15 bp, Homo sapiens
ctgcctaataaagag

SEQ ID NO: 4527696 - DNA, 18 bp, Homo sapiens
ctgcctaataaagagact

SEQ ID NO: 4527697 - DNA, 16 bp, Homo sapiens
ctgcctacagccaggt

SEQ ID NO: 4527698 - DNA, 13 bp, Homo sapiens
ctgcctactcacg

SEQ ID NO: 4527699 - DNA, 14 bp, Homo sapiens
ctgcctatgcactg

SEQ ID NO: 4527700 - DNA, 20 bp, Homo sapiens
ctgcctatgcactgaagagc

SEQ ID NO: 4527701 - DNA, 23 bp, Homo sapiens
ctgcctatgcactgaagagctct

SEQ ID NO: 4527702 - DNA, 17 bp, Homo sapiens
ctgcctattatctgtca

SEQ ID NO: 4527703 - DNA, 23 bp, Homo sapiens
ctgcctattatctgtcagctgca

SEQ ID NO: 4527704 - DNA, 13 bp, Homo sapiens
ctgcctcactcct

SEQ ID NO: 4527705 - DNA, 21 bp, Homo sapiens
ctgcctcactcctccgtgagc

SEQ ID NO: 4527706 - DNA, 22 bp, Homo sapiens
ctgcctcactcctccgtgagca

SEQ ID NO: 4527707 - DNA, 14 bp, Homo sapiens
ctgcctcacttcct

SEQ ID NO: 4527708 - DNA, 13 bp, Homo sapiens
ctgcctcagcctc

SEQ ID NO: 4527709 - DNA, 17 bp, Homo sapiens
ctgcctcagcctcccat

SEQ ID NO: 4527710 - DNA, 15 bp, Homo sapiens
ctgcctcagccttcc

SEQ ID NO: 4527711 - DNA, 21 bp, Homo sapiens
ctgcctccaccctctgagctt

SEQ ID NO: 4527712 - DNA, 16 bp, Homo sapiens
ctgcctccagggctgg

SEQ ID NO: 4527713 - DNA, 15 bp, Homo sapiens
ctgcctcccacttca

SEQ ID NO: 4527714 - DNA, 18 bp, Homo sapiens
ctgcctcccacttcactg

SEQ ID NO: 4527715 - DNA, 16 bp, Homo sapiens
ctgcctcccattctgc

SEQ ID NO: 4527716 - DNA, 23 bp, Homo sapiens
ctgcctccctctccatatctcct

SEQ ID NO: 4527717 - DNA, 11 bp, Homo sapiens
ctgcctcctgc

SEQ ID NO: 4527718 - DNA, 14 bp, Homo sapiens
ctgcctcctgccta

SEQ ID NO: 4527719 - DNA, 22 bp, Homo sapiens
ctgcctcctggccaagcaggct

SEQ ID NO: 4527720 - DNA, 12 bp, Homo sapiens
ctgcctccttta

SEQ ID NO: 4527721 - DNA, 16 bp, Homo sapiens
ctgcctcgtagagtga

SEQ ID NO: 4527722 - DNA, 22 bp, Homo sapiens
ctgcctctcatcaactgaatga

SEQ ID NO: 4527723 - DNA, 12 bp, Homo sapiens
ctgcctctgacc

SEQ ID NO: 4527724 - DNA, 14 bp, Homo sapiens
ctgcctctgacccc

SEQ ID NO: 4527725 - DNA, 12 bp, Homo sapiens
ctgcctctgctc

SEQ ID NO: 4527726 - DNA, 13 bp, Homo sapiens
ctgcctctgctcc

SEQ ID NO: 4527727 - DNA, 14 bp, Homo sapiens
ctgcctctgctccc

SEQ ID NO: 4527728 - DNA, 20 bp, Homo sapiens
ctgcctgacatttggagtgt

SEQ ID NO: 4527729 - DNA, 16 bp, Homo sapiens
ctgcctgcagcaggca

SEQ ID NO: 4527730 - DNA, 18 bp, Homo sapiens
ctgcctgcagcaggcagc

SEQ ID NO: 4527731 - DNA, 20 bp, Homo sapiens
ctgcctgcagccagggctgg

SEQ ID NO: 4527732 - DNA, 15 bp, Homo sapiens
ctgcctgcggcccag

SEQ ID NO: 4527733 - DNA, 12 bp, Homo sapiens
ctgcctgctcct

SEQ ID NO: 4527734 - DNA, 15 bp, Homo sapiens
ctgcctgctccttgg

SEQ ID NO: 4527735 - DNA, 16 bp, Homo sapiens
ctgcctgctccttggc

SEQ ID NO: 4527736 - DNA, 15 bp, Homo sapiens
ctgcctgctgagatg

SEQ ID NO: 4527737 - DNA, 11 bp, Homo sapiens
ctgcctggagc

SEQ ID NO: 4527738 - DNA, 12 bp, Homo sapiens
ctgcctggcagg

SEQ ID NO: 4527739 - DNA, 13 bp, Homo sapiens
ctgcctggccagg

SEQ ID NO: 4527740 - DNA, 16 bp, Homo sapiens
ctgcctggccaggcag

SEQ ID NO: 4527741 - DNA, 12 bp, Homo sapiens
ctgcctggcccc

SEQ ID NO: 4527742 - DNA, 22 bp, Homo sapiens
ctgcctggcccccaacctcagg

SEQ ID NO: 4527743 - DNA, 19 bp, Homo sapiens
ctgcctggccctccccaca

SEQ ID NO: 4527744 - DNA, 20 bp, Homo sapiens
ctgcctgggttttgttccct

SEQ ID NO: 4527745 - DNA, 20 bp, Homo sapiens
ctgcctggttccctccccaa

SEQ ID NO: 4527746 - DNA, 21 bp, Homo sapiens
ctgcctggttccctccccaag

SEQ ID NO: 4527747 - DNA, 21 bp, Homo sapiens
ctgcctgtccccaaacaggac

SEQ ID NO: 4527748 - DNA, 17 bp, Homo sapiens
ctgcctgtctgcttgca

SEQ ID NO: 4527749 - DNA, 23 bp, Homo sapiens
ctgcctgtggcccctcccctgca

SEQ ID NO: 4527750 - DNA, 22 bp, Homo sapiens
ctgcctgttataactctgcact

SEQ ID NO: 4527751 - DNA, 16 bp, Homo sapiens
ctgcctgttggcaggc

SEQ ID NO: 4527752 - DNA, 19 bp, Homo sapiens
ctgcctgttggcaggccca

SEQ ID NO: 4527753 - DNA, 19 bp, Homo sapiens
ctgccttaaaaccaaagag

SEQ ID NO: 4527754 - DNA, 15 bp, Homo sapiens
ctgccttagcttcag

SEQ ID NO: 4527755 - DNA, 16 bp, Homo sapiens
ctgccttagcttcagg

SEQ ID NO: 4527756 - DNA, 14 bp, Homo sapiens
ctgccttcccccaa

SEQ ID NO: 4527757 - DNA, 15 bp, Homo sapiens
ctgccttccctagct

SEQ ID NO: 4527758 - DNA, 15 bp, Homo sapiens
ctgccttcctcctgg

SEQ ID NO: 4527759 - DNA, 16 bp, Homo sapiens
ctgccttcctcctggg

SEQ ID NO: 4527760 - DNA, 18 bp, Homo sapiens
ctgccttctggccttgta

SEQ ID NO: 4527761 - DNA, 24 bp, Homo sapiens
ctgccttcttcggggaactcctgg

SEQ ID NO: 4527762 - DNA, 23 bp, Homo sapiens
ctgccttctttccatcaactccc

SEQ ID NO: 4527763 - DNA, 15 bp, Homo sapiens
ctgccttgccctcct

SEQ ID NO: 4527764 - DNA, 16 bp, Homo sapiens
ctgccttgccctcctg

SEQ ID NO: 4527765 - DNA, 17 bp, Homo sapiens
ctgccttgccctcctgg

SEQ ID NO: 4527766 - DNA, 15 bp, Homo sapiens
ctgccttggcctccc

SEQ ID NO: 4527767 - DNA, 16 bp, Homo sapiens
ctgccttggcctccca

SEQ ID NO: 4527768 - DNA, 23 bp, Homo sapiens
ctgcctttgcagttggactctca

SEQ ID NO: 4527769 - DNA, 20 bp, Homo sapiens
ctgcgaagaccctcttgccc

SEQ ID NO: 4527770 - DNA, 21 bp, Homo sapiens
ctgcgaagaccctcttgccca

SEQ ID NO: 4527771 - DNA, 15 bp, Homo sapiens
ctgcgcccaccccgc

SEQ ID NO: 4527772 - DNA, 16 bp, Homo sapiens
ctgcgccctgtgcccg

SEQ ID NO: 4527773 - DNA, 13 bp, Homo sapiens
ctgcgcctgcagg

SEQ ID NO: 4527774 - DNA, 17 bp, Homo sapiens
ctgcgcctgcaggcaga

SEQ ID NO: 4527775 - DNA, 17 bp, Homo sapiens
ctgcgcctgctgcctgc

SEQ ID NO: 4527776 - DNA, 16 bp, Homo sapiens
ctgcggccaggcctgc

SEQ ID NO: 4527777 - DNA, 13 bp, Homo sapiens
ctgcgggagccag

SEQ ID NO: 4527778 - DNA, 21 bp, Homo sapiens
ctgcgggagccagactgtcca

SEQ ID NO: 4527779 - DNA, 17 bp, Homo sapiens
ctgcgggagctctgtat

SEQ ID NO: 4527780 - DNA, 18 bp, Homo sapiens
ctgcgggaggctggggcc

SEQ ID NO: 4527781 - DNA, 14 bp, Homo sapiens
ctgcgggcccctgg

SEQ ID NO: 4527782 - DNA, 17 bp, Homo sapiens
ctgcgggcccctggtga

SEQ ID NO: 4527783 - DNA, 20 bp, Homo sapiens
ctgcgggcgcgggcagccac

SEQ ID NO: 4527784 - DNA, 22 bp, Homo sapiens
ctgcgggcgcgggcagccaccc

SEQ ID NO: 4527785 - DNA, 23 bp, Homo sapiens
ctgcgggcgcgggcagccaccca

SEQ ID NO: 4527786 - DNA, 13 bp, Homo sapiens
ctgcgtccaccct

SEQ ID NO: 4527787 - DNA, 19 bp, Homo sapiens
ctgcgtccaccctgagctc

SEQ ID NO: 4527788 - DNA, 13 bp, Homo sapiens
ctgcgtcctcctc

SEQ ID NO: 4527789 - DNA, 17 bp, Homo sapiens
ctgcgtcctcctcacct

SEQ ID NO: 4527790 - DNA, 18 bp, Homo sapiens
ctgcgtcctcctcacctc

SEQ ID NO: 4527791 - DNA, 14 bp, Homo sapiens
ctgcgtgggtcaga

SEQ ID NO: 4527792 - DNA, 21 bp, Homo sapiens
ctgcgttttcctagctgtgtt

SEQ ID NO: 4527793 - DNA, 21 bp, Homo sapiens
ctgctaaagggagaaatgcca

SEQ ID NO: 4527794 - DNA, 12 bp, Homo sapiens
ctgctaaatctc

SEQ ID NO: 4527795 - DNA, 17 bp, Homo sapiens
ctgctaaatctcctatt

SEQ ID NO: 4527796 - DNA, 18 bp, Homo sapiens
ctgctaaatctcctattt

SEQ ID NO: 4527797 - DNA, 17 bp, Homo sapiens
ctgctaaccatttatat

SEQ ID NO: 4527798 - DNA, 17 bp, Homo sapiens
ctgctaaggctcctcct

SEQ ID NO: 4527799 - DNA, 15 bp, Homo sapiens
ctgctactcctgtgc

SEQ ID NO: 4527800 - DNA, 17 bp, Homo sapiens
ctgctactcctgtgctc

SEQ ID NO: 4527801 - DNA, 20 bp, Homo sapiens
ctgctacttcactgtcatct

SEQ ID NO: 4527802 - DNA, 12 bp, Homo sapiens
ctgctagaacct

SEQ ID NO: 4527803 - DNA, 22 bp, Homo sapiens
ctgctagagcagacaggcctgg

SEQ ID NO: 4527804 - DNA, 14 bp, Homo sapiens
ctgctagcacagag

SEQ ID NO: 4527805 - DNA, 15 bp, Homo sapiens
ctgctagcacagagg

SEQ ID NO: 4527806 - DNA, 16 bp, Homo sapiens
ctgctagcacagaggc

SEQ ID NO: 4527807 - DNA, 16 bp, Homo sapiens
ctgctaggcgctgggg

SEQ ID NO: 4527808 - DNA, 18 bp, Homo sapiens
ctgctataaagttaaagt

SEQ ID NO: 4527809 - DNA, 16 bp, Homo sapiens
ctgctatccccatctc

SEQ ID NO: 4527810 - DNA, 21 bp, Homo sapiens
ctgctatccccatctccctgc

SEQ ID NO: 4527811 - DNA, 23 bp, Homo sapiens
ctgctatccccatctccctgcct

SEQ ID NO: 4527812 - DNA, 21 bp, Homo sapiens
ctgctcaactctacccctgct

SEQ ID NO: 4527813 - DNA, 22 bp, Homo sapiens
ctgctcaactctacccctgctc

SEQ ID NO: 4527814 - DNA, 16 bp, Homo sapiens
ctgctcaagatatgga

SEQ ID NO: 4527815 - DNA, 16 bp, Homo sapiens
ctgctcaaggccacag

SEQ ID NO: 4527816 - DNA, 15 bp, Homo sapiens
ctgctcacaagttct

SEQ ID NO: 4527817 - DNA, 15 bp, Homo sapiens
ctgctcaccgcccat

SEQ ID NO: 4527818 - DNA, 19 bp, Homo sapiens
ctgctcaccgcccatcagg

SEQ ID NO: 4527819 - DNA, 22 bp, Homo sapiens
ctgctcagcaattcagacccct

SEQ ID NO: 4527820 - DNA, 21 bp, Homo sapiens
ctgctcaggcgtcgctggatt

SEQ ID NO: 4527821 - DNA, 22 bp, Homo sapiens
ctgctcaggcgtcgctggattt

SEQ ID NO: 4527822 - DNA, 20 bp, Homo sapiens
ctgctcagtgcttgggctcc

SEQ ID NO: 4527823 - DNA, 23 bp, Homo sapiens
ctgctcagtgcttgggctccacg

SEQ ID NO: 4527824 - DNA, 14 bp, Homo sapiens
ctgcactttgttta

SEQ ID NO: 4527825 - DNA, 15 bp, Homo sapiens
ctgcactttgtttag

SEQ ID NO: 4527826 - DNA, 18 bp, Homo sapiens
ctgcactttgtttagaaa

SEQ ID NO: 4527827 - DNA, 20 bp, Homo sapiens
ctgcactttgtttagaaaaa

SEQ ID NO: 4527828 - DNA, 15 bp, Homo sapiens
ctgcagaacccacca

SEQ ID NO: 4527829 - DNA, 20 bp, Homo sapiens
ctgcagaacgtattggtcca

SEQ ID NO: 4527830 - DNA, 17 bp, Homo sapiens
ctgcagacacctggact

SEQ ID NO: 4527831 - DNA, 18 bp, Homo sapiens
ctgcagacacctggactg

SEQ ID NO: 4527832 - DNA, 22 bp, Homo sapiens
ctgcagacacctggactgagcc

SEQ ID NO: 4527833 - DNA, 17 bp, Homo sapiens
ctgcagacctggttccc

SEQ ID NO: 4527834 - DNA, 20 bp, Homo sapiens
ctgcagacctgtcctcctgg

SEQ ID NO: 4527835 - DNA, 22 bp, Homo sapiens
ctgcagacctgtcctcctggtg

SEQ ID NO: 4527836 - DNA, 23 bp, Homo sapiens
ctgcagacggatgcccattcctg

SEQ ID NO: 4527837 - DNA, 16 bp, Homo sapiens
ctgcagacttcccagc

SEQ ID NO: 4527838 - DNA, 21 bp, Homo sapiens
ctgcagatgtgcggagcggga

SEQ ID NO: 4527839 - DNA, 24 bp, Homo sapiens
ctgcagattagttctttttgccag

SEQ ID NO: 4527840 - DNA, 21 bp, Homo sapiens
ctgcagattctgagcaaaggc

SEQ ID NO: 4527841 - DNA, 12 bp, Homo sapiens
ctgcagcaactc

SEQ ID NO: 4527842 - DNA, 14 bp, Homo sapiens
ctgcagcaactccc

SEQ ID NO: 4527843 - DNA, 15 bp, Homo sapiens
ctgcagcaactccca

SEQ ID NO: 4527844 - DNA, 16 bp, Homo sapiens
ctgcagcaactcccac

SEQ ID NO: 4527845 - DNA, 14 bp, Homo sapiens
ctgcagcaggcagc

SEQ ID NO: 4527846 - DNA, 15 bp, Homo sapiens
ctgcagcaggcagct

SEQ ID NO: 4527847 - DNA, 15 bp, Homo sapiens
ctgcagccagcccag

SEQ ID NO: 4527848 - DNA, 22 bp, Homo sapiens
ctgcagccagcccagcccagct

SEQ ID NO: 4527849 - DNA, 13 bp, Homo sapiens
ctgcagccagggc

SEQ ID NO: 4527850 - DNA, 15 bp, Homo sapiens
ctgcagccagggctg

SEQ ID NO: 4527851 - DNA, 16 bp, Homo sapiens
ctgcagccagggctgg

SEQ ID NO: 4527852 - DNA, 17 bp, Homo sapiens
ctgcagccagggctggg

SEQ ID NO: 4527853 - DNA, 15 bp, Homo sapiens
ctgcagcctcatact

SEQ ID NO: 4527854 - DNA, 20 bp, Homo sapiens
ctgcagcggctgccctctgg

SEQ ID NO: 4527855 - DNA, 18 bp, Homo sapiens
ctgcaggaatcacccctc

SEQ ID NO: 4527856 - DNA, 13 bp, Homo sapiens
ctgcaggacagag

SEQ ID NO: 4527857 - DNA, 16 bp, Homo sapiens
ctgcaggacagaggga

SEQ ID NO: 4527858 - DNA, 17 bp, Homo sapiens
ctgcaggagagagcagc

SEQ ID NO: 4527859 - DNA, 14 bp, Homo sapiens
ctgcaggcaggaac

SEQ ID NO: 4527860 - DNA, 12 bp, Homo sapiens
ctgcaggctggg

SEQ ID NO: 4527861 - DNA, 14 bp, Homo sapiens
ctgcaggctgggga

SEQ ID NO: 4527862 - DNA, 20 bp, Homo sapiens
ctgcaggctggggaggtgct

SEQ ID NO: 4527863 - DNA, 12 bp, Homo sapiens
ctgcagggaaaa

SEQ ID NO: 4527864 - DNA, 23 bp, Homo sapiens
ctgcagggaaaattatttgcata

SEQ ID NO: 4527865 - DNA, 21 bp, Homo sapiens
ctgcagggagccttctgccac

SEQ ID NO: 4527866 - DNA, 16 bp, Homo sapiens
ctgcagggcttctcct

SEQ ID NO: 4527867 - DNA, 20 bp, Homo sapiens
ctgcaggtcagttgtaataa

SEQ ID NO: 4527868 - DNA, 14 bp, Homo sapiens
ctgcaggttgttca

SEQ ID NO: 4527869 - DNA, 16 bp, Homo sapiens
ctgcagtaaaacacat

SEQ ID NO: 4527870 - DNA, 14 bp, Homo sapiens
ctgcagtaaatctt

SEQ ID NO: 4527871 - DNA, 17 bp, Homo sapiens
ctgcagtaaatctttta

SEQ ID NO: 4527872 - DNA, 23 bp, Homo sapiens
ctgcagtcagccctgattgtgcc

SEQ ID NO: 4527873 - DNA, 18 bp, Homo sapiens
ctgcagtctcatttctca

SEQ ID NO: 4527874 - DNA, 14 bp, Homo sapiens
ctgcagtggctccc

SEQ ID NO: 4527875 - DNA, 16 bp, Homo sapiens
ctgcagttttgctatc

SEQ ID NO: 4527876 - DNA, 15 bp, Homo sapiens
ctgcataatgtttct

SEQ ID NO: 4527877 - DNA, 17 bp, Homo sapiens
ctgcatacaggggaggg

SEQ ID NO: 4527878 - DNA, 18 bp, Homo sapiens
ctgcatacaggggagggg

SEQ ID NO: 4527879 - DNA, 21 bp, Homo sapiens
ctgcatatgttgaatactttt

SEQ ID NO: 4527880 - DNA, 21 bp, Homo sapiens
ctgcatccagagattcatttt

SEQ ID NO: 4527881 - DNA, 19 bp, Homo sapiens
ctgcatcccacgttctgtt

SEQ ID NO: 4527882 - DNA, 19 bp, Homo sapiens
ctgcatccgtagttccctg

SEQ ID NO: 4527883 - DNA, 21 bp, Homo sapiens
ctgcatcctggcttgaaaaac

SEQ ID NO: 4527884 - DNA, 15 bp, Homo sapiens
ctgcatgacctacca

SEQ ID NO: 4527885 - DNA, 20 bp, Homo sapiens
ctgcatgacctaccaggaca

SEQ ID NO: 4527886 - DNA, 16 bp, Homo sapiens
ctgcatgcggcccagc

SEQ ID NO: 4527887 - DNA, 17 bp, Homo sapiens
ctgcatgcggcccagcc

SEQ ID NO: 4527888 - DNA, 20 bp, Homo sapiens
ctgcatgcggcccagcccgg

SEQ ID NO: 4527889 - DNA, 15 bp, Homo sapiens
ctgcatggtaattta

SEQ ID NO: 4527890 - DNA, 19 bp, Homo sapiens
ctgcatggtaatttatagt

SEQ ID NO: 4527891 - DNA, 20 bp, Homo sapiens
ctgcatggtaatttatagtt

SEQ ID NO: 4527892 - DNA, 23 bp, Homo sapiens
ctgcattactattaactctgcat

SEQ ID NO: 4527893 - DNA, 16 bp, Homo sapiens
ctgcattcctgtgccc

SEQ ID NO: 4527894 - DNA, 23 bp, Homo sapiens
ctgcattgagcttgcatgcttgc

SEQ ID NO: 4527895 - DNA, 15 bp, Homo sapiens
ctgcatttacagtgt

SEQ ID NO: 4527896 - DNA, 20 bp, Homo sapiens
ctgcatttaccactgtatat

SEQ ID NO: 4527897 - DNA, 15 bp, Homo sapiens
ctgcatttcatatta

SEQ ID NO: 4527898 - DNA, 17 bp, Homo sapiens
ctgcatttgcctgcttc

SEQ ID NO: 4527899 - DNA, 18 bp, Homo sapiens
ctgcatttgcctgcttct

SEQ ID NO: 4527900 - DNA, 19 bp, Homo sapiens
ctgcatttgcctgcttctt

SEQ ID NO: 4527901 - DNA, 14 bp, Homo sapiens
ctgccaaaatgcaa

SEQ ID NO: 4527902 - DNA, 15 bp, Homo sapiens
ctgccaaaatgcaac

SEQ ID NO: 4527903 - DNA, 16 bp, Homo sapiens
ctgccaaacctcctgt

SEQ ID NO: 4527904 - DNA, 19 bp, Homo sapiens
ctgccaaacctcctgtcag

SEQ ID NO: 4527905 - DNA, 17 bp, Homo sapiens
ctgccaaagtaaaacaa

SEQ ID NO: 4527906 - DNA, 16 bp, Homo sapiens
ctgccaacctaaaact

SEQ ID NO: 4527907 - DNA, 21 bp, Homo sapiens
ctgccaaggccagagtggcct

SEQ ID NO: 4527908 - DNA, 16 bp, Homo sapiens
ctgccaagtcagttct

SEQ ID NO: 4527909 - DNA, 17 bp, Homo sapiens
ctgccaataacattctt

SEQ ID NO: 4527910 - DNA, 23 bp, Homo sapiens
ctgccaattgctaccgagaaggt

SEQ ID NO: 4527911 - DNA, 19 bp, Homo sapiens
ctgccacaaaccaccagga

SEQ ID NO: 4527912 - DNA, 22 bp, Homo sapiens
ctgccacacggaagcaagcaga

SEQ ID NO: 4527913 - DNA, 14 bp, Homo sapiens
ctgccacagccaga

SEQ ID NO: 4527914 - DNA, 22 bp, Homo sapiens
ctgccacagcctcccctgccag

SEQ ID NO: 4527915 - DNA, 14 bp, Homo sapiens
ctgccacatggagc

SEQ ID NO: 4527916 - DNA, 19 bp, Homo sapiens
ctgccacatggagccccct

SEQ ID NO: 4527917 - DNA, 23 bp, Homo sapiens
ctgccaccggaggtcactccacc

SEQ ID NO: 4527918 - DNA, 22 bp, Homo sapiens
ctgccacctcccctatccaccc

SEQ ID NO: 4527919 - DNA, 17 bp, Homo sapiens
ctgccacctctccatcc

SEQ ID NO: 4527920 - DNA, 15 bp, Homo sapiens
ctgccactcacacag

SEQ ID NO: 4527921 - DNA, 18 bp, Homo sapiens
ctgccactcacacagcca

SEQ ID NO: 4527922 - DNA, 16 bp, Homo sapiens
ctgccactctctggga

SEQ ID NO: 4527923 - DNA, 17 bp, Homo sapiens
ctgccactctctgggac

SEQ ID NO: 4527924 - DNA, 18 bp, Homo sapiens
ctgccactctctgggact

SEQ ID NO: 4527925 - DNA, 23 bp, Homo sapiens
ctgccactctctgggactctcct

SEQ ID NO: 4527926 - DNA, 21 bp, Homo sapiens
ctgccagaagatcccctcagg

SEQ ID NO: 4527927 - DNA, 16 bp, Homo sapiens
ctgccagaatctagag

SEQ ID NO: 4527928 - DNA, 15 bp, Homo sapiens
ctgccagcaacgcag

SEQ ID NO: 4527929 - DNA, 16 bp, Homo sapiens
ctgccagccactgtca

SEQ ID NO: 4527930 - DNA, 19 bp, Homo sapiens
ctgccagcccacccccttt

SEQ ID NO: 4527931 - DNA, 15 bp, Homo sapiens
ctgccagccttgagc

SEQ ID NO: 4527932 - DNA, 17 bp, Homo sapiens
ctgccagccttgagccc

SEQ ID NO: 4527933 - DNA, 22 bp, Homo sapiens
ctgccagccttgagccctggct

SEQ ID NO: 4527934 - DNA, 19 bp, Homo sapiens
ctgccagctggatcgctgc

SEQ ID NO: 4527935 - DNA, 20 bp, Homo sapiens
ctgccagctggatcgctgca

SEQ ID NO: 4527936 - DNA, 21 bp, Homo sapiens
ctgccagctggatcgctgcac

SEQ ID NO: 4527937 - DNA, 16 bp, Homo sapiens
ctgccaggagacaggt

SEQ ID NO: 4527938 - DNA, 20 bp, Homo sapiens
ctgccaggcaggggtggggg

SEQ ID NO: 4527939 - DNA, 17 bp, Homo sapiens
ctgccaggccagcctcc

SEQ ID NO: 4527940 - DNA, 20 bp, Homo sapiens
ctgccaggccagcctccgag

SEQ ID NO: 4527941 - DNA, 23 bp, Homo sapiens
ctgccaggccagcctccgagagg

SEQ ID NO: 4527942 - DNA, 16 bp, Homo sapiens
ctgccaggctgcctcc

SEQ ID NO: 4527943 - DNA, 20 bp, Homo sapiens
ctgccaggctgcctcctgcc

SEQ ID NO: 4527944 - DNA, 23 bp, Homo sapiens
ctggcaaacagggcctctgcgga

SEQ ID NO: 4527945 - DNA, 16 bp, Homo sapiens
ctggcaaagaactcat

SEQ ID NO: 4527946 - DNA, 16 bp, Homo sapiens
ctggcaacacagaggc

SEQ ID NO: 4527947 - DNA, 14 bp, Homo sapiens
ctggcaacatcttt

SEQ ID NO: 4527948 - DNA, 17 bp, Homo sapiens
ctggcaacatctttatc

SEQ ID NO: 4527949 - DNA, 20 bp, Homo sapiens
ctggcaaggactttgtacat

SEQ ID NO: 4527950 - DNA, 14 bp, Homo sapiens
ctggcacagcccct

SEQ ID NO: 4527951 - DNA, 15 bp, Homo sapiens
ctggcacagcccctg

SEQ ID NO: 4527952 - DNA, 16 bp, Homo sapiens
ctggcacagcctggct

SEQ ID NO: 4527953 - DNA, 23 bp, Homo sapiens
ctggcacagcctggctgtggcct

SEQ ID NO: 4527954 - DNA, 21 bp, Homo sapiens
ctggcacattgcccctctgcc

SEQ ID NO: 4527955 - DNA, 15 bp, Homo sapiens
ctggcactattataa

SEQ ID NO: 4527956 - DNA, 19 bp, Homo sapiens
ctggcacttagcccaagag

SEQ ID NO: 4527957 - DNA, 23 bp, Homo sapiens
ctggcacttagcccaagaggtct

SEQ ID NO: 4527958 - DNA, 20 bp, Homo sapiens
ctggcagagaggtaaagggt

SEQ ID NO: 4527959 - DNA, 12 bp, Homo sapiens
ctggcagctgag

SEQ ID NO: 4527960 - DNA, 12 bp, Homo sapiens
ctggcagctgct

SEQ ID NO: 4527961 - DNA, 19 bp, Homo sapiens
ctggcaggggagacaggag

SEQ ID NO: 4527962 - DNA, 19 bp, Homo sapiens
ctggcagtccgtgggacgg

SEQ ID NO: 4527963 - DNA, 17 bp, Homo sapiens
ctggcatcgcagcttcc

SEQ ID NO: 4527964 - DNA, 20 bp, Homo sapiens
ctggcatcgtgtattccata

SEQ ID NO: 4527965 - DNA, 21 bp, Homo sapiens
ctggcatcgtgtattccatat

SEQ ID NO: 4527966 - DNA, 17 bp, Homo sapiens
ctggcatgtcatttgca

SEQ ID NO: 4527967 - DNA, 17 bp, Homo sapiens
ctggccacccctcccca

SEQ ID NO: 4527968 - DNA, 14 bp, Homo sapiens
ctggccagacgctg

SEQ ID NO: 4527969 - DNA, 21 bp, Homo sapiens
ctggccagcaccctctcctgg

SEQ ID NO: 4527970 - DNA, 13 bp, Homo sapiens
ctggccaggcaga

SEQ ID NO: 4527971 - DNA, 14 bp, Homo sapiens
ctggccaggcagat

SEQ ID NO: 4527972 - DNA, 23 bp, Homo sapiens
ctggccagggccacgctccagct

SEQ ID NO: 4527973 - DNA, 17 bp, Homo sapiens
ctggccagtgctgccca

SEQ ID NO: 4527974 - DNA, 21 bp, Homo sapiens
ctggccagtggctggatctgt

SEQ ID NO: 4527975 - DNA, 13 bp, Homo sapiens
ctggccagtgttt

SEQ ID NO: 4527976 - DNA, 17 bp, Homo sapiens
ctggcccacccagtcca

SEQ ID NO: 4527977 - DNA, 17 bp, Homo sapiens
ctggcccagccctgctg

SEQ ID NO: 4527978 - DNA, 19 bp, Homo sapiens
ctggcccagccctgctggc

SEQ ID NO: 4527979 - DNA, 17 bp, Homo sapiens
ctggcccagggcatctg

SEQ ID NO: 4527980 - DNA, 18 bp, Homo sapiens
ctggcccagggcatctgg

SEQ ID NO: 4527981 - DNA, 13 bp, Homo sapiens
ctggcccaggtgc

SEQ ID NO: 4527982 - DNA, 13 bp, Homo sapiens
ctggccccagcct

SEQ ID NO: 4527983 - DNA, 14 bp, Homo sapiens
ctggccccagcctg

SEQ ID NO: 4527984 - DNA, 18 bp, Homo sapiens
ctggccccagcctgggcc

SEQ ID NO: 4527985 - DNA, 21 bp, Homo sapiens
ctggccccaggccccagacag

SEQ ID NO: 4527986 - DNA, 13 bp, Homo sapiens
ctggcccccacag

SEQ ID NO: 4527987 - DNA, 16 bp, Homo sapiens
ctggcccccatcagcc

SEQ ID NO: 4527988 - DNA, 19 bp, Homo sapiens
ctggcccccatcagccctg

SEQ ID NO: 4527989 - DNA, 21 bp, Homo sapiens
ctggcccccatcagccctgct

SEQ ID NO: 4527990 - DNA, 21 bp, Homo sapiens
ctggccctccactcctcatcc

SEQ ID NO: 4527991 - DNA, 12 bp, Homo sapiens
ctggccctgctt

SEQ ID NO: 4527992 - DNA, 13 bp, Homo sapiens
ctggcccttagag

SEQ ID NO: 4527993 - DNA, 15 bp, Homo sapiens
ctggccgacccactg

SEQ ID NO: 4527994 - DNA, 17 bp, Homo sapiens
ctggccgacccactgac

SEQ ID NO: 4527995 - DNA, 13 bp, Homo sapiens
ctggccgcagagg

SEQ ID NO: 4527996 - DNA, 14 bp, Homo sapiens
ctggccgcctcacc

SEQ ID NO: 4527997 - DNA, 18 bp, Homo sapiens
ctggccgcgccaaataat

SEQ ID NO: 4527998 - DNA, 15 bp, Homo sapiens
ctggccgctgagcgc

SEQ ID NO: 4527999 - DNA, 20 bp, Homo sapiens
ctggccgggactgctgctct

SEQ ID NO: 4528000 - DNA, 21 bp, Homo sapiens
ctggccgggactgctgctctc

SEQ ID NO: 4528001 - DNA, 20 bp, Homo sapiens
ctggcctcatctcagaccct

SEQ ID NO: 4528002 - DNA, 18 bp, Homo sapiens
ctggcctcccgccactcg

SEQ ID NO: 4528003 - DNA, 16 bp, Homo sapiens
ctggcctccgcctggg

SEQ ID NO: 4528004 - DNA, 17 bp, Homo sapiens
ctggcctgaactgagga

SEQ ID NO: 4528005 - DNA, 16 bp, Homo sapiens
ctggcctgccagtctg

SEQ ID NO: 4528006 - DNA, 15 bp, Homo sapiens
ctggcctgctgggct

SEQ ID NO: 4528007 - DNA, 19 bp, Homo sapiens
ctggccttctgaactccat

SEQ ID NO: 4528008 - DNA, 14 bp, Homo sapiens
ctggcctttcatgg

SEQ ID NO: 4528009 - DNA, 19 bp, Homo sapiens
ctggcctttttcatttatc

SEQ ID NO: 4528010 - DNA, 22 bp, Homo sapiens
ctggcgacacgtagcagcttag

SEQ ID NO: 4528011 - DNA, 16 bp, Homo sapiens
ctggcgcccctgcctg

SEQ ID NO: 4528012 - DNA, 14 bp, Homo sapiens
ctggcgcctctgca

SEQ ID NO: 4528013 - DNA, 20 bp, Homo sapiens
ctggcgcctctgcaagggca

SEQ ID NO: 4528014 - DNA, 13 bp, Homo sapiens
ctggcgctcagca

SEQ ID NO: 4528015 - DNA, 16 bp, Homo sapiens
ctggcgcttggatctg

SEQ ID NO: 4528016 - DNA, 16 bp, Homo sapiens
ctggcggctactcagc

SEQ ID NO: 4528017 - DNA, 17 bp, Homo sapiens
ctggcggctactcagca

SEQ ID NO: 4528018 - DNA, 18 bp, Homo sapiens
ctggcgggcctttttcct

SEQ ID NO: 4528019 - DNA, 22 bp, Homo sapiens
ctggcgttctcaagaatctaga

SEQ ID NO: 4528020 - DNA, 13 bp, Homo sapiens
ctggctaaagctc

SEQ ID NO: 4528021 - DNA, 17 bp, Homo sapiens
ctggctagagtcctcac

SEQ ID NO: 4528022 - DNA, 19 bp, Homo sapiens
ctggctagagtcctcactc

SEQ ID NO: 4528023 - DNA, 20 bp, Homo sapiens
ctggctagagtcctcactcc

SEQ ID NO: 4528024 - DNA, 22 bp, Homo sapiens
ctggctagagtcctcactccca

SEQ ID NO: 4528025 - DNA, 13 bp, Homo sapiens
ctggctcacccag

SEQ ID NO: 4528026 - DNA, 14 bp, Homo sapiens
ctggctcaggagga

SEQ ID NO: 4528027 - DNA, 14 bp, Homo sapiens
ctggctccactctt

SEQ ID NO: 4528028 - DNA, 22 bp, Homo sapiens
ctggctccagtctcatcctccc

SEQ ID NO: 4528029 - DNA, 17 bp, Homo sapiens
ctggctccagtgaaact

SEQ ID NO: 4528030 - DNA, 17 bp, Homo sapiens
ctggctccccctcccca

SEQ ID NO: 4528031 - DNA, 20 bp, Homo sapiens
ctggctccccctccccaggc

SEQ ID NO: 4528032 - DNA, 21 bp, Homo sapiens
ctggctccccctccccaggct

SEQ ID NO: 4528033 - DNA, 22 bp, Homo sapiens
ctggctccccctccccaggctg

SEQ ID NO: 4528034 - DNA, 22 bp, Homo sapiens
ctggctccctcctccaggcctg

SEQ ID NO: 4528035 - DNA, 23 bp, Homo sapiens
ctggctcggacccaccccaactc

SEQ ID NO: 4528036 - DNA, 15 bp, Homo sapiens
ctggctctaattcac

SEQ ID NO: 4528037 - DNA, 17 bp, Homo sapiens
ctggctctaccttcctg

SEQ ID NO: 4528038 - DNA, 14 bp, Homo sapiens
ctggctctgccccc

SEQ ID NO: 4528039 - DNA, 18 bp, Homo sapiens
ctggctctgccccctccc

SEQ ID NO: 4528040 - DNA, 20 bp, Homo sapiens
ctggctctgccccctccccc

SEQ ID NO: 4528041 - DNA, 16 bp, Homo sapiens
ctggctctgcctcagg

SEQ ID NO: 4528042 - DNA, 13 bp, Homo sapiens
ctggctctgtggc

SEQ ID NO: 4528043 - DNA, 15 bp, Homo sapiens
ctggctgctgccccc

SEQ ID NO: 4528044 - DNA, 16 bp, Homo sapiens
ctggctgctgccccca

SEQ ID NO: 4528045 - DNA, 19 bp, Homo sapiens
ctggctgctgcccccaccc

SEQ ID NO: 4528046 - DNA, 21 bp, Homo sapiens
ctggctggaggagcagcagct

SEQ ID NO: 4528047 - DNA, 17 bp, Homo sapiens
ctggctggcctcaccca

SEQ ID NO: 4528048 - DNA, 18 bp, Homo sapiens
ctggctggtgggccccca

SEQ ID NO: 4528049 - DNA, 19 bp, Homo sapiens
ctggctgtcagtatgacat

SEQ ID NO: 4528050 - DNA, 14 bp, Homo sapiens
ctggctgtcctacc

SEQ ID NO: 4528051 - DNA, 18 bp, Homo sapiens
ctggctgtgaatgccaaa

SEQ ID NO: 4528052 - DNA, 21 bp, Homo sapiens
ctggctgtttggactttgtat

SEQ ID NO: 4528053 - DNA, 21 bp, Homo sapiens
ctggcttctgtggggcccctc

SEQ ID NO: 4528054 - DNA, 16 bp, Homo sapiens
ctggctttcccaggag

SEQ ID NO: 4528055 - DNA, 19 bp, Homo sapiens
ctggctttgaaacctcagg

SEQ ID NO: 4528056 - DNA, 12 bp, Homo sapiens
ctggctttgcct

SEQ ID NO: 4528057 - DNA, 17 bp, Homo sapiens
ctggctttgcctcttct

SEQ ID NO: 4528058 - DNA, 15 bp, Homo sapiens
ctggctttggcactc

SEQ ID NO: 4528059 - DNA, 22 bp, Homo sapiens
ctggctttggcactctctgcca

SEQ ID NO: 4528060 - DNA, 21 bp, Homo sapiens
ctggcttttgcctgtaagaaa

SEQ ID NO: 4528061 - DNA, 19 bp, Homo sapiens
ctgggaaaatccactatga

SEQ ID NO: 4528062 - DNA, 16 bp, Homo sapiens
ctgggaaatgaggttt

SEQ ID NO: 4528063 - DNA, 22 bp, Homo sapiens
ctgggaacccaagtccaagcat

SEQ ID NO: 4528064 - DNA, 21 bp, Homo sapiens
ctgggaactgcagacctgtcc

SEQ ID NO: 4528065 - DNA, 23 bp, Homo sapiens
ctgggaactgcagacctgtcctc

SEQ ID NO: 4528066 - DNA, 22 bp, Homo sapiens
ctgggaagagaagagggcccag

SEQ ID NO: 4528067 - DNA, 13 bp, Homo sapiens
ctgggaaggcctc

SEQ ID NO: 4528068 - DNA, 15 bp, Homo sapiens
ctgggaatgggagag

SEQ ID NO: 4528069 - DNA, 16 bp, Homo sapiens
ctgggaatgggagagg

SEQ ID NO: 4528070 - DNA, 15 bp, Homo sapiens
ctgggaatttatata

SEQ ID NO: 4528071 - DNA, 19 bp, Homo sapiens
ctgggacacagacccagga

SEQ ID NO: 4528072 - DNA, 23 bp, Homo sapiens
ctgggacagtttatcatgaagcc

SEQ ID NO: 4528073 - DNA, 19 bp, Homo sapiens
ctgggacccttaggatggg

SEQ ID NO: 4528074 - DNA, 20 bp, Homo sapiens
ctgggaccctttccttcctt

SEQ ID NO: 4528075 - DNA, 19 bp, Homo sapiens
ctgggacctgccaggcagg

SEQ ID NO: 4528076 - DNA, 19 bp, Homo sapiens
ctgggacggaccagcatct

SEQ ID NO: 4528077 - DNA, 21 bp, Homo sapiens
ctgggactacaggcgcccgcc

SEQ ID NO: 4528078 - DNA, 22 bp, Homo sapiens
ctgggactacaggctcatgcca

SEQ ID NO: 4528079 - DNA, 16 bp, Homo sapiens
ctgggactacaggtgc

SEQ ID NO: 4528080 - DNA, 21 bp, Homo sapiens
ctgggactctcctcctcccct

SEQ ID NO: 4528081 - DNA, 15 bp, Homo sapiens
ctgggactgtgcctg

SEQ ID NO: 4528082 - DNA, 16 bp, Homo sapiens
ctgggactgtgcctgg

SEQ ID NO: 4528083 - DNA, 18 bp, Homo sapiens
ctgggactgtgcctggct

SEQ ID NO: 4528084 - DNA, 23 bp, Homo sapiens
ctgggactgtgcctggctccctg

SEQ ID NO: 4528085 - DNA, 17 bp, Homo sapiens
ctgggacttgaacaaag

SEQ ID NO: 4528086 - DNA, 23 bp, Homo sapiens
ctgggacttgaacaaagacattt

SEQ ID NO: 4528087 - DNA, 13 bp, Homo sapiens
ctgggagagaagt

SEQ ID NO: 4528088 - DNA, 17 bp, Homo sapiens
ctgggagccacttctcc

SEQ ID NO: 4528089 - DNA, 18 bp, Homo sapiens
ctgggagccacttctccc

SEQ ID NO: 4528090 - DNA, 19 bp, Homo sapiens
ctgggagccacttctcccc

SEQ ID NO: 4528091 - DNA, 15 bp, Homo sapiens
ctgggagccagtcct

SEQ ID NO: 4528092 - DNA, 18 bp, Homo sapiens
ctgggaggaaccgagggg

SEQ ID NO: 4528093 - DNA, 14 bp, Homo sapiens
ctgggaggacaggc

SEQ ID NO: 4528094 - DNA, 15 bp, Homo sapiens
ctgggaggagggaga

SEQ ID NO: 4528095 - DNA, 20 bp, Homo sapiens
ctgggaggagggagagggag

SEQ ID NO: 4528096 - DNA, 13 bp, Homo sapiens
ctgggagggcagc

SEQ ID NO: 4528097 - DNA, 15 bp, Homo sapiens
ctgggagggcagcag

SEQ ID NO: 4528098 - DNA, 17 bp, Homo sapiens
ctgggagggcagcaggg

SEQ ID NO: 4528099 - DNA, 14 bp, Homo sapiens
ctgggagtcacaca

SEQ ID NO: 4528100 - DNA, 16 bp, Homo sapiens
ctgggagtcacacagt

SEQ ID NO: 4528101 - DNA, 15 bp, Homo sapiens
ctgggatatggctgc

SEQ ID NO: 4528102 - DNA, 21 bp, Homo sapiens
ctgggatcctgactaagcctt

SEQ ID NO: 4528103 - DNA, 22 bp, Homo sapiens
ctgggatgacaggcgcctgcca

SEQ ID NO: 4528104 - DNA, 18 bp, Homo sapiens
ctgggatggtgactcctg

SEQ ID NO: 4528105 - DNA, 14 bp, Homo sapiens
ctgggattaagaaa

SEQ ID NO: 4528106 - DNA, 19 bp, Homo sapiens
ctgggattaagaaaccttg

SEQ ID NO: 4528107 - DNA, 21 bp, Homo sapiens
ctgggattaaggcgtgagcca

SEQ ID NO: 4528108 - DNA, 13 bp, Homo sapiens
ctgggattacagg

SEQ ID NO: 4528109 - DNA, 17 bp, Homo sapiens
ctgggcaaggaaaaaga

SEQ ID NO: 4528110 - DNA, 18 bp, Homo sapiens
ctgggcaccacaaaatat

SEQ ID NO: 4528111 - DNA, 19 bp, Homo sapiens
ctgggcacgcctgctggcc

SEQ ID NO: 4528112 - DNA, 21 bp, Homo sapiens
ctgggcacgcctgctggccga

SEQ ID NO: 4528113 - DNA, 19 bp, Homo sapiens
ctgggcactggggcctcag

SEQ ID NO: 4528114 - DNA, 13 bp, Homo sapiens
ctgggcagaggga

SEQ ID NO: 4528115 - DNA, 18 bp, Homo sapiens
ctgggcagcacctctggt

SEQ ID NO: 4528116 - DNA, 15 bp, Homo sapiens
ctgggcagccaggct

SEQ ID NO: 4528117 - DNA, 21 bp, Homo sapiens
ctgggcagtgagtgccatgct

SEQ ID NO: 4528118 - DNA, 18 bp, Homo sapiens
ctgggcattttcctcctc

SEQ ID NO: 4528119 - DNA, 19 bp, Homo sapiens
ctgggcattttcctcctct

SEQ ID NO: 4528120 - DNA, 22 bp, Homo sapiens
ctgggccaattcaatacaaaca

SEQ ID NO: 4528121 - DNA, 12 bp, Homo sapiens
ctgggccactgg

SEQ ID NO: 4528122 - DNA, 18 bp, Homo sapiens
ctgggccacttctgggtg

SEQ ID NO: 4528123 - DNA, 12 bp, Homo sapiens
ctgggccagtca

SEQ ID NO: 4528124 - DNA, 21 bp, Homo sapiens
ctgggccagtcaacggggggc

SEQ ID NO: 4528125 - DNA, 13 bp, Homo sapiens
ctgggccatctct

SEQ ID NO: 4528126 - DNA, 18 bp, Homo sapiens
ctgggccatgtccaaaga

SEQ ID NO: 4528127 - DNA, 19 bp, Homo sapiens
ctgggcccaaccctgtctg

SEQ ID NO: 4528128 - DNA, 18 bp, Homo sapiens
ctgggccccaccacctag

SEQ ID NO: 4528129 - DNA, 15 bp, Homo sapiens
ctgggccccagccca

SEQ ID NO: 4528130 - DNA, 18 bp, Homo sapiens
ctgggccccagcccaccc

SEQ ID NO: 4528131 - DNA, 20 bp, Homo sapiens
ctgggccccagcccaccctc

SEQ ID NO: 4528132 - DNA, 21 bp, Homo sapiens
ctgggccccagcccaccctcc

SEQ ID NO: 4528133 - DNA, 17 bp, Homo sapiens
ctgggcccctccacgcc

SEQ ID NO: 4528134 - DNA, 21 bp, Homo sapiens
ctgggcccctccacgcctcct

SEQ ID NO: 4528135 - DNA, 17 bp, Homo sapiens
ctgggcccctgggatgg

SEQ ID NO: 4528136 - DNA, 14 bp, Homo sapiens
ctgggcccgagcct

SEQ ID NO: 4528137 - DNA, 13 bp, Homo sapiens
ctgggccctctct

SEQ ID NO: 4528138 - DNA, 15 bp, Homo sapiens
ctgggccctctctgc

SEQ ID NO: 4528139 - DNA, 16 bp, Homo sapiens
ctgggccctctttccc

SEQ ID NO: 4528140 - DNA, 20 bp, Homo sapiens
ctgggccctctttccctgcg

SEQ ID NO: 4528141 - DNA, 23 bp, Homo sapiens
ctgggccctctttccctgcgaga

SEQ ID NO: 4528142 - DNA, 13 bp, Homo sapiens
ctgggccctgcct

SEQ ID NO: 4528143 - DNA, 14 bp, Homo sapiens
ctgggccctgcctg

SEQ ID NO: 4528144 - DNA, 19 bp, Homo sapiens
ctgggccctgcctgcagcc

SEQ ID NO: 4528145 - DNA, 12 bp, Homo sapiens
ctgggccctggg

SEQ ID NO: 4528146 - DNA, 19 bp, Homo sapiens
ctgggccctgggctggcac

SEQ ID NO: 4528147 - DNA, 17 bp, Homo sapiens
ctgggccctgtcgcccc

SEQ ID NO: 4528148 - DNA, 22 bp, Homo sapiens
ctgggccctgtcgcccctcctt

SEQ ID NO: 4528149 - DNA, 16 bp, Homo sapiens
ctgggcctttgcaaga

SEQ ID NO: 4528150 - DNA, 17 bp, Homo sapiens
ctgggcctttgcaagat

SEQ ID NO: 4528151 - DNA, 14 bp, Homo sapiens
ctgggccttttaac

SEQ ID NO: 4528152 - DNA, 23 bp, Homo sapiens
ctgggctcaaatgatcctcccac

SEQ ID NO: 4528153 - DNA, 21 bp, Homo sapiens
ctgggctcaagcaatcctcct

SEQ ID NO: 4528154 - DNA, 21 bp, Homo sapiens
ctgggctcggaggctgccccc

SEQ ID NO: 4528155 - DNA, 12 bp, Homo sapiens
ctgggctctcca

SEQ ID NO: 4528156 - DNA, 15 bp, Homo sapiens
ctgggctctccacct

SEQ ID NO: 4528157 - DNA, 16 bp, Homo sapiens
ctgggctctccacctc

SEQ ID NO: 4528158 - DNA, 21 bp, Homo sapiens
ctgggctctccacctcagcct

SEQ ID NO: 4528159 - DNA, 12 bp, Homo sapiens
ctgggctctgtc

SEQ ID NO: 4528160 - DNA, 12 bp, Homo sapiens
ctgggctgaggg

SEQ ID NO: 4528161 - DNA, 13 bp, Homo sapiens
ctgggctgaggga

SEQ ID NO: 4528162 - DNA, 19 bp, Homo sapiens
ctgggctgagggagcctgg

SEQ ID NO: 4528163 - DNA, 23 bp, Homo sapiens
ctgggctgagggagcctggcccc

SEQ ID NO: 4528164 - DNA, 15 bp, Homo sapiens
ctgggctgccaccag

SEQ ID NO: 4528165 - DNA, 12 bp, Homo sapiens
ctgggctggcac

SEQ ID NO: 4528166 - DNA, 18 bp, Homo sapiens
ctgggctggcacagcccc

SEQ ID NO: 4528167 - DNA, 21 bp, Homo sapiens
ctgggctggcacagcccctgg

SEQ ID NO: 4528168 - DNA, 21 bp, Homo sapiens
ctgggctgggccctctttccc

SEQ ID NO: 4528169 - DNA, 12 bp, Homo sapiens
ctgggctggggc

SEQ ID NO: 4528170 - DNA, 13 bp, Homo sapiens
ctgggctggggcc

SEQ ID NO: 4528171 - DNA, 21 bp, Homo sapiens
ctgggctggggccacctttgt

SEQ ID NO: 4528172 - DNA, 13 bp, Homo sapiens
ctgggctgtctgt

SEQ ID NO: 4528173 - DNA, 18 bp, Homo sapiens
ctgggctgtctgtcacca

SEQ ID NO: 4528174 - DNA, 15 bp, Homo sapiens
ctgggctgtgggcaa

SEQ ID NO: 4528175 - DNA, 19 bp, Homo sapiens
ctgggcttcatctggcaac

SEQ ID NO: 4528176 - DNA, 18 bp, Homo sapiens
ctgggcttggcctgctgt

SEQ ID NO: 4528177 - DNA, 17 bp, Homo sapiens
ctgggcttggggtgtgg

SEQ ID NO: 4528178 - DNA, 15 bp, Homo sapiens
ctggggaagaacagc

SEQ ID NO: 4528179 - DNA, 16 bp, Homo sapiens
ctggggaatgctccca

SEQ ID NO: 4528180 - DNA, 19 bp, Homo sapiens
ctggggacacacattctgc

SEQ ID NO: 4528181 - DNA, 22 bp, Homo sapiens
ctggggacacacattctgcctt

SEQ ID NO: 4528182 - DNA, 17 bp, Homo sapiens
ctggggacggggggccc

SEQ ID NO: 4528183 - DNA, 19 bp, Homo sapiens
ctggggacggggggcccca

SEQ ID NO: 4528184 - DNA, 23 bp, Homo sapiens
ctggggacggggggccccagtca

SEQ ID NO: 4528185 - DNA, 23 bp, Homo sapiens
ctggggacgttgctgagccagct

SEQ ID NO: 4528186 - DNA, 14 bp, Homo sapiens
ctggggactcaggg

SEQ ID NO: 4528187 - DNA, 20 bp, Homo sapiens
ctggggactgctacctctga

SEQ ID NO: 4528188 - DNA, 13 bp, Homo sapiens
ctggggacttgtg

SEQ ID NO: 4528189 - DNA, 17 bp, Homo sapiens
ctggggacttgtgtctg

SEQ ID NO: 4528190 - DNA, 21 bp, Homo sapiens
ctggggactttatttatttct

SEQ ID NO: 4528191 - DNA, 23 bp, Homo sapiens
ctggggactttatttatttctag

SEQ ID NO: 4528192 - DNA, 14 bp, Homo sapiens
ctggggagctcctg

SEQ ID NO: 4528193 - DNA, 17 bp, Homo sapiens
ctggggagctcctggga

SEQ ID NO: 4528194 - DNA, 22 bp, Homo sapiens
ctggggaggaatcctggaccaa

SEQ ID NO: 4528195 - DNA, 22 bp, Homo sapiens
ctggggaggccctaggggagca

SEQ ID NO: 4528196 - DNA, 21 bp, Homo sapiens
ctggggagtaaacggcccagg

SEQ ID NO: 4528197 - DNA, 20 bp, Homo sapiens
ctggggagtggttaggcagc

SEQ ID NO: 4528198 - DNA, 17 bp, Homo sapiens
ctggggatcttcccaca

SEQ ID NO: 4528199 - DNA, 19 bp, Homo sapiens
ctggggatcttcccacagg

SEQ ID NO: 4528200 - DNA, 22 bp, Homo sapiens
ctggggatgtctctcatgacca

SEQ ID NO: 4528201 - DNA, 21 bp, Homo sapiens
ctggggcaggctgggccatgt

SEQ ID NO: 4528202 - DNA, 20 bp, Homo sapiens
ctggggccacctttgtgcag

SEQ ID NO: 4528203 - DNA, 13 bp, Homo sapiens
ctggggccccatc

SEQ ID NO: 4528204 - DNA, 14 bp, Homo sapiens
ctggggccctgggc

SEQ ID NO: 4528205 - DNA, 13 bp, Homo sapiens
ctggggctgagtc

SEQ ID NO: 4528206 - DNA, 16 bp, Homo sapiens
ctgggggaagccctgg

SEQ ID NO: 4528207 - DNA, 14 bp, Homo sapiens
ctgggggcaggagg

SEQ ID NO: 4528208 - DNA, 19 bp, Homo sapiens
ctggggggcaattttgcac

SEQ ID NO: 4528209 - DNA, 14 bp, Homo sapiens
ctgggggtgccagg

SEQ ID NO: 4528210 - DNA, 13 bp, Homo sapiens
ctgggggtggcag

SEQ ID NO: 4528211 - DNA, 14 bp, Homo sapiens
ctgggggtgggaag

SEQ ID NO: 4528212 - DNA, 16 bp, Homo sapiens
ctggggtgcagcttca

SEQ ID NO: 4528213 - DNA, 17 bp, Homo sapiens
ctggggtgccgcctgcc

SEQ ID NO: 4528214 - DNA, 16 bp, Homo sapiens
ctggggtggccaccag

SEQ ID NO: 4528215 - DNA, 22 bp, Homo sapiens
ctggggtgggagtaacagggca

SEQ ID NO: 4528216 - DNA, 18 bp, Homo sapiens
ctggggtgggcagttttt

SEQ ID NO: 4528217 - DNA, 10 bp, Homo sapiens
ctggggtgtc

SEQ ID NO: 4528218 - DNA, 19 bp, Homo sapiens
ctggggttcagcccctcct

SEQ ID NO: 4528219 - DNA, 15 bp, Homo sapiens
ctggggttgccagag

SEQ ID NO: 4528220 - DNA, 16 bp, Homo sapiens
ctggggttgccagagg

SEQ ID NO: 4528221 - DNA, 14 bp, Homo sapiens
ctgggtaagaagaa

SEQ ID NO: 4528222 - DNA, 17 bp, Homo sapiens
ctgggtaagaagaaagc

SEQ ID NO: 4528223 - DNA, 17 bp, Homo sapiens
ctgggtaagaagggtgg

SEQ ID NO: 4528224 - DNA, 21 bp, Homo sapiens
ctgggtcagtctggtgggagg

SEQ ID NO: 4528225 - DNA, 15 bp, Homo sapiens
ctgggtcatgggcct

SEQ ID NO: 4528226 - DNA, 14 bp, Homo sapiens
ctgggtccagggag

SEQ ID NO: 4528227 - DNA, 17 bp, Homo sapiens
ctgggtccatatcacac

SEQ ID NO: 4528228 - DNA, 17 bp, Homo sapiens
ctgggtcctgccagctg

SEQ ID NO: 4528229 - DNA, 14 bp, Homo sapiens
ctgggtctgaggcc

SEQ ID NO: 4528230 - DNA, 20 bp, Homo sapiens
ctgggtctgaggcccctgcc

SEQ ID NO: 4528231 - DNA, 14 bp, Homo sapiens
ctgggtctggccag

SEQ ID NO: 4528232 - DNA, 15 bp, Homo sapiens
ctgggtctggccagg

SEQ ID NO: 4528233 - DNA, 17 bp, Homo sapiens
ctgggtcttcagcttta

SEQ ID NO: 4528234 - DNA, 18 bp, Homo sapiens
ctgggtgagagaggaata

SEQ ID NO: 4528235 - DNA, 18 bp, Homo sapiens
ctgggtgataattttgaa

SEQ ID NO: 4528236 - DNA, 16 bp, Homo sapiens
ctgggtgctgatcctt

SEQ ID NO: 4528237 - DNA, 13 bp, Homo sapiens
ctgggtgctggga

SEQ ID NO: 4528238 - DNA, 14 bp, Homo sapiens
ctgggtgggctctg

SEQ ID NO: 4528239 - DNA, 15 bp, Homo sapiens
ctgggtggggcagtg

SEQ ID NO: 4528240 - DNA, 18 bp, Homo sapiens
ctgggtggggctgctcct

SEQ ID NO: 4528241 - DNA, 22 bp, Homo sapiens
ctgggtggggctgctcctccag

SEQ ID NO: 4528242 - DNA, 14 bp, Homo sapiens
ctgggtggtggcct

SEQ ID NO: 4528243 - DNA, 19 bp, Homo sapiens
ctgggtgtcaagtgcctgc

SEQ ID NO: 4528244 - DNA, 16 bp, Homo sapiens
ctgggttccctttcct

SEQ ID NO: 4528245 - DNA, 21 bp, Homo sapiens
ctgggttccctttccttccat

SEQ ID NO: 4528246 - DNA, 15 bp, Homo sapiens
ctggtaagactgctg

SEQ ID NO: 4528247 - DNA, 17 bp, Homo sapiens
ctggtaagactgctggt

SEQ ID NO: 4528248 - DNA, 18 bp, Homo sapiens
ctggtaagactgctggtt

SEQ ID NO: 4528249 - DNA, 20 bp, Homo sapiens
ctggtaagattgttattaaa

SEQ ID NO: 4528250 - DNA, 23 bp, Homo sapiens
ctggtaagattgttattaaatgt

SEQ ID NO: 4528251 - DNA, 15 bp, Homo sapiens
ctggtagagaccccc

SEQ ID NO: 4528252 - DNA, 17 bp, Homo sapiens
ctggtagagacccccag

SEQ ID NO: 4528253 - DNA, 13 bp, Homo sapiens
ctggtagcagcag

SEQ ID NO: 4528254 - DNA, 18 bp, Homo sapiens
ctggtagcagcaggctca

SEQ ID NO: 4528255 - DNA, 20 bp, Homo sapiens
ctggtagcagcaggctcagg

SEQ ID NO: 4528256 - DNA, 18 bp, Homo sapiens
ctggtatatccaaaagct

SEQ ID NO: 4528257 - DNA, 22 bp, Homo sapiens
ctggtatgtaaaagaaaatcca

SEQ ID NO: 4528258 - DNA, 11 bp, Homo sapiens
ctggtattaaa

SEQ ID NO: 4528259 - DNA, 12 bp, Homo sapiens
ctggtattaaat

SEQ ID NO: 4528260 - DNA, 13 bp, Homo sapiens
ctggtattaaatg

SEQ ID NO: 4528261 - DNA, 16 bp, Homo sapiens
ctggtattaaatgcca

SEQ ID NO: 4528262 - DNA, 15 bp, Homo sapiens
ctggtattgttctca

SEQ ID NO: 4528263 - DNA, 14 bp, Homo sapiens
ctggtattttatct

SEQ ID NO: 4528264 - DNA, 18 bp, Homo sapiens
ctggtcagagagacctca

SEQ ID NO: 4528265 - DNA, 17 bp, Homo sapiens
ctggtccagggaagctg

SEQ ID NO: 4528266 - DNA, 21 bp, Homo sapiens
ctggtccagggaagctggccg

SEQ ID NO: 4528267 - DNA, 20 bp, Homo sapiens
ctggtccaggtcttcagttt

SEQ ID NO: 4528268 - DNA, 20 bp, Homo sapiens
ctggtcccggggccagcact

SEQ ID NO: 4528269 - DNA, 17 bp, Homo sapiens
ctggtcccttgcagcta

SEQ ID NO: 4528270 - DNA, 16 bp, Homo sapiens
ctggtccggacactcc

SEQ ID NO: 4528271 - DNA, 14 bp, Homo sapiens
ctggtccttattta

SEQ ID NO: 4528272 - DNA, 19 bp, Homo sapiens
ctggtccttccactgtgca

SEQ ID NO: 4528273 - DNA, 23 bp, Homo sapiens
ctggtctcaaacttgtggcctca

SEQ ID NO: 4528274 - DNA, 13 bp, Homo sapiens
ctggtctcagcag

SEQ ID NO: 4528275 - DNA, 12 bp, Homo sapiens
ctggtctctggt

SEQ ID NO: 4528276 - DNA, 19 bp, Homo sapiens
ctggtctgctgttccagtg

SEQ ID NO: 4528277 - DNA, 11 bp, Homo sapiens
ctggtctgtga

SEQ ID NO: 4528278 - DNA, 20 bp, Homo sapiens
ctggtgaagctcacttctgg

SEQ ID NO: 4528279 - DNA, 21 bp, Homo sapiens
ctggtgagcaggggaagcagg

SEQ ID NO: 4528280 - DNA, 16 bp, Homo sapiens
ctggtgcaaattcaga

SEQ ID NO: 4528281 - DNA, 17 bp, Homo sapiens
ctggtgcactttgtaaa

SEQ ID NO: 4528282 - DNA, 17 bp, Homo sapiens
ctggtgcaggtctccac

SEQ ID NO: 4528283 - DNA, 15 bp, Homo sapiens
ctggtgccatttctg

SEQ ID NO: 4528284 - DNA, 12 bp, Homo sapiens
ctggtgcctcac

SEQ ID NO: 4528285 - DNA, 12 bp, Homo sapiens
ctggtgcctcct

SEQ ID NO: 4528286 - DNA, 13 bp, Homo sapiens
ctggtgcctcctc

SEQ ID NO: 4528287 - DNA, 15 bp, Homo sapiens
ctggtgcctcctcaa

SEQ ID NO: 4528288 - DNA, 19 bp, Homo sapiens
ctggtgcctctcacttcgt

SEQ ID NO: 4528289 - DNA, 14 bp, Homo sapiens
ctggtgctgccgag

SEQ ID NO: 4528290 - DNA, 17 bp, Homo sapiens
ctggtgctgccgagggc

SEQ ID NO: 4528291 - DNA, 18 bp, Homo sapiens
ctggtgctgccgagggct

SEQ ID NO: 4528292 - DNA, 12 bp, Homo sapiens
ctggtggcacca

SEQ ID NO: 4528293 - DNA, 14 bp, Homo sapiens
ctggtggcaccaga

SEQ ID NO: 4528294 - DNA, 16 bp, Homo sapiens
ctggtggcaggggctt

SEQ ID NO: 4528295 - DNA, 22 bp, Homo sapiens
ctggtggcccactgactaagaa

SEQ ID NO: 4528296 - DNA, 17 bp, Homo sapiens
ctggtggtgcagccttc

SEQ ID NO: 4528297 - DNA, 22 bp, Homo sapiens
ctggtggtggctcgggaggcga

SEQ ID NO: 4528298 - DNA, 17 bp, Homo sapiens
ctggtgtccccttcccc

SEQ ID NO: 4528299 - DNA, 23 bp, Homo sapiens
ctggtgtccccttcccctgctga

SEQ ID NO: 4528300 - DNA, 17 bp, Homo sapiens
ctggttatttttctctt

SEQ ID NO: 4528301 - DNA, 20 bp, Homo sapiens
ctggttcacactgaccaaga

SEQ ID NO: 4528302 - DNA, 13 bp, Homo sapiens
ctggttcctgtgt

SEQ ID NO: 4528303 - DNA, 15 bp, Homo sapiens
ctggttctcatcttt

SEQ ID NO: 4528304 - DNA, 20 bp, Homo sapiens
ctggttctcatctttcttga

SEQ ID NO: 4528305 - DNA, 16 bp, Homo sapiens
ctctataaagggtcag

SEQ ID NO: 4528306 - DNA, 14 bp, Homo sapiens
ctctatatgtaata

SEQ ID NO: 4528307 - DNA, 23 bp, Homo sapiens
ctctatcatctgctaagtaattt

SEQ ID NO: 4528308 - DNA, 21 bp, Homo sapiens
ctctatcatggtgaaaagctc

SEQ ID NO: 4528309 - DNA, 14 bp, Homo sapiens
ctctattaaaatgc

SEQ ID NO: 4528310 - DNA, 17 bp, Homo sapiens
ctctattccctcagcct

SEQ ID NO: 4528311 - DNA, 19 bp, Homo sapiens
ctctattgggcacagccta

SEQ ID NO: 4528312 - DNA, 12 bp, Homo sapiens
ctctatttaaat

SEQ ID NO: 4528313 - DNA, 14 bp, Homo sapiens
ctctatttgagaat

SEQ ID NO: 4528314 - DNA, 22 bp, Homo sapiens
ctctattttacttttctgccaa

SEQ ID NO: 4528315 - DNA, 12 bp, Homo sapiens
ctctcaaaacaa

SEQ ID NO: 4528316 - DNA, 16 bp, Homo sapiens
ctctcaaattcagctc

SEQ ID NO: 4528317 - DNA, 19 bp, Homo sapiens
ctctcaaattcagctctga

SEQ ID NO: 4528318 - DNA, 19 bp, Homo sapiens
ctctcaccatgatgtgaag

SEQ ID NO: 4528319 - DNA, 14 bp, Homo sapiens
ctctcacccccatc

SEQ ID NO: 4528320 - DNA, 13 bp, Homo sapiens
ctctcacctgctc

SEQ ID NO: 4528321 - DNA, 19 bp, Homo sapiens
ctctcacctgctcccagtc

SEQ ID NO: 4528322 - DNA, 14 bp, Homo sapiens
ctctcactcccctc

SEQ ID NO: 4528323 - DNA, 15 bp, Homo sapiens
ctctcagagtgacag

SEQ ID NO: 4528324 - DNA, 14 bp, Homo sapiens
ctctcagcccagaa

SEQ ID NO: 4528325 - DNA, 14 bp, Homo sapiens
ctctcagcctccca

SEQ ID NO: 4528326 - DNA, 15 bp, Homo sapiens
ctctcagctgctgga

SEQ ID NO: 4528327 - DNA, 19 bp, Homo sapiens
ctctcagctgctggatgac

SEQ ID NO: 4528328 - DNA, 17 bp, Homo sapiens
ctctcaggaccaaagct

SEQ ID NO: 4528329 - DNA, 15 bp, Homo sapiens
ctctcagtctctgag

SEQ ID NO: 4528330 - DNA, 17 bp, Homo sapiens
ctctcagtctctgagca

SEQ ID NO: 4528331 - DNA, 17 bp, Homo sapiens
ctctcatagaacattga

SEQ ID NO: 4528332 - DNA, 16 bp, Homo sapiens
ctctcatcaactgaat

SEQ ID NO: 4528333 - DNA, 17 bp, Homo sapiens
ctctcatcaactgaatg

SEQ ID NO: 4528334 - DNA, 13 bp, Homo sapiens
ctctcatgcctcc

SEQ ID NO: 4528335 - DNA, 21 bp, Homo sapiens
ctctcattccccaggtggctg

SEQ ID NO: 4528336 - DNA, 14 bp, Homo sapiens
ctctcattttcctg

SEQ ID NO: 4528337 - DNA, 14 bp, Homo sapiens
ctctccaacctgga

SEQ ID NO: 4528338 - DNA, 16 bp, Homo sapiens
ctctccaacctggaca

SEQ ID NO: 4528339 - DNA, 16 bp, Homo sapiens
ctctccaagacagcag

SEQ ID NO: 4528340 - DNA, 17 bp, Homo sapiens
ctctccaagacagcagc

SEQ ID NO: 4528341 - DNA, 21 bp, Homo sapiens
ctctccaagacagcagcagcc

SEQ ID NO: 4528342 - DNA, 22 bp, Homo sapiens
ctctccaagacagcagcagcct

SEQ ID NO: 4528343 - DNA, 20 bp, Homo sapiens
ctctccaagtctcagtggct

SEQ ID NO: 4528344 - DNA, 10 bp, Homo sapiens
ctctccacct

SEQ ID NO: 4528345 - DNA, 16 bp, Homo sapiens
ctctccacctcagcct

SEQ ID NO: 4528346 - DNA, 17 bp, Homo sapiens
ctctccacctcagcctt

SEQ ID NO: 4528347 - DNA, 13 bp, Homo sapiens
ctctccacggtag

SEQ ID NO: 4528348 - DNA, 19 bp, Homo sapiens
ctctccactcatgtgactc

SEQ ID NO: 4528349 - DNA, 15 bp, Homo sapiens
ctctccagctgacta

SEQ ID NO: 4528350 - DNA, 18 bp, Homo sapiens
ctctccagctgactaaac

SEQ ID NO: 4528351 - DNA, 13 bp, Homo sapiens
ctctcccacagag

SEQ ID NO: 4528352 - DNA, 19 bp, Homo sapiens
ctctcccacccggccacag

SEQ ID NO: 4528353 - DNA, 20 bp, Homo sapiens
ctctcccagtctacccagag

SEQ ID NO: 4528354 - DNA, 13 bp, Homo sapiens
ctctcccagtgaa

SEQ ID NO: 4528355 - DNA, 18 bp, Homo sapiens
ctctcccatggagcccca

SEQ ID NO: 4528356 - DNA, 18 bp, Homo sapiens
ctctccccaatccatgct

SEQ ID NO: 4528357 - DNA, 14 bp, Homo sapiens
ctctccccacacta

SEQ ID NO: 4528358 - DNA, 15 bp, Homo sapiens
ctctccccacactaa

SEQ ID NO: 4528359 - DNA, 19 bp, Homo sapiens
ctctccccacgagggctgg

SEQ ID NO: 4528360 - DNA, 21 bp, Homo sapiens
ctctccccacgagggctggct

SEQ ID NO: 4528361 - DNA, 22 bp, Homo sapiens
ctctccccagccccctcccacc

SEQ ID NO: 4528362 - DNA, 13 bp, Homo sapiens
ctctccccaggaa

SEQ ID NO: 4528363 - DNA, 16 bp, Homo sapiens
ctctccccagtgcctg

SEQ ID NO: 4528364 - DNA, 16 bp, Homo sapiens
ctctcccccaccccct

SEQ ID NO: 4528365 - DNA, 16 bp, Homo sapiens
ctctccccctcctcca

SEQ ID NO: 4528366 - DNA, 12 bp, Homo sapiens
ctctccctctgg

SEQ ID NO: 4528367 - DNA, 13 bp, Homo sapiens
ctctccctctggc

SEQ ID NO: 4528368 - DNA, 18 bp, Homo sapiens
ctctccctctggccctgc

SEQ ID NO: 4528369 - DNA, 19 bp, Homo sapiens
ctctccctctggccctgcc

SEQ ID NO: 4528370 - DNA, 22 bp, Homo sapiens
ctctccctctggccctgccttc

SEQ ID NO: 4528371 - DNA, 13 bp, Homo sapiens
ctctccctgccaa

SEQ ID NO: 4528372 - DNA, 19 bp, Homo sapiens
ctctccctgtgttctgggc

SEQ ID NO: 4528373 - DNA, 20 bp, Homo sapiens
ctctccctgtgttctgggct

SEQ ID NO: 4528374 - DNA, 23 bp, Homo sapiens
ctctccgactctgcacccgcctc

SEQ ID NO: 4528375 - DNA, 15 bp, Homo sapiens
ctctccgcgcctacc

SEQ ID NO: 4528376 - DNA, 20 bp, Homo sapiens
ctctcctatctctctgtctt

SEQ ID NO: 4528377 - DNA, 11 bp, Homo sapiens
ctctcctcccc

SEQ ID NO: 4528378 - DNA, 15 bp, Homo sapiens
ctctcctccccaaat

SEQ ID NO: 4528379 - DNA, 16 bp, Homo sapiens
ctctcctccccttcct

SEQ ID NO: 4528380 - DNA, 17 bp, Homo sapiens
ctctcctcctcccctcc

SEQ ID NO: 4528381 - DNA, 13 bp, Homo sapiens
ctctcctctctgc

SEQ ID NO: 4528382 - DNA, 16 bp, Homo sapiens
ctctcctgacccctgc

SEQ ID NO: 4528383 - DNA, 13 bp, Homo sapiens
ctctcctgccctg

SEQ ID NO: 4528384 - DNA, 13 bp, Homo sapiens
ctctcctgcctac

SEQ ID NO: 4528385 - DNA, 13 bp, Homo sapiens
ctctcctgctgca

SEQ ID NO: 4528386 - DNA, 13 bp, Homo sapiens
ctctcctggccta

SEQ ID NO: 4528387 - DNA, 20 bp, Homo sapiens
ctctcctggcctatccgctg

SEQ ID NO: 4528388 - DNA, 13 bp, Homo sapiens
ctctcctgggccc

SEQ ID NO: 4528389 - DNA, 17 bp, Homo sapiens
ctctcctgggcccctcc

SEQ ID NO: 4528390 - DNA, 19 bp, Homo sapiens
ctctcctgggcccctccct

SEQ ID NO: 4528391 - DNA, 22 bp, Homo sapiens
ctctcctgggcccctccctacc

SEQ ID NO: 4528392 - DNA, 20 bp, Homo sapiens
ctctcctgtaagccaaagaa

SEQ ID NO: 4528393 - DNA, 12 bp, Homo sapiens
ctctcctgtcca

SEQ ID NO: 4528394 - DNA, 16 bp, Homo sapiens
ctctcctgtcctccct

SEQ ID NO: 4528395 - DNA, 17 bp, Homo sapiens
ctctcctgtctccctcc

SEQ ID NO: 4528396 - DNA, 22 bp, Homo sapiens
ctctccttaacctccagcagac

SEQ ID NO: 4528397 - DNA, 23 bp, Homo sapiens
ctctccttcactctgacagtatt

SEQ ID NO: 4528398 - DNA, 16 bp, Homo sapiens
ctctccttcctggagc

SEQ ID NO: 4528399 - DNA, 15 bp, Homo sapiens
ctctccttggaaggt

SEQ ID NO: 4528400 - DNA, 16 bp, Homo sapiens
ctctccttggccacag

SEQ ID NO: 4528401 - DNA, 18 bp, Homo sapiens
ctctccttggccacagac

SEQ ID NO: 4528402 - DNA, 14 bp, Homo sapiens
ctctcctttctttt

SEQ ID NO: 4528403 - DNA, 13 bp, Homo sapiens
ctctcctttgaaa

SEQ ID NO: 4528404 - DNA, 13 bp, Homo sapiens
ctctcctttgtag

SEQ ID NO: 4528405 - DNA, 19 bp, Homo sapiens
ctctcgccccatccctgct

SEQ ID NO: 4528406 - DNA, 21 bp, Homo sapiens
ctctcgccccatccctgcttg

SEQ ID NO: 4528407 - DNA, 21 bp, Homo sapiens
ctctcgctgccctgtggacag

SEQ ID NO: 4528408 - DNA, 15 bp, Homo sapiens
ctctcggccaggcat

SEQ ID NO: 4528409 - DNA, 11 bp, Homo sapiens
ctctcggcccc

SEQ ID NO: 4528410 - DNA, 14 bp, Homo sapiens
ctctcggcccctgt

SEQ ID NO: 4528411 - DNA, 15 bp, Homo sapiens
ctctcggcccctgtc

SEQ ID NO: 4528412 - DNA, 16 bp, Homo sapiens
ctctcggcccctgtct

SEQ ID NO: 4528413 - DNA, 19 bp, Homo sapiens
ctctcggtgctccatctcc

SEQ ID NO: 4528414 - DNA, 21 bp, Homo sapiens
ctctctaccttttaaaattga

SEQ ID NO: 4528415 - DNA, 20 bp, Homo sapiens
ctctctattccctcagccta

SEQ ID NO: 4528416 - DNA, 13 bp, Homo sapiens
ctctctcacctgc

SEQ ID NO: 4528417 - DNA, 21 bp, Homo sapiens
ctctctcataccctccctccc

SEQ ID NO: 4528418 - DNA, 23 bp, Homo sapiens
ctctctcccagtctacccagaga

SEQ ID NO: 4528419 - DNA, 16 bp, Homo sapiens
ctctctccctgcctca

SEQ ID NO: 4528420 - DNA, 19 bp, Homo sapiens
ctctctcggcccctgtctg

SEQ ID NO: 4528421 - DNA, 17 bp, Homo sapiens
ctctctctaccttttaa

SEQ ID NO: 4528422 - DNA, 13 bp, Homo sapiens
ctctctctcactc

SEQ ID NO: 4528423 - DNA, 12 bp, Homo sapiens
ctctctctgggc

SEQ ID NO: 4528424 - DNA, 14 bp, Homo sapiens
ctctctcttttcta

SEQ ID NO: 4528425 - DNA, 15 bp, Homo sapiens
ctctctcttttctac

SEQ ID NO: 4528426 - DNA, 15 bp, Homo sapiens
ctctctcttttttct

SEQ ID NO: 4528427 - DNA, 14 bp, Homo sapiens
ctccttccatctct

SEQ ID NO: 4528428 - DNA, 20 bp, Homo sapiens
ctccttccatctcttccttc

SEQ ID NO: 4528429 - DNA, 21 bp, Homo sapiens
ctccttccccagacccagagg

SEQ ID NO: 4528430 - DNA, 23 bp, Homo sapiens
ctccttccccagacccagaggtc

SEQ ID NO: 4528431 - DNA, 23 bp, Homo sapiens
ctccttcccctacacctccctcc

SEQ ID NO: 4528432 - DNA, 23 bp, Homo sapiens
ctccttcctggagcccagaggag

SEQ ID NO: 4528433 - DNA, 18 bp, Homo sapiens
ctccttccttcaggactc

SEQ ID NO: 4528434 - DNA, 19 bp, Homo sapiens
ctccttccttcaggactct

SEQ ID NO: 4528435 - DNA, 22 bp, Homo sapiens
ctccttctgctgtgtatcatgg

SEQ ID NO: 4528436 - DNA, 20 bp, Homo sapiens
ctccttgccccccgccctca

SEQ ID NO: 4528437 - DNA, 21 bp, Homo sapiens
ctccttgccccccgccctcat

SEQ ID NO: 4528438 - DNA, 15 bp, Homo sapiens
ctccttggcaccccc

SEQ ID NO: 4528439 - DNA, 21 bp, Homo sapiens
ctccttggcacccccatgctg

SEQ ID NO: 4528440 - DNA, 14 bp, Homo sapiens
ctccttggccacag

SEQ ID NO: 4528441 - DNA, 15 bp, Homo sapiens
ctccttggccacaga

SEQ ID NO: 4528442 - DNA, 16 bp, Homo sapiens
ctccttgggccctttg

SEQ ID NO: 4528443 - DNA, 18 bp, Homo sapiens
ctccttgggccctttgag

SEQ ID NO: 4528444 - DNA, 19 bp, Homo sapiens
ctccttgggccctttgagt

SEQ ID NO: 4528445 - DNA, 16 bp, Homo sapiens
ctccttggtgcctctg

SEQ ID NO: 4528446 - DNA, 17 bp, Homo sapiens
ctccttggttatatttt

SEQ ID NO: 4528447 - DNA, 21 bp, Homo sapiens
ctccttgtcaacaaagtgctt

SEQ ID NO: 4528448 - DNA, 22 bp, Homo sapiens
ctccttgtcaacaaagtgcttt

SEQ ID NO: 4528449 - DNA, 11 bp, Homo sapiens
ctcctttacca

SEQ ID NO: 4528450 - DNA, 16 bp, Homo sapiens
ctcctttatctgtaat

SEQ ID NO: 4528451 - DNA, 22 bp, Homo sapiens
ctcctttatctgtaattgtaat

SEQ ID NO: 4528452 - DNA, 23 bp, Homo sapiens
ctcctttatctgtaattgtaatt

SEQ ID NO: 4528453 - DNA, 15 bp, Homo sapiens
ctcctttctcctgtg

SEQ ID NO: 4528454 - DNA, 19 bp, Homo sapiens
ctcctttgaaacctgctct

SEQ ID NO: 4528455 - DNA, 16 bp, Homo sapiens
ctccttttatctggtg

SEQ ID NO: 4528456 - DNA, 23 bp, Homo sapiens
ctccttttatctggtgcctcctc

SEQ ID NO: 4528457 - DNA, 19 bp, Homo sapiens
ctcgaaacacagaaacctt

SEQ ID NO: 4528458 - DNA, 19 bp, Homo sapiens
ctcgacaaaggccacaggc

SEQ ID NO: 4528459 - DNA, 19 bp, Homo sapiens
ctcgacccagaatggagcc

SEQ ID NO: 4528460 - DNA, 19 bp, Homo sapiens
ctcgagaactttcattttt

SEQ ID NO: 4528461 - DNA, 17 bp, Homo sapiens
ctcgagcccagatggaa

SEQ ID NO: 4528462 - DNA, 12 bp, Homo sapiens
ctcgaggcctgc

SEQ ID NO: 4528463 - DNA, 13 bp, Homo sapiens
ctcgaggcctgca

SEQ ID NO: 4528464 - DNA, 13 bp, Homo sapiens
ctcgagtactgtg

SEQ ID NO: 4528465 - DNA, 22 bp, Homo sapiens
ctcgagtactgtgggcaattta

SEQ ID NO: 4528466 - DNA, 14 bp, Homo sapiens
ctcgatccaaattg

SEQ ID NO: 4528467 - DNA, 15 bp, Homo sapiens
ctcgatccaaattgt

SEQ ID NO: 4528468 - DNA, 21 bp, Homo sapiens
ctcgatccaaattgtgcttct

SEQ ID NO: 4528469 - DNA, 17 bp, Homo sapiens
ctcgatggacctcagca

SEQ ID NO: 4528470 - DNA, 20 bp, Homo sapiens
ctcgatgtggtcacagctgt

SEQ ID NO: 4528471 - DNA, 24 bp, Homo sapiens
ctcgatgtggtcacagctgtatag

SEQ ID NO: 4528472 - DNA, 20 bp, Homo sapiens
ctcgcagggaatgcagcagg

SEQ ID NO: 4528473 - DNA, 16 bp, Homo sapiens
ctcgcatccagacagt

SEQ ID NO: 4528474 - DNA, 22 bp, Homo sapiens
ctcgcatttgtcaatgacagtt

SEQ ID NO: 4528475 - DNA, 22 bp, Homo sapiens
ctcgccaagcaggacagtgctt

SEQ ID NO: 4528476 - DNA, 12 bp, Homo sapiens
ctcgcccagcag

SEQ ID NO: 4528477 - DNA, 13 bp, Homo sapiens
ctcgcccagcagg

SEQ ID NO: 4528478 - DNA, 12 bp, Homo sapiens
ctcgccctgggt

SEQ ID NO: 4528479 - DNA, 15 bp, Homo sapiens
ctcgccctgggtcta

SEQ ID NO: 4528480 - DNA, 18 bp, Homo sapiens
ctcgccggatctgaggga

SEQ ID NO: 4528481 - DNA, 22 bp, Homo sapiens
ctcgctcaccgctggcccttag

SEQ ID NO: 4528482 - DNA, 15 bp, Homo sapiens
ctcgctccctgtagc

SEQ ID NO: 4528483 - DNA, 19 bp, Homo sapiens
ctcgctgccagctctgtat

SEQ ID NO: 4528484 - DNA, 19 bp, Homo sapiens
ctcgctgcgcagcctccag

SEQ ID NO: 4528485 - DNA, 15 bp, Homo sapiens
ctcgctggactctca

SEQ ID NO: 4528486 - DNA, 19 bp, Homo sapiens
ctcgctggactctcagtct

SEQ ID NO: 4528487 - DNA, 20 bp, Homo sapiens
ctcgctgtgattttaagaca

SEQ ID NO: 4528488 - DNA, 19 bp, Homo sapiens
ctcgcttgctggaacacag

SEQ ID NO: 4528489 - DNA, 21 bp, Homo sapiens
ctcggaattcataataaattt

SEQ ID NO: 4528490 - DNA, 13 bp, Homo sapiens
ctcggacacagtt

SEQ ID NO: 4528491 - DNA, 18 bp, Homo sapiens
ctcggacagagcccccct

SEQ ID NO: 4528492 - DNA, 15 bp, Homo sapiens
ctcggacccacccca

SEQ ID NO: 4528493 - DNA, 17 bp, Homo sapiens
ctcggacccaccccaac

SEQ ID NO: 4528494 - DNA, 22 bp, Homo sapiens
ctcggactaagcctacctgctc

SEQ ID NO: 4528495 - DNA, 20 bp, Homo sapiens
ctcggagagcagcagcacca

SEQ ID NO: 4528496 - DNA, 20 bp, Homo sapiens
ctcggatcaccgagagtagc

SEQ ID NO: 4528497 - DNA, 21 bp, Homo sapiens
ctcggatgaccatactcagac

SEQ ID NO: 4528498 - DNA, 24 bp, Homo sapiens
ctcggatggaccaacctgctctgt

SEQ ID NO: 4528499 - DNA, 15 bp, Homo sapiens
ctcggcaccaactaa

SEQ ID NO: 4528500 - DNA, 11 bp, Homo sapiens
ctcggcccctg

SEQ ID NO: 4528501 - DNA, 12 bp, Homo sapiens
ctcggcccctgt

SEQ ID NO: 4528502 - DNA, 15 bp, Homo sapiens
ctcggcctcccaaag

SEQ ID NO: 4528503 - DNA, 18 bp, Homo sapiens
ctcggcctcccaaagtgc

SEQ ID NO: 4528504 - DNA, 21 bp, Homo sapiens
ctcggcctccgaggctccccg

SEQ ID NO: 4528505 - DNA, 16 bp, Homo sapiens
ctcgggcccagccccc

SEQ ID NO: 4528506 - DNA, 14 bp, Homo sapiens
ctcggggtccctgg

SEQ ID NO: 4528507 - DNA, 24 bp, Homo sapiens
ctcgtcaagagcatgcacatgctg

SEQ ID NO: 4528508 - DNA, 15 bp, Homo sapiens
ctcgtcctccccctg

SEQ ID NO: 4528509 - DNA, 15 bp, Homo sapiens
ctcgtgagtcattta

SEQ ID NO: 4528510 - DNA, 20 bp, Homo sapiens
ctcgtgagtcatttaaatgt

SEQ ID NO: 4528511 - DNA, 16 bp, Homo sapiens
ctcgtgatgggcccgc

SEQ ID NO: 4528512 - DNA, 18 bp, Homo sapiens
ctcgtgatgggcccgcct

SEQ ID NO: 4528513 - DNA, 21 bp, Homo sapiens
ctcgtgcattaaaatttctta

SEQ ID NO: 4528514 - DNA, 15 bp, Homo sapiens
ctcgtggactgtgct

SEQ ID NO: 4528515 - DNA, 12 bp, Homo sapiens
ctcgtgtttgct

SEQ ID NO: 4528516 - DNA, 20 bp, Homo sapiens
ctcgttgactggctgtgtgt

SEQ ID NO: 4528517 - DNA, 23 bp, Homo sapiens
ctcgttgactggctgtgtgttgg

SEQ ID NO: 4528518 - DNA, 16 bp, Homo sapiens
ctcgttgtcacaccca

SEQ ID NO: 4528519 - DNA, 22 bp, Homo sapiens
ctctaaacagacaggaatttag

SEQ ID NO: 4528520 - DNA, 14 bp, Homo sapiens
ctctaacagccctc

SEQ ID NO: 4528521 - DNA, 17 bp, Homo sapiens
ctctaaccccaggcccc

SEQ ID NO: 4528522 - DNA, 18 bp, Homo sapiens
ctctaaccccaggccccg

SEQ ID NO: 4528523 - DNA, 19 bp, Homo sapiens
ctctaaccccaggccccga

SEQ ID NO: 4528524 - DNA, 16 bp, Homo sapiens
ctctaactcctgccat

SEQ ID NO: 4528525 - DNA, 16 bp, Homo sapiens
ctctaactgtatattt

SEQ ID NO: 4528526 - DNA, 21 bp, Homo sapiens
ctctaactgtatatttgtatg

SEQ ID NO: 4528527 - DNA, 19 bp, Homo sapiens
ctctaatatgattatacaa

SEQ ID NO: 4528528 - DNA, 14 bp, Homo sapiens
ctctaatattgctt

SEQ ID NO: 4528529 - DNA, 17 bp, Homo sapiens
ctctaatattgcttctt

SEQ ID NO: 4528530 - DNA, 16 bp, Homo sapiens
ctctaatgttgtatca

SEQ ID NO: 4528531 - DNA, 14 bp, Homo sapiens
ctctacagccgtcc

SEQ ID NO: 4528532 - DNA, 19 bp, Homo sapiens
ctctacaggtccgtttcct

SEQ ID NO: 4528533 - DNA, 18 bp, Homo sapiens
ctctaccaaaaaaaggaa

SEQ ID NO: 4528534 - DNA, 20 bp, Homo sapiens
ctctaccaaaaaaaggaagg

SEQ ID NO: 4528535 - DNA, 23 bp, Homo sapiens
ctctaccatggttctgcctcctg

SEQ ID NO: 4528536 - DNA, 17 bp, Homo sapiens
ctctaccctcccacccc

SEQ ID NO: 4528537 - DNA, 22 bp, Homo sapiens
ctctaccctcccacccccttct

SEQ ID NO: 4528538 - DNA, 21 bp, Homo sapiens
ctctaccttcctgtccctgag

SEQ ID NO: 4528539 - DNA, 23 bp, Homo sapiens
ctctaccttcctgtccctgaggt

SEQ ID NO: 4528540 - DNA, 23 bp, Homo sapiens
ctctacgtttccccaataaagcc

SEQ ID NO: 4528541 - DNA, 19 bp, Homo sapiens
ctctactaaaaatacaaaa

SEQ ID NO: 4528542 - DNA, 15 bp, Homo sapiens
ctctagagccttcag

SEQ ID NO: 4528543 - DNA, 15 bp, Homo sapiens
ctctaggctgttctg

SEQ ID NO: 4528544 - DNA, 18 bp, Homo sapiens
ctctaggctgttctgtag

SEQ ID NO: 4528545 - DNA, 14 bp, Homo sapiens
ctctataaagggtc

SEQ ID NO: 4528546 - DNA, 15 bp, Homo sapiens
ctcctccatgggaga

SEQ ID NO: 4528547 - DNA, 17 bp, Homo sapiens
ctcctccccaaatcaat

SEQ ID NO: 4528548 - DNA, 15 bp, Homo sapiens
ctcctccccagagct

SEQ ID NO: 4528549 - DNA, 11 bp, Homo sapiens
ctcctccccca

SEQ ID NO: 4528550 - DNA, 12 bp, Homo sapiens
ctcctcccccag

SEQ ID NO: 4528551 - DNA, 14 bp, Homo sapiens
ctcctcccccagtg

SEQ ID NO: 4528552 - DNA, 14 bp, Homo sapiens
ctcctccccttcct

SEQ ID NO: 4528553 - DNA, 17 bp, Homo sapiens
ctcctccccttcctgtt

SEQ ID NO: 4528554 - DNA, 19 bp, Homo sapiens
ctcctccccttcctgtttc

SEQ ID NO: 4528555 - DNA, 17 bp, Homo sapiens
ctcctcccgaaaaatgt

SEQ ID NO: 4528556 - DNA, 21 bp, Homo sapiens
ctcctcccgccccgcccctcc

SEQ ID NO: 4528557 - DNA, 11 bp, Homo sapiens
ctcctccctca

SEQ ID NO: 4528558 - DNA, 12 bp, Homo sapiens
ctcctccctcaa

SEQ ID NO: 4528559 - DNA, 17 bp, Homo sapiens
ctcctccctcagaccca

SEQ ID NO: 4528560 - DNA, 18 bp, Homo sapiens
ctcctccctcagactcag

SEQ ID NO: 4528561 - DNA, 20 bp, Homo sapiens
ctcctccctcaggcccagga

SEQ ID NO: 4528562 - DNA, 13 bp, Homo sapiens
ctcctcccttcct

SEQ ID NO: 4528563 - DNA, 14 bp, Homo sapiens
ctcctcccttcctt

SEQ ID NO: 4528564 - DNA, 15 bp, Homo sapiens
ctcctcccttccttt

SEQ ID NO: 4528565 - DNA, 18 bp, Homo sapiens
ctcctccttgcccagact

SEQ ID NO: 4528566 - DNA, 21 bp, Homo sapiens
ctcctcgagatcccaacactg

SEQ ID NO: 4528567 - DNA, 21 bp, Homo sapiens
ctcctcggagagcagcagcac

SEQ ID NO: 4528568 - DNA, 22 bp, Homo sapiens
ctcctctcccacagagtgctgg

SEQ ID NO: 4528569 - DNA, 13 bp, Homo sapiens
ctcctctcctgga

SEQ ID NO: 4528570 - DNA, 9 bp, Homo sapiens
ctcctctct

SEQ ID NO: 4528571 - DNA, 11 bp, Homo sapiens
ctcctctctgc

SEQ ID NO: 4528572 - DNA, 11 bp, Homo sapiens
ctcctctgaaa

SEQ ID NO: 4528573 - DNA, 12 bp, Homo sapiens
ctcctctgaaac

SEQ ID NO: 4528574 - DNA, 13 bp, Homo sapiens
ctcctctgaaaca

SEQ ID NO: 4528575 - DNA, 14 bp, Homo sapiens
ctcctctgaaacag

SEQ ID NO: 4528576 - DNA, 15 bp, Homo sapiens
ctcctctgaaacagc

SEQ ID NO: 4528577 - DNA, 19 bp, Homo sapiens
ctcctctgaaacagctgcc

SEQ ID NO: 4528578 - DNA, 20 bp, Homo sapiens
ctcctctgaaacagctgcct

SEQ ID NO: 4528579 - DNA, 21 bp, Homo sapiens
ctcctctgaaacagctgcctt

SEQ ID NO: 4528580 - DNA, 13 bp, Homo sapiens
ctcctctgactca

SEQ ID NO: 4528581 - DNA, 18 bp, Homo sapiens
ctcctctgactcagggct

SEQ ID NO: 4528582 - DNA, 17 bp, Homo sapiens
ctcctctgcagtgcctt

SEQ ID NO: 4528583 - DNA, 12 bp, Homo sapiens
ctcctctgccta

SEQ ID NO: 4528584 - DNA, 13 bp, Homo sapiens
ctcctctgcctac

SEQ ID NO: 4528585 - DNA, 20 bp, Homo sapiens
ctcctctgcctacagccagg

SEQ ID NO: 4528586 - DNA, 12 bp, Homo sapiens
ctcctctggctt

SEQ ID NO: 4528587 - DNA, 17 bp, Homo sapiens
ctcctctggctttccca

SEQ ID NO: 4528588 - DNA, 22 bp, Homo sapiens
ctcctctggctttcccaggaga

SEQ ID NO: 4528589 - DNA, 16 bp, Homo sapiens
ctcctctgtctgccct

SEQ ID NO: 4528590 - DNA, 13 bp, Homo sapiens
ctcctctttaaaa

SEQ ID NO: 4528591 - DNA, 16 bp, Homo sapiens
ctcctctttaaaacaa

SEQ ID NO: 4528592 - DNA, 19 bp, Homo sapiens
ctcctctttaaaacaaaac

SEQ ID NO: 4528593 - DNA, 18 bp, Homo sapiens
ctcctgaaacctcttcct

SEQ ID NO: 4528594 - DNA, 18 bp, Homo sapiens
ctcctgacccccatgtaa

SEQ ID NO: 4528595 - DNA, 20 bp, Homo sapiens
ctcctgacccccatgtaaat

SEQ ID NO: 4528596 - DNA, 17 bp, Homo sapiens
ctcctgagacccctggc

SEQ ID NO: 4528597 - DNA, 20 bp, Homo sapiens
ctcctgagacccctggcctc

SEQ ID NO: 4528598 - DNA, 16 bp, Homo sapiens
ctcctgaggctgtttt

SEQ ID NO: 4528599 - DNA, 23 bp, Homo sapiens
ctcctgaggctgtttttggctgt

SEQ ID NO: 4528600 - DNA, 16 bp, Homo sapiens
ctcctgaggctttgga

SEQ ID NO: 4528601 - DNA, 16 bp, Homo sapiens
ctcctgaggggcatct

SEQ ID NO: 4528602 - DNA, 21 bp, Homo sapiens
ctcctgaggggcatctgcccc

SEQ ID NO: 4528603 - DNA, 14 bp, Homo sapiens
ctcctgcactgttt

SEQ ID NO: 4528604 - DNA, 14 bp, Homo sapiens
ctcctgccaggcac

SEQ ID NO: 4528605 - DNA, 12 bp, Homo sapiens
ctcctgcccagg

SEQ ID NO: 4528606 - DNA, 14 bp, Homo sapiens
ctcctgcccaggag

SEQ ID NO: 4528607 - DNA, 13 bp, Homo sapiens
ctcctgcccaggc

SEQ ID NO: 4528608 - DNA, 15 bp, Homo sapiens
ctcctgcccaggcca

SEQ ID NO: 4528609 - DNA, 16 bp, Homo sapiens
ctcctgcccaggccac

SEQ ID NO: 4528610 - DNA, 19 bp, Homo sapiens
ctcctgcccaggccacaga

SEQ ID NO: 4528611 - DNA, 16 bp, Homo sapiens
ctcctgccccctgcca

SEQ ID NO: 4528612 - DNA, 17 bp, Homo sapiens
ctcctgccccctgccag

SEQ ID NO: 4528613 - DNA, 13 bp, Homo sapiens
ctcctgccctgtg

SEQ ID NO: 4528614 - DNA, 14 bp, Homo sapiens
ctcctgccctgtga

SEQ ID NO: 4528615 - DNA, 14 bp, Homo sapiens
ctcctgccgcagag

SEQ ID NO: 4528616 - DNA, 18 bp, Homo sapiens
ctcctgccgcagagctgg

SEQ ID NO: 4528617 - DNA, 13 bp, Homo sapiens
ctcctgcctactc

SEQ ID NO: 4528618 - DNA, 16 bp, Homo sapiens
ctcctgcctactcacg

SEQ ID NO: 4528619 - DNA, 12 bp, Homo sapiens
ctcctgcctcag

SEQ ID NO: 4528620 - DNA, 14 bp, Homo sapiens
ctcctgctctctat

SEQ ID NO: 4528621 - DNA, 21 bp, Homo sapiens
ctcctgctgcctaataaagag

SEQ ID NO: 4528622 - DNA, 12 bp, Homo sapiens
ctcctggaaact

SEQ ID NO: 4528623 - DNA, 18 bp, Homo sapiens
ctcctggccaagcaggct

SEQ ID NO: 4528624 - DNA, 12 bp, Homo sapiens
ctcctggccaga

SEQ ID NO: 4528625 - DNA, 13 bp, Homo sapiens
ctcctggcctatc

SEQ ID NO: 4528626 - DNA, 20 bp, Homo sapiens
ctcctggcctggccatctcc

SEQ ID NO: 4528627 - DNA, 18 bp, Homo sapiens
ctcctgggacccttggct

SEQ ID NO: 4528628 - DNA, 19 bp, Homo sapiens
ctcctgggacccttggcta

SEQ ID NO: 4528629 - DNA, 14 bp, Homo sapiens
ctcctgggccctgg

SEQ ID NO: 4528630 - DNA, 17 bp, Homo sapiens
ctcctgggccctgggct

SEQ ID NO: 4528631 - DNA, 18 bp, Homo sapiens
ctcctggggagctcctgg

SEQ ID NO: 4528632 - DNA, 21 bp, Homo sapiens
ctcctggggagctcctgggac

SEQ ID NO: 4528633 - DNA, 16 bp, Homo sapiens
ctcctgggggtggcag

SEQ ID NO: 4528634 - DNA, 20 bp, Homo sapiens
ctcctgggggtggcaggcac

SEQ ID NO: 4528635 - DNA, 21 bp, Homo sapiens
ctcctgggttttgtattctct

SEQ ID NO: 4528636 - DNA, 22 bp, Homo sapiens
ctcctggtagaggggccggctg

SEQ ID NO: 4528637 - DNA, 16 bp, Homo sapiens
ctcctggtctgtgaag

SEQ ID NO: 4528638 - DNA, 14 bp, Homo sapiens
ctcctggtgggtcc

SEQ ID NO: 4528639 - DNA, 20 bp, Homo sapiens
ctcctgtaagccaaagaaat

SEQ ID NO: 4528640 - DNA, 17 bp, Homo sapiens
ctcctgtacctcagtgg

SEQ ID NO: 4528641 - DNA, 18 bp, Homo sapiens
ctcctgtacctcagtgga

SEQ ID NO: 4528642 - DNA, 16 bp, Homo sapiens
ctcctgtcagtgagga

SEQ ID NO: 4528643 - DNA, 14 bp, Homo sapiens
ctcctgtccctttt

SEQ ID NO: 4528644 - DNA, 20 bp, Homo sapiens
ctcctgtcccttttccctta

SEQ ID NO: 4528645 - DNA, 12 bp, Homo sapiens
ctcctgtcctcc

SEQ ID NO: 4528646 - DNA, 18 bp, Homo sapiens
ctcctgtcctccctcacc

SEQ ID NO: 4528647 - DNA, 10 bp, Homo sapiens
ctcctgtctt

SEQ ID NO: 4528648 - DNA, 14 bp, Homo sapiens
ctcctgtcttccca

SEQ ID NO: 4528649 - DNA, 19 bp, Homo sapiens
ctcctgtcttcccagggta

SEQ ID NO: 4528650 - DNA, 17 bp, Homo sapiens
ctcctgtgaatggaggc

SEQ ID NO: 4528651 - DNA, 20 bp, Homo sapiens
ctcctgtgaatggaggcaga

SEQ ID NO: 4528652 - DNA, 11 bp, Homo sapiens
ctcctgtgacc

SEQ ID NO: 4528653 - DNA, 16 bp, Homo sapiens
ctcctgtgcctggccc

SEQ ID NO: 4528654 - DNA, 17 bp, Homo sapiens
ctcctgtgcctggcccc

SEQ ID NO: 4528655 - DNA, 19 bp, Homo sapiens
ctcctgtgctcaccctctc

SEQ ID NO: 4528656 - DNA, 14 bp, Homo sapiens
ctcctgtgctctgg

SEQ ID NO: 4528657 - DNA, 21 bp, Homo sapiens
ctcctgtgctctggaggctgc

SEQ ID NO: 4528658 - DNA, 17 bp, Homo sapiens
ctcctgttgcacccagc

SEQ ID NO: 4528659 - DNA, 19 bp, Homo sapiens
ctcctgttgcacccagccc

SEQ ID NO: 4528660 - DNA, 13 bp, Homo sapiens
ctccttaaggctc

SEQ ID NO: 4528661 - DNA, 22 bp, Homo sapiens
ctccttagccctgtctgctagg

SEQ ID NO: 4528662 - DNA, 20 bp, Homo sapiens
ctccttatagacacttgctc

SEQ ID NO: 4528663 - DNA, 21 bp, Homo sapiens
ctccttcaacaattctaaaat

SEQ ID NO: 4528664 - DNA, 16 bp, Homo sapiens
ctccttcactctgaca

SEQ ID NO: 4528665 - DNA, 17 bp, Homo sapiens
ctccttcactctgacag

SEQ ID NO: 4528666 - DNA, 13 bp, Homo sapiens
ctccttcactgtt

SEQ ID NO: 4528667 - DNA, 15 bp, Homo sapiens
ctccttcactgtttc

SEQ ID NO: 4528668 - DNA, 20 bp, Homo sapiens
ctccttcagctctggggcag

SEQ ID NO: 4528669 - DNA, 12 bp, Homo sapiens
ctccctccaccc

SEQ ID NO: 4528670 - DNA, 15 bp, Homo sapiens
ctccctccaccccag

SEQ ID NO: 4528671 - DNA, 13 bp, Homo sapiens
ctccctccagctg

SEQ ID NO: 4528672 - DNA, 22 bp, Homo sapiens
ctccctccccacacctccctac

SEQ ID NO: 4528673 - DNA, 12 bp, Homo sapiens
ctccctccccag

SEQ ID NO: 4528674 - DNA, 21 bp, Homo sapiens
ctccctcctcacctctggact

SEQ ID NO: 4528675 - DNA, 15 bp, Homo sapiens
ctccctcctccaggc

SEQ ID NO: 4528676 - DNA, 16 bp, Homo sapiens
ctccctcctccaggcc

SEQ ID NO: 4528677 - DNA, 13 bp, Homo sapiens
ctccctctccaag

SEQ ID NO: 4528678 - DNA, 14 bp, Homo sapiens
ctccctctccaaga

SEQ ID NO: 4528679 - DNA, 19 bp, Homo sapiens
ctccctctccaagacagca

SEQ ID NO: 4528680 - DNA, 22 bp, Homo sapiens
ctccctctccaagacagcagca

SEQ ID NO: 4528681 - DNA, 20 bp, Homo sapiens
ctccctctctcttctgctcc

SEQ ID NO: 4528682 - DNA, 15 bp, Homo sapiens
ctccctctggccctg

SEQ ID NO: 4528683 - DNA, 19 bp, Homo sapiens
ctccctctggccctgcctt

SEQ ID NO: 4528684 - DNA, 20 bp, Homo sapiens
ctccctctggccctgccttc

SEQ ID NO: 4528685 - DNA, 22 bp, Homo sapiens
ctccctgaccttagcgttctgg

SEQ ID NO: 4528686 - DNA, 10 bp, Homo sapiens
ctccctgcct

SEQ ID NO: 4528687 - DNA, 13 bp, Homo sapiens
ctccctgcctgag

SEQ ID NO: 4528688 - DNA, 14 bp, Homo sapiens
ctccctgcctgctc

SEQ ID NO: 4528689 - DNA, 15 bp, Homo sapiens
ctccctgcctggccc

SEQ ID NO: 4528690 - DNA, 12 bp, Homo sapiens
ctccctgcctgt

SEQ ID NO: 4528691 - DNA, 18 bp, Homo sapiens
ctccctgctagcacagag

SEQ ID NO: 4528692 - DNA, 20 bp, Homo sapiens
ctccctgctagcacagaggc

SEQ ID NO: 4528693 - DNA, 23 bp, Homo sapiens
ctccctgctgtgccatgctgggc

SEQ ID NO: 4528694 - DNA, 11 bp, Homo sapiens
ctccctggctc

SEQ ID NO: 4528695 - DNA, 16 bp, Homo sapiens
ctccctggctccctcc

SEQ ID NO: 4528696 - DNA, 15 bp, Homo sapiens
ctccctggcttctgt

SEQ ID NO: 4528697 - DNA, 18 bp, Homo sapiens
ctccctggcttctgtggg

SEQ ID NO: 4528698 - DNA, 19 bp, Homo sapiens
ctccctgggacacagaccc

SEQ ID NO: 4528699 - DNA, 20 bp, Homo sapiens
ctccctggggttctctacag

SEQ ID NO: 4528700 - DNA, 15 bp, Homo sapiens
ctccctggtcccctc

SEQ ID NO: 4528701 - DNA, 16 bp, Homo sapiens
ctccctggtcccctcc

SEQ ID NO: 4528702 - DNA, 19 bp, Homo sapiens
ctccctgtaacctcttcag

SEQ ID NO: 4528703 - DNA, 11 bp, Homo sapiens
ctccctgtcct

SEQ ID NO: 4528704 - DNA, 13 bp, Homo sapiens
ctccctgtcctcc

SEQ ID NO: 4528705 - DNA, 15 bp, Homo sapiens
ctccctgtcctcctc

SEQ ID NO: 4528706 - DNA, 15 bp, Homo sapiens
ctccctgtctccagg

SEQ ID NO: 4528707 - DNA, 22 bp, Homo sapiens
ctccctgtggcactcagggagc

SEQ ID NO: 4528708 - DNA, 21 bp, Homo sapiens
ctccctgtgggggtggccatc

SEQ ID NO: 4528709 - DNA, 18 bp, Homo sapiens
ctccctgtgttctgggct

SEQ ID NO: 4528710 - DNA, 20 bp, Homo sapiens
ctccctgtgttctgggctgg

SEQ ID NO: 4528711 - DNA, 21 bp, Homo sapiens
ctccctgtgttctgggctggg

SEQ ID NO: 4528712 - DNA, 18 bp, Homo sapiens
ctcccttaagcagcaaca

SEQ ID NO: 4528713 - DNA, 17 bp, Homo sapiens
ctcccttaaggtctcca

SEQ ID NO: 4528714 - DNA, 19 bp, Homo sapiens
ctcccttccttttccctgc

SEQ ID NO: 4528715 - DNA, 15 bp, Homo sapiens
ctcccttctacctgc

SEQ ID NO: 4528716 - DNA, 18 bp, Homo sapiens
ctcccttctcatctcccc

SEQ ID NO: 4528717 - DNA, 19 bp, Homo sapiens
ctcccttctcgtgtttgct

SEQ ID NO: 4528718 - DNA, 21 bp, Homo sapiens
ctcccttctctacactcttgt

SEQ ID NO: 4528719 - DNA, 13 bp, Homo sapiens
ctcccttctgtag

SEQ ID NO: 4528720 - DNA, 19 bp, Homo sapiens
ctcccttggcccagagacg

SEQ ID NO: 4528721 - DNA, 14 bp, Homo sapiens
ctcccttgggctcc

SEQ ID NO: 4528722 - DNA, 14 bp, Homo sapiens
ctccctttctcagg

SEQ ID NO: 4528723 - DNA, 12 bp, Homo sapiens
ctccctttctcc

SEQ ID NO: 4528724 - DNA, 18 bp, Homo sapiens
ctccctttctctctcctc

SEQ ID NO: 4528725 - DNA, 15 bp, Homo sapiens
ctcccttttctcctc

SEQ ID NO: 4528726 - DNA, 15 bp, Homo sapiens
ctccgaagaaaagaa

SEQ ID NO: 4528727 - DNA, 19 bp, Homo sapiens
ctccgactctgcacccgcc

SEQ ID NO: 4528728 - DNA, 13 bp, Homo sapiens
ctccgaggccagt

SEQ ID NO: 4528729 - DNA, 23 bp, Homo sapiens
ctccgagtgaactggtcttcctt

SEQ ID NO: 4528730 - DNA, 18 bp, Homo sapiens
ctccgcatcacctcacca

SEQ ID NO: 4528731 - DNA, 15 bp, Homo sapiens
ctccgccagcctcct

SEQ ID NO: 4528732 - DNA, 18 bp, Homo sapiens
ctccgccagcctcctctg

SEQ ID NO: 4528733 - DNA, 13 bp, Homo sapiens
ctccgcctccaca

SEQ ID NO: 4528734 - DNA, 14 bp, Homo sapiens
ctccgcctcccggg

SEQ ID NO: 4528735 - DNA, 22 bp, Homo sapiens
ctccgcctgggtcatgggcctg

SEQ ID NO: 4528736 - DNA, 16 bp, Homo sapiens
ctccgcgccgatgcca

SEQ ID NO: 4528737 - DNA, 19 bp, Homo sapiens
ctccgcttgtccaagacag

SEQ ID NO: 4528738 - DNA, 13 bp, Homo sapiens
ctccggaggactg

SEQ ID NO: 4528739 - DNA, 19 bp, Homo sapiens
ctccggaggactgagcccc

SEQ ID NO: 4528740 - DNA, 19 bp, Homo sapiens
ctccggccatactgccttt

SEQ ID NO: 4528741 - DNA, 19 bp, Homo sapiens
ctccggccctccagagccc

SEQ ID NO: 4528742 - DNA, 18 bp, Homo sapiens
ctccggcctgggtgacag

SEQ ID NO: 4528743 - DNA, 23 bp, Homo sapiens
ctccggcgtcagcctccagcctc

SEQ ID NO: 4528744 - DNA, 17 bp, Homo sapiens
ctccggctgtgctggga

SEQ ID NO: 4528745 - DNA, 15 bp, Homo sapiens
ctccgggacctggtg

SEQ ID NO: 4528746 - DNA, 16 bp, Homo sapiens
ctccgggtgtggcctc

SEQ ID NO: 4528747 - DNA, 17 bp, Homo sapiens
ctccgggtgtggcctca

SEQ ID NO: 4528748 - DNA, 20 bp, Homo sapiens
ctccgggtgtggcctcagcc

SEQ ID NO: 4528749 - DNA, 21 bp, Homo sapiens
ctccgggtgtggcctcagccc

SEQ ID NO: 4528750 - DNA, 14 bp, Homo sapiens
ctccgtcaagctgg

SEQ ID NO: 4528751 - DNA, 18 bp, Homo sapiens
ctccgtcagcttctccca

SEQ ID NO: 4528752 - DNA, 22 bp, Homo sapiens
ctccgtcttagaagtggaccag

SEQ ID NO: 4528753 - DNA, 14 bp, Homo sapiens
ctccgtgtggagca

SEQ ID NO: 4528754 - DNA, 20 bp, Homo sapiens
ctccgtgtggagcacgtgga

SEQ ID NO: 4528755 - DNA, 13 bp, Homo sapiens
ctcctaccctccc

SEQ ID NO: 4528756 - DNA, 17 bp, Homo sapiens
ctcctaccctcccacca

SEQ ID NO: 4528757 - DNA, 18 bp, Homo sapiens
ctcctaccctcccaccag

SEQ ID NO: 4528758 - DNA, 13 bp, Homo sapiens
ctcctagaagaac

SEQ ID NO: 4528759 - DNA, 22 bp, Homo sapiens
ctcctagaagaaccaaatacct

SEQ ID NO: 4528760 - DNA, 13 bp, Homo sapiens
ctcctagaagtct

SEQ ID NO: 4528761 - DNA, 14 bp, Homo sapiens
ctcctagaagtctt

SEQ ID NO: 4528762 - DNA, 21 bp, Homo sapiens
ctcctagagaacgcagcccta

SEQ ID NO: 4528763 - DNA, 12 bp, Homo sapiens
ctcctagctctc

SEQ ID NO: 4528764 - DNA, 22 bp, Homo sapiens
ctcctaggacccgtctccagct

SEQ ID NO: 4528765 - DNA, 19 bp, Homo sapiens
ctcctagtgtttctttgtg

SEQ ID NO: 4528766 - DNA, 15 bp, Homo sapiens
ctcctatatatttct

SEQ ID NO: 4528767 - DNA, 13 bp, Homo sapiens
ctcctatctgtgt

SEQ ID NO: 4528768 - DNA, 13 bp, Homo sapiens
ctcctatggtcac

SEQ ID NO: 4528769 - DNA, 16 bp, Homo sapiens
ctcctcaaacccagtc

SEQ ID NO: 4528770 - DNA, 18 bp, Homo sapiens
ctcctcaccccgtctggg

SEQ ID NO: 4528771 - DNA, 15 bp, Homo sapiens
ctcctcacccttccc

SEQ ID NO: 4528772 - DNA, 17 bp, Homo sapiens
ctcctcacctcatgccc

SEQ ID NO: 4528773 - DNA, 13 bp, Homo sapiens
ctcctcacctctg

SEQ ID NO: 4528774 - DNA, 16 bp, Homo sapiens
ctcctcactcccttct

SEQ ID NO: 4528775 - DNA, 19 bp, Homo sapiens
ctcctcactgtatccaggt

SEQ ID NO: 4528776 - DNA, 17 bp, Homo sapiens
ctcctcagagcgccagg

SEQ ID NO: 4528777 - DNA, 16 bp, Homo sapiens
ctcctcagccagcctc

SEQ ID NO: 4528778 - DNA, 21 bp, Homo sapiens
ctcctcaggcacacagctact

SEQ ID NO: 4528779 - DNA, 23 bp, Homo sapiens
ctcctcaggcccagctgctcccc

SEQ ID NO: 4528780 - DNA, 11 bp, Homo sapiens
ctcctcagggt

SEQ ID NO: 4528781 - DNA, 16 bp, Homo sapiens
ctcctcagggtggggg

SEQ ID NO: 4528782 - DNA, 13 bp, Homo sapiens
ctcctcagtggct

SEQ ID NO: 4528783 - DNA, 19 bp, Homo sapiens
ctcctcagtggcttctcca

SEQ ID NO: 4528784 - DNA, 23 bp, Homo sapiens
ctcctcagtggcttctccaggga

SEQ ID NO: 4528785 - DNA, 16 bp, Homo sapiens
ctcctccactctcccc

SEQ ID NO: 4528786 - DNA, 17 bp, Homo sapiens
ctcctccaggcctgcct

SEQ ID NO: 4528787 - DNA, 23 bp, Homo sapiens
ctcctccaggcctgcctcccact

SEQ ID NO: 4528788 - DNA, 14 bp, Homo sapiens
ctcctccagggcca

SEQ ID NO: 4528789 - DNA, 20 bp, Homo sapiens
ctcctccagggccacgtgcc

SEQ ID NO: 4528790 - DNA, 14 bp, Homo sapiens
ctcccaacagtggg

SEQ ID NO: 4528791 - DNA, 14 bp, Homo sapiens
ctcccaacttcttc

SEQ ID NO: 4528792 - DNA, 16 bp, Homo sapiens
ctcccaacttcttcct

SEQ ID NO: 4528793 - DNA, 20 bp, Homo sapiens
ctcccaacttcttcctgtga

SEQ ID NO: 4528794 - DNA, 18 bp, Homo sapiens
ctcccaagcgttcctggc

SEQ ID NO: 4528795 - DNA, 22 bp, Homo sapiens
ctcccaagcgttcctggccttc

SEQ ID NO: 4528796 - DNA, 17 bp, Homo sapiens
ctcccaaggagaacaaa

SEQ ID NO: 4528797 - DNA, 22 bp, Homo sapiens
ctcccaagtagctgggattaca

SEQ ID NO: 4528798 - DNA, 13 bp, Homo sapiens
ctcccaagtggtg

SEQ ID NO: 4528799 - DNA, 18 bp, Homo sapiens
ctcccaagtggtgcctaa

SEQ ID NO: 4528800 - DNA, 15 bp, Homo sapiens
ctcccaatcagcttt

SEQ ID NO: 4528801 - DNA, 23 bp, Homo sapiens
ctcccacaccgcgtcccagctcc

SEQ ID NO: 4528802 - DNA, 12 bp, Homo sapiens
ctcccaccccac

SEQ ID NO: 4528803 - DNA, 11 bp, Homo sapiens
ctcccaccccc

SEQ ID NO: 4528804 - DNA, 13 bp, Homo sapiens
ctcccacccccag

SEQ ID NO: 4528805 - DNA, 16 bp, Homo sapiens
ctcccacccccagccc

SEQ ID NO: 4528806 - DNA, 18 bp, Homo sapiens
ctcccacccccttctctg

SEQ ID NO: 4528807 - DNA, 22 bp, Homo sapiens
ctcccacccccttctctgctcc

SEQ ID NO: 4528808 - DNA, 15 bp, Homo sapiens
ctcccacccggccac

SEQ ID NO: 4528809 - DNA, 19 bp, Homo sapiens
ctcccacccggccacagct

SEQ ID NO: 4528810 - DNA, 20 bp, Homo sapiens
ctcccacccggccacagctg

SEQ ID NO: 4528811 - DNA, 14 bp, Homo sapiens
ctcccacctggctc

SEQ ID NO: 4528812 - DNA, 22 bp, Homo sapiens
ctcccacctggctctgtggcga

SEQ ID NO: 4528813 - DNA, 18 bp, Homo sapiens
ctcccacctgtttctgga

SEQ ID NO: 4528814 - DNA, 21 bp, Homo sapiens
ctcccacgcctcaccagcccc

SEQ ID NO: 4528815 - DNA, 13 bp, Homo sapiens
ctcccagacaggc

SEQ ID NO: 4528816 - DNA, 22 bp, Homo sapiens
ctcccagagcttgttgtctcca

SEQ ID NO: 4528817 - DNA, 23 bp, Homo sapiens
ctcccagaggagccaccagttct

SEQ ID NO: 4528818 - DNA, 14 bp, Homo sapiens
ctcccagccaggcc

SEQ ID NO: 4528819 - DNA, 16 bp, Homo sapiens
ctcccagccaggccct

SEQ ID NO: 4528820 - DNA, 20 bp, Homo sapiens
ctcccagcccatctgaacac

SEQ ID NO: 4528821 - DNA, 15 bp, Homo sapiens
ctcccagctcctttc

SEQ ID NO: 4528822 - DNA, 18 bp, Homo sapiens
ctcccagctgtgctgtgg

SEQ ID NO: 4528823 - DNA, 20 bp, Homo sapiens
ctcccaggccccaggggaga

SEQ ID NO: 4528824 - DNA, 13 bp, Homo sapiens
ctcccaggggtct

SEQ ID NO: 4528825 - DNA, 21 bp, Homo sapiens
ctcccaggggtctccctggct

SEQ ID NO: 4528826 - DNA, 17 bp, Homo sapiens
ctcccagggtccctgcc

SEQ ID NO: 4528827 - DNA, 16 bp, Homo sapiens
ctcccaggtcccataa

SEQ ID NO: 4528828 - DNA, 16 bp, Homo sapiens
ctcccagtatgtttta

SEQ ID NO: 4528829 - DNA, 19 bp, Homo sapiens
ctcccagtctacccagaga

SEQ ID NO: 4528830 - DNA, 15 bp, Homo sapiens
ctcccagtgaactcc

SEQ ID NO: 4528831 - DNA, 18 bp, Homo sapiens
ctcccagtgaactcctgc

SEQ ID NO: 4528832 - DNA, 22 bp, Homo sapiens
ctcccagtgaactcctgccagg

SEQ ID NO: 4528833 - DNA, 16 bp, Homo sapiens
ctcccatagctgggac

SEQ ID NO: 4528834 - DNA, 17 bp, Homo sapiens
ctcccatgaagcctttt

SEQ ID NO: 4528835 - DNA, 16 bp, Homo sapiens
ctcccatgaccatact

SEQ ID NO: 4528836 - DNA, 22 bp, Homo sapiens
ctcccatgagggagatgccatg

SEQ ID NO: 4528837 - DNA, 24 bp, Homo sapiens
ctcccatgagggagatgccatgag

SEQ ID NO: 4528838 - DNA, 18 bp, Homo sapiens
ctcccatggagccccagc

SEQ ID NO: 4528839 - DNA, 19 bp, Homo sapiens
ctcccatggagccccagcc

SEQ ID NO: 4528840 - DNA, 14 bp, Homo sapiens
ctcccattgcccag

SEQ ID NO: 4528841 - DNA, 20 bp, Homo sapiens
ctcccattgcccagtgagcc

SEQ ID NO: 4528842 - DNA, 22 bp, Homo sapiens
ctcccattgcccagtgagccct

SEQ ID NO: 4528843 - DNA, 23 bp, Homo sapiens
ctccccaaagtgctgggattaca

SEQ ID NO: 4528844 - DNA, 21 bp, Homo sapiens
ctccccaacacctgcctctga

SEQ ID NO: 4528845 - DNA, 19 bp, Homo sapiens
ctccccaatccatgcttca

SEQ ID NO: 4528846 - DNA, 21 bp, Homo sapiens
ctccccacactaacctgggtt

SEQ ID NO: 4528847 - DNA, 19 bp, Homo sapiens
ctccccaccctcctcttgg

SEQ ID NO: 4528848 - DNA, 16 bp, Homo sapiens
ctccccacgagggctg

SEQ ID NO: 4528849 - DNA, 23 bp, Homo sapiens
ctccccacttcactttcttcaaa

SEQ ID NO: 4528850 - DNA, 23 bp, Homo sapiens
ctccccagaattcacgcctctcc

SEQ ID NO: 4528851 - DNA, 14 bp, Homo sapiens
ctccccagagctgg

SEQ ID NO: 4528852 - DNA, 15 bp, Homo sapiens
ctccccagccagccc

SEQ ID NO: 4528853 - DNA, 16 bp, Homo sapiens
ctccccagccagccct

SEQ ID NO: 4528854 - DNA, 21 bp, Homo sapiens
ctccccagccagcccttccct

SEQ ID NO: 4528855 - DNA, 15 bp, Homo sapiens
ctccccagccccagc

SEQ ID NO: 4528856 - DNA, 13 bp, Homo sapiens
ctccccagccccc

SEQ ID NO: 4528857 - DNA, 11 bp, Homo sapiens
ctccccagggg

SEQ ID NO: 4528858 - DNA, 21 bp, Homo sapiens
ctccccagtacaggggtgctg

SEQ ID NO: 4528859 - DNA, 13 bp, Homo sapiens
ctccccagtgcct

SEQ ID NO: 4528860 - DNA, 20 bp, Homo sapiens
ctccccagtgcctgccactc

SEQ ID NO: 4528861 - DNA, 22 bp, Homo sapiens
ctccccagtgcctgccactctc

SEQ ID NO: 4528862 - DNA, 17 bp, Homo sapiens
ctccccagttccacagc

SEQ ID NO: 4528863 - DNA, 21 bp, Homo sapiens
ctccccagttccacagcagtg

SEQ ID NO: 4528864 - DNA, 20 bp, Homo sapiens
ctccccatttcccatctgca

SEQ ID NO: 4528865 - DNA, 23 bp, Homo sapiens
ctcccccaacccccaccccacac

SEQ ID NO: 4528866 - DNA, 22 bp, Homo sapiens
ctcccccagttcctcccaggaa

SEQ ID NO: 4528867 - DNA, 23 bp, Homo sapiens
ctcccccctcctctgaaacagct

SEQ ID NO: 4528868 - DNA, 20 bp, Homo sapiens
ctcccccgtggtgcctgcac

SEQ ID NO: 4528869 - DNA, 22 bp, Homo sapiens
ctcccccgtttctccttttcct

SEQ ID NO: 4528870 - DNA, 12 bp, Homo sapiens
ctccccctcaga

SEQ ID NO: 4528871 - DNA, 15 bp, Homo sapiens
ctccccctcctccag

SEQ ID NO: 4528872 - DNA, 16 bp, Homo sapiens
ctccccctccttgtgc

SEQ ID NO: 4528873 - DNA, 13 bp, Homo sapiens
ctccccctgcaac

SEQ ID NO: 4528874 - DNA, 17 bp, Homo sapiens
ctccccctgccagtgcc

SEQ ID NO: 4528875 - DNA, 13 bp, Homo sapiens
ctccccctgcgcc

SEQ ID NO: 4528876 - DNA, 23 bp, Homo sapiens
ctcccccttccccttctgtgtca

SEQ ID NO: 4528877 - DNA, 22 bp, Homo sapiens
ctccccctttcacactggatcc

SEQ ID NO: 4528878 - DNA, 20 bp, Homo sapiens
ctccccgcagcccgcctgcc

SEQ ID NO: 4528879 - DNA, 15 bp, Homo sapiens
ctccccgcctccact

SEQ ID NO: 4528880 - DNA, 14 bp, Homo sapiens
ctccccgctctgga

SEQ ID NO: 4528881 - DNA, 23 bp, Homo sapiens
ctcccctatccacccagcccatt

SEQ ID NO: 4528882 - DNA, 14 bp, Homo sapiens
ctcccctattttaa

SEQ ID NO: 4528883 - DNA, 15 bp, Homo sapiens
ctcccctattttaag

SEQ ID NO: 4528884 - DNA, 13 bp, Homo sapiens
ctcccctctcctc

SEQ ID NO: 4528885 - DNA, 16 bp, Homo sapiens
ctcccctgcccccagg

SEQ ID NO: 4528886 - DNA, 20 bp, Homo sapiens
ctcccctgcccccaggactg

SEQ ID NO: 4528887 - DNA, 12 bp, Homo sapiens
ctcccctggctg

SEQ ID NO: 4528888 - DNA, 18 bp, Homo sapiens
ctcccctggctggctcct

SEQ ID NO: 4528889 - DNA, 20 bp, Homo sapiens
ctcccctggctggctcctag

SEQ ID NO: 4528890 - DNA, 13 bp, Homo sapiens
ctccccttcctgt

SEQ ID NO: 4528891 - DNA, 20 bp, Homo sapiens
ctcccgaaaaatgtgtggtt

SEQ ID NO: 4528892 - DNA, 19 bp, Homo sapiens
ctcccgccactcgccttct

SEQ ID NO: 4528893 - DNA, 14 bp, Homo sapiens
ctcccgccccgccc

SEQ ID NO: 4528894 - DNA, 18 bp, Homo sapiens
ctcccgccccgcccctcc

SEQ ID NO: 4528895 - DNA, 22 bp, Homo sapiens
ctcccgcccttccatgtgcctt

SEQ ID NO: 4528896 - DNA, 13 bp, Homo sapiens
ctcccgctcccag

SEQ ID NO: 4528897 - DNA, 15 bp, Homo sapiens
ctcccggggcctgga

SEQ ID NO: 4528898 - DNA, 19 bp, Homo sapiens
ctccctaaactttggcctt

SEQ ID NO: 4528899 - DNA, 18 bp, Homo sapiens
ctccctaatttatgtgct

SEQ ID NO: 4528900 - DNA, 13 bp, Homo sapiens
ctccctaccctaa

SEQ ID NO: 4528901 - DNA, 19 bp, Homo sapiens
ctccctcaccccctccttc

SEQ ID NO: 4528902 - DNA, 17 bp, Homo sapiens
ctccctcagacccagcg

SEQ ID NO: 4528903 - DNA, 12 bp, Homo sapiens
ctccctcagact

SEQ ID NO: 4528904 - DNA, 14 bp, Homo sapiens
ctccctcagactca

SEQ ID NO: 4528905 - DNA, 15 bp, Homo sapiens
ctccctcagactcag

SEQ ID NO: 4528906 - DNA, 17 bp, Homo sapiens
ctccctcagctctctgg

SEQ ID NO: 4528907 - DNA, 18 bp, Homo sapiens
ctccctcagctctctggg

SEQ ID NO: 4528908 - DNA, 10 bp, Homo sapiens
ctccctcagg

SEQ ID NO: 4528909 - DNA, 13 bp, Homo sapiens
ctccctcaggccc

SEQ ID NO: 4528910 - DNA, 13 bp, Homo sapiens
ctcattttttaaa

SEQ ID NO: 4528911 - DNA, 15 bp, Homo sapiens
ctccaaaacatttct

SEQ ID NO: 4528912 - DNA, 22 bp, Homo sapiens
ctccaaaatgttggtcatttta

SEQ ID NO: 4528913 - DNA, 13 bp, Homo sapiens
ctccaaagaaatg

SEQ ID NO: 4528914 - DNA, 20 bp, Homo sapiens
ctccaaagagccttcagaat

SEQ ID NO: 4528915 - DNA, 19 bp, Homo sapiens
ctccaaatccaaggaaaca

SEQ ID NO: 4528916 - DNA, 13 bp, Homo sapiens
ctccaaatgtcct

SEQ ID NO: 4528917 - DNA, 21 bp, Homo sapiens
ctccaacacagtgcatctcag

SEQ ID NO: 4528918 - DNA, 19 bp, Homo sapiens
ctccaagacagcagcagcc

SEQ ID NO: 4528919 - DNA, 20 bp, Homo sapiens
ctccaagacagcagcagcct

SEQ ID NO: 4528920 - DNA, 21 bp, Homo sapiens
ctccaagacagcagcagcctg

SEQ ID NO: 4528921 - DNA, 20 bp, Homo sapiens
ctccaagagctacataattt

SEQ ID NO: 4528922 - DNA, 16 bp, Homo sapiens
ctccaagcacagagcc

SEQ ID NO: 4528923 - DNA, 19 bp, Homo sapiens
ctccaagcacagagcctgg

SEQ ID NO: 4528924 - DNA, 14 bp, Homo sapiens
ctccaagcctgcct

SEQ ID NO: 4528925 - DNA, 18 bp, Homo sapiens
ctccaagcctgcctccca

SEQ ID NO: 4528926 - DNA, 19 bp, Homo sapiens
ctccaagcctgcctcccaa

SEQ ID NO: 4528927 - DNA, 22 bp, Homo sapiens
ctccaagtagtccaccttcatt

SEQ ID NO: 4528928 - DNA, 16 bp, Homo sapiens
ctccaagtctcagtgg

SEQ ID NO: 4528929 - DNA, 22 bp, Homo sapiens
ctccaataaagtgccttctggg

SEQ ID NO: 4528930 - DNA, 14 bp, Homo sapiens
ctccaatggaaagc

SEQ ID NO: 4528931 - DNA, 11 bp, Homo sapiens
ctccaatgtcg

SEQ ID NO: 4528932 - DNA, 18 bp, Homo sapiens
ctccaattctgaaatact

SEQ ID NO: 4528933 - DNA, 22 bp, Homo sapiens
ctccacacaggtgttccgtggg

SEQ ID NO: 4528934 - DNA, 16 bp, Homo sapiens
ctccacacgccccggt

SEQ ID NO: 4528935 - DNA, 17 bp, Homo sapiens
ctccacacgccccggtc

SEQ ID NO: 4528936 - DNA, 14 bp, Homo sapiens
ctccacactgacca

SEQ ID NO: 4528937 - DNA, 22 bp, Homo sapiens
ctccacactgaccaagtgctgg

SEQ ID NO: 4528938 - DNA, 14 bp, Homo sapiens
ctccacagagagga

SEQ ID NO: 4528939 - DNA, 22 bp, Homo sapiens
ctccacatcaacattccaggga

SEQ ID NO: 4528940 - DNA, 17 bp, Homo sapiens
ctccacatcctccacgt

SEQ ID NO: 4528941 - DNA, 17 bp, Homo sapiens
ctccacatctgccttaa

SEQ ID NO: 4528942 - DNA, 20 bp, Homo sapiens
ctccaccaacccatcagaag

SEQ ID NO: 4528943 - DNA, 16 bp, Homo sapiens
ctccaccacccaaaag

SEQ ID NO: 4528944 - DNA, 15 bp, Homo sapiens
ctccaccagcagcat

SEQ ID NO: 4528945 - DNA, 11 bp, Homo sapiens
ctccaccccag

SEQ ID NO: 4528946 - DNA, 13 bp, Homo sapiens
ctccaccctctga

SEQ ID NO: 4528947 - DNA, 17 bp, Homo sapiens
ctccacccttggcctgt

SEQ ID NO: 4528948 - DNA, 12 bp, Homo sapiens
ctccacctcagc

SEQ ID NO: 4528949 - DNA, 16 bp, Homo sapiens
ctccacgcctcctggc

SEQ ID NO: 4528950 - DNA, 21 bp, Homo sapiens
ctccacgcctcctggccagac

SEQ ID NO: 4528951 - DNA, 13 bp, Homo sapiens
ctccactccttcc

SEQ ID NO: 4528952 - DNA, 20 bp, Homo sapiens
ctccactctagttctagatg

SEQ ID NO: 4528953 - DNA, 16 bp, Homo sapiens
ctccactctcccccac

SEQ ID NO: 4528954 - DNA, 24 bp, Homo sapiens
ctccactcttgatctctcttgtcc

SEQ ID NO: 4528955 - DNA, 11 bp, Homo sapiens
ctccactgctg

SEQ ID NO: 4528956 - DNA, 12 bp, Homo sapiens
ctccactgctgg

SEQ ID NO: 4528957 - DNA, 18 bp, Homo sapiens
ctccagaagcctctggct

SEQ ID NO: 4528958 - DNA, 19 bp, Homo sapiens
ctccagaagcctctggcta

SEQ ID NO: 4528959 - DNA, 13 bp, Homo sapiens
ctccagagacact

SEQ ID NO: 4528960 - DNA, 23 bp, Homo sapiens
ctccagcaccttctttctggact

SEQ ID NO: 4528961 - DNA, 13 bp, Homo sapiens
ctccagccagcgc

SEQ ID NO: 4528962 - DNA, 20 bp, Homo sapiens
ctccagccagcgcctccctc

SEQ ID NO: 4528963 - DNA, 22 bp, Homo sapiens
ctccagccagcgcctccctcca

SEQ ID NO: 4528964 - DNA, 16 bp, Homo sapiens
ctccagcctcccctcc

SEQ ID NO: 4528965 - DNA, 14 bp, Homo sapiens
ctccagcctctgcc

SEQ ID NO: 4528966 - DNA, 15 bp, Homo sapiens
ctccagcctctgccg

SEQ ID NO: 4528967 - DNA, 17 bp, Homo sapiens
ctccagcctctgccgct

SEQ ID NO: 4528968 - DNA, 23 bp, Homo sapiens
ctccagcctgggcaacaagagca

SEQ ID NO: 4528969 - DNA, 16 bp, Homo sapiens
ctccagcctgggggac

SEQ ID NO: 4528970 - DNA, 21 bp, Homo sapiens
ctccagcctgggtcacagagt

SEQ ID NO: 4528971 - DNA, 23 bp, Homo sapiens
ctccagcgatggtgctgcccagg

SEQ ID NO: 4528972 - DNA, 21 bp, Homo sapiens
ctccagctcgtgtgtcctcat

SEQ ID NO: 4528973 - DNA, 16 bp, Homo sapiens
ctccagctctggcaca

SEQ ID NO: 4528974 - DNA, 13 bp, Homo sapiens
ctccagctgcccc

SEQ ID NO: 4528975 - DNA, 12 bp, Homo sapiens
ctccagctgcga

SEQ ID NO: 4528976 - DNA, 21 bp, Homo sapiens
ctccagctgctgagatcctgg

SEQ ID NO: 4528977 - DNA, 23 bp, Homo sapiens
ctccagctgctgagatcctggac

SEQ ID NO: 4528978 - DNA, 16 bp, Homo sapiens
ctccaggaaagagcag

SEQ ID NO: 4528979 - DNA, 20 bp, Homo sapiens
ctccaggaaagagcagtcag

SEQ ID NO: 4528980 - DNA, 15 bp, Homo sapiens
ctccaggaagaaaga

SEQ ID NO: 4528981 - DNA, 15 bp, Homo sapiens
ctccaggatctttga

SEQ ID NO: 4528982 - DNA, 22 bp, Homo sapiens
ctccaggatctttgactgaaaa

SEQ ID NO: 4528983 - DNA, 18 bp, Homo sapiens
ctccaggattttaatttc

SEQ ID NO: 4528984 - DNA, 20 bp, Homo sapiens
ctccaggcatttagccctca

SEQ ID NO: 4528985 - DNA, 11 bp, Homo sapiens
ctccaggccca

SEQ ID NO: 4528986 - DNA, 12 bp, Homo sapiens
ctccaggcccaa

SEQ ID NO: 4528987 - DNA, 17 bp, Homo sapiens
ctccaggcccaaggctc

SEQ ID NO: 4528988 - DNA, 16 bp, Homo sapiens
ctccaggcccccaact

SEQ ID NO: 4528989 - DNA, 13 bp, Homo sapiens
ctccaggcctgcc

SEQ ID NO: 4528990 - DNA, 22 bp, Homo sapiens
ctccagggaaggtggccacagc

SEQ ID NO: 4528991 - DNA, 22 bp, Homo sapiens
ctccagggatgattcaagccat

SEQ ID NO: 4528992 - DNA, 18 bp, Homo sapiens
ctccagggccacgtgcca

SEQ ID NO: 4528993 - DNA, 19 bp, Homo sapiens
ctccagggccacgtgccag

SEQ ID NO: 4528994 - DNA, 18 bp, Homo sapiens
ctccagggcccccaccga

SEQ ID NO: 4528995 - DNA, 21 bp, Homo sapiens
ctccagggcctctccttggaa

SEQ ID NO: 4528996 - DNA, 23 bp, Homo sapiens
ctccagggcctctccttggaagg

SEQ ID NO: 4528997 - DNA, 17 bp, Homo sapiens
ctccagggctggactga

SEQ ID NO: 4528998 - DNA, 18 bp, Homo sapiens
ctccagggctggactgag

SEQ ID NO: 4528999 - DNA, 14 bp, Homo sapiens
ctccaggggcacct

SEQ ID NO: 4529000 - DNA, 19 bp, Homo sapiens
ctccaggggggacaatatg

SEQ ID NO: 4529001 - DNA, 16 bp, Homo sapiens
ctccagtcatggtact

SEQ ID NO: 4529002 - DNA, 12 bp, Homo sapiens
ctccagtgcagt

SEQ ID NO: 4529003 - DNA, 13 bp, Homo sapiens
ctccagtgcagtc

SEQ ID NO: 4529004 - DNA, 22 bp, Homo sapiens
ctccagtgggctgatgctggga

SEQ ID NO: 4529005 - DNA, 21 bp, Homo sapiens
ctccagtttttgtttttgcat

SEQ ID NO: 4529006 - DNA, 14 bp, Homo sapiens
ctccatacagcctc

SEQ ID NO: 4529007 - DNA, 18 bp, Homo sapiens
ctccataccttttctctt

SEQ ID NO: 4529008 - DNA, 19 bp, Homo sapiens
ctccatactgggctaagga

SEQ ID NO: 4529009 - DNA, 20 bp, Homo sapiens
ctccatatctccatggccct

SEQ ID NO: 4529010 - DNA, 16 bp, Homo sapiens
ctccatcagaaaacca

SEQ ID NO: 4529011 - DNA, 20 bp, Homo sapiens
ctccatccacatgggagccg

SEQ ID NO: 4529012 - DNA, 14 bp, Homo sapiens
ctccatcccctccc

SEQ ID NO: 4529013 - DNA, 19 bp, Homo sapiens
ctccatcccctccctgcct

SEQ ID NO: 4529014 - DNA, 23 bp, Homo sapiens
ctccatcccctccctgcctgctc

SEQ ID NO: 4529015 - DNA, 23 bp, Homo sapiens
ctccatcctaccccctgtgcctt

SEQ ID NO: 4529016 - DNA, 13 bp, Homo sapiens
ctccatcctgctg

SEQ ID NO: 4529017 - DNA, 17 bp, Homo sapiens
ctccatctccgcctcca

SEQ ID NO: 4529018 - DNA, 19 bp, Homo sapiens
ctccatctccgcctccaca

SEQ ID NO: 4529019 - DNA, 20 bp, Homo sapiens
ctccatcttggtagttctgt

SEQ ID NO: 4529020 - DNA, 22 bp, Homo sapiens
ctccatcttggtagttctgtgc

SEQ ID NO: 4529021 - DNA, 14 bp, Homo sapiens
ctccatgctcctca

SEQ ID NO: 4529022 - DNA, 17 bp, Homo sapiens
ctccatggggttcgaga

SEQ ID NO: 4529023 - DNA, 23 bp, Homo sapiens
ctccatggggttcgagactccat

SEQ ID NO: 4529024 - DNA, 14 bp, Homo sapiens
ctccatgtgtgtgc

SEQ ID NO: 4529025 - DNA, 17 bp, Homo sapiens
ctccattctattttaga

SEQ ID NO: 4529026 - DNA, 20 bp, Homo sapiens
ctcccaaacgccctttcctc

SEQ ID NO: 4529027 - DNA, 17 bp, Homo sapiens
ctcccaaagctcagact

SEQ ID NO: 4529028 - DNA, 15 bp, Homo sapiens
ctcccaaagtgctga

SEQ ID NO: 4529029 - DNA, 22 bp, Homo sapiens
ctcccaaagtgttgggattaca

SEQ ID NO: 4529030 - DNA, 15 bp, Homo sapiens
ctcaggcacacagct

SEQ ID NO: 4529031 - DNA, 13 bp, Homo sapiens
ctcaggcccagga

SEQ ID NO: 4529032 - DNA, 19 bp, Homo sapiens
ctcaggcccaggagtccag

SEQ ID NO: 4529033 - DNA, 12 bp, Homo sapiens
ctcaggccgaga

SEQ ID NO: 4529034 - DNA, 20 bp, Homo sapiens
ctcaggctcctaaagagaca

SEQ ID NO: 4529035 - DNA, 20 bp, Homo sapiens
ctcagggacagagacacctg

SEQ ID NO: 4529036 - DNA, 23 bp, Homo sapiens
ctcagggacagagacacctgcac

SEQ ID NO: 4529037 - DNA, 21 bp, Homo sapiens
ctcagggaccggtgctgcagg

SEQ ID NO: 4529038 - DNA, 23 bp, Homo sapiens
ctcagggaccggtgctgcaggag

SEQ ID NO: 4529039 - DNA, 18 bp, Homo sapiens
ctcagggagcagggaagg

SEQ ID NO: 4529040 - DNA, 21 bp, Homo sapiens
ctcagggagcagggaaggcct

SEQ ID NO: 4529041 - DNA, 22 bp, Homo sapiens
ctcagggagcagggaaggcctg

SEQ ID NO: 4529042 - DNA, 14 bp, Homo sapiens
ctcagggagcctcc

SEQ ID NO: 4529043 - DNA, 15 bp, Homo sapiens
ctcagggagcctccc

SEQ ID NO: 4529044 - DNA, 18 bp, Homo sapiens
ctcagggattctgggctt

SEQ ID NO: 4529045 - DNA, 17 bp, Homo sapiens
ctcagggcctcaggcac

SEQ ID NO: 4529046 - DNA, 18 bp, Homo sapiens
ctcagggcctcaggcacc

SEQ ID NO: 4529047 - DNA, 14 bp, Homo sapiens
ctcagggctcctgg

SEQ ID NO: 4529048 - DNA, 17 bp, Homo sapiens
ctcagggctcctgggtt

SEQ ID NO: 4529049 - DNA, 13 bp, Homo sapiens
ctcagggctgtcc

SEQ ID NO: 4529050 - DNA, 22 bp, Homo sapiens
ctcagggctgtcccagccccgg

SEQ ID NO: 4529051 - DNA, 14 bp, Homo sapiens
ctcaggggcctctc

SEQ ID NO: 4529052 - DNA, 13 bp, Homo sapiens
ctcagggtggggg

SEQ ID NO: 4529053 - DNA, 12 bp, Homo sapiens
ctcaggttccag

SEQ ID NO: 4529054 - DNA, 13 bp, Homo sapiens
ctcaggttccaga

SEQ ID NO: 4529055 - DNA, 14 bp, Homo sapiens
ctcaggttccagaa

SEQ ID NO: 4529056 - DNA, 16 bp, Homo sapiens
ctcaggttccagaaca

SEQ ID NO: 4529057 - DNA, 17 bp, Homo sapiens
ctcaggtttttgaggaa

SEQ ID NO: 4529058 - DNA, 18 bp, Homo sapiens
ctcagtaatttagaaatc

SEQ ID NO: 4529059 - DNA, 17 bp, Homo sapiens
ctcagtacccagaacag

SEQ ID NO: 4529060 - DNA, 18 bp, Homo sapiens
ctcagtcattagactcct

SEQ ID NO: 4529061 - DNA, 14 bp, Homo sapiens
ctcagtctctgagc

SEQ ID NO: 4529062 - DNA, 21 bp, Homo sapiens
ctcagtctgttcactgcattc

SEQ ID NO: 4529063 - DNA, 15 bp, Homo sapiens
ctcagtgaagaatac

SEQ ID NO: 4529064 - DNA, 14 bp, Homo sapiens
ctcagtgaccagtg

SEQ ID NO: 4529065 - DNA, 15 bp, Homo sapiens
ctcagtgagcctcct

SEQ ID NO: 4529066 - DNA, 17 bp, Homo sapiens
ctcagtgagcctcctgt

SEQ ID NO: 4529067 - DNA, 18 bp, Homo sapiens
ctcagtgagcctcctgtg

SEQ ID NO: 4529068 - DNA, 22 bp, Homo sapiens
ctcagtgcatttgtgctagaaa

SEQ ID NO: 4529069 - DNA, 12 bp, Homo sapiens
ctcagtgctcct

SEQ ID NO: 4529070 - DNA, 14 bp, Homo sapiens
ctcagtgctcctgg

SEQ ID NO: 4529071 - DNA, 21 bp, Homo sapiens
ctcagtggcttcatctgtcaa

SEQ ID NO: 4529072 - DNA, 13 bp, Homo sapiens
ctcagtggcttct

SEQ ID NO: 4529073 - DNA, 16 bp, Homo sapiens
ctcagtggcttctcca

SEQ ID NO: 4529074 - DNA, 21 bp, Homo sapiens
ctcagttcaacctggtggcac

SEQ ID NO: 4529075 - DNA, 22 bp, Homo sapiens
ctcagttcaacctggtggcacc

SEQ ID NO: 4529076 - DNA, 15 bp, Homo sapiens
ctcagttcccttggc

SEQ ID NO: 4529077 - DNA, 22 bp, Homo sapiens
ctcagttcccttggcctcagaa

SEQ ID NO: 4529078 - DNA, 13 bp, Homo sapiens
ctcagttccttca

SEQ ID NO: 4529079 - DNA, 14 bp, Homo sapiens
ctcagttttcataa

SEQ ID NO: 4529080 - DNA, 15 bp, Homo sapiens
ctcataagcatatgt

SEQ ID NO: 4529081 - DNA, 21 bp, Homo sapiens
ctcataattcctacagcacta

SEQ ID NO: 4529082 - DNA, 21 bp, Homo sapiens
ctcatactacattgagtagac

SEQ ID NO: 4529083 - DNA, 15 bp, Homo sapiens
ctcataggttaaaaa

SEQ ID NO: 4529084 - DNA, 16 bp, Homo sapiens
ctcataggttgagcaa

SEQ ID NO: 4529085 - DNA, 19 bp, Homo sapiens
ctcatattgtgattctgcc

SEQ ID NO: 4529086 - DNA, 13 bp, Homo sapiens
ctcatcaactgaa

SEQ ID NO: 4529087 - DNA, 17 bp, Homo sapiens
ctcatcacataaagaaa

SEQ ID NO: 4529088 - DNA, 16 bp, Homo sapiens
ctcatcacccttccga

SEQ ID NO: 4529089 - DNA, 14 bp, Homo sapiens
ctcatcatattttg

SEQ ID NO: 4529090 - DNA, 17 bp, Homo sapiens
ctcatcatgtctattgt

SEQ ID NO: 4529091 - DNA, 14 bp, Homo sapiens
ctcatcattctctg

SEQ ID NO: 4529092 - DNA, 13 bp, Homo sapiens
ctcatcatttttt

SEQ ID NO: 4529093 - DNA, 15 bp, Homo sapiens
ctcatccagcctcag

SEQ ID NO: 4529094 - DNA, 16 bp, Homo sapiens
ctcatccatcatcatg

SEQ ID NO: 4529095 - DNA, 13 bp, Homo sapiens
ctcatccccaggg

SEQ ID NO: 4529096 - DNA, 14 bp, Homo sapiens
ctcatccctggact

SEQ ID NO: 4529097 - DNA, 13 bp, Homo sapiens
ctcatcctcccat

SEQ ID NO: 4529098 - DNA, 22 bp, Homo sapiens
ctcatcctcccattgcccagtg

SEQ ID NO: 4529099 - DNA, 23 bp, Homo sapiens
ctcatcctcccattgcccagtga

SEQ ID NO: 4529100 - DNA, 18 bp, Homo sapiens
ctcatcctgatttttact

SEQ ID NO: 4529101 - DNA, 14 bp, Homo sapiens
ctcatcctgctctt

SEQ ID NO: 4529102 - DNA, 16 bp, Homo sapiens
ctcatcctgctctttt

SEQ ID NO: 4529103 - DNA, 23 bp, Homo sapiens
ctcatcctgctcttttgtgatga

SEQ ID NO: 4529104 - DNA, 24 bp, Homo sapiens
ctcatcctgctcttttgtgatgaa

SEQ ID NO: 4529105 - DNA, 16 bp, Homo sapiens
ctcatctcagaccctg

SEQ ID NO: 4529106 - DNA, 14 bp, Homo sapiens
ctcatctcccaggc

SEQ ID NO: 4529107 - DNA, 15 bp, Homo sapiens
ctcatctcccaggcc

SEQ ID NO: 4529108 - DNA, 16 bp, Homo sapiens
ctcatctcccaggccc

SEQ ID NO: 4529109 - DNA, 22 bp, Homo sapiens
ctcatctcttagctcccctcca

SEQ ID NO: 4529110 - DNA, 13 bp, Homo sapiens
ctcatctgcaaaa

SEQ ID NO: 4529111 - DNA, 18 bp, Homo sapiens
ctcatctgcaggacagag

SEQ ID NO: 4529112 - DNA, 18 bp, Homo sapiens
ctcatcttagttctgtat

SEQ ID NO: 4529113 - DNA, 14 bp, Homo sapiens
ctcatcttgtgaaa

SEQ ID NO: 4529114 - DNA, 14 bp, Homo sapiens
ctcatctttctcct

SEQ ID NO: 4529115 - DNA, 12 bp, Homo sapiens
ctcatctttctt

SEQ ID NO: 4529116 - DNA, 14 bp, Homo sapiens
ctcatgactttata

SEQ ID NO: 4529117 - DNA, 21 bp, Homo sapiens
ctcatgagctgtgttcacaga

SEQ ID NO: 4529118 - DNA, 18 bp, Homo sapiens
ctcatgagtgtgccccat

SEQ ID NO: 4529119 - DNA, 16 bp, Homo sapiens
ctcatgatcaagatat

SEQ ID NO: 4529120 - DNA, 22 bp, Homo sapiens
ctcatgatcaagatatatgtgt

SEQ ID NO: 4529121 - DNA, 18 bp, Homo sapiens
ctcatgcacccctgagcc

SEQ ID NO: 4529122 - DNA, 18 bp, Homo sapiens
ctcatgccagtgccttat

SEQ ID NO: 4529123 - DNA, 17 bp, Homo sapiens
ctcatgccccctttcag

SEQ ID NO: 4529124 - DNA, 18 bp, Homo sapiens
ctcatgcgtacgtcccac

SEQ ID NO: 4529125 - DNA, 15 bp, Homo sapiens
ctcatgctaatataa

SEQ ID NO: 4529126 - DNA, 14 bp, Homo sapiens
ctcatgctgttgct

SEQ ID NO: 4529127 - DNA, 22 bp, Homo sapiens
ctcatgggtcctagcccttccc

SEQ ID NO: 4529128 - DNA, 14 bp, Homo sapiens
ctcatgggtggcac

SEQ ID NO: 4529129 - DNA, 14 bp, Homo sapiens
ctcatgtgactctt

SEQ ID NO: 4529130 - DNA, 15 bp, Homo sapiens
ctcatgtttacaggg

SEQ ID NO: 4529131 - DNA, 19 bp, Homo sapiens
ctcattaaactctaaagat

SEQ ID NO: 4529132 - DNA, 20 bp, Homo sapiens
ctcattaaactctaaagatt

SEQ ID NO: 4529133 - DNA, 19 bp, Homo sapiens
ctcattagaattaccattt

SEQ ID NO: 4529134 - DNA, 17 bp, Homo sapiens
ctcattaggatggctag

SEQ ID NO: 4529135 - DNA, 17 bp, Homo sapiens
ctcattatttcaaaatg

SEQ ID NO: 4529136 - DNA, 17 bp, Homo sapiens
ctcattccagaggaagg

SEQ ID NO: 4529137 - DNA, 12 bp, Homo sapiens
ctcattccagat

SEQ ID NO: 4529138 - DNA, 12 bp, Homo sapiens
ctcattccccag

SEQ ID NO: 4529139 - DNA, 17 bp, Homo sapiens
ctcattccccattctgt

SEQ ID NO: 4529140 - DNA, 15 bp, Homo sapiens
ctcattgaaatgtaa

SEQ ID NO: 4529141 - DNA, 23 bp, Homo sapiens
ctcattgaaatgtaatttcagtt

SEQ ID NO: 4529142 - DNA, 21 bp, Homo sapiens
ctcattgagaattcaaatcct

SEQ ID NO: 4529143 - DNA, 13 bp, Homo sapiens
ctcattggaccct

SEQ ID NO: 4529144 - DNA, 15 bp, Homo sapiens
ctcattgtttttccc

SEQ ID NO: 4529145 - DNA, 14 bp, Homo sapiens
ctcatttaaatatc

SEQ ID NO: 4529146 - DNA, 14 bp, Homo sapiens
ctcatttcacccct

SEQ ID NO: 4529147 - DNA, 17 bp, Homo sapiens
ctcatttcacccctccc

SEQ ID NO: 4529148 - DNA, 13 bp, Homo sapiens
ctcatttcatctc

SEQ ID NO: 4529149 - DNA, 16 bp, Homo sapiens
ctcatttcatctcatt

SEQ ID NO: 4529150 - DNA, 15 bp, Homo sapiens
ctcattttaatgtaa

SEQ ID NO: 4529151 - DNA, 16 bp, Homo sapiens
ctcattttagttgcct

SEQ ID NO: 4529152 - DNA, 15 bp, Homo sapiens
ctcactcctccgtga

SEQ ID NO: 4529153 - DNA, 14 bp, Homo sapiens
ctcactcctgagac

SEQ ID NO: 4529154 - DNA, 20 bp, Homo sapiens
ctcactcctgagacccctgg

SEQ ID NO: 4529155 - DNA, 22 bp, Homo sapiens
ctcactcctgagacccctggcc

SEQ ID NO: 4529156 - DNA, 23 bp, Homo sapiens
ctcactctgtccctgtccttccc

SEQ ID NO: 4529157 - DNA, 22 bp, Homo sapiens
ctcactgcatcctctgcctccc

SEQ ID NO: 4529158 - DNA, 14 bp, Homo sapiens
ctcactgccaggcc

SEQ ID NO: 4529159 - DNA, 22 bp, Homo sapiens
ctcactgccaggccagcctccg

SEQ ID NO: 4529160 - DNA, 16 bp, Homo sapiens
ctcactgcttgaacta

SEQ ID NO: 4529161 - DNA, 18 bp, Homo sapiens
ctcactgcttgaactagg

SEQ ID NO: 4529162 - DNA, 19 bp, Homo sapiens
ctcactgggcccgagcctg

SEQ ID NO: 4529163 - DNA, 22 bp, Homo sapiens
ctcactgtccaatatgaaaacc

SEQ ID NO: 4529164 - DNA, 20 bp, Homo sapiens
ctcactgtctatttaagtgc

SEQ ID NO: 4529165 - DNA, 23 bp, Homo sapiens
ctcactgtgggaaggccagctgc

SEQ ID NO: 4529166 - DNA, 19 bp, Homo sapiens
ctcactgtgtataggaatt

SEQ ID NO: 4529167 - DNA, 16 bp, Homo sapiens
ctcactgtttataaat

SEQ ID NO: 4529168 - DNA, 14 bp, Homo sapiens
ctcacttagtcctt

SEQ ID NO: 4529169 - DNA, 15 bp, Homo sapiens
ctcacttatctgata

SEQ ID NO: 4529170 - DNA, 16 bp, Homo sapiens
ctcacttatctgatac

SEQ ID NO: 4529171 - DNA, 17 bp, Homo sapiens
ctcacttcgcttcctgg

SEQ ID NO: 4529172 - DNA, 13 bp, Homo sapiens
ctcacttctaaat

SEQ ID NO: 4529173 - DNA, 24 bp, Homo sapiens
ctcacttctagatctcagccattc

SEQ ID NO: 4529174 - DNA, 20 bp, Homo sapiens
ctcacttctgggcttcatct

SEQ ID NO: 4529175 - DNA, 16 bp, Homo sapiens
ctcactttactttcaa

SEQ ID NO: 4529176 - DNA, 17 bp, Homo sapiens
ctcactttactttcaag

SEQ ID NO: 4529177 - DNA, 20 bp, Homo sapiens
ctcactttcctcctgaggct

SEQ ID NO: 4529178 - DNA, 15 bp, Homo sapiens
ctcactttgtaaata

SEQ ID NO: 4529179 - DNA, 22 bp, Homo sapiens
ctcagaaagatttgatgggcca

SEQ ID NO: 4529180 - DNA, 17 bp, Homo sapiens
ctcagaaatctgtttga

SEQ ID NO: 4529181 - DNA, 15 bp, Homo sapiens
ctcagaaggccccag

SEQ ID NO: 4529182 - DNA, 20 bp, Homo sapiens
ctcagaaggccccagagaga

SEQ ID NO: 4529183 - DNA, 20 bp, Homo sapiens
ctcagaattcggtgtgctgc

SEQ ID NO: 4529184 - DNA, 14 bp, Homo sapiens
ctcagacatttata

SEQ ID NO: 4529185 - DNA, 14 bp, Homo sapiens
ctcagacccaacag

SEQ ID NO: 4529186 - DNA, 11 bp, Homo sapiens
ctcagacccag

SEQ ID NO: 4529187 - DNA, 23 bp, Homo sapiens
ctcagacccagcggtccaatgcc

SEQ ID NO: 4529188 - DNA, 12 bp, Homo sapiens
ctcagacccagg

SEQ ID NO: 4529189 - DNA, 13 bp, Homo sapiens
ctcagacccagga

SEQ ID NO: 4529190 - DNA, 18 bp, Homo sapiens
ctcagacccaggagtcca

SEQ ID NO: 4529191 - DNA, 22 bp, Homo sapiens
ctcagacccaggagtccagacc

SEQ ID NO: 4529192 - DNA, 20 bp, Homo sapiens
ctcagacccaggggtccagg

SEQ ID NO: 4529193 - DNA, 13 bp, Homo sapiens
ctcagacccccac

SEQ ID NO: 4529194 - DNA, 16 bp, Homo sapiens
ctcagacccccactct

SEQ ID NO: 4529195 - DNA, 19 bp, Homo sapiens
ctcagacgggctgagagga

SEQ ID NO: 4529196 - DNA, 19 bp, Homo sapiens
ctcagacgtgtgacctcca

SEQ ID NO: 4529197 - DNA, 17 bp, Homo sapiens
ctcagacgttgcctgag

SEQ ID NO: 4529198 - DNA, 22 bp, Homo sapiens
ctcagacgttgcctgagaagaa

SEQ ID NO: 4529199 - DNA, 14 bp, Homo sapiens
ctcagactcagagg

SEQ ID NO: 4529200 - DNA, 20 bp, Homo sapiens
ctcagagatgtgcacccatg

SEQ ID NO: 4529201 - DNA, 19 bp, Homo sapiens
ctcagagcgccaggaagcc

SEQ ID NO: 4529202 - DNA, 22 bp, Homo sapiens
ctcagagcgccaggaagccaga

SEQ ID NO: 4529203 - DNA, 11 bp, Homo sapiens
ctcagagcttt

SEQ ID NO: 4529204 - DNA, 22 bp, Homo sapiens
ctcagaggcctgctgccagtgc

SEQ ID NO: 4529205 - DNA, 17 bp, Homo sapiens
ctcagaggtccaggccc

SEQ ID NO: 4529206 - DNA, 22 bp, Homo sapiens
ctcagattcttcattgaggatt

SEQ ID NO: 4529207 - DNA, 22 bp, Homo sapiens
ctcagcaactgttagctgggaa

SEQ ID NO: 4529208 - DNA, 22 bp, Homo sapiens
ctcagcacattcgggaccaata

SEQ ID NO: 4529209 - DNA, 19 bp, Homo sapiens
ctcagcagcagagagccct

SEQ ID NO: 4529210 - DNA, 14 bp, Homo sapiens
ctcagcagccctcc

SEQ ID NO: 4529211 - DNA, 21 bp, Homo sapiens
ctcagcagccctcctcacccc

SEQ ID NO: 4529212 - DNA, 19 bp, Homo sapiens
ctcagcagcgaccacccct

SEQ ID NO: 4529213 - DNA, 20 bp, Homo sapiens
ctcagcagcgaccacccctg

SEQ ID NO: 4529214 - DNA, 13 bp, Homo sapiens
ctcagcagctctg

SEQ ID NO: 4529215 - DNA, 14 bp, Homo sapiens
ctcagcagctctgg

SEQ ID NO: 4529216 - DNA, 22 bp, Homo sapiens
ctcagcagctctggctctgcct

SEQ ID NO: 4529217 - DNA, 12 bp, Homo sapiens
ctcagcagggca

SEQ ID NO: 4529218 - DNA, 17 bp, Homo sapiens
ctcagccaaatttcctg

SEQ ID NO: 4529219 - DNA, 14 bp, Homo sapiens
ctcagccacaaagc

SEQ ID NO: 4529220 - DNA, 21 bp, Homo sapiens
ctcagccacaaagccccccag

SEQ ID NO: 4529221 - DNA, 19 bp, Homo sapiens
ctcagccactgtcacaggc

SEQ ID NO: 4529222 - DNA, 21 bp, Homo sapiens
ctcagccactgtcacaggcat

SEQ ID NO: 4529223 - DNA, 13 bp, Homo sapiens
ctcagccagcctc

SEQ ID NO: 4529224 - DNA, 11 bp, Homo sapiens
ctcagccaggc

SEQ ID NO: 4529225 - DNA, 13 bp, Homo sapiens
ctcagccaggccc

SEQ ID NO: 4529226 - DNA, 15 bp, Homo sapiens
ctcagccaggccctg

SEQ ID NO: 4529227 - DNA, 17 bp, Homo sapiens
ctcagccccaactcttt

SEQ ID NO: 4529228 - DNA, 14 bp, Homo sapiens
ctcagccccagccc

SEQ ID NO: 4529229 - DNA, 17 bp, Homo sapiens
ctcagccccagcccaga

SEQ ID NO: 4529230 - DNA, 13 bp, Homo sapiens
ctcagccccaggc

SEQ ID NO: 4529231 - DNA, 18 bp, Homo sapiens
ctcagccccaggccagct

SEQ ID NO: 4529232 - DNA, 19 bp, Homo sapiens
ctcagccccaggccagctg

SEQ ID NO: 4529233 - DNA, 21 bp, Homo sapiens
ctcagccccaggccagctgcg

SEQ ID NO: 4529234 - DNA, 19 bp, Homo sapiens
ctcagccctgaaaataaca

SEQ ID NO: 4529235 - DNA, 18 bp, Homo sapiens
ctcagccctgctccctgc

SEQ ID NO: 4529236 - DNA, 21 bp, Homo sapiens
ctcagccctgggccccaccac

SEQ ID NO: 4529237 - DNA, 13 bp, Homo sapiens
ctcagcctcccat

SEQ ID NO: 4529238 - DNA, 15 bp, Homo sapiens
ctcagcctccctagt

SEQ ID NO: 4529239 - DNA, 13 bp, Homo sapiens
ctcagcctcctga

SEQ ID NO: 4529240 - DNA, 20 bp, Homo sapiens
ctcagcctctgccagcgcca

SEQ ID NO: 4529241 - DNA, 14 bp, Homo sapiens
ctcagcctctgctg

SEQ ID NO: 4529242 - DNA, 15 bp, Homo sapiens
ctcagcctctgctgg

SEQ ID NO: 4529243 - DNA, 23 bp, Homo sapiens
ctcagcctctgctggagaaagcc

SEQ ID NO: 4529244 - DNA, 20 bp, Homo sapiens
ctcagccttccaactagctg

SEQ ID NO: 4529245 - DNA, 22 bp, Homo sapiens
ctcagccttccaactagctggg

SEQ ID NO: 4529246 - DNA, 17 bp, Homo sapiens
ctcagccttcctcctca

SEQ ID NO: 4529247 - DNA, 14 bp, Homo sapiens
ctcagcgaggtgta

SEQ ID NO: 4529248 - DNA, 23 bp, Homo sapiens
ctcagctagttggggagctaagg

SEQ ID NO: 4529249 - DNA, 14 bp, Homo sapiens
ctcagctcatccat

SEQ ID NO: 4529250 - DNA, 17 bp, Homo sapiens
ctcagctctaggctgtt

SEQ ID NO: 4529251 - DNA, 19 bp, Homo sapiens
ctcagctgcctcctgcgcc

SEQ ID NO: 4529252 - DNA, 14 bp, Homo sapiens
ctcagctgctggat

SEQ ID NO: 4529253 - DNA, 16 bp, Homo sapiens
ctcagcttcctaccca

SEQ ID NO: 4529254 - DNA, 22 bp, Homo sapiens
ctcagcttcctacccacacctc

SEQ ID NO: 4529255 - DNA, 19 bp, Homo sapiens
ctcagcttcttctttcatt

SEQ ID NO: 4529256 - DNA, 19 bp, Homo sapiens
ctcaggaaccgaggcaggg

SEQ ID NO: 4529257 - DNA, 14 bp, Homo sapiens
ctcaggaagtccag

SEQ ID NO: 4529258 - DNA, 16 bp, Homo sapiens
ctcaggaagtccagcc

SEQ ID NO: 4529259 - DNA, 19 bp, Homo sapiens
ctcaggaagtccagccact

SEQ ID NO: 4529260 - DNA, 20 bp, Homo sapiens
ctcaggaccaaagctttcat

SEQ ID NO: 4529261 - DNA, 16 bp, Homo sapiens
ctcaggactgcaacag

SEQ ID NO: 4529262 - DNA, 17 bp, Homo sapiens
ctcaggactgcaacagg

SEQ ID NO: 4529263 - DNA, 19 bp, Homo sapiens
ctcaggactgcaacaggct

SEQ ID NO: 4529264 - DNA, 20 bp, Homo sapiens
ctcaggagatggagggcttg

SEQ ID NO: 4529265 - DNA, 14 bp, Homo sapiens
ctcaggagcttggg

SEQ ID NO: 4529266 - DNA, 18 bp, Homo sapiens
ctcaggaggcgaataaat

SEQ ID NO: 4529267 - DNA, 18 bp, Homo sapiens
ctcaggaggctgagacag

SEQ ID NO: 4529268 - DNA, 18 bp, Homo sapiens
ctcaggaggctgaggcag

SEQ ID NO: 4529269 - DNA, 19 bp, Homo sapiens
ctcaggaggctgaggcaga

SEQ ID NO: 4529270 - DNA, 18 bp, Homo sapiens
ctcaggaggtcacctgcc

SEQ ID NO: 4529271 - DNA, 20 bp, Homo sapiens
ctcaggagtttgagaccagg

SEQ ID NO: 4529272 - DNA, 21 bp, Homo sapiens
ctgacaaaatggggcagaaga

SEQ ID NO: 4529273 - DNA, 22 bp, Homo sapiens
ctgacaacatttctatagccaa

SEQ ID NO: 4529274 - DNA, 19 bp, Homo sapiens
ctgacaaccattaaagtca

SEQ ID NO: 4529275 - DNA, 20 bp, Homo sapiens
ctgacaaccattaaagtcag

SEQ ID NO: 4529276 - DNA, 13 bp, Homo sapiens
ctgacaatgaagg

SEQ ID NO: 4529277 - DNA, 15 bp, Homo sapiens
ctgacaatgaaggga

SEQ ID NO: 4529278 - DNA, 14 bp, Homo sapiens
ctgacacaccaggc

SEQ ID NO: 4529279 - DNA, 18 bp, Homo sapiens
ctgacacattgctgatat

SEQ ID NO: 4529280 - DNA, 17 bp, Homo sapiens
ctgacactcccttgggc

SEQ ID NO: 4529281 - DNA, 17 bp, Homo sapiens
ctgacagaagttatttc

SEQ ID NO: 4529282 - DNA, 15 bp, Homo sapiens
ctgacagatgcctgg

SEQ ID NO: 4529283 - DNA, 18 bp, Homo sapiens
ctgacagatgcctggtga

SEQ ID NO: 4529284 - DNA, 20 bp, Homo sapiens
ctgacagccctgcggagacc

SEQ ID NO: 4529285 - DNA, 13 bp, Homo sapiens
ctgacagctctgt

SEQ ID NO: 4529286 - DNA, 21 bp, Homo sapiens
ctgacagggacatgccctgtg

SEQ ID NO: 4529287 - DNA, 21 bp, Homo sapiens
ctgacaggtgaattggatggt

SEQ ID NO: 4529288 - DNA, 19 bp, Homo sapiens
ctgacagtccacaggggcc

SEQ ID NO: 4529289 - DNA, 16 bp, Homo sapiens
ctgacattcactgagt

SEQ ID NO: 4529290 - DNA, 17 bp, Homo sapiens
ctgacattgccaaaaag

SEQ ID NO: 4529291 - DNA, 16 bp, Homo sapiens
ctgaccaacatggaga

SEQ ID NO: 4529292 - DNA, 19 bp, Homo sapiens
ctgaccaagtgctggccca

SEQ ID NO: 4529293 - DNA, 18 bp, Homo sapiens
ctgaccaatattgtacag

SEQ ID NO: 4529294 - DNA, 19 bp, Homo sapiens
ctgaccaatattgtacagt

SEQ ID NO: 4529295 - DNA, 19 bp, Homo sapiens
ctgaccagctgctccgagg

SEQ ID NO: 4529296 - DNA, 14 bp, Homo sapiens
ctgaccagtcagat

SEQ ID NO: 4529297 - DNA, 19 bp, Homo sapiens
ctgaccatccactctaccc

SEQ ID NO: 4529298 - DNA, 20 bp, Homo sapiens
ctgacccagagtggagtctg

SEQ ID NO: 4529299 - DNA, 15 bp, Homo sapiens
ctgacccccatgtaa

SEQ ID NO: 4529300 - DNA, 18 bp, Homo sapiens
ctgacccccatgtaaata

SEQ ID NO: 4529301 - DNA, 22 bp, Homo sapiens
ctgacccctgcctgttggcagg

SEQ ID NO: 4529302 - DNA, 14 bp, Homo sapiens
ctgacccctgctca

SEQ ID NO: 4529303 - DNA, 16 bp, Homo sapiens
ctgacccctgctcagt

SEQ ID NO: 4529304 - DNA, 18 bp, Homo sapiens
ctgaccctcatctttctt

SEQ ID NO: 4529305 - DNA, 13 bp, Homo sapiens
ctgaccctcctgt

SEQ ID NO: 4529306 - DNA, 17 bp, Homo sapiens
ctgaccctcctgttgca

SEQ ID NO: 4529307 - DNA, 17 bp, Homo sapiens
ctgaccctgcccccact

SEQ ID NO: 4529308 - DNA, 16 bp, Homo sapiens
ctgaccctgctcctag

SEQ ID NO: 4529309 - DNA, 17 bp, Homo sapiens
ctgaccctgctcctagc

SEQ ID NO: 4529310 - DNA, 18 bp, Homo sapiens
ctgaccgggctcacttgc

SEQ ID NO: 4529311 - DNA, 15 bp, Homo sapiens
ctgacctcctctggg

SEQ ID NO: 4529312 - DNA, 16 bp, Homo sapiens
ctgacctcctctgggc

SEQ ID NO: 4529313 - DNA, 20 bp, Homo sapiens
ctgacctcctctgggccctg

SEQ ID NO: 4529314 - DNA, 21 bp, Homo sapiens
ctgacctcctctgggccctgt

SEQ ID NO: 4529315 - DNA, 17 bp, Homo sapiens
ctgaccttagcgttctg

SEQ ID NO: 4529316 - DNA, 22 bp, Homo sapiens
ctgaccttagcgttctggactc

SEQ ID NO: 4529317 - DNA, 20 bp, Homo sapiens
ctgaccttggaggaatgaca

SEQ ID NO: 4529318 - DNA, 21 bp, Homo sapiens
ctgaccttggaggaatgacaa

SEQ ID NO: 4529319 - DNA, 14 bp, Homo sapiens
ctgaccttgtgatc

SEQ ID NO: 4529320 - DNA, 15 bp, Homo sapiens
ctgacgctcagcccc

SEQ ID NO: 4529321 - DNA, 21 bp, Homo sapiens
ctgacgctcagccccaggcca

SEQ ID NO: 4529322 - DNA, 15 bp, Homo sapiens
ctgactaaacttttt

SEQ ID NO: 4529323 - DNA, 15 bp, Homo sapiens
ctgactaagcctttg

SEQ ID NO: 4529324 - DNA, 18 bp, Homo sapiens
ctgactaagcctttgact

SEQ ID NO: 4529325 - DNA, 23 bp, Homo sapiens
ctgactagaagggccagtcctgc

SEQ ID NO: 4529326 - DNA, 16 bp, Homo sapiens
ctgactcagctaatgt

SEQ ID NO: 4529327 - DNA, 12 bp, Homo sapiens
ctgactcagggc

SEQ ID NO: 4529328 - DNA, 14 bp, Homo sapiens
ctgactcagggctc

SEQ ID NO: 4529329 - DNA, 21 bp, Homo sapiens
ctgactcagggctcctgggtt

SEQ ID NO: 4529330 - DNA, 16 bp, Homo sapiens
ctgactccctgtgggg

SEQ ID NO: 4529331 - DNA, 12 bp, Homo sapiens
ctgactcctctg

SEQ ID NO: 4529332 - DNA, 14 bp, Homo sapiens
ctgactcctctggc

SEQ ID NO: 4529333 - DNA, 17 bp, Homo sapiens
ctgactcctctggcttt

SEQ ID NO: 4529334 - DNA, 16 bp, Homo sapiens
ctgactcctggactcc

SEQ ID NO: 4529335 - DNA, 20 bp, Homo sapiens
ctgactctgccccctgctgg

SEQ ID NO: 4529336 - DNA, 16 bp, Homo sapiens
ctgactctgttattga

SEQ ID NO: 4529337 - DNA, 16 bp, Homo sapiens
ctgactggccaaaccc

SEQ ID NO: 4529338 - DNA, 21 bp, Homo sapiens
ctgactggtttctcctggtag

SEQ ID NO: 4529339 - DNA, 17 bp, Homo sapiens
ctgactgtccaggagct

SEQ ID NO: 4529340 - DNA, 22 bp, Homo sapiens
ctgactgttcttggtaactgat

SEQ ID NO: 4529341 - DNA, 16 bp, Homo sapiens
ctgacttgagccactc

SEQ ID NO: 4529342 - DNA, 17 bp, Homo sapiens
ctgacttgagccactcc

SEQ ID NO: 4529343 - DNA, 22 bp, Homo sapiens
ctgacttgagccactccttcct

SEQ ID NO: 4529344 - DNA, 19 bp, Homo sapiens
ctgacttggggaccttttg

SEQ ID NO: 4529345 - DNA, 20 bp, Homo sapiens
ctgactttccgagcctccag

SEQ ID NO: 4529346 - DNA, 12 bp, Homo sapiens
ctgagaaagact

SEQ ID NO: 4529347 - DNA, 20 bp, Homo sapiens
ctgagaaagactattcaaac

SEQ ID NO: 4529348 - DNA, 23 bp, Homo sapiens
ctgagaaagactattcaaacagt

SEQ ID NO: 4529349 - DNA, 20 bp, Homo sapiens
ctgagaactcgttcacctcc

SEQ ID NO: 4529350 - DNA, 18 bp, Homo sapiens
ctgagaagaagtggctgc

SEQ ID NO: 4529351 - DNA, 14 bp, Homo sapiens
ctgagaatatacaa

SEQ ID NO: 4529352 - DNA, 14 bp, Homo sapiens
ctgagaccagggtg

SEQ ID NO: 4529353 - DNA, 16 bp, Homo sapiens
ctgagaccagggtggc

SEQ ID NO: 4529354 - DNA, 17 bp, Homo sapiens
ctgagaccagggtggcc

SEQ ID NO: 4529355 - DNA, 20 bp, Homo sapiens
ctgagaccagggtggccaca

SEQ ID NO: 4529356 - DNA, 13 bp, Homo sapiens
ctgagacccctgg

SEQ ID NO: 4529357 - DNA, 22 bp, Homo sapiens
ctgagacgccggcttcctcctt

SEQ ID NO: 4529358 - DNA, 21 bp, Homo sapiens
ctgagactctcttaggagcag

SEQ ID NO: 4529359 - DNA, 15 bp, Homo sapiens
ctgagagacccaagg

SEQ ID NO: 4529360 - DNA, 17 bp, Homo sapiens
ctgagagacccaaggag

SEQ ID NO: 4529361 - DNA, 13 bp, Homo sapiens
ctgagagaggcca

SEQ ID NO: 4529362 - DNA, 14 bp, Homo sapiens
ctgagagccctgct

SEQ ID NO: 4529363 - DNA, 16 bp, Homo sapiens
ctgagagccctgctgt

SEQ ID NO: 4529364 - DNA, 21 bp, Homo sapiens
ctgagagccctgctgtgggag

SEQ ID NO: 4529365 - DNA, 21 bp, Homo sapiens
ctgagagccggccgtggaagg

SEQ ID NO: 4529366 - DNA, 12 bp, Homo sapiens
ctgagagcctgt

SEQ ID NO: 4529367 - DNA, 13 bp, Homo sapiens
ctgagagcctgtg

SEQ ID NO: 4529368 - DNA, 21 bp, Homo sapiens
ctgagagcctgtggaggggct

SEQ ID NO: 4529369 - DNA, 15 bp, Homo sapiens
ctgagaggaagcaag

SEQ ID NO: 4529370 - DNA, 19 bp, Homo sapiens
ctgagaggcaccagtccag

SEQ ID NO: 4529371 - DNA, 23 bp, Homo sapiens
ctgagaggcaccagtccagcaaa

SEQ ID NO: 4529372 - DNA, 15 bp, Homo sapiens
ctgagagtcaggagt

SEQ ID NO: 4529373 - DNA, 20 bp, Homo sapiens
ctgagatacaaggcccagaa

SEQ ID NO: 4529374 - DNA, 21 bp, Homo sapiens
ctgagatacaaggcccagaag

SEQ ID NO: 4529375 - DNA, 23 bp, Homo sapiens
ctgagatatgaacatattgttga

SEQ ID NO: 4529376 - DNA, 15 bp, Homo sapiens
ctgagatattatttt

SEQ ID NO: 4529377 - DNA, 14 bp, Homo sapiens
ctgagatctgctgt

SEQ ID NO: 4529378 - DNA, 18 bp, Homo sapiens
ctgagattcaatattgaa

SEQ ID NO: 4529379 - DNA, 21 bp, Homo sapiens
ctgagattgcagatgtgagcc

SEQ ID NO: 4529380 - DNA, 16 bp, Homo sapiens
ctgagatttcatctgc

SEQ ID NO: 4529381 - DNA, 19 bp, Homo sapiens
ctgagatttcatctgctct

SEQ ID NO: 4529382 - DNA, 16 bp, Homo sapiens
ctgagcaaaggccctg

SEQ ID NO: 4529383 - DNA, 19 bp, Homo sapiens
ctgagcaaaggccctgggt

SEQ ID NO: 4529384 - DNA, 24 bp, Homo sapiens
ctgagcaaggagtttaaatgagac

SEQ ID NO: 4529385 - DNA, 17 bp, Homo sapiens
ctgagcaatctgaccct

SEQ ID NO: 4529386 - DNA, 12 bp, Homo sapiens
ctgagcacttag

SEQ ID NO: 4529387 - DNA, 18 bp, Homo sapiens
ctgagcagccgccagctg

SEQ ID NO: 4529388 - DNA, 16 bp, Homo sapiens
ctgagcagcctctgga

SEQ ID NO: 4529389 - DNA, 17 bp, Homo sapiens
ctgagcagcctctggac

SEQ ID NO: 4529390 - DNA, 16 bp, Homo sapiens
ctgagcaggggcccct

SEQ ID NO: 4529391 - DNA, 21 bp, Homo sapiens
ctgagcaggggcccctgggga

SEQ ID NO: 4529392 - DNA, 14 bp, Homo sapiens
ctctttccctgcga

SEQ ID NO: 4529393 - DNA, 18 bp, Homo sapiens
ctctttccgactgcccag

SEQ ID NO: 4529394 - DNA, 20 bp, Homo sapiens
ctctttccgactgcccagaa

SEQ ID NO: 4529395 - DNA, 13 bp, Homo sapiens
ctctttctcacct

SEQ ID NO: 4529396 - DNA, 23 bp, Homo sapiens
ctctttctgagtgccttctgtgg

SEQ ID NO: 4529397 - DNA, 13 bp, Homo sapiens
ctctttctgtata

SEQ ID NO: 4529398 - DNA, 15 bp, Homo sapiens
ctctttcttcccatg

SEQ ID NO: 4529399 - DNA, 10 bp, Homo sapiens
ctctttgaga

SEQ ID NO: 4529400 - DNA, 21 bp, Homo sapiens
ctctttggcgacctcctttca

SEQ ID NO: 4529401 - DNA, 14 bp, Homo sapiens
ctcttttacctgct

SEQ ID NO: 4529402 - DNA, 13 bp, Homo sapiens
ctcttttattctg

SEQ ID NO: 4529403 - DNA, 16 bp, Homo sapiens
ctcttttattctgtta

SEQ ID NO: 4529404 - DNA, 16 bp, Homo sapiens
ctcttttcctggcagc

SEQ ID NO: 4529405 - DNA, 21 bp, Homo sapiens
ctcttttcctggcagctgctg

SEQ ID NO: 4529406 - DNA, 12 bp, Homo sapiens
ctcttttctttc

SEQ ID NO: 4529407 - DNA, 24 bp, Homo sapiens
ctcttttgtattgtttctacaata

SEQ ID NO: 4529408 - DNA, 13 bp, Homo sapiens
ctcttttgtgatg

SEQ ID NO: 4529409 - DNA, 18 bp, Homo sapiens
ctcttttgtgatgaacat

SEQ ID NO: 4529410 - DNA, 13 bp, Homo sapiens
ctctttttcctcc

SEQ ID NO: 4529411 - DNA, 14 bp, Homo sapiens
ctctttttcctcct

SEQ ID NO: 4529412 - DNA, 17 bp, Homo sapiens
ctcttttttcgtttgtt

SEQ ID NO: 4529413 - DNA, 19 bp, Homo sapiens
ctcttttttgtttgtttct

SEQ ID NO: 4529414 - DNA, 18 bp, Homo sapiens
ctgaaaaaaaaaaagaag

SEQ ID NO: 4529415 - DNA, 21 bp, Homo sapiens
ctgaaaaaaaaaaagaagaag

SEQ ID NO: 4529416 - DNA, 19 bp, Homo sapiens
ctgaaaaaaacatatccaa

SEQ ID NO: 4529417 - DNA, 15 bp, Homo sapiens
ctgaaaaaatatatg

SEQ ID NO: 4529418 - DNA, 13 bp, Homo sapiens
ctgaaaaatggga

SEQ ID NO: 4529419 - DNA, 14 bp, Homo sapiens
ctgaaaacctacca

SEQ ID NO: 4529420 - DNA, 12 bp, Homo sapiens
ctgaaaagaagg

SEQ ID NO: 4529421 - DNA, 20 bp, Homo sapiens
ctgaaaataacagaattctg

SEQ ID NO: 4529422 - DNA, 13 bp, Homo sapiens
ctgaaaatgaaag

SEQ ID NO: 4529423 - DNA, 22 bp, Homo sapiens
ctgaaaatgtttttctgccagg

SEQ ID NO: 4529424 - DNA, 17 bp, Homo sapiens
ctgaaaattatttaaac

SEQ ID NO: 4529425 - DNA, 13 bp, Homo sapiens
ctgaaaatttaac

SEQ ID NO: 4529426 - DNA, 15 bp, Homo sapiens
ctgaaaatttaacag

SEQ ID NO: 4529427 - DNA, 11 bp, Homo sapiens
ctgaaacagct

SEQ ID NO: 4529428 - DNA, 13 bp, Homo sapiens
ctgaaacagctgc

SEQ ID NO: 4529429 - DNA, 19 bp, Homo sapiens
ctgaaacagctgccttagc

SEQ ID NO: 4529430 - DNA, 22 bp, Homo sapiens
ctgaaactggcttccccactcc

SEQ ID NO: 4529431 - DNA, 23 bp, Homo sapiens
ctgaaagaagaaaacagtacaga

SEQ ID NO: 4529432 - DNA, 16 bp, Homo sapiens
ctgaaagtagggggct

SEQ ID NO: 4529433 - DNA, 16 bp, Homo sapiens
ctgaaagtcctgcttt

SEQ ID NO: 4529434 - DNA, 19 bp, Homo sapiens
ctgaaagtcctgctttcct

SEQ ID NO: 4529435 - DNA, 18 bp, Homo sapiens
ctgaaagttttgtaaaag

SEQ ID NO: 4529436 - DNA, 19 bp, Homo sapiens
ctgaaataatatatttctt

SEQ ID NO: 4529437 - DNA, 16 bp, Homo sapiens
ctgaaatgacatttca

SEQ ID NO: 4529438 - DNA, 23 bp, Homo sapiens
ctgaaattgagaatccagtttct

SEQ ID NO: 4529439 - DNA, 14 bp, Homo sapiens
ctgaaatttcacca

SEQ ID NO: 4529440 - DNA, 13 bp, Homo sapiens
ctgaaattttaga

SEQ ID NO: 4529441 - DNA, 18 bp, Homo sapiens
ctgaaattttagaaatat

SEQ ID NO: 4529442 - DNA, 22 bp, Homo sapiens
ctgaaattttagaaatattcac

SEQ ID NO: 4529443 - DNA, 14 bp, Homo sapiens
ctgaacaatatttt

SEQ ID NO: 4529444 - DNA, 11 bp, Homo sapiens
ctgaacaccat

SEQ ID NO: 4529445 - DNA, 20 bp, Homo sapiens
ctgaacaccattgaaggctt

SEQ ID NO: 4529446 - DNA, 14 bp, Homo sapiens
ctgaaccacagaaa

SEQ ID NO: 4529447 - DNA, 23 bp, Homo sapiens
ctgaaccaggccagagcaaacag

SEQ ID NO: 4529448 - DNA, 16 bp, Homo sapiens
ctgaaccccagaggca

SEQ ID NO: 4529449 - DNA, 13 bp, Homo sapiens
ctgaacggggaga

SEQ ID NO: 4529450 - DNA, 19 bp, Homo sapiens
ctgaactaaagtgctgcac

SEQ ID NO: 4529451 - DNA, 18 bp, Homo sapiens
ctgaactcaaactgagga

SEQ ID NO: 4529452 - DNA, 21 bp, Homo sapiens
ctgaactccatacagcctcta

SEQ ID NO: 4529453 - DNA, 13 bp, Homo sapiens
ctgaactgagccc

SEQ ID NO: 4529454 - DNA, 14 bp, Homo sapiens
ctgaactgagcccc

SEQ ID NO: 4529455 - DNA, 17 bp, Homo sapiens
ctgaactgagccccagc

SEQ ID NO: 4529456 - DNA, 12 bp, Homo sapiens
ctgaactgagga

SEQ ID NO: 4529457 - DNA, 13 bp, Homo sapiens
ctgaactgaggag

SEQ ID NO: 4529458 - DNA, 14 bp, Homo sapiens
ctgaactgctttta

SEQ ID NO: 4529459 - DNA, 17 bp, Homo sapiens
ctgaactggtagaaaaa

SEQ ID NO: 4529460 - DNA, 20 bp, Homo sapiens
ctgaacttaataactgtgta

SEQ ID NO: 4529461 - DNA, 23 bp, Homo sapiens
ctgaagaaggaaggcctgagccc

SEQ ID NO: 4529462 - DNA, 20 bp, Homo sapiens
ctgaagagctattatataaa

SEQ ID NO: 4529463 - DNA, 12 bp, Homo sapiens
ctgaagagctct

SEQ ID NO: 4529464 - DNA, 15 bp, Homo sapiens
ctgaagagctcttgg

SEQ ID NO: 4529465 - DNA, 22 bp, Homo sapiens
ctgaagagctcttggcccggca

SEQ ID NO: 4529466 - DNA, 17 bp, Homo sapiens
ctgaagaggcttctcct

SEQ ID NO: 4529467 - DNA, 19 bp, Homo sapiens
ctgaagaggcttctcctgt

SEQ ID NO: 4529468 - DNA, 15 bp, Homo sapiens
ctgaagatggagggg

SEQ ID NO: 4529469 - DNA, 21 bp, Homo sapiens
ctgaagatggagggggctggg

SEQ ID NO: 4529470 - DNA, 15 bp, Homo sapiens
ctgaagcctctggga

SEQ ID NO: 4529471 - DNA, 22 bp, Homo sapiens
ctgaagctcgcatccagacagt

SEQ ID NO: 4529472 - DNA, 17 bp, Homo sapiens
ctgaagctgacagcact

SEQ ID NO: 4529473 - DNA, 14 bp, Homo sapiens
ctgaagctgctgtg

SEQ ID NO: 4529474 - DNA, 15 bp, Homo sapiens
ctgaagctgctgtgt

SEQ ID NO: 4529475 - DNA, 16 bp, Homo sapiens
ctgaagctgctgtgtc

SEQ ID NO: 4529476 - DNA, 17 bp, Homo sapiens
ctgaagctgctgtgtcc

SEQ ID NO: 4529477 - DNA, 18 bp, Homo sapiens
ctgaaggaaaaacacaag

SEQ ID NO: 4529478 - DNA, 12 bp, Homo sapiens
ctgaaggagaag

SEQ ID NO: 4529479 - DNA, 13 bp, Homo sapiens
ctgaaggcacagc

SEQ ID NO: 4529480 - DNA, 20 bp, Homo sapiens
ctgaagggcattctttccca

SEQ ID NO: 4529481 - DNA, 20 bp, Homo sapiens
ctgaagggtggatgtgctgg

SEQ ID NO: 4529482 - DNA, 22 bp, Homo sapiens
ctgaaggtgttgggtcagtggc

SEQ ID NO: 4529483 - DNA, 23 bp, Homo sapiens
ctgaaggtgttgggtcagtggcc

SEQ ID NO: 4529484 - DNA, 17 bp, Homo sapiens
ctgaagtacaaacatga

SEQ ID NO: 4529485 - DNA, 15 bp, Homo sapiens
ctgaagtcaaaatat

SEQ ID NO: 4529486 - DNA, 18 bp, Homo sapiens
ctgaagttgctgctgtga

SEQ ID NO: 4529487 - DNA, 14 bp, Homo sapiens
ctgaataaagcaat

SEQ ID NO: 4529488 - DNA, 13 bp, Homo sapiens
ctgaatacacagt

SEQ ID NO: 4529489 - DNA, 15 bp, Homo sapiens
ctgaatagatatgaa

SEQ ID NO: 4529490 - DNA, 15 bp, Homo sapiens
ctgaatagcagaagg

SEQ ID NO: 4529491 - DNA, 11 bp, Homo sapiens
ctgaatatttt

SEQ ID NO: 4529492 - DNA, 17 bp, Homo sapiens
ctgaatcaccaattaaa

SEQ ID NO: 4529493 - DNA, 23 bp, Homo sapiens
ctgaatcccggcggaaagcctct

SEQ ID NO: 4529494 - DNA, 17 bp, Homo sapiens
ctgaatctgctaccaaa

SEQ ID NO: 4529495 - DNA, 22 bp, Homo sapiens
ctgaatctgctaccaaaacagt

SEQ ID NO: 4529496 - DNA, 21 bp, Homo sapiens
ctgaatgccgcgatgggtcag

SEQ ID NO: 4529497 - DNA, 22 bp, Homo sapiens
ctgaatgccgcgatgggtcagg

SEQ ID NO: 4529498 - DNA, 18 bp, Homo sapiens
ctgaatggactttgcaca

SEQ ID NO: 4529499 - DNA, 15 bp, Homo sapiens
ctgaatgtatgtaaa

SEQ ID NO: 4529500 - DNA, 20 bp, Homo sapiens
ctgaatgttcttgaattata

SEQ ID NO: 4529501 - DNA, 21 bp, Homo sapiens
ctgaatgttcttgaattatat

SEQ ID NO: 4529502 - DNA, 15 bp, Homo sapiens
ctgaatgttgggact

SEQ ID NO: 4529503 - DNA, 16 bp, Homo sapiens
ctgaatgttgggactg

SEQ ID NO: 4529504 - DNA, 18 bp, Homo sapiens
ctgaattatctatttcat

SEQ ID NO: 4529505 - DNA, 14 bp, Homo sapiens
ctgaattgctttct

SEQ ID NO: 4529506 - DNA, 19 bp, Homo sapiens
ctgaattggctaaaagaca

SEQ ID NO: 4529507 - DNA, 19 bp, Homo sapiens
ctgaatttaattctttcaa

SEQ ID NO: 4529508 - DNA, 12 bp, Homo sapiens
ctgaatttgcaa

SEQ ID NO: 4529509 - DNA, 13 bp, Homo sapiens
ctgaatttgcaaa

SEQ ID NO: 4529510 - DNA, 17 bp, Homo sapiens
ctgaattttataaataa

SEQ ID NO: 4529511 - DNA, 12 bp, Homo sapiens
ctgaatttttaa

SEQ ID NO: 4529512 - DNA, 15 bp, Homo sapiens
ctgaatttttttgta

SEQ ID NO: 4529513 - DNA, 23 bp, Homo sapiens
ctgaatttttttgtaataagcaa

SEQ ID NO: 4529514 - DNA, 16 bp, Homo sapiens
ctgagcattcaggcag

SEQ ID NO: 4529515 - DNA, 15 bp, Homo sapiens
ctgagccaaggaggc

SEQ ID NO: 4529516 - DNA, 16 bp, Homo sapiens
ctgagccaaggaggcc

SEQ ID NO: 4529517 - DNA, 18 bp, Homo sapiens
ctgagccacagccgtgct

SEQ ID NO: 4529518 - DNA, 13 bp, Homo sapiens
ctgagccagatta

SEQ ID NO: 4529519 - DNA, 14 bp, Homo sapiens
ctgagccagcaggg

SEQ ID NO: 4529520 - DNA, 14 bp, Homo sapiens
ctgagccagctgca

SEQ ID NO: 4529521 - DNA, 21 bp, Homo sapiens
ctgagccaggcttttctcagg

SEQ ID NO: 4529522 - DNA, 12 bp, Homo sapiens
ctgagccccagc

SEQ ID NO: 4529523 - DNA, 14 bp, Homo sapiens
ctgagcccccaccg

SEQ ID NO: 4529524 - DNA, 16 bp, Homo sapiens
ctgagcccccaccgga

SEQ ID NO: 4529525 - DNA, 15 bp, Homo sapiens
ctgagccctcctgag

SEQ ID NO: 4529526 - DNA, 13 bp, Homo sapiens
ctgagccctggtg

SEQ ID NO: 4529527 - DNA, 18 bp, Homo sapiens
ctgagccctggtgtgttt

SEQ ID NO: 4529528 - DNA, 19 bp, Homo sapiens
ctgagccggccccaggctc

SEQ ID NO: 4529529 - DNA, 20 bp, Homo sapiens
ctgagcgacagtgagactct

SEQ ID NO: 4529530 - DNA, 19 bp, Homo sapiens
ctgagcgcccccgagccct

SEQ ID NO: 4529531 - DNA, 23 bp, Homo sapiens
ctgagcgggagtcagggacctgc

SEQ ID NO: 4529532 - DNA, 19 bp, Homo sapiens
ctgagctattttcctctgg

SEQ ID NO: 4529533 - DNA, 15 bp, Homo sapiens
ctgagctcacatggg

SEQ ID NO: 4529534 - DNA, 22 bp, Homo sapiens
ctgagctcacatgggactggga

SEQ ID NO: 4529535 - DNA, 17 bp, Homo sapiens
ctgagctcggggacagg

SEQ ID NO: 4529536 - DNA, 13 bp, Homo sapiens
ctgagctgaggca

SEQ ID NO: 4529537 - DNA, 18 bp, Homo sapiens
ctgagctgaggcagcagt

SEQ ID NO: 4529538 - DNA, 19 bp, Homo sapiens
ctgagctgtccagtggagg

SEQ ID NO: 4529539 - DNA, 16 bp, Homo sapiens
ctgagctgtgacccag

SEQ ID NO: 4529540 - DNA, 13 bp, Homo sapiens
ctgagctgtgcag

SEQ ID NO: 4529541 - DNA, 11 bp, Homo sapiens
ctgagctttat

SEQ ID NO: 4529542 - DNA, 12 bp, Homo sapiens
ctgagctttgca

SEQ ID NO: 4529543 - DNA, 15 bp, Homo sapiens
ctgaggaagaacggg

SEQ ID NO: 4529544 - DNA, 18 bp, Homo sapiens
ctgaggaagagggactgt

SEQ ID NO: 4529545 - DNA, 23 bp, Homo sapiens
ctgaggaagagggactgttcttt

SEQ ID NO: 4529546 - DNA, 19 bp, Homo sapiens
ctgaggaggcctccatctc

SEQ ID NO: 4529547 - DNA, 16 bp, Homo sapiens
ctgaggagtaaaaaga

SEQ ID NO: 4529548 - DNA, 14 bp, Homo sapiens
ctgaggcaggagga

SEQ ID NO: 4529549 - DNA, 12 bp, Homo sapiens
ctgaggccagag

SEQ ID NO: 4529550 - DNA, 15 bp, Homo sapiens
ctgaggccagagtca

SEQ ID NO: 4529551 - DNA, 18 bp, Homo sapiens
ctgaggccagagtcacct

SEQ ID NO: 4529552 - DNA, 23 bp, Homo sapiens
ctgaggccagagtcaccttttct

SEQ ID NO: 4529553 - DNA, 12 bp, Homo sapiens
ctgaggcccctg

SEQ ID NO: 4529554 - DNA, 15 bp, Homo sapiens
ctgaggccctgggct

SEQ ID NO: 4529555 - DNA, 17 bp, Homo sapiens
ctgaggcctagactctg

SEQ ID NO: 4529556 - DNA, 19 bp, Homo sapiens
ctgaggcctagactctgtc

SEQ ID NO: 4529557 - DNA, 14 bp, Homo sapiens
ctgaggcctccaag

SEQ ID NO: 4529558 - DNA, 18 bp, Homo sapiens
ctgaggcctgagcgctcc

SEQ ID NO: 4529559 - DNA, 22 bp, Homo sapiens
ctgaggcctgagcgctcctgcc

SEQ ID NO: 4529560 - DNA, 17 bp, Homo sapiens
ctgaggcggaggctgtg

SEQ ID NO: 4529561 - DNA, 20 bp, Homo sapiens
ctgaggctgtttttggctgt

SEQ ID NO: 4529562 - DNA, 15 bp, Homo sapiens
ctgaggctttggatt

SEQ ID NO: 4529563 - DNA, 17 bp, Homo sapiens
ctgaggctttggatttg

SEQ ID NO: 4529564 - DNA, 21 bp, Homo sapiens
ctgaggctttggatttgacat

SEQ ID NO: 4529565 - DNA, 12 bp, Homo sapiens
ctgagggaccaa

SEQ ID NO: 4529566 - DNA, 16 bp, Homo sapiens
ctgagggaccaactgg

SEQ ID NO: 4529567 - DNA, 20 bp, Homo sapiens
ctgagggaccaactgggccc

SEQ ID NO: 4529568 - DNA, 14 bp, Homo sapiens
ctgagggactctga

SEQ ID NO: 4529569 - DNA, 21 bp, Homo sapiens
ctgagggactctgaagcctct

SEQ ID NO: 4529570 - DNA, 15 bp, Homo sapiens
ctgagggatctttac

SEQ ID NO: 4529571 - DNA, 13 bp, Homo sapiens
ctgagggcaaatc

SEQ ID NO: 4529572 - DNA, 21 bp, Homo sapiens
ctgagggctaattctgggaag

SEQ ID NO: 4529573 - DNA, 16 bp, Homo sapiens
ctgaggggcatctgcc

SEQ ID NO: 4529574 - DNA, 17 bp, Homo sapiens
ctgaggggcatctgccc

SEQ ID NO: 4529575 - DNA, 18 bp, Homo sapiens
ctgaggggcatctgcccc

SEQ ID NO: 4529576 - DNA, 14 bp, Homo sapiens
ctgaggggccaggg

SEQ ID NO: 4529577 - DNA, 18 bp, Homo sapiens
ctgaggttcctctgcctg

SEQ ID NO: 4529578 - DNA, 20 bp, Homo sapiens
ctgaggttcctctgcctgcc

SEQ ID NO: 4529579 - DNA, 23 bp, Homo sapiens
ctgaggttcctctgcctgccccg

SEQ ID NO: 4529580 - DNA, 20 bp, Homo sapiens
ctgagtaaacataaaaactg

SEQ ID NO: 4529581 - DNA, 16 bp, Homo sapiens
ctgagtactctttctc

SEQ ID NO: 4529582 - DNA, 22 bp, Homo sapiens
ctgagtcacacaagggaagtgg

SEQ ID NO: 4529583 - DNA, 14 bp, Homo sapiens
ctgagtcaccagga

SEQ ID NO: 4529584 - DNA, 14 bp, Homo sapiens
ctgagtcactcaca

SEQ ID NO: 4529585 - DNA, 13 bp, Homo sapiens
ctgagtcctgtct

SEQ ID NO: 4529586 - DNA, 18 bp, Homo sapiens
ctgagtcctgtctctgcc

SEQ ID NO: 4529587 - DNA, 21 bp, Homo sapiens
ctgagtcctgtctctgcctgc

SEQ ID NO: 4529588 - DNA, 20 bp, Homo sapiens
ctgagtcctttccaggggcc

SEQ ID NO: 4529589 - DNA, 18 bp, Homo sapiens
ctgagtcgtacagaaagc

SEQ ID NO: 4529590 - DNA, 19 bp, Homo sapiens
ctgagtcgtacagaaagct

SEQ ID NO: 4529591 - DNA, 14 bp, Homo sapiens
ctgagtctccaggg

SEQ ID NO: 4529592 - DNA, 15 bp, Homo sapiens
ctgagtctccagggc

SEQ ID NO: 4529593 - DNA, 22 bp, Homo sapiens
ctgagtctccagggccccccaa

SEQ ID NO: 4529594 - DNA, 18 bp, Homo sapiens
ctgagtctgagtcctgtc

SEQ ID NO: 4529595 - DNA, 13 bp, Homo sapiens
ctgagtgccttct

SEQ ID NO: 4529596 - DNA, 20 bp, Homo sapiens
ctgagtgcgggctgaggcca

SEQ ID NO: 4529597 - DNA, 22 bp, Homo sapiens
ctgagtgcgggctgaggccaga

SEQ ID NO: 4529598 - DNA, 15 bp, Homo sapiens
ctgagtgggaagccc

SEQ ID NO: 4529599 - DNA, 17 bp, Homo sapiens
ctgagtgggaagcccat

SEQ ID NO: 4529600 - DNA, 21 bp, Homo sapiens
ctgagtgggaagcccatcctg

SEQ ID NO: 4529601 - DNA, 18 bp, Homo sapiens
ctgagttatcaggtgcag

SEQ ID NO: 4529602 - DNA, 15 bp, Homo sapiens
ctgagttcccgggag

SEQ ID NO: 4529603 - DNA, 21 bp, Homo sapiens
ctgagttcccgggagctgggc

SEQ ID NO: 4529604 - DNA, 23 bp, Homo sapiens
ctgagttcccgggagctgggccc

SEQ ID NO: 4529605 - DNA, 19 bp, Homo sapiens
ctgagttctgggtttctag

SEQ ID NO: 4529606 - DNA, 23 bp, Homo sapiens
ctgagttgggggtgtggctctgc

SEQ ID NO: 4529607 - DNA, 13 bp, Homo sapiens
ctgagttttgtgt

SEQ ID NO: 4529608 - DNA, 14 bp, Homo sapiens
ctgagttttgtgtt

SEQ ID NO: 4529609 - DNA, 17 bp, Homo sapiens
ctgagttttgtgtttgt

SEQ ID NO: 4529610 - DNA, 19 bp, Homo sapiens
ctgagttttgtgtttgttg

SEQ ID NO: 4529611 - DNA, 19 bp, Homo sapiens
ctgagttttgtttcacttt

SEQ ID NO: 4529612 - DNA, 19 bp, Homo sapiens
ctgataaaaccatgtagaa

SEQ ID NO: 4529613 - DNA, 17 bp, Homo sapiens
ctgataacttggggagg

SEQ ID NO: 4529614 - DNA, 20 bp, Homo sapiens
ctgataacttggggaggcaa

SEQ ID NO: 4529615 - DNA, 15 bp, Homo sapiens
ctgataattttaaat

SEQ ID NO: 4529616 - DNA, 12 bp, Homo sapiens
ctgatacacagt

SEQ ID NO: 4529617 - DNA, 18 bp, Homo sapiens
ctgatacacagtaattgt

SEQ ID NO: 4529618 - DNA, 23 bp, Homo sapiens
ctgatacacagtaattgtgacaa

SEQ ID NO: 4529619 - DNA, 21 bp, Homo sapiens
ctgatatcatggggagtaata

SEQ ID NO: 4529620 - DNA, 20 bp, Homo sapiens
ctgatcagagccgtggtcct

SEQ ID NO: 4529621 - DNA, 18 bp, Homo sapiens
ctgatcccaccccctcct

SEQ ID NO: 4529622 - DNA, 20 bp, Homo sapiens
ctgatcccaccccctcctcc

SEQ ID NO: 4529623 - DNA, 20 bp, Homo sapiens
ctgatcccccagatgcaggg

SEQ ID NO: 4529624 - DNA, 15 bp, Homo sapiens
ctgatctctgctccc

SEQ ID NO: 4529625 - DNA, 17 bp, Homo sapiens
ctgatctgtactttgtg

SEQ ID NO: 4529626 - DNA, 21 bp, Homo sapiens
ctgatctgtgctttccagctc

SEQ ID NO: 4529627 - DNA, 23 bp, Homo sapiens
ctgatctgtgctttccagctcac

SEQ ID NO: 4529628 - DNA, 20 bp, Homo sapiens
ctgatctttgggcatcagaa

SEQ ID NO: 4529629 - DNA, 22 bp, Homo sapiens
ctgatctttgggcatcagaaaa

SEQ ID NO: 4529630 - DNA, 14 bp, Homo sapiens
ctgatgaatctcaa

SEQ ID NO: 4529631 - DNA, 20 bp, Homo sapiens
ctgatgagtaaactgaggcc

SEQ ID NO: 4529632 - DNA, 21 bp, Homo sapiens
ctgatgagtaaactgaggccc

SEQ ID NO: 4529633 - DNA, 14 bp, Homo sapiens
ctgatgattttcct

SEQ ID NO: 4529634 - DNA, 18 bp, Homo sapiens
ctctctgatgtcccagtg

SEQ ID NO: 4529635 - DNA, 21 bp, Homo sapiens
ctctctgatgtcccagtgctc

SEQ ID NO: 4529636 - DNA, 16 bp, Homo sapiens
ctctctgcagccagcc

SEQ ID NO: 4529637 - DNA, 14 bp, Homo sapiens
ctctctgccattct

SEQ ID NO: 4529638 - DNA, 14 bp, Homo sapiens
ctctctgccctctc

SEQ ID NO: 4529639 - DNA, 12 bp, Homo sapiens
ctctctgctcca

SEQ ID NO: 4529640 - DNA, 13 bp, Homo sapiens
ctctctgctccat

SEQ ID NO: 4529641 - DNA, 14 bp, Homo sapiens
ctctctgctctgcg

SEQ ID NO: 4529642 - DNA, 13 bp, Homo sapiens
ctctctgctgtac

SEQ ID NO: 4529643 - DNA, 17 bp, Homo sapiens
ctctctgggacctcctt

SEQ ID NO: 4529644 - DNA, 20 bp, Homo sapiens
ctctctgggactctcctcct

SEQ ID NO: 4529645 - DNA, 17 bp, Homo sapiens
ctctctggggccctggg

SEQ ID NO: 4529646 - DNA, 23 bp, Homo sapiens
ctctctggggccctgggcctcag

SEQ ID NO: 4529647 - DNA, 15 bp, Homo sapiens
ctctcttcaataaac

SEQ ID NO: 4529648 - DNA, 17 bp, Homo sapiens
ctctcttcaataaacca

SEQ ID NO: 4529649 - DNA, 22 bp, Homo sapiens
ctctcttcagactctcagccca

SEQ ID NO: 4529650 - DNA, 15 bp, Homo sapiens
ctctcttccacagtg

SEQ ID NO: 4529651 - DNA, 13 bp, Homo sapiens
ctctcttcccctt

SEQ ID NO: 4529652 - DNA, 13 bp, Homo sapiens
ctctcttggaccc

SEQ ID NO: 4529653 - DNA, 17 bp, Homo sapiens
ctctcttggacccacct

SEQ ID NO: 4529654 - DNA, 17 bp, Homo sapiens
ctctcttggggcgccca

SEQ ID NO: 4529655 - DNA, 13 bp, Homo sapiens
ctctcttttaaag

SEQ ID NO: 4529656 - DNA, 18 bp, Homo sapiens
ctctcttttctacacact

SEQ ID NO: 4529657 - DNA, 20 bp, Homo sapiens
ctctcttttctacacactca

SEQ ID NO: 4529658 - DNA, 22 bp, Homo sapiens
ctctcttttctacacactcagc

SEQ ID NO: 4529659 - DNA, 17 bp, Homo sapiens
ctctcttttctgtactt

SEQ ID NO: 4529660 - DNA, 19 bp, Homo sapiens
ctctcttttctgtacttcc

SEQ ID NO: 4529661 - DNA, 14 bp, Homo sapiens
ctctcttttgttta

SEQ ID NO: 4529662 - DNA, 16 bp, Homo sapiens
ctctgaaacagctgcc

SEQ ID NO: 4529663 - DNA, 19 bp, Homo sapiens
ctctgaaacagctgcctta

SEQ ID NO: 4529664 - DNA, 19 bp, Homo sapiens
ctctgaagaactctctgga

SEQ ID NO: 4529665 - DNA, 15 bp, Homo sapiens
ctctgaagggacccc

SEQ ID NO: 4529666 - DNA, 15 bp, Homo sapiens
ctctgaatacacagt

SEQ ID NO: 4529667 - DNA, 18 bp, Homo sapiens
ctctgaatacacagtatt

SEQ ID NO: 4529668 - DNA, 16 bp, Homo sapiens
ctctgaatagttaaaa

SEQ ID NO: 4529669 - DNA, 17 bp, Homo sapiens
ctctgaattttcagaga

SEQ ID NO: 4529670 - DNA, 18 bp, Homo sapiens
ctctgaattttcagagac

SEQ ID NO: 4529671 - DNA, 22 bp, Homo sapiens
ctctgacagccctgcggagacc

SEQ ID NO: 4529672 - DNA, 12 bp, Homo sapiens
ctctgacagctc

SEQ ID NO: 4529673 - DNA, 13 bp, Homo sapiens
ctctgacagtatt

SEQ ID NO: 4529674 - DNA, 22 bp, Homo sapiens
ctctgacagtccacaggggcca

SEQ ID NO: 4529675 - DNA, 16 bp, Homo sapiens
ctctgaccgattcctt

SEQ ID NO: 4529676 - DNA, 17 bp, Homo sapiens
ctctgacctcctctggg

SEQ ID NO: 4529677 - DNA, 16 bp, Homo sapiens
ctctgactcagggctc

SEQ ID NO: 4529678 - DNA, 20 bp, Homo sapiens
ctctgactcagggctcctgg

SEQ ID NO: 4529679 - DNA, 14 bp, Homo sapiens
ctctgagcagtcag

SEQ ID NO: 4529680 - DNA, 14 bp, Homo sapiens
ctctgagccagatt

SEQ ID NO: 4529681 - DNA, 20 bp, Homo sapiens
ctctgagccagattacagga

SEQ ID NO: 4529682 - DNA, 13 bp, Homo sapiens
ctctgagctttgc

SEQ ID NO: 4529683 - DNA, 17 bp, Homo sapiens
ctctgagctttgcatgt

SEQ ID NO: 4529684 - DNA, 18 bp, Homo sapiens
ctctgatacacagtaatt

SEQ ID NO: 4529685 - DNA, 22 bp, Homo sapiens
ctctgatacacagtaattgtga

SEQ ID NO: 4529686 - DNA, 23 bp, Homo sapiens
ctctgatagctgtttcaaatgtg

SEQ ID NO: 4529687 - DNA, 15 bp, Homo sapiens
ctctgatcaagtatt

SEQ ID NO: 4529688 - DNA, 12 bp, Homo sapiens
ctctgatccctc

SEQ ID NO: 4529689 - DNA, 17 bp, Homo sapiens
ctctgattctacagtga

SEQ ID NO: 4529690 - DNA, 14 bp, Homo sapiens
ctctgcacccagaa

SEQ ID NO: 4529691 - DNA, 16 bp, Homo sapiens
ctctgcacccagaaca

SEQ ID NO: 4529692 - DNA, 14 bp, Homo sapiens
ctctgcacccagtg

SEQ ID NO: 4529693 - DNA, 23 bp, Homo sapiens
ctctgcacccgcctcgacctccc

SEQ ID NO: 4529694 - DNA, 13 bp, Homo sapiens
ctctgcactactc

SEQ ID NO: 4529695 - DNA, 23 bp, Homo sapiens
ctctgcactactcctctgcagtg

SEQ ID NO: 4529696 - DNA, 22 bp, Homo sapiens
ctctgcagacttcccagctagg

SEQ ID NO: 4529697 - DNA, 13 bp, Homo sapiens
ctctgcagccagc

SEQ ID NO: 4529698 - DNA, 15 bp, Homo sapiens
ctctgcagccagccc

SEQ ID NO: 4529699 - DNA, 16 bp, Homo sapiens
ctctgcagccagccca

SEQ ID NO: 4529700 - DNA, 18 bp, Homo sapiens
ctctgcagccagcccagc

SEQ ID NO: 4529701 - DNA, 14 bp, Homo sapiens
ctctgcaggctggg

SEQ ID NO: 4529702 - DNA, 16 bp, Homo sapiens
ctctgcaggctgggga

SEQ ID NO: 4529703 - DNA, 18 bp, Homo sapiens
ctctgcaggctggggagg

SEQ ID NO: 4529704 - DNA, 20 bp, Homo sapiens
ctctgcatagacaaaggcct

SEQ ID NO: 4529705 - DNA, 21 bp, Homo sapiens
ctctgcatgcggcccagcccg

SEQ ID NO: 4529706 - DNA, 20 bp, Homo sapiens
ctctgcatgttttttttaaa

SEQ ID NO: 4529707 - DNA, 14 bp, Homo sapiens
ctctgcatttgtct

SEQ ID NO: 4529708 - DNA, 12 bp, Homo sapiens
ctctgccacctc

SEQ ID NO: 4529709 - DNA, 13 bp, Homo sapiens
ctctgccacctcc

SEQ ID NO: 4529710 - DNA, 17 bp, Homo sapiens
ctctgccagaagatccc

SEQ ID NO: 4529711 - DNA, 15 bp, Homo sapiens
ctctgccattctgtg

SEQ ID NO: 4529712 - DNA, 11 bp, Homo sapiens
ctctgcccact

SEQ ID NO: 4529713 - DNA, 12 bp, Homo sapiens
ctctgccccaat

SEQ ID NO: 4529714 - DNA, 21 bp, Homo sapiens
ctctgcccccatttccccgat

SEQ ID NO: 4529715 - DNA, 14 bp, Homo sapiens
ctctgcccctgcag

SEQ ID NO: 4529716 - DNA, 15 bp, Homo sapiens
ctctgcccctggacc

SEQ ID NO: 4529717 - DNA, 20 bp, Homo sapiens
ctctgcccctggacctggga

SEQ ID NO: 4529718 - DNA, 14 bp, Homo sapiens
ctctgcccgggagc

SEQ ID NO: 4529719 - DNA, 17 bp, Homo sapiens
ctctgccctctccctgt

SEQ ID NO: 4529720 - DNA, 14 bp, Homo sapiens
ctctgccctggaaa

SEQ ID NO: 4529721 - DNA, 13 bp, Homo sapiens
ctctgccctggat

SEQ ID NO: 4529722 - DNA, 14 bp, Homo sapiens
ctctgccctggatt

SEQ ID NO: 4529723 - DNA, 15 bp, Homo sapiens
ctctgccctggattg

SEQ ID NO: 4529724 - DNA, 15 bp, Homo sapiens
ctctgccgctgccat

SEQ ID NO: 4529725 - DNA, 17 bp, Homo sapiens
ctctgccgctgccatgc

SEQ ID NO: 4529726 - DNA, 24 bp, Homo sapiens
ctctgccggtcgggcagccagcag

SEQ ID NO: 4529727 - DNA, 15 bp, Homo sapiens
ctctgcctcccaggt

SEQ ID NO: 4529728 - DNA, 13 bp, Homo sapiens
ctctgcctccctc

SEQ ID NO: 4529729 - DNA, 12 bp, Homo sapiens
ctctgcctgccc

SEQ ID NO: 4529730 - DNA, 20 bp, Homo sapiens
ctctgcctgccccgccccca

SEQ ID NO: 4529731 - DNA, 15 bp, Homo sapiens
ctctgccttgccctc

SEQ ID NO: 4529732 - DNA, 17 bp, Homo sapiens
ctctgccttgccctcct

SEQ ID NO: 4529733 - DNA, 20 bp, Homo sapiens
ctctgccttgccctcctggg

SEQ ID NO: 4529734 - DNA, 21 bp, Homo sapiens
ctctgccttgccctcctgggc

SEQ ID NO: 4529735 - DNA, 20 bp, Homo sapiens
ctctgcctttgtgatcctga

SEQ ID NO: 4529736 - DNA, 18 bp, Homo sapiens
ctctgcggagcacactgg

SEQ ID NO: 4529737 - DNA, 19 bp, Homo sapiens
ctctgcggagcacactggc

SEQ ID NO: 4529738 - DNA, 16 bp, Homo sapiens
ctctgcgggaggctgg

SEQ ID NO: 4529739 - DNA, 18 bp, Homo sapiens
ctctgcgggaggctgggg

SEQ ID NO: 4529740 - DNA, 20 bp, Homo sapiens
ctctgcgggaggctggggcc

SEQ ID NO: 4529741 - DNA, 22 bp, Homo sapiens
ctctgcgtgtcacctgtgcttc

SEQ ID NO: 4529742 - DNA, 15 bp, Homo sapiens
ctctgctatgagtgt

SEQ ID NO: 4529743 - DNA, 15 bp, Homo sapiens
ctctgctccaccaca

SEQ ID NO: 4529744 - DNA, 18 bp, Homo sapiens
ctctgctccaccacatcc

SEQ ID NO: 4529745 - DNA, 14 bp, Homo sapiens
ctctgctccctgca

SEQ ID NO: 4529746 - DNA, 16 bp, Homo sapiens
ctctgctgctctgacc

SEQ ID NO: 4529747 - DNA, 12 bp, Homo sapiens
ctctgctgcttt

SEQ ID NO: 4529748 - DNA, 21 bp, Homo sapiens
ctctgctggagaaagccacgc

SEQ ID NO: 4529749 - DNA, 20 bp, Homo sapiens
ctctgctggctcaggaggag

SEQ ID NO: 4529750 - DNA, 19 bp, Homo sapiens
ctctggaataaagttgcag

SEQ ID NO: 4529751 - DNA, 19 bp, Homo sapiens
ctctggacactctatatgt

SEQ ID NO: 4529752 - DNA, 17 bp, Homo sapiens
ctctggacagcagaagc

SEQ ID NO: 4529753 - DNA, 18 bp, Homo sapiens
ctctggacagcagaagcc

SEQ ID NO: 4529754 - DNA, 16 bp, Homo sapiens
ctctggacagccagtg

SEQ ID NO: 4529755 - DNA, 17 bp, Homo sapiens
ctctggacagccagtga

SEQ ID NO: 4529756 - DNA, 15 bp, Homo sapiens
ctctggacggcaggc

SEQ ID NO: 4529757 - DNA, 16 bp, Homo sapiens
ctctggacggcaggct

SEQ ID NO: 4529758 - DNA, 19 bp, Homo sapiens
ctctggactggctagagtc

SEQ ID NO: 4529759 - DNA, 17 bp, Homo sapiens
ctctggaggctgcagag

SEQ ID NO: 4529760 - DNA, 21 bp, Homo sapiens
ctctggatgatggattccaca

SEQ ID NO: 4529761 - DNA, 15 bp, Homo sapiens
ctctggcaaactttt

SEQ ID NO: 4529762 - DNA, 12 bp, Homo sapiens
ctctggcacagt

SEQ ID NO: 4529763 - DNA, 13 bp, Homo sapiens
ctctggcaccaca

SEQ ID NO: 4529764 - DNA, 15 bp, Homo sapiens
ctctggccctgcctt

SEQ ID NO: 4529765 - DNA, 18 bp, Homo sapiens
ctctggccctgccttctt

SEQ ID NO: 4529766 - DNA, 16 bp, Homo sapiens
ctctggctagaggcca

SEQ ID NO: 4529767 - DNA, 19 bp, Homo sapiens
ctctggctagaggccagcc

SEQ ID NO: 4529768 - DNA, 23 bp, Homo sapiens
ctctggctggctaactggaagca

SEQ ID NO: 4529769 - DNA, 15 bp, Homo sapiens
ctctggctttcccag

SEQ ID NO: 4529770 - DNA, 17 bp, Homo sapiens
ctctggctttcccagga

SEQ ID NO: 4529771 - DNA, 18 bp, Homo sapiens
ctctggctttcccaggag

SEQ ID NO: 4529772 - DNA, 20 bp, Homo sapiens
ctctgggactctcctcctcc

SEQ ID NO: 4529773 - DNA, 22 bp, Homo sapiens
ctctgggatttatgctcatgaa

SEQ ID NO: 4529774 - DNA, 17 bp, Homo sapiens
ctctgggccacttggag

SEQ ID NO: 4529775 - DNA, 22 bp, Homo sapiens
ctctgggcccaggggctgtggc

SEQ ID NO: 4529776 - DNA, 19 bp, Homo sapiens
ctctggggatttctgggat

SEQ ID NO: 4529777 - DNA, 15 bp, Homo sapiens
ctctggggccctggg

SEQ ID NO: 4529778 - DNA, 22 bp, Homo sapiens
ctctggggccctgggcctcagt

SEQ ID NO: 4529779 - DNA, 15 bp, Homo sapiens
ctctggggtgggcag

SEQ ID NO: 4529780 - DNA, 15 bp, Homo sapiens
ctctgggtctggcca

SEQ ID NO: 4529781 - DNA, 20 bp, Homo sapiens
ctctggtaaacattcctcca

SEQ ID NO: 4529782 - DNA, 21 bp, Homo sapiens
ctctggtaaacattcctccag

SEQ ID NO: 4529783 - DNA, 21 bp, Homo sapiens
ctctggtgataaaaataaagc

SEQ ID NO: 4529784 - DNA, 22 bp, Homo sapiens
ctctggtgataaaaataaagct

SEQ ID NO: 4529785 - DNA, 22 bp, Homo sapiens
ctctggttatttttctcttgta

SEQ ID NO: 4529786 - DNA, 12 bp, Homo sapiens
ctctgtactttt

SEQ ID NO: 4529787 - DNA, 17 bp, Homo sapiens
ctctgtagtttatggca

SEQ ID NO: 4529788 - DNA, 18 bp, Homo sapiens
ctctgtagtttatggcag

SEQ ID NO: 4529789 - DNA, 20 bp, Homo sapiens
ctctgtcagccagccgccct

SEQ ID NO: 4529790 - DNA, 21 bp, Homo sapiens
ctctgtcagccagccgccctg

SEQ ID NO: 4529791 - DNA, 23 bp, Homo sapiens
ctctgtcagccagccgccctggg

SEQ ID NO: 4529792 - DNA, 17 bp, Homo sapiens
ctctgtccccttctctc

SEQ ID NO: 4529793 - DNA, 23 bp, Homo sapiens
ctctgtccccttctctcatctct

SEQ ID NO: 4529794 - DNA, 14 bp, Homo sapiens
ctctgtccctgtcc

SEQ ID NO: 4529795 - DNA, 15 bp, Homo sapiens
ctctgtcgcccaggc

SEQ ID NO: 4529796 - DNA, 16 bp, Homo sapiens
ctctgtcgcccaggct

SEQ ID NO: 4529797 - DNA, 16 bp, Homo sapiens
ctctgtctacctggtc

SEQ ID NO: 4529798 - DNA, 17 bp, Homo sapiens
ctctgtctgcccttcac

SEQ ID NO: 4529799 - DNA, 22 bp, Homo sapiens
ctctgtgaactgtgtgtgaatc

SEQ ID NO: 4529800 - DNA, 17 bp, Homo sapiens
ctctgtgaccaatgtct

SEQ ID NO: 4529801 - DNA, 17 bp, Homo sapiens
ctctgtgagactcgaga

SEQ ID NO: 4529802 - DNA, 18 bp, Homo sapiens
ctctgtgagactcgagaa

SEQ ID NO: 4529803 - DNA, 14 bp, Homo sapiens
ctctgtgctgtgga

SEQ ID NO: 4529804 - DNA, 18 bp, Homo sapiens
ctctgtgctgtggaagca

SEQ ID NO: 4529805 - DNA, 16 bp, Homo sapiens
ctctgtggcgagccat

SEQ ID NO: 4529806 - DNA, 13 bp, Homo sapiens
ctctgtggtccct

SEQ ID NO: 4529807 - DNA, 15 bp, Homo sapiens
ctctgtgtatatctc

SEQ ID NO: 4529808 - DNA, 21 bp, Homo sapiens
ctctgtgtggctgtgcaattt

SEQ ID NO: 4529809 - DNA, 13 bp, Homo sapiens
ctctgttaatgtg

SEQ ID NO: 4529810 - DNA, 23 bp, Homo sapiens
ctctgttccatgcaactggagtt

SEQ ID NO: 4529811 - DNA, 14 bp, Homo sapiens
ctctgttcccctag

SEQ ID NO: 4529812 - DNA, 17 bp, Homo sapiens
ctctgtttagaggaggc

SEQ ID NO: 4529813 - DNA, 18 bp, Homo sapiens
ctctgtttgtgggactgg

SEQ ID NO: 4529814 - DNA, 14 bp, Homo sapiens
ctctgtttgtgggg

SEQ ID NO: 4529815 - DNA, 14 bp, Homo sapiens
ctctgttttctctc

SEQ ID NO: 4529816 - DNA, 18 bp, Homo sapiens
ctcttaaattatatattt

SEQ ID NO: 4529817 - DNA, 20 bp, Homo sapiens
ctcttaaattatatatttat

SEQ ID NO: 4529818 - DNA, 14 bp, Homo sapiens
ctcttacttgccaa

SEQ ID NO: 4529819 - DNA, 14 bp, Homo sapiens
ctcttagaatttgt

SEQ ID NO: 4529820 - DNA, 15 bp, Homo sapiens
ctcttagctcccctc

SEQ ID NO: 4529821 - DNA, 19 bp, Homo sapiens
ctcttatagaagcttcagc

SEQ ID NO: 4529822 - DNA, 17 bp, Homo sapiens
ctcttattgttctttca

SEQ ID NO: 4529823 - DNA, 23 bp, Homo sapiens
ctcttatttctttcctttaaaaa

SEQ ID NO: 4529824 - DNA, 16 bp, Homo sapiens
ctcttcaataaaccac

SEQ ID NO: 4529825 - DNA, 17 bp, Homo sapiens
ctcttcagactctcagc

SEQ ID NO: 4529826 - DNA, 17 bp, Homo sapiens
ctcttcaggcctccctc

SEQ ID NO: 4529827 - DNA, 19 bp, Homo sapiens
ctcttcaggcctccctctc

SEQ ID NO: 4529828 - DNA, 20 bp, Homo sapiens
ctcttcaggcctccctctct

SEQ ID NO: 4529829 - DNA, 21 bp, Homo sapiens
ctcttcatgcttgacatacct

SEQ ID NO: 4529830 - DNA, 18 bp, Homo sapiens
ctcttcattattctctgc

SEQ ID NO: 4529831 - DNA, 14 bp, Homo sapiens
ctcttccacagtgg

SEQ ID NO: 4529832 - DNA, 12 bp, Homo sapiens
ctcttccccaga

SEQ ID NO: 4529833 - DNA, 19 bp, Homo sapiens
ctcttccccagagaggcac

SEQ ID NO: 4529834 - DNA, 16 bp, Homo sapiens
ctcttccccttccctt

SEQ ID NO: 4529835 - DNA, 17 bp, Homo sapiens
ctcttccctttgtgtat

SEQ ID NO: 4529836 - DNA, 16 bp, Homo sapiens
ctcttccttttatcag

SEQ ID NO: 4529837 - DNA, 13 bp, Homo sapiens
ctcttctacttgt

SEQ ID NO: 4529838 - DNA, 22 bp, Homo sapiens
ctcttctagatggaccccagca

SEQ ID NO: 4529839 - DNA, 23 bp, Homo sapiens
ctcttctagatggaccccagcat

SEQ ID NO: 4529840 - DNA, 15 bp, Homo sapiens
ctcttctcatttcac

SEQ ID NO: 4529841 - DNA, 13 bp, Homo sapiens
ctcttctctccag

SEQ ID NO: 4529842 - DNA, 14 bp, Homo sapiens
ctcttctctccagc

SEQ ID NO: 4529843 - DNA, 15 bp, Homo sapiens
ctcttctctccagct

SEQ ID NO: 4529844 - DNA, 13 bp, Homo sapiens
ctcttctctcccc

SEQ ID NO: 4529845 - DNA, 14 bp, Homo sapiens
ctcttctctcccca

SEQ ID NO: 4529846 - DNA, 15 bp, Homo sapiens
ctcttctctccccag

SEQ ID NO: 4529847 - DNA, 17 bp, Homo sapiens
ctcttctctccccagcc

SEQ ID NO: 4529848 - DNA, 22 bp, Homo sapiens
ctcttctcttgacagtctgaag

SEQ ID NO: 4529849 - DNA, 10 bp, Homo sapiens
ctcttctgaa

SEQ ID NO: 4529850 - DNA, 20 bp, Homo sapiens
ctcttctgaataaagcaatt

SEQ ID NO: 4529851 - DNA, 13 bp, Homo sapiens
ctcttctgctcca

SEQ ID NO: 4529852 - DNA, 16 bp, Homo sapiens
ctcttctgctccaccc

SEQ ID NO: 4529853 - DNA, 21 bp, Homo sapiens
ctcttctgggagggcagcagg

SEQ ID NO: 4529854 - DNA, 17 bp, Homo sapiens
ctcttctttaagccata

SEQ ID NO: 4529855 - DNA, 19 bp, Homo sapiens
ctcttctttaagccataga

SEQ ID NO: 4529856 - DNA, 16 bp, Homo sapiens
ctcttctttgtgcctt

SEQ ID NO: 4529857 - DNA, 21 bp, Homo sapiens
ctcttgaaatattcagaaatt

SEQ ID NO: 4529858 - DNA, 23 bp, Homo sapiens
ctcttgatctctcttgtcctctt

SEQ ID NO: 4529859 - DNA, 14 bp, Homo sapiens
ctcttgcaggctga

SEQ ID NO: 4529860 - DNA, 17 bp, Homo sapiens
ctcttgcaggctgagtc

SEQ ID NO: 4529861 - DNA, 21 bp, Homo sapiens
ctcttgccatttgtagctttg

SEQ ID NO: 4529862 - DNA, 15 bp, Homo sapiens
ctcttgcccatcctg

SEQ ID NO: 4529863 - DNA, 19 bp, Homo sapiens
ctcttgcccatcctgactg

SEQ ID NO: 4529864 - DNA, 20 bp, Homo sapiens
ctcttgcccatcctgactga

SEQ ID NO: 4529865 - DNA, 18 bp, Homo sapiens
ctcttgcctcgaggggcc

SEQ ID NO: 4529866 - DNA, 21 bp, Homo sapiens
ctcttggggagtttagggtgg

SEQ ID NO: 4529867 - DNA, 16 bp, Homo sapiens
ctcttgggtcagagaa

SEQ ID NO: 4529868 - DNA, 21 bp, Homo sapiens
ctcttggttcgatacctggag

SEQ ID NO: 4529869 - DNA, 17 bp, Homo sapiens
ctcttgtgatttcttta

SEQ ID NO: 4529870 - DNA, 22 bp, Homo sapiens
ctcttgtgatttctttaaaaga

SEQ ID NO: 4529871 - DNA, 12 bp, Homo sapiens
ctctttaaaaca

SEQ ID NO: 4529872 - DNA, 15 bp, Homo sapiens
ctctttaaaacaaaa

SEQ ID NO: 4529873 - DNA, 15 bp, Homo sapiens
ctctttacatttctt

SEQ ID NO: 4529874 - DNA, 16 bp, Homo sapiens
ctctttacctttgccc

SEQ ID NO: 4529875 - DNA, 12 bp, Homo sapiens
ctctttcaaaac

SEQ ID NO: 4529876 - DNA, 18 bp, Homo sapiens
ctctttccatgacatcaa

SEQ ID NO: 4529877 - DNA, 16 bp, Homo sapiens
ctatttgtataaaaat

SEQ ID NO: 4529878 - DNA, 18 bp, Homo sapiens
ctatttgtataaaaatta

SEQ ID NO: 4529879 - DNA, 12 bp, Homo sapiens
ctatttgtctct

SEQ ID NO: 4529880 - DNA, 22 bp, Homo sapiens
ctattttacttttctgccaaaa

SEQ ID NO: 4529881 - DNA, 12 bp, Homo sapiens
ctattttcagaa

SEQ ID NO: 4529882 - DNA, 15 bp, Homo sapiens
ctattttcagaatct

SEQ ID NO: 4529883 - DNA, 19 bp, Homo sapiens
ctattttcatcacagttgc

SEQ ID NO: 4529884 - DNA, 12 bp, Homo sapiens
ctattttctatt

SEQ ID NO: 4529885 - DNA, 15 bp, Homo sapiens
ctattttgatgcagc

SEQ ID NO: 4529886 - DNA, 19 bp, Homo sapiens
ctatttttaatgtttgtac

SEQ ID NO: 4529887 - DNA, 20 bp, Homo sapiens
ctatttttattttaaaataa

SEQ ID NO: 4529888 - DNA, 14 bp, Homo sapiens
ctatttttctctcc

SEQ ID NO: 4529889 - DNA, 20 bp, Homo sapiens
ctatttttctctcctgtcct

SEQ ID NO: 4529890 - DNA, 16 bp, Homo sapiens
ctatttttctttccaa

SEQ ID NO: 4529891 - DNA, 22 bp, Homo sapiens
ctatttttgacatggaaatgaa

SEQ ID NO: 4529892 - DNA, 14 bp, Homo sapiens
ctatttttgactgt

SEQ ID NO: 4529893 - DNA, 18 bp, Homo sapiens
ctatttttggcagtctga

SEQ ID NO: 4529894 - DNA, 22 bp, Homo sapiens
ctatttttggcagtctgaattt

SEQ ID NO: 4529895 - DNA, 21 bp, Homo sapiens
ctatttttttaaaatcactaa

SEQ ID NO: 4529896 - DNA, 14 bp, Homo sapiens
ctatttttttcaaa

SEQ ID NO: 4529897 - DNA, 22 bp, Homo sapiens
ctatttttttcctaagacattt

SEQ ID NO: 4529898 - DNA, 19 bp, Homo sapiens
ctcaaaaaaaaaaagaaaa

SEQ ID NO: 4529899 - DNA, 14 bp, Homo sapiens
ctcaaaaagaaatc

SEQ ID NO: 4529900 - DNA, 21 bp, Homo sapiens
ctcaaaacacttccagtctgg

SEQ ID NO: 4529901 - DNA, 20 bp, Homo sapiens
ctcaaaagagaaaaacaaaa

SEQ ID NO: 4529902 - DNA, 22 bp, Homo sapiens
ctcaaaccaagggtacagatcc

SEQ ID NO: 4529903 - DNA, 15 bp, Homo sapiens
ctcaaaccatatttt

SEQ ID NO: 4529904 - DNA, 23 bp, Homo sapiens
ctcaaactcattgcagcagataa

SEQ ID NO: 4529905 - DNA, 17 bp, Homo sapiens
ctcaaagaagtcggaat

SEQ ID NO: 4529906 - DNA, 15 bp, Homo sapiens
ctcaaatacatgcac

SEQ ID NO: 4529907 - DNA, 18 bp, Homo sapiens
ctcaaatacatgcacagt

SEQ ID NO: 4529908 - DNA, 21 bp, Homo sapiens
ctcaaatcagtgataattggt

SEQ ID NO: 4529909 - DNA, 21 bp, Homo sapiens
ctcaacaaaaaaccgaggccc

SEQ ID NO: 4529910 - DNA, 20 bp, Homo sapiens
ctcaacacccaactgtctcg

SEQ ID NO: 4529911 - DNA, 14 bp, Homo sapiens
ctcaacagagagga

SEQ ID NO: 4529912 - DNA, 14 bp, Homo sapiens
ctcaacccccctcc

SEQ ID NO: 4529913 - DNA, 22 bp, Homo sapiens
ctcaacccccctcccagacagg

SEQ ID NO: 4529914 - DNA, 15 bp, Homo sapiens
ctcaacctgtaaatt

SEQ ID NO: 4529915 - DNA, 22 bp, Homo sapiens
ctcaacgcctccccctccccca

SEQ ID NO: 4529916 - DNA, 14 bp, Homo sapiens
ctcaactactcagc

SEQ ID NO: 4529917 - DNA, 23 bp, Homo sapiens
ctcaactccgtgcttaaccaaag

SEQ ID NO: 4529918 - DNA, 14 bp, Homo sapiens
ctcaactcctccca

SEQ ID NO: 4529919 - DNA, 17 bp, Homo sapiens
ctcaactttctgttgga

SEQ ID NO: 4529920 - DNA, 21 bp, Homo sapiens
ctcaagaatctagaagatgtg

SEQ ID NO: 4529921 - DNA, 12 bp, Homo sapiens
ctcaagaccccc

SEQ ID NO: 4529922 - DNA, 22 bp, Homo sapiens
ctcaagacccccatttgtccca

SEQ ID NO: 4529923 - DNA, 18 bp, Homo sapiens
ctcaagccccatttcctc

SEQ ID NO: 4529924 - DNA, 15 bp, Homo sapiens
ctcaaggacaggagc

SEQ ID NO: 4529925 - DNA, 16 bp, Homo sapiens
ctcaaggacaggagcc

SEQ ID NO: 4529926 - DNA, 19 bp, Homo sapiens
ctcaaggacaggagcctgg

SEQ ID NO: 4529927 - DNA, 22 bp, Homo sapiens
ctcaaggagaggcaaagaaagg

SEQ ID NO: 4529928 - DNA, 22 bp, Homo sapiens
ctcaagtgggaacgactgggca

SEQ ID NO: 4529929 - DNA, 16 bp, Homo sapiens
ctcaatcagtctcaga

SEQ ID NO: 4529930 - DNA, 20 bp, Homo sapiens
ctcaatcctaatttctcctc

SEQ ID NO: 4529931 - DNA, 20 bp, Homo sapiens
ctcaatgtgaatcagaccct

SEQ ID NO: 4529932 - DNA, 21 bp, Homo sapiens
ctcaatgtgaatcagacccta

SEQ ID NO: 4529933 - DNA, 23 bp, Homo sapiens
ctcaatttttgtttttgagtact

SEQ ID NO: 4529934 - DNA, 22 bp, Homo sapiens
ctcacaaaaaggcaaatattga

SEQ ID NO: 4529935 - DNA, 15 bp, Homo sapiens
ctcacaatgaggcta

SEQ ID NO: 4529936 - DNA, 15 bp, Homo sapiens
ctcacacagccaggt

SEQ ID NO: 4529937 - DNA, 16 bp, Homo sapiens
ctcacacctcactctt

SEQ ID NO: 4529938 - DNA, 20 bp, Homo sapiens
ctcacacgtttaatcccagc

SEQ ID NO: 4529939 - DNA, 14 bp, Homo sapiens
ctcacactgagaat

SEQ ID NO: 4529940 - DNA, 20 bp, Homo sapiens
ctcacactgagaatgtaaga

SEQ ID NO: 4529941 - DNA, 17 bp, Homo sapiens
ctcacagccgcattggt

SEQ ID NO: 4529942 - DNA, 17 bp, Homo sapiens
ctcacagtcccactgtg

SEQ ID NO: 4529943 - DNA, 19 bp, Homo sapiens
ctcacagttcctcgccctg

SEQ ID NO: 4529944 - DNA, 21 bp, Homo sapiens
ctcacagttcctcgccctggg

SEQ ID NO: 4529945 - DNA, 22 bp, Homo sapiens
ctcacagttcctcgccctgggt

SEQ ID NO: 4529946 - DNA, 21 bp, Homo sapiens
ctcacataagcccagttcatc

SEQ ID NO: 4529947 - DNA, 21 bp, Homo sapiens
ctcacatagccaactctccca

SEQ ID NO: 4529948 - DNA, 12 bp, Homo sapiens
ctcacatgggac

SEQ ID NO: 4529949 - DNA, 19 bp, Homo sapiens
ctcacatgggactgggata

SEQ ID NO: 4529950 - DNA, 18 bp, Homo sapiens
ctcaccactaccagccag

SEQ ID NO: 4529951 - DNA, 23 bp, Homo sapiens
ctcaccactaccagccagcctca

SEQ ID NO: 4529952 - DNA, 15 bp, Homo sapiens
ctcaccagccctgca

SEQ ID NO: 4529953 - DNA, 12 bp, Homo sapiens
ctcaccagctgc

SEQ ID NO: 4529954 - DNA, 13 bp, Homo sapiens
ctcaccagctgca

SEQ ID NO: 4529955 - DNA, 15 bp, Homo sapiens
ctcaccagctgcaaa

SEQ ID NO: 4529956 - DNA, 16 bp, Homo sapiens
ctcaccagctgcaaag

SEQ ID NO: 4529957 - DNA, 17 bp, Homo sapiens
ctcaccagctgcaaagt

SEQ ID NO: 4529958 - DNA, 18 bp, Homo sapiens
ctcaccagctgcaaagtg

SEQ ID NO: 4529959 - DNA, 20 bp, Homo sapiens
ctcaccagctgcaaagtgtt

SEQ ID NO: 4529960 - DNA, 17 bp, Homo sapiens
ctcacccatcctagagg

SEQ ID NO: 4529961 - DNA, 14 bp, Homo sapiens
ctcacccccatccc

SEQ ID NO: 4529962 - DNA, 14 bp, Homo sapiens
ctcaccccctccca

SEQ ID NO: 4529963 - DNA, 18 bp, Homo sapiens
ctcaccccctcccacccc

SEQ ID NO: 4529964 - DNA, 22 bp, Homo sapiens
ctcaccccctcccacccccagc

SEQ ID NO: 4529965 - DNA, 13 bp, Homo sapiens
ctcaccccctcgg

SEQ ID NO: 4529966 - DNA, 21 bp, Homo sapiens
ctcaccccctcgggtctcctc

SEQ ID NO: 4529967 - DNA, 14 bp, Homo sapiens
ctcacccctcgcca

SEQ ID NO: 4529968 - DNA, 17 bp, Homo sapiens
ctcacccctggttctca

SEQ ID NO: 4529969 - DNA, 16 bp, Homo sapiens
ctcaccctctcttggt

SEQ ID NO: 4529970 - DNA, 15 bp, Homo sapiens
ctcaccctgctacac

SEQ ID NO: 4529971 - DNA, 13 bp, Homo sapiens
ctcaccctgggag

SEQ ID NO: 4529972 - DNA, 15 bp, Homo sapiens
ctcaccctgggagcc

SEQ ID NO: 4529973 - DNA, 14 bp, Homo sapiens
ctcaccgcccatca

SEQ ID NO: 4529974 - DNA, 15 bp, Homo sapiens
ctcacctagcctgat

SEQ ID NO: 4529975 - DNA, 15 bp, Homo sapiens
ctcacctcatgccca

SEQ ID NO: 4529976 - DNA, 17 bp, Homo sapiens
ctcacctcatgcccacc

SEQ ID NO: 4529977 - DNA, 23 bp, Homo sapiens
ctcacctcatgcccaccccctgc

SEQ ID NO: 4529978 - DNA, 15 bp, Homo sapiens
ctcacctctctctaa

SEQ ID NO: 4529979 - DNA, 16 bp, Homo sapiens
ctcacctctgcctcaa

SEQ ID NO: 4529980 - DNA, 19 bp, Homo sapiens
ctcacctctgcctcaatgt

SEQ ID NO: 4529981 - DNA, 12 bp, Homo sapiens
ctcacctgacct

SEQ ID NO: 4529982 - DNA, 20 bp, Homo sapiens
ctcacctgcactaacagagt

SEQ ID NO: 4529983 - DNA, 23 bp, Homo sapiens
ctcacctgctcccagtcctgcct

SEQ ID NO: 4529984 - DNA, 16 bp, Homo sapiens
ctcacgaaagtattta

SEQ ID NO: 4529985 - DNA, 17 bp, Homo sapiens
ctcacgaaagtatttac

SEQ ID NO: 4529986 - DNA, 21 bp, Homo sapiens
ctcacgcctgtaatcccagca

SEQ ID NO: 4529987 - DNA, 22 bp, Homo sapiens
ctcacgcctgtaatcccagcac

SEQ ID NO: 4529988 - DNA, 16 bp, Homo sapiens
ctcacgctttgtttac

SEQ ID NO: 4529989 - DNA, 19 bp, Homo sapiens
ctcacgggcagtagctgtg

SEQ ID NO: 4529990 - DNA, 20 bp, Homo sapiens
ctcacggggttggctgttcc

SEQ ID NO: 4529991 - DNA, 21 bp, Homo sapiens
ctcacggggttggctgttcca

SEQ ID NO: 4529992 - DNA, 17 bp, Homo sapiens
ctcactaatttttgtat

SEQ ID NO: 4529993 - DNA, 17 bp, Homo sapiens
ctcactataccagtata

SEQ ID NO: 4529994 - DNA, 21 bp, Homo sapiens
ctcactatggtatgctggcca

SEQ ID NO: 4529995 - DNA, 12 bp, Homo sapiens
ctcactccacca

SEQ ID NO: 4529996 - DNA, 17 bp, Homo sapiens
ctcactcccctctcctc

SEQ ID NO: 4529997 - DNA, 15 bp, Homo sapiens
ctatccacccagccc

SEQ ID NO: 4529998 - DNA, 17 bp, Homo sapiens
ctatccacccagcccat

SEQ ID NO: 4529999 - DNA, 17 bp, Homo sapiens
ctatccccatctccctg

SEQ ID NO: 4530000 - DNA, 18 bp, Homo sapiens
ctatccctaggcacttaa

SEQ ID NO: 4530001 - DNA, 15 bp, Homo sapiens
ctatccgctgccagc

SEQ ID NO: 4530002 - DNA, 15 bp, Homo sapiens
ctatccgtgttgcag

SEQ ID NO: 4530003 - DNA, 18 bp, Homo sapiens
ctatcctacaaggcctat

SEQ ID NO: 4530004 - DNA, 12 bp, Homo sapiens
ctatcctctgta

SEQ ID NO: 4530005 - DNA, 18 bp, Homo sapiens
ctatcctgtaaatatatc

SEQ ID NO: 4530006 - DNA, 19 bp, Homo sapiens
ctatccttccagtggctcg

SEQ ID NO: 4530007 - DNA, 14 bp, Homo sapiens
ctatcctttcaaac

SEQ ID NO: 4530008 - DNA, 21 bp, Homo sapiens
ctatccttttgcctgcaggtc

SEQ ID NO: 4530009 - DNA, 15 bp, Homo sapiens
ctatctaatgacatg

SEQ ID NO: 4530010 - DNA, 20 bp, Homo sapiens
ctatctacaaagaaaaatta

SEQ ID NO: 4530011 - DNA, 17 bp, Homo sapiens
ctatctagcatttattt

SEQ ID NO: 4530012 - DNA, 18 bp, Homo sapiens
ctatctcaatcctaattt

SEQ ID NO: 4530013 - DNA, 21 bp, Homo sapiens
ctatctcatctatctcaatcc

SEQ ID NO: 4530014 - DNA, 23 bp, Homo sapiens
ctatctccgttccatctgggctt

SEQ ID NO: 4530015 - DNA, 23 bp, Homo sapiens
ctatctctctgtcttttttctct

SEQ ID NO: 4530016 - DNA, 18 bp, Homo sapiens
ctatctgaaagtaaagtt

SEQ ID NO: 4530017 - DNA, 21 bp, Homo sapiens
ctatctggtattaaatgccaa

SEQ ID NO: 4530018 - DNA, 17 bp, Homo sapiens
ctatctggtgatttcta

SEQ ID NO: 4530019 - DNA, 14 bp, Homo sapiens
ctatctgtgattcc

SEQ ID NO: 4530020 - DNA, 16 bp, Homo sapiens
ctatctgttcctatct

SEQ ID NO: 4530021 - DNA, 14 bp, Homo sapiens
ctatcttcatgtaa

SEQ ID NO: 4530022 - DNA, 14 bp, Homo sapiens
ctatctttgctgca

SEQ ID NO: 4530023 - DNA, 21 bp, Homo sapiens
ctatgaaaagctagaattgag

SEQ ID NO: 4530024 - DNA, 18 bp, Homo sapiens
ctatgaaaatgagccctg

SEQ ID NO: 4530025 - DNA, 17 bp, Homo sapiens
ctatgaaataatgtgaa

SEQ ID NO: 4530026 - DNA, 11 bp, Homo sapiens
ctatgaacaga

SEQ ID NO: 4530027 - DNA, 20 bp, Homo sapiens
ctatgaagagctagagaaat

SEQ ID NO: 4530028 - DNA, 23 bp, Homo sapiens
ctatgacctaggggtttctgttg

SEQ ID NO: 4530029 - DNA, 19 bp, Homo sapiens
ctatgagatggccatgctc

SEQ ID NO: 4530030 - DNA, 22 bp, Homo sapiens
ctatgagatggccatgctcaac

SEQ ID NO: 4530031 - DNA, 23 bp, Homo sapiens
ctatgaggaaactgagtcactca

SEQ ID NO: 4530032 - DNA, 20 bp, Homo sapiens
ctatgagggtgtttcctcta

SEQ ID NO: 4530033 - DNA, 23 bp, Homo sapiens
ctatgatattttctgtgcctgaa

SEQ ID NO: 4530034 - DNA, 18 bp, Homo sapiens
ctatgatgagaggccagc

SEQ ID NO: 4530035 - DNA, 16 bp, Homo sapiens
ctatgcactgaagagc

SEQ ID NO: 4530036 - DNA, 17 bp, Homo sapiens
ctatgcactgaagagct

SEQ ID NO: 4530037 - DNA, 18 bp, Homo sapiens
ctatgcactgaagagctc

SEQ ID NO: 4530038 - DNA, 20 bp, Homo sapiens
ctatgcactgaagagctctt

SEQ ID NO: 4530039 - DNA, 15 bp, Homo sapiens
ctatgcaggcagcac

SEQ ID NO: 4530040 - DNA, 21 bp, Homo sapiens
ctatgcctgtggtgaagtgtg

SEQ ID NO: 4530041 - DNA, 18 bp, Homo sapiens
ctatgctgtttgtagtga

SEQ ID NO: 4530042 - DNA, 15 bp, Homo sapiens
ctatggaaagatggc

SEQ ID NO: 4530043 - DNA, 18 bp, Homo sapiens
ctatggaacataaagttg

SEQ ID NO: 4530044 - DNA, 22 bp, Homo sapiens
ctatggaacataaagttgtatt

SEQ ID NO: 4530045 - DNA, 18 bp, Homo sapiens
ctatggagactttgctgt

SEQ ID NO: 4530046 - DNA, 19 bp, Homo sapiens
ctatggagactttgctgtt

SEQ ID NO: 4530047 - DNA, 17 bp, Homo sapiens
ctatggagtcttgtgaa

SEQ ID NO: 4530048 - DNA, 19 bp, Homo sapiens
ctatggagtcttgtgaaag

SEQ ID NO: 4530049 - DNA, 17 bp, Homo sapiens
ctatggattcacttcta

SEQ ID NO: 4530050 - DNA, 20 bp, Homo sapiens
ctatggattcacttctattt

SEQ ID NO: 4530051 - DNA, 22 bp, Homo sapiens
ctatggattcacttctatttat

SEQ ID NO: 4530052 - DNA, 19 bp, Homo sapiens
ctatggctttaaataaatt

SEQ ID NO: 4530053 - DNA, 13 bp, Homo sapiens
ctatggctttcaa

SEQ ID NO: 4530054 - DNA, 14 bp, Homo sapiens
ctatggctttcaaa

SEQ ID NO: 4530055 - DNA, 15 bp, Homo sapiens
ctatggctttcaaag

SEQ ID NO: 4530056 - DNA, 18 bp, Homo sapiens
ctatggctttcaaagcta

SEQ ID NO: 4530057 - DNA, 21 bp, Homo sapiens
ctatgggagattaaaaccaga

SEQ ID NO: 4530058 - DNA, 16 bp, Homo sapiens
ctatgggagccccagg

SEQ ID NO: 4530059 - DNA, 19 bp, Homo sapiens
ctatgggtctaggacacag

SEQ ID NO: 4530060 - DNA, 21 bp, Homo sapiens
ctatgggtttagttactttag

SEQ ID NO: 4530061 - DNA, 17 bp, Homo sapiens
ctatggtatgctggcca

SEQ ID NO: 4530062 - DNA, 22 bp, Homo sapiens
ctatgtaataatgtacagagga

SEQ ID NO: 4530063 - DNA, 23 bp, Homo sapiens
ctatgtaataatgtacagaggaa

SEQ ID NO: 4530064 - DNA, 18 bp, Homo sapiens
ctatgtattttcctaatg

SEQ ID NO: 4530065 - DNA, 15 bp, Homo sapiens
ctatgtctgccttcg

SEQ ID NO: 4530066 - DNA, 12 bp, Homo sapiens
ctatgtgacaat

SEQ ID NO: 4530067 - DNA, 21 bp, Homo sapiens
ctatgtgacatttctcttccc

SEQ ID NO: 4530068 - DNA, 18 bp, Homo sapiens
ctatgtgattctggaagc

SEQ ID NO: 4530069 - DNA, 20 bp, Homo sapiens
ctatgtgattctggaagcaa

SEQ ID NO: 4530070 - DNA, 17 bp, Homo sapiens
ctatgtgtttttctcat

SEQ ID NO: 4530071 - DNA, 14 bp, Homo sapiens
ctatgttaatattt

SEQ ID NO: 4530072 - DNA, 15 bp, Homo sapiens
ctatgttaatatttt

SEQ ID NO: 4530073 - DNA, 21 bp, Homo sapiens
ctatgttaatattttaggtgt

SEQ ID NO: 4530074 - DNA, 19 bp, Homo sapiens
ctatgttccaataaaactt

SEQ ID NO: 4530075 - DNA, 21 bp, Homo sapiens
ctatgtttatttttgtacatt

SEQ ID NO: 4530076 - DNA, 14 bp, Homo sapiens
ctatgtttcatctt

SEQ ID NO: 4530077 - DNA, 16 bp, Homo sapiens
ctatgtttttaatgta

SEQ ID NO: 4530078 - DNA, 22 bp, Homo sapiens
ctatgtttttgttcaaagccag

SEQ ID NO: 4530079 - DNA, 19 bp, Homo sapiens
ctattaacaattaattgtc

SEQ ID NO: 4530080 - DNA, 20 bp, Homo sapiens
ctattaacaattaattgtct

SEQ ID NO: 4530081 - DNA, 22 bp, Homo sapiens
ctattaatatttgtttagttca

SEQ ID NO: 4530082 - DNA, 15 bp, Homo sapiens
ctattacttgaactt

SEQ ID NO: 4530083 - DNA, 18 bp, Homo sapiens
ctattacttgaactttcc

SEQ ID NO: 4530084 - DNA, 20 bp, Homo sapiens
ctattacttgaactttccaa

SEQ ID NO: 4530085 - DNA, 13 bp, Homo sapiens
ctattacttttct

SEQ ID NO: 4530086 - DNA, 17 bp, Homo sapiens
ctattacttttctgttt

SEQ ID NO: 4530087 - DNA, 20 bp, Homo sapiens
ctattagtattattaacact

SEQ ID NO: 4530088 - DNA, 17 bp, Homo sapiens
ctattatagtgaaacat

SEQ ID NO: 4530089 - DNA, 17 bp, Homo sapiens
ctattatggaaaactgt

SEQ ID NO: 4530090 - DNA, 16 bp, Homo sapiens
ctattcaaacagtctc

SEQ ID NO: 4530091 - DNA, 23 bp, Homo sapiens
ctattcaaacagtctcaggaaat

SEQ ID NO: 4530092 - DNA, 16 bp, Homo sapiens
ctattcacaattattc

SEQ ID NO: 4530093 - DNA, 23 bp, Homo sapiens
ctattcagcttcgtttattttca

SEQ ID NO: 4530094 - DNA, 13 bp, Homo sapiens
ctattcatggcta

SEQ ID NO: 4530095 - DNA, 16 bp, Homo sapiens
ctattccttcacacag

SEQ ID NO: 4530096 - DNA, 21 bp, Homo sapiens
ctattctgatgaatctcaaag

SEQ ID NO: 4530097 - DNA, 23 bp, Homo sapiens
ctattcttgatttatttgcttct

SEQ ID NO: 4530098 - DNA, 23 bp, Homo sapiens
ctattcttggaccatgccagatt

SEQ ID NO: 4530099 - DNA, 12 bp, Homo sapiens
ctattgacaata

SEQ ID NO: 4530100 - DNA, 21 bp, Homo sapiens
ctattgatgtacagtctgtca

SEQ ID NO: 4530101 - DNA, 14 bp, Homo sapiens
ctattgcatttata

SEQ ID NO: 4530102 - DNA, 17 bp, Homo sapiens
ctattgcatttatatgt

SEQ ID NO: 4530103 - DNA, 18 bp, Homo sapiens
ctattgctgctgcccctt

SEQ ID NO: 4530104 - DNA, 16 bp, Homo sapiens
ctattgtgccaactgc

SEQ ID NO: 4530105 - DNA, 17 bp, Homo sapiens
ctatttaacaagatgtt

SEQ ID NO: 4530106 - DNA, 13 bp, Homo sapiens
ctatttaacattt

SEQ ID NO: 4530107 - DNA, 16 bp, Homo sapiens
ctatttaacattttac

SEQ ID NO: 4530108 - DNA, 21 bp, Homo sapiens
ctatttataatacagaatctt

SEQ ID NO: 4530109 - DNA, 11 bp, Homo sapiens
ctatttcaata

SEQ ID NO: 4530110 - DNA, 13 bp, Homo sapiens
ctatttctatgtc

SEQ ID NO: 4530111 - DNA, 14 bp, Homo sapiens
ctatttctatgtca

SEQ ID NO: 4530112 - DNA, 15 bp, Homo sapiens
ctatttctcctccat

SEQ ID NO: 4530113 - DNA, 16 bp, Homo sapiens
ctatttctcctccatg

SEQ ID NO: 4530114 - DNA, 16 bp, Homo sapiens
ctatttcttgaagaat

SEQ ID NO: 4530115 - DNA, 12 bp, Homo sapiens
ctatttgtacaa

SEQ ID NO: 4530116 - DNA, 21 bp, Homo sapiens
ctatttgtacaattttaaagt

SEQ ID NO: 4530117 - DNA, 19 bp, Homo sapiens
ctagcctgcattgagcttg

SEQ ID NO: 4530118 - DNA, 22 bp, Homo sapiens
ctagcgctgccgcaccccagag

SEQ ID NO: 4530119 - DNA, 15 bp, Homo sapiens
ctagcggagcccagc

SEQ ID NO: 4530120 - DNA, 17 bp, Homo sapiens
ctagctgcacagggcag

SEQ ID NO: 4530121 - DNA, 20 bp, Homo sapiens
ctagctgcacagggcagctg

SEQ ID NO: 4530122 - DNA, 23 bp, Homo sapiens
ctagctgtgtgaatacctgctca

SEQ ID NO: 4530123 - DNA, 20 bp, Homo sapiens
ctagcttaagtgtaaatgaa

SEQ ID NO: 4530124 - DNA, 16 bp, Homo sapiens
ctagcttctgcttttc

SEQ ID NO: 4530125 - DNA, 18 bp, Homo sapiens
ctagcttctgcttttctg

SEQ ID NO: 4530126 - DNA, 19 bp, Homo sapiens
ctaggacacagttcctggg

SEQ ID NO: 4530127 - DNA, 21 bp, Homo sapiens
ctaggacccgtctccagctgc

SEQ ID NO: 4530128 - DNA, 22 bp, Homo sapiens
ctaggacccgtctccagctgct

SEQ ID NO: 4530129 - DNA, 13 bp, Homo sapiens
ctaggacttaaaa

SEQ ID NO: 4530130 - DNA, 22 bp, Homo sapiens
ctaggacttaaccttgaaatgg

SEQ ID NO: 4530131 - DNA, 20 bp, Homo sapiens
ctaggagaagagttgaggaa

SEQ ID NO: 4530132 - DNA, 19 bp, Homo sapiens
ctaggagctgggaggaaaa

SEQ ID NO: 4530133 - DNA, 17 bp, Homo sapiens
ctaggatgaacaatgta

SEQ ID NO: 4530134 - DNA, 20 bp, Homo sapiens
ctaggatgaacaatgtatac

SEQ ID NO: 4530135 - DNA, 14 bp, Homo sapiens
ctaggatggttctg

SEQ ID NO: 4530136 - DNA, 15 bp, Homo sapiens
ctaggcaggacctgt

SEQ ID NO: 4530137 - DNA, 14 bp, Homo sapiens
ctaggcatttcatt

SEQ ID NO: 4530138 - DNA, 18 bp, Homo sapiens
ctaggccacgtccaggtc

SEQ ID NO: 4530139 - DNA, 14 bp, Homo sapiens
ctaggccactcctc

SEQ ID NO: 4530140 - DNA, 16 bp, Homo sapiens
ctaggccactcctcca

SEQ ID NO: 4530141 - DNA, 16 bp, Homo sapiens
ctaggcctgaaatgac

SEQ ID NO: 4530142 - DNA, 20 bp, Homo sapiens
ctaggcttcaggttgcattg

SEQ ID NO: 4530143 - DNA, 21 bp, Homo sapiens
ctaggcttcaggttgcattgg

SEQ ID NO: 4530144 - DNA, 22 bp, Homo sapiens
ctagggacccctcgccccagcc

SEQ ID NO: 4530145 - DNA, 17 bp, Homo sapiens
ctagggattcaggctgc

SEQ ID NO: 4530146 - DNA, 18 bp, Homo sapiens
ctaggggtttcacctgca

SEQ ID NO: 4530147 - DNA, 20 bp, Homo sapiens
ctaggtacgatgacagtgtt

SEQ ID NO: 4530148 - DNA, 15 bp, Homo sapiens
ctaggtagaaaaagg

SEQ ID NO: 4530149 - DNA, 17 bp, Homo sapiens
ctaggtagaaaaagggt

SEQ ID NO: 4530150 - DNA, 18 bp, Homo sapiens
ctaggtagaaaaagggtc

SEQ ID NO: 4530151 - DNA, 22 bp, Homo sapiens
ctaggtatcattcaactctcca

SEQ ID NO: 4530152 - DNA, 17 bp, Homo sapiens
ctaggtctcctcagggt

SEQ ID NO: 4530153 - DNA, 13 bp, Homo sapiens
ctaggtgtcccca

SEQ ID NO: 4530154 - DNA, 16 bp, Homo sapiens
ctaggtgtccccaacg

SEQ ID NO: 4530155 - DNA, 17 bp, Homo sapiens
ctaggtgtttcaacaga

SEQ ID NO: 4530156 - DNA, 14 bp, Homo sapiens
ctaggttaaagcta

SEQ ID NO: 4530157 - DNA, 16 bp, Homo sapiens
ctagtaaatgttaact

SEQ ID NO: 4530158 - DNA, 17 bp, Homo sapiens
ctagtaacaatacatga

SEQ ID NO: 4530159 - DNA, 22 bp, Homo sapiens
ctagtaacaatacatgagaaag

SEQ ID NO: 4530160 - DNA, 18 bp, Homo sapiens
ctagtaagtgccttccat

SEQ ID NO: 4530161 - DNA, 13 bp, Homo sapiens
ctagtactattac

SEQ ID NO: 4530162 - DNA, 14 bp, Homo sapiens
ctagtagcaatgtg

SEQ ID NO: 4530163 - DNA, 18 bp, Homo sapiens
ctagtagcaatgtgcctt

SEQ ID NO: 4530164 - DNA, 18 bp, Homo sapiens
ctagtaggaatgtacatg

SEQ ID NO: 4530165 - DNA, 23 bp, Homo sapiens
ctagtaggcagcaaaagaccaaa

SEQ ID NO: 4530166 - DNA, 20 bp, Homo sapiens
ctagtagttagaaattaaat

SEQ ID NO: 4530167 - DNA, 22 bp, Homo sapiens
ctagtagttagaaattaaatct

SEQ ID NO: 4530168 - DNA, 18 bp, Homo sapiens
ctagtataagtctgggca

SEQ ID NO: 4530169 - DNA, 17 bp, Homo sapiens
ctagtatcaaaagaaag

SEQ ID NO: 4530170 - DNA, 22 bp, Homo sapiens
ctagtcattaacccatctctga

SEQ ID NO: 4530171 - DNA, 17 bp, Homo sapiens
ctagtcccttcccctcc

SEQ ID NO: 4530172 - DNA, 14 bp, Homo sapiens
ctagtctatcagca

SEQ ID NO: 4530173 - DNA, 19 bp, Homo sapiens
ctagtctatcagcatctga

SEQ ID NO: 4530174 - DNA, 12 bp, Homo sapiens
ctagtctctcct

SEQ ID NO: 4530175 - DNA, 20 bp, Homo sapiens
ctagtctgtgtgggactgta

SEQ ID NO: 4530176 - DNA, 21 bp, Homo sapiens
ctagtgaaggcttctctctgt

SEQ ID NO: 4530177 - DNA, 17 bp, Homo sapiens
ctagtggggtctccctc

SEQ ID NO: 4530178 - DNA, 23 bp, Homo sapiens
ctagtggggtctccctctcctgc

SEQ ID NO: 4530179 - DNA, 14 bp, Homo sapiens
ctagtgtttaagtc

SEQ ID NO: 4530180 - DNA, 16 bp, Homo sapiens
ctagttctcagcttgc

SEQ ID NO: 4530181 - DNA, 16 bp, Homo sapiens
ctagttctgccaggag

SEQ ID NO: 4530182 - DNA, 16 bp, Homo sapiens
ctagttctttcctccc

SEQ ID NO: 4530183 - DNA, 21 bp, Homo sapiens
ctagttctttcctccccctgc

SEQ ID NO: 4530184 - DNA, 22 bp, Homo sapiens
ctagttctttcctccccctgca

SEQ ID NO: 4530185 - DNA, 15 bp, Homo sapiens
ctagttttcagcctt

SEQ ID NO: 4530186 - DNA, 16 bp, Homo sapiens
ctataaaactttctgt

SEQ ID NO: 4530187 - DNA, 12 bp, Homo sapiens
ctataaaatgcc

SEQ ID NO: 4530188 - DNA, 14 bp, Homo sapiens
ctataaagcagtat

SEQ ID NO: 4530189 - DNA, 18 bp, Homo sapiens
ctataaagcagtattttt

SEQ ID NO: 4530190 - DNA, 19 bp, Homo sapiens
ctataaagcagtatttttc

SEQ ID NO: 4530191 - DNA, 14 bp, Homo sapiens
ctataaagggtcag

SEQ ID NO: 4530192 - DNA, 18 bp, Homo sapiens
ctataaagggtcaggccc

SEQ ID NO: 4530193 - DNA, 13 bp, Homo sapiens
ctataagaataag

SEQ ID NO: 4530194 - DNA, 20 bp, Homo sapiens
ctataagatacaataaaaca

SEQ ID NO: 4530195 - DNA, 23 bp, Homo sapiens
ctataagattccaaaaagcacat

SEQ ID NO: 4530196 - DNA, 23 bp, Homo sapiens
ctataaggtgctctctttctgtc

SEQ ID NO: 4530197 - DNA, 12 bp, Homo sapiens
ctataagtgctc

SEQ ID NO: 4530198 - DNA, 18 bp, Homo sapiens
ctataatcaaatgatttc

SEQ ID NO: 4530199 - DNA, 19 bp, Homo sapiens
ctataatcaaatgatttca

SEQ ID NO: 4530200 - DNA, 23 bp, Homo sapiens
ctataatcaaatgatttcatatt

SEQ ID NO: 4530201 - DNA, 14 bp, Homo sapiens
ctataatcccagct

SEQ ID NO: 4530202 - DNA, 13 bp, Homo sapiens
ctataatgtgaaa

SEQ ID NO: 4530203 - DNA, 17 bp, Homo sapiens
ctataattctgttatat

SEQ ID NO: 4530204 - DNA, 17 bp, Homo sapiens
ctatacaacctaactta

SEQ ID NO: 4530205 - DNA, 21 bp, Homo sapiens
ctatacatgttggaaatgtgt

SEQ ID NO: 4530206 - DNA, 17 bp, Homo sapiens
ctatactgcatactttt

SEQ ID NO: 4530207 - DNA, 11 bp, Homo sapiens
ctatacttgaa

SEQ ID NO: 4530208 - DNA, 22 bp, Homo sapiens
ctatagctgttctaatggatta

SEQ ID NO: 4530209 - DNA, 20 bp, Homo sapiens
ctataggtgctacaaaaaca

SEQ ID NO: 4530210 - DNA, 22 bp, Homo sapiens
ctatagtatttgattcaaaata

SEQ ID NO: 4530211 - DNA, 14 bp, Homo sapiens
ctatataaaataac

SEQ ID NO: 4530212 - DNA, 17 bp, Homo sapiens
ctatataaaataactaa

SEQ ID NO: 4530213 - DNA, 22 bp, Homo sapiens
ctatataaaataactaaaatgt

SEQ ID NO: 4530214 - DNA, 22 bp, Homo sapiens
ctatatagaatttcctgtaata

SEQ ID NO: 4530215 - DNA, 13 bp, Homo sapiens
ctatatatttcta

SEQ ID NO: 4530216 - DNA, 14 bp, Homo sapiens
ctatatatttctat

SEQ ID NO: 4530217 - DNA, 22 bp, Homo sapiens
ctatatcataactatacttgat

SEQ ID NO: 4530218 - DNA, 19 bp, Homo sapiens
ctatatgtgaaacattttt

SEQ ID NO: 4530219 - DNA, 17 bp, Homo sapiens
ctatattagatcaaata

SEQ ID NO: 4530220 - DNA, 22 bp, Homo sapiens
ctatattgcttagtaagtattt

SEQ ID NO: 4530221 - DNA, 16 bp, Homo sapiens
ctatattgttcagcat

SEQ ID NO: 4530222 - DNA, 15 bp, Homo sapiens
ctatcaacaataaaa

SEQ ID NO: 4530223 - DNA, 19 bp, Homo sapiens
ctatcaacaataaaatttt

SEQ ID NO: 4530224 - DNA, 18 bp, Homo sapiens
ctatcaatatttaagttt

SEQ ID NO: 4530225 - DNA, 17 bp, Homo sapiens
ctatcacctatttccat

SEQ ID NO: 4530226 - DNA, 19 bp, Homo sapiens
ctatcagagttgctgcaaa

SEQ ID NO: 4530227 - DNA, 20 bp, Homo sapiens
ctatcagttgatttttctta

SEQ ID NO: 4530228 - DNA, 21 bp, Homo sapiens
ctatcagttgatttttcttat

SEQ ID NO: 4530229 - DNA, 16 bp, Homo sapiens
ctatcatagttaacat

SEQ ID NO: 4530230 - DNA, 13 bp, Homo sapiens
ctatcatggcata

SEQ ID NO: 4530231 - DNA, 22 bp, Homo sapiens
ctatcatggtgaaaagctccat

SEQ ID NO: 4530232 - DNA, 16 bp, Homo sapiens
ctatcatttttacact

SEQ ID NO: 4530233 - DNA, 17 bp, Homo sapiens
ctatccaaaataaagat

SEQ ID NO: 4530234 - DNA, 18 bp, Homo sapiens
ctatccacagaacctttg

SEQ ID NO: 4530235 - DNA, 21 bp, Homo sapiens
ctatccacagaacctttgtca

SEQ ID NO: 4530236 - DNA, 19 bp, Homo sapiens
ctacctgctctccaagtct

SEQ ID NO: 4530237 - DNA, 14 bp, Homo sapiens
ctacctgtttgaag

SEQ ID NO: 4530238 - DNA, 13 bp, Homo sapiens
ctaccttgctttt

SEQ ID NO: 4530239 - DNA, 19 bp, Homo sapiens
ctaccttttaaaattgaat

SEQ ID NO: 4530240 - DNA, 16 bp, Homo sapiens
ctacgcactggacagc

SEQ ID NO: 4530241 - DNA, 21 bp, Homo sapiens
ctacgccaatgttatgccagc

SEQ ID NO: 4530242 - DNA, 16 bp, Homo sapiens
ctacgctgtccagaaa

SEQ ID NO: 4530243 - DNA, 17 bp, Homo sapiens
ctacgtacatgtgaggc

SEQ ID NO: 4530244 - DNA, 14 bp, Homo sapiens
ctacgtatttaata

SEQ ID NO: 4530245 - DNA, 13 bp, Homo sapiens
ctacgtccaaggt

SEQ ID NO: 4530246 - DNA, 21 bp, Homo sapiens
ctacgtttccccaataaagcc

SEQ ID NO: 4530247 - DNA, 14 bp, Homo sapiens
ctactaaaattcaa

SEQ ID NO: 4530248 - DNA, 13 bp, Homo sapiens
ctactaaggcctt

SEQ ID NO: 4530249 - DNA, 22 bp, Homo sapiens
ctactaaggccttttatgtaat

SEQ ID NO: 4530250 - DNA, 12 bp, Homo sapiens
ctactaattcca

SEQ ID NO: 4530251 - DNA, 15 bp, Homo sapiens
ctactaattccacac

SEQ ID NO: 4530252 - DNA, 13 bp, Homo sapiens
ctactataatcaa

SEQ ID NO: 4530253 - DNA, 22 bp, Homo sapiens
ctactataatcaaatgatttca

SEQ ID NO: 4530254 - DNA, 23 bp, Homo sapiens
ctactataatcaaatgatttcat

SEQ ID NO: 4530255 - DNA, 13 bp, Homo sapiens
ctactatttttct

SEQ ID NO: 4530256 - DNA, 15 bp, Homo sapiens
ctactcagcagccct

SEQ ID NO: 4530257 - DNA, 18 bp, Homo sapiens
ctactcagcagccctcct

SEQ ID NO: 4530258 - DNA, 21 bp, Homo sapiens
ctactcagcagccctcctcac

SEQ ID NO: 4530259 - DNA, 17 bp, Homo sapiens
ctactcagctctcctgc

SEQ ID NO: 4530260 - DNA, 20 bp, Homo sapiens
ctactcagctctcctgctgc

SEQ ID NO: 4530261 - DNA, 13 bp, Homo sapiens
ctactcccctggg

SEQ ID NO: 4530262 - DNA, 18 bp, Homo sapiens
ctactcctagaagaacca

SEQ ID NO: 4530263 - DNA, 14 bp, Homo sapiens
ctactcctgtgctc

SEQ ID NO: 4530264 - DNA, 14 bp, Homo sapiens
ctactctttgattt

SEQ ID NO: 4530265 - DNA, 14 bp, Homo sapiens
ctactgaaaatgca

SEQ ID NO: 4530266 - DNA, 20 bp, Homo sapiens
ctactgcatttataggacct

SEQ ID NO: 4530267 - DNA, 15 bp, Homo sapiens
ctactgccatcctgg

SEQ ID NO: 4530268 - DNA, 17 bp, Homo sapiens
ctactgccatcctggcc

SEQ ID NO: 4530269 - DNA, 16 bp, Homo sapiens
ctactgctcagcttct

SEQ ID NO: 4530270 - DNA, 15 bp, Homo sapiens
ctactggattcttat

SEQ ID NO: 4530271 - DNA, 18 bp, Homo sapiens
ctactggggaggctgagg

SEQ ID NO: 4530272 - DNA, 19 bp, Homo sapiens
ctactggggaggctgaggc

SEQ ID NO: 4530273 - DNA, 21 bp, Homo sapiens
ctactggggaggctgaggcag

SEQ ID NO: 4530274 - DNA, 14 bp, Homo sapiens
ctactgggtgtcat

SEQ ID NO: 4530275 - DNA, 16 bp, Homo sapiens
ctactgggtgtcattt

SEQ ID NO: 4530276 - DNA, 18 bp, Homo sapiens
ctactgggtgtcatttca

SEQ ID NO: 4530277 - DNA, 20 bp, Homo sapiens
ctactgtacataaacaatga

SEQ ID NO: 4530278 - DNA, 19 bp, Homo sapiens
ctactgtatcaataaaatt

SEQ ID NO: 4530279 - DNA, 15 bp, Homo sapiens
ctactgtgtgtgtga

SEQ ID NO: 4530280 - DNA, 17 bp, Homo sapiens
ctacttacccaggtggg

SEQ ID NO: 4530281 - DNA, 14 bp, Homo sapiens
ctacttccaggatg

SEQ ID NO: 4530282 - DNA, 22 bp, Homo sapiens
ctacttccctgccggaatgaac

SEQ ID NO: 4530283 - DNA, 23 bp, Homo sapiens
ctacttggcaaggtcatagacaa

SEQ ID NO: 4530284 - DNA, 13 bp, Homo sapiens
ctacttgggaggc

SEQ ID NO: 4530285 - DNA, 18 bp, Homo sapiens
ctacttgggaggctgaga

SEQ ID NO: 4530286 - DNA, 13 bp, Homo sapiens
ctactttctctct

SEQ ID NO: 4530287 - DNA, 20 bp, Homo sapiens
ctactttgactttttgcatt

SEQ ID NO: 4530288 - DNA, 20 bp, Homo sapiens
ctactttgttaggattttca

SEQ ID NO: 4530289 - DNA, 13 bp, Homo sapiens
ctacttttctaaa

SEQ ID NO: 4530290 - DNA, 21 bp, Homo sapiens
ctagaaaaaagggctgagagg

SEQ ID NO: 4530291 - DNA, 19 bp, Homo sapiens
ctagaaatatatcctgtgt

SEQ ID NO: 4530292 - DNA, 18 bp, Homo sapiens
ctagaaattgaacaaaaa

SEQ ID NO: 4530293 - DNA, 16 bp, Homo sapiens
ctagaaattgggcagt

SEQ ID NO: 4530294 - DNA, 12 bp, Homo sapiens
ctagaaattttc

SEQ ID NO: 4530295 - DNA, 18 bp, Homo sapiens
ctagaacctagaagggct

SEQ ID NO: 4530296 - DNA, 22 bp, Homo sapiens
ctagaagaaccaaatacctcaa

SEQ ID NO: 4530297 - DNA, 16 bp, Homo sapiens
ctagaagagtctattg

SEQ ID NO: 4530298 - DNA, 17 bp, Homo sapiens
ctagaagatgtgtaaac

SEQ ID NO: 4530299 - DNA, 18 bp, Homo sapiens
ctagaagattagaaacta

SEQ ID NO: 4530300 - DNA, 22 bp, Homo sapiens
ctagaaggcgtccatgtttatt

SEQ ID NO: 4530301 - DNA, 23 bp, Homo sapiens
ctagaagggccagtcctgcctgg

SEQ ID NO: 4530302 - DNA, 22 bp, Homo sapiens
ctagaagggctagaacctggag

SEQ ID NO: 4530303 - DNA, 15 bp, Homo sapiens
ctagaagtcttaatt

SEQ ID NO: 4530304 - DNA, 22 bp, Homo sapiens
ctagaatcaccgcatttcagtg

SEQ ID NO: 4530305 - DNA, 23 bp, Homo sapiens
ctagaatgtctgaagtacaaaca

SEQ ID NO: 4530306 - DNA, 14 bp, Homo sapiens
ctagacaaaatcaa

SEQ ID NO: 4530307 - DNA, 18 bp, Homo sapiens
ctagacacaatttcattt

SEQ ID NO: 4530308 - DNA, 23 bp, Homo sapiens
ctagacacaatttcatttccagc

SEQ ID NO: 4530309 - DNA, 21 bp, Homo sapiens
ctagacatcattgtcagcctt

SEQ ID NO: 4530310 - DNA, 22 bp, Homo sapiens
ctagacatcattgtcagccttg

SEQ ID NO: 4530311 - DNA, 16 bp, Homo sapiens
ctagacgcccctccca

SEQ ID NO: 4530312 - DNA, 17 bp, Homo sapiens
ctagacgcccctcccaa

SEQ ID NO: 4530313 - DNA, 17 bp, Homo sapiens
ctagactgttactttgg

SEQ ID NO: 4530314 - DNA, 18 bp, Homo sapiens
ctagactgttactttggc

SEQ ID NO: 4530315 - DNA, 18 bp, Homo sapiens
ctagagaaatcagctgct

SEQ ID NO: 4530316 - DNA, 16 bp, Homo sapiens
ctagagaaattcttgt

SEQ ID NO: 4530317 - DNA, 18 bp, Homo sapiens
ctagagaaattcttgtta

SEQ ID NO: 4530318 - DNA, 16 bp, Homo sapiens
ctagagaacgcagccc

SEQ ID NO: 4530319 - DNA, 17 bp, Homo sapiens
ctagagatattttgtaa

SEQ ID NO: 4530320 - DNA, 18 bp, Homo sapiens
ctagagatattttgtaaa

SEQ ID NO: 4530321 - DNA, 16 bp, Homo sapiens
ctagagcctgcctgga

SEQ ID NO: 4530322 - DNA, 18 bp, Homo sapiens
ctagagcctgcctggagc

SEQ ID NO: 4530323 - DNA, 20 bp, Homo sapiens
ctagaggccagccccaccca

SEQ ID NO: 4530324 - DNA, 22 bp, Homo sapiens
ctagaggccagccccacccagg

SEQ ID NO: 4530325 - DNA, 21 bp, Homo sapiens
ctagagtgactctacctgcaa

SEQ ID NO: 4530326 - DNA, 13 bp, Homo sapiens
ctagagttatctt

SEQ ID NO: 4530327 - DNA, 20 bp, Homo sapiens
ctagagttatcttctttatt

SEQ ID NO: 4530328 - DNA, 14 bp, Homo sapiens
ctagatacaataaa

SEQ ID NO: 4530329 - DNA, 23 bp, Homo sapiens
ctagatacaataaattgctaatg

SEQ ID NO: 4530330 - DNA, 24 bp, Homo sapiens
ctagatatgaatatatggcatttg

SEQ ID NO: 4530331 - DNA, 14 bp, Homo sapiens
ctagatcctgcacc

SEQ ID NO: 4530332 - DNA, 20 bp, Homo sapiens
ctagatgattttttgaaagt

SEQ ID NO: 4530333 - DNA, 14 bp, Homo sapiens
ctagatgggttctt

SEQ ID NO: 4530334 - DNA, 17 bp, Homo sapiens
ctagatgggttcttagc

SEQ ID NO: 4530335 - DNA, 15 bp, Homo sapiens
ctagcaagtgagaga

SEQ ID NO: 4530336 - DNA, 15 bp, Homo sapiens
ctagcacagaggcct

SEQ ID NO: 4530337 - DNA, 16 bp, Homo sapiens
ctagcacagaggcctg

SEQ ID NO: 4530338 - DNA, 21 bp, Homo sapiens
ctagcacagaggcctgactga

SEQ ID NO: 4530339 - DNA, 22 bp, Homo sapiens
ctagcaccattttaagtccctg

SEQ ID NO: 4530340 - DNA, 12 bp, Homo sapiens
ctagcaccctgg

SEQ ID NO: 4530341 - DNA, 15 bp, Homo sapiens
ctagcaccctggaga

SEQ ID NO: 4530342 - DNA, 17 bp, Homo sapiens
ctagcactgccccacat

SEQ ID NO: 4530343 - DNA, 19 bp, Homo sapiens
ctagcactgccccacatgc

SEQ ID NO: 4530344 - DNA, 16 bp, Homo sapiens
ctagcactggcctgca

SEQ ID NO: 4530345 - DNA, 16 bp, Homo sapiens
ctagcaggctgttcca

SEQ ID NO: 4530346 - DNA, 17 bp, Homo sapiens
ctagcaggctgttccat

SEQ ID NO: 4530347 - DNA, 22 bp, Homo sapiens
ctagcattgtaaaattatttca

SEQ ID NO: 4530348 - DNA, 16 bp, Homo sapiens
ctagcatttatttctc

SEQ ID NO: 4530349 - DNA, 15 bp, Homo sapiens
ctagccactcctgcc

SEQ ID NO: 4530350 - DNA, 18 bp, Homo sapiens
ctagcccaatgaaatgaa

SEQ ID NO: 4530351 - DNA, 14 bp, Homo sapiens
ctagcccacccccc

SEQ ID NO: 4530352 - DNA, 13 bp, Homo sapiens
ctagcccagtgct

SEQ ID NO: 4530353 - DNA, 15 bp, Homo sapiens
ctagcccagtgcttc

SEQ ID NO: 4530354 - DNA, 19 bp, Homo sapiens
ctagcccttccctgagtgc

SEQ ID NO: 4530355 - DNA, 19 bp, Homo sapiens
ctagcctgcactttgatgt

SEQ ID NO: 4530356 - DNA, 16 bp, Homo sapiens
cgggcatgatggtgca

SEQ ID NO: 4530357 - DNA, 20 bp, Homo sapiens
cgggcatggtggctcatgcc

SEQ ID NO: 4530358 - DNA, 16 bp, Homo sapiens
cgggccaggaggctgc

SEQ ID NO: 4530359 - DNA, 19 bp, Homo sapiens
cgggccccatcctcatccc

SEQ ID NO: 4530360 - DNA, 21 bp, Homo sapiens
cgggcccctctctagggaccc

SEQ ID NO: 4530361 - DNA, 15 bp, Homo sapiens
cgggcccctgggctt

SEQ ID NO: 4530362 - DNA, 15 bp, Homo sapiens
cgggcccctggtgat

SEQ ID NO: 4530363 - DNA, 21 bp, Homo sapiens
cgggcccttcccacaggacat

SEQ ID NO: 4530364 - DNA, 15 bp, Homo sapiens
cgggcctttttcctg

SEQ ID NO: 4530365 - DNA, 14 bp, Homo sapiens
cgggcgcgggcagc

SEQ ID NO: 4530366 - DNA, 23 bp, Homo sapiens
cgggcgcgggcagccacccaagc

SEQ ID NO: 4530367 - DNA, 12 bp, Homo sapiens
cgggctcagagc

SEQ ID NO: 4530368 - DNA, 15 bp, Homo sapiens
cgggctcagagcttt

SEQ ID NO: 4530369 - DNA, 15 bp, Homo sapiens
cgggctcggaggcta

SEQ ID NO: 4530370 - DNA, 17 bp, Homo sapiens
cgggctcggaggctacc

SEQ ID NO: 4530371 - DNA, 19 bp, Homo sapiens
cgggctcgggtctgggcag

SEQ ID NO: 4530372 - DNA, 15 bp, Homo sapiens
cgggctctctgctgt

SEQ ID NO: 4530373 - DNA, 22 bp, Homo sapiens
cgggctggcgggcctttttcct

SEQ ID NO: 4530374 - DNA, 20 bp, Homo sapiens
cgggctgggcccctccagga

SEQ ID NO: 4530375 - DNA, 16 bp, Homo sapiens
cgggcttccctggcct

SEQ ID NO: 4530376 - DNA, 15 bp, Homo sapiens
cgggcttttccccgg

SEQ ID NO: 4530377 - DNA, 16 bp, Homo sapiens
cggggaactcctggaa

SEQ ID NO: 4530378 - DNA, 14 bp, Homo sapiens
cggggacagaggcc

SEQ ID NO: 4530379 - DNA, 17 bp, Homo sapiens
cggggacagaggcctgc

SEQ ID NO: 4530380 - DNA, 16 bp, Homo sapiens
cggggacaggtgacag

SEQ ID NO: 4530381 - DNA, 13 bp, Homo sapiens
cggggcctggaca

SEQ ID NO: 4530382 - DNA, 15 bp, Homo sapiens
cggggcctggacagg

SEQ ID NO: 4530383 - DNA, 18 bp, Homo sapiens
cggggcctggacaggcgg

SEQ ID NO: 4530384 - DNA, 17 bp, Homo sapiens
cggggcctgggcaggag

SEQ ID NO: 4530385 - DNA, 19 bp, Homo sapiens
cggggcctgggcaggaggg

SEQ ID NO: 4530386 - DNA, 22 bp, Homo sapiens
cggggccttgcggtatccgccc

SEQ ID NO: 4530387 - DNA, 23 bp, Homo sapiens
cggggctcttctcatttcacccc

SEQ ID NO: 4530388 - DNA, 23 bp, Homo sapiens
cggggcttctgcggggctgagac

SEQ ID NO: 4530389 - DNA, 17 bp, Homo sapiens
cgggggagtgagacagg

SEQ ID NO: 4530390 - DNA, 22 bp, Homo sapiens
cggggggccccagtcagcctct

SEQ ID NO: 4530391 - DNA, 19 bp, Homo sapiens
cggggggctcctgcccagg

SEQ ID NO: 4530392 - DNA, 23 bp, Homo sapiens
cggggtgagtccattctcccagg

SEQ ID NO: 4530393 - DNA, 17 bp, Homo sapiens
cgggtccagagaccaca

SEQ ID NO: 4530394 - DNA, 21 bp, Homo sapiens
cgggtccatagagatgagccc

SEQ ID NO: 4530395 - DNA, 19 bp, Homo sapiens
cgggtccggcctctccctg

SEQ ID NO: 4530396 - DNA, 13 bp, Homo sapiens
cgggtctgcctct

SEQ ID NO: 4530397 - DNA, 14 bp, Homo sapiens
cgggtgcaagcact

SEQ ID NO: 4530398 - DNA, 15 bp, Homo sapiens
cgggtggatcacctg

SEQ ID NO: 4530399 - DNA, 14 bp, Homo sapiens
cgggtgtggcctca

SEQ ID NO: 4530400 - DNA, 18 bp, Homo sapiens
cgggtgtggcctcagccc

SEQ ID NO: 4530401 - DNA, 19 bp, Homo sapiens
cgggtgtggcctcagccct

SEQ ID NO: 4530402 - DNA, 13 bp, Homo sapiens
cgggttctagacg

SEQ ID NO: 4530403 - DNA, 21 bp, Homo sapiens
cgggttttattgtttaaaatc

SEQ ID NO: 4530404 - DNA, 13 bp, Homo sapiens
cggtacacagcca

SEQ ID NO: 4530405 - DNA, 16 bp, Homo sapiens
cggtacacagccagta

SEQ ID NO: 4530406 - DNA, 13 bp, Homo sapiens
cggtcagtgcctt

SEQ ID NO: 4530407 - DNA, 23 bp, Homo sapiens
cggtccaatgccacctagactct

SEQ ID NO: 4530408 - DNA, 17 bp, Homo sapiens
cggtccacaggtccaag

SEQ ID NO: 4530409 - DNA, 20 bp, Homo sapiens
cggtccacaggtccaaggac

SEQ ID NO: 4530410 - DNA, 15 bp, Homo sapiens
cggtcccccagagca

SEQ ID NO: 4530411 - DNA, 14 bp, Homo sapiens
cggtccctgtccct

SEQ ID NO: 4530412 - DNA, 19 bp, Homo sapiens
cggtcccttgagacctcag

SEQ ID NO: 4530413 - DNA, 23 bp, Homo sapiens
cggtcccttgagacctcagccat

SEQ ID NO: 4530414 - DNA, 16 bp, Homo sapiens
cggtcgggcagccagc

SEQ ID NO: 4530415 - DNA, 16 bp, Homo sapiens
cggtctccaccccagg

SEQ ID NO: 4530416 - DNA, 20 bp, Homo sapiens
cggtctccaccccagggtca

SEQ ID NO: 4530417 - DNA, 13 bp, Homo sapiens
cggtcttgggcac

SEQ ID NO: 4530418 - DNA, 16 bp, Homo sapiens
cggtgaccactcttct

SEQ ID NO: 4530419 - DNA, 13 bp, Homo sapiens
cggtgccagctgc

SEQ ID NO: 4530420 - DNA, 15 bp, Homo sapiens
cggtgccagctgccc

SEQ ID NO: 4530421 - DNA, 17 bp, Homo sapiens
cggtgccagctgccctt

SEQ ID NO: 4530422 - DNA, 17 bp, Homo sapiens
cggtgcccatcctgcca

SEQ ID NO: 4530423 - DNA, 21 bp, Homo sapiens
cggtgcctttatttccactgt

SEQ ID NO: 4530424 - DNA, 23 bp, Homo sapiens
cggtgcctttatttccactgtgc

SEQ ID NO: 4530425 - DNA, 15 bp, Homo sapiens
cggtgctgcaggagt

SEQ ID NO: 4530426 - DNA, 18 bp, Homo sapiens
cggtgctgtgagggaggg

SEQ ID NO: 4530427 - DNA, 20 bp, Homo sapiens
cggtggctcacgcctgtaat

SEQ ID NO: 4530428 - DNA, 19 bp, Homo sapiens
cggtgggaccctgtccggc

SEQ ID NO: 4530429 - DNA, 14 bp, Homo sapiens
cggtggtgcccgtg

SEQ ID NO: 4530430 - DNA, 14 bp, Homo sapiens
cggtgtgctgccaa

SEQ ID NO: 4530431 - DNA, 14 bp, Homo sapiens
cggttccagacact

SEQ ID NO: 4530432 - DNA, 14 bp, Homo sapiens
cggttgttctttcc

SEQ ID NO: 4530433 - DNA, 16 bp, Homo sapiens
cggttttcctcagctc

SEQ ID NO: 4530434 - DNA, 18 bp, Homo sapiens
cggttttcctcagctcta

SEQ ID NO: 4530435 - DNA, 13 bp, Homo sapiens
cgtaaagaatttt

SEQ ID NO: 4530436 - DNA, 17 bp, Homo sapiens
cgtaaagctagaaatga

SEQ ID NO: 4530437 - DNA, 14 bp, Homo sapiens
cgtaatcccagcta

SEQ ID NO: 4530438 - DNA, 16 bp, Homo sapiens
cgtacattatgtgttt

SEQ ID NO: 4530439 - DNA, 14 bp, Homo sapiens
cgtactcctcagac

SEQ ID NO: 4530440 - DNA, 22 bp, Homo sapiens
cgtagttccctgaaaacccaga

SEQ ID NO: 4530441 - DNA, 21 bp, Homo sapiens
cgtataaatatcagtattctg

SEQ ID NO: 4530442 - DNA, 22 bp, Homo sapiens
cgtataaatatcagtattctga

SEQ ID NO: 4530443 - DNA, 17 bp, Homo sapiens
cgtataatgctttctga

SEQ ID NO: 4530444 - DNA, 20 bp, Homo sapiens
cgtatgcagtgtagatttta

SEQ ID NO: 4530445 - DNA, 15 bp, Homo sapiens
cgtatttaatagcaa

SEQ ID NO: 4530446 - DNA, 23 bp, Homo sapiens
cgtatttaatagcaaagaattga

SEQ ID NO: 4530447 - DNA, 16 bp, Homo sapiens
cgtcaagacatttgct

SEQ ID NO: 4530448 - DNA, 18 bp, Homo sapiens
cgtcactttttggccatg

SEQ ID NO: 4530449 - DNA, 17 bp, Homo sapiens
cgtcagcatcactgatg

SEQ ID NO: 4530450 - DNA, 22 bp, Homo sapiens
cgtcagcatcactgatgggaat

SEQ ID NO: 4530451 - DNA, 13 bp, Homo sapiens
cgtcagcctccag

SEQ ID NO: 4530452 - DNA, 16 bp, Homo sapiens
cgtcagcctccagcct

SEQ ID NO: 4530453 - DNA, 14 bp, Homo sapiens
cgtcaggccctgac

SEQ ID NO: 4530454 - DNA, 17 bp, Homo sapiens
cgtcaggcctggcctca

SEQ ID NO: 4530455 - DNA, 18 bp, Homo sapiens
cgtcatcggaggctgggc

SEQ ID NO: 4530456 - DNA, 20 bp, Homo sapiens
cgtcatcggaggctgggccc

SEQ ID NO: 4530457 - DNA, 13 bp, Homo sapiens
cgtcatttgtgca

SEQ ID NO: 4530458 - DNA, 21 bp, Homo sapiens
cgtccaccctgagctcgggga

SEQ ID NO: 4530459 - DNA, 18 bp, Homo sapiens
cgtcccagcatccctgga

SEQ ID NO: 4530460 - DNA, 11 bp, Homo sapiens
cgtcccagcct

SEQ ID NO: 4530461 - DNA, 11 bp, Homo sapiens
cgtcccagctc

SEQ ID NO: 4530462 - DNA, 12 bp, Homo sapiens
cgtcccagctcc

SEQ ID NO: 4530463 - DNA, 17 bp, Homo sapiens
cgtccccccccaacctt

SEQ ID NO: 4530464 - DNA, 22 bp, Homo sapiens
cgtcccctccgccgtgccggcg

SEQ ID NO: 4530465 - DNA, 11 bp, Homo sapiens
cgtccctggcg

SEQ ID NO: 4530466 - DNA, 15 bp, Homo sapiens
cgtcctccccctgcc

SEQ ID NO: 4530467 - DNA, 15 bp, Homo sapiens
cgtcctcctctgtga

SEQ ID NO: 4530468 - DNA, 23 bp, Homo sapiens
cgtcctgtccacacccagctcag

SEQ ID NO: 4530469 - DNA, 22 bp, Homo sapiens
cgtcggactgcccccagaaagc

SEQ ID NO: 4530470 - DNA, 20 bp, Homo sapiens
cgtctcccttggcccagaga

SEQ ID NO: 4530471 - DNA, 13 bp, Homo sapiens
cgtctcctccctc

SEQ ID NO: 4530472 - DNA, 19 bp, Homo sapiens
cgtctctactaaaaatgca

SEQ ID NO: 4530473 - DNA, 13 bp, Homo sapiens
cgtctctctccca

SEQ ID NO: 4530474 - DNA, 21 bp, Homo sapiens
cgtctctcttggacccacctg

SEQ ID NO: 4530475 - DNA, 19 bp, Homo sapiens
cgtctgccttggcatcctc

SEQ ID NO: 4530476 - DNA, 21 bp, Homo sapiens
cgtcttaagtcagatttttat

SEQ ID NO: 4530477 - DNA, 16 bp, Homo sapiens
cgtcttccctgcttca

SEQ ID NO: 4530478 - DNA, 22 bp, Homo sapiens
cgtgaactctggtgctcctgca

SEQ ID NO: 4530479 - DNA, 13 bp, Homo sapiens
cgtgactcaccca

SEQ ID NO: 4530480 - DNA, 22 bp, Homo sapiens
cgtgactgccccaactcctgga

SEQ ID NO: 4530481 - DNA, 13 bp, Homo sapiens
cgtgagcatgcac

SEQ ID NO: 4530482 - DNA, 20 bp, Homo sapiens
cgtgagcatgcacactgaga

SEQ ID NO: 4530483 - DNA, 18 bp, Homo sapiens
cgtgagctggggactcag

SEQ ID NO: 4530484 - DNA, 19 bp, Homo sapiens
cgtgagctggggactcagg

SEQ ID NO: 4530485 - DNA, 18 bp, Homo sapiens
cgtgatgtggaggaagag

SEQ ID NO: 4530486 - DNA, 22 bp, Homo sapiens
cgtgatgtggaggaagagccac

SEQ ID NO: 4530487 - DNA, 21 bp, Homo sapiens
cgtgcacgtggagagctggtg

SEQ ID NO: 4530488 - DNA, 21 bp, Homo sapiens
cgtgcatcccccctgctcagc

SEQ ID NO: 4530489 - DNA, 20 bp, Homo sapiens
cgtgcatggctcctgtctgg

SEQ ID NO: 4530490 - DNA, 22 bp, Homo sapiens
cgtgcatggctcctgtctggct

SEQ ID NO: 4530491 - DNA, 17 bp, Homo sapiens
cgtgccagatataactg

SEQ ID NO: 4530492 - DNA, 19 bp, Homo sapiens
cgtgccagatataactgtc

SEQ ID NO: 4530493 - DNA, 22 bp, Homo sapiens
cgtgccagatataactgtcttg

SEQ ID NO: 4530494 - DNA, 17 bp, Homo sapiens
cgtgccagctctagttt

SEQ ID NO: 4530495 - DNA, 13 bp, Homo sapiens
cgtgccaggcccg

SEQ ID NO: 4530496 - DNA, 16 bp, Homo sapiens
cgtgcccccctcctcc

SEQ ID NO: 4530497 - DNA, 19 bp, Homo sapiens
cgtgcccccgcctgccacc

SEQ ID NO: 4530498 - DNA, 20 bp, Homo sapiens
cgtgcccccgcctgccaccg

SEQ ID NO: 4530499 - DNA, 15 bp, Homo sapiens
cgtgcccgcaggaac

SEQ ID NO: 4530500 - DNA, 21 bp, Homo sapiens
cgtgccggcggcagccccact

SEQ ID NO: 4530501 - DNA, 16 bp, Homo sapiens
cgtgcctgagaccagg

SEQ ID NO: 4530502 - DNA, 13 bp, Homo sapiens
cgtgcctggccag

SEQ ID NO: 4530503 - DNA, 14 bp, Homo sapiens
cgtgcctggccaga

SEQ ID NO: 4530504 - DNA, 15 bp, Homo sapiens
cgtgcctgggagagt

SEQ ID NO: 4530505 - DNA, 13 bp, Homo sapiens
cgtgcctgtagtc

SEQ ID NO: 4530506 - DNA, 13 bp, Homo sapiens
cgtgcgcactgca

SEQ ID NO: 4530507 - DNA, 15 bp, Homo sapiens
cgtggaacgtttttc

SEQ ID NO: 4530508 - DNA, 19 bp, Homo sapiens
cgtggactgagtgggaagc

SEQ ID NO: 4530509 - DNA, 13 bp, Homo sapiens
cgtggactgtgct

SEQ ID NO: 4530510 - DNA, 15 bp, Homo sapiens
cgtggagatagtgcc

SEQ ID NO: 4530511 - DNA, 18 bp, Homo sapiens
cgtggagatagtgccagg

SEQ ID NO: 4530512 - DNA, 23 bp, Homo sapiens
cgtggagatagtgccaggtggct

SEQ ID NO: 4530513 - DNA, 17 bp, Homo sapiens
cgtggagcagaatcagt

SEQ ID NO: 4530514 - DNA, 18 bp, Homo sapiens
cgtggagcagaatcagta

SEQ ID NO: 4530515 - DNA, 17 bp, Homo sapiens
cgtggccatccctgtga

SEQ ID NO: 4530516 - DNA, 19 bp, Homo sapiens
cgtggccatccctgtgagg

SEQ ID NO: 4530517 - DNA, 21 bp, Homo sapiens
cgtggcctcccaaagtgctgg

SEQ ID NO: 4530518 - DNA, 17 bp, Homo sapiens
cgtggctctgggtgagg

SEQ ID NO: 4530519 - DNA, 16 bp, Homo sapiens
cgtggcttccctgtcc

SEQ ID NO: 4530520 - DNA, 19 bp, Homo sapiens
cgtgggaccctcagcagct

SEQ ID NO: 4530521 - DNA, 18 bp, Homo sapiens
cgtgggccagtccccgag

SEQ ID NO: 4530522 - DNA, 23 bp, Homo sapiens
cgtgggccagtccccgaggagct

SEQ ID NO: 4530523 - DNA, 18 bp, Homo sapiens
cgtgggcttaaagcagaa

SEQ ID NO: 4530524 - DNA, 13 bp, Homo sapiens
cgtggggcccact

SEQ ID NO: 4530525 - DNA, 15 bp, Homo sapiens
cgtggggtgctgccc

SEQ ID NO: 4530526 - DNA, 12 bp, Homo sapiens
cgtggtgcctgc

SEQ ID NO: 4530527 - DNA, 19 bp, Homo sapiens
cgtggtggcggtggctgcc

SEQ ID NO: 4530528 - DNA, 13 bp, Homo sapiens
cgtggtttctcat

SEQ ID NO: 4530529 - DNA, 19 bp, Homo sapiens
cgtggtttgcctgaggctg

SEQ ID NO: 4530530 - DNA, 13 bp, Homo sapiens
cgtgtctggcaca

SEQ ID NO: 4530531 - DNA, 19 bp, Homo sapiens
cgtgtctgggtatctttgt

SEQ ID NO: 4530532 - DNA, 19 bp, Homo sapiens
cgtgtgtagatagtatgca

SEQ ID NO: 4530533 - DNA, 16 bp, Homo sapiens
cgtgtgtgtggccggc

SEQ ID NO: 4530534 - DNA, 22 bp, Homo sapiens
cgtgttccagccaaagcatgcc

SEQ ID NO: 4530535 - DNA, 15 bp, Homo sapiens
cgtgtttctgactct

SEQ ID NO: 4530536 - DNA, 21 bp, Homo sapiens
cgtgtttgggtttttttcctt

SEQ ID NO: 4530537 - DNA, 14 bp, Homo sapiens
cgttagaggaaaaa

SEQ ID NO: 4530538 - DNA, 17 bp, Homo sapiens
cgttagaggaaaaatat

SEQ ID NO: 4530539 - DNA, 15 bp, Homo sapiens
cgttatatattgtat

SEQ ID NO: 4530540 - DNA, 16 bp, Homo sapiens
cgttcacctccctgct

SEQ ID NO: 4530541 - DNA, 21 bp, Homo sapiens
cgttccagccggcatggctgg

SEQ ID NO: 4530542 - DNA, 16 bp, Homo sapiens
cgttcctggccttctg

SEQ ID NO: 4530543 - DNA, 16 bp, Homo sapiens
cgttctcaagaatcta

SEQ ID NO: 4530544 - DNA, 18 bp, Homo sapiens
cgttctcaagaatctaga

SEQ ID NO: 4530545 - DNA, 16 bp, Homo sapiens
cgttctgatatgtgaa

SEQ ID NO: 4530546 - DNA, 19 bp, Homo sapiens
cgttctggactctgcccca

SEQ ID NO: 4530547 - DNA, 15 bp, Homo sapiens
cgttgctgagccagc

SEQ ID NO: 4530548 - DNA, 21 bp, Homo sapiens
cgttgctgagccagctgcaga

SEQ ID NO: 4530549 - DNA, 19 bp, Homo sapiens
cgttggagtttgggctgga

SEQ ID NO: 4530550 - DNA, 20 bp, Homo sapiens
cgttggagtttgggctggag

SEQ ID NO: 4530551 - DNA, 20 bp, Homo sapiens
cgttggtgaccagtttctta

SEQ ID NO: 4530552 - DNA, 18 bp, Homo sapiens
cgttgtgttttttaagat

SEQ ID NO: 4530553 - DNA, 13 bp, Homo sapiens
cgtttaaagttct

SEQ ID NO: 4530554 - DNA, 17 bp, Homo sapiens
cgtttaaagttctgtgt

SEQ ID NO: 4530555 - DNA, 14 bp, Homo sapiens
cgtttattttcaag

SEQ ID NO: 4530556 - DNA, 15 bp, Homo sapiens
cgtttattttcaaga

SEQ ID NO: 4530557 - DNA, 18 bp, Homo sapiens
cgtttccccaataaagcc

SEQ ID NO: 4530558 - DNA, 21 bp, Homo sapiens
cgtttccccaataaagccttt

SEQ ID NO: 4530559 - DNA, 12 bp, Homo sapiens
cgtttctccttt

SEQ ID NO: 4530560 - DNA, 13 bp, Homo sapiens
cgtttctcctttt

SEQ ID NO: 4530561 - DNA, 17 bp, Homo sapiens
cgtttctccttttccta

SEQ ID NO: 4530562 - DNA, 15 bp, Homo sapiens
cgtttcttgcaaggg

SEQ ID NO: 4530563 - DNA, 19 bp, Homo sapiens
cgttttccaaactgactca

SEQ ID NO: 4530564 - DNA, 13 bp, Homo sapiens
cgttttgaagcta

SEQ ID NO: 4530565 - DNA, 22 bp, Homo sapiens
cgtttttgtgctgtgggcagca

SEQ ID NO: 4530566 - DNA, 20 bp, Homo sapiens
ctaaaaacatttactgacca

SEQ ID NO: 4530567 - DNA, 17 bp, Homo sapiens
ctaaaaagttgaaccat

SEQ ID NO: 4530568 - DNA, 21 bp, Homo sapiens
ctaaaacacaacaagaaactg

SEQ ID NO: 4530569 - DNA, 17 bp, Homo sapiens
ctaaaacattcccctcc

SEQ ID NO: 4530570 - DNA, 17 bp, Homo sapiens
ctaaaactctttcggta

SEQ ID NO: 4530571 - DNA, 23 bp, Homo sapiens
ctaaaactgggattaagaaacct

SEQ ID NO: 4530572 - DNA, 13 bp, Homo sapiens
ctaaaagaaactt

SEQ ID NO: 4530573 - DNA, 12 bp, Homo sapiens
ctaaaagcaaaa

SEQ ID NO: 4530574 - DNA, 15 bp, Homo sapiens
ctaaaagctctgttc

SEQ ID NO: 4530575 - DNA, 15 bp, Homo sapiens
ctaaaaggcttccag

SEQ ID NO: 4530576 - DNA, 21 bp, Homo sapiens
ctaaaaggtgttgtaatggtg

SEQ ID NO: 4530577 - DNA, 19 bp, Homo sapiens
ctaaaagtgggcttgattc

SEQ ID NO: 4530578 - DNA, 18 bp, Homo sapiens
ctaaaagttcataacagt

SEQ ID NO: 4530579 - DNA, 22 bp, Homo sapiens
ctaaaatagcaataactgaaaa

SEQ ID NO: 4530580 - DNA, 23 bp, Homo sapiens
ctaaaatagttagatctttgtaa

SEQ ID NO: 4530581 - DNA, 22 bp, Homo sapiens
ctaaaattaaaaagaaaatatt

SEQ ID NO: 4530582 - DNA, 16 bp, Homo sapiens
ctaaaattatgttact

SEQ ID NO: 4530583 - DNA, 18 bp, Homo sapiens
ctaaaattatgttactgt

SEQ ID NO: 4530584 - DNA, 18 bp, Homo sapiens
ctaaaattcaaaaacaaa

SEQ ID NO: 4530585 - DNA, 21 bp, Homo sapiens
ctaaaatttcataattctgaa

SEQ ID NO: 4530586 - DNA, 18 bp, Homo sapiens
ctaaacagttatttctgt

SEQ ID NO: 4530587 - DNA, 12 bp, Homo sapiens
ctaaacctcagt

SEQ ID NO: 4530588 - DNA, 16 bp, Homo sapiens
ctaaactagtttttcc

SEQ ID NO: 4530589 - DNA, 14 bp, Homo sapiens
ctaaactttagact

SEQ ID NO: 4530590 - DNA, 18 bp, Homo sapiens
ctaaactttttttctgta

SEQ ID NO: 4530591 - DNA, 14 bp, Homo sapiens
ctaaagaagataaa

SEQ ID NO: 4530592 - DNA, 19 bp, Homo sapiens
ctaaagaagataaacacaa

SEQ ID NO: 4530593 - DNA, 16 bp, Homo sapiens
ctaaagagcccttgcc

SEQ ID NO: 4530594 - DNA, 17 bp, Homo sapiens
ctaaagagcccttgcct

SEQ ID NO: 4530595 - DNA, 21 bp, Homo sapiens
ctaaagagcccttgcctcccc

SEQ ID NO: 4530596 - DNA, 22 bp, Homo sapiens
ctaaagagcccttgcctcccca

SEQ ID NO: 4530597 - DNA, 17 bp, Homo sapiens
ctaaagatggaaaagaa

SEQ ID NO: 4530598 - DNA, 18 bp, Homo sapiens
ctaaagcactggtttcaa

SEQ ID NO: 4530599 - DNA, 22 bp, Homo sapiens
ctaaagcactggtttcaagaat

SEQ ID NO: 4530600 - DNA, 18 bp, Homo sapiens
ctaaagctaaaaatatta

SEQ ID NO: 4530601 - DNA, 14 bp, Homo sapiens
ctaaagctggagag

SEQ ID NO: 4530602 - DNA, 19 bp, Homo sapiens
ctaaaggaaatcaaatgaa

SEQ ID NO: 4530603 - DNA, 14 bp, Homo sapiens
ctaaaggatccaga

SEQ ID NO: 4530604 - DNA, 20 bp, Homo sapiens
ctaaaggatccagagagcag

SEQ ID NO: 4530605 - DNA, 19 bp, Homo sapiens
ctaaagggagaaatgccag

SEQ ID NO: 4530606 - DNA, 18 bp, Homo sapiens
ctaaagtctctgctgcta

SEQ ID NO: 4530607 - DNA, 15 bp, Homo sapiens
ctaaagttatatttc

SEQ ID NO: 4530608 - DNA, 22 bp, Homo sapiens
ctaaataaacacatagattcac

SEQ ID NO: 4530609 - DNA, 16 bp, Homo sapiens
ctaaatctcctatttt

SEQ ID NO: 4530610 - DNA, 11 bp, Homo sapiens
ctaaatgaagt

SEQ ID NO: 4530611 - DNA, 19 bp, Homo sapiens
ctaaatgagtcactgagca

SEQ ID NO: 4530612 - DNA, 23 bp, Homo sapiens
ctaaatgcaataagatttagttg

SEQ ID NO: 4530613 - DNA, 21 bp, Homo sapiens
ctaaatgcagacaacaccttc

SEQ ID NO: 4530614 - DNA, 18 bp, Homo sapiens
ctaaatgcccagttcact

SEQ ID NO: 4530615 - DNA, 15 bp, Homo sapiens
ctaaatgctcataca

SEQ ID NO: 4530616 - DNA, 14 bp, Homo sapiens
ctaaattatttact

SEQ ID NO: 4530617 - DNA, 20 bp, Homo sapiens
ctaaattgtctgccattaca

SEQ ID NO: 4530618 - DNA, 14 bp, Homo sapiens
ctaaattttaaagc

SEQ ID NO: 4530619 - DNA, 21 bp, Homo sapiens
ctaacaataatatttcaagtg

SEQ ID NO: 4530620 - DNA, 13 bp, Homo sapiens
ctaacaatgacat

SEQ ID NO: 4530621 - DNA, 13 bp, Homo sapiens
ctaacaattgtta

SEQ ID NO: 4530622 - DNA, 23 bp, Homo sapiens
ctaacactttagttatattcact

SEQ ID NO: 4530623 - DNA, 20 bp, Homo sapiens
ctaacagctacaaactttta

SEQ ID NO: 4530624 - DNA, 21 bp, Homo sapiens
ctaacagctacaaacttttaa

SEQ ID NO: 4530625 - DNA, 18 bp, Homo sapiens
ctaacaggagaaaggaca

SEQ ID NO: 4530626 - DNA, 15 bp, Homo sapiens
ctaacagttgccaca

SEQ ID NO: 4530627 - DNA, 22 bp, Homo sapiens
ctaacatggtgaaaccccgtct

SEQ ID NO: 4530628 - DNA, 16 bp, Homo sapiens
ctaacatggtttaaaa

SEQ ID NO: 4530629 - DNA, 17 bp, Homo sapiens
ctaacatgtcctgccta

SEQ ID NO: 4530630 - DNA, 16 bp, Homo sapiens
ctaacattatattgca

SEQ ID NO: 4530631 - DNA, 20 bp, Homo sapiens
ctaacattatattgcaatga

SEQ ID NO: 4530632 - DNA, 16 bp, Homo sapiens
ctaaccacggttattt

SEQ ID NO: 4530633 - DNA, 21 bp, Homo sapiens
ctaaccacggttatttaagca

SEQ ID NO: 4530634 - DNA, 12 bp, Homo sapiens
ctaaccatcccc

SEQ ID NO: 4530635 - DNA, 13 bp, Homo sapiens
ctaaccatcccca

SEQ ID NO: 4530636 - DNA, 21 bp, Homo sapiens
ctaaccatccccaactccatg

SEQ ID NO: 4530637 - DNA, 12 bp, Homo sapiens
ctaaccccaggg

SEQ ID NO: 4530638 - DNA, 14 bp, Homo sapiens
ctaaccccagggca

SEQ ID NO: 4530639 - DNA, 16 bp, Homo sapiens
ctaaccccagggcact

SEQ ID NO: 4530640 - DNA, 14 bp, Homo sapiens
ctaacccctttcct

SEQ ID NO: 4530641 - DNA, 23 bp, Homo sapiens
ctaacctcccttaagcagcaaca

SEQ ID NO: 4530642 - DNA, 21 bp, Homo sapiens
ctaactgactctgttattgat

SEQ ID NO: 4530643 - DNA, 22 bp, Homo sapiens
ctaactggaaacaaaacagaag

SEQ ID NO: 4530644 - DNA, 14 bp, Homo sapiens
ctaactggactggt

SEQ ID NO: 4530645 - DNA, 18 bp, Homo sapiens
ctaactgtaaatcatgtt

SEQ ID NO: 4530646 - DNA, 23 bp, Homo sapiens
ctaactgtgatttgtagatttac

SEQ ID NO: 4530647 - DNA, 17 bp, Homo sapiens
ctaacttatggactgtt

SEQ ID NO: 4530648 - DNA, 21 bp, Homo sapiens
ctaacttcctgtgcctttcct

SEQ ID NO: 4530649 - DNA, 23 bp, Homo sapiens
ctaacttcctgtgcctttcctat

SEQ ID NO: 4530650 - DNA, 11 bp, Homo sapiens
ctaagaaaaag

SEQ ID NO: 4530651 - DNA, 20 bp, Homo sapiens
ctaagaaatatctgtgaaat

SEQ ID NO: 4530652 - DNA, 18 bp, Homo sapiens
ctaagaatttttttttaa

SEQ ID NO: 4530653 - DNA, 14 bp, Homo sapiens
ctaagacatttttc

SEQ ID NO: 4530654 - DNA, 15 bp, Homo sapiens
ctaagacatttttca

SEQ ID NO: 4530655 - DNA, 18 bp, Homo sapiens
ctaagactctgtgtggct

SEQ ID NO: 4530656 - DNA, 15 bp, Homo sapiens
ctaagagaagtagaa

SEQ ID NO: 4530657 - DNA, 19 bp, Homo sapiens
ctaagagaagttattttct

SEQ ID NO: 4530658 - DNA, 20 bp, Homo sapiens
ctaagagccatttaggggcc

SEQ ID NO: 4530659 - DNA, 16 bp, Homo sapiens
ctaagagctagcgctg

SEQ ID NO: 4530660 - DNA, 19 bp, Homo sapiens
ctaagagctagcgctgccg

SEQ ID NO: 4530661 - DNA, 15 bp, Homo sapiens
ctaagatacactgca

SEQ ID NO: 4530662 - DNA, 18 bp, Homo sapiens
ctaagatgtgttcttatt

SEQ ID NO: 4530663 - DNA, 21 bp, Homo sapiens
ctaagattacaaatcagaagt

SEQ ID NO: 4530664 - DNA, 14 bp, Homo sapiens
ctaagattctttta

SEQ ID NO: 4530665 - DNA, 12 bp, Homo sapiens
ctaagcacttct

SEQ ID NO: 4530666 - DNA, 16 bp, Homo sapiens
ctaagcattgcctggc

SEQ ID NO: 4530667 - DNA, 23 bp, Homo sapiens
ctaagccaggcctggctggagga

SEQ ID NO: 4530668 - DNA, 14 bp, Homo sapiens
ctaaggaaccttcc

SEQ ID NO: 4530669 - DNA, 18 bp, Homo sapiens
ctaaggaagtatcagcac

SEQ ID NO: 4530670 - DNA, 21 bp, Homo sapiens
ctaaggaggggaaaaaaatgt

SEQ ID NO: 4530671 - DNA, 11 bp, Homo sapiens
ctaaggatttt

SEQ ID NO: 4530672 - DNA, 14 bp, Homo sapiens
ctaaggctcctcct

SEQ ID NO: 4530673 - DNA, 22 bp, Homo sapiens
ctaaggttgtctacgggggcac

SEQ ID NO: 4530674 - DNA, 18 bp, Homo sapiens
ctaagtaaaaccacagca

SEQ ID NO: 4530675 - DNA, 22 bp, Homo sapiens
ctaagtaaaaccacagcagttg

SEQ ID NO: 4530676 - DNA, 20 bp, Homo sapiens
ctaagtgaaataagccagac

SEQ ID NO: 4530677 - DNA, 23 bp, Homo sapiens
ctaagtgaaataagccagacatc

SEQ ID NO: 4530678 - DNA, 19 bp, Homo sapiens
ctaagtgaaatttctagcc

SEQ ID NO: 4530679 - DNA, 14 bp, Homo sapiens
ctaagtggctgcct

SEQ ID NO: 4530680 - DNA, 17 bp, Homo sapiens
ctaagtggctgccttct

SEQ ID NO: 4530681 - DNA, 12 bp, Homo sapiens
ctaagtgggaca

SEQ ID NO: 4530682 - DNA, 22 bp, Homo sapiens
ctaagtgggacattcaaaaaac

SEQ ID NO: 4530683 - DNA, 16 bp, Homo sapiens
ctaataaagagactga

SEQ ID NO: 4530684 - DNA, 15 bp, Homo sapiens
ctaataaagtgccgg

SEQ ID NO: 4530685 - DNA, 18 bp, Homo sapiens
ctaataagtgacaaataa

SEQ ID NO: 4530686 - DNA, 20 bp, Homo sapiens
ctaataatgagctattaaaa

SEQ ID NO: 4530687 - DNA, 19 bp, Homo sapiens
ctaatacagcaacaattta

SEQ ID NO: 4530688 - DNA, 23 bp, Homo sapiens
ctaatacagcaacaatttatgaa

SEQ ID NO: 4530689 - DNA, 19 bp, Homo sapiens
ctaatacgtgccagatata

SEQ ID NO: 4530690 - DNA, 13 bp, Homo sapiens
ctaatagaacttg

SEQ ID NO: 4530691 - DNA, 16 bp, Homo sapiens
ctaatagtttttcact

SEQ ID NO: 4530692 - DNA, 12 bp, Homo sapiens
ctaatatacttt

SEQ ID NO: 4530693 - DNA, 13 bp, Homo sapiens
ctaatatactttt

SEQ ID NO: 4530694 - DNA, 19 bp, Homo sapiens
ctaatatatgaaataagta

SEQ ID NO: 4530695 - DNA, 15 bp, Homo sapiens
ctaatatatttaaaa

SEQ ID NO: 4530696 - DNA, 23 bp, Homo sapiens
ctaatatgatagcgggaaaagga

SEQ ID NO: 4530697 - DNA, 23 bp, Homo sapiens
ctaatattagttcccttaacaaa

SEQ ID NO: 4530698 - DNA, 18 bp, Homo sapiens
ctaatattagttggcttt

SEQ ID NO: 4530699 - DNA, 15 bp, Homo sapiens
ctaatattgcttctt

SEQ ID NO: 4530700 - DNA, 21 bp, Homo sapiens
ctaatattgcttcttgtgttt

SEQ ID NO: 4530701 - DNA, 14 bp, Homo sapiens
ctaatatttttcat

SEQ ID NO: 4530702 - DNA, 18 bp, Homo sapiens
ctaatcacaaactgaatg

SEQ ID NO: 4530703 - DNA, 17 bp, Homo sapiens
ctaatcatacaccagaa

SEQ ID NO: 4530704 - DNA, 13 bp, Homo sapiens
ctaatccttttcc

SEQ ID NO: 4530705 - DNA, 23 bp, Homo sapiens
ctaatctgaccgttctattgtgt

SEQ ID NO: 4530706 - DNA, 12 bp, Homo sapiens
ctaatctgcctg

SEQ ID NO: 4530707 - DNA, 14 bp, Homo sapiens
ctaatcttccgtca

SEQ ID NO: 4530708 - DNA, 11 bp, Homo sapiens
ctaatgaagta

SEQ ID NO: 4530709 - DNA, 23 bp, Homo sapiens
ctaatgacatgcctatatgagaa

SEQ ID NO: 4530710 - DNA, 20 bp, Homo sapiens
ctaatgattcaaatgtttta

SEQ ID NO: 4530711 - DNA, 20 bp, Homo sapiens
ctaatggactgaccttaaaa

SEQ ID NO: 4530712 - DNA, 21 bp, Homo sapiens
ctaatggattataatcagaat

SEQ ID NO: 4530713 - DNA, 22 bp, Homo sapiens
ctaatggttgggttgattgtat

SEQ ID NO: 4530714 - DNA, 13 bp, Homo sapiens
ctaatgtgatcat

SEQ ID NO: 4530715 - DNA, 16 bp, Homo sapiens
ctaatgtgcagggata

SEQ ID NO: 4530716 - DNA, 12 bp, Homo sapiens
ctaatgtttact

SEQ ID NO: 4530717 - DNA, 18 bp, Homo sapiens
ctaattaaaattgtgcat

SEQ ID NO: 4530718 - DNA, 17 bp, Homo sapiens
ctaattaagaaaactat

SEQ ID NO: 4530719 - DNA, 13 bp, Homo sapiens
ctaattaatatat

SEQ ID NO: 4530720 - DNA, 21 bp, Homo sapiens
ctaattaatatattaaaattc

SEQ ID NO: 4530721 - DNA, 19 bp, Homo sapiens
ctaattatcaatgggatat

SEQ ID NO: 4530722 - DNA, 19 bp, Homo sapiens
ctaattattattttaaaat

SEQ ID NO: 4530723 - DNA, 18 bp, Homo sapiens
ctaattcaaggaatttct

SEQ ID NO: 4530724 - DNA, 22 bp, Homo sapiens
ctaattcacaaaaaaagtaatt

SEQ ID NO: 4530725 - DNA, 15 bp, Homo sapiens
ctaattctgggaagg

SEQ ID NO: 4530726 - DNA, 18 bp, Homo sapiens
ctaattctgtgattaaaa

SEQ ID NO: 4530727 - DNA, 12 bp, Homo sapiens
ctaattggaaag

SEQ ID NO: 4530728 - DNA, 19 bp, Homo sapiens
ctaattggaaagtgccagc

SEQ ID NO: 4530729 - DNA, 11 bp, Homo sapiens
ctaatttaaca

SEQ ID NO: 4530730 - DNA, 12 bp, Homo sapiens
ctaatttataaa

SEQ ID NO: 4530731 - DNA, 18 bp, Homo sapiens
ctaatttcaaaatgcttt

SEQ ID NO: 4530732 - DNA, 19 bp, Homo sapiens
ctaatttcaaaatgctttt

SEQ ID NO: 4530733 - DNA, 22 bp, Homo sapiens
ctaatttcaaaatgctttttat

SEQ ID NO: 4530734 - DNA, 15 bp, Homo sapiens
ctaatttcatttcaa

SEQ ID NO: 4530735 - DNA, 15 bp, Homo sapiens
ctaatttctcctccc

SEQ ID NO: 4530736 - DNA, 18 bp, Homo sapiens
ctaatttctcctcccttc

SEQ ID NO: 4530737 - DNA, 19 bp, Homo sapiens
ctaatttctcctcccttcc

SEQ ID NO: 4530738 - DNA, 21 bp, Homo sapiens
ctaatttgcattaaattcaca

SEQ ID NO: 4530739 - DNA, 15 bp, Homo sapiens
ctaattttacactct

SEQ ID NO: 4530740 - DNA, 12 bp, Homo sapiens
ctaattttctgt

SEQ ID NO: 4530741 - DNA, 17 bp, Homo sapiens
ctaatttttattaattt

SEQ ID NO: 4530742 - DNA, 12 bp, Homo sapiens
ctaatttttcca

SEQ ID NO: 4530743 - DNA, 15 bp, Homo sapiens
ctaatttttgtattt

SEQ ID NO: 4530744 - DNA, 14 bp, Homo sapiens
ctaattttttgttg

SEQ ID NO: 4530745 - DNA, 21 bp, Homo sapiens
ctaatttttttgtattttagc

SEQ ID NO: 4530746 - DNA, 18 bp, Homo sapiens
ctaatttttttttgtagt

SEQ ID NO: 4530747 - DNA, 16 bp, Homo sapiens
ctacaaaaacacagca

SEQ ID NO: 4530748 - DNA, 17 bp, Homo sapiens
ctacaaaaacacagcaa

SEQ ID NO: 4530749 - DNA, 13 bp, Homo sapiens
ctacaaacaaaat

SEQ ID NO: 4530750 - DNA, 17 bp, Homo sapiens
ctacaaacaaaatttct

SEQ ID NO: 4530751 - DNA, 23 bp, Homo sapiens
ctacaaacgtttgacaaacacaa

SEQ ID NO: 4530752 - DNA, 17 bp, Homo sapiens
ctacaaacttttaagat

SEQ ID NO: 4530753 - DNA, 20 bp, Homo sapiens
ctacaaagcactagagaatg

SEQ ID NO: 4530754 - DNA, 22 bp, Homo sapiens
ctacaagccaaaagtccctccc

SEQ ID NO: 4530755 - DNA, 21 bp, Homo sapiens
ctacaatcttggagctgcttg

SEQ ID NO: 4530756 - DNA, 21 bp, Homo sapiens
ctacaatttgtttttgcattt

SEQ ID NO: 4530757 - DNA, 22 bp, Homo sapiens
ctacaatttgtttttgcatttt

SEQ ID NO: 4530758 - DNA, 13 bp, Homo sapiens
ctacacaaagcag

SEQ ID NO: 4530759 - DNA, 15 bp, Homo sapiens
ctacacactcagcca

SEQ ID NO: 4530760 - DNA, 17 bp, Homo sapiens
ctacacactcagccaca

SEQ ID NO: 4530761 - DNA, 13 bp, Homo sapiens
ctacacatgttgc

SEQ ID NO: 4530762 - DNA, 18 bp, Homo sapiens
ctacacccttttccagct

SEQ ID NO: 4530763 - DNA, 21 bp, Homo sapiens
ctacacgcatgatggagctga

SEQ ID NO: 4530764 - DNA, 22 bp, Homo sapiens
ctacactagtccataagcttta

SEQ ID NO: 4530765 - DNA, 14 bp, Homo sapiens
ctacactctcctgg

SEQ ID NO: 4530766 - DNA, 21 bp, Homo sapiens
ctacactctcctgggcccctc

SEQ ID NO: 4530767 - DNA, 14 bp, Homo sapiens
ctacactgggtgct

SEQ ID NO: 4530768 - DNA, 14 bp, Homo sapiens
ctacacttctcctt

SEQ ID NO: 4530769 - DNA, 19 bp, Homo sapiens
ctacacttctccttatctt

SEQ ID NO: 4530770 - DNA, 20 bp, Homo sapiens
ctacagccgtcccgcgttca

SEQ ID NO: 4530771 - DNA, 16 bp, Homo sapiens
ctacagctccacacgc

SEQ ID NO: 4530772 - DNA, 17 bp, Homo sapiens
ctacagctccacacgcc

SEQ ID NO: 4530773 - DNA, 22 bp, Homo sapiens
ctacagctccacacgccccggt

SEQ ID NO: 4530774 - DNA, 20 bp, Homo sapiens
ctacaggaagcaccccatgc

SEQ ID NO: 4530775 - DNA, 18 bp, Homo sapiens
ctacaggcagtctctctc

SEQ ID NO: 4530776 - DNA, 18 bp, Homo sapiens
ctacagtaatgaaatgtt

SEQ ID NO: 4530777 - DNA, 12 bp, Homo sapiens
ctacagtatata

SEQ ID NO: 4530778 - DNA, 15 bp, Homo sapiens
ctacagtcaggaaag

SEQ ID NO: 4530779 - DNA, 14 bp, Homo sapiens
ctacagtggtttta

SEQ ID NO: 4530780 - DNA, 16 bp, Homo sapiens
ctacagtggttttata

SEQ ID NO: 4530781 - DNA, 21 bp, Homo sapiens
ctacagtggttttatactgaa

SEQ ID NO: 4530782 - DNA, 16 bp, Homo sapiens
ctacagtgtacagtct

SEQ ID NO: 4530783 - DNA, 19 bp, Homo sapiens
ctacagttttaactgtgga

SEQ ID NO: 4530784 - DNA, 14 bp, Homo sapiens
ctacatcagactct

SEQ ID NO: 4530785 - DNA, 21 bp, Homo sapiens
ctacatgacgacaaagctgct

SEQ ID NO: 4530786 - DNA, 15 bp, Homo sapiens
ctacatgaggtactg

SEQ ID NO: 4530787 - DNA, 18 bp, Homo sapiens
ctacatgaggtactgaga

SEQ ID NO: 4530788 - DNA, 19 bp, Homo sapiens
ctacatgatgctaaaggct

SEQ ID NO: 4530789 - DNA, 14 bp, Homo sapiens
ctacatgcagccca

SEQ ID NO: 4530790 - DNA, 17 bp, Homo sapiens
ctacatgcagcccatgc

SEQ ID NO: 4530791 - DNA, 16 bp, Homo sapiens
ctacatgcataaacta

SEQ ID NO: 4530792 - DNA, 13 bp, Homo sapiens
ctacatgccatgc

SEQ ID NO: 4530793 - DNA, 13 bp, Homo sapiens
ctacattaaacaa

SEQ ID NO: 4530794 - DNA, 20 bp, Homo sapiens
ctacattaaacaatgatcac

SEQ ID NO: 4530795 - DNA, 22 bp, Homo sapiens
ctacattataataaaatttctt

SEQ ID NO: 4530796 - DNA, 12 bp, Homo sapiens
ctacattcattt

SEQ ID NO: 4530797 - DNA, 21 bp, Homo sapiens
ctacattcttggttgttaatt

SEQ ID NO: 4530798 - DNA, 16 bp, Homo sapiens
ctaccaactttactgt

SEQ ID NO: 4530799 - DNA, 11 bp, Homo sapiens
ctaccagccag

SEQ ID NO: 4530800 - DNA, 17 bp, Homo sapiens
ctaccagccagcctcag

SEQ ID NO: 4530801 - DNA, 13 bp, Homo sapiens
ctaccagtattta

SEQ ID NO: 4530802 - DNA, 16 bp, Homo sapiens
ctaccatcagctctgc

SEQ ID NO: 4530803 - DNA, 17 bp, Homo sapiens
ctaccatcagctctgcc

SEQ ID NO: 4530804 - DNA, 20 bp, Homo sapiens
ctaccatcagctctgccttg

SEQ ID NO: 4530805 - DNA, 21 bp, Homo sapiens
ctaccatcagctctgccttgc

SEQ ID NO: 4530806 - DNA, 22 bp, Homo sapiens
ctaccatcagctctgccttgca

SEQ ID NO: 4530807 - DNA, 18 bp, Homo sapiens
ctacccacacctctgcca

SEQ ID NO: 4530808 - DNA, 19 bp, Homo sapiens
ctacccacacctctgccag

SEQ ID NO: 4530809 - DNA, 18 bp, Homo sapiens
ctacccagagaagcccct

SEQ ID NO: 4530810 - DNA, 18 bp, Homo sapiens
ctacccagcgtggcctcc

SEQ ID NO: 4530811 - DNA, 14 bp, Homo sapiens
ctacccagttgcct

SEQ ID NO: 4530812 - DNA, 14 bp, Homo sapiens
ctaccccaccacga

SEQ ID NO: 4530813 - DNA, 22 bp, Homo sapiens
ctaccccagttcctagcactgc

SEQ ID NO: 4530814 - DNA, 15 bp, Homo sapiens
ctacccctgctccca

SEQ ID NO: 4530815 - DNA, 12 bp, Homo sapiens
ctaccctcccac

SEQ ID NO: 4530816 - DNA, 19 bp, Homo sapiens
ctaccctcccacccccttc

SEQ ID NO: 4530817 - DNA, 19 bp, Homo sapiens
ctaccctgagatctgcaca

SEQ ID NO: 4530818 - DNA, 18 bp, Homo sapiens
ctaccctgagctgaggca

SEQ ID NO: 4530819 - DNA, 13 bp, Homo sapiens
ctacccttaatta

SEQ ID NO: 4530820 - DNA, 19 bp, Homo sapiens
ctacccttaattacttaaa

SEQ ID NO: 4530821 - DNA, 15 bp, Homo sapiens
ctacctacatatttg

SEQ ID NO: 4530822 - DNA, 15 bp, Homo sapiens
ctacctcaacctgta

SEQ ID NO: 4530823 - DNA, 13 bp, Homo sapiens
ctacctcaggcag

SEQ ID NO: 4530824 - DNA, 20 bp, Homo sapiens
ctacctcaggcaggaagggc

SEQ ID NO: 4530825 - DNA, 23 bp, Homo sapiens
ctacctcaggcaggaagggcagg

SEQ ID NO: 4530826 - DNA, 17 bp, Homo sapiens
ctacctcagtgctcctg

SEQ ID NO: 4530827 - DNA, 18 bp, Homo sapiens
ctacctcagtgctcctgg

SEQ ID NO: 4530828 - DNA, 19 bp, Homo sapiens
ctacctcagtgctcctgga

SEQ ID NO: 4530829 - DNA, 13 bp, Homo sapiens
ctacctctgagaa

SEQ ID NO: 4530830 - DNA, 15 bp, Homo sapiens
ctacctctgagaaga

SEQ ID NO: 4530831 - DNA, 16 bp, Homo sapiens
ctacctctgagaagac

SEQ ID NO: 4530832 - DNA, 17 bp, Homo sapiens
ctacctctgagaagaca

SEQ ID NO: 4530833 - DNA, 20 bp, Homo sapiens
ctacctgacactcccttggg

SEQ ID NO: 4530834 - DNA, 14 bp, Homo sapiens
ctacctgccactca

SEQ ID NO: 4530835 - DNA, 16 bp, Homo sapiens
ctacctgccactcaca

SEQ ID NO: 4530836 - DNA, 16 bp, Homo sapiens
ctacctgccctcaagg

SEQ ID NO: 4530837 - DNA, 14 bp, Homo sapiens
ctacctgccttgga

SEQ ID NO: 4530838 - DNA, 19 bp, Homo sapiens
cggatctcacaggctgaga

SEQ ID NO: 4530839 - DNA, 18 bp, Homo sapiens
cggatgacaccctggcct

SEQ ID NO: 4530840 - DNA, 20 bp, Homo sapiens
cggatgacaccctggcctga

SEQ ID NO: 4530841 - DNA, 20 bp, Homo sapiens
cggatgcccattcctgcctg

SEQ ID NO: 4530842 - DNA, 21 bp, Homo sapiens
cggatgcccattcctgcctgg

SEQ ID NO: 4530843 - DNA, 22 bp, Homo sapiens
cggatgcccattcctgcctggt

SEQ ID NO: 4530844 - DNA, 22 bp, Homo sapiens
cggatggaccaacctgctctgt

SEQ ID NO: 4530845 - DNA, 15 bp, Homo sapiens
cggatgtataaatgt

SEQ ID NO: 4530846 - DNA, 15 bp, Homo sapiens
cggatttgtccaaat

SEQ ID NO: 4530847 - DNA, 13 bp, Homo sapiens
cggattttttcca

SEQ ID NO: 4530848 - DNA, 16 bp, Homo sapiens
cggattttttccaaaa

SEQ ID NO: 4530849 - DNA, 18 bp, Homo sapiens
cggcaacctgcggaagga

SEQ ID NO: 4530850 - DNA, 19 bp, Homo sapiens
cggcaacgtagcctgggct

SEQ ID NO: 4530851 - DNA, 18 bp, Homo sapiens
cggcacagatgctccagg

SEQ ID NO: 4530852 - DNA, 14 bp, Homo sapiens
cggcagccccactt

SEQ ID NO: 4530853 - DNA, 15 bp, Homo sapiens
cggcagccccacttc

SEQ ID NO: 4530854 - DNA, 18 bp, Homo sapiens
cggcaggctcactgccag

SEQ ID NO: 4530855 - DNA, 22 bp, Homo sapiens
cggcaggctcactgccaggcca

SEQ ID NO: 4530856 - DNA, 20 bp, Homo sapiens
cggcagggcccccaataaac

SEQ ID NO: 4530857 - DNA, 15 bp, Homo sapiens
cggcaggttctcttt

SEQ ID NO: 4530858 - DNA, 17 bp, Homo sapiens
cggcatagcacccgtgg

SEQ ID NO: 4530859 - DNA, 15 bp, Homo sapiens
cggcatagtccccag

SEQ ID NO: 4530860 - DNA, 14 bp, Homo sapiens
cggccacacccagc

SEQ ID NO: 4530861 - DNA, 18 bp, Homo sapiens
cggccacacccagcggcc

SEQ ID NO: 4530862 - DNA, 14 bp, Homo sapiens
cggccacacccctc

SEQ ID NO: 4530863 - DNA, 16 bp, Homo sapiens
cggccacagctgctgg

SEQ ID NO: 4530864 - DNA, 22 bp, Homo sapiens
cggccagccccggccctgggct

SEQ ID NO: 4530865 - DNA, 12 bp, Homo sapiens
cggcccacagct

SEQ ID NO: 4530866 - DNA, 15 bp, Homo sapiens
cggcccacagctccc

SEQ ID NO: 4530867 - DNA, 19 bp, Homo sapiens
cggcccacagctcccaccc

SEQ ID NO: 4530868 - DNA, 22 bp, Homo sapiens
cggcccacagctcccaccccac

SEQ ID NO: 4530869 - DNA, 17 bp, Homo sapiens
cggcccagatgtgtccc

SEQ ID NO: 4530870 - DNA, 11 bp, Homo sapiens
cggcccaggcc

SEQ ID NO: 4530871 - DNA, 16 bp, Homo sapiens
cggcccaggccaggtg

SEQ ID NO: 4530872 - DNA, 21 bp, Homo sapiens
cggccccccgcacagccaccc

SEQ ID NO: 4530873 - DNA, 22 bp, Homo sapiens
cggccccccgcacagccacccg

SEQ ID NO: 4530874 - DNA, 22 bp, Homo sapiens
cggccccccgcgctcgcccagc

SEQ ID NO: 4530875 - DNA, 15 bp, Homo sapiens
cggcccccggccaag

SEQ ID NO: 4530876 - DNA, 17 bp, Homo sapiens
cggcccccggccaagga

SEQ ID NO: 4530877 - DNA, 18 bp, Homo sapiens
cggccccctggtctctgg

SEQ ID NO: 4530878 - DNA, 15 bp, Homo sapiens
cggcccctcccgccc

SEQ ID NO: 4530879 - DNA, 19 bp, Homo sapiens
cggcccctcggctgttcct

SEQ ID NO: 4530880 - DNA, 13 bp, Homo sapiens
cggcccctgtctg

SEQ ID NO: 4530881 - DNA, 14 bp, Homo sapiens
cggcccctgtctgt

SEQ ID NO: 4530882 - DNA, 15 bp, Homo sapiens
cggcccggctgagcc

SEQ ID NO: 4530883 - DNA, 12 bp, Homo sapiens
cggccctaaggg

SEQ ID NO: 4530884 - DNA, 13 bp, Homo sapiens
cggccctccagag

SEQ ID NO: 4530885 - DNA, 18 bp, Homo sapiens
cggccctgggctcggagg

SEQ ID NO: 4530886 - DNA, 13 bp, Homo sapiens
cggccgcattccc

SEQ ID NO: 4530887 - DNA, 18 bp, Homo sapiens
cggccgcattccctgagt

SEQ ID NO: 4530888 - DNA, 18 bp, Homo sapiens
cggccgccatagccccag

SEQ ID NO: 4530889 - DNA, 21 bp, Homo sapiens
cggcctcccaaagtgctggga

SEQ ID NO: 4530890 - DNA, 16 bp, Homo sapiens
cggcctcccaggtccc

SEQ ID NO: 4530891 - DNA, 15 bp, Homo sapiens
cggcctccgaggctc

SEQ ID NO: 4530892 - DNA, 13 bp, Homo sapiens
cggcctctaaccc

SEQ ID NO: 4530893 - DNA, 21 bp, Homo sapiens
cggcctctaaccccaggcccc

SEQ ID NO: 4530894 - DNA, 22 bp, Homo sapiens
cggcctctaaccccaggccccg

SEQ ID NO: 4530895 - DNA, 15 bp, Homo sapiens
cggcctgatgctccc

SEQ ID NO: 4530896 - DNA, 19 bp, Homo sapiens
cggcctgatgctccctccc

SEQ ID NO: 4530897 - DNA, 15 bp, Homo sapiens
cggcctgggtgacag

SEQ ID NO: 4530898 - DNA, 21 bp, Homo sapiens
cggcctgtgggtctctgaagg

SEQ ID NO: 4530899 - DNA, 18 bp, Homo sapiens
cggcgaagaagagaaaga

SEQ ID NO: 4530900 - DNA, 20 bp, Homo sapiens
cggcgcggtggctcacgcct

SEQ ID NO: 4530901 - DNA, 15 bp, Homo sapiens
cggcggaaagcctct

SEQ ID NO: 4530902 - DNA, 18 bp, Homo sapiens
cggcgggtgacagctccg

SEQ ID NO: 4530903 - DNA, 21 bp, Homo sapiens
cggcggtggactgcgctggac

SEQ ID NO: 4530904 - DNA, 17 bp, Homo sapiens
cggcgtcagcctccagc

SEQ ID NO: 4530905 - DNA, 19 bp, Homo sapiens
cggcgtcagcctccagcct

SEQ ID NO: 4530906 - DNA, 23 bp, Homo sapiens
cggcgtcagcctccagcctctgt

SEQ ID NO: 4530907 - DNA, 13 bp, Homo sapiens
cggctacatcagc

SEQ ID NO: 4530908 - DNA, 14 bp, Homo sapiens
cggctactcagcag

SEQ ID NO: 4530909 - DNA, 18 bp, Homo sapiens
cggctactcagcagccct

SEQ ID NO: 4530910 - DNA, 20 bp, Homo sapiens
cggctactcagcagccctcc

SEQ ID NO: 4530911 - DNA, 19 bp, Homo sapiens
cggctcccctctgcttctc

SEQ ID NO: 4530912 - DNA, 11 bp, Homo sapiens
cggctcctgca

SEQ ID NO: 4530913 - DNA, 14 bp, Homo sapiens
cggctcctggtgct

SEQ ID NO: 4530914 - DNA, 18 bp, Homo sapiens
cggctctgggggtgggaa

SEQ ID NO: 4530915 - DNA, 20 bp, Homo sapiens
cggctctgtgggtgatgggg

SEQ ID NO: 4530916 - DNA, 14 bp, Homo sapiens
cggctgagccctgc

SEQ ID NO: 4530917 - DNA, 23 bp, Homo sapiens
cggctgagtcatgatctccctgc

SEQ ID NO: 4530918 - DNA, 21 bp, Homo sapiens
cggctgcttggcagttgcagt

SEQ ID NO: 4530919 - DNA, 12 bp, Homo sapiens
cggctgggagga

SEQ ID NO: 4530920 - DNA, 16 bp, Homo sapiens
cggctggggactgcta

SEQ ID NO: 4530921 - DNA, 14 bp, Homo sapiens
cggctgtgctggga

SEQ ID NO: 4530922 - DNA, 22 bp, Homo sapiens
cggctgttcctcccctgtaggg

SEQ ID NO: 4530923 - DNA, 20 bp, Homo sapiens
cggcttcgttagaccgctct

SEQ ID NO: 4530924 - DNA, 20 bp, Homo sapiens
cggcttctcacgctttgttt

SEQ ID NO: 4530925 - DNA, 21 bp, Homo sapiens
cggcttctcacgctttgttta

SEQ ID NO: 4530926 - DNA, 16 bp, Homo sapiens
cgggaaggtcaccagc

SEQ ID NO: 4530927 - DNA, 16 bp, Homo sapiens
cgggaagtttatttcc

SEQ ID NO: 4530928 - DNA, 18 bp, Homo sapiens
cgggaagtttatttcctg

SEQ ID NO: 4530929 - DNA, 18 bp, Homo sapiens
cgggacacctaggctagg

SEQ ID NO: 4530930 - DNA, 19 bp, Homo sapiens
cgggacacctaggctaggg

SEQ ID NO: 4530931 - DNA, 18 bp, Homo sapiens
cgggacagtgctgcagct

SEQ ID NO: 4530932 - DNA, 16 bp, Homo sapiens
cgggaccaccctgagc

SEQ ID NO: 4530933 - DNA, 17 bp, Homo sapiens
cgggaccaccctgagcc

SEQ ID NO: 4530934 - DNA, 18 bp, Homo sapiens
cgggaccaccctgagccg

SEQ ID NO: 4530935 - DNA, 17 bp, Homo sapiens
cgggactgctgctctcc

SEQ ID NO: 4530936 - DNA, 23 bp, Homo sapiens
cgggactgctgctctcccaaggg

SEQ ID NO: 4530937 - DNA, 18 bp, Homo sapiens
cgggagacagcttctctg

SEQ ID NO: 4530938 - DNA, 13 bp, Homo sapiens
cgggagcacccag

SEQ ID NO: 4530939 - DNA, 16 bp, Homo sapiens
cgggagcacccagagc

SEQ ID NO: 4530940 - DNA, 13 bp, Homo sapiens
cgggagccagact

SEQ ID NO: 4530941 - DNA, 23 bp, Homo sapiens
cgggagccagactgtccagggaa

SEQ ID NO: 4530942 - DNA, 18 bp, Homo sapiens
cgggagctctgtatggtc

SEQ ID NO: 4530943 - DNA, 18 bp, Homo sapiens
cgggagctgggccctgcc

SEQ ID NO: 4530944 - DNA, 20 bp, Homo sapiens
cgggagctgggccctgcctg

SEQ ID NO: 4530945 - DNA, 20 bp, Homo sapiens
cgggaggcagaggttgcagt

SEQ ID NO: 4530946 - DNA, 18 bp, Homo sapiens
cgggaggcagcgccccac

SEQ ID NO: 4530947 - DNA, 22 bp, Homo sapiens
cgggaggcagcgccccaccacg

SEQ ID NO: 4530948 - DNA, 15 bp, Homo sapiens
cgggagtcagggacc

SEQ ID NO: 4530949 - DNA, 20 bp, Homo sapiens
cgggatgctctttaaataat

SEQ ID NO: 4530950 - DNA, 16 bp, Homo sapiens
cgggatggttctggct

SEQ ID NO: 4530951 - DNA, 18 bp, Homo sapiens
cgggcagagggctggagg

SEQ ID NO: 4530952 - DNA, 23 bp, Homo sapiens
cgggcagagggctggaggcccag

SEQ ID NO: 4530953 - DNA, 14 bp, Homo sapiens
cgggcagccaccca

SEQ ID NO: 4530954 - DNA, 15 bp, Homo sapiens
cgggcagccacccaa

SEQ ID NO: 4530955 - DNA, 13 bp, Homo sapiens
cgggcagccagca

SEQ ID NO: 4530956 - DNA, 12 bp, Homo sapiens
cgggcagccccg

SEQ ID NO: 4530957 - DNA, 14 bp, Homo sapiens
cgggcagtctgctc

SEQ ID NO: 4530958 - DNA, 18 bp, Homo sapiens
cgcctgcaggagagagca

SEQ ID NO: 4530959 - DNA, 11 bp, Homo sapiens
cgcctgccacc

SEQ ID NO: 4530960 - DNA, 12 bp, Homo sapiens
cgcctgcctgca

SEQ ID NO: 4530961 - DNA, 18 bp, Homo sapiens
cgcctgcctgcagcaggc

SEQ ID NO: 4530962 - DNA, 21 bp, Homo sapiens
cgcctggcagtccgtgggacg

SEQ ID NO: 4530963 - DNA, 16 bp, Homo sapiens
cgcctgggtcatgggc

SEQ ID NO: 4530964 - DNA, 17 bp, Homo sapiens
cgcctgggtcatgggcc

SEQ ID NO: 4530965 - DNA, 18 bp, Homo sapiens
cgcctgggtcatgggcct

SEQ ID NO: 4530966 - DNA, 16 bp, Homo sapiens
cgcctgtaatcccagc

SEQ ID NO: 4530967 - DNA, 17 bp, Homo sapiens
cgcctgtaatcccagca

SEQ ID NO: 4530968 - DNA, 18 bp, Homo sapiens
cgcctgtaatcccagcag

SEQ ID NO: 4530969 - DNA, 18 bp, Homo sapiens
cgccttcgtgcctgagac

SEQ ID NO: 4530970 - DNA, 13 bp, Homo sapiens
cgccttgtgagat

SEQ ID NO: 4530971 - DNA, 15 bp, Homo sapiens
cgcgactaatttcaa

SEQ ID NO: 4530972 - DNA, 22 bp, Homo sapiens
cgcgactaatttcaaaatgctt

SEQ ID NO: 4530973 - DNA, 21 bp, Homo sapiens
cgcgccaaataatgtctctgt

SEQ ID NO: 4530974 - DNA, 15 bp, Homo sapiens
cgcgccgatgccacc

SEQ ID NO: 4530975 - DNA, 16 bp, Homo sapiens
cgcgctcgcccagcag

SEQ ID NO: 4530976 - DNA, 17 bp, Homo sapiens
cgcgctcgcccagcagg

SEQ ID NO: 4530977 - DNA, 22 bp, Homo sapiens
cgcggccagccccggccctggg

SEQ ID NO: 4530978 - DNA, 11 bp, Homo sapiens
cgcggctggga

SEQ ID NO: 4530979 - DNA, 17 bp, Homo sapiens
cgcgggcagccacccaa

SEQ ID NO: 4530980 - DNA, 18 bp, Homo sapiens
cgcgggccaggaggctgc

SEQ ID NO: 4530981 - DNA, 17 bp, Homo sapiens
cgcggggaagctggctt

SEQ ID NO: 4530982 - DNA, 13 bp, Homo sapiens
cgcggtggctcac

SEQ ID NO: 4530983 - DNA, 15 bp, Homo sapiens
cgcgtcccagctccc

SEQ ID NO: 4530984 - DNA, 13 bp, Homo sapiens
cgctaaaagaaac

SEQ ID NO: 4530985 - DNA, 15 bp, Homo sapiens
cgctaaaagaaactt

SEQ ID NO: 4530986 - DNA, 18 bp, Homo sapiens
cgctaataagtgacaaat

SEQ ID NO: 4530987 - DNA, 17 bp, Homo sapiens
cgctagtgtttaaaagg

SEQ ID NO: 4530988 - DNA, 15 bp, Homo sapiens
cgctcaccgctggcc

SEQ ID NO: 4530989 - DNA, 21 bp, Homo sapiens
cgctcaccgctggcccttaga

SEQ ID NO: 4530990 - DNA, 14 bp, Homo sapiens
cgctcagcagccct

SEQ ID NO: 4530991 - DNA, 23 bp, Homo sapiens
cgctcagcagccctagcggctgc

SEQ ID NO: 4530992 - DNA, 13 bp, Homo sapiens
cgctcagccccag

SEQ ID NO: 4530993 - DNA, 18 bp, Homo sapiens
cgctcagccccaggccag

SEQ ID NO: 4530994 - DNA, 19 bp, Homo sapiens
cgctcagccccaggccagc

SEQ ID NO: 4530995 - DNA, 20 bp, Homo sapiens
cgctcagccccaggccagct

SEQ ID NO: 4530996 - DNA, 22 bp, Homo sapiens
cgctcagccccaggccagctgc

SEQ ID NO: 4530997 - DNA, 13 bp, Homo sapiens
cgctcatctggct

SEQ ID NO: 4530998 - DNA, 20 bp, Homo sapiens
cgctccctgtagctctgcct

SEQ ID NO: 4530999 - DNA, 22 bp, Homo sapiens
cgctccgggaacagtgcatgtg

SEQ ID NO: 4531000 - DNA, 19 bp, Homo sapiens
cgctcctgccgcagagctg

SEQ ID NO: 4531001 - DNA, 20 bp, Homo sapiens
cgctcgatggacctcagcaa

SEQ ID NO: 4531002 - DNA, 16 bp, Homo sapiens
cgctcgcccagcagga

SEQ ID NO: 4531003 - DNA, 18 bp, Homo sapiens
cgctcgcccagcaggaga

SEQ ID NO: 4531004 - DNA, 19 bp, Homo sapiens
cgctcggtctccaccccag

SEQ ID NO: 4531005 - DNA, 15 bp, Homo sapiens
cgctcgtgtgttcta

SEQ ID NO: 4531006 - DNA, 13 bp, Homo sapiens
cgctctcttttct

SEQ ID NO: 4531007 - DNA, 12 bp, Homo sapiens
cgctctgcatgc

SEQ ID NO: 4531008 - DNA, 23 bp, Homo sapiens
cgctctgcatgcggcccagcccg

SEQ ID NO: 4531009 - DNA, 17 bp, Homo sapiens
cgctgaagatggagggg

SEQ ID NO: 4531010 - DNA, 14 bp, Homo sapiens
cgctgagccacctg

SEQ ID NO: 4531011 - DNA, 17 bp, Homo sapiens
cgctgcacatggcctga

SEQ ID NO: 4531012 - DNA, 18 bp, Homo sapiens
cgctgcagaccccaggtt

SEQ ID NO: 4531013 - DNA, 14 bp, Homo sapiens
cgctgccagccttg

SEQ ID NO: 4531014 - DNA, 12 bp, Homo sapiens
cgctgccctgtg

SEQ ID NO: 4531015 - DNA, 20 bp, Homo sapiens
cgctgcccttgggtcccccc

SEQ ID NO: 4531016 - DNA, 22 bp, Homo sapiens
cgctgcccttgggtccccccga

SEQ ID NO: 4531017 - DNA, 13 bp, Homo sapiens
cgctgccgcaccc

SEQ ID NO: 4531018 - DNA, 20 bp, Homo sapiens
cgctgccgcaccccagagtg

SEQ ID NO: 4531019 - DNA, 18 bp, Homo sapiens
cgctgccgctgcaccacg

SEQ ID NO: 4531020 - DNA, 15 bp, Homo sapiens
cgctgccgctgccgc

SEQ ID NO: 4531021 - DNA, 18 bp, Homo sapiens
cgctgccgctgccgctgc

SEQ ID NO: 4531022 - DNA, 17 bp, Homo sapiens
cgctgcctaagtggctg

SEQ ID NO: 4531023 - DNA, 19 bp, Homo sapiens
cgctgcgcagcctccaggg

SEQ ID NO: 4531024 - DNA, 19 bp, Homo sapiens
cgctgctacatcagactct

SEQ ID NO: 4531025 - DNA, 19 bp, Homo sapiens
cgctgctgtgctctgggga

SEQ ID NO: 4531026 - DNA, 23 bp, Homo sapiens
cgctggactattgtgccaactgc

SEQ ID NO: 4531027 - DNA, 23 bp, Homo sapiens
cgctggcgacacactccgtccat

SEQ ID NO: 4531028 - DNA, 16 bp, Homo sapiens
cgctgtataaagcatg

SEQ ID NO: 4531029 - DNA, 23 bp, Homo sapiens
cgctgtcctctcgagcccagatg

SEQ ID NO: 4531030 - DNA, 20 bp, Homo sapiens
cgctgttctgggcatggcag

SEQ ID NO: 4531031 - DNA, 22 bp, Homo sapiens
cgcttaatccaatattttgcct

SEQ ID NO: 4531032 - DNA, 20 bp, Homo sapiens
cgcttatcaactaatgattt

SEQ ID NO: 4531033 - DNA, 21 bp, Homo sapiens
cgcttccttagccttgctcag

SEQ ID NO: 4531034 - DNA, 20 bp, Homo sapiens
cgcttgctggaacacagggg

SEQ ID NO: 4531035 - DNA, 17 bp, Homo sapiens
cgcttgcttctgcagca

SEQ ID NO: 4531036 - DNA, 21 bp, Homo sapiens
cgcttgcttctgcagcaactc

SEQ ID NO: 4531037 - DNA, 22 bp, Homo sapiens
cgcttgcttctgcagcaactcc

SEQ ID NO: 4531038 - DNA, 17 bp, Homo sapiens
cgcttgtccagcgccta

SEQ ID NO: 4531039 - DNA, 20 bp, Homo sapiens
cgcttgtccagcgcctagtg

SEQ ID NO: 4531040 - DNA, 14 bp, Homo sapiens
cgctttcctgaatc

SEQ ID NO: 4531041 - DNA, 13 bp, Homo sapiens
cgctttgtttact

SEQ ID NO: 4531042 - DNA, 17 bp, Homo sapiens
cgctttgtttactctct

SEQ ID NO: 4531043 - DNA, 20 bp, Homo sapiens
cggaaagtgaagagtcagaa

SEQ ID NO: 4531044 - DNA, 13 bp, Homo sapiens
cggaatatatttt

SEQ ID NO: 4531045 - DNA, 11 bp, Homo sapiens
cggaatgaact

SEQ ID NO: 4531046 - DNA, 14 bp, Homo sapiens
cggacactcctaga

SEQ ID NO: 4531047 - DNA, 15 bp, Homo sapiens
cggacactcctagag

SEQ ID NO: 4531048 - DNA, 23 bp, Homo sapiens
cggacagttccagaagtgtgact

SEQ ID NO: 4531049 - DNA, 17 bp, Homo sapiens
cggaccactcgaggcct

SEQ ID NO: 4531050 - DNA, 16 bp, Homo sapiens
cggacccaccccaact

SEQ ID NO: 4531051 - DNA, 17 bp, Homo sapiens
cggaccccactccggcc

SEQ ID NO: 4531052 - DNA, 15 bp, Homo sapiens
cggaccccagccatc

SEQ ID NO: 4531053 - DNA, 22 bp, Homo sapiens
cggacccttctgggtccaggga

SEQ ID NO: 4531054 - DNA, 21 bp, Homo sapiens
cggactaagcctacctgctct

SEQ ID NO: 4531055 - DNA, 16 bp, Homo sapiens
cggactgcccccagaa

SEQ ID NO: 4531056 - DNA, 18 bp, Homo sapiens
cggactgcccccagaaag

SEQ ID NO: 4531057 - DNA, 17 bp, Homo sapiens
cggagactatggcctcg

SEQ ID NO: 4531058 - DNA, 18 bp, Homo sapiens
cggagactatggcctcgc

SEQ ID NO: 4531059 - DNA, 16 bp, Homo sapiens
cggagagcagcagcac

SEQ ID NO: 4531060 - DNA, 17 bp, Homo sapiens
cggagagcagcagcacc

SEQ ID NO: 4531061 - DNA, 17 bp, Homo sapiens
cggagccactcctctga

SEQ ID NO: 4531062 - DNA, 18 bp, Homo sapiens
cggagccactcctctgac

SEQ ID NO: 4531063 - DNA, 19 bp, Homo sapiens
cggagcccacactgccacc

SEQ ID NO: 4531064 - DNA, 13 bp, Homo sapiens
cggagcccagcct

SEQ ID NO: 4531065 - DNA, 15 bp, Homo sapiens
cggagcccagcctgg

SEQ ID NO: 4531066 - DNA, 20 bp, Homo sapiens
cggaggctacccgctgtggc

SEQ ID NO: 4531067 - DNA, 13 bp, Homo sapiens
cggaggctgggcc

SEQ ID NO: 4531068 - DNA, 22 bp, Homo sapiens
cggaggctgggcccctgggatg

SEQ ID NO: 4531069 - DNA, 14 bp, Homo sapiens
cggaggctgtgctc

SEQ ID NO: 4531070 - DNA, 22 bp, Homo sapiens
cggagggcccctgcgtgggggc

SEQ ID NO: 4531071 - DNA, 17 bp, Homo sapiens
cggaggtcactccacca

SEQ ID NO: 4531072 - DNA, 17 bp, Homo sapiens
cggagtgaatgtggcag

SEQ ID NO: 4531073 - DNA, 18 bp, Homo sapiens
cggagtggggggacagag

SEQ ID NO: 4531074 - DNA, 18 bp, Homo sapiens
cggatcaccgagagtagc

SEQ ID NO: 4531075 - DNA, 23 bp, Homo sapiens
cggatcaccgagagtagccgaga

SEQ ID NO: 4531076 - DNA, 19 bp, Homo sapiens
cggatcatcaacaagattt

SEQ ID NO: 4531077 - DNA, 21 bp, Homo sapiens
cggatcatcaacaagatttcc

SEQ ID NO: 4531078 - DNA, 12 bp, Homo sapiens
cgaggggagggc

SEQ ID NO: 4531079 - DNA, 17 bp, Homo sapiens
cgaggggcccagggaag

SEQ ID NO: 4531080 - DNA, 14 bp, Homo sapiens
cgagggtcctggct

SEQ ID NO: 4531081 - DNA, 16 bp, Homo sapiens
cgaggtcaacagagaa

SEQ ID NO: 4531082 - DNA, 22 bp, Homo sapiens
cgaggtggatcacagaggcttc

SEQ ID NO: 4531083 - DNA, 17 bp, Homo sapiens
cgaggttcccagggctg

SEQ ID NO: 4531084 - DNA, 14 bp, Homo sapiens
cgagtactgtgggc

SEQ ID NO: 4531085 - DNA, 13 bp, Homo sapiens
cgagtccaaggcc

SEQ ID NO: 4531086 - DNA, 21 bp, Homo sapiens
cgagtctggggacctggcact

SEQ ID NO: 4531087 - DNA, 13 bp, Homo sapiens
cgagttcctctgg

SEQ ID NO: 4531088 - DNA, 21 bp, Homo sapiens
cgagtttctggtaagactgct

SEQ ID NO: 4531089 - DNA, 16 bp, Homo sapiens
cgagtttggtccctgg

SEQ ID NO: 4531090 - DNA, 18 bp, Homo sapiens
cgatatcagaatttgtgt

SEQ ID NO: 4531091 - DNA, 13 bp, Homo sapiens
cgatattctccct

SEQ ID NO: 4531092 - DNA, 22 bp, Homo sapiens
cgatcaagttgttgactgtgat

SEQ ID NO: 4531093 - DNA, 21 bp, Homo sapiens
cgatcctggattcactcactc

SEQ ID NO: 4531094 - DNA, 23 bp, Homo sapiens
cgatcgtaccactacactccagc

SEQ ID NO: 4531095 - DNA, 15 bp, Homo sapiens
cgatctctcctggcc

SEQ ID NO: 4531096 - DNA, 23 bp, Homo sapiens
cgatggacctcagcaagctgccc

SEQ ID NO: 4531097 - DNA, 12 bp, Homo sapiens
cgatgggtcagg

SEQ ID NO: 4531098 - DNA, 13 bp, Homo sapiens
cgatgtgctcagc

SEQ ID NO: 4531099 - DNA, 11 bp, Homo sapiens
cgatgtggccc

SEQ ID NO: 4531100 - DNA, 17 bp, Homo sapiens
cgatgtggccctggcct

SEQ ID NO: 4531101 - DNA, 17 bp, Homo sapiens
cgatttaaactccagca

SEQ ID NO: 4531102 - DNA, 17 bp, Homo sapiens
cgatttctgtaaactct

SEQ ID NO: 4531103 - DNA, 17 bp, Homo sapiens
cgcaaccaagtgtgcta

SEQ ID NO: 4531104 - DNA, 19 bp, Homo sapiens
cgcaaggtgtgctctgagc

SEQ ID NO: 4531105 - DNA, 16 bp, Homo sapiens
cgcaagttaacttgga

SEQ ID NO: 4531106 - DNA, 17 bp, Homo sapiens
cgcaatagttttttact

SEQ ID NO: 4531107 - DNA, 22 bp, Homo sapiens
cgcaatgaaaagtcgttttcca

SEQ ID NO: 4531108 - DNA, 16 bp, Homo sapiens
cgcacacagctgagca

SEQ ID NO: 4531109 - DNA, 12 bp, Homo sapiens
cgcacagccacc

SEQ ID NO: 4531110 - DNA, 16 bp, Homo sapiens
cgcacagccacccgtg

SEQ ID NO: 4531111 - DNA, 21 bp, Homo sapiens
cgcacatgtgccactgttcag

SEQ ID NO: 4531112 - DNA, 18 bp, Homo sapiens
cgcaccctgtcctgcaca

SEQ ID NO: 4531113 - DNA, 21 bp, Homo sapiens
cgcaccgcctgaaggcacagc

SEQ ID NO: 4531114 - DNA, 23 bp, Homo sapiens
cgcacgactgcgggagccagact

SEQ ID NO: 4531115 - DNA, 14 bp, Homo sapiens
cgcactctgccccc

SEQ ID NO: 4531116 - DNA, 14 bp, Homo sapiens
cgcagactcctcca

SEQ ID NO: 4531117 - DNA, 15 bp, Homo sapiens
cgcagactcctccac

SEQ ID NO: 4531118 - DNA, 22 bp, Homo sapiens
cgcagaggatccatcacagacg

SEQ ID NO: 4531119 - DNA, 22 bp, Homo sapiens
cgcagatttttatgttttgaaa

SEQ ID NO: 4531120 - DNA, 18 bp, Homo sapiens
cgcagccctagagcctgc

SEQ ID NO: 4531121 - DNA, 19 bp, Homo sapiens
cgcagccctagagcctgcc

SEQ ID NO: 4531122 - DNA, 14 bp, Homo sapiens
cgcagcggggtagg

SEQ ID NO: 4531123 - DNA, 20 bp, Homo sapiens
cgcaggaactgggctgggcc

SEQ ID NO: 4531124 - DNA, 18 bp, Homo sapiens
cgcaggtgggctggactt

SEQ ID NO: 4531125 - DNA, 22 bp, Homo sapiens
cgcagttgtgtggcccagcacg

SEQ ID NO: 4531126 - DNA, 22 bp, Homo sapiens
cgcatagtgtgctcggacacag

SEQ ID NO: 4531127 - DNA, 14 bp, Homo sapiens
cgcatcttctccat

SEQ ID NO: 4531128 - DNA, 19 bp, Homo sapiens
cgcatggtcacacactgat

SEQ ID NO: 4531129 - DNA, 19 bp, Homo sapiens
cgcattctaacctggaggt

SEQ ID NO: 4531130 - DNA, 17 bp, Homo sapiens
cgcattgctgtccttgg

SEQ ID NO: 4531131 - DNA, 21 bp, Homo sapiens
cgcattttggtttttcctcat

SEQ ID NO: 4531132 - DNA, 17 bp, Homo sapiens
cgccaaataatgtctct

SEQ ID NO: 4531133 - DNA, 19 bp, Homo sapiens
cgccaaggaggtgggccac

SEQ ID NO: 4531134 - DNA, 17 bp, Homo sapiens
cgccaagtctggcacca

SEQ ID NO: 4531135 - DNA, 19 bp, Homo sapiens
cgccaatgttatgccagct

SEQ ID NO: 4531136 - DNA, 16 bp, Homo sapiens
cgccaccgtgcctggc

SEQ ID NO: 4531137 - DNA, 16 bp, Homo sapiens
cgccactaggtgtccc

SEQ ID NO: 4531138 - DNA, 18 bp, Homo sapiens
cgccactaggtgtcccca

SEQ ID NO: 4531139 - DNA, 19 bp, Homo sapiens
cgccactaggtgtccccaa

SEQ ID NO: 4531140 - DNA, 23 bp, Homo sapiens
cgccactaggtgtccccaacgtc

SEQ ID NO: 4531141 - DNA, 17 bp, Homo sapiens
cgccactcatttcatct

SEQ ID NO: 4531142 - DNA, 15 bp, Homo sapiens
cgccactcgccttct

SEQ ID NO: 4531143 - DNA, 14 bp, Homo sapiens
cgccagcctcctct

SEQ ID NO: 4531144 - DNA, 15 bp, Homo sapiens
cgccagcctcctctg

SEQ ID NO: 4531145 - DNA, 16 bp, Homo sapiens
cgccagcctcctctgg

SEQ ID NO: 4531146 - DNA, 20 bp, Homo sapiens
cgccagctgggagcactggt

SEQ ID NO: 4531147 - DNA, 14 bp, Homo sapiens
cgccaggaagccag

SEQ ID NO: 4531148 - DNA, 20 bp, Homo sapiens
cgccaggccagcaggcgggc

SEQ ID NO: 4531149 - DNA, 11 bp, Homo sapiens
cgccagggctg

SEQ ID NO: 4531150 - DNA, 16 bp, Homo sapiens
cgccagggctggggac

SEQ ID NO: 4531151 - DNA, 21 bp, Homo sapiens
cgccagggctggggacagagg

SEQ ID NO: 4531152 - DNA, 18 bp, Homo sapiens
cgccattctcctgcctca

SEQ ID NO: 4531153 - DNA, 14 bp, Homo sapiens
cgccattgccacca

SEQ ID NO: 4531154 - DNA, 17 bp, Homo sapiens
cgccattgccaccagga

SEQ ID NO: 4531155 - DNA, 17 bp, Homo sapiens
cgcccaaggccttcccc

SEQ ID NO: 4531156 - DNA, 16 bp, Homo sapiens
cgcccaccagccttgc

SEQ ID NO: 4531157 - DNA, 13 bp, Homo sapiens
cgcccacccccac

SEQ ID NO: 4531158 - DNA, 19 bp, Homo sapiens
cgcccacccccacccccag

SEQ ID NO: 4531159 - DNA, 19 bp, Homo sapiens
cgcccaccccgctctgcat

SEQ ID NO: 4531160 - DNA, 12 bp, Homo sapiens
cgcccagacacc

SEQ ID NO: 4531161 - DNA, 11 bp, Homo sapiens
cgccccagcct

SEQ ID NO: 4531162 - DNA, 16 bp, Homo sapiens
cgccccatccctgctt

SEQ ID NO: 4531163 - DNA, 22 bp, Homo sapiens
cgccccatccctgcttgcccgc

SEQ ID NO: 4531164 - DNA, 18 bp, Homo sapiens
cgcccccagtccccaccc

SEQ ID NO: 4531165 - DNA, 22 bp, Homo sapiens
cgcccccagtccccacccctgc

SEQ ID NO: 4531166 - DNA, 14 bp, Homo sapiens
cgcccccgagccct

SEQ ID NO: 4531167 - DNA, 17 bp, Homo sapiens
cgccccggtcccccaga

SEQ ID NO: 4531168 - DNA, 18 bp, Homo sapiens
cgccccggtcccccagag

SEQ ID NO: 4531169 - DNA, 19 bp, Homo sapiens
cgccccggtcccccagagc

SEQ ID NO: 4531170 - DNA, 15 bp, Homo sapiens
cgccccgtgtttgcg

SEQ ID NO: 4531171 - DNA, 15 bp, Homo sapiens
cgcccctcccaagcg

SEQ ID NO: 4531172 - DNA, 16 bp, Homo sapiens
cgcccctcccacgcct

SEQ ID NO: 4531173 - DNA, 13 bp, Homo sapiens
cgccccttccctc

SEQ ID NO: 4531174 - DNA, 11 bp, Homo sapiens
cgccctccctg

SEQ ID NO: 4531175 - DNA, 22 bp, Homo sapiens
cgccctccctgctagcacagag

SEQ ID NO: 4531176 - DNA, 14 bp, Homo sapiens
cgccctgggctgtc

SEQ ID NO: 4531177 - DNA, 14 bp, Homo sapiens
cgcccttccatgtg

SEQ ID NO: 4531178 - DNA, 20 bp, Homo sapiens
cgcccttccatgtgcctttc

SEQ ID NO: 4531179 - DNA, 17 bp, Homo sapiens
cgccctttcctcctcag

SEQ ID NO: 4531180 - DNA, 20 bp, Homo sapiens
cgccctttcctcctcaggca

SEQ ID NO: 4531181 - DNA, 14 bp, Homo sapiens
cgccgccgccgctg

SEQ ID NO: 4531182 - DNA, 15 bp, Homo sapiens
cgccggcttcctcct

SEQ ID NO: 4531183 - DNA, 18 bp, Homo sapiens
cgccgggcaccaactcca

SEQ ID NO: 4531184 - DNA, 22 bp, Homo sapiens
cgccgtgccggcggcagcccca

SEQ ID NO: 4531185 - DNA, 22 bp, Homo sapiens
cgcctacccttcccgcctccct

SEQ ID NO: 4531186 - DNA, 17 bp, Homo sapiens
cgcctataatcccagct

SEQ ID NO: 4531187 - DNA, 19 bp, Homo sapiens
cgcctcaccagccccccgc
